(12) United States Patent
Kunsch et al.

(10) Patent No.: US 6,593,114 B1
(45) Date of Patent: Jul. 15, 2003

(54) STAPHYLOCOCCUS AUREUS POLYNUCLEOTIDES AND SEQUENCES

(75) Inventors: Charles A. Kunsch, Norcross, GA (US); Gil H. Choi, Rockville, MD (US); Steven Barash, Rockville, MD (US); Patrick J. Dillon, Carlsbad, CA (US); Michael R. Fannon, Silver Spring, MD (US); Craig A. Rosen, Laytonsville, MD (US)

(73) Assignee: Human Genome Sciences, Inc., Rockville, MD (US)

( * ) Notice: Subject to any disclaimer, the term of this patent is extended or adjusted under 35 U.S.C. 154(b) by 0 days.

(21) Appl. No.: 08/956,171

(22) Filed: Oct. 20, 1997

Related U.S. Application Data

(63) Continuation-in-part of application No. 08/781,986, filed on Jan. 3, 1997.
(60) Provisional application No. 60/009,861, filed on Jan. 5, 1996.

(51) Int. Cl.⁷ ........................... C12N 15/64; C07H 21/04
(52) U.S. Cl. ................ 435/91.41; 435/91.4; 435/252.3; 435/254.11; 435/257.2; 435/320.1; 435/325; 536/23.7
(58) Field of Search ........................ 536/23.7; 435/69.1, 435/69.7, 70.1, 71.1, 71.2, 320.1, 325, 252.3, 254.11, 257.2, 91.4, 91.41; 935/6, 11, 12, 22, 23, 66

(56) References Cited

U.S. PATENT DOCUMENTS 5,175,101 A * 12/1992 Gotz et al.
6,019,984 A * 2/2000 MacInnes et al.

OTHER PUBLICATIONS

Lewin, in Genes IV, Oxford University Press, p. 816, 1990.*
Sharrocks, in "PCR Technology Current Innovations", Griffin et al eds. CRC Press Inc, pp. 5–11, 1994.*
American Type Culture (ATCC), Catalogue of Bacteria & Bacteriophages 17th Edition, pp. 202–204, 1989.*
Walkenhorst et al, Microbiol Res, 150:347–361, 1995.*
Dorrell et al, Photochem. Photobiol, 58:831–835, 1993.*
Sambrook et al Molecular Cloning, A Laboratory Manual, 2nd Ed., Cold Spring Harbor pp. 17.1–17.44, 1989.*
Kennell et al, Proc. Nucl. Acid Res. Mol. Biol. 11:259–301, 1971.*
Herzog et al, DNA and Cell Biology 12(6): 465–471, 1993.*
Jazin et al, Regulatory Peptides 47:247–258, 1993.*
Rudinger et al, in "Peptide Hormones", ed. Parsons J.A. University Park Press, pp. 1–6, 1976.*
Burgess et. al. et al., The Journal of Cell Biology 111:2129–2138, 1990.*
Lazar et al., Molecular and Cellular Biology 8(3):1247–1252, 1988.*
Jubling et al, Mol. Microbiol., 5(7):1755–67, 1991.*

* cited by examiner

Primary Examiner—Patricia A. Duffy
(74) Attorney, Agent, or Firm—Human Genome Sciences, Inc.

(57) ABSTRACT

The present invention provides polynucleotide sequences of the genome of *Staphylococcus aureus*, polypeptide sequences encoded by the polynucleotide sequences, corresponding polynucleotides and polypeptides, vectors and hosts comprising the polynucleotides, and assays and other uses thereof. The present invention further provides polynucleotide and polypeptide sequence information stored on computer readable media, and computer-based systems and methods which facilitate its use.

15 Claims, 2 Drawing Sheets

STAPHYLOCOCCUS AUREUS POLYNUCLEOTIDES AND SEQUENCES

CROSS REFERENCE TO RELATED APPLICATIONS

This application is a continuation-in-part of and claims priority under 35 U.S.C. § 120 to U.S. patent application Ser. No. 08/781,986, filed Jan. 3, 1997 (pending), which is a non-provisional of and claims benefit under 35 U.S.C. § 119(e) of U.S. Provisional Application Ser. No. 60/009,861 filed Jan. 5, 1996.

Reference to a Sequence Listing Provided on Compact Disc

This application refers to a "Sequence Listing", which is provided as an electronic document on two identical compact discs (CD-R), labeled "Copy 1" and "Copy 2." These compact discs each contain the electronic document, filename "PB248P1 sequence listing.txt" (6,143,313 bytes in size, created on Jan. 24, 2002), which is hereby incorporated in its entirety herein.

FIELD OF THE INVENTION

The present invention relates to the field of molecular biology. In particular, it relates to, among other things, nucleotide sequences of *Staphylococcus aureus*, contigs, ORFs, fragments, probes, primers and related polynucleotides thereof, peptides and polypeptides encoded by the sequences, and uses of the polynucleotides and sequences thereof, such as in fermentation, polypeptide production, assays and pharmaceutical development, among others.

BACKGROUND OF THE INVENTION

The genus Staphylococcus includes at least 20 distinct species. (For a review see Novick, R. P., The Staphylococcus as a Molecular Genetic System, Chapter 1, pgs. 1–37 in MOLECULAR BIOLOGY OF THE STAPHYLOCOCCI, R. Novick, Ed., VCH Publishers, New York (1990)). Species differ from one another by 80% or more, by hybridization kinetics, whereas strains within a species are at least 90% identical by the same measure.

The species *Staphylococcus aureus*, a gram-positive, facultatively aerobic, clump-forming cocci, is among the most important etiological agents of bacterial infection in humans, as discussed briefly below.

Human Health and S. Aureus

*Staphylococcus aureus* is a ubiquitous pathogen. (See, for instance, Mims et al., MEDICAL MICROBIOLOGY, Mosby-Year Book Europe Limited, London, UK (1993)). It is an etiological agent of a variety of conditions, ranging in severity from mild to fatal. A few of the more common conditions caused by *S. aureus* infection are burns, cellulitis, eyelid infections, food poisoning, joint infections, neonatal conjunctivitis, osteomyelitis, skin infections, surgical wound infection, scalded skin syndrome and toxic shock syndrome, some of which are described further below.

Burns

Burn wounds generally are sterile initially. However, they generally compromise physical and immune barriers to infection, cause loss of fluid and electrolytes and result in local or general physiological dysfunction. After cooling, contact with viable bacteria results in mixed colonization at the injury site. Infection may be restricted to the non-viable debris on the burn surface ("eschar"), it may progress into full skin infection and invade viable tissue below the eschar and it may reach below the skin, enter the lymphatic and blood circulation and develop into septicaemia *S. aureus*, is among the most important pathogens typically found in burn wound infections. It can destroy granulation tissue and produce severe septicaemia.

Cellulitis

Cellulitis, an acute infection of the skin that expands from a typically superficial origin to spread below the cutaneous layer, most commonly is caused by *S. aureus* in conjunction with *S. pyrogenes*. Cellulitis can lead to systemic infection. In fact, cellulitis can be one aspect of synergistic bacterial gangrene. This condition typically is caused by a mixture of *S. aureus* and microaerophilic streptococci. It causes necrosis and treatment is limited to excision of the necrotic tissue. The condition often is fatal.

P Eyelid infections

*S. aureus* is the cause of styes and of sticky eye" in neonates, among other eye infections. Typically such infections are limited to the surface of the eye, and may occasionally penetrate the surface with more severe consequences.

Food poisoning

Some strains of *S. aureus* produce one or more of five serologically distinct, heat and acid stable enterotoxins that are not destroyed by digestive process of the stomach and small intestine (enterotoxins A–E). Ingestion of the toxin, in sufficient quantities, typically results in severe vomiting, but not diarrhoea. The effect does not require viable bacteria. Although the toxins are known, their mechanism of action is not understood.

Joint infections

*S. aureus* infects bone joints causing diseases such osteomyelitis.

Osteomyelitis

*S. aureus* is the most common causative agent of haematogenous osteomyelitis. The disease tends to occur in children and adolescents more than adults and it is associated with non-penetrating injuries to bones. Infection typically occurs in the long end of growing bone, hence its occurrence in physically immature populations. Most often, infection is localized in the vicinity of sprouting capillary loops adjacent to epiphysial growth plates in the end of long, growing bones.

Skin infections

*S. aureus* is the most common pathogen of such minor skin infections as abscesses and boils. Such infections often are resolved by normal host response mechanisms, but they also can develop into severe internal infections. Recurrent infections of the nasal passages plague nasal carriers of *S. aureus*.

Surgical Wound Infections

Surgical wounds often penetrate far into the body. Infection of such wound thus poses a grave risk to the patient. *S. aureus* is the most important causative agent of infections in surgical wounds. *S. aureus* is unusually adept at invading surgical wounds; sutured wounds can be infected by far fewer *S. aureus* cells then are necessary to cause infection in normal skin. Invasion of surgical wound can lead to severe *S. aureus* septicaemia. Invasion of the blood stream by *S. aureus* can lead to seeding and infection of internal organs, particularly heart valves and bone, causing systemic diseases, such as endocarditis and osteomyelitis.

Scalded Skin Syndrome

*S. aureus* is responsible for "scalded skin syndrome" (also called toxic epidermal necrosis, Ritter's disease and Lyell's disease). This diseases occurs in older children, typically in outbreaks caused by flowering of S. aureus strains produce exfoliation(also called scalded skin syndrome toxin). Although the bacteria initially may infect only a minor lesion, the toxin destroys intercellular connections, spreads epidermal layers and allows the infection to penetrate the outer layer of the skin, producing the desquamation that typifies the diseases. Shedding of the outer layer of skin generally reveals normal skin below, but fluid lost in the process can produce severe injury in young children if it is not treated properly.

Toxic Shock Syndrome

Toxic shock syndrome is caused by strains of S. aureas that produce the so-called toxic shock syndrome toxin. The disease can be caused by S. aureus infection at any site, but it is too often erroneously viewed exclusively as a disease solely of women who use tampons. The disease involves toxaemia and septicaemia, and can be fatal.

Nocosomial Infections

In the 1984 National Nocosomial Infection Surveillance Study ("NNIS") S. aureus was the most prevalent agent of surgical wound infections in many hospital services, including medicine, surgery, obstetrics, pediatrics and newborns.

Resistance to drugs of S. aureus strains

Prior to the introduction of penicillin the prognosis for patients seriously infected with S. aureus was unfavorable. Following the introduction of penicillin in the early 1940s even the worst S. aureus infections generally could be treated successfully. The emergence of penicillin-resistant strains of S. aureus did not take long, however. Most strains of S. aureus encountered in hospital infections today do not respond to penicillin; although, fortunately, this is not the case for S. aureus encountered in community infections.

It is well known now that penicillin-resistant strains of S. aureus produce a lactamase which converts penicillin to pencillinoic acid, and thereby destroys antibiotic activity. Furthermore, the lactamase gene often is propagated episomally, typically on a plasmid, and often is only one of several genes on an episomal element that, together, confer multidrug resistance.

Methicillins, introduced in the 1960s, largely overcame the problem of penicillin resistance in S. aureus . These compounds conserve the portions of penicillin responsible for antibiotic activity and modify or alter other portions that make penicillin a good substrate for inactivating lactamases. However, methicillin resistance has emerged in S. aureus , along with resistance to many other antibiotics effective against this organism, including aminoglycosides, tetracycline, chloramphenicol, macrolides and lincosamides. In fact, methicillin-resistant strains of S. aureus generally are multiply drug resistant.

The molecular genetics of most types of drug resistance in S. aureus has been elucidated (See Lyon et al., Microbiology Reviews 51: 88–134 (1987)). Generally, resistance is mediated by plasmids, as noted above regarding penicillin resistance; however, several stable forms of drug resistance have been observed that apparently involve integration of a resistance element into the S. aureus genome itself.

Thus far each new antibiotic gives rise to resistance strains, stains emerge that are resistance to multiple drugs and increasingly persistent forms of resistance begin to emerge. Drug resistance of S. aureus infections already poses significant treatment difficulties, which are likely to get much worse unless new therapeutic agents are developed.

Molecular Genetics of Staphylococcus Aureus

Despite its importance in, among other things, human disease, relatively little is known about the genome of this organism.

Most genetic studies of S. aureus have been carried out using the strain NCTC8325, which contains prophages psi11, psi 12 and psi13, and the UV-cured derivative of this strain, 8325-4 (also referred to as RN450), which is free of the prophages.

These studies revealed that the S. aureus genome, like that of other staphylococci, consists of one circular, covalently closed, double-stranded DNA and a collection of so-called variable accessory genetic elements, such as prophages, plasmids, transposons and the like.

Physical characterization of the genome has not been carried out in any detail. Pattee et al. published a low resolution and incomplete genetic and physical map of the chromosome of S. aureus strain NCTC 8325. (Pattee et al. Genetic and Physical Mapping of Chromosome of Staphylococcus aureus NCTC 8325, Chapter 11, pgs. 163–169 in MOLECULAR BIOLOGY OF THE STAPHYLOCOCCI, R. P. Novick, Ed., VCH Publishers, N.Y., (1990) The genetic map largely was produced by mapping insertions of Tn551 and Tn4001, which, respectively, confer erythromycin and gentamicin resistance, and by analysis of SmaI-digested DNA by Pulsed Field Gel Electrophoresis ("PFGE").

The map was of low resolution; even estimating the physical size of the genome was difficult, according to the investigators. The size of the largest SmaI chromosome fragment, for instance, was too large for accurate sizing by PFGE. To estimate its size, additional restriction sites had to be introduced into the chromosome using a transposon containing a SmaI recognition sequence.

In sum, most physical characteristics and almost all of the genes of Staphylococcus aureus are unknown. Among the few genes that have been identified, most have not been physically mapped or characterized in detail. Only a very few genes of this organism have been sequenced. (See, for instance Thornsberry, J. , Antimicrobial Chemotherapy 21 Suppl C: 9–16 (1988), current versions of GENBANK and other nucleic acid databases, and references that relate to the genome of S. aureus such as those set out elsewhere herein.)

It is clear that the etiology of diseases mediated or exacerbated by S. aureus infection involves the programmed expression of S. aureus genes, and that characterizing the genes and their patterns of expression would add dramatically to our understanding of the organism and its host interactions. Knowledge of S. aureus genes and genomic organization would dramatically improve understanding of disease etiology and lead to improved and new ways of preventing, ameliorating, arresting and reversing diseases. Moreover, characterized genes and genomic fragments of S. aureus would provide reagents for, among other things, detecting, characterizing and controlling S. aureus infections. There is a need therefore to characterize the genome of S. aureus and for polynucleotides and sequences of this organism.

SUMMARY OF THE INVENTION

The present invention is based on the sequencing of fragments of the Staphylococcus aureus genome. The primary nucleotide sequences which were generated are provided in SEQ ID NOS:1–5,191.

The present invention provides the nucleotide sequence of several thousand contigs of the Staphylococcus aureus genome, which are listed in tables below and set out in the Sequence Listing submitted herewith, and representative fragments thereof, in a form which can be readily used, analyzed, and interpreted by a skilled artisan. In one embodiment, the present invention is provided as contiguous strings of primary sequence information corresponding to the nucleotide sequences depicted in SEQ ID NOS: 1–5,191.

The present invention further provides nucleotide sequences which are at least 95% identical to the nucleotide sequences of SEQ ID NOS: 1–5,191.

The nucleotide sequence of SEQ ID NOS:1–5,191, a representative fragment thereof, or a nucleotide sequence which is at least 95% identical to the nucleotide sequence of SEQ ID NOS:1–5,191 may be provided in a variety of mediums to facilitate its use. In one application of this embodiment, the sequences of the present invention are recorded on computer readable media. Such media includes, but is not limited to magnetic storage media, such as floppy discs, hard disc storage medium, and magnetic tape; optical storage media such as CD-ROM; electrical storage media such as RAM and ROM; and hybrids of these categories such as magnetic/optical storage media.

The present invention further provides systems, particularly computer-based systems which contain the sequence information herein described stored in a data storage means. Such systems are designed to identify commercially important fragments of the *Staphylococcus aureus* genome.

Another embodiment of the present invention is directed to fragments of the *Staphylococcus aureus* genome having particular structural or functional attributes. Such fragments of the *Staphylococcus aureus* genome of the present invention include, but are not limited to, fragments which encode peptides, hereinafter referred to as open reading frames or ORFs," fragments which modulate the expression of an operably linked ORF, hereinafter referred to as expression modulating fragments or EMFs," and fragments which can be used to diagnose the presence of Staphylococcus aureus in a sample, hereinafter referred to as diagnostic fragments or "DFs.".

Each of the ORFs in fragments of the *Staphylococcus aureus* genome disclosed in Tables 1–3, and the EMFs found 5' to the ORFs, can be used in numerous ways as polynucleotide reagents. For instance, the sequences can be used as diagnostic probes or amplification primers for detecting or determining the presence of a specific microbe in a sample, to selectively control gene expression in a host and in the production of polypeptides, such as polypeptides encoded by ORFs of the present invention,. particular those polypeptides that have a pharmacological activity.

The present invention further includes recombinant constructs comprising one or more fragments of the *Staphylococcus aureus* genome of the present invention. The recombinant constructs of the present invention comprise vectors, such as a plasmid or viral vector, into which a fragment of the *Staphylococcus aureus* has been inserted.

The present invention further provides host cells containing any of the isolated fragments of the *Staphylococcus aureus* genome of the present invention. The host cells can be a higher eukaryotic host cell, such as a mammalian cell, a lower eukaryotic cell, such as a yeast cell, or a procaryotic cell such as a bacterial cell.

The present invention is further directed to isolated polypeptides and proteins encoded by ORFs of the present invention. A variety of methods, well known to those of skill in the art, routinely may be utilized to obtain any of the polypeptides and proteins of the present invention. For instance, polypeptides and proteins of the present invention having relatively short, simple amino acid sequences readily can be synthesized using commercially available automated peptide synthesizers. Polypeptides and proteins of the present invention also may be purified from bacterial cells which naturally produce the protein. Yet another alternative is to purify polypeptide and proteins of the present invention from cells which have been altered to express them.

The invention further provides polypeptides comprising *Staphylococcus aureus* epitopes and vaccine compositions comprising such polypeptides. Also provided are methods for vacciniating an individual against *Staphylococcus aureus* infection.

The invention further provides methods of obtaining homologs of the fragments of the *Staphylococcus aureus* genome of the present invention and homologs of the proteins encoded by the ORFs of the present invention. Specifically, by using the nucleotide and amino acid sequences disclosed herein as a probe or as primers, and techniques such as PCR cloning and colony/plaque hybridization, one skilled in the art can obtain homologs.

The invention further provides antibodies which selectively bind polypeptides and proteins of the present invention. Such antibodies include both monoclonal and polyclonal antibodies.

The invention further provides hybridomas which produce the above-described antibodies. A hybridoma is an immortalized cell line which is capable of secreting a specific monoclonal antibody.

The present invention further provides methods of identifying test samples derived from cells which express one of the ORFs of the present invention, or a homolog thereof. Such methods comprise incubating a test sample with one or more of the antibodies of the present invention, or one or more of the Dfs or antigens of the present invention, under conditions which allow a skilled artisan to determine if the sample contains the ORF or product produced therefrom.

In another embodiment of the present invention, kits are provided which contain the necessary reagents to carry out the above-described assays.

Specifically, the invention provides a compartmentalized kit to receive, in close confinement, one or more containers which comprises: (a) a first container comprising one of the antibodies, antigens, or one of the DFs of the present invention; and (b) one or more other containers comprising one or more of the following wash reagents, reagents capable of detecting presence of bound antibodies, antigens or hybridized DFs.

Using the isolated proteins of the present invention, the present invention further provides methods of obtaining and identifying agents capable of binding to a polypeptide, or protein encoded by one of the ORFs of the present invention. Specifically, such agents include, as further described below, antibodies, peptides, carbohydrates, pharmaceutical agents and the like. Such methods comprise steps of: (a)contacting an agent with an isolated protein encoded by one of the ORFs of the present invention; and (b)determining whether the agent binds to said protein.

The present genomic sequences of *Staphylococcus aureus* will be of great value to all laboratories working with this organism and for a variety of commercial purposes. Many fragments of the *Staphylococcus aureus* genome will be immediately identified by similarity searches against GenBank or protein databases and will be of immediate value to *Staphylococcus aureus* researchers and for immediate commercial value for the production of proteins or to control gene expression.

The methodology and technology for elucidating extensive genomic sequences of bacterial and other genomes has and will greatly enhance the ability to analyze and understand chromosomal organization. In particular, sequenced contigs and genomes will provide the models for developing tools for the analysis of chromosome structure and function, including the ability to identify genes within large segments of genomic DNA, the structure, position, and spacing of regulatory elements, the identification of genes with potential industrial applications, and the ability to do comparative genomic and molecular phylogeny.

DETAILED DESCRIPTION OF ILLUSTRATIVE EMBODIMENTS

Figure 1:
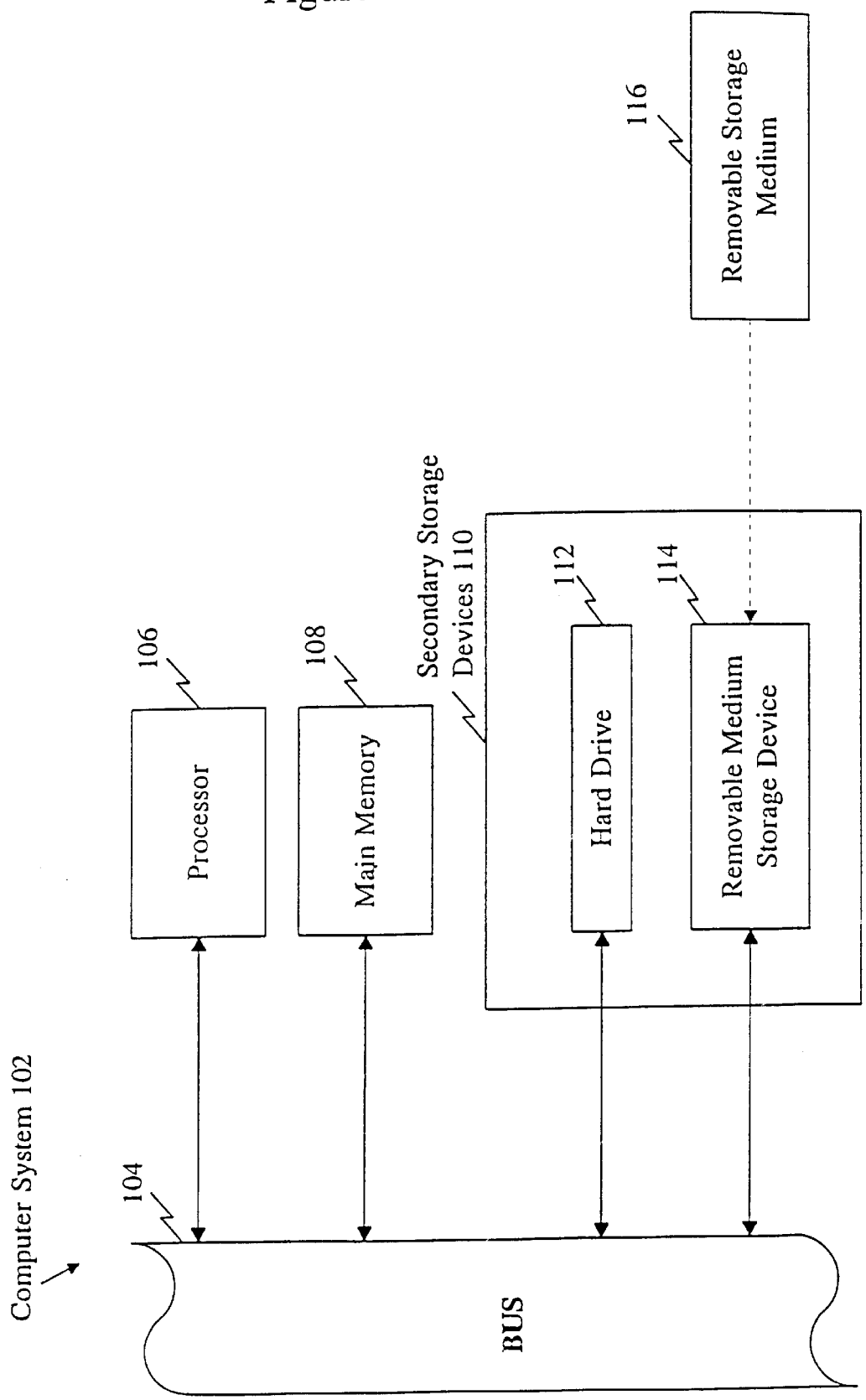
FIG. 1 is a block diagram of a computer system (102) that can be used to implement computer-based systems of present invention.
Figure 2:
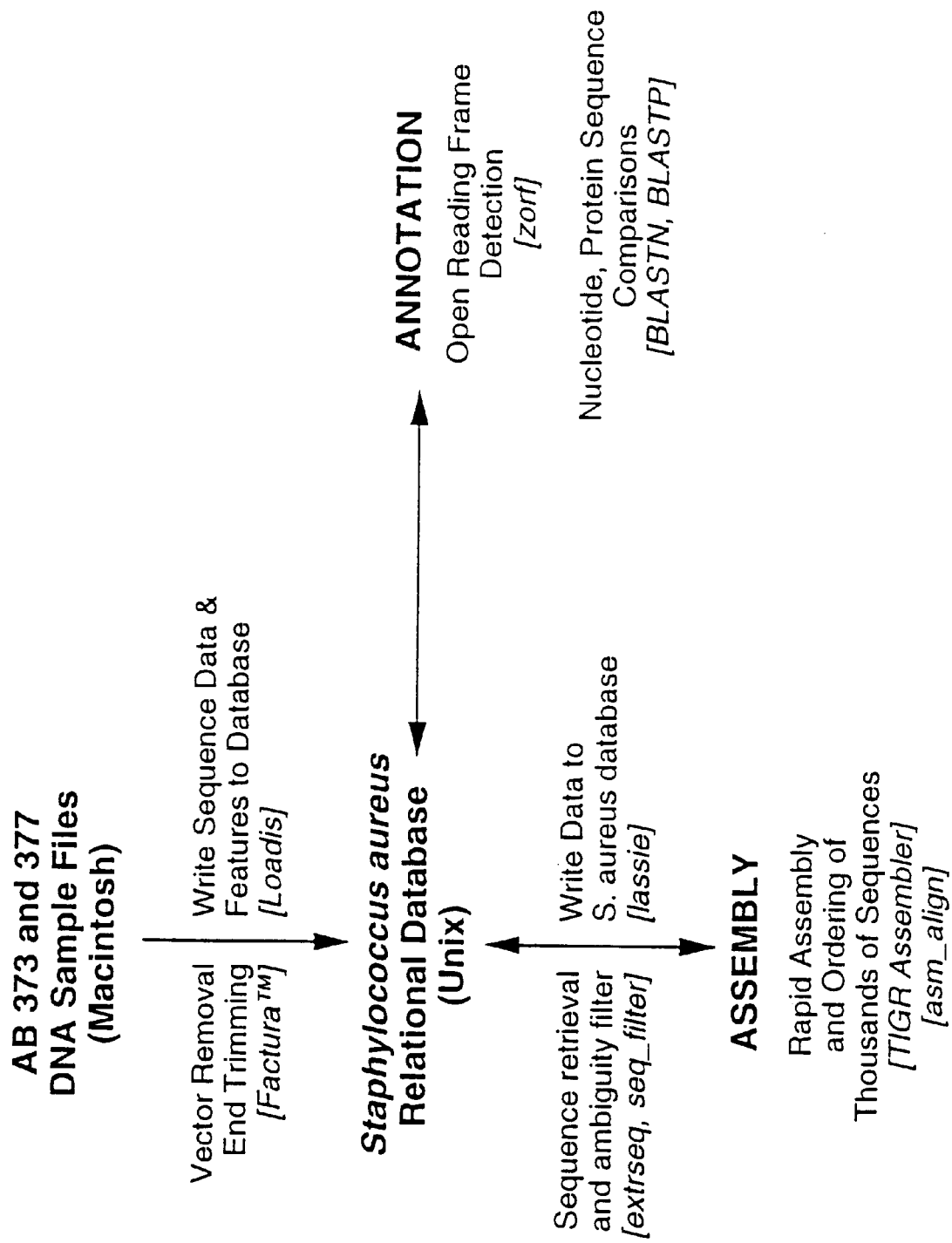
FIG. 2 is a schematic diagram depicting the data flow and computer programs used to collect, assemble, edit and annotate the contigs of the *Staphylococcus aureus* genome of the present invention. Both Macintosh and Unix platforms are used to handle the AB 373 and 377 sequence data files, largely as described in Kerlavage et al., *Proceedings of the Twenty-Sixth Annual Hawaii International Conference on System Sciences*, 585, IEEE Computer Society Press, Washington D.C. (1993). Factura (AB) is a Macintosh program designed for automatic vector sequence removal and end-trimming of sequence files. The program Loadis runs on a Macintosh platform and parses the feature data extracted from the sequence files by Factura to the Unix based *Staphylococcus aureus* relational database. Assembly of contigs (and whole genome sequences) is accomplished by retrieving a specific set of sequence files and their associated features using extrseq, a Unix utility for retrieving sequences from an SQL database. The resulting sequence file is processed by seqfilter to trim portions of the sequences with more than 2% ambiguous nucleotides. The sequence files were assembled using TIGR Assembler, an assembly engine designed at The Institute for Genomic Research ( TIGR") for rapid and accurate assembly of thousands of sequence fragments. The collection of contigs generated by the assembly step is loaded into the database with the lassie program. Identification of open reading frames (ORFs) is accomplished by processing contigs with zorf. The ORFs are searched against *S. aureus* sequences from Genbank and against all protein sequences using the BLASTN and BLASTP programs, described in Altschul et al., *J. Mol. Biol.* 215: 403:410 (1990)). Results of the ORF determination and similarity searching steps were loaded into the database. As described below, some results of the determination and the searches are set out in Tables 1–3.

The present invention is based on the sequencing of fragments of the *Staphylococcus aureus* genome and analysis of the sequences. The primary nucleotide sequences generated by sequencing the fragments are provided in SEQ ID NOS: 1–5,191. (As used herein, the "primary sequence" refers to the nucleotide sequence represented by the WUPAC nomenclature system.)

In addition to the aforementioned *Staphylococcus aureus* polynucleotide and polynucleotide sequences, the present invention provides the nucleotide sequences of SEQ ID NOS:1–5,191, or representative fragments thereof, in a form which can be readily used, analyzed, and interpreted by a skilled artisan.

As used herein, a "representative fragment of the nucleotide sequence depicted in SEQ ID NOS:1–5,191 " refers to any portion of the SEQ ID NOS: 1–5,191 which is not presently represented within a publicly available database. Preferred representative fragments of the present invention are *Staphylococcus aureus* open reading frames ( ORFs"), expression modulating fragment ( EMFs") and fragments which can be used to diagnose the presence of *Staphylococcus aureus* in sample ("DFs"). A non-limiting identification of preferred representative fragments is provided in Tables 1–3.

As discussed in detail below, the information provided in SEQ ID NOS: 1–5,191 and in Tables 1–3 together with routine cloning, synthesis, sequencing and assay methods will enable those skilled in the art to clone and sequence all "representative fragments" of interest, including open reading frames encoding a large variety of *Staphylococcus aureus* proteins.

While the presently disclosed sequences of SEQ ID NOS: 1–5,191 are highly accurate, sequencing techniques are not perfect and, in relatively rare instances, further investigation of a fragment or sequence of the invention may reveal a nucleotide sequence error present in a nucleotide sequence disclosed in SEQ ID NOS:1–5,191. However, once the present invention is made available (i.e., once the information in SEQ ID NOS: 1–5,191 and Tables 1–3 has been made available), resolving a rare sequencing error in SEQ ID NOS: 1–5,191 will be well within the skill of the art. The present disclosure makes available sufficient sequence information to allow any of the described contigs or portions thereof to be obtained readily by straightforward application of routine techniques. Further sequencing of such polynucleotide may proceed in like manner using manual and automated sequencing methods which are employed ubiquitous in the art. Nucleotide sequence editing software is publicly available. For example, Applied Biosystem's (AB) AutoAssembler can be used as an aid during visual inspection of nucleotide sequences. By employing such routine techniques potential errors readily may be identified and the correct sequence then may be ascertained by targeting further sequencing effort, also of a routine nature, to the region containing the potential error.

Even if all of the very rare sequencing errors in SEQ ID NOS. 1–5,191 were corrected, the resulting nucleotide sequences would still be at least 95% identical, nearly all would be at least 99% identical, and the great majority would be at least 99.9% identical to the nucleotide sequences of SEQ ID NOS: 1–5,191.

As discussed elsewhere herein, polynucleotides of the present invention readily may be obtained by routine application of well known and standard procedures for cloning and sequencing DNA. Detailed methods for obtaining libraries and for sequencing are provided below, for instance. A wide variety of *Staphylococcus aureus* strains that can be used to prepare *S aureus* genomic DNA for cloning and for obtaining polynucleotides of the present invention are available to the public from recognized depository institutions, such as the American Type Culture Collection (ATCC").

The nucleotide sequences of the genomes from different strains of *Staphylococcus aureus* differ somewhat. However, the nucleotide sequences of the genomes of all *Staphylococcus aureus* strains will be at least 95% identical, in corresponding part, to the nucleotide sequences provided in SEQ ID NOS:1–5,191. Nearly all will be at least 99% identical and the great majority will be 99.9% identical.

Thus, the present invention further provides nucleotide sequences which are at least 95%, preferably 99% and most preferably 99.9% identical to the nucleotide sequences of SEQ ID NOS:1–5,191, in a form which can be readily used, analyzed and interpreted by the skilled artisan.

Methods for determining whether a nucleotide sequence is at least 95%, at least 99% or at least 99.9% identical to the nucleotide sequences of SEQ ID NOS: 1–5,191 are routine and readily available to the skilled artisan. For example, the well known fast algorithm described in Pearson and Lipman, *Proc. Natl. Acad. Sci.* USA 85: 2444 (1988) can be used to generate the percent identity of nucleotide sequences. The BLASTN program also can be used to generate an identity score of polynucleotides compared to one another.

COMPUTER RELATED EMBODIMENTS

The nucleotide sequences provided in SEQ ID NOS:1–5, 191, a representative fragment thereof, or a nucleotide sequence at least 95%, preferably at least 96%, 97%, 98% or 99% and most preferably at least 99.9% identical to a polynucleotide sequence of SEQ ID NOS:1–5,191 may be "provided" in a variety of mediums to facilitate use thereof. As used herein, "provided" refers to a manufacture, other than an isolated nucleic acid molecule, which contains a nucleotide sequence of the present invention; i.e., a nucleotide sequence provided in SEQ ID NOS:1–5,191, a representative fragment thereof, or a nucleotide sequence at least 95%, preferably at least 96%, 97%, 98% or 99% and most preferably at least 99.9% identical to a polynucleotide of SEQ ID NOS:1–5,191. Such a manufacture provides a large portion of the *Staphylococcus aureus* genome and parts thereof (e.g., a *Staphylococcus aureus* open reading frame (ORF)) in a form which allows a skilled artisan to examine the manufacture using means not directly applicable to examining the Staphylococcus aureus genome or a subset thereof as it exists in nature or in purified form.

In one application of this embodiment, a nucleotide sequence of the present invention can be recorded on computer readable media. As used herein, "computer readable media" refers to any medium which can be read and accessed directly by a computer. Such media include, but are not limited to: magnetic storage media, such as floppy discs, hard disc storage medium, and magnetic tape; optical storage media such as CD-ROM; electrical storage media such as RAM and ROM; and hybrids of these categories, such as magnetic/optical storage media. A skilled artisan can readily appreciate how any of the presently known computer readable mediums can be used to create a manufacture comprising computer readable medium having recorded thereon a nucleotide sequence of the present invention. Likewise, it will be clear to those of skill how additional computer readable media that may be developed also can be used to create analogous manufactures having recorded thereon a nucleotide sequence of the present invention.

As used herein, "recorded" refers to a process for storing information on computer readable medium. A skilled artisan can readily adopt any of the presently know methods for recording information on computer readable medium to generate manufactures comprising the nucleotide sequence information of the present invention.

A variety of data storage structures are available to a skilled artisan for creating a computer readable medium having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and MicroSoft Word, or represented in the form of an ASCII file, stored in a database application, such as DB2, Sybase, Oracle, or the like. A skilled artisan can readily adapt any number of data-processor structuring formats (e.g., text file or database) in order to obtain computer readable medium having recorded thereon the nucleotide sequence information of the present invention.

Computer software is publicly available which allows a skilled artisan to access sequence information provided in a computer readable medium. Thus, by providing in computer readable form the nucleotide sequences of SEQ ID NOS: 1-5,191, a representative fragment thereof, or a nucleotide sequence at least 95%, preferably at least 96%, 97%, 98% or 99% and most preferably at least 99.9% identical to a sequence of SEQ ID NOS: 1–5,191 the present invention enables the skilled artisan routinely to access the provided sequence information for a wide variety of purposes.

The examples which follow demonstrate how software which implements the BLAST (Altschul et al., J. Mol. Biol. 215:403–410 (1990)) and BLAZE (Brutlag et al., Comp. Chem. 17:203–207 (1993)) search algorithms on a Sybase system was used to identify open reading frames (ORFs) within the *Staphylococcus aureus* genome which contain homology to ORFs or proteins from both *Staphylococcus aureus* and from other organisms. Among the ORFs discussed herein are protein encoding fragments of the *Staphylococcus aureus* genome useful in producing commercially important proteins, such as enzymes used in fermentation reactions and in the production of commercially useful metabolites.

The present invention further provides systems, particularly computer-based systems, which contain the sequence information described herein. Such systems are designed to identify, among other things, commercially important fragments of the *Staphylococcus aureus* genome.

As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A skilled artisan can readily appreciate that any one of the currently available computer-based system are suitable for use in the present invention.

As stated above, the computer-based systems of the present invention comprise a data storage means having stored therein a nucleotide sequence of the present invention and the necessary hardware means and software means for supporting and implementing a search means.

As used herein, "data storage means" refers to memory which can store nucleotide sequence information of the present invention, or a memory access means which can access manufactures having recorded thereon the nucleotide sequence information of the present invention.

As used herein, "search means" refers to one or more programs which are implemented on the computer-based system to compare a target sequence or target structural motif with the sequence information stored within the data storage means. Search means are used to identify fragments or regions of the present genomic sequences which match a particular target sequence or target motif. A variety of known algorithms are disclosed publicly and a variety of commercially available software for conducting search means are and can be used in the computer-based systems of the present invention. Examples of such software includes, but is not limited to, MacPattern (EMBL), BLASTN and BLASTX (NCBIA). A skilled artisan can readily recognize that any one of the available algorithms or implementing software packages for conducting homology searches can be adapted for use in the present computer-based systems.

As used herein, a "target sequence" can be any DNA or amino acid sequence of six or more nucleotides or two or more amino acids. A skilled artisan can readily recognize that the longer a target sequence is, the less likely a target sequence will be present as a random occurrence in the database. The most preferred sequence length of a target sequence is from about 10 to 100 amino acids or from about 30 to 300 nucleotide residues. However, it is well recognized that searches for commercially important fragments, such as sequence fragments involved in gene expression and protein processing, may be of shorter length.

As used herein, "a target structural motif," or "target motif," refers to any rationally selected sequence or combination of sequences in which the sequence(s) are chosen based on a three-dimensional configuration which is formed upon the folding of the target motif. There are a variety of target motifs known in the art. Protein target motifs include, but are not limited to, enzymic active sites and signal sequences. Nucleic acid target motifs include, but are not limited to, promoter sequences, hairpin structures and inducible expression elements (protein binding sequences).

A variety of structural formats for the input and output means can be used to input and output the information in the computer-based systems of the present invention. A preferred format for an output means ranks fragments of the *Staphylococcus aureus* genomic sequences possessing varying degrees of homology to the target sequence or target motif. Such presentation provides a skilled artisan with a ranking of sequences which contain various amounts of the target sequence or target motif and identifies the degree of homology contained in the identified fragment.

A variety of comparing means can be used to compare a target sequence or target motif with the data storage means to identify sequence fragments of the *Staphylococcus aureus* genome. In the present examples, implementing software which implement the BLAST and BLAZE algorithms, described in Altschul et al., *J. Mol. Biol.* 215: 403–410 (1990), was used to identify open reading frames within the *Staphylococcus aureus* genome. A skilled artisan can readily recognize that any one of the publicly available homology search programs can be used as the search means for the computer-based systems of the present invention. Of course, suitable proprietary systems that may be known to those of skill also may be employed in this regard.

FIG. 1 provides a block diagram of a computer system illustrative of embodiments of this aspect of present invention. The computer system 102 includes a processor 106 connected to a bus 104. Also connected to the bus 104 are a main memory 108 (preferably implemented as random access memory, RAM) and a variety of secondary storage devices 110, such as a hard drive 112 and a removable medium storage device 114. The removable medium storage device 114 may represent, for example, a floppy disk drive, a CD-ROM drive, a magnetic tape drive, etc. A removable storage medium 116 (such as a floppy disk, a compact disk, a magnetic tape, etc.) containing control logic and/or data recorded therein may be inserted into the removable medium storage device 114. The computer system 102 includes appropriate software for reading the control logic and/or the data from the removable medium storage device 114, once it is inserted into the removable medium storage device 114.

A nucleotide sequence of the present invention may be stored in a well known manner in the main memory 108, any of the secondary storage devices 110, and/or a removable storage medium 116. During execution, software for accessing and processing the genomic sequence (such as search tools, comparing tools, etc.) reside in main memory 108, in accordance with the requirements and operating parameters of the operating system, the hardware system and the software program or programs.

BIOCHEMICAL EMBODIMENTS

Other embodiments of the present invention are directed to isolated fragments of the *Staphylococcus aureus* genome. The fragments of the *Staphylococcus aureus* genome of the present invention include, but are not limited to fragments which encode peptides, hereinafter open reading frames (ORFs), fragments which modulate the expression of an operably linked ORF, hereinafter expression modulating fragments (EMFs) and fragments which can be used to diagnose the presence of *Staphylococcus aureus* in a sample, hereinafter diagnostic fragments (DFs).

As used herein, an "isolated nucleic acid molecule" or an "isolated fragment of the *Staphylococcus aureus* genome" refers to a nucleic acid molecule possessing a specific nucleotide sequence which has been subjected to purification means to reduce, from the composition, the number of compounds which are normally associated with the composition. Particularly, the term refers to the nucleic acid molecules having the sequences set out in SEQ ID NOS: 1–5,191, to representative fragments thereof as described above, to polynucleotides at least 95%, preferably at least 96%, 97%, 98% or 99% and especially preferably at least 99.9% identical in sequence thereto, also as set out above.

A variety of purification means can be used to generated the isolated fragments of the present invention. These include, but are not limited to methods which separate constituents of a solution based on charge, solubility, or size.

In one embodiment, *Staphylococcus aureus* DNA can be mechanically sheared to produce fragments of 15–20 kb in length. These fragments can then be used to generate an *Staphylococcus aureus* library by inserting them into lambda clones as described in the Examples below. Primers flanking, for example, an ORF, such as those enumerated in Tables 1–3 can then be generated using nucleotide sequence information provided in SEQ ID NOS:1–5,191. Well known and routine techniques of PCR cloning then can be used to isolate the ORF from the lambda DNA library of *Staphylococcus aureus* genomic DNA. Thus, given the availability of SEQ ID NOS: 1–5,191, the information in Tables 1, 2 and 3, and the information that may be obtained readily by analysis of the sequences of SEQ ID NOS:1–5,191 using methods set out above, those of skill will be enabled by the present disclosure to isolate any ORF-containing or other nucleic acid fragment of the present invention.

The isolated nucleic acid molecules of the present invention include, but are not limited to single stranded and double stranded DNA, and single stranded RNA.

As used herein, an "open reading frame," ORF, means a series of triplets coding for amino acids without any termination codons and is a sequence translatable into protein.

Tables 1, 2 and 3 list ORFs in the *Staphylococcus aureus* genomic contigs of the present invention that were identified as putative coding regions by the GeneMark software using organism-specific second-order Markov probability transition matrices. It will be appreciated that other criteria can be used, in accordance with well known analytical methods, such as those discussed herein, to generate more inclusive, more restrictive or more selective lists.

Table 1 sets out ORFs in the *Staphylococcus aureus* contigs of the present invention that are at least 80 amino acids long and over a continuous region of at least 50 bases which are 95% or more identical (by BLAST analysis) to an S. aureus nucleotide sequence available through Genbank in November 1996.

Table 2 sets out ORFs in the *Staphylococcus aureus* contigs of the present invention that are not in Table 1 and match, with a BLASTP probability score of 0.01 or less, a polypeptide sequence available through Genbank by Sep. 1996.

Table 3 sets out ORFs in the *Staphylococcus aureus* contigs of the present invention that do not match significantly, by BLASTP analysis, a polypeptide sequence available through Genbank by Sep. 1996.

In each table, the first and second columns identify the ORF by, respectively, contig number (SEQ ID NO) and ORF number within the contig; the third column indicates the first nucleotide of the ORF, counting from the 5' end of the contig strand shown in the sequence listing; and the fifth column indicates the length of each ORF in nucleotides. It will be appreciated that some ORFs are located on the reverse strand. The numbering identifying such ORFs also represents nucleotide positions counting from the 5' end of the strand shown in the sequence listing.

In Tables 1 and 2, column five, lists the "match accession" for the closest matching sequence available through Genbank. These reference numbers are the databases entry numbers commonly used by those of skill in the art, who will be familiar with their denominators. Descriptions of the nomenclature are available from the National Center for Biotechnology Information. Column six in Tables 1 and 2 provides the "gene name" of the matching sequence; column seven provides the BLAST "similarity"; column eight provides the BLAST "identity" score from the comparison of the ORF and the homologous gene; and column nine indicates the length in nucleotides of the highest scoring segment pair identified by the BLAST identity analysis.

The concepts of percent identity and percent similarity of two polypeptide sequences is well understood in the art. For example, two polypeptides 10 amino acids in length which differ at three amino acid positions (e.g., at positions 1, 3 and 5) are said to have a percent identity of 70%. However, the same two polypeptides would be deemed to have a percent similarity of 80% if, for example at position 5, the amino acids moieties, although not identical, were "similar" (i.e., possessed similar biochemical characteristics). Many programs for analysis of nucleotide or amino acid sequence similarity, such as fast and BLAST specifically list percent identity of a matching region as an output parameter. Thus, for instance, Tables 1 and 2 herein enumerate the percent identity of the highest scoring segment pair" in each ORF and its listed relative. Further details concerning the algorithms and criteria used for homology searches are provided below and are described in the pertinent literature highlighted by the citations provided below.

It will be appreciated that other criteria can be used to generate more inclusive and more exclusive listings of the types set out in the tables. As those of skill will appreciate, narrow and broad searches both ate useful. Thus, a skilled artisan can readily identify ORFs in contigs of the *Staphylococcus aureus* genome other than those listed in Tables 1–3, such as ORFs which are overlapping or encoded by the opposite strand of an identified ORF in addition to those ascertainable using the computer-based systems of the present invention.

As used herein, an "expression modulating fragment," EMF, means a series of nucleotide molecules which modulates the expression of an operably linked ORF or EMF.

As used herein, a sequence is said to "modulate the expression of an operably linked sequence" when the expression of the sequence is altered by the presence of the EMF. EMFs include, but are not limited to, promoters, and promoter modulating sequences (inducible elements). One class of EMFs are fragments which induce the expression or an operably linked ORF in response to a specific regulatory factor or physiological event.

EMF sequences can be identified within the contigs of the *Staphylococcus aureus* genome by their proximity to the ORFs provided in Tables 1–3. An intergenic segment, or a fragment of the intergenic segment, from about 10 to 200 nucleotides in length, taken from any one of the ORFs of Tables 1–3 will modulate the expression of an operably linked ORF in a fashion similar to that found with the naturally linked ORF sequence. As used herein, an "intergenic segment" refers to fragments of the *Staphylococcus aureus* genome which are between two ORF(s) herein described. EMFs also can be identified using known EMFs as a target sequence or target motif in the computer-based systems of the present invention. Further, the two methods can be combined and used together.

The presence and activity of an EMF can be confirmed using an EMF trap vector. An EMF trap vector contains a cloning site linked to a marker sequence. A marker sequence encodes an identifiable phenotype, such as antibiotic resistance or a complementing nutrition auxotrophic factor, which can be identified or assayed when the EMF trap vector is placed within an appropriate host under appropriate conditions. As described above, a EMF will modulate the expression of an operably linked marker sequence. A more detailed discussion of various marker sequences is provided below.

A sequence which is suspected as being an EMF is cloned in all three reading frames in one or more restriction sites upstream from the marker sequence in the EMF trap vector. The vector is then transformed into an appropriate host using known procedures and the phenotype of the transformed host in examined under appropriate conditions. As described above, an EMF will modulate the expression of an operably linked marker sequence.

As used herein, a "diagnostic fragment," DF, means a series of nucleotide molecules which selectively hybridize to *Staphylococcus aureus* sequences. DFs can be readily identified by identifying unique sequences within contigs of the *Staphylococcus aureus* genome, such as by using well-known computer analysis software, and by generating and testing probes or amplification primers consisting of the DF sequence in an appropriate diagnostic format which determines amplification or hybridization selectivity.

The sequences falling within the scope of the present invention are not limited to the specific sequences herein described, but also include allelic and species variations thereof. Allelic and species variations can be routinely determined by comparing the sequences provided in SEQ ID NOS:1–5,191, a representative fragment thereof, or a nucleotide sequence at least 99% and preferably 99.9% identical to SEQ ID NOS:1–5,191, with a sequence from another isolate of the same species.

Furthermore, to accommodate codon variability, the invention includes nucleic acid molecules coding for the same amino acid sequences as do the specific ORFs disclosed herein. In other words, in the coding region of an ORF, substitution of one codon for another which encodes the same amino acid is expressly contemplated.

Any specific sequence disclosed herein can be readily screened for errors by resequencing a particular fragment, such as an ORF, in both directions (i.e., sequence both strands). Alternatively, error screening can be performed by sequencing corresponding polynucleotides of *Staphylococcus aureus* origin isolated by using part or all of the fragments in question as a probe or primer.

Each of the ORFs of the *Staphylococcus aureus* genome disclosed in Tables is 1, 2 and 3, and the EMFs found 5' to the ORFs, can be used as polynucleotide reagents in numerous ways. For example, the sequences can be used as diagnostic probes or diagnostic amplification primers to detect the presence of a specific microbe in a sample, particular *Staphylococcus aureus*. Especially preferred in this regard are ORF such as those of Table 3, which do not match previously characterized sequences from other organisms and thus are most likely to be highly selective for *Staphylococcus aureus*. Also particularly preferred are ORFs that can be used to distinguish between strains of *Staphylococcus aureus*, particularly those that distinguish medically important strain, such as drug-resistant strains.

In addition, the fragments of the present invention, as broadly described, can be used to control gene expression through triple helix formation or antisense DNA or RNA, both of which methods are based on the binding of a polynucleotide sequence to DNA or RNA. Triple helix—formation optimally results in a shut-off of RNA transcription from DNA, while antisense RNA hybridization blocks translation of an mRNA molecule into polypeptide. Information from the sequences of the present invention can be used to design antisense and triple helix-forming oligonucleotides. Polynucleotides suitable for use in these methods are usually 20 to 40 bases in length and are designed to be complementary to a region of the gene involved in transcription, for triple-helix formation, or to the mRNA itself, for antisense inhibition. Both techniques have been demonstrated to be effective in model systems, and the requisite techniques are well known and involve routine procedures. Triple helix techniques are discussed in, for example, Lee et al., *Nucl. Acids Res.* 6: 3073 (1979); Cooney et al., Science 241:456 (1988); and Dervan et al., Science 251: 1360 (1991). Antisense techniques in general are discussed in, for instance, Okano, *J. Neurochem.* 56: 560 (1991) and OLIGODEOXYNUCLEOTIDES AS ANTISENSE INHIBITORS OF GENE EXPRESSION, CRC Press, Boca Raton, Fla. (1988)).

The present invention further provides recombinant constructs comprising one or more fragments of the *Staphylococcus aureus* genomic fragments and contigs of the present invention. Certain preferred recombinant constructs of the present invention comprise a vector, such as a plasmid or viral vector, into which a fragment of the *Staphylococcus aureus* genome has been inserted, in a forward or reverse orientation. In the case of a vector comprising one of the ORFs of the present invention, the vector may further comprise regulatory sequences, including for example, a promoter, operably linked to the ORF. For vectors comprising the EMFs of the present invention, the vector may further comprise a marker sequence or heterologous ORF operably linked to the EMF.

Large numbers of suitable vectors and promoters are known to those of skill in the art and are commercially available for generating the recombinant constructs of the present invention. The following vectors are provided by way of example. Useful bacterial vectors include phagescript, PsiXI74, pBluescript SK and KS (+ and –), pNH8a, pNH16a, pNH18a, pNH46a (available from Stratagene); pTrc99A, pKK223–3, pKK233–3, pDR540, pRIT5 (available from Pharmacia). Useful eukaryotic vectors include pWLneo, pSV2cat, pOG44, pXT 1, pSG (available from Stratagene) pSVK3, pBPV, pMSG, pSVL (available from Pharmacia).

Promoter regions can be selected from any desired gene using CAT (chloramphenicol transferase) vectors or other vectors with selectable markers. Two appropriate vectors are pKK232–8 and pCM7. Particular named bacterial promoters include lac, lacZ, T3, T7, gpt, lambda PR, and trc. Eukaryotic promoters include CMV immediate early, HSV thymidine kinase, early and late SV40, LTRs from retrovirus, and mouse metallothionein- I. Selection of the appropriate vector and promoter is well within the level of ordinary skill in the art.

The present invention further provides host cells containing any one of the isolated fragments of the *Staphylococcus aureus* genomic fragments and contigs of the present invention, wherein the fragment has been introduced into the host cell using known methods. The host cell can be a higher eukaryotic host cell, such as a mammalian cell, a lower eukaryotic host cell, such as a yeast cell, or a procaryotic cell, such as a bacterial cell.

A polynucleotide of the present invention, such as a recombinant construct comprising an ORF of the present invention, may be introduced into the host by a variety of well established techniques that are standard in the art, such as calcium phosphate transfection, DEAE, dextran mediated transfection and electroporation, which are described in, for instance, Davis, L. et al., BASIC METHODS IN MOLECULAR BIOLOGY (1986).

A host cell containing one of the fragments of the *Staphylococcus aureus* genomic fragments and contigs of the present invention, can be used in conventional manners to produce the gene product encoded by the isolated fragment (in the case of an ORF) or can be used to produce a heterologous protein under the control of the EMF.

The present invention further provides isolated polypeptides encoded by the nucleic acid fragments of the present invention or by degenerate variants of the nucleic acid fragments of the present invention. By "degenerate variant" is intended nucleotide fragments which differ from a nucleic acid fragment of the present invention (e.g., an ORF) by nucleotide sequence but, due to the degeneracy of the Genetic Code, encode an identical polypeptide sequence.

Preferred nucleic acid fragments of the present invention are the ORFs depicted in Tables 2 and 3 which encode proteins.

A variety of methodologies known in the art can be utilized to obtain any one of the isolated polypeptides or proteins of the present invention. At the simplest level, the amino acid sequence can be synthesized using commercially available peptide synthesizers. This is particularly useful in producing small peptides and fragments of larger polypeptides. Such short fragments as may be obtained most readily by synthesis are useful, for example, in generating antibodies against the native polypeptide, as discussed further below.

In an alternative method, the polypeptide or protein is purified from bacterial cells which naturally produce the polypeptide or protein. One skilled in the art can readily employ well-known methods for isolating polpeptides and proteins to isolate and purify polypeptides or proteins of the present invention produced naturally by a bacterial strain, or by other methods. Methods for isolation and purification that can be employed in this regard include, but are not limited to, immunochromatography, HPLC, size-exclusion chromatography, ion-exchange chromatography, and immuno-affinity chromatography.

The polypeptides and proteins of the present invention also can be purified from cells which have been altered to express the desired polypeptide or protein. As used herein, a cell is said to be altered to express a desired polypeptide or protein when the cell, through genetic manipulation, is made to produce a polypeptide or protein which it normally does not produce or which the cell normally produces at a lower level. Those skilled in the art can readily adapt procedures for introducing and expressing either recombinant or synthetic sequences into eukaryotic or prokaryotic cells in order to generate a cell which produces one of the polypeptides or proteins of the present invention.

Any host/vector system can be used to express one or more of the ORFs of the present invention. These include, but are not limited to, eukaryotic hosts such as HeLa cells, CV-1 cell, COS cells, and Sf9 cells, as well as prokaryotic host such as E. coli and B. subtilis. The most preferred cells are those which do not normally express the particular polypeptide or protein or which expresses the polypeptide or protein at low natural level.

"Recombinant," as used herein, means that a polypeptide or protein is derived from recombinant (e.g., microbial or mammalian) expression systems. "Microbial" refers to recombinant polypeptides or proteins made in bacterial or fungal (e.g., yeast) expression systems. As a product, "recombinant microbial" defines a polypeptide or protein essentially free of native endogenous substances and unaccompanied by associated native glycosylation. Polypeptides or proteins expressed in most bacterial cultures, e.g., E. coli, will be free of glycosylation modifications; polypeptides or proteins expressed in yeast will have a glycosylation pattern different from that expressed in mammalian cells.

"Nucleotide sequence" refers to a heteropolymer of deoxyribonucleotides. Generally, DNA segments encoding the polypeptides and proteins provided by this invention are assembled from fragments of the Staphylococcus aureus genome and short oligonucleotide linkers, or from a series of oligonucleotides, to provide a synthetic gene which is capable of being expressed in a recombinant transcriptional unit comprising regulatory elements derived from a microbial or viral operon.

"Recombinant expression vehicle or vector" refers to a plasmid or phage or virus or vector, for expressing a polypeptide from a DNA (RNA) sequence. The expression vehicle can comprise a transcriptional unit comprising an assembly of (1) a genetic regulatory elements necessary for gene expression in the host, including elements required to initiate and maintain transcription at a level sufficient for suitable expression of the desired polypeptide, including, for example, promoters and, where necessary, an enhancers and a polyadenylation signal; (2) a structural or coding sequence which is transcribed into mRNA and translated into protein, and (3) appropriate signals to initiate translation at the beginning of the desired coding region and terminate translation at its end. Structural units intended for use in yeast or eukaryotic expression systems preferably include a leader sequence enabling extracellular secretion of translated protein by a host cell. Alternatively, where recombinant protein is expressed without a leader or transport sequence, it may include an N-terminal methionine residue. This residue may or may not be subsequently cleaved from the expressed recombinant protein to provide a final product.

"Recombinant expression system" means host cells which have stably integrated a recombinant transcriptional unit into chromosomal DNA or carry the recombinant transcriptional unit extra chromosomally. The cells can be prokaryotic or eukaryotic. Recombinant expression systems as defined herein will express heterologous polypeptides or proteins upon induction of the regulatory elements linked to the DNA segment or synthetic gene to be expressed.

Mature proteins can be expressed in mammalian cells, yeast, bacteria, or other cells under the control of appropriate promoters. Cell-free translation systems can also be employed to produce such proteins using RNAs derived from the DNA constructs of the present invention. Appropriate cloning and expression vectors for use with prokaryotic and eukaryotic hosts are described in Sambrook et al., MOLECULAR CLONING:A LABORATORY MANUAL, 2nd Edition, Cold Spring Harbor Laboratory Press, Cold Spring Harbor, N.Y. (1989), the disclosure of which is hereby incorporated by reference in its entirety.

Generally, recombinant expression vectors will include origins of replication and selectable markers permitting transformation of the host cell, e.g., the ampicillin resistance gene of E. coli and S. cerevisiae TRP1 gene, and a promoter derived from a highly expressed gene to direct transcription of a downstream structural sequence. Such promoters can be derived from operons encoding glycolytic enzymes such as 3- phosphoglycerate kinase (PGK), alpha-factor, acid phosphatase, or heat shock proteins, among others. The heterologous structural sequence is assembled in appropriate phase with translation initiation and termination sequences, and preferably, a leader sequence capable of directing secretion of translated protein into the periplasmic space or extracellular medium. Optionally, the heterologous sequence can encode a fusion protein including an N-terminal identification peptide imparting desired characteristics, e.g., stabilization or simplified purification of expressed recombinant product.

Useful expression vectors for bacterial use are constructed by inserting a structural DNA sequence encoding a desired protein together with suitable translation initiation and termination signals in operable reading phase with a functional promoter. The vector will comprise one or more phenotypic selectable markers and an origin of replication to ensure maintenance of the vector and, when desirable, provide amplification within the host.

Suitable prokaryotic hosts for transformation include strains of Staphylococcus aureus, E. coli, B. subtilis, Salmonella typhimurium and various species within the genera Pseudomonas, Streptomyces, and Staphylococcus. Others may, also be employed as a matter of choice.

As a representative but non-limiting example, useful expression vectors for bacterial use can comprise a selectable marker and bacterial origin of replication derived from commercially available plasmids comprising genetic elements of the well known cloning vector pBR322 (ATCC 37017). Such commercial vectors include, for example, pKK223–3 (available form Pharmacia Fine Chemicals, Uppsala, Sweden) and GEM 1 (available from Promega Biotec, Madison, Wis., USA). These pBR322 "backbone" sections are combined with an appropriate promoter and the structural sequence to be expressed.

Following transformation of a suitable host strain and growth of the host strain to an appropriate cell density, the selected promoter, where it is inducible, is depressed or induced by appropriate means (e.g., temperature shift or chemical induction) and cells are cultured for an additional period to provide for expression of the induced gene product. Thereafter cells are typically harvested, generally by centrifugation, disrupted to release expressed protein, generally by physical or chemical means, and the resulting crude extract is retained for further purification.

Various mammalian cell culture systems can also be employed to express recombinant protein. Examples of mammalian expression systems include the COS-7 lines of monkey kidney fibroblasts, described in Gluzman, Cell 23: 175 (1981), and other cell lines capable of expressing a compatible vector, for example, the C127, 3T3, CHO, HeLa and BHK cell lines.

Mammalian expression vectors will comprise an origin of replication, a suitable promoter and enhancer, and also any necessary ribosome binding sites, polyadenylation site, splice donor and acceptor sites, transcriptional termination sequences, and 5' flanking nontranscribed sequences. DNA sequences derived from the SV40 viral genome, for example, SV40 origin, early promoter, enhancer, splice, and polyadenylation sites may be used to provide the required nontranscribed genetic elements.

Recombinant polypeptides and proteins produced in bacterial culture is usually isolated by initial extraction from cell pellets, followed by one or more salting-out, aqueous ion exchange or size exclusion chromatography steps. Microbial cells employed in expression of proteins can be disrupted by any convenient method, including freeze-thaw cycling, sonication, mechanical disruption, or use of cell lysing agents. Protein refolding steps can be used, as necessary, in completing configuration of the mature protein. Finally, high performance liquid chromatography (HPLC) can be employed for final purification steps. An additional aspect of the invention includes *Staphylococcus aureus* polypeptides which are useful as immunodiagnostic antigens and/or immunoprotective vaccines, collectively "immunologically useful polypeptides". Such immunologically useful polypeptides may be selected from the ORFs disclosed herein based on techniques well known in the art and described elsewhere herein. The inventors have used the following criteria to select several immunologically useful polypeptides:

As is known in the art, an amino terminal type I signal sequence directs a nascent protein across the plasma and outer membranes to the exterior of the bacterial cell. Such outermembrane polypeptides are expected to be immunologically useful. According to Izard, J. W. et al., Mol. Microbiol. 13, 765–773; (1994), polypeptides containing type I signal sequences contain the following physical attributes: The length of the type I signal sequence is approximately 15 to 25 primarily hydrophobic amino acid residues with a net positive charge in the extreme amino terminus; the central region of the signal sequence must adopt an alpha-helical conformation in a hydrophobic environment; and the region surrounding the actual site of cleavage is ideally six residues long, with small side-chain amino acids in the −1 and −3 positions.

Also known in the art is the type IV signal sequence which is an example of the several types of functional signal sequences which exist in addition to the type I signal sequence detailed above. Although functionally related, the type IV signal sequence possesses a unique set of biochemical and physical attributes (Strom, M. S. and Lory, S., J. Bacteriol. 1–74, 7345–7351; 1992)). These are typically six to eight amino acids with a net basic charge followed by an additional sixteen to thirty primarily hydrophobic residues. The cleavage site of a type IV signal sequence is typically after the initial six to eight amino acids at the extreme amino terminus. In addition, all type IV signal sequences contain a phenylalanine residue at the +1 site relative to the cleavage site.

Studies of the cleavage sites of twenty-six bacterial lipoprotein precursors has allowed the definition of a consensus amino acid sequence for lipoprotein cleavage. Nearly three-fourths of the bacterial lipoprotein precursors examined contained the sequence L-(A,S)-(G,A)-C at positions −3 to +1, relative to the point of cleavage (Hayashi, S. and Wu, H. C. Lipoproteins in bacteria. J Bioenerg. Biomembr. 22, 451–471; 1990).

It is well known that most anchored proteins found on the surface of gram-positive bacteria possess a highly conserved carboxy terminal sequence. More than fifty such proteins from organisms such as *S. pyogenes, S. mutans, E. faecalis, S. pneumoniae*, and others, have been identified based on their extracellular location and carboxy terminal amino acid sequence (Fischetti, V. A. Gram-positive commensal bacteria deliver antigens to elicit mucosal and systemic immunity. ASM News 62, 405–410; 1996). The conserved region is comprised of six charged amino acids at the extreme carboxy terminus coupled to 15–20 hydrophobic amino acids presumed to function as a transmembrane domain. Immediately adjacent to the transmembrane domain is a six amino acid sequence conserved in nearly all proteins examined. The amino acid sequence of this region is L-P-X-T-G-X (SEQ ID NO:5256), where X is any amino acid.

Amino acid sequence similarities to proteins of known function by BLAST enables the assignment of putative functions to novel amino acid sequences and allows for the selection of proteins thought to function outside the cell wall. Such proteins are well known in the art and include "lipoprotein", "periplasmic", or "antigen".

An algorithm for selecting antigenic and immunogenic *Staphylococcus aureus* polypeptides including the foregoing criteria was developed by the present inventors. Use of the algorithm by the inventors to select immunologically useful *Staphylococcus aureus* polypeptides resulted in the selection of several ORFs which are predicted to be outer membrane-associated proteins. These proteins are identified below, and shown in the Sequence Listing as SEQ ID NOS:5,192 to 5,255. Thus the amino acid sequence of each of several antigenic *Staphylococcus aureus* polypeptides can be determined, for example, by locating the amino acid sequence of the ORF in the Sequence Listing. Likewise the polynucleotide sequence encoding each ORF can be found by locating the corresponding polynucleotide SEQ ID in Tables 1, 2, or 3, and finding the corresponding nucleotide sequence in the sequence listing.

As will be appreciated by those of ordinary skill in the art, although a polypeptide representing an entire ORF may be the closest approximation to a protein found in vivo, it is not always technically practical to express a complete ORF in vitro. It may be very challenging to express and purify a highly hydrophobic protein by common laboratory methods. As a result, the immunologically useful polypeptides described herein as SEQ ID NOS:5,192–5,255 may have been modified slightly to simplify the production of recombinant protein, and are the preferred embodiments. In general, nucleotide sequences which encode highly hydrophobic domains, such as those found at the amino terminal signal sequence, are excluded for enhanced in vitro expression of the polypeptides. Furthermore, any highly hydrophobic amino acid sequences occurring at the carboxy terminus are also excluded. Such truncated polypeptides include for example the mature forms of the polypeptides expected to exist in nature.

Those of ordinary skill in the art can identify soluble portions the polypeptide, and in the case of truncated polypeptides sequences shown as SEQ ID NOS:5,192–5, 255, may obtain the complete predicted amino acid sequence of each polypeptide by translating the corresponding polynucleotides sequences of the corresponding ORF listed in Tables 1,2 and 3 and found in the sequence listing.

Accordingly, polypeptides comprising the complete amino acid sequence of an immunologically useful polypeptide selected from the group of polypeptides encoded by the ORFs shown as SEQ ID NOS:5,192–5,255, or an amino acid sequence at least 95% identical thereto, preferably at least 97% identical thereto, and most preferably at least 99% identical thereto form an embodiment of the invention; in addition, polypeptides comprising an amino acid sequence selected from the group of amino acid sequences shown in the sequence listing as SEQ ID NOS:5,191–5,255, or an amino acid sequence at least 95% identical thereto, preferably at least 97% identical thereto and most preferably 99% identical thereto, form an embodiment of the invention. Polynucleotides encoding the foregoing polypeptides also form part of the invention.

In another aspect, the invention provides a peptide or polypeptide comprising an epitope-bearing portion of a polypeptide of the invention, particularly those epitope-bearing portions (antigenic regions) identified in the sequence listing as SEQ ID NOS:5,191–5,255. The epitope-bearing portion is an immunogenic or antigenic epitope of a polypeptide of the invention. An "immunogenic epitope" is defined as a part of a protein that elicits an antibody response when the whole protein is the immunogen. On the other hand, a region of a protein molecule to which an antibody can bind is defined as an "antigenic epitope." The number of immunogenic epitopes of a protein generally is less than the number of antigenic epitopes. See, for instance, Geysen et al., Proc. Natl. Acad. Sci. USA 81:3998–4002 (1983).

As to the selection of peptides or polypeptides bearing an antigenic epitope (i.e., that contain a region of a protein molecule to which an antibody can bind), it is well known in that art that relatively short synthetic peptides that mimic part of a protein sequence are routinely capable of eliciting an antiserum that reacts with the partially mimicked protein. See, for instance, Sutcliffe, J. G., Shinnick, T. M., Green, N. and Learner, R. A. (1983) "Antibodies that react with predetermined sites on proteins", Science, 219:660–666. Peptides capable of eliciting protein-reactive sera are frequently represented in the primary sequence of a protein, can be characterized by a set of simple chemical rules, and are confined neither to immunodominant regions of intact proteins (i.e., immunogenic epitopes) nor to the amino or carboxyl terminals.

Antigenic epitope-bearing peptides and polypeptides of the invention are therefore useful to raise antibodies, including—monoclonal antibodies, that bind specifically to a polypeptide of the invention. See, for instance, Wilson et al., Cell 37:767–778 (1984) at 777.

Antigenic epitope-bearing peptides and polypeptides of the invention preferably contain a sequence of at least seven, more preferably at least nine and most preferably between about 15 to about 30 amino acids contained within the amino acid sequence of a polypeptide of the invention. Non-limiting examples of antigenic polypeptides or peptides that can be used to generate S. aureus specific antibodies include: a polypeptide comprising peptides shown below. These polypeptide fragments have been determined to bear antigenic epitopes of indicated S. aureus proteins by the analysis of the Jameson-Wolf antigenic index.

The epitope-bearing peptides and polypeptides of the invention may be produced by any conventional means. See, e.g., Houghtein, R. A. (1985) General method for the rapid solid-phase synthesis of large numbers of peptides: specificity of antigen-antibody interaction at the level of individual amino acids. Proc. Natl. Acad. Sci. USA 82:5131–5135; this "Simultaneous Multiple Peptide Synthesis (SMPS)" process is further described in U.S. Pat. No. 4,631,211 to Houghten et al. (1986). Epitope-bearing peptides and polypeptides of the invention are used to induce antibodies according to methods well known in the art. See, for instance, Sutcliffe et al., supra; Wilson et al., supra; Chow, M. et al., Proc. Natl. Acad. Sci. USA 82:910–914; and Bittle, F. J. et al., J. Gen. Virol. 66:2347–2354 (1985).

Immunogenic epitope-bearing peptides of the invention, i.e., those parts of a protein that elicit an antibody response when the whole protein is the immunogen, are identified according to methods known in the art. See, for instance, Geysen et al., supra. Further still, U.S. Pat. No. 5,194,392 to Geysen (1990) describes a general method of detecting or determining the sequence of monomers (amino acids or other compounds) which is a topological equivalent of the epitope (i.e., a "mimotope") which is complementary to a particular paratope (antigen binding site) of an antibody of interest. More generally, U.S. Pat. No. 4,433,092 to Geysen (1989) describes a method of detecting or determining a sequence of monomers which is a topographical- equivalent of a ligand which is complementary to the ligand binding site of a particular receptor of interest. Similarly, U.S. Pat. No. 5,480,971 to Houghten, R. A. et al. (1996) on Peralkylated Oligopeptide Mixtures discloses linear C1–C7-alkyl peralkylated oligopeptides and sets and libraries of such peptides, as well as methods for using such oligopeptide sets and libraries for determining the sequence of a peralkylated oligopeptide that preferentially binds to an acceptor molecule of interest. Thus, non-peptide analogs of the epitope-bearing peptides of the invention also can be made routinely by these methods.

Immunologically useful polypeptides may be identified by an algorithm which locates novel Staphylococcus aureus outer membrane proteins, as is described above. Also listed are epitopes or "antigenic regions" of each of the identified polypeptides. The antigenic regions, or epitopes, are delineated by two numbers x-y, where x is the number of the first amino acid in the open reading frame included within the epitope and y is the number of the last amino acid in the open reading frame included within the epitope. For example, the first epitope in ORF. 168-6 is comprised of amino acids 36 to 45 of SEQ ID NO:5,192. The inventors have identified several epitopes for each of the antigenic polypeptides identified. Accordingly, forming part of the present invention are polypeptides comprising an amino acid sequence of one or more antigenic regions identified. The invention further provides polynucleotides encoding such polypeptides.

The present invention further includes isolated polypeptides, proteins and nucleic acid molecules which are substantially equivalent to those herein described. As used herein, substantially equivalent can refer both to nucleic acid and amino acid sequences, for example a mutant sequence, that varies from a reference sequence by one or more substitutions, deletions, or additions, the net effect of which does not result in an adverse functional dissimilarity between reference and subject sequences. For purposes of the present invention, sequences having equivalent biological activity, and equivalent expression characteristics are considered substantially equivalent. For purposes of determining equivalence, truncation of the mature sequence should be disregarded.

The invention further provides methods of obtaining homologs from other strains of Staphylococcus aureus, of the fragments of the Staphylococcus aureus genome of the present invention and homologs of the proteins encoded by the ORFs of the present invention. As used herein, a sequence or protein of *Staphylococcus aureus* is defined as a homolog of a fragment of the *Staphylococcus aureus* fragments or contigs or a protein encoded by one of the ORFs of the present invention, if it shares significant homology to one of the fragments of the *Staphylococcus aureus* genome of the present invention or a protein encoded by one of the ORFs of the present invention. Specifically, by using the sequence disclosed herein as a probe or as primers, and techniques such as PCR cloning and colony/plaque hybridization, one skilled in the art can obtain homologs.

As used herein, two nucleic acid molecules or proteins are said to "share significant homology" if the two contain regions which prossess greater than 85% sequence (amino acid or nucleic acid) homology. Preferred homologs in this regard are those with more than 90% homology. Especially preferred are those with 93% or more homology. Among especially preferred homologs those with 95% or more homology are particularly preferred. Very particularly preferred among these are those with 97% and even more particularly preferred among those are homologs with 99% or more homology. The most preferred homologs among these are those with 99.9% homology or more. It will be understood that, among measures of homology, identity is particularly preferred in this regard.

Region specific primers or probes derived from the nucleotide sequence provided in SEQ ID NOS: 1–5,191 or from a nucleotide sequence at least 95%, particularly at least 99%, especially at least 99.5% identical to a sequence of SEQ ID NOS:1–5,191 can be used to prime DNA synthesis and PCR amplification, as well as to identify colonies containing cloned DNA encoding a homolog. Methods suitable to this aspect of the present invention are well known and have been described in great detail in many publications such as, for example, Innis et al., PCR PROTOCOLS, Academic Press, San Diego, Calif. (1990)).

When using primers derived from SEQ ID NOS: 1–5,191 or from a nucleotide sequence having an aforementioned identity to a sequence of SEQ ID NOS:1–5,191, one skilled in the art will recognize that by employing high stringency conditions (e.g., annealing at 50–60° C. in 6X SSPC and 50% formamide, and washing at 50–65° C. in 0.5X SSPC) only sequences which are greater than 75% homologous to the primer will be amplified. By employing lower stringency conditions (e.g., hybridizing at 35–37° C. in 5X SSPC and 40–45% formamide, and washing at 42° C. in 0.5X SSPC), sequences which are greater than 40–50% homologous to the primer will also be amplified.

When using DNA probes derived from SEQ ID NOS:1–5, 191, or from a nucleotide sequence having an aforementioned identity to a sequence of SEQ ID NOS:1–5,191, for colony/plaque hybridization, one skilled in the art will recognize that by employing high stringency conditions (e.g., hybridizing at 50–65° C. in 5X SSPC and 50% formamide, and washing at 50–65° C. in 0.5X SSPC), sequences having regions which are greater than 90% homologous to the probe can be obtained, and that by employing lower stringency conditions (e.g., hybridizing at 35–37° C. in 5X SSPC and 40–45% formamide, and washing at 42° C. in 0.5X SSPC), sequences having regions which are greater than 35–45% homologous to the probe will be obtained.

Any organism can be used as the source for homologs of the present invention so long as the organism naturally expresses such a protein or contains genes encoding the same. The most preferred organism for isolating homologs are bacterias which are closely related to *Staphylococcus aureus*.

ILLUSTRATIVE USES OF COMPOSITIONS OF THE INVENTION

Each ORF provided in Tables 1 and 2 is identified with a function by homology to a known gene or polypeptide. As a result, one skilled in the art can use the polypeptides of the present invention for commercial, therapeutic and industrial purposes consistent with the type of putative identification of the polypeptide. Such identifications permit one skilled in the art to use the *Staphylococcus aureus* ORFs in a manner similar to the known type of sequences for which the identification is made; for example, to ferment a particular sugar source or to produce a particular metabolite. A variety of reviews illustrative of this aspect of the invention are available, including the following reviews on the industrial use of enzymes, for example, BIOCHEMICAL ENGINEERING AND BIOTECHNOLOGY HANDBOOK, 2nd Ed., Macmillan Publications, Ltd. N.Y. (1991) and BIOCATALYSTS IN ORGANIC SYNTHESES, Tramper et al., Eds., Elsevier Science Publishers, Amsterdam, The Netherlands (1985). A variety of exemplary uses that illustrate this and similar aspects of the present invention are discussed below.

1. Biosynthetic Enzymes

Open reading frames encoding proteins involved in mediating the catalytic reactions involved in intermediary and macromolecular metabolism, the biosynthesis of small molecules, cellular processes and other functions includes enzymes involved in the degradation of the intermediary products of metabolism, enzymes involved in central intermediary metabolism, enzymes involved in respiration, both aerobic and anaerobic, enzymes involved in fermentation, enzymes involved in ATP proton motor force conversion, enzymes involved in broad regulatory function, enzymes involved in amino acid synthesis, enzymes involved in nucleotide synthesis, enzymes involved in cofactor and vitamin synthesis, can be used for industrial biosynthesis.

The various metabolic pathways present in *Staphylococcus aureus* can be identified based on absolute nutritional requirements as well as by examining the various enzymes identified in Table 1–3 and SEQ ID NOS: 1–5,191.

Of particular interest are polypeptides involved in the degradation of intermediary metabolites as well as non-macromolecular metabolism. Such enzymes include amylases, glucose oxidases, and catalase.

Proteolytic enzymes are another class of commercially important enzymes. Proteolytic enzymes find use in a number of industrial processes including the processing of flax and other vegetable fibers, in the extraction, clarification and depectinization of fruit juices, in the extraction of vegetables' oil and in the maceration of fruits and vegetables to give unicellular fruits. A detailed review of the proteolytic enzymes used in the food industry is provided in Rombouts et al., *Symbiosis* 21: 79 (1986) and Voragen et al. in BIOCATALYSTS IN AGRICULTURAL BIOTECHNOLOGY, Whitaker et al., Eds., *American Chemical Society Symposium Series* 389: 93 (1989).

The metabolism of sugars is an important aspect of the primary metabolism of *Staphylococcus aureus*. Enzymes involved in the degradation of sugars, such as, particularly, glucose, galactose, fructose and xylose, can be used in industrial fermentation. Some of the important sugar transforming enzymes, from a commercial viewpoint, include sugar isomerases such as glucose isomerase. Other metabolic enzymes have found commercial use such as glucose oxidases which produces ketogulonic acid (KGA). KGA is an intermediate in the commercial production of ascorbic acid using the Reichstein's procedure, as described in Krueger et al., *Biotechnology* 6(A), Rhine et al., Eds., Verlag Press, Weinheim, Germany (1984).

Glucose oxidase (GOD) is commercially available and has been used in purified form as well as in an immobilized form for the deoxygenation of beer. See, for instance, Hartmeir et al., *Biotechnology Letters* 1: 21 (1979). The most important application of GOD is the industrial scale fermentation of gluconic acid. Market for gluconic acids which are used in the detergent, textile, leather, photographic, pharmaceutical, food, feed and concrete industry, as described, for example, in Bigelis et al., beginning on page 357 in GENE MANIPULATIONS AND FUNGI; Benett et al., Eds., Academic Press, New York (1985). In addition to industrial applications GOD has found applications in medicine for quantitative determination of glucose in body fluids recently in biotechnology for analyzing syrups from starch and cellulose hydrosylates. This application is described in Owusu et al., *Biochem. et Biophysica. Acta.* 872: 83 (1986), for instance.

The main sweetener used in the world today is sugar which comes from sugar beets and sugar cane. In the field of industrial enzymes, the glucose isomerase process shows the largest expansion in the market today. Initially, soluble enzymes were used and later immobilized enzymes were developed (Krueger et al., Biotechnology, The Textbook of Industrial Microbiology, Sinauer Associated Incorporated, Sunderland, Mass. (1990)). Today, the use of glucose-produced high fructose syrups is by far the largest industrial business using immobilized enzymes. A review of the industrial use of these enzymes is provided by Jorgensen, Starch 40:307 (1988).

Proteinases, such as alkaline serine proteinases, are used as detergent additives and thus represent one of the largest volumes of microbial enzymes used in the industrial sector. Because of their industrial importance, there is a large body of published and unpublished information regarding the use of these enzymes in industrial processes. (See Faultman et al., Acid Proteases Structure Function and Biology, Tang, J., ed., Plenum Press, New York (1977) and Godfrey et al., Industrial Enzymes, MacMillan Publishers, Surrey, UK (1983) and Hepner et al., Report Industrial Enzymes by 1990, Hel Hepner & Associates, London (1986)).

Another class of commercially usable proteins of the present invention are the microbial lipases, described by, for instance, Macrae et al., Philosophical Transactions of the Chiral Society of London 310:227 (1985) and Poserke, Journal of the American Oil Chemist Society 61:1758 (1984). A major use of lipases is in the fat and oil industry for the production of neutral glycerides using lipase catalyzed inter-esterification of readily available triglycerides. Application of lipases include the use as a detergent additive to facilitate the removal of fats from fabrics in the course of the washing procedures.

The use of enzymes, and in particular microbial enzymes, as catalyst for key steps in the synthesis of complex organic molecules is gaining popularity at a great rate. One area of great interest is the preparation of chiral intermediates. Preparation of chiral intermediates is of interest to a wide range of synthetic chemists particularly those scientists involved with the preparation of new pharmaceuticals, agrochemicals, fragrances and flavors. (See Davies et al., Recent Advances in the Generation of Chiral Intermediates Using Enzymes, CRC Press, Boca Raton, Fla. (1990)). The following reactions catalyzed by enzymes are of interest to organic chemists:hydrolysis of carboxylic acid esters, phosphate esters, amides and nitriles, esterification reactions, trans-esterification reactions, synthesis of amides, reduction of alkanones and oxoalkanates, oxidation of alcohols to carbonyl compounds, oxidation of sulfides to sulfoxides, and carbon bond forming reactions such as the aldol reaction.

When considering the use of an enzyme encoded by one of the ORFs of the present invention for biotransformation and organic synthesis it is sometimes necessary to consider the respective advantages and disadvantages of using a microorganism as opposed to an isolated enzyme. Pros and cons of using a whole cell system on the one hand or an isolated partially purified enzyme on the other hand, has been described in detail by Bud et al., Chemistry in Britain (1987), p. 127.

Amino transferases, enzymes involved in the biosynthesis and metabolism of amino acids, are useful in the catalytic production of amino acids. The advantages of using microbial based enzyme systems is that the amino transferase enzymes catalyze the stereo- selective synthesis of only L-amino acids and generally possess uniformly high catalytic rates. A description of the use of amino transferases for amino acid production is provided by Roselle-David, *Methods of Enzymology* 136:479 (1987).

Another category of useful proteins encoded by the ORFs of the present invention include enzymes involved in nucleic acid synthesis, repair, and recombination. A variety of commercially important enzymes have previously been isolated from members of *Staphylococcus aureus*. These include Sau3A and Sau961.

2. Generation of Antibodies

As described here, the proteins of the present invention, as well as homologs thereof, can be used in a variety procedures and methods known in the art which are currently applied to other proteins. The proteins, of the present invention can further be used to generate an antibody which selectively binds the protein. Such antibodies can be either monoclonal or polyclonal antibodies, as well fragments of these antibodies, and humanized forms.

The invention further provides antibodies which selectively bind to one of the proteins of the present invention and hybridomas which produce these antibodies. A hybridoma is an immortalized cell line which is capable of secreting a specific monoclonal antibody.

In general, techniques for preparing polyclonal and monoclonal antibodies as well as hybridomas capable of producing the desired antibody are well known in the art (Campbell, A. M., MONOCLONAL ANTIBODY TECHNOLOGY: LABORATORY TECHNIQUES IN BIOCHEMISTRY AND MOLECULAR BIOLOGY, Elsevier Science Publishers, Amsterdam, The Netherlands (1984); St. Groth et al., *J. Immunol. Methods* 35: 1–21 (1980), Kohler and Milstein, *Nature* 256: 495–497 (1975)), the trioma technique, the human B- cell hybridoma technique (Kozbor et al., *Immunology Today* 4: 72 (1983), pgs. 77–96 of Cole et al., in MONOCLONAL ANTIBODIES AND CANCER THERAPY, Alan R. Liss, Inc. (1985)).

Any animal (mouse, rabbit, etc.) which is known to produce antibodies can be immunized with the pseudogene polypeptide. Methods for immunization are well known in the art. Such methods include subcutaneous or interperitoneal injection of the polypeptide. One skilled in the art will recognize that the amount of the protein encoded by the ORF of the present invention used for immunization will vary based on the animal which is immunized, the antigenicity of the peptide and the site of injection.

The protein which is used as an immunogen may be modified or administered in an adjuvant in order to increase the protein's antigenicity. Methods of increasing the antigenicity of a protein are well known in the art and include, but are not limited to coupling the antigen with a heterologous protein (such as globulin or galactosidase) or through the inclusion of an adjuvant during immunization.

For monoclonal antibodies, spleen cells from the immunized animals are removed, fused with myeloma cells, such as SP2/0-Ag14 myeloma cells, and allowed to become monoclonal antibody producing hybridoma cells.

Any one of a number of methods well known in the art can be used to identify the hybridoma cell which produces an antibody with the desired characteristics. These include screening the hybridomas with an ELISA assay, western blot analysis, or radioimmunoassay (Lutz et al., *Exp. Cell Res.* 175: 109–124 (1988)).

Hybridomas secreting the desired antibodies are cloned and the class and subclass is determined using procedures known in the art (Campbell, A. M., Monoclonal Antibody Technology: Laboratory Techniques in Biochemistry and Molecular Biology, Elsevier Science Publishers, Amsterdam, The Netherlands (1984)).

Techniques described for the production of single chain antibodies (U.S. Pat. No. 4,946,778) can be adapted to produce single chain antibodies to proteins of the present invention.

For polyclonal antibodies, antibody containing antisera is isolated from the immunized animal and is screened for the presence of antibodies with the desired specificity using one of the above-described procedures.

The present invention further provides the above-described antibodies in detectably labelled form. Antibodies can be detectably labelled through the use of radioisotopes, affinity labels (such as biotin, avidin, etc.), enzymatic labels (such as horseradish peroxidase, alkaline phosphatase, etc.) fluorescent labels (such as FITC or rhodamine, etc.), paramagnetic atoms, etc. Procedures for accomplishing such labelling are well-known in the art, for example see Sternberger et al., J. Histochem. Cytochem. 18:315 (1970); Bayer, E. A. et al., Meth. Enzym. 62:308 (1979); Engval, E. et al., Immunol. 109:129 (1972); Goding, J. W. J. Immunol. Meth. 13:215 (1976)).

The labeled antibodies of the present invention can be used for in vitro, in vivo, and in situ assays to identify cells or tissues in which a fragment of the *Staphylococcus aureus* genome is expressed.

The present invention further provides the above-described antibodies immobilized on a solid support. Examples of such solid supports include plastics such as polycarbonate, complex carbohydrates such as agarose and sepharose, acrylic resins and such as polyacrylamide and latex beads. Techniques for coupling antibodies to such solid supports are well known in the art (Weir, D. M. et al., "Handbook of Experimental Immunology" 4th Ed., Blackwell Scientific Publications, Oxford, England, Chapter 10 (1986); Jacoby, W. D. et al., Meth. Enzym. 34 Academic Press, N.Y. (1974)). The immobilized antibodies of the present invention can be used for in vitro, in vivo, and in situ assays as well as for immunoaffinity purification of the proteins of the present invention.

3. Diagnostic Assays and Kits

The present invention further provides methods to identify the expression of one of the ORFs of the present invention, or homolog thereof, in a test sample, using one of the DFs, antigens or antibodies of the present invention.

In detail, such methods comprise incubating a test sample with one or more of the antibodies, or one or more of the DFs, or one or more antigens of the present invention and assaying for binding of the DFs, antigens or antibodies to components within the test sample.

Conditions for incubating a DF, antigen or antibody with a test sample vary. Incubation conditions depend on the format employed in the assay, the detection methods employed, and the type and nature of the DF or antibody used in the assay. One skilled in the art will recognize that any one of the commonly available hybridization, amplification or immunological assay formats can readily be adapted to employ the Dfs, antigens or antibodies of the present invention. Examples of such assays can be found in Chard, T., An Introduction to Radioimmunoassay and Related Techniques, Elsevier Science Publishers, Amsterdam, The Netherlands (1986); Bullock, G. R. et al., Techniques in Immunocytochemistry, Academic Press, Orlando, Fla. Vol. 1 (1982), Vol. 2 (1983), Vol. 3 (1985); Tijssen, P., Practice and Theory of Enzyme Immunoassays: Laboratory Techniques in Biochemistry; PCT publication WO95/32291, and Molecular Biology, Elsevier Science Publishers, Amsterdam, The Netherlands (1985), all of which are hereby incorporated herein by reference.

The test samples of the present invention include cells, protein or membrane extracts of cells, or biological fluids such as sputum, blood, serum, plasma, or urine. The test sample used in the above-described method will vary based on the assay format, nature of the detection method and the tissues, cells or extracts used as the sample to be assayed. Methods for preparing protein extracts or membrane extracts of cells are well known in the art and can be readily be adapted in order to obtain a sample which is compatible with the system utilized.

In another embodiment of the present invention, kits are provided which contain the necessary reagents to carry out the assays of the present invention.

Specifically, the invention provides a compartmentalized kit to receive, in close confinement, one or more containers which comprises:(a) a first container comprising one of the Dfs, antigens or antibodies of the present invention; and (b) one or more other containers comprising one or more of the following:wash reagents, reagents capable of detecting presence of a bound DF, antigen or antibody.

In detail, a compartmentalized kit includes any kit in which reagents are contained in separate containers. Such containers include small glass containers, plastic containers or strips of plastic or paper. Such containers allows one to efficiently transfer reagents from one compartment to another compartment such that the samples and reagents are not cross-contaminated, and the agents or solutions of each container can be added in a quantitative fashion from one compartment to another. Such containers will include a container which will accept the test sample, a container which contains the antibodies used in the assay, containers which contain wash reagents (such as phosphate buffered saline, Tris-buffers, etc.), and containers which contain the reagents used to detect the bound antibody, antigen or DF.

Types of detection reagents include labelled nucleic acid probes, labelled secondary antibodies, or in the alternative, if the primary antibody is labelled, the enzymatic, or antibody binding reagents which are capable of reacting with the labelled antibody. One skilled in the art will readily recognize that the disclosed Dfs, antigens and antibodies of the present invention can be readily incorporated into one of the established kit formats which are well known in the art.

4. Screening Assay for Binding Agents

Using the isolated proteins of the present invention, the present invention further provides methods of obtaining and identifying agents which bind to a protein encoded by one of the ORFs of the present invention or to one of the fragments and the *Staphylococcus aureus* fragment and contigs herein described.

In general, such methods comprise steps of:
(a) contacting an agent with an isolated protein encoded by one of the ORFs of the present invention, or an isolated fragment of the *Staphylococcus aureus* genome; and
(b) determining whether the agent binds to said protein or said fragment.

The agents screened in the above assay can be, but are not limited to, peptides, carbohydrates, vitamin derivatives, or other pharmaceutical agents. The agents can be selected and screened at random or rationally selected or designed using protein modeling techniques.

For random screening, agents such as peptides, carbohydrates, pharmaceutical agents and the like are selected at random and are assayed for their ability to bind to the protein encoded by the ORF of the present invention.

Alternatively, agents may be rationally selected or designed. As used herein, an agent is said to be "rationally selected or designed" when the agent is chosen based on the configuration of the particular protein. For example, one skilled in the art can readily adapt currently available procedures to generate peptides, pharmaceutical agents and the like capable of binding to a specific peptide sequence in order to generate rationally designed antipeptide peptides, for example see Hurby et al., Application of Synthetic Peptides: Antisense Peptides," In Synthetic Peptides, A User's Guide, W. H. Freeman, N.Y. (1992), pp. 289–307, and Kaspczak et al., Biochemistry 28:9230–8 (1989), or pharmaceutical agents, or the like.

In addition to the foregoing, one class of agents of the present invention, as broadly described, can be used to control gene expression through binding to one of the ORFs or EMFs of the present invention. As described above, such agents can be randomly screened or rationally designed/selected. Targeting the ORF or EMF allows a skilled artisan to design sequence specific or element specific agents, modulating the expression of either a single ORF or multiple ORFs which rely on the same EMF for expression control.

One class of DNA binding agents are agents which contain base residues which hybridize or form a triple helix by binding to DNA or RNA. Such agents can be based on the classic phosphodiester, ribonucleic acid backbone, or can be a variety of sulfhydryl or polymeric derivatives which have base attachment capacity.

Agents suitable for use in these methods usually contain 20 to 40 bases and are designed to be complementary to a region of the gene involved in transcription (triple helix—see Lee et al., Nucl. Acids Res. 6:3073 (1979); Cooney et al., Science 241:456 (1988); and Dervan et al., Science 251: 1360 (1991)) or to the mRNA itself (antisense—Okano, J. Neurochem. 56:560 (1991); Oligodeoxynucleotides as Antisense Inhibitors of Gene Expression, CRC Press, Boca Raton, Fla. (1988)). Triple helix- formation optimally results in a shut-off of RNA transcription from DNA, while antisense RNA hybridization blocks translation of an mRNA molecule into polypeptide. Both techniques have been demonstrated to be effective in model systems. Information contained in the sequences of the present invention can be used to design antisense and triple helix-forming oligonucleotides, and other DNA binding agents.

5. Pharmaceutical Compositions and Vaccines

The present invention further provides pharmaceutical agents which can be used to modulate the growth or pathogenicity of *Staphylococcus aureus*, or another related organism, in vivo or in vitro. As used herein, a "pharmaceutical agent" is defined as a composition of matter which can be formulated using known techniques to provide a pharmaceutical compositions. As used herein, the "pharmaceutical agents of the present invention" refers the pharmaceutical agents which are derived from the proteins encoded by the ORFs of the present invention or are agents which are identified using the herein described assays.

As used herein, a pharmaceutical agent is said to "modulate the growth or pathogenicity of *Staphylococcus aureus* or a related organism, in vivo or in vitro," when the agent reduces the rate of growth, rate of division, or viability of the organism in question. The pharmaceutical agents of the present invention can modulate the growth or pathogenicity of an organism in many fashions, although an understanding of the underlying mechanism of action is not needed to practice the use of the pharmaceutical agents of the present invention. Some agents will modulate the growth or pathogenicity by binding to an important protein thus blocking the biological activity of the protein, while other agents may bind to a component of the outer surface of the organism blocking attachment or rendering the organism more prone to act the bodies nature immune system. Alternatively, the agent may comprise a protein encoded by one of the ORFs of the present invention and serve as a vaccine. The development and use of vaccines derived from membrane associated polypeptides are well known in the art. The inventors have identified particularly preferred immunogenic *Staphylococcus aureus* polypeptides for use as vaccines. Such immunogenic polypeptides are described above and summarized below.

As used herein, a "related organism" is a broad term which refers to any organism whose growth or pathogenicity can be modulated by one of the pharmaceutical agents of the present invention. In general, such an organism will contain a homolog of the protein which is the target of the pharmaceutical agent or the protein used as a vaccine. As such, related organisms do not need to be bacterial but may be fungal or viral pathogens.

The pharmaceutical agents and compositions of the present invention may be administered in a convenient manner, such as by the oral, topical, intravenous, intraperitoneal, intramuscular, subcutaneous, intranasal or intradermal routes. The pharmaceutical compositions are administered in an amount which is effective for treating and/or prophylaxis of the specific indication. In general, they are administered in an amount of at least about 1 mg/kg body weight and in most cases they will be administered in an amount not in excess of about 1 g/kg body weight per day. In most cases, the dosage is from about 0.1 mg/kg to about 10 g/kg body weight daily, taking into account the routes of administration, symptoms, etc.

The agents of the present invention can be used in native form or can be modified to form a chemical derivative. As used herein, a molecule is said to be a "chemical derivative" of another molecule when it contains additional chemical moieties not normally a part of the molecule. Such moieties may improve the molecule's solubility, absorption, biological half life, etc. The moieties may alternatively decrease the toxicity of the molecule, eliminate or attenuate any undesirable side effect of the molecule, etc. Moieties capable of mediating such effects are disclosed in, among other sources, REMINGTON'S PHARMACEUTICAL SCIENCES (1980) cited elsewhere herein.

For example, such moieties may change an immunological character of the functional derivative, such as affinity for a given antibody. Such changes in immunomodulation activity are measured by the appropriate assay, such as a competitive type immunoassay. Modifications of such protein properties as redox or thermal stability, biological half-life, hydrophobicity, susceptibility to proteolytic degradation or the tendency to aggregate with carriers or into multimers also may be effected in this way and can be assayed by methods well known to the skilled artisan.

The therapeutic effects of the agents of the present invention may be obtained by providing the agent to a patient by any suitable means (e.g., inhalation, intravenously, intramuscularly, subcutaneously, enterally, or parenterally). It is preferred to administer the agent of the present invention so as to achieve an effective concentration within the blood or tissue in which the growth of the organism is to be controlled. To achieve an effective blood concentration, the preferred method is to administer the agent by injection. The administration may be by continuous infusion, or by single or multiple injections.

In providing a patient with one of the agents of the present invention, the dosage of the administered agent will vary depending upon such factors as the patient's age, weight, height, sex, general medical condition, previous medical history, etc. In general, it is desirable to provide the recipient with a dosage of agent which is in the range of from about 1 pg/kg to 10 mg/kg (body weight of patient), although a lower or higher dosage may be administered. The therapeutically effective dose can be lowered by using combinations of the agents of the present invention or another agent.

As used herein, two or more compounds or agents are said to be administered "in combination" with each other when either (1) the physiological effects of each compound, or (2) the serum concentrations of each compound can be measured at the same time. The composition of the present invention can be administered concurrently with, prior to, or following the administration of the other agent.

The agents of the present invention are intended to be provided to recipient subjects in an amount sufficient to decrease the rate of growth (as defined above) of the target organism.

The administration of the agent(s) of the invention may be for either a "prophylactic" or "therapeutic" purpose. When provided prophylactically, the agent(s) are provided in advance of any symptoms indicative of the organisms growth. The prophylactic administration of the agent(s) serves to prevent, attenuate, or decrease the rate of onset of any subsequent infection. When provided therapeutically, the agent(s) are provided at (or shortly after) the onset of an indication of infection. The therapeutic administration of the compound(s) serves to attenuate the pathological symptoms of the infection and to increase the rate of recovery.

The agents of the present invention are administered to a subject, such as a mammal, or a patient, in a pharmaceutically acceptable form and in a therapeutically effective concentration. A composition is said to be "pharmacologically acceptable" if its administration can be tolerated by a recipient patient. Such an agent is said to be administered in a "therapeutically effective amount" if the amount administered is physiologically significant. An agent is physiologically significant if its presence results in a detectable change in the physiology of a recipient patient.

The agents of the present invention can be formulated according to known methods to prepare pharmaceutically useful compositions, whereby these materials, or their functional derivatives, are combined in admixture with a pharmaceutically acceptable carrier vehicle. Suitable vehicles and their formulation, inclusive of other human proteins, e.g., human serum albumin, are described, for example, in REMINGTON'S PHARMACEUTICAL SCIENCES, 16$^{th}$ Ed., Osol, A., Ed., Mack Publishing, Easton Pa. (1980). In order to form a pharmaceutically acceptable composition suitable for effective administration, such compositions will contain an effective amount of one or more of the agents of the present invention, together with a suitable amount of carrier vehicle.

Additional pharmaceutical methods may be employed to control the duration of action. Control release preparations may be achieved through the use of polymers to complex or absorb one or more of the agents of the present invention. The controlled delivery may be effectuated by a variety of well known techniques, including formulation with macromolecules such as, for example, polyesters, polyamino acids, polyvinyl, pyrrolidone, ethylenevinylacetate, methylcellulose, carboxymethylcellulose, or protamine, sulfate, adjusting the concentration of the macromolecules and the agent in the formulation, and by appropriate use of methods of incorporation, which can be manipulated to effectuate a desired time course of release. Another possible method to control the duration of action by controlled release preparations is to incorporate agents of the present invention into particles of a polymeric material such as polyesters, polyamino acids, hydrogels, poly(lactic acid) or ethylene vinylacetate copolymers. Alternatively, instead of incorporating these agents into polymeric particles, it is possible to entrap these materials in microcapsules prepared, for example, by coacervation techniques or by interfacial polymerization with, for example, hydroxymethylcellulose or gelatine-microcapsules and poly(methylmethacylate) microcapsules, respectively, or in colloidal drug delivery systems, for example, liposomes, albumin microspheres, microemulsions, nanoparticles, and nanocapsules or in macroemulsions. Such techniques are disclosed in REMINGTON'S PHARMACEUTICAL SCIENCES (1980).

The invention further provides a pharmaceutical pack or kit comprising one or more containers filled with one or more of the ingredients of the pharmaceutical compositions of the invention. Associated with such container(s) can be a notice in the form prescribed by a governmental agency regulating the manufacture, use or sale of pharmaceuticals or biological products, which notice reflects approval by the agency of manufacture, use or sale for human administration.

In addition, the agents of the present invention may be employed in conjunction with other therapeutic compounds.

6. Shot-Gun Approach to Megabase DNA Sequencing

The present invention further demonstrates that a large sequence can be sequenced using a random shotgun approach. This procedure, described in detail in the examples that follow, has eliminated the up front cost of isolating and ordering overlapping or contiguous subclones prior to the start of the sequencing protocols.

Certain aspects of the present invention are described in greater detail in the examples that follow. The examples are provided by way of illustration. Other aspects and embodiments of the present invention are contemplated by the inventors, as will be clear to those of skill in the art from reading the present disclosure.

ILLUSTRATIVE EXAMPLES
LIBRARIES AND SEQUENCING

1. Shotgun Sequencing Probability Analysis

The overall strategy for a shotgun approach to whole genome sequencing follows from the Lander and Waterman (Landerman and Waterman, Genomics 2: 231 (1988)) application of the equation for the Poisson distribution. According to this treatment, the probability, $P_0$, that any given base in a sequence of size L, in nucleotides, is not sequenced after a certain amount, n, in nucleotides, of random sequence has been determined can be calculated by the equation $P_0 = e^{-m}$, where m is L/n, the fold coverage." For instance, for a genome of 2.8 Mb, m=1 when 2.8 Mb of sequence has been randomly generated (1X coverage). At that point, $P_0=e^{-1}=0.37$. The probability that any given base has not been sequenced is the same as the probability that any region of the whole sequence L has not been determined and, therefore, is equivilent to the fraction of the whole sequence that has yet to be determined. Thus, at one-fold coverage, approximately 37% of a polynucleotide of size L, in nucleotides has not been sequenced. When 14 Mb of sequence has been generated, coverage is 5X for a 0.2.8 Mb and the unsequenced fraction drops to 0.0067 or 0.67%. 5X coverage of a 2.8 Mb sequence can be attained by sequencing approximately 17,000 random clones from both insert ends with an average sequence read length of 410 bp.

Similarly, the total gap length, G, is determined by the equation $G=Le^{-m}$, and the average gap size, g, follows the equation, $g=L/n$. Thus, 5X coverage leaves about 240 gaps averaging about 82 bp in size in a sequence of a. polynucleotide 2.8 Mb long.

The treatment above is essentially that of Lander and Waterman, Genomics 2: 231 (1988).

2. Random Library Construction

In order to approximate the random model described above during actual sequencing, a nearly ideal library of cloned genomic fragments is required. The following library construction procedure was developed to achieve this end.

*Staphylococcus aureus* DNA was prepared by phenol extraction. A mixture containing 600 ug DNA in 3.3 ml of 300 mM sodium acetate, 10 mM Tris-HCl, 1 mM Na-EDTA, 30% glycerol was sonicated for 1 min. at 0° C. in a Branson Model 450 Sonicator at the lowest energy setting using a 3 mm probe. The sonicated DNA was ethanol precipitated and redissolved in 500 ul TE buffer.

To create blunt-ends, a 100 ul aliquot of the resuspended DNA was digested with 5 units of BAL31 nuclease (New England BioLabs) for 10 min at 30° C. in 200 ul BAL3 1 buffer. The digested DNA was phenol-extracted, ethanol-precipitated, redissolved in 100 ul TE buffer, and then size-fractionated by electrophoresis through a 1.0% low melting temperature agarose gel. The section containing DNA fragments 1.6–2.0 kb in size was excised from the gel, and the LGT agarose was melted and the resulting solution was extracted with phenol to separate the agarose from the DNA. DNA was ethanol precipitated and redissolved in 20 ul of TE buffer for ligation to vector.

A two-step ligation procedure was used to produce a plasmid library with 97% inserts, of which >99% were single inserts. The first ligation mixture (50 ul) contained 2 ug of DNA fragments, 2 ug pUC 18 DNA (Pharmacia) cut with SmaI and dephosphorylated with bacterial alkaline phosphatase, and 10 units of T4 ligase (GIBCO/BRL) and was incubated at 14° C. for 4 hr. The ligation mixture then was phenol extracted and ethanol precipitated, and the precipitated DNA was dissolved in 20 ul TE buffer and electrophoresed on a 1.0% low melting agarose gel. Discrete bands in a ladder were visualized by ethidium bromide-staining and UV illumination and identified by size as insert (i), vector (v), v+i, v+2i, v+3i, etc. The portion of the gel containing v+i DNA was excised and the v+i DNA was recovered and resuspended into 20 ul TE. The v+i DNA then was blunt-ended by T4 polymerase treatment for 5 min. at 37° C. in a reaction mixture (50 ul) containing the v+i linears, 500 uM each of the 4 dNTPs, and 9 units of T4 polymerase (New England BioLabs), under recommended buffer conditions. After phenol extraction and ethanol precipitation the repaired v+i linears were dissolved in 20 ul TE.

The final ligation to produce circles was carried out in a 50 ul reaction containing 5 ul of v+i linears and 5 units of T4 ligase at 14° C. overnight. After 10 min. at 70° C. the following day, the reaction mixture was stored at −20° C.

This two-stage procedure resulted in a molecularly random collection of single-insert plasmid recombinants with minimal contamination from double-insert chimeras (<1%) or free vector (<3%).

Since deviation from randomness can arise from propagation the DNA in the host, *E.coli* host cells deficient in all recombination and restriction functions (A. Greener, Strategies 3 (1):5 (1990)) were used to prevent rearrangements, deletions, and loss of clones by restriction. Furthermore, transformed cells were plated directly on antibiotic diffusion plates to avoid the usual broth recovery phase which allows multiplication and selection of the most rapidly growing cells.

Plating was carried out as follows. A 100 ul aliquot of Epicurian Coli SURE II Supercompetent Cells (Stratagene 200152) was thawed on ice and transferred to a chilled Falcon 2059 tube on ice. A 1.7 ul aliquot of 1.42M beta-mercaptoethanol was added to the aliquot of cells to a final concentration of 25 mM. Cells were incubated on ice for 10 min. A 1 ul aliquot of the final ligation was added to the cells and incubated on ice for 30 min. The cells were heat pulsed for 30 sec. at 42° C. and placed back on ice for 2 min. The outgrowth period in liquid culture was eliminated from this protocol in order to minimize the preferential growth of any given transformed cell. Instead the transformation mixture was plated directly on a nutrient rich SOB plate containing a 5 ml bottom layer of SOB agar (5% SOB agar: 20 g tryptone, 5 g yeast extract, 0.5 g NaCl, 1.5% Difco Agar per liter of media). The 5 ml bottom layer is supplemented with 0.4 ml of 50 mg/ml ampicillin per 100 ml SOB agar. The 15 ml top layer of SOB agar is supplemented with 1 ml X-Gal (2%), 1 ml $MgCl_2$ (1M), and 1 ml $MgSO_4$/100 ml SOB agar. The 15 ml top layer was poured just prior to plating. Our titer was approximately 100 colonies/10 ul aliquot of transformation.

All colonies were picked for template preparation regardless of size. Thus, only clones lost due to "poison" DNA or deleterious gene products would be deleted from the library, resulting in a slight increase in gap number over that expected.

3. Random DNA Sequencing

High quality double stranded DNA plasmid templates were prepared using an alkaline lysis method developed in collaboration with 5Prime→3Prime Inc. (Boulder, Colo.). Plasmid preparation was performed in a 96-well format for all stages of DNA preparation from bacterial growth through final DNA purification. Average template concentration was determined by running 25% of the samples on an agarose gel. DNA concentrations were not adjusted.

Templates were also prepared from a *Staphylococcus aureus* lambda genomic library. An unamplified library was constructed in Lambda DASH II vector (Stratagene). *Staphylococcus aureus* DNA (>100 kb) was partially digested in a reaction mixture (200 ul) containing 50 ug DNA, 1X Sau3AI buffer, 20 units Sau3AI for 6 min. at 23 C. The digested DNA was phenol-extracted and centrifuges over a 10–40% sucrose gradient. Fractions containing genomic DNA of 15–25 kb were recovered by precipitation . One ul of fragments was used with 1 ul of DASHII vector (Stratagene) in the recommended ligation reaction. One ul of the ligation mixture was used per packaging reaction following the recommended protocol with the Gigapack II XL Packaging Extract Phage were plated directly without amplification from the packaging mixture (after dilution with 500 ul of recommended SM buffer and chloroform treatment). Yield was about $2.5 \times 10^9$ pfu/ul.

An amplified library was prepared from the primary packaging mixture according to the manufactureer's protocol. The amplified library is stored frozen in 7% dimethylsulfoxide. The phage titer is approximately $1 \times 10^9$ pfu/ml.

Mini-liquid lysates (0.1 ul) are prepared from randomly selected plaques and template is prepared by long range PCR. Samples are PCR amplified using modified T3 and T7primers, and Elongase Supermix (LTI).

Sequencing reactions are carried out on plasmid templates using a combination of two workstations (BIOMEK 1000 and Hamilton Microlab 2200) and the Perkin-Elmer 9600 thermocycler with Applied Biosystems PRISM Ready Reaction Dye Primer Cycle Sequencing Kits for the M1 3 forward (M13-21) and the M13 reverse (M13RP1) primers. Dye terminator sequencing reactions are carried out on the lambda templates on a Perkin-Elmer 9600 Thermocycler using the Applied Biosystems Ready Reaction Dye Terminator Cycle Sequencing kits. Modified T7 and T3 primers are used to sequence the ends of the inserts from the Lambda DASH II library. Sequencing reactions are on a combination of AB 373 DNA Sequencers and ABI 377 DNA sequencers. All of the dye terminator sequencing reactions are analyzed using the 2X 9 hour module on the AB 377. Dye primer reactions are analyzed on a combination of ABI 373 and ABI 377 DNA sequencers. The overall sequencing success rate very approximately is about 85% for M13-21 and M13RP1 sequences and 65% for dye-terminator reactions. The average usable read length is 485 bp for M13-21 sequences, 445bp for M13RP1 sequences, and 375 bp for dye-terminator reactions.

4. Protocol for Automated Cycle Sequencing

The sequencing was carried out using Hamilton Microstation 2200, Perkin Elmer 9600 thermocyclers, ABI 373 and ABI 377 Automated DNA Sequencers. The Hamilton combines pre-aliquoted templates and reaction mixes consisting of deoxy- and dideoxynucleotides, the thermostable Taq DNA polymerase, fluorescently-labelled sequencing primers, and reaction buffer. Reaction mixes and templates were combined in the wells of a 96-well thermocycling plate and transferred to the Perkin Elmer 9600 thermocycler. Thirty consecutive cycles of linear amplification (i.e.., one primer synthesis) steps were performed including denaturation, annealing of primer and template, and extension; i.e., DNA synthesis. A heated lid with rubber gaskets on the thermocycling plate prevents evaporation without the need for an oil overlay.

Two sequencing protocols were used: one for dye-labelled primers and a second for dye-labelled dideoxy chain terminators. The shotgun sequencing involves use of four dye-labelled sequencing primers, one for each of the four terminator nucleotide. Each dye-primer was labelled with a different fluorescent dye, permitting the four individual reactions to be combined into one lane of the 373 or 377 DNA Sequencer for electrophoresis, detection, and base-calling. ABI currently supplies pre-mixed reaction mixes in bulk packages containing all the necessary non-template reagents for sequencing. Sequencing can be done with both plasmid and PCR- generated templates with both dye-primers and dye-terminators with approximately equal fidelity, although plasmid templates generally give longer usable sequences.

Thirty-two reactions were loaded per ABI 373 Sequencer each day and 96 samples can be loaded on an ABI 377 per day. Electrophoresis was run overnight (ABI 373) or for 2½ hours (ABI 377) following the manufacturer's protocols. Following electrophoresis and fluorescence detection, the ABI 373 or ABI 377 performs automatic lane tracking and base-calling. The lane-tracking was confirmed visually. Each sequence electropherogram (or fluorescence lane trace) was inspected visually and assessed for quality. Trailing sequences of low quality were removed and the sequence itself was loaded via software to a Sybase database (archived daily to 8mm tape). Leading vector polylinker sequence was removed automatically by a software program. Average edited lengths of sequences from the standard ABI 373 or ABI 377 were around 400 bp and depend mostly on the quality of the template used for the sequencing reaction.

INFORMATICS

1. Data Management

A number of information management systems for a large-scale sequencing lab have been developed. (For review see, for instance, Kerlavage et al., *Proceedings of the Twenty-Sixth Annual Hawaii International Conference on System Sciences,* IEEE Computer Society Press, Washington D. C., 585 (1993)) The system used to collect and assemble the sequence data was developed using the Sybase relational database management system and was designed to automate data flow whereever possible and to reduce user error. The database stores and correlates all information collected during the entire operation from template preparation to final analysis of the genome. Because the raw output of the ABI 373 Sequencers was based on a Macintosh platform and the data management system chosen was based on a Unix platform, it was necessary to design and implement a variety of multi- user, client-server applications which allow the raw data as well as analysis results to flow seamlessly into the database with a minimum of user effort.

2. Assembly

An assembly engine (TIGR Assembler) developed for the rapid and accurate assembly of thousands of sequence fragments was enployed to generate contigs. The TIGR assembler simultaneously clusters and assembles fragments of the genome. In order to obtain the speed necessary to assemble more than $10^4$ fragments, the algorithm builds a hash table of 12 bp oligonucleotide subsequences to generate a list of potential sequence fragment overlaps. The number of potential overlaps for each fragment determines which fragments are likely to fall into repetitive elements. Beginning with a single seed sequence fragment, TIGR Assembler extends the current contig by attempting to add the best matching fragment based on oligonucleotide content. The contig and candidate fragment are aligned using a modified version of the Smith-Waterman algorithm which provides for optimal gapped alignments (Waterman, M. S., *Methods in Enzymology* 164: 765 (1988)). The contig is extended by the fragment only if strict criteria for the quality of the match are met. The match criteria include the minimum length of overlap, the maximum length of an unmatched end, and the minimum percentage match. These criteria are automatically lowered by the algorithm in regions of minimal coverage and raised in regions with a possible repetitive element. The number of potential overlaps for each fragment determines which fragments are likely to fall into repetitive elements. Fragments representing the boundaries of repetitive elements and potentially chimeric fragments are often rejected based on partial mismatches at the ends of alignments and excluded from the current contig. TIGR Assembler is designed to take advantage of clone size information coupled with sequencing from both ends of each template. It enforces the constraint that sequence fragments from two ends of the same template point toward one another in the contig and are located within a certain ranged of base pairs (definable for each clone based on the known clone size range for a given library).

3. Identifying Genes

Tables 1, 2, and 3 list ORFs in the *Staphylococcus aureus* genomic contigs of the present invention that were identified as putative coding regions by the. GeneMark software using organism-specific second-order Markov probability transition matrices. It will be appreciated that other criteria can be used, in accordance with well known analytical methods, such as those discussed herein, to generate more inclusive, more restrictive, or more selective lists.

Table 1 sets out ORFs in the *Staphylococcus aureus* contigs of the present invention that over a continuous region of at least 50 bases are 95% or more identical (by BLASTN analysis) to a nucleotide sequence available through Genbank in November 1996.

Table 2 sets out ORFs in the *Staphylococcus aureus* contigs of the present invention that are not in Table I and match, with a BLASTP probability score of 0.01 or less, a polypeptide sequence available through a non-redundant database of known proteins generated by combining the Swiss-Prot, PIR, and GenPept databases.

Table 3 sets out the remaining ORFs in the *Staphylococcus aureus* contigs of the present invention, which did not have significant matches to the public databases by the criteria described above.

ILLUSTRATIVE APPLICATIONS

1. Production of an Antibody to a *Staphylococcus aureus* Protein

Substantially pure protein or polypeptide is isolated from the transfected or transformed cells using any one of the methods known in the art. The protein can also be produced in a recombinant prokaryotic expression system, such as *E. coli,* or can by chemically synthesized. Concentration of protein in the final preparation is adjusted, for example, by concentration on an Amicon filter device, to the level of a few micrograms/ml. Monoclonal or polyclonal antibody to the protein can then be prepared as follows.

2. Monoclonal Antibody Production by Hybridoma Fusion

Monoclonal antibody to epitopes of any of the peptides identified and isolated as described can be prepared from murine hybridomas according to the classical method of Kohler, G. and Milstein, C., Nature 256:495 (1975) or modifications of the methods thereof. Briefly, a mouse is repetitively inoculated with a few micrograms of the selected protein over a period of a few weeks. The mouse is then sacrificed, and the antibody producing cells of the spleen isolated. The spleen cells are fused by means of polyethylene glycol with mouse myeloma cells, and the excess unfused cells destroyed by growth of the system on selective media comprising aminopterin (HAT media). The successfully fused cells are diluted and aliquots of the dilution placed in wells of a microtiter plate where growth of the culture is continued. Antibody-producing clones are identified by detection of antibody in the supernatant fluid of the wells by immunoassay procedures, such as ELISA, as originally described by Engvall, E., Meth. Enzymol. 70:419 (1980), and modified methods thereof. Selected positive clones can be expanded and their monoclonal antibody product harvested for use. Detailed procedures for monoclonal antibody production are described in Davis, L. et al. Basic Methods in Molecular Biology Elsevier, New York. Section 21-2 (1989).

3. Polyclonal Antibody Production by Immunization

Polyclonal antiserum containing antibodies to heterogenous epitopes of a single protein can be prepared by immunizing suitable animals with the expressed protein described above, which can be unmodified or modified to enhance immunogenicity. Effective polyclonal antibody production is affected by many factors related both to the antigen and the host species. For example, small molecules tend to be less immunogenic than other and may require the use of carriers and adjuvant. Also, host animals vary in response to site of inoculations and dose, with both inadequate or excessive doses of antigen resulting in low titer antisera. Small doses (ng level) of antigenadministered at multiple intradermal sites appears to be most reliable. An effective immunization protocol for rabbits can be found in Vaitukaitis, J. et al., J. Clin. Endocrinol. Metab. 33:988–991 (1971).

Booster injections can be given at regular intervals, and antiserum harvested when antibody titer thereof, as determined semi-quantitatively, for example, by double immunodiffusion in agar against known concentrations of the antigen, begins to fall. See, for example, Ouchterlony, O. et al., Chap. 19 in:Handbook of Experimental Immunology, Wier, D., ed, Blackwell (1973). Plateau concentration of antibody is usually in the range of 0.1 to 0.2 mg/ml of serum (about 12M). Affinity of the antisera for the antigen is determined by preparing competitive binding curves, as described, for example, by Fisher, D., Chap. 42 in:Manual of Clinical Immunology, second edition, Rose and Friedman, eds., Amer. Soc. For Microbiology, Washington, D. C. (1980)

Antibody preparations prepared according to either protocol are useful in quantitative immunoassays which determine concentrations of antigen-bearing substances in biological samples; they are also used semi- quantitatively or qualitatively to identify the presence of antigen in a biological sample. In addition, they are useful in various animal models of Staphylococcal disease known to those of skill in the art as a means of evaluating the protein used to make the antibody as a potential vaccine target or as a means of evaluating the antibody as a potential immunothereapeutic reagent.

3. Preparation of PCR Primers and Amplification of DNA

Various fragments of the *Staphylococcus aureus* genome, such as those of Tables 1–3 and SEQ ID NOS: 1–5,191 can be used, in accordance with the present invention, to prepare PCR primers for a variety of uses. The PCR primers are preferably at least 15 bases, and more preferably at least 18 bases in length. When selecting a primer sequence, it is preferred that the primer pairs have approximately the same G/C ratio, so that melting temperatures are approximately the same. The PCR primers and amplified DNA of this Example find use in the Examples that follow.

4. Gene expression from DNA Sequences Corresponding to ORFs

A fragment of the *Staphylococcus aureus* genome provided in Tables 1–3 is introduced into an expression vector using conventional technology. Techniques to transfer cloned sequences into expression vectors that direct protein translation in mammalian, yeast, insect or bacterial expression systems are well known in the art. Commercially available vectors and expression systems are available from a variety of suppliers including Stratagene (La Jolla, Calif.), Promega (Madison, Wis.), and Invitrogen (San Diego, Calif.). If desired, to enhance expression and facilitate proper protein folding, the codon context and codon pairing of the sequence may be optimized for the particular expression organism, as explained by Hatfield et al.; U.S. Pat. No. 5,082,767, incorporated herein by this reference.

The following is provided as one exemplary method to generate polypeptide(s) from cloned ORFs of the *Staphylococcus aureus* genome fragment. Bacterial ORFs generally lack a poly A addition signal. The addition signal sequence can be added to the construct by, for example, splicing out the poly A addition sequence from pSG5 (Stratagene) using BglI and SalI restriction endonuclease enzymes and incorporating it into the mammalian expression vector pXT1 (Stratagene) for use in eukaryotic expression systems. pXT1 contains the LTRs and a portion of the gag gene of Moloney Murine Leukemia Virus. The positions of the LTRs in the construct allow efficient stable transfected. The vector includes the Herpes Simplex thymidine kinase promoter and the selectable neomycin gene. The *Staphylococcus aureus* DNA is obtained by PCR from the bacterial vector using oligonucleotide primers complementary to the *Staphylococcus aureus* DNA and containing restriction endonuclease sequences for PstI incorporated into the 5' primer and BglII at the 5' end of the corresponding *Staphylococcus aureus* DNA 3' primer, taking care to ensure that the *Staphylococcus aureus* DNA is positioned such that its followed with the poly A addition sequence. The purified fragment obtained from the resulting PCR reaction is digested with PstI, blunt ended with an exonuclease, digested with BglII, purified and ligated to pXT1, now containing a poly A addition sequence and digested BglII.

The ligated product is transfected into mouse NIH 3T3 cells using Lipofectin (Life Technologies, Inc., Grand Island, N.Y.) under conditions outlined in the product specification. Positive transfectants are selected after growing the transfected cells in 600 ug/ml G418 (Sigma, St. Louis, Mo.). The protein is preferably released into the supernatant. However if the protein has membrane binding domains, the protein may additionally be retained within the cell or expression may be restricted to the cell surface. Since it may be necessary to purify and locate the transfected product, synthetic 15-mer peptides synthesized from the predicted *Staphylococcus aureus* DNA sequence are injected into mice to generate antibody to the polypeptide encoded by the *Staphylococcus aureus* DNA.

Alternativly and if antibody production is not possible, the *Staphylococcus aureus* DNA sequence is additionally incorporated into eukaryotic expression vectors and expressed as, for example, a globin fusion. Antibody to the globin moiety then is used to purify the chimeric protein. Corresponding protease cleavage sites are engineered between the globin moiety and the polypeptide encoded by the *Staphylococcus aureus* DNA so that the latter may be freed from the formed by simple protease digestion. One useful expression vector for generating globin chimerics is pSG5 (Stratagene). This vector encodes a rabbit globin. Intron II of the rabbit globin gene facilitates splicing of the expressed transcript, and the polyadenylation signal incorporated into the construct increases the level of expression. These techniques are well known to those skilled in the art of molecular biology. Standard methods are published in methods texts such as Davis et al., cited elsewhere herein, and many of the methods are available from the technical assistance representatives from Stratagene, Life Technologies, Inc., or Promega. Polypeptides of the invention also may be produced using in vitro translation systems such as in vitro ExpressTM Translation Kit (Stratagene).

While the present invention has been described in some detail for purposes of clarity and understanding, one skilled in the art will appreciate that various changes in form and detail can be made without departing from the true scope of the invention.

All patents, patent applications and publications referred to above are hereby incorporated by reference.

TABLE 1

S. aureus Coding regions containing known sequences

| Contig ID | ORF ID | Start (nt) | Stop (nt) | match accession | match gene name | percent ident | HSP nt length | ORF nt length |
|---|---|---|---|---|---|---|---|---|
| 1 | 1 | 757 | 95 | emb\|X17301\|SAHD | S. aureus DNA for hld gene and for part of agr gene | 100 | 663 | 663 |
| 1 | 2 | 2452 | 1631 | emb\|X52543\|SAAG | S. aureus agrA, agrB and hld genes | 99 | 809 | 822 |
| 5 | 5 | 5651 | 4884 | dbj\|D14711\|STAH | Staphylococcus aureus HSP10 and HSP60 genes | 98 | 223 | 768 |
| 5 | 4 | 439 | 71 | emb\|X72700\|SAPV | S. aureus genes for S and F components of Panton-Valentine leucocidins | 81 | 2Y6 | 369 |
| 5 | 1 | 3571 | 2111 | emb\|X72700\|SAPV | S. aureus genes for S and F components of Panton-Valentine leucocidins | 95 | 424 | 1461 |
| 10 | 4 | 86 | 904 | gb\|L25288\| | Staphylococcus aureus gyrase-like protein alpha and beta subunit (gr1A and complete cds | 98 | 715 | 819 |
| 16 | 5 | 5302 | 6246 | gb\|U35773\| | Staphylolococcus aureus prolipoprotein diacylglyceryl transferase (lgt) gene, complete cds | 94 | 251 | 945 |
| 16 | 6 | 6249 | 7091 | gb\|U35773\| | Staphylococcus aureus prolipoprotein diacylglyceryl transferase (lgt) gene, complete cds | 99 | 843 | 843 |
| 16 | 7 | 7084 | 7584 | gb\|U35773\| | Staphylococcus aureus prolipoprotein diacylglyceryl transferase (lgt) gene, complete cds | 99 | 342 | 501 |
| 20 | 1 | 549 | 103 | gb\|L19300\| | Staphylococcus aureus DNA sequence encoding three ORFs, complete cds; prophage phi-11 sequence homology, 5' flank | 100 | 443 | 447 |
| 20 | 2 | 841 | 671 | gb\|L19300\| | Staphylococcus aureus DNA seguence encoding three ORFs, complete cds; prophage phi-11 sequence homology, 5' flank | 91 | 137 | 171 |
| 20 | 3 | 1798 | 1586 | gb\|L19300\| | Staphylococcus aureus DNA sequence encoding three ORFs, complete cds; prophage phi-11 sequence homology, 5' flank | 100 | 110 | 213 |
| 20 | 4 | 3825 | 2350 | gb\|M76714\| | Staphylococcus aureus peptidoglycan hydrolase gene, complete cds | 100 | 948 | 1476 |
| 20 | 5 | 4282 | 3776 | gb\|M76714\| | Staphylococcus aureus peptidoglycan hydrolase gene, complete cds | 100 | 309 | 507 |
| 26 | 1 | 2 | 145 | gb\|U41072\| | Staphylococcus aureus isoleucyl-tRNA synthetase (ileS) gene, partial cds | 100 | 126 | 144 |
| 26 | 2 | 84 | 557 | gb\|U41072\| | Staphylococcus aureus isoleucyl-tRNA synthetase (ileS) gene, partial cds | 99 | 430 | 474 |
| 26 | 3 | 763 | 3531 | emb\|X74219\|SAIL | S. aureus gene for isoleucyl-tRNA synthetase | 99 | 2769 | 2769 |
| 29 | 3 | 1261 | 4392 | gb\|U66665\| | Staphylococcus aureus DNA fragment with class II promoter activity | 100 | 117 | 3132 |
| 31 | 14 | 13463 | 11949 | gb\|X73889\|SAP1 | S. aureus genes P1 and P2 | 99 | 1351 | 1515 |
| 31 | 15 | 13855 | 13469 | gb\|X73889\|SAP1 | S. aureus genes P1 and P2 | 98 | 258 | 387 |
| 38 | 17 | 13112 | 11940 | gb\|M12715\| | S. aureus geh gene encoding lipase (glycerol ester hydrolase) | 100 | 372 | 1173 |
| 38 | 19 | 13434 | 15518 | gb\|M12715\| | S. aureus geh gene encoding lipase (glycerol ester hydrolase) | 100 | 2085 | 2085 |
| 46 | 2 | 519 | 1727 | gb\|U73374\| | Staphylococcus aureus type 8 capsule genes, cap8A, cap8B, cap8C, cap8D, cap8E, cap8F, cap8G, cap8H, cap8I, cap8J, cap8K, cap8L, cap8M, cap8N. cap8O, cap8P, complete cds | 98 | 1209 | 1209 |
| 46 | 3 | 1720 | 2295 | gb\|U73374\| | Staphylococcus aureus type 8 capsule genes, cap8A, cap8B, cap8C, cap8D, cap8E, cap8F, cap8G, cap8H, cap8I, cap8J, cap8K, cap8L, cap8M, cap8N. cap8O, cap8P, complete cds | 98 | 576 | 576 |
| 46 | 4 | 2259 | 3182 | gb\|U73374\| | Staphylococcus aureus type 8 capsule genes, cap8A, cap8B, cap8C, cap8D, cap8E, cap8F, cap8G, cap8H, cap8I, cap8J, cap8K, cap8L, cap8M, cap8N. cap8O, cap8P, complete cds | 97 | 924 | 924 |
| 46 | 5 | 3173 | 4498 | gb\|U73374\| | Staphylococcus aureus type 8 capsule genes, cap8A, cap8B, cap8C, cap8D, cap8E, cap8F, cap8G, cap8H, cap8I, cap8J, cap8K, cap8L, cap8M, cap8N. cap8O, cap8P, complete cds | 98 | 1283 | 1326 |
| 46 | 6 | 4536 | 5720 | gb\|U73374\| | Staphylococcus aureus type 8 capsule genes, cap8A, cap8B, cap8C, cap8D, cap8E, cap8F, cap8G, cap8H, cap8I, cap8J, cap8K, cap8L, cap8M, cap8N. cap8O, cap8P, complete cds | 98 | 1185 | 1185 |
| 46 | 7 | 6120 | 5785 | gb\|U73374\| | Staphylococcus aureus type 8 capsule genes, cap8A, cap8B, cap8C, cap8D, cap8E, cap8F, cap8G, cap8H, cap8I, cap8J, cap8K, cap8L, cap8M, cap8N. cap8O, cap8P, complete cds | 99 | 278 | 336 |

TABLE 1-continued

S. aureus Coding regions containing known sequences

| Contig ID | ORF ID | Start (nt) | Stop (nt) | match accession | match gene name | percent ident | HSP nt length | ORF nt length |
|---|---|---|---|---|---|---|---|---|
| 48 | 1 | 2 | 955 | gb\|L25893\| | *Staphylococcus aureus* recA gene, complete cds | 99 | 954 | 954 |
| 50 | 3 | 2924 | 1383 | emb\|X85029\|SAAH | *S. aureus* AhpC gene | 100 | 88 | 1542 |
| 50 | 4 | 3515 | 2922 | emb\|X85029\|SAAH | *S. aureus* AhpC gene | 98 | 540 | 594 |
| 54 | 3 | 3392 | 1710 | emb\|X62992\|SAFN | *S. aureus* fnbB gene for fibronectin binding protein B | 100 | 1668 | 1683 |
| 54 | 4 | 4122 | 3379 | emb\|X62992\|SAFN | *S. aureus* fnbB gene for fibronectin binding protein B | 99 | 720 | 744 |
| 54 | 5 | 4562 | 4068 | emb\|X82992\|SAFN | *S. aureus* fnbB gene for fibronectin binding protein B | 100 | 463 | 495 |
| 54 | 6 | 8300 | 5214 | gb\|U04151\| | *S. aureus* fibronectin-binding protein (fnbA) mRNA, complete cds | 100 | 3087 | 3087 |
| 58 | 3 | 1743 | 2819 | emb\|X87104\|SADN | *S. aureus* mdr, pbp4 and tagD genes (SG51-55 isolate) | 89 | 68 | 1077 |
| 58 | 4 | 2858 | 3280 | emb\|X91786\|SAPB | *S. aureus* abcA, pbp4, and tagD genes | 99 | 423 | 423 |
| 58 | 5 | 4701 | 3397 | emb\|X91786\|SAPB | *S. aureus* abcA, pbp4, and tagD genes | 99 | 1305 | 1305 |
| 58 | 6 | 5378 | 5079 | gb\|U29478\| | *Staphylococcum aureus* ABC transporter-like protein AbcA (abcA) gene, 100 | 300 | 300 | |
| 58 | 7 | 5086 | 6840 | emb\|X91786\|SAPB | *S. aureus* abcA, pbp4, and tagD genes | 99 | 1755 | 1755 |
| 72 | 1 | 445 | 2 | gb\|M21854\| | *S. aureus* agr gene encoding an accessory gene regulator protein, complete | 100 | 444 | 444 |
| 72 | 2 | 1453 | 449 | emb\|X52543\|SAAG | *S. aureus* agrA, agrB and hld genes | 99 | 673 | 1005 |
| 82 | 1 | 357 | 3917 | emb\|X64172\|SARP | *S. aureus* rpl1L, orf202, rpoB(rif) and rpoC genes for ribosomal protein L7/L12, hypothetical protein ORF202. DNA-directed RNA polymerase beta & beta' chains | 99 | 2396 | 3561 |
| 82 | 2 | 4027 | 7677 | emb\|X89233S\|ARP | *S. aureus* DNA for rpoC | 99 | 3171 | 3651 |
| 82 | 3 | 7745 | 8068 | gb\|U20869\| | *Staphylococcus aureus* ribosomal protein S7 (rpsG) and ORF 1 genes, partial cds ribosomal protein S12 (rpsL) gene, complete cds. | 100 | 320 | 324 |
| 82 | 4 | 8103 | 8579 | gb\|U20869\| | *Staphylococcus aureus* ribosomal protein S7 (rpsG) and ORF 1 genes, partial cds ribosomal protein S12 (rpsL) gene, complete cds, | 100 | 477 | 477 |
| 82 | 5 | 8618 | 8821 | gb\|U20869\| | *Staphylococcus aureus* ribosomal protein S7 (rpsG) and ORF 1 genes, partial cds ribosomal protein S12 (rpsL) gene, complete cds | 100 | 154 | 204 |
| 84 | 1 | 18 | 191 | gb\|73374\| | *Staphylococcus aureus* type 8 capsule genes, cap8A, cap8B, cap8C, cap8D, cap8E, cap8F, cap8G, cap8H, cap8I, cap8J, cap8K, cap8L, cap8M, cap8N, cap8O, cap8P, complete cds | 98 | 164 | 174 |
| 84 | 2 | 189 | 893 | gb\|73374\| | *Staphylococcus aureus* type 8 capsule genes, cap8A, cap8B, cap8C, cap8D, cap8E, cap8F, cap8G, cap8H, cap8I, cap8J, cap8K, cap8L, cap8M, cap8N, cap8O, cap8P, complete cds | 94 | 705 | 705 |
| 84 | 3 | 887 | 3660 | gb\|U73374\| | *Staphylococcus aureus* type 8 capsule genes, cap8A, cap8B, cap8C, cap8D, cap8E, cap8F, cap8G, cap8H, cap8I, cap8J, cap8K, cap8L, cap8M, cap8N, cap8O, cap8P, complete cds | 99 | 774 | 774 |
| 84 | 4 | 1584 | 3503 | gb\|U73374\| | *Staphylococcus aureus* type 8 capsule genes, cap8A, cap8B, cap8C, cap8D, cap8E, cap8F, cap8G, cap8H, cap8I, cap8J, cap8K, cap8L, cap8M, cap8N, cap8O, cap8P, complete cds | 98 | 1920 | 1920 |
| 84 | 5 | 3394 | 4521 | gb\|U73374\| | *Staphylococcus aureus* type 8 capsule genes, cap8A, cap8B, cap8C, cap8D, cap8E, cap8F, cap8G, cap8H, cap8I, cap8J, cap8K, cap8L, cap8M, cap8N, cap8O, cap8P, complete cds | 597 | 1128 | 1128 |
| 84 | 6 | 4519 | 5643 | gb\|U73374\| | *Staphylococcus aureus* type 8 capsule genes, cap8A, cap8B, cap8C, cap8D, cap8E, cap8F, cap8G, cap8H, cap8I, cap8J, cap8K, cap8L, cap8M, cap8N, cap8O, cap8P, complete cds | 97 | 1125 | 3125 |
| 96 | 2 | 1245 | 3896 | emb\|Z18852\|SACF | *S. aureus* gene for clumping factor | 83 | 660 | 2652 |
| 97 | 2 | 625 | 882 | gb\|41072\| | *Staphylococcus aureus* isoleucyl-tRNA synthetase (ileS) gene, partial cds | 97 | 68 | 258 |
| 111 | 1 | 3 | 452 | gb\|41499\| | *Staphylococcus aureus* ORF1, partial cds, ORF2, ORF3, autolysin (atl) genes, complete cds | 100 | 450 | 450 |

TABLE 1-continued

*S. aureus* Coding regions containing known sequences

| Contig ID | ORF ID | Start (nt) | Stop (nt) | match acession | match gene name | percent ident | HSP nt length | ORF nt length |
|---|---|---|---|---|---|---|---|---|
| 111 | 2 | 526 | 1041 | gb|41499| | *Staphylococcus aureus* ORF1, partial cds, ORF2, ORF3, autolysin (atl) genes, complete cds | 99 | 516 | 516 |
| 117 | 2 | 1278 | 1958 | gb|M83994| | *Staphylococcus aureus* prolipoprotein signal peptidase (lsp) gene, complete cds | 100 | 61 | 681 |
| 118 | 4 | 3787 | 4254 | dbj|D30690|STAN | *Staphylococcus aureus* genes for ORF37; HSP20; HSP70; HSP40; ORF35, complete cds | 99 | 467 | 468 |
| 130 | 4 | 2597 | 3640 | emb|X13290|SATN | *Staphylococcus aureus* multi-resistance plasmid pSK1 DNA containing transposon Tn4003 | 78 | 956 | 1044 |
| 130 | 5 | 3813 | 4265 | emb|Z16422|SADI | *S. aureus* dfrB gene for dihydrofolate reductase | 98 | 416 | 453 |
| 130 | 6 | 4309 | 5172 | emb|Z16422|SADI | *S. aureus* dfrB gene for dihydrofolate reductase | 98 | 607 | 864 |
| 136 | 4 | 5296 | 6207 | emb|X71437|SAGY | *S. aureus* genes gyrR, gyrA and recF (partial) | 97 | 838 | 912 |
| 136 | 5 | 8987 | 6294 | dbj|D10489|STAG | *Staphylococcus aureus* genes for DNA gyrase A and B, complete cds | 100 | 2694 | 2694 |
| 136 | 6 | 10940 | 8994 | dbj|D10489|STAD | *Staphylococcus aureus* genes for DNA gyrase A and B, complete cds | 99 | 1947 | 1947 |
| 136 | 7 | 111765 | 10938 | gb|S77055| | recF cluster: dnaA = replisome assembly protein. . gyrB = DNA gyrase beta subunit [*Staphylococcus aureus*, YB886, Genomic, 5 genes, 3573 nt] | 99 | 822 | 828 |
| 143 | 3 | 2867 | 1563 | gb|U36379| | *Staphylococcus aureus* S-adenosylmethionine synthetase gene, complete cds | 99 | 1305 | 1305 |
| 143 | 4 | 3100 | 4281 | gb|L42943| | *Staphylococcus aureus* (clone KN50) phosphoenolpyruvate carboxykinase | 100 | 1170 | 1182 |
| 143 | 5 | 4254 | 4718 | gb|U51133| | *Staphylococcus aureus* phosphoenolpyruvate carboxykinase (pcka) gene, complete cds | 100 | 449 | 465 |
| 143 | 9 | 6977 | 7263 | gb|U51132| | *Staphylococcus aureus* o-succinylbenzoic acid CoA ligase (mene) genes, and o-succinylbenzoic acid synthetase (mene) genes, complete cds. | 100 | 75 | 285 |
| 143 | 10 | 8361 | 7258 | gb|U51132| | *Staphylococcus aureus* o-succinylbenzoic acid CoA ligase (mene), and o-succinylbenzoic acid synthetase (mene) genes, complete cds | 100 | 1104 | 1104 |
| 143 | 11 | 9748 | 8264 | gb|U51132| | *Staphylococcus aureus* o-succinylbenzoic acid CoA ligase (mene), and o-succinylbenzoic acid synthetase (mene) genes, complete cds | 100 | 1485 | 1485 |
| 143 | 12 | 10320 | 9901 | gb|U51132| | *Staphylococcus aureus* o-succinylbenzoic acid CoA ligase (mene), and o-succinylbenzoic acid synthetase (mene) genes, complete cds | 100 | 332 | 420 |
| 152 | 5 | 2454 | 3437 | gb|577055| | *S. aureus* pdhB, pdhC and pdhD genes for pyruvate decarboxylase, dihydrolipoamide acetyltransferase and dihydrolipoamide dehydrogenase | 99 | 305 | 984 |
| 152 | 6 | 3513 | 4820 | emb|X58434|SAPD | *S. aureus* pdhB, pdhC and pdhD genes for pyruvate decarboxylase, dihydrolipoamide acetyltransferase and dihydrolipoamide dehydrogenase | 98 | 1308 | 1308 |
| 152 | 7 | 4818 | 6230 | emb|X58434|SAPD | *S. aureus* pdhB, pdhC and pdhD genes for pyruvate decarboxylase, dihydrolipoamide acetyltransferase and dihydrolipoamide dehydrogenase | 99 | 1413 | 1413 |
| 153 | 1 | 387 | 1526 | gb|577055| | recF cluster: dnaA = replisome assembly protein. . gyrB = DNA gyrase beta subunit [*Staphylococcus aureus*, YB886, Genomic, 5 genes, 3573 nt] | 99 | 1140 | 1140 |
| 153 | 2 | 1877 | 2152 | gb|577055| | recF cluster: dnaA = replisome assembly protein. . gyrB = DNA gyrase beta subunit [*Staphylococcus aureus*, YB886, Genomic, 5 genes, 3573 nt] | 100 | 276 | 276 |
| 153 | 3 | 2143 | 2289 | gb|577055| | recF cluster: dnaA = replisome assembly protein. . gyrB = DNA gyrase beta subunit [*Staphylococcus aureus*, YB886, Genomic, 5 genes, 3573 nt] | 99 | 113 | 147 |
| 154 | 10 | 9314 | 7836 | gb|U06451| | *Staphylococcus aureus* proline permease homolog (putP) gene, complete cds | 91 | 154 | 1479 |
| 154 | 11 | 9615 | 9295 | gb|U06451| | *Staphylococcus aureus* proline permease homolog (putP) gene, complete cds | 99 | 229 | 32 |
| 154 | 12 | 9943 | 10167 | gb|U06451| | *Staphylococcus aureus* proline permease homolog (putP) gene, complete cds | 94 | 123 | 225 |
| 154 | 13 | 10089 | 11501 | gb|U06451| | *Staphylococcus aureus* proline permease homolog (putP) gene, complete cds | 99 | 1326 | 1413 |
| 159 | 2 | 1212 | 229 | dbj|D28879|STAP | *Staphylococcus aureus* gene for penicillin-binding protein 1, complete cds | 100 | 71 | 984 |
| 161 | 3 | 2270 | 1944 | gb|M83994| | *Staphylococcus aureus* prolipoprotein signal peptidase (lsp) gene, complete cds | 92 | 203 | 327 |

TABLE 1-continued

S. aureus Coding regions containing known sequences

| Contig ID | ORF ID | Start (nt) | Stop (nt) | match acession | match gene name | percent ident | HSP nt length | ORF nt length |
|---|---|---|---|---|---|---|---|---|
| 162 | 1 | 705 | 4 | gb|U21221| | Staphylococcus aureus hyaluronate lyase (hysA) gene, complete cds | 100 | 702 | 702 |
| 163 | 4 | 1263 | 1772 | gb|U19770| | Staphylococcus aureus pyrrolidone carboxyl peptidase (pcp) gene, complete cds | 96 | 27 | 510 |
| 164 | 7 | 4774 | 9117 | dbj|D86727|D867 | Staphyloococcus aureus DNA for DNA polymerase III, complete cds | 99 | 3470 | 4344 |
| 168 | 7 | 6447 | 5446 | gb|U21636| | Staphyloococcus aureus cmp-binding-factor 1 (cbf1) and ORF X genes, complete cds | 100 | 1002 | 1002 |
| 168 | 8 | 7961 | 6384 | gb|U21636| | Staphyloococcus aureus cmp-binding-factor 1 (cbf1) and ORF X genes, complete cds | 99 | 1158 | 1578 |
| 173 | 6 | 7801 | 6362 | gb|I03479| | S. aureus enzyme III-lac (lacF), enzyme II-lac (lacE), and phospho-beta-galactosidase (lacG) genes, complete cds | 100 | 1440 | 1440 |
| 173 | 7 | 9522 | 7792 | gb|I03479| | S. aureus enzyme III-lac (lacF), enzyme II-lac (lacE), and phospho-beta-galactosidase (lacG) genes, complete cds | 99 | 1731 | 1731 |
| 173 | 8 | 8285 | 8704 | gb|I03479| | S. aureus enzyme III-lac (lacF), enzyme II-lac (lacE), and phospho-beta-galactosidase (lacG) genes, complete cds | 100 | 420 | 420 |
| 173 | 9 | 9839 | 9510 | gb|I03479| | S. aureus enzyme III-lac (lacF), enzyme II-lac (lacE), and phospho-beta-galactosidase (lacG) genes, complete cds | 100 | 330 | 330 |
| 173 | 10 | 10829 | 9843 | emb|X14827|SALA | Staphylococcus aureus lacC and lacD genes | 100 | 987 | 987 |
| 173 | 11 | 11774 | 10827 | emb|X14827|SALA | Staphylococcus aureus lacC and lacD genes | 100 | 948 | 948 |
| 173 | 12 | 12305 | 11772 | gb|M64724| | S. aureus tagatose 6-phosphate isomerase gene, complete cds | 100 | 534 | 534 |
| 173 | 13 | 12773 | 12303 | gb|M32103| | Staphylococcus aureus lac repressor (lacR) gene, complete cds and lacA repressor (lacA), partial cds | 100 | 471 | 471 |
| 173 | 14 | 13866 | 3099 | gb|M32103| | Staphylococcus aureus lac repressor (lacR) gene, comlpete cds and lacA repressor (lacA), partial cds | 100 | 768 | 768 |
| 178 | 1 | 2 | 655 | gb|U52961| | Staphylococcus aureus holin-like protein LrgA (lrgA) and LrgB (lrgB) genes, complete cds | 100 | 115 | 654 |
| 178 | 2 | 142 | 763 | gb|U52961| | Staphylococcus aureus holin-like protein LrgA (lrgA) and LrgB (lrgB) genes, complete cds | 100 | 720 | 720 |
| 178 | 3 | 1909 | 1457 | gb|U52961| | Staphylococcus aureus holin-like protein LrgA (lrgA) and LrgB (lrgB) genes, complete cds | 100 | 453 | 453 |
| 178 | 4 | 1551 | 1853 | gb|U52961| | Staphylococcus aureus holin-like protein LrgA (lrgA) and LrgB (lrgB) genes, complete cds | 100 | 303 | 303 |
| 178 | 5 | 2777 | 2013 | gb|L42945| | Staphylococcus aureus lytS and lytR genes, complete cds | 99 | 765 | 765 |
| 178 | 6 | 3025 | 2756 | gb|L42945| | Staphylococcus aureus lytS and lytR genes, complete cds | 99 | 270 | 270 |
| 181 | 1 | 590 | 66 | gb|M63177| | S. aureus sigma factor (plaC) gene, complete cds | 99 | 499 | 525 |
| 182 | 1 | 3 | 341 | emb|X61307|SASP | Staphylococcus aureus spa gene for protein A | 98 | 277 | 339 |
| 182 | 2 | 690 | 2312 | gb|J01786| | S. aureus spa gene coding for protein A, complete csd | 97 | 1332 | 1623 |
| 182 | 3 | 4251 | 2641 | emb|X61307|SASP | Staphylococcus aureus spa gene for protein A | 99 | 119 | 1611 |
| 185 | 1 | 3 | 824 | gb|U31979| | Staphylococcus aureus chorismate synthase (aroC), dehydroauinate synthase homolog (gerCC) genes, partial cds and geranylgeranyl pyrophosphate synthetase homolog (aroB) and kinase (ndk) genes, complete cds | 90 | 132 | 822 |
| 191 | 3 | 841 | 2760 | emb|X17679|SACO | Staphylococcus aureus coa gene for coagulase | 99 | 1920 | 1920 |
| 191 | 4 | 2967 | 3143 | emb|X16457|SAST | Staphylococcus aureus gene for staphylocoagulase | 99 | 177 | 177 |
| 191 | 5 | 4566 | 3364 | emb|X16457|SAST | Staphylococcus aureus gene for staphylocoagulase | 99 | 250 | 1203 |
| 196 | 1 | 872 | 3 | gb|L36472| | Staphylococcus aureus lysyl-tRNA sythetase gene, complete cds, transfer RNA (tRNA) genes, 5S ribosomal RNA (5S rRNA) gene, 16S ribosomal RNA (16S rRNA) gene, 23S ribosomal RNA (23S rRNA) gene | 99 | 870 | 870 |

TABLE 1-continued

S. aureus Coding regions containing known sequences

| Contig ID | ORF ID | Start (nt) | Stop (nt) | match accession | match gene name | percent ident | HSP nt length | ORF nt length |
|---|---|---|---|---|---|---|---|---|
| 198 | 3 | 1688 | 2011 | emb\|X93205\|SAPT | S. aureus ptsH and ptsI genes | 99 | 324 | 324 |
| 198 | 4 | 2005 | 2310 | emb\|X93205\|SAPT | S. aureus ptsH and ptsI genes | 97 | 304 | 306 |
| 202 | 1 | 163 | 1305 | emb\|X97985\|SA12 | S. aureus orfs 1,2,3 & 4 | 99 | 1143 | 1143 |
| 202 | 2 | 1303 | 2175 | emb\|X73889\|SAP1 | S. aureus genes P1 and P2 | 94 | 444 | 873 |
| 210 | 1 | 1558 | 2 | dbj\|D17366\|SAA | Staphylococcus aureus atl gene for autolysin, complete cds and other ORFs | 99 | 1552 | 1557 |
| 210 | 2 | 2232 | 1525 | gb\|L41499\| | Staphylococcus aureus ORF1, partial cds, ORF2, ORF3, autolysin (atl) genes, complete cds | 99 | 684 | 708 |
| 214 | 11 | 7429 | 7770 | dbj\|D86240\|D862 | Staphylococcus aureus gene for unknown function and dlt operon dltA, dltB, dltC and dltD genes, complete cds | 96 | 157 | 342 |
| 216 | 3 | 398 | 1318 | emb\|X72700\|SAPV | S. aureus genes for S and F components of Panton-Valentine leucocidins | 88 | 265 | 921 |
| 219 | 2 | 1073 | 336 | dbj\|D30690\|STAN | Staphylococcus aureus genes for ORF37; HSP70; (HSP40; ORF35, complete cds | 100 | 60 | 738 |
| 219 | 3 | 2035 | 1091 | dbj\|D30690\|STAN | Staphylococcus aureus genes for ORF37; HSP70; (HSP40; ORF35, complete cds | 99 | 945 | 945 |
| 219 | 4 | 3196 | 2033 | dbj\|D30690\|STAN | Staphylococcus aureus genes for ORF37; HSP70; (HSP40; ORF35, complete cds | 99 | 3164 | 1164 |
| 219 | 5 | 5176 | 3308 | dbj\|D30690\|STAN | Staphylococcus aureus genes for ORF37; HSP70; (HSP40; ORF35, complete cds | 98 | 1869 | 1869 |
| 219 | 6 | 5883 | 5209 | dbj\|D30690\|STAN | Staphylococcus aureus genes for ORF37; HSP70; (HSP40; ORF35, complete cds | 99 | 675 | 675 |
| 219 | 7 | 6334 | 5867 | dbj\|D30690\|STAN | Staphylococcus aureus genes for ORF37; HSP70; (HSP40; ORF35, complete cds | 98 | 468 | 468 |
| 221 | 8 | 10034 | 9252 | gb\|L19298\| | Staphylococcus aures phospharidylinositol-specific phospholipase C (plc) gene, complete cds | 91 | 67 | 783 |
| 223 | 1 | 1506 | 157 | gb\|U73374\| | Staphylococcus aureus type 8 capsule genes, cap8A, cap8B, cap8C, cap8D, cap8E, cap8F, cap8G, cap8H, cap8I, cap8J, cap8K, cap8L, cap8M, cap8N, cap8O, cap8P, complete cds | 99 | 102 | 1350 |
| 234 | 1 | 2 | 1357 | emb\|X97985\|SA12 | S. aureus orfs 1,2,3 & 4 | 100 | 176 | 1356 |
| 234 | 2 | 1694 | 2485 | emb\|X97985\|SA12 | S. aureus orfs 1,2,3 & 4 | 100 | 792 | 792 |
| 234 | 3 | 2648 | 3148 | emb\|X97985\|SA12 | S. aureus orfs 1,2,3 & 4 | 99 | 501 | 501 |
| 234 | 4 | 3120 | 4604 | emb\|X97985\|SA12 | S. aureus orfs 1,2,3 & 4 | 99 | 1305 | 1485 |
| 236 | 6 | 3826 | 5322 | gb\|U48826\| | Staphylococcus aureus elastin binding protein (ebpS) gene, complete cds | 96 | 648 | 1497 |
| 248 | 1 | 2 | 403 | emb\|X62288\|SAPE | S. aureus DHA for penicillin-binding protein 2 | 100 | 103 | 402 |
| 248 | 2 | 388 | 852 | gb\|25426\| | Staphylococcus aureus penicillin-binding protein 2 (pbp2) gene, complete cds | 99 | 465 | 465 |
| 253 | 2 | 1093 | 647 | gb\|U46541\| | Staphylococcus aureus sarA gene, complete cds | 96 | 447 | 447 |
| 254 | 2 | 150 | 1835 | gb\|U57060\| | Staphylococcus aureus scdA gene, complete cds | 94 | 142 | 1686 |
| 254 | 3 | 1973 | 2728 | gb\|U57060\| | Staphylococcus aureus scdA gene, complete cds | 99 | 756 | 756 |
| 260 | 1 | 2 | 1900 | gb\|M90693\| | Staphylococcus aureus glycrol ester hydrolase (lip) gene, complete cds | 99 | 1213 | 1899 |
| 265 | 1 | 1 | 942 | dbj\|D21131\|STAS | Staphylococcus aureus gene for a participant in homogeneous expression of high-level methicillin resistance, complete cds | 99 | 941 | 942 |
| 265 | 2 | 476 | 264 | dbj\|D21131\|STAS | Staphylococcus aureus gene for a participant in homogeneous expression of high-level methicillin resistance, complete cds | 99 | 213 | 213 |
| 265 | 3 | 1765 | 1112 | dbj\|D21131\|STAS | Staphylococcus aureus gene for a participant in homogeneous expression of high-level methicillin resistance, complete cds | 98 | 69 | 654 |
| 266 | 1 | 2 | 1018 | dbj\|D14711\|STAH | Staphylococcus aureus HSP10 and HSP60 genes | 98 | 743 | 1017 |
| 282 | 1 | 1 | 525 | gb\|S72488\| | hemB-porphobilinogen synthase [Staphylococcus aureus, SA1959, Genomic, 1087 | 100 | 110 | 525 |

TABLE 1-continued

S. aureus Coding regions containing known sequences

| Contig ID | ORF ID | Start (nt) | Stop (nt) | match acession | match gene name | percent ident | HSP nt length | ORF nt length |
|---|---|---|---|---|---|---|---|---|
| 282 | 2 | 516 | 1502 | gb|S72488| | hemB-porphobilinogen synthase [Staphylococcus aureus, SA1959, Genomic, 1087 | 100 | 952 | 987 |
| 284 | 1 | 3 | 170 | gb|M63176| | Staphylococcus aureus helicase required for T181 replication (pctA) gene, complete cds | 98 | 84 | 168 |
| 284 | 2 | 282 | 1034 | gb|M63176| | Staphylococcus aureus helicase required for T181 replication (pctA) gene, complete cds | 300 | 712 | 753 |
| 284 | 3 | 1028 | 2026 | gb|M63176| | Staphylococcus aureus helicase required for T181 replication (pctA) gene, complete cds | 99 | 979 | 999 |
| 284 | 4 | 1990 | 2202 | gb|M63176| | Staphylococcus aureus helicase required for T181 replication (pctA) gene, complete cds | 98 | 187 | 213 |
| 289 | 3 | 1536 | 1991 | gb|M32470| | S. aureus Sau3AI-restriction-enzyme and Sau3AI-modification-enzyme genes, complete cds | 99 | 338 | 456 |
| 303 | 1 | 2 | 868 | gb|L01055| | Staphylococcus aureus gamma-hemolysin components A, B and C (hlgA, hlgB, hglC) genes, complete cds | 99 | 867 | 867 |
| 303 | 2 | 1409 | 2383 | gb|L01055| | Staphylococcus aureus gamma-hemolysin components A, B and C (hlgA, hlgB, hglC) genes, complete cds | 100 | 975 | 975 |
| 303 | 3 | 2367 | 3161 | gb|L01055| | Staphylococcus aureus gamma-hemolysin components A, B and C (hlgA, hlgB, hglC) genes, complete cds | 99 | 793 | 795 |
| 305 | 1 | 1355 | 3 | dbj|D17366|STAA | Staphylococcus aureus atl gene for autolysin, complete cds and other ORFs | 99 | 1343 | 1353 |
| 311 | 1 | 1315 | 2 | gb|L42945| | Staphylococcus aureus lytS and lytR genes, complete cds | 98 | 1314 | 1314 |
| 312 | 6 | 7019 | 7870 | gb|L14017| | Staphylococcus aureus methicillin-resistance protein (meCR) gene and unknown DRF, complete cds | 74 | 351 | 852 |
| 323 | 1 | 1003 | 8 | gb|U31175| | Staphylococcus aureus D-specific D-2-hydroxyacid dehydrogenase (ddh) gene, complete cds | 98 | 996 | 996 |
| 326 | 1 | 1 | 237 | emb|Y00356|SASP | Staphylococcus aureus V8 serine protease gene | 100 | 108 | 237 |
| 338 | 1 | 388 | 89 | emb|X64389|SALE | S. aureus leuF-P83 gene for F component of leucocidin R | 98 | 259 | 300 |
| 338 | 2 | 1088 | 348 | emb|X64389|SALE | S. aureus leuF-P83 gene for F component of leucocidin R | 97 | 137 | 741 |
| 342 | 2 | 579 | 1754 | gb|U06462| | Staphylococcus aureus SA4 FtsZ (ftsZ) gene, complete cds | 100 | 1176 | 1176 |
| 344 | 2 | 517 | 1248 | emb|V01281|SANU | S. aureus mRNA for nuclease | 98 | 732 | 732 |
| 349 | 1 | 230 | 3 | gb|M20393| | Staphylococcus aureus bacteriophage phi-11 attachment site (attB) | 96 | 172 | 228 |
| 353 | 1 | 516 | 16 | gb|M83994| | Staphylococcus aureus prolipoprotein signal peptidase (lsp) gene, complete cds | 100 | 187 | 501 |
| 353 | 2 | 1046 | 510 | gb|M83994| | Staphylococcus aureus prolipoprotein signal peptidase (lsp) gene, complete cds | 99 | 537 | 537 |
| 356 | 1 | 3 | 674 | gb|U20503| | Staphylococcus aureus MHC-class II analog gene, complete cds | 75 | 671 | 672 |
| 361 | 1 | 1 | 903 | gb|L19298| | Staphylococcus aureus phosphatidylinositol-specific phospholipase C (plc) gene, complete cds | 98 | 747 | 903 |
| 361 | 2 | 1103 | 1507 | gb|L19298| | Staphylococcus aureus phosphatidylinositol-specific phospholipase C (plc) gene, complete cds | 97 | 68 | 405 |
| 373 | 3 | 3 | 1148 | emb|X62288|SAPE | S. aureus DNA for penicillin-binding protein 2 | 99 | 1146 | 1146 |
| 389 | 3 | 1248 | 592 | emb|X62282|SATS | S. aureus target Site DNA for IS431 insertion | 97 | 349 | 657 |
| 400 | 1 | 1 | 540 | emb|X61716|SAHL | S. aureus hlb gene encoding sphingomyelinase | 99 | 389 | 540 |
| 400 | 2 | 187 | 681 | emb|X134D4|SAHL | Staphylococcus aureus hlb gene for beta-hemolysin | 99 | 178 | 507 |
| 408 | 1 | 1049 | 288 | gb|S76213| | Staphylococcus aureus asp23 = alkaline shock protein 23 (methicillin resistant) [Staphylococcus aureus, 912, Genomic, 1360 nt] | 99 | 163 | 762 |
| 408 | 1 | 2 | 217 | gb|L41499| | Staphylococcus aureus ORF1, partial cds, CRF2, ORF3, autolysin (atl) genes, complete cds | 100 | 216 | 216 |

TABLE 1-continued

S. aureus Coding regions containing known sequences

| Contig ID | ORF ID | Start (nt) | Stop (nt) | match acession | match gene name | percent ident | HSP nt length | ORF nt length |
|---|---|---|---|---|---|---|---|---|
| 418 | 2 | 639 | 424 | dbj\|D17366\|STAA | *Staphylococcus aureus* atl gene for autolysin, complete cds and other ORFs | 100 | 188 | 216 |
| 421 | 2 | 1262 | 2509 | gb\|L43098\| | Transposon Tn5404 and insertion sequences IS1181 and IS1182 (from *Staphylococcus aureus*) DNA | 99 | 1248 | 1248 |
| 422 | 1 | 2 | 325 | gb\|K02985\| | *S. aureus* (Strain RN450) transposon Tn554 insertion site | 96 | 200 | 324 |
| 427 | 1 | 434 | 3 | dbj\|D28879\|STAP | *Staphylococcus aureus* gene for penicillin-binding protein 1, complete cds | 100 | 432 | 432 |
| 427 | 2 | 1122 | 415 | dbj\|D28879\|STAP | *Staphylococcus aureus* gene for penicillin-binding protein 1, complete cds | 100 | 151 | 708 |
| 435 | 1 | 2 | 808 | dbj\|D86240\|D862 | *Staphylococcus aureus* gene for unknown function and dlt operon dltA, dltB, dltC and dltD genes, complete cds | 100 | 556 | 807 |
| 435 | 2 | 832 | 999 | dbj\|D86240\|D862 | *Staphylococcus aureus* gene for unknown function and dlt operon dltA, dltB, ditC and ditD genes, complete cds | 100 | 134 | 168 |
| 436 | 1 | 685 | 29 | emb\|X17688\|SAFE | *S. aureus* factor essential for expression of methicillin resistance (femA) gene, complete cds, and trpA gene, 3' end | 97 | 657 | 657 |
| 436 | 2 | 1657 | 911 | emb\|X17688\|SAFE | *S. aureus* factor essential for expression of methicillin resistance (femA) gene, complete cds, and trpA gene, 3' end | 100 | 294 | 747 |
| 442 | 1 | 347 | 1300 | emb\|X72700\|SAPV | *S. aureus* genes for S and F components of Panton-Valentine leucocidins | 84 | 204 | 954 |
| 445 | 2 | 1906 | 2178 | gb\|L01055\| | *Staphylococcus aureus* gamma-hemolysin components A, B and C (hlgA, hlgB, hglC) genes, complete cds | 98 | 187 | 273 |
| 447 | 1 | 167 | 1078 | gb\|U19770\| | *Staphylococcus aureus* pyrrolidone carboxyl peptidase (pcp) gene, complete cds | 100 | 51 | 912 |
| 447 | 2 | 1176 | 1784 | gb\|U19770\| | *Staphylococcus aureus* pyrrolidone carboxyl peptidase (pcp) gene, complete cds | 96 | 597 | 609 |
| 454 | 3 | 4319 | 1329 | emb\|Z18852\|SACF | *S. aureus* gene for clumping factor | 75 | 653 | 2991 |
| 472 | 4 | 5479 | 3062 | gb\|L25288\| | *Staphylococcus aureus* gyrase-like protein alpha and beta subunit (grlA and grlB) genes, complete cds | 99 | 2418 | 2418 |
| 472 | 5 | 6792 | 5464 | gb\|L25288\| | *Staphylococcus aureus* gyrase-like protein alpha and beta subunit (grlA and grlB) genes, complete cds | 99 | 1328 | 1329 |
| 475 | 2 | 566 | 889 | emb\|X52543\|SAAG | *S. aureus* agrA, aqrB and hld genes | 100 | 76 | 324 |
| 481 | 4 | 1560 | 1198 | emb\|X64172\|SARP | *S. aureus* rplL, orf202, rpoB(rif) and rpoC genes for ribosomal protein L7/L12, hypothetical protein ORF202, DNA-directed RNA polymerase beta & beta' chains | 100 | 250 | 363 |
| 481 | 5 | 1244 | 1534 | emb\|X64172\|SARP | *S. aureus* rplL, orf202, rpoB(rif) and rpoC genes for ribosomal protein L7/L12, hypothetical protein ORF202, DNA-directed RNA polymerase beta & beta' chains | 100 | 224 | 291 |
| 487 | 2 | 1188 | 988 | gb\|M83994\| | *Staphylococcus aureus* prolipoprotein signal peptidase (lsp) gene, complete cds | 98 | 72 | 201 |
| 489 | 1 | 1370 | 3 | gb\|U21221\| | *Staphylococcus aureus* hyaluronate lyase (hysA) gene, complete cds | 99 | 1368 | 1368 |
| 503 | 2 | 653 | 171 | gb\|M83994\| | *Staphylococcus aureus* prolipoprotein signal peptidase (lsp) gene, complete cds | 100 | 108 | 483 |
| 511 | 3 | 1613 | 2242 | gb\|L14017\| | *Staphylococcus aureus* methicillin-resistance protein (mecR) gene and unknown ORF, complete cds | 84 | 323 | 630 |
| 511 | 4 | 2700 | 2278 | gb\|S76213\| | asp23 = alkaline shock protein 23 (methicillin resistant) [*Staphylococcus aureus*, 912, Genomic, 1360 nt] | 96 | 423 | 423 |
| 520 | 2 | 758 | 1297 | emb\|X72014\|SAFI | *S. aureus* flb gene for fibrinogen-binding protein | 99 | 540 | 540 |
| 520 | 3 | 1436 | 1801 | emb\|X72013\|SAFI | *S. aureus* flb gene for fibrinogen-binding protein | 99 | 221 | 366 |
| 526 | 1 | 1092 | 34 | dbj\|D17366\|STAA | *Staphylococcus aureus* at gene for autolysin, complete cds and other ORFs | 99 | 641 | 1059 |
| 528 | 2 | 58 | 963 | gb\|L19300\| | *Staphylococcus aureus* DNA sequence encoding three ORFs, complete cds; prophage phi-11 sequence homology, 5' flank | 99 | 260 | 906 |

TABLE 1-continued

S. aureus Coding regions containing known sequences

| Contig ID | ORF ID | Start (nt) | Stop (nt) | match acession | match gene name | percent ident | HSP nt length | ORF nt length |
|---|---|---|---|---|---|---|---|---|
| 528 | 3 | 1098 | 2870 | gb|L19300| | *Staphylococcus aureus* DNA sequence encoding three ORFs, *complete cds*; prophage phi-11 sequence homology, 5' flank | 99 | 866 | 1773 |
| 530 | 1 | 3 | 434 | gb|U31979| | *Staphylococcus aureus* chorismate synthase (aroC) and nucleoside diphosphate kinase (ndk) genes, complete cds, dehydroauinate synthase (aroB) and geranylgeranyl pyrophosphate synthetase homolog (gerCC) genes, partial cds | 99 | 432 | 432 |
| 530 | 2 | 1211 | 2395 | gb|U31979| | *Staphylococcus aureus* chorismate synthase (aroC) and nucleoside diphosphate kinase ndk genes, complete cds, dehydroauinate synthase (aroB) and geranylgeranyl pyrophosphate synthetase homolog (gerCC) genes, partial cds | 91 | 1185 | 1185 |
| 530 | 3 | 2409 | 2801 | gb|U31979| | *Staphylococcus aureus* chorismate synthase (aroC) and nucleoside diphosphate kinase ndk genes, complete cds, dehydroauinate synthase (aroB) and geranylgeranyl pyrophosphate synthetase homolog (gerCC) genes, partial cds | 88 | 181 | 393 |
| 530 | 4 | 2690 | 3484 | gb|L05004| | *Staphylococcus aureus* dehydroquinate synthase (aroB) gene, 3' end cds; 3-phoshoshikimate-1-carboxyvinyltransferase (aroA) gene, complete cds; ORF3, complete cds | 100 | 75 | 795 |
| 530 | 5 | 3482 | 4792 | gb|L05004| | *Staphylococcus aureus* dehydroquinate synthase (aroB) gene, 3' end cds; 3-phosphoshikimate-1-carboxyvinyltransferase (aroA) gene, complete cds; ORF3, complete cds | 99 | 905 | 1311 |
| 530 | 6 | 4790 | 5380 | gb|L05004| | *Staphylococcus aureus* dehydroquinate synthase (aroA) gene, 3' end cds; 3-phosphoshikimate-1-carboxyvinyltransferase (aroA) gene, complete cds; ORF3, complete cds | 100 | 196 | 591 |
| 539 | 1 | 3 | 338 | emb|X76490|SAGL | S. aureus (bb270) glnA and glnR genes | 99 | 336 | 336 |
| 539 | 2 | 336 | 527 | emb|X76490|SAGL | S. aureus (bb270) glnA and glnR genes | 100 | 189 | 192 |
| 554 | 1 | 365 | 3 | gb|U73374| | *Staphylococcus aureus* type 8 capsule genes, cap8A, cap8B, cap8C, cap8D, cap8E, cap8F, cap8G, cap8H, cap8I, capJ, cap8K, cap8L, cap8M, cap8N, cap8O, cap8P, complete cds | 100 | 54 | 363 |
| 554 | 2 | 1252 | 329 | gb|U73374| | *Staphylococcus aureus* type 8 capsule genes, cap8A, cap8B, cap8C, cap8D, cap8E, cap8F, cap8G, cap8H, cap8I, capJ, cap8K, cap8L, cap8M, cap8N, cap8O, cap8P, complete cds | 99 | 918 | 924 |
| 554 | 3 | 1374 | 1174 | gb|U73374| | *Staphylococcus aureus* type 8 capsule genes, cap8A, cap8B, cap8C, cap8D, cap8E, cap8F, cap8G, cap8H, cap8I, capJ, cap8K, cap8L, cap8M, cap8N, cap8O, cap8P, complete cds | 96 | 122 | 201 |
| 584 | 2 | 705 | 391 | gb|U21221| | *Staphylococcus aureus* hyaluronate lyase (hysA) gene, complete cds | 99 | 306 | 315 |
| 587 | 3 | 1475 | 4288 | emb|Z18852|SACF | S. aureus gene for clumping factor | 98 | 2588 | 2814 |
| 598 | 1 | 1953 | 25 | dbj|D28879|STAP | *Staphylococcus aureus* gene for penticillin-binding protein 1, complete cds | 99 | 1873 | 1929 |
| 605 | 1 | 2 | 745 | dbj|D86240|D862 | *Staphylococcus areus* gene for unkown function and dlt operon dltA, dltB, dltC and dltD genes, complete cds | 98 | 338 | 744 |
| 609 | 1 | 816 | 4 | emb|X76490|SAGL | S. aureus (bb270) glnA and glnR genes | 100 | 495 | 813 |
| 614 | 1 | 642 | 4 | gb|M32103| | *Staphylococcus aureus* lac represso (lacR) gene, complete cds and lacA repressor (lacA), partial cds | 99 | 639 | 639 |
| 626 | 1 | 1255 | 2 | gb|M63176| | *Staphylococcus aureus* helicase required for T181 replication (pctA) gene. complete cds | 100 | 225 | 1254 |
| 626 | 2 | 2284 | 1253 | gb|M63176| | *Staphylococcus aureus* helicase required for T181 replication (pctA) gene. complete cds | 99 | 838 | 1032 |
| 629 | 1 | 100 | 3 | emb|X17688|SAFE | S. aureus factor essential for expression of methicillin resistance (femA) gene, complete cds, and trpA gene, 3' end | 99 | 990 | 999 |
| 629 | 2 | 1195 | 983 | emb|X17688|SAFE | S. aureus factor essential for expression of methicillin resistance (femA) gene, complete cds, and trpA gene, 3' end | 98 | 194 | 213 |

TABLE 1-continued

S. aureus Coding regions containing known sequences

| Contig ID | ORF ID | Start (nt) | Stop (nt) | match accession | match gene name | percent ident | HSP nt length | ORF nt length |
|---|---|---|---|---|---|---|---|---|
| 631 | 2 | 3228 | 1330 | emb\|Z18852\|SACF | S. aureus gene for clumping factor | 82 | 489 | 1899 |
| 632 | 1 | 3 | 551 | emb\|Z30588\|SAST | S. aureus (RN4220) genes for potential ABC transporter and potential membrane spanning protein | 99 | 549 | 549 |
| 632 | 2 | 529 | 1323 | emb\|Z30588\|SAST | S. aureus (RN4220) genes for potential ABC transporter and potential membrane spanning protein | 99 | 795 | 795 |
| 651 | 1 | 1070 | 231 | gb\|L19300\| | Staphylococcus aureus DNA sequence encoding three ORFs, complete cds: prophage phi-11 sequence homology, 5' flank | 99 | 478 | 840 |
| 657 | 1 | 1105 | 410 | gb\|L14017\| | Staphylococcus aureus methicillin-resistance protein (mecR) gene and unknown ORF, complete cds | 84 | 456 | 696 |
| 662 | 1 | 456 | 4 | emb\|X13404\|SAHL | Staphylococcus aureus hlb gene for beta-hemolysin | 100 | 369 | 453 |
| 662 | 2 | 230 | 475 | emb\|X13404\|SAHL | Staphylococcus aureus hlb gene for beta-hemolysin | 100 | 246 | 246 |
| 662 | 3 | 746 | 1399 | emb\|X13404\|SAHL | Staphylococcus aureus hlb gene for beta-hemolysin | 99 | 653 | 654 |
| 682 | 1 | 480 | 4 | gb\|M63177\| | S. aureus sigma factor (plaC) gene, complete cds | 100 | 136 | 477 |
| 685 | 1 | 592 | 2 | gb\|U65000\| | Staphylococcus aureus type signal peptidase SpsB (spsA) gene, and typ-I signal peptidase SpsB (spsB) gene, complete cds | 98 | 534 | 591 |
| 685 | 2 | 1153 | 590 | gb\|U65000\| | Staphylococcus aureus type signal peptidase SpsB (spsA) gene, and typ-I signal peptidase SpsB (spsB) gene, complete cds | 96 | 564 | 564 |
| 697 | 1 | 3 | 527 | gb\|M63177\| | S. aureus sigma factor (plaC) gene, complete cds | 100 | 195 | 525 |
| 697 | 2 | 485 | 784 | gb\|M63177\| | S. aureus sigma factor (plaC) gene, complete cds | 97 | 280 | 300 |
| 710 | 1 | 15 | 503 | dbj\|086240\|D862 | Staphylococcus aureus gene for unknown function and dlt operon dltA, dltB, dltC and dltD genes, complete cds | 99 | 217 | 489 |
| 733 | 1 | 26 | 205 | gb\|M80252\| | Staphylococcus aureus norA1199 gene (which mediates active efflux of fluoroquinolones), complete cds | 97 | 140 | 180 |
| 741 | 1 | 1197 | 658 | dbj\|D83951\|STAL | Staphylococcus aureus DNA for LukF component, LukF-PV like component, complete cds | 81 | 522 | 540 |
| 752 | 1 | 1 | 636 | emb\|Y00356\|SASP | Staphylococcus aureus V8 serine protease gene | 99 | 618 | 636 |
| 752 | 2 | 588 | 956 | emb\|Y00356\|SASP | Staphylococcus aureus V8 serine protease gene | 99 | 340 | 369 |
| 756 | 1 | 709 | 110 | emb\|X01645\|SATO | Staphylococcus aureus (Wood 46) gene for alpha-toxin | 98 | 567 | 600 |
| 777 | 1 | 950 | 318 | emb\|Z49245\|SA42 | S. aureus partial sod gene for superoxide dismutase | 99 | 429 | 633 |
| 780 | 1 | 557 | 3 | gb\|U20503\| | Staphylococcus aureus MHC class II analog gene, complete cds | 86 | 550 | 555 |
| 784 | 1 | 73 | 687 | gb\|U63529\| | Staphylococcus aureus novel antigen gene complete cds | 99 | 568 | 615 |
| 797 | 1 | 182 | 544 | dbj\|14711\|STAH | Staphylococcus aureus HSP10 and NSP60 genes | 98 | 363 | 363 |
| 798 | 1 | 302 | 72 | emb\|X58434\|SAPD | S. aureus pdhB, pdhC and pdhD genes for pyruvate decarboxylase, dihydrolipoamide acetyltransferase and dihydrolipoamide dehydrogenase | 95 | 196 | 231 |
| 823 | 1 | 3 | 467 | gb\|S77055\| | recF cluster: dnaA = replisome assembly protein.. gyrB = DNA gyrase beta subunit [Staphylococcus aureus, YB886, Genomic, 5 genes, 3573 nt] | 99 | 156 | 465 |
| 848 | 1 | 175 | 2 | gb\|L25288\| | Staphylococcus aureus gyrase-like protein alpha and beta subunit (gr1A and gr1B) genes, complete cds | 99 | 174 | 174 |
| 866 | 1 | 397 | 2 | emb\|X64172\|SARP | S. aureus rp1L, orf202, rpoB(rif) and rpoC genes for ribosomal protein L7/L12, hypothetical protein DRF202, DNA-directed RNA polymerase beta & beta chains | 99 | 395 | 396 |
| 883 | 1 | 1 | 285 | dbj\|D90119\|STAN | S. aureus norA gene | 99 | 131 | 285 |
| 884 | 1 | 334 | 62 | emb\|X25243\|SAAG | S. aureus agrA, agrB and hld genes | 98 | 265 | 273 |
| 884 | 2 | 522 | 328 | emb\|X25243\|SAAG | S. aureus agrA, agrB and hld genes | 100 | 195 | 195 |
| 912 | 2 | 517 | 681 | emb\|Z30588\|SAST | S. aureus (RN4220) genes for potential ABC transporter and potential membrane spanning protein | 99 | 163 | 165 |

TABLE 1-continued

S. aureus Coding regions containing known sequences

| Contig ID | ORF ID | Start (nt) | Stop (nt) | match acession | match gene name | percent ident | HSP nt length | ORF nt length |
|---|---|---|---|---|---|---|---|---|
| 917 | 1 | 2 | 265 | gb\|M64724\| | S. aureus tagatose 6-phosphate isomerase gene, complete cds | 99 | 247 | 264 |
| 917 | 2 | 238 | 396 | gb\|N64724\| | S. aureus tagatose 6-phosphate isomerase gene, complete cds | 95 | 147 | 159 |
| 918 | 1 | 1215 | 4 | emb\|X93205\|SAPT | S. aureus ptsH and ptsI genes | 99 | 1212 | 1212 |
| 967 | 1 | 1 | 411 | dbj\|D90119\|STAN | S. aureus norA gene | 97 | 395 | 411 |
| 991 | 1 | 337 | 2 | emb\|X25543\|SAAG | S. aureus aqrA, agrB and hld genes | 99 | 336 | 336 |
| 1000 | 1 | 845 | 573 | gb\|L14017\| | Staphylococcus aureus methicillin-resistance protein (mecR) gene and unknown ORF, complete cds | 78 | 90 | 273 |
| 1001 | 1 | 265 | 32 | dbj\|D86240\|D862 | Staphylococcus aureus gene for unknown function and dlt operon dltA, dltB, dltC and dltD genes, complete cds | 99 | 234 | 234 |
| 1010 | 1 | 1 | 285 | gb\|U2122\| | Staphylococcus aureus hyaluronate lyase (hysA gene, complete cds | 99 | 224 | 285 |
| 1046 | 1 | 330 | 4 | emb\|X72700\|SAPV | S. aureus genes for S and F components of Panton-Valentine leucocidins | 85 | 205 | 327 |
| 1060 | 1 | 286 | 92 | emb\|X58434\|SAPD | S. aureus pdhB, pdhC and pdhD genes for pyruvate decarboxylase, dihydrolipoamide acetyltransferase and dihydrolipoamide dehydrogenase | 99 | 180 | 195 |
| 1073 | 1 | 589 | 2 | gb\|K02985\| | S. aureus (strain RN450) transposon Tn554 insertion site | 100 | 131 | 588 |
| 1379 | 1 | 3 | 230 | dbj\|D86240\|D862 | Staphylococcus aureus gene for unknown function and dlt operon dltA, dltB, dltC and dltD genes, complete cds | 99 | 228 | 228 |
| 1079 | 2 | 218 | 484 | dbj\|D86240\|D862 | Staphylococcus aureus gene for unknown function and dlt operon dltA, dltB, dltC and dltD genes, complete cds | 100 | 267 | 267 |
| 1079 | 3 | 460 | 645 | dbj\|D86240\|D862 | Staphylococcus aureus gene for unknown function and dlt operon dltA, dltB, dltC and dltD genes, complete cds | 100 | 186 | 186 |
| 1092 | 1 | 146 | 3 | emb\|X58434\|SAPD | S. aureus pdhB, pdhC and pdhD genes for pyruvate decarboxylase, dihydrolipoarside acetyltransferase and dihydrolipoamide dehydrogenase | 98 | 124 | 144 |
| 1143 | 1 | 1 | 243 | gb\|M63177\| | S. aureus sigma factor (plaC) gene, complete cds | 99 | 243 | 243 |
| 1157 | 1 | 2 | 136 | emb\|Z48003\|SADN | S. aureus gene for DNA polymerase | 97 | 127 | 135 |
| 1189 | 1 | 361 | 2 | gb\|S74031\| | norA = NorA (ISP794) [Staphylococcus aureus, NCTC 8325, Insertion, 1820 nt] | 99 | 360 | 360 |
| 1190 | 1 | 2 | 283 | gb\|M21854\| | S. aureus agr gene encoding an accessory gene regulator protein, complete cds | 100 | 282 | 282 |
| 1190 | 2 | 888 | 649 | emb\|X25543\|SAAG | S. aureus agrA, agrB and hld genes | 100 | 240 | 240 |
| 1225 | 1 | 2 | 163 | emb\|XY7679\|SACD | Staphylococcus aureus coa gene for coagulase | 97 | 124 | 162 |
| 1243 | 1 | 2 | 529 | dbj\|D86240\|D862 | Staphylococcus aureus gene for unknown function and dlt operon dltA, dltB, dltC and dltD genes, complete cds | 99 | 495 | 528 |
| 1244 | 1 | 1 | 210 | gb\|S74031\| | NorA = NorA (ISP794) [Staphylococcus aureus, NCTC 8325, Insertion, 1820 nt] | 100 | 210 | 210 |
| 1301 | 1 | 41 | 472 | emb\|X76490\|SAGL | S. aureus (bb270) glnA and glnB genes | 99 | 299 | 432 |
| 1315 | 1 | 8 | 326 | emb\|X64172\|SARP | S. aureus rp1L, orf202, rpoB(rif) and rpoC genes for ribosomal protein L7/L12, hypothetical protein ORF202, DNA-directed RNA polymerase beta & beta chains | 98 | 277 | 309 |
| 1519 | 1 | 2 | 175 | dbj\|D28879\|STAP | Staphylococcus aureus gene for penicillin-binding protein 1, complete cds | 98 | 139 | 174 |
| 1663 | 1 | 675 | 4 | dbj\|D86240\|D862 | Staphylococcus aureus gene for unknown function and dlt operon dltA, dltB, dltC and dltD genes, complete cds | 98 | 672 | 672 |
| 1797 | 1 | 324 | 4 | gb\|U73374\| | Staphylococcus aureus type 8 capsule genes, cap8A, cap8B, cap8C, cap8D, cap8E, cap8F, cap8G, cap8H, cap8I, cap8J, cap8K, cap8L, cap8M, cap8N, cap8O, cap8P, complete cds | 99 | 321 | 321 |
| 1857 | 1 | 1 | 192 | gb\|M90536\| | Staphylococcus aureus alpha-hemolysin gene, 3′ end | 98 | 192 | 192 |
| 1923 | 1 | 2 | 181 | emb\|X17688\|SAFE | S. aureus factor essential for expression of methicillin resistance (femA) gene, complete cds, and trpA gene, 3′ end | 300 | 180 | 180 |

TABLE 1-continued

S. aureus Coding regions containing known sequences

| Contig ID | ORF ID | Start (nt) | Stop (nt) | match acession | match gene name | percent ident | HSP nt length | ORF nt length |
|---|---|---|---|---|---|---|---|---|
| 1957 | 1 | 2 | 346 | gb\|U60589\| | *Staphylococcus aureus* novel antigen gene, complete cds | 99 | 345 | 345 |
| 1988 | 1 | 1 | 402 | dbj\|86240\|D862 | *Staphylococcus aureus* gene for unkown function and dlt operon dltA, dltB, dltC and dltD genes, complete cds | 100 | 402 | 402 |
| 2100 | 1 | 208 | 2 | gb\|M63177\| | *S. aureus* sigma factor plaC gene, complete cds | 99 | 207 | 207 |
| 2399 | 1 | 1 | 402 | gb\|U06664\| | *Staphylococcus aureus* DHA fragment with class promoter activity | 99 | 131 | 402 |
| 2537 | 1 | 156 | 4 | emb\|X17688\|SAFE | *S. aureus* factor essential for expression of methicillin resistance (femA) gene, complete cds, and trpA gene, 3′ end | 99 | 153 | 153 |
| 2891 | 1 | 2 | 400 | gb\|L25426\| | *Staphylococcus aureus* penicillin-binding protein 2 (pbp2) gene, complete cds | 99 | 399 | 399 |
| 2950 | 1 | 398 | 18 | dbj\|D30690\|STAN | *Staphylococcus aureus* genes for ORF37; HSP20; HSP70; HSP40; ORF35, complete cds | 100 | 358 | 381 |
| 2971 | 1 | 3 | 398 | gb\|U51132\| | *Staphylococcus aureus* osuccinylbenzoic acid COA ligase mene, and o-succinylbenzoic acid synthetase (mene) genes, complete cds | 97 | 272 | 396 |
| 2978 | 1 | 328 | 38 | gb\|U31979\| | *Staphylococcus aureus* chorismate synthase (aroC) and nucleoside diphosphate kinase (ndk) genes, complete cds, dehydroauinate synthase (aroB) and geranylgeranyl pyrophosphate synthetase homolog (gerCC) genes, partial cds | 98 | 250 | 291 |
| 2985 | 1 | 464 | 96 | emb\|X17679\|SACO | *Staphylococcus aureus* coa gene for coagulase | 98 | 347 | 369 |
| 3006 | 1 | 1784 | 1398 | emb\|U117791\| | *Staphylococcus aureus* methicillin-resistant ATCC 33952 clone RRNV30 16S–235 rRNA spacer region | 87 | 82 | 387 |
| 3008 | 1 | 238 | 2 | dbj\|D30690\|STAN | *Staphylococcus aureus* genes for ORF37; HSP20; HSP70; HSP40; ORF35, complete cds | 88 | 378 | 237 |
| 308 | 2 | 281 | 111 | dbj\|D30690\|STAN | *Staphylococcus aureus* genes for ORF37; HSP20; HSP70; HSP40; ORF35, complete cds | 97 | 120 | 171 |
| 3011 | 1 | 398 | 3 | emb\|X62992\|SAFN | *S. aureus* fnbB gene for fibronectin binding protein B | 93 | 135 | 396 |
| 3019 | 1 | 2 | 235 | gb\|J03479\| | *S. aureus* rp1L, orf202, rpoB(rif), and rpoC genes for ribosomal protein L7/L12, hypothetical protein ORF202, DNA-directed RHA polymerase beta & beta′ chains | 97 | 234 | 234 |
| 3023 | 1 | 81 | 233 | gb\|U06451\| | *Staphylococcus aureus* proline permease homolog (putP) gene, complete cds | 87 | 100 | 153 |
| 3029 | 1 | 90 | 287 | emb\|X64172\|SARP | *Staphylococcus aureus* phosphoenolpyruvate carboxykinase (pcka) gene, complete cds | 100 | 135 | 198 |
| 3039 | 1 | 18 | 164 | gb\|U51133\| | *Staphylococcus aureus* phosphoenolpyruvate carboxykinase (pcka) gene, complete cds | 97 | 135 | 147 |
| 3039 | 2 | 70 | 327 | gb\|U51133\| | *Staphylococcus aureus* phosphoenolpyruvate carboxykinase (pcka) gene, complete cds | 77 | 183 | 258 |
| 3056 | 1 | 3 | 215 | emb\|X64172\|SARP | *S. aureus* rp1L, orf202, rpoB(rif) and rpoC genes for ribosomal protein L7/L12, hypothetical protein ORF202, DNA-directed RHA polymerase beta & beta′ chains | 99 | 213 | 213 |
| 3059 | 1 | 1 | 261 | dbj\|D30690\|STAN | *Staphylococcus aureus* genes for ORF37; HSP20; NSP70; HSP40; ORF35, complete cds | 98 | 234 | 261 |
| 3073 | 1 | 27 | 284 | gb\|U06451\| | *Staphylococcus aureus* proline permease homolog (putP) gene, complete cds | 99 | 229 | 258 |
| 3074 | 1 | 2 | 397 | emb\|X64172\|SARP | *S. aureus* rp1L, orf202, rpoB(rif) and rpoC genes for ribosomal protein L7/L12, hypothetical protein ORF202, DNA-directed RNA polymerase beta & beta′ chains | 96 | 250 | 396 |
| 3088 | 1 | 3 | 239 | dbj\|D86727\|D867 | *Staphylococcus aureus* DNA for DNA polymerase complete cds | 95 | 215 | 237 |
| 3097 | 1 | 244 | 44 | emb\|Z48003\|SADN | *S. aureus* gene for DNA polymerase III | 97 | 160 | 201 |
| 3102 | 1 | 155 | 3 | gb\|J03479\| | *S. aureus* enzyme III-lac (lacF), enzyme II-lac (lacE), and phospho-beta-galactosidase (lacG) genes, complete cds | 97 | 142 | 153 |

TABLE 1-continued

S. aureus Coding regions containing known sequences

| Contig ID | ORF ID | Start (nt) | Stop (nt) | match acession | match gene name | percent ident | HSP nt length | ORF nt length |
|---|---|---|---|---|---|---|---|---|
| 3121 | 1 | 398 | 228 | emb\|X58434\|SAPD | *S. aureus* pdhB, pdhC and pdhD genes for pyruvate decarboxylase, dihydrolipoamide acetyltransferase and dihydrolipoamide dehydrogenase | 100 | 88 | 71 |
| 3125 | 1 | 233 | 3 | emb\|X89233\|SARP | *S. aureus* DNA for rpoC gene | 98 | 192 | 231 |
| 3133 | 1 | 2 | 175 | emb\|Z18852\|SACF | *S. aureus* gene for clumping factor | 96 | 54 | 174 |
| 3160 | 1 | 211 | 2 | dbj\|D10489\|STAG | *Staphylococcus aureus* genes for DNA gyrase A and B, complete cds | 89 | 197 | 210 |
| 3176 | 1 | 1 | 378 | emb\|X58434\|SAPD | *S. aureus* pdhB, pdhC and pdhD genes for pyruvate decarboxylase, dihydrolipoamide acetyltransferase and dihydrolipoamide dehydrogenase | 96 | 91 | 378 |
| 3192 | 1 | 211 | 2 | gb\|l03479\| | *S. aureus* enzyme III-lac (lacF), enzyme II-lac (lacE), and phospho-beta-galactosidase (lacG) genes, complete cda | 98 | 72 | 230 |
| 3210 | 1 | 3 | 143 | gb\|M76714\| | *Staphylococcus aureus* peptidoglycan hydrolase gene, complete cds | 96 | 141 | 141 |
| 3232 | 3 | 1282 | 458 | gb\|L14017\| | *Staphylococcus aureus* methicillin-resistance protein (mecR) gene and unknown ORF, complete cds | 71 | 257 | 825 |
| 3538 | 1 | 2 | 394 | emb\|X89233\|SARP | *S. aureus* DNA for rpoC gene | 99 | 350 | 393 |
| 3543 | 1 | 392 | 634 | gb\|L11530\| | *Staphylococcus aureus* transfer RNA sequence with two rRNAs | 99 | 102 | 243 |
| 3555 | 1 | 320 | 3 | emb\|Z18852\|SACF | *S. aureus* gene for clumping factor | 99 | 307 | 318 |
| 3559 | 1 | 3 | 182 | emb\|X37679\|SACO | *Staphylococcus aureus* coa gene for coagulase | 100 | 141 | 180 |
| 3559 | 2 | 95 | 313 | emb\|X17679\|SACO | *Staphylococcus aureus* coa gene for coagulase | 98 | 374 | 219 |
| 3563 | 1 | 141 | 4 | gb\|U35773\| | *Staphylococcus aureus* prolipoprotein diacylglyceryl transferase (lgt) gene, complete cds | 100 | 79 | 138 |
| 3563 | 2 | 363 | 199 | gb\|U35773\| | *Staphylococcus aureus* prolipoprotein diacylglyceryl transferase (lgt) gene, complete cds | 98 | 162 | 165 |
| 3566 | 1 | 3 | 422 | emb\|X16457\|SAST | *Staphylococcus aureus* gene for staphylocoagulase | 98 | 175 | 420 |
| 3588 | 1 | 2 | 262 | gb\|L43098\| | Transposon Tn5404 and insertion sequences IS1181 and IS1182 (from *Staphylococcus aureus*) DNA | 99 | 253 | 261 |
| 3593 | 1 | 3 | 350 | gb\|l03479\| | *S. aureus* enzyme lac (lacE), enzyme II-lac (lacF), and phospho-beta-galactosidase (lacG) genes, complete cds | 99 | 345 | 348 |
| 3600 | 1 | 381 | 4 | emb\|Z18852\|SACF | *S. aureus* gene for clumping factor | 72 | 346 | 378 |
| 3602 | 1 | 396 | 4 | emb\|Z18852\|SACF | *S. aureus* gene for clumping factor | 98 | 319 | 393 |
| 3656 | 1 | 528 | 43 | emb\|Z18852\|SACF | *S. aureus* gene for clumping factor | 84 | 403 | 486 |
| 3682 | 1 | 3 | 236 | emb\|X64172\|SARP | *S. aureus* rp1L, orf202, rpoB(rif) and rpoC genes for ribosomal protein L7/L12, hypothetical protein ORF202, DNA-directed RNA polymerase beta & beta' chains | 100 | 231 | 234 |
| 3682 | 2 | 224 | 415 | emb\|X64172\|SARP | *S. aureus* rp1L, orf202, rpoB(rif) and rpoC genes for ribosomal protein L7/L12, hypothetical protein ORF202, DNA-directed RNA polymerase beta & beta' chains | 100 | 112 | 192 |
| 3693 | 1 | 423 | 88 | emb\|X62992\|SAFN | *S. aureus* fnbB gene for fibromectin binding protein B | 100 | 229 | 336 |
| 3702 | 1 | 354 | 115 | gb\|L11530\| | *Staphylococcus aureus* transfer RNA sequence with two rRNAs | 96 | 81 | 240 |
| 3725 | 1 | 463 | 2 | emb\|Z18852\|SACF | *S. aureus* gene for clumping factor | 71 | 367 | 462 |
| 3761 | 1 | 450 | 91 | gb\|L14017\| | *Staphylococcus aureus* methicillin-resistance protein (mecR) gene and unknown ORF, complete cds | 85 | 333 | 360 |
| 3767 | 1 | 1 | 402 | emb\|X64172\|SARP | *S. aureus* rp1L, orf202, rpoB(rif) and rpoC genes for ribosomal protein L7/L12, hypothetical protein ORF202, DNA-directed RNA polymerase beta & beta' chains | 98 | 387 | 402 |
| 3775 | 1 | 2 | 26 | emb\|X64172\|SARP | *S. aureus* rp1L, orf202, rpoB(rif) and rpoC genes for ribosomal protein L7/L12, hypothetical protein ORF202, DNA-directed RNA polymerase beta & beta' chains | 100 | 227 | 285 |

TABLE 1-continued

S. aureus Coding regions containing known sequences

| Contig ID | ORF ID | Start (nt) | Stop (nt) | match acession | match gene name | percent ident | HSP nt length | ORF nt length |
|---|---|---|---|---|---|---|---|---|
| 3786 | 1 | 229 | 2 | dbj\|D10489\|STAG | *Staphylococcus aureus* genes for DNA gyrase A and B, complete cds | 100 | 204 | 228 |
| 3786 | 2 | 366 | 190 | dbj\|D10489\|STAG | *Staphylococcus aureus* genes for DNA gyrase A and B, complete cds | 95 | 123 | 177 |
| 3798 | 1 | 3 | 251 | emb\|X17679\|SACO | *Staphylococcus aureus* coa gene for coagulase | 99 | 249 | 249 |
| 3813 | 1 | 398 | 3 | gb\|J04151\| | *S. aureus* fibronectin-binding protein (fnbA) mRNA, complete cds | 98 | 396 | 396 |
| 3819 | 1 | 14 | 402 | emb\|X6425\|SA23 | *S. aureus* gene for 23S rRNA | 99 | 161 | 219 |
| 3844 | 1 | 46 | 4 | gb\|U48826\| | *Staphylococcus aureus* elastin binding protein (ebpS) gene, complete cds | 87 | 204 | 465 |
| 3845 | 1 | 1 | 381 | emb\|X58434\|SAPD | *S. aureus* pdhB, pdhC and pdhD genes for pyruvate decarboxylase, dihydrolipoamide acetyltransferase and dihydrolipoamide dehydrogenase | 94 | 356 | 381 |
| 3856 | 1 | 400 | 2 | gb\|L14017\| | *Staphylococcus aureus* methicillin-resistance protein (mecR) gene and unknown ORF, complete cds | 76 | 192 | 399 |
| 3859 | 1 | 573 | 97 | emb\|Z1852\|SACF | *S. aureus* gene for clumping factor | 85 | 347 | 477 |
| 3871 | 1 | 327 | 4 | gb\|M76714\| | *Staphylococcus aureus* peptidoglycan hydrolase gene, complete cds | 100 | 299 | 324 |
| 3876 | 1 | 2 | 253 | dbj\|D10489\|STAG | *Staphylococcus aureus* genes for DNA gyrase A and B, complete cds | 100 | 217 | 252 |
| 3877 | 1 | 28 | 4 | gb\|J03479\| | *S. aureus* enzyme III-lac (lacF), enzyme lac (lacE), and phospho-beta-galactosidase (lacG) genes, complete cds | 97 | 209 | 285 |
| 3878 | 1 | 1 | 237 | emb\|X58434\|SAPD | *S. aureus* pdhB, pdhC and pdhD genes for pyruvate decarboxylase, dihydrolipoamide acetyltransferase and dihydrolipoamide dehydrogenase | 96 | 155 | 237 |
| 3888 | 1 | 3 | 173 | emb\|X16457\|SAST | *Staphylococcus aureus* gene for staphylocoagulase | 98 | 171 | 171 |
| 3893 | 1 | 1 | 183 | emb\|X8923\|SARP | *S. aureus* DNA for rpoC gene 100 | 170 | 183 | 252 |
| 3893 | 2 | 11 | 357 | emb\|X9233\|SARP | *S. aureus* DNA for rpoC gene 99 | 79 | 177 | 375 |
| 3894 | 1 | 3 | 485 | emb\|K6172\|SARP | *S. aureus* rp1L, orf202, rpoB(rIf) and rpoC genes for ribosomal protein L7/L12, hypothetical protein ORF202, DNA-directed RNA polymerase beta & beta' chains | 99 | 450 | 483 |
| 3895 | 1 | 420 | 4 | gb\|J04151\| | *S. aureus* fibronectin-binding protein (fnbA) mRNA, complete cds | 99 | 411 | 417 |
| 3905 | 1 | 4 | 239 | gb\|L05004\| | *Staphylococcus aureus* dehydroquinate synthase (aroB) gene, 3' end cds; 3-phosphoshikimate-1-carboxyvinyltransferase (aroA) gene, complete cds; ORF3, complete cds | 100 | 159 | 192 |
| 3905 | 2 | 188 | 400 | gb\|L05004\| | *Staphylococcus aureus* dehydroquinate synthase (aroB) gene, 3' end cds; 3-phosphoshikimate-1-carboxyvinyltransferase (aroA) gene, complete cds; ORF3, complete cds | 97 | 88 | 233 |
| 3910 | 1 | 3 | 359 | emb\|X58434\|SAPD | *S. aureus* pdhB, pdhC and pdhD genes for pyruvate decarboxylase, dihydrolipoamide acetyltransferase and dihydrolipoamide dehydrogenase | 99 | 278 | 357 |
| 3915 | 1 | 1 | 330 | gb\|L14017\| | *Staphylococcus aureus* methicillin-resistance protein (mecR) gene and unknown ORF, complete cds | 75 | 175 | 330 |
| 3964 | 1 | 347 | 3 | emb\|Z48003\|SADN | *S. aureus* gene for DNA polymerase III | 100 | 295 | 345 |
| 4007 | 1 | 199 | 390 | emb\|X16457\|SAST | *Staphylococcus aureus* gene for staphylocoagulase | 98 | 163 | 192 |
| 4036 | 1 | 3 | 371 | dbj\|D10489\|STAG | *Staphylococcus aureus* genes for DNA gyrase A and B, complete cds | 99 | 339 | 369 |
| 4046 | 1 | 348 | 4 | emb\|Z18852\|SACF | *S. aureus* gene for clumping factor | 87 | 221 | 345 |
| 4060 | 1 | 1 | 375 | emb\|Z18852\|SACF | *S. aureus* gene for clumping factor | 96 | 271 | 375 |
| 4061 | 1 | 432 | 4 | emb\|Z48003\|SADN | *S. aureus* gene for DNA polymerase | 99 | 429 | 429 |
| 4062 | 1 | 304 | 2 | gn\|L14017\| | *Staphylococcus aureus* methicillin-resistance protein (mecR) gene and unknown ORF, complete cds | 75 | 198 | 303 |
| 4085 | 1 | 58 | 402 | gb\|U11786\| | *Staphylococcus aureus* methicillin-resistant ATCC 33952 clone RRNV42 16S-23S rRNA spacer region | 98 | 127 | 345 |
| 4088 | 1 | 2 | 301 | gb\|L43098\| | Transposon Tn5404 and insertion sequences IS1181 and IS1182 (from *Staphylococcus aureus*) DNA | 99 | 227 | 300 |

TABLE 1-continued

S. aureus Coding regions containing known sequences

| Contig ID | ORF ID | Start (nt) | Stop (nt) | match acession | match gene name | percent ident | HSP nt length | ORF nt length |
|---|---|---|---|---|---|---|---|---|
| 4093 | 1 | 2 | 277 | emb\|X58434\|SAPD | S. aureus pdhB, pdhC and pdhD genes for pyruvate decarboxylase, dihydrolipoamide acetyltransferase and dihydrolipoamide dehydrogenase | 99 | 276 | 276 |
| 4097 | 1 | 1 | 402 | emb\|Z18852\|SACF | S. aureus gene for clumping factor | 74 | 307 | 402 |
| 4116 | 1 | 22 | 402 | gb\|L05004\| | Staphylococcus aureus dehydroquinate synthase (aroB) gene, 3' end cds: 3-phosphoshikimate-1-carboxyvinyltransferase (aroA) gene, complete cds; ORF3, complete cds | 98 | 157 | 381 |
| 4125 | 1 | 240 | 401 | gb\|U73374\| | Staphylococcus aureus type 8 capsule genes, cap8A, cap8B, cap8C, cap8D, cap8E, cap8F, cap8G, cap8H, cap8I, cap8J, cap8K, cap8L, cap8M, cap8N, cap8O, cap8P, complete cds | 100 | 86 | 162 |
| 4149 | 1 | 35 | 247 | gb\|J04151\| | S. aureus fibronectin-binding protein (fnbA) mRNA, complete cds | 99 | 200 | 213 |
| 4151 | 1 | 366 | 103 | gb\|L14017\| | Staphylococcus aureus methicillin-resistance protein (mecR) gene and unknown ORF, complete cds | 87 | 150 | 264 |
| 4154 | 1 | 398 | 42 | emb\|X64172\|SARP | S. aureus rp1L, orf202, rpoB(rif) and rpoC genes for ribosomal protein L7/L12, hypothetical protein ORF202, DNA-directed RNA polymerase beta & beta' chains | 99 | 297 | 357 |
| 4179 | 1 | 1 | 294 | emb\|X64172\|SARP | S. aureus rp1L, orf202, rpoB(rif) and rpoC genes for ribosomal protein L7/L12, hypothetical protein ORF202, DNA-directed RNA polymerase beta & beta' chains | 98 | 240 | 294 |
| 4203 | 1 | 1 | 255 | emb\|X89233\|SARP | S. aureus DNA for rpoC gene | 99 | 239 | 255 |
| 4206 | 1 | 1 | 303 | emb\|Z18852\|SACF | S. aureus gene for clumping factor | 100 | 236 | 303 |
| 4206 | 2 | 195 | 344 | emb\|Z18552\|SACF | S. aureus gene for clumping factor | 95 | 65 | 150 |
| 4208 | 1 | 108 | 314 | emb\|X58434\|SAPD | S. aureus pdhB, pdhC and pdhD genes for pyruvate decarboxylase, dihydrolipoamide acetyltransferase and dihydrolipoamide dehydrogenase | 89 | 76 | 207 |
| 4216 | 1 | 330 | 4 | emb\|X58434\|SAPD | S. aureus pdhB, pdhC and pdhD genes for pyruvate decarboxylase, dihydrolipoamide acetyltransferase and dihydrolipoamide dehydrogenase | 99 | 326 | 327 |
| 4226 | 1 | 298 | 2 | gb\|L11530\| | Staphylococcus aureus transfer RNA sequence with two rRNAs | 97 | 132 | 297 |
| 4260 | 1 | 216 | 383 | gb\|U11784\| | Staphylococcus aureus methicillin-resistant AITCC 33952 clone RRNV40 16S-23S rRNA spacer region | 83 | 141 | 168 |
| 4272 | 1 | 179 | 3 | emb\|Z48003\|SADN | S. aureus gene for DNA polymerase | 100 | 164 | 277 |
| 4276 | 1 | 4 | 177 | emb\|X16457\|SAST | Staphylococcus aureus gene for staphylocoagulase | 99 | 150 | 174 |
| 4277 | 1 | 1 | 270 | emb\|X64172\|SARP | S. aureus rp1L, orf202, rpoB(rif) and rpoC genes for ribosomal protein L7/L12, hypothetical protein ORF202, DNA-directed RNA polymerase beta & beta' chains | 99 | 265 | 270 |
| 4282 | 1 | 377 | 63 | emb\|X64172\|SARP | S. aureus rp1L, orf202, rpoB(rif) and rpoC genes for ribosomal protein L7/L12, hypothetical protein ORF202, DNA-directed RNA polymerase beta & beta' chains | 98 | 282 | 315 |
| 4291 | 1 | 191 | 3 | emb\|X64172\|SARP | S. aureus rp1L, orf202, rpoB(rif) and rpoC genes for ribosomal protein L7/L12, hypothetical protein ORF202, DNA-directed RNA polymerase beta & beta' chains | 99 | 183 | 289 |
| 4295 | 1 | 3 | 329 | emb\|X16457\|SAST | Staphylococcus aureus gene for staphylocoagulase | 94 | 144 | 327 |
| 4313 | 1 | 280 | 125 | gb\|L11530\| | Staphylococcus aureus transfer RNA sequence with two rRNAs | 100 | 94 | 156 |
| 4315 | 1 | 3 | 185 | gb\|J03479\| | S. aureus enzyme III-lac (lacF), enzyme II-lac (lacE), and phospho-beta-galactosidase (lacG) genes, complete cds | 100 | 158 | 183 |
| 4315 | 2 | 101 | 310 | gb\|J03479\| | S. aureus enzyme lac (lacF), enzyme lac (lacE), and phospho-beta-galactosidase (lacG) genes, complete cds | 98 | 75 | 210 |
| 4327 | 1 | 1 | 294 | gb\|L43098\| | Transposon Tn5404 and insertion sequences IS1181 and IS1182 from Staphylococcus aureus DNA | 98 | 294 | 294 |

TABLE 1-continued

S. aureus Coding regions containing known sequences

| Contig ID | ORF ID | Start (nt) | Stop (nt) | match acession | match gene name | percent ident | HSP nt length | ORF nt length |
|---|---|---|---|---|---|---|---|---|
| 4360 | 1 | 319 | 35 | gb|U02910| | Staphylococcus aureus ATCC 25923 16S rRNA gene, partial sequence | 100 | 116 | 285 |
| 4364 | 1 | 3 | 46 | emb|X64172|SARP | S. aureus rplL, orf202, rpoB(rif) and rpoC genes for ribosomal protein L7/L12, hypothetical protein ORF202, DNA-directed RNA polymerase beta & beta' chains | 95 | 140 | 144 |
| 4388 | 1 | 167 | 310 | emb|X62992|SAFN | S. aureus fnbB gene for fibronectin binding protein B | 73 | 119 | 144 |
| 4403 | 1 | 2 | 313 | emb|X62992|SAFN | S. aureus fnhB gene for fibronectin binding protein B | 97 | 243 | 312 |
| 4423 | 1 | 36 | 281 | dbj|D12572|STA2 | Staphylococcus aureus rrnA gene for 23S ribosomal RNA | 100 | 112 | 246 |
| 4426 | 1 | 3 | 293 | emb|Z8852|SACF | S. aureus gene for clumping factor | 85 | 185 | 291 |
| 4428 | 1 | 248 | 3 | emb|X64172|SARP | S. aureus rplL, orf202, rpoB(rif) and rpoC genes for ribosomal protein L7/L12, hypothetical protein ORF202, DNA-directed RNA polymerase beta & beta' chains | 100 | 139 | 246 |
| 4462 | 1 | 2 | 271 | emb|X64172|SARP | S. aureus rplL, orf202, rpoB(rif) and rpoC genes for ribosomal protein L7/L12, hypothetical protein ORF202, DNA-directed RNA polymerase beta & beta' chains | 99 | 270 | 270 |
| 4466 | 1 | 1 | 240 | emb|Z18852|SACF | S. aureus gene for clumping factor | 99 | 231 | 240 |
| 4469 | 1 | 1 | 312 | gb|J03479| | S. aureus enzyme lac (lacF) enzyme II-lac (lacE) and phospho-beta-galactosidase (lacG) genes, complete cds | 99 | 265 | 312 |
| 4485 | 1 | 3 | 263 | gb|L43098| | Transposon Tn5404 and insertion sequences IS1181 and IS1182 (from Staphylococcus aureus) DNA | 98 | 259 | 261 |
| 4492 | 1 | 74 | 400 | gb|M86227| | Staphylococcus aureus DNA gyrase B subunit (gyrB) RecF homologue (recF) and DNA gyrase A subunit (gyrA) gene, complete cds | 85 | 104 | 327 |
| 4497 | 1 | 269 | 3 | emb|Z18852|SACF | S. aureus gene for clumping factor | 99 | 213 | 267 |
| 4529 | 1 | 2 | 172 | emb|X64172|SARP | S. aureus rplL, orf202, rpoB(rif) and rpoC genes for ribosomal protein L7/L12, hypothetical protein ORF202, DNA-directed RNA polymerase beta & beta' chains | 100 | 151 | 171 |
| 4547 | 1 | 1 | 300 | emb|X62992|SAFN | S. aureus fnbB gene for fibronectin binding protein B | 100 | 157 | 300 |
| 4554 | 1 | 160 | 2 | emb|Z18852|SACF | S. aureus gene for clumping factor | 84 | 126 | 159 |
| 4565 | 1 | 9 | 227 | emb|Z18852|SACF | S. aureus gene for clumping factor | 84 | 213 | 219 |
| 4569 | 1 | 79 | 222 | emb|Z18852|SACF | S. aureus gene for clumping factor | 98 | 127 | 144 |
| 4608 | 1 | 22 | 216 | emb|X58434|SAPD | S. aureus pdhB, pdhC and pdhD genes for pyruvate decarboxylase, dihydrolipoamide acetyltransferase and dihydrolipoamide dehydrogenase | 92 | 168 | 195 |
| 4614 | 1 | 234 | 4 | emb|Z18852|SACF | S. aureus gene for clumping factor | 86 | 169 | 231 |
| 4623 | 1 | 105 | 302 | gb|J04151| | S. aureus fibronectin-binding protein (fnbA) mRNA, complete cds | 99 | 152 | 198 |
| 4632 | 1 | 18 | 206 | gb|J03479| | S. aureus fibronectin-binding protein III-lac (lacF), enzyme II-lac (lacE) and phospho-beta-galactosidase (lacG) genes, complete cds | 98 | 183 | 189 |
| 4646 | 1 | 1 | 222 | emb|Z18852|SACF | S. aureus gene for clumping factor | 84 | 100 | 222 |
| 4687 | 1 | 2 | 166 | gb|J04151| | S. aureus fibronectin-binding protein (fnbA) mRNA, complete cds | 98 | 156 | 165 |
| 4695 | 1 | 158 | 3 | gb|L14017| | Staphylococcus aureus methicillin-resistance protein (mecR) gene and unknown ORF, complete cds | 75 | 155 | 156 |
| 4703 | 1 | 1 | 153 | emb|X58434|SAPD | S. aureus pdhB, pdhC and pdhD genes for pyruvate decarboxylase, dihydrolipoamide acetyltransferase and dihydrolipoamide dehydrogenase | 98 | 103 | 153 |

TABLE 2

*S. aureus*-Putative coding regions of novel proteins similar to known proteins

| Contig ID | ORF ID | Start (nt) | Stop (nt) | match acession | match gene name | % sim | % ident | length (nt) |
|---|---|---|---|---|---|---|---|---|
| 20 | 6 | 4679 | 4269 | gi\|511839 | ORF1 [*Staphylococcus bacteriophage* phi 11] | 100 | 100 | 411 |
| 149 | 3 | 1577 | 1122 | pir\|B49703\|B497 | int gene activator RinA-bacteriophage phi 11 | 100 | 100 | 456 |
| 149 | 5 | 1912 | 1715 | gi\|166161 | Bacteriophage phi-11 int gene activator [*Staphylococcus acteriophage* phi 11] | 100 | 100 | 198 |
| 349 | 2 | 409 | 260 | gi\|166159 | integrase (int) [*Staphylococcus bacteriophage* phi 11] | 100 | 100 | 150 |
| 398 | 1 | 707 | 42 | gi\|166159 | integrase (int) [*Staphylococcus bacteriophage* phi 11] | 100 | 99 | 666 |
| 398 | 2 | 783 | 1001 | gi\|455128 | excisionase (xi) [*Staphylococcus bacteriophage* phi 11] | 100 | 100 | 239 |
| 502 | 4 | 1744 | 1574 | gi\|1204912 | M. influenzae predicted coding region HI0660 [*Haemophilus influenzae*] | 100 | 71 | 171 |
| 849 | 1 | 2 | 262 | gi\|1373002 | polyprotein (Bean common mosaic virus) | 100 | 46 | 261 |
| 1349 | 1 | 140 | 3 | gi\|143359 | protein synthesis initiation factor 2 (infB) [*Bacillus subtilis*] gi\|49319 IF2 gene product [*Bacillus subtilis*] | 100 | 82 | 138 |
| 2880 | 1 | 21 | 308 | gi\|862933 | protein kinase C inhibitor-I [Homo sapiens] | 100 | 98 | 288 |
| 3085 | 1 | 216 | 4 | gi\|1354213 | PET112-like protein [*Bacillus subtilis*] | 100 | 100 | 213 |
| 4168 | 2 | 398 | 225 | gi\|1354211 | PET112-like protein [*Bacillus subtilis*] | 100 | 100 | 174 |
| 311 | 1 | 2 | 247 | gi\|426473 | nusG gene product [*Staphylococcus carnosus*] | 98 | 95 | 246 |
| 207 | 2 | 1272 | 1463 | gi\|460259 | enolase [*Bacillus subtilis*] | 97 | 90 | 192 |
| 331 | 2 | 395 | 850 | gi\|581638 | L11 protein [*Staphylococcus carnosus*] | 97 | 93 | 456 |
| 366 | 1 | 39 | 215 | gi\|166161 | Bacteriophage phi-11 int gene activator [*Staphylococcus acteriophage* phi 11] | 97 | 95 | 177 |
| 680 | 3 | 718 | 936 | gi\|426473 | nusG gene product [*Staphylococcus carnosus*] | 97 | 97 | 219 |
| 3578 | 1 | 144 | 4 | gi\|1339950 | large subunit of NADH-dependent glutamate synthase [*Plectonema boryanum*] | 97 | 79 | 141 |
| 157 | 1 | 321 | 518 | gi\|1022726 | unknown [*Staphlococcus haemolyticus*] | 96 | 88 | 198 |
| 205 | 33 | 16147 | 15824 | gi\|1165302 | S10 [*Bacillus subtilis*] | 96 | 91 | 324 |
| 3919 | 1 | 48 | 401 | gi\|871784 | Clp-like ATP-dependent protease binding subunit [*Bos taurus*] | 96 | 81 | 354 |
| 4133 | 1 | 417 | 4 | gi\|1022726 | unknown [*Staphylococcus haemolyticus*] | 96 | 84 | 414 |
| 4168 | 1 | 355 | 2 | gi\|1354211 | PET112-like protein [*Bacillus subtilis*] | 96 | 95 | 354 |
| 4207 | 1 | 157 | 2 | gi\|602031 | similar to trimethylamine DH [*Mycoplasma capricolum*] pir\|S49950\|S49950 probable trimethylamine dehydrogenase (EC .5.99.7)-*Mycoplasma capricolum* (SGC3) (fragment) | 96 | 86 | 156 |
| 4227 | 2 | 152 | 333 | gi\|1871784 | Clp-like ATP-dependent protease binding subunit [*Bos taurus*] | 96 | 81 | 180 |
| 4418 | 1 | 286 | 2 | gi\|11022726 | unknown [*Staphylococcus haemoyticus*] | 96 | 84 | 285 |
| 22 | 1 | 430 | 2 | gi\|1511070 | UreG [*Staphylococcus xylosus*] | 95 | 88 | 429 |
| 22 | 7 | 4036 | 3710 | gi\|1581787 | urease gamma subunit [*Staphylococcus xylosus*] | 95 | 79 | 327 |
| 82 | 6 | 8794 | 9114 | pir\|JG0008\|JG00 | ribosomal protein S7-*Bacillus stearothermophilus* | 95 | 83 | 321 |
| 154 | 9 | 7838 | 6396 | gi\|1354211 | PET112-like protein [*Bacillus subtilis*] | 95 | 92 | 1443 |
| 186 | 3 | 2055 | 1312 | gi\|1514656 | serine O-acetyltransrerase [*Staphylococcus xylosus*] | 95 | 87 | 744 |
| 205 | 5 | 4014 | 3622 | gi\|142462 | ribosomal protein S11 [*Bacillus subtilis*] | 95 | 85 | 393 |
| 205 | 7 | 4793 | 4569 | gi\|142459 | initiation factor 1 [*Bacillus subtilis*] | 95 | 84 | 225 |
| 205 | 21 | 10991 | 10617 | gi\|1044974 | ribosomal protein L14 [*Bacillus subtilis*] | 95 | 93 | 375 |
| 259 | 5 | 6644 | 6000 | sp\|P47995\|YSEA_ | HYPOTHETICAL PROTEIN IN SECA 5'REGION (ORF1) (FRAGMENT). | 95 | 85 | 645 |
| 302 | 3 | 795 | 1097 | gi\|40186 | homologous to E. coli ribosomal protein L27 [*Bacillus subtilis*] i\|143592 L27 ribosomal protein [*Bacillus subtilis*] ir\|C21895\|C21895 ribosomal protein L27-*Bacillus subtilis* p\|P05657\|RL27_BACSU 50S RIBOSOMAL PROTEIN L27 (BL30) (BL24). i\|40175 L24 gene prod | 95 | 89 | 303 |
| 310 | 1 | 579 | 1523 | gi\|1177684 | chorismate mutase [*Staphylococcus xylosus*] | 95 | 92 | 945 |
| 414 | 1 | 2 | 163 | (pir\|C48396\|C483 | ribosomal protein L34-*Bacillus stearothermophilus* | 95 | 90 | 162 |
| 4185 | 2 | 125 | 277 | gi\|1276841 | glutamate synthase (GOGAT) [*Porphyra purpurea*] | 95 | 86 | 153 |
| 22 | 2 | 723 | 418 | gi\|511069 | UreF [*Staphylococcus xylosus*] | 94 | 91 | 308 |
| 22 | 5 | 3310 | 1574 | gi\|410516 | urease alpha subunit [*Staphylococcus xylosus*] | 94 | 85 | 1737 |
| 60 | 4 | 815 | 1372 | gi\|666116 | glucose kinase [*Staphylococcus xylosus*] | 94 | 87 | 558 |
| 205 | 18 | 9536 | 9060 | gi\|1044978 | ribosomal protein 58 [*Bacillus subtilis*] | 94 | 78 | 477 |
| 326 | 4 | 2542 | 1706 | gi\|557492 | dihydroxynapthoic acid (DNNA) synthetase [*Bacillus subtilis*] gi\|143186 dihydroxynapthoic acid (DNNA) synthetase [*Bacillus subtilis*] | 94 | 85 | 837 |
| 414 | 3 | 737 | 955 | gi\|467386 | thiophen and furen oxidation [*Bacillus subtilis*] | 94 | 77 | 219 |
| 426 | 3 | 1823 | 1386 | gi\|1263908 | putative [*Staphylococcus epidermidis*] | 94 | 87 | 438 |
| 534 | 1 | 2 | 355 | gi\|633650 | enzyme II(mannitol) [*Staphylococcus carnosus*] | 94 | 84 | 354 |
| 1017 | 1 | 2 | 229 | gi\|149435 | putative [*Lactococcus lactis*] | 94 | 73 | 228 |
| 3098 | 1 | 184 | 38 | gi\|413952 | ipa-28d gene product [*Bacillus subtilis*] | 94 | 50 | 147 |
| 3232 | 1 | 316 | 2 | gi\|1022725 | unknown [*Staphylococcus haemolyticus*] | 94 | 84 | 315 |
| 42 | 5 | 2089 | 2259 | pir\|848396\|B483 | ribosomal protein L33-*Bacillus stearothermophilus* | 93 | 81 | 171 |
| 101 | 2 | 1383 | 1021 | gi\|155345 | arsenic efflux pump protein [Plasmid pSX267] | 93 | 82 | 363 |
| 205 | 24 | 11865 | 11503 | sp\|P14577\|RL16_ | 50S RIBOSOMAL PROTEIN L16. | 93 | 83 | 363 |
| 259 | 4 | 5673 | 3055 | gi\|499335 | secA protein [*Staphylococcus carnosus*] | 93 | 85 | 2619 |
| 275 | 1 | 1114 | 2 | gi\|633650 | enzyme II(mannitol) [*Staphylococcus carnosus*] | 93 | 86 | 1113 |
| 444 | 6 | 5773 | 5339 | gi\|1022726 | unknown [*Staphylococcus haemolyticus*] | 93 | 81 | 435 |
| 491 | 1 | 152 | 622 | gi\|46912 | ribosomal protein L13 [*Staphylococcus carnosus*] | 93 | 88 | 471 |
| 607 | 6 | 1674 | 2033 | gi\|1022726 | unknown [*Staphylococcus haemolyticus*] | 93 | 83 | 360 |
| 653 | 1 | 488 | 3 | gi\|580890 | translation initiation factor 1F3 (AA 1-172) [*Bacillus tearothermophilus*] | 93 | 77 | 486 |

TABLE 2-continued

| | | | | | | | | |
|---|---|---|---|---|---|---|---|---|
| 1864 | 1 | 3 | 194 | gi\|306553 | ribosomal protein small subunit [Homo sapiens] | 93 | 93 | 192 |
| 2997 | 1 | 28 | 300 | gi\|143390 | carbamyl phosphate synthetase [Bacillus subtilis] | 93 | 82 | 273 |
| 3232 | 2 | 596 | 285 | gi\|1022725 | unknown [Staphylococcus haemolyticus] | 93 | 84 | 312 |
| 3761 | 2 | 621 | 448 | gi\|1022725 | unknown [Staphylococcus haemolyticus] | 93 | 88 | 174 |
| 16 | 1 | 3 | 374 | gi\|142781 | putative cytoplasmic protein: putative [Bacillus subtilis] sp\|P37954\|UVRB_BACSU EXCINUCLEASE ABC SUBUNIT B (DINA PROTEIN) FRAGMENT). | 92 | 83 | 372 |
| 31 | 7 | 5915 | 6124 | gi\|1136430 | KIAA0185 protein [Homo sapiens] | 92 | 46 | 210 |
| 56 | 19 | 26483 | 27391 | gi\|467401 | unknown [Bacillus subtilis] | 92 | 80 | 909 |
| 69 | 6 | 5882 | 6130 | gi\|530200 | trophoblastin [Ovis aries] | 92 | 53 | 249 |
| 145 | 3 | 2038 | 1508 | gi\|1022725 | unknown [Staphylococcus haemolyticus] | 92 | 80 | 531 |
| 171 | 3 | 2362 | 1964 | gi\|517475 | D-amino acid transaminase [Staphylococcus haemolyticus] | 92 | 86 | 399 |
| 205 | 12 | 6962 | 6429 | gi\|49189 | secY gene product [Staphylococcus carnosus] | 92 | 85 | 534 |
| 205 | 19 | 10255 | 9698 | gi\|1044976 | ribosomal protein L5 [Bacillus subtilis] | 92 | 82 | 558 |
| 219 | 1 | 357 | | gi\|1303812 | YqeV [Bacillus subtilis] | 92 | 88 | 354 |
| 344 | 3 | 1575 | 1805 | gi\|1405474 | CspC protein [Bacillus cereua] | 92 | 85 | 231 |
| 699 | 1 | 20 | 361 | gi\|413999 | ipa-75d gene product [Bacillus subtilis] | 92 | 81 | 342 |
| 1343 | 1 | 2 | 160 | pir\|A45434\|A454 | ribosomal protein L19-Bacillus stearothermophilus | 92 | 84 | 159 |
| 1958 | 1 | 264 | 4 | gi\|407908 | EIIscr [Staphylococcus xylosus] | 92 | 80 | 261 |
| 3578 | 2 | 386 | 54 | gi\|1339950 | large subunit of NADH-dependent glutamate synthase [Plectonema boryanum] | 92 | 78 | 333 |
| 3585 | 1 | 324 | 4 | gi\|1339950 | large subunit of NADH-dependent glutamate synthase [Plectonema boryanum] | 92 | 81 | 321 |
| 3640 | 1 | 4 | 402 | gi\|1022726 | unknown [Staphylococcus haemolyticus] | 92 | 81 | 399 |
| 4362 | 1 | 14 | 178 | gi\|450688 | hsdM gene of EcoprrI gene product [Escherichia coli] pir\|S38437\|S38437 hsdM protein-Escherichia coli pir\|S09629\|S09629 hypothetical protein A-Escherichia coli (SUB 40-520) | 92 | 78 | 165 |
| 4446 | 1 | 182 | 6 | gi\|1022725 | unknown [Staphylococcus haemolyticus] | 92 | 82 | 177 |
| 4549 | 1 | 232 | 2 | gi\|1022726 | unknown [Staphylococcus haemolyticus] | 92 | 80 | 231 |
| 4626 | 1 | 3 | 224 | gi\|1022725 | unknown [Staphylococcus haemolyticus] | 92 | 84 | 222 |
| 2 | 4 | 3980 | 4531 | gi\|535349 | CodW [Bacillus subtilis] | 91 | 74 | 552 |
| 28 | 1 | 2 | 1126 | gi\|1001376 | hypothetical protein [Synechocystis sp.] | 91 | 78 | 1125 |
| 60 | 5 | 1354 | 1701 | gi\|1226043 | orf2 downstream of glucose kinase [Staphylococcus xylosus] | 91 | 80 | 348 |
| 101 | 1 | 036 | 83 | gi\|150728 | arsenic efflux pump protein [Plasmid p1258] | 91 | 80 | 954 |
| 187 | 2 | 412 | 1194 | gi\|142559 | ATP synthase alpha subunit [Bacillus megaterium] | 91 | 79 | 783 |
| 205 | 22 | 11298 | 11017 | gi\|40149 | S17 protein AA 1-87) [Bacillus subtilis] | 91 | 83 | 282 |
| 206 | 7 | 8184 | 10262 | gi\|1072418 | glcA gene product [Staphylococcus carnosus] | 91 | 83 | 2079 |
| 306 | 2 | 2326 | 767 | gi\|143012 | GNP synthetase [Bacillus subtilis] | 91 | 78 | 1560 |
| 306 | 3 | 3826 | 2333 | gi\|467398 | IMP dehydrogenase [Bacillus subtilis] | 91 | 79 | 1494 |
| 310 | 3 | 2194 | 3207 | gi\|1177685 | ccpA gene product [Staphylococcus xylosus] | 91 | 81 | 1014 |
| 343 | 4 | 2974 | 3150 | gi\|949974 | sucrose repressor [Staphylococcus xylosus] | 91 | 82 | 177 |
| 480 | 3 | 1606 | 3042 | gi\|433991 | ATP synthase subunit beta [Bacillus subtilis] | 91 | 85 | 1437 |
| 536 | 3 | 1280 | 534 | gi\|143366 | adenylosuccinate lyase (PUR-s) [Bacillus subtilis] pir\|C29326\|WZBSDS adenylosuccinate lyase (EC 4.3.2.2)-Bacillus subtilis | 91 | 79 | 747 |
| 552 | 1 | 615 | 166 | gi\|297874 | fructose-bisphosphate aldolase [Staphylococcus carnosus] pir\|A49943\|A49943 fructose-bisphosphate aldolase (EC 4.1.2.13)-taphylococcus carnosus (strain TN300) | 91 | 79 | 450 |
| 637 | 1 | 1 | 1536 | gi\|143597 | CTP synthetase [Bacillus subtilis] | 91 | 79 | 1536 |
| 859 | 1 | 21 | 359 | gi\|385178 | unknown [Bacillus subtilis] | 91 | 66 | 339 |
| 1327 | 1 | 339 | 530 | gi\|496558 | orfX [Bacillus subtilis] | 91 | 71 | 192 |
| 2515 | 1 | 275 | 84 | gi\|511070 | UreG [Staphylococcus xylosus] | 91 | 85 | 192 |
| 2594 | 1 | 2 | 202 | gi\|146824 | beta-cystathionase [Escherichia coli] | 91 | 75 | 201 |
| 3764 | 1 | 425 | 3 | gi\|1022725 | unknown [Staphylococcus haemolyticus] | 91 | 78 | 423 |
| 4031 | 1 | 127 | 495 | gi\|1022726 | unknown [Staphylococcus haemolyticus] | 91 | 79 | 369 |
| 4227 | 1 | 1 | 177 | gi\|1296464 | ATPase [Lactococcus lactis] | 91 | 66 | 177 |
| 42 | 3 | 815 | 1033 | gi\|520401 | catalase [Haemophilus influenzae] | 90 | 86 | 219 |
| 51 | 8 | 3717 | 4607 | gi\|580899 | OppF gene product [Bacillus subtilis] | 90 | 74 | 891 |
| 129 | 3 | 4001 | 2685 | gi\|1146206 | glutamate dehydrogenase [Bacillus subtilis] | 90 | 76 | 1317 |
| 164 | 17 | 16628 | 16933 | sp\|P05766\|RS15_ | 30S RIBOSOMAL PROTEIN S15 (BS18). | 90 | 74 | 306 |
| 171 | 5 | 2819 | 2655 | gi\|517475 | D-amino acid transaminase [Staphylococcus haemolyticus] | 90 | 78 | 165 |
| 205 | 4 | 3550 | 2603 | gi\|142463 | RNA polyserase alpha-core-subunit [Bacillus subtilis] | 90 | 76 | 948 |
| 205 | 6 | 4410 | 4072 | gi\|1044989 | ribosomal protein S13 [Bacillus subtilis] | 90 | 73 | 339 |
| 205 | 10 | 6404 | 5643 | gi\|49189 | secY gene product [Staphylococcus carnosus] | 90 | 81 | 762 |
| 205 | 11 | 6472 | 6299 | gi\|49189 | secY gene product [Staphylococcus carnosus] | 90 | 78 | 174 |
| 205 | 27 | 13345 | 2998 | gi\|786157 | Ribosomal Protein S19 [Bacillus subtilis] | 90 | 79 | 348 |
| 205 | 31 | 15496 | 15134 | gi\|1165303 | L3 [Bacillus subtilis] | 90 | 79 | 363 |
| 260 | 5 | 5773 | 4523 | gi\|1161380 | IcaA [Staphylococcus epidermidis] | 90 | 78 | 1251 |
| 299 | 6 | 3378 | 3947 | gi\|467440 | phosphoribosylpyrophosphate synthetase [Bacillus subtilis] gi\|40218 PRPP synthetase (AA 1-317) [Bacillus subtilis] | 90 | 78 | 570 |
| 320 | 2 | 1025 | 1717 | gi\|312443 | carbamoyl-phosphate synthase (glutamine-hydrolysing) [Bacillus aldolyticus] | 90 | 75 | 693 |
| 330 | 4 | 1581 | 1769 | gi\|986963 | beta-tubulin [Sporidiobolus pararoseus] | 90 | 80 | 189 |
| 369 | 1 | 523 | 92 | pir\|S34762\|S347 | L-serine dehydratase beta chain-Clostridium sp. | 90 | 77 | 432 |
| 557 | 1 | 3 | 188 | gi\|1511589 | M. jannaschii predicted coding region NJ1624 [Methanococcus jannaschii] | 90 | 54 | 186 |
| 663 | 2 | 667 | 1200 | gi\|143786 | tryptophanyl-tRNA synthetase (EC 6.1.1.2) [Bacillus subtilis] pir\|JT0481\|YWBS tryptophan-tRHA ligase (EC 6.1.1.2)-Bacillus ubtilis | 90 | 73 | 534 |

TABLE 2-continued

| | | | | | | | | |
|---|---|---|---|---|---|---|---|---|
| 717 | 1 | 1 | 261 | gi\|143065 | hubst [*Bacillus stearothermophilus*] | 90 | 79 | 261 |
| 745 | 4 | 865 | 671 | gi\|1205433 | *H. influenzae* predicted coding region HI1190 [*Haemophilus influenzae*] | 90 | 81 | 195 |
| 1007 | 1 | 386 | 565 | gi\|143366 | adenylosuccinate lyase (PUR-B) [*Bacillus subtilis*] pir\|C29326\|WZBSDS adenylosuccinate lyase (EC 4.3.2.2)-*Bacillus ubtilis* | 90 | 77 | 180 |
| 1054 | 1 | 331 | 83 | gi\|1033122 | ORF_f729 [*Escherichia coli*] | 90 | 50 | 249 |
| 1156 | 1 | 117 | 707 | gi\|1477776 | ClpP [*Bacillus subtilis*] | 90 | 80 | 591 |
| 1180 | 1 | 205 | 2 | gi\|1377831 | unknown [*Bacillus subtilis*] | 90 | 74 | 204 |
| 1253 | 1 | 1 | 462 | gi\|40046 | phosphoglucose isomerase A (AA 1-449) [*Bacillus stearothermophilus*] ir\|S15936\|BUBSSA glucose-6-phosphate isomerase (EC 5.3.1.9)A-*cillus stearothermophilus* | 90 | 75 | 462 |
| 2951 | 1 | 3 | 269 | gi\|144816 | formyltetrahydrofolate synthetase (FTHFS) (ttg start codon) (EC .3.4.3) [*Moorella theraoacetica*] | 90 | 76 | 267 |
| 3140 | 1 | 166 | 5 | gi\|1070014 | protein-dependent [*Bacillus subtilis*] | 90 | 52 | 162 |
| 4594 | 1 | 3 | 233 | gi\|871784 | Clp-like ATP-dependent protease binding subunit [*Bos taurus*] | 90 | 76 | 231 |
| 87 | 1 | 1028 | 1750 | gi\|467327 | unknown [*Bacillus subtilis*] | 89 | 75 | 723 |
| 112 | 1 | 2 | 505 | gi\|153741 | ATP-binding protein [*Streptococcus mutans*] | 89 | 77 | 504 |
| 118 | 1 | 120 | 398 | gi\|1303804 | YqeQ [*Bacillus subtilis*] | 89 | 75 | 279 |
| 128 | 4 | 3545 | 3757 | gi\|460257 | triose phosphate isomerase [*Bacillus subtilis*] | 89 | 84 | 213 |
| 164 | 12 | 11667 | 12755 | gi\|39954 | IF2 (aa 1-741) [*Bacillus stearothermophilus*] | 89 | 80 | 1089 |
| 205 | 13 | 7405 | 6935 | gi\|216338 | ORF for L15 ribosomal protein [*Bacillus subtilis*] | 89 | 76 | 471 |
| 205 | 32 | 15823 | 15494 | gi\|1165303 | L3 [*Bacillus subtilis*] | 89 | 80 | 330 |
| 270 | 3 | 2207 | 2007 | pir\|C41902\|C419 | arsenate reductase (EC 1.-.-.-)-*Staphylococcus xylosus* plasmid pSX267 | 89 | 81 | 201 |
| 395 | 2 | 157 | 672 | gi\|520574 | glutamate racemate [*Staphylococcus haemolyticus*] | 89 | 80 | 516 |
| 494 | 1 | 3 | 839 | gi\|396259 | protease [*Staphylococcus epidermidis*] | 89 | 77 | 837 |
| 510 | 1 | 1 | 444 | gi\|40046 | phosphoglucose isomerase A (AA 1-449) [*Bacillus stearothermophilus*] ir\|S15936\|NUBSSA glucose-6-phosphate isomerase (EC 5.3.1.9) A-*cillus stearothermophilus* | 89 | 74 | 444 |
| 615 | 1 | 1210 | 296 | gi\|1303812 | YqeV [*Bacillus subtilis*] | 89 | 74 | 915 |
| 841 | 1 | 18 | 341 | gi\|1165303 | L3 [*Bacillus subtilis*] | 89 | 80 | 324 |
| 1111 | 1 | 352 | 813 | gi\|47146 | thermonuclease [*Staphylococcus intermedius*] | 89 | 70 | 462 |
| 1875 | 1 | 2 | 256 | gi\|1205108 | ATP-dependent protease binding subunit [*Haemophilus influenzae*] | 89 | 82 | 255 |
| 2963 | 1 | 11 | 367 | gi\|467458 | cell division protein [*Bacillus subtilis*] | 89 | 83 | 357 |
| 3020 | 1 | 90 | 362 | gi\|1239988 | hypothetical protein [*Bacillus subtilis*] | 89 | 66 | 273 |
| 3565 | 1 | 2 | 400 | gi\|1256635 | dihydroxy-acid dehydratase [*Bacillus subtilis*] | 89 | 75 | 399 |
| 3586 | 1 | 105 | 314 | gi\|1580832 | ATP synthase subunit gamma [*Bacillus subtilis*] | 89 | 82 | 210 |
| 3629 | 1 | 399 | 4 | gi\|1009366 | Respiratory nitrate reductase[*Bacillus subtilis*] | 89 | 78 | 396 |
| 3688 | 1 | 2 | 400 | gi\|1146286 | glutamate dehydrogenase [*Bacillus subtilis*] | 89 | 75 | 399 |
| 3699 | 1 | 399 | 4 | gi\|1339950 | large subunit of NADN-dependent glutamate synthase [*Plectonema boryanum*] | 89 | 75 | 396 |
| 4016 | 1 | 216 | 4 | gi\|1009366 | Respiratory nitrate reductase [*Bacillus subtilis*] | 89 | 71 | 213 |
| 4177 | 1 | 301 | 131 | gi\|149426 | putative [*Lactococcus lactis*] | 89 | 76 | 171 |
| 4436 | 1 | 302 | 3 | gi\|1022725 | unknown [*Staphylococcus haemolyticus*] | 89 | 80 | 300 |
| 4635 | 1 | 162 | 4 | gi\|1022725 | unknown [*Staphylococcus haemolyticus*] | 89 | 73 | 159 |
| 2 | 2 | 1330 | 2676 | gi\|520754 | putative[*Bacillus subtilis*] | 88 | 76 | 1347 |
| 42 | 2 | 468 | 848 | sp\|P42321\|CATA | CATALASE (EC 1.11.1.6). | 88 | 76 | 381 |
| 53 | 5 | 4722 | 3055 | gi\|474177 | alpha-D-1,4-glucosidase [*Staphylococcus xylosus*] | 88 | 80 | 1668 |
| 56 | 16 | 18018 | 18617 | gi\|467411 | recombination protein [*Bacillus subtilis*] | 88 | 77 | 600 |
| 53 | 5 | 376 | 843 | gi\|666116 | glucose kinase [*Staphylococcus xylosus*] | 88 | 77 | 468 |
| 70 | 2 | 1245 | 907 | gi\|44095 | replication initiator protein [*Listeria aonocytogenes*] | 88 | 74 | 339 |
| 82 | 8 | 11514 | 12719 | pir\|A60663\|A606 | translation elongation factor Tu-[*Bacillus subtilis*] | 88 | 79 | 1206 |
| 103 | 7 | 4179 | 4391 | gi\|167181 | serine/threonine kinase receptor [*Brassica napus*] | 88 | 77 | 213 |
| 114 | 8 | 7732 | 8232 | gi\|1022726 | unknown [*Staphylococcus haemolyticus*] | 88 | 72 | 501 |
| 118 | 2 | 308 | 2011 | gi\|1303804 | YqeQ[*Bacillus subtilis*] | 88 | 77 | 1704 |
| 141 | 3 | 657 | 1136 | gi\|1405446 | transketolase [*Bacillus subtilis*] | 88 | 72 | 480 |
| 148 | 7 | 5871 | 6116 | gi\|1118002 | dihydropteroate synthase [*Staphylococcus haemolyticus*] | 88 | 78 | 246 |
| 165 | 3 | 1428 | 2231 | gi\|40053 | phenylalanyl-tRNA synthetase alpha subunit [*Bacillus subtilis*] ir\|S11730\|YFBSA phenylalanine-tRNA ligase (EC 6.1.1.20) alpha ain-*Bacillus subtilis* | 88 | 80 | 804 |
| 205 | 28 | 14185 | 13343 | gi\|1165306 | L2 [*Bacillus subtilis*] | 88 | 82 | 843 |
| 225 | 1 | 898 | 227 | gi\|1303840 | YgfS[*Bacillus subtilis*] | 88 | 78 | 672 |
| 235 | 1 | 2 | 1975 | gi\|452309 | valyl-tRNA synthetase [*Bacillus subtilis*] | 88 | 76 | 1974 |
| 339 | 3 | 1566 | 1072 | gi\|1118002 | dihydropteroate synthase [*Staphylococcus haemolyticus*] | 88 | 73 | 495 |
| 443 | 4 | 2928 | 1531 | gi\|558559 | pyrimidine nucleoside phosphorylase [*Bacillus subtilis*] | 88 | 73 | 1398 |
| 532 | 1 | 3 | 419 | gi\|143797 | valyl-tRNA synthetase [*Bacillus stearothermophilus*] sp\|P11931\|SYV_BACST VALYL-TRNA SYNTHETASE (EC 6.1.1.9) VALINE-TRNA LIGASE) (VALRS). | 88 | 78 | 417 |
| 534 | 3 | 2504 | 2968 | gi\|153049 | mannitol-specific enzyme-III [*Staphylococcus carnosus*] pir\|JQ0088\|JQ0088 phosphotransferase system enzyme II (EC .7.1.69), mannitol-specific, factor III-*Staphylococcus carnosus* sp\|P17876\|PTMA_STACA PTS SYSTEM, MANNITOL-SPECIFIC IIA CONPONENT EIIA-MTL) ( | 88 | 82 | 465 |
| 705 | 2 | 399 | 214 | gi\|710018 | nitrite reductase (nirB) [*Bacillus subtilis*] | 88 | 70 | 186 |
| 1000 | 2 | 1309 | 794 | gi\|1022726 | unknown [*Staphylococcus haemolyticus*] | 88 | 78 | 516 |
| 1299 | 1 | 324 | 63 | gi\|401786 | phosphomannomutase [*Mycoplasma pirum*] | 88 | 55 | 264 |
| 1341 | 2 | 170 | 400 | gi\|39963 | ribosomal protein L20 (AA 1-119) [*Bacillus stearothermophilus*] ir\|S05348\|R55520 ribosomal protein L20-*Bacillus earothermophilus* | 88 | 82 | 231 |

TABLE 2-continued

| | | | | | | | | |
|---|---|---|---|---|---|---|---|---|
| 1386 | 1 | 41 | 214 | pir\|B47154\|B471 | signal recognition particle 54K chain homolog Ffh-*Bacillus subtilis* | 88 | 71 | 174 |
| 386 | 2 | 183 | 533 | pir\|B47154\|B471 | signal recognition particle 54K chain homolog Ffh-*Bacillus subtilis* | 88 | 73 | 351 |
| 2949 | 1 | 399 | 94 | gi\|535350 | CodX [*Bacillus subtilis*] | 88 | 73 | 306 |
| 2984 | 1 | 5 | 169 | gi\|218277 | O-acetylserine(thiol) lyase [*Spinacia oleracea*] | 88 | 70 | 165 |
| 3035 | 1 | 1 | 138 | gi\|493083 | dihydroxyacetone kinase [*Citrobacter freundii*] | 88 | 67 | 138 |
| 3089 | 1 | 3 | 152 | gi\|606055 | ORF_f746 [*Escherichia coli*] | 88 | 88 | 150 |
| 3917 | 1 | 410 | 3 | gi\|143378 | pyruvate decarboxylase (E-1) beta subunit [*Bacillus subtilis*] gi\|1377836 pyruvate decarboxylase E-1 beta subunit [*Bacillus ubtilis*] | 88 | 77 | 408 |
| 4199 | 1 | 342 | 4 | gi\|1405454 | aconitase [*Bacillus subtilis*] | 88 | 82 | 339 |
| 4201 | 1 | 369 | 4 | gi\|515938 | glutamate synthase (ferredoxin) [*Synechocystis sp.*] pir\|S46957\|S46957 glutamate synthase (ferredoxin) (EC 1.4.7.1)-*ynechocystis sp.* | 88 | 84 | 366 |
| 4274 | 1 | 1 | 336 | gi\|515938 | glutamate synthase (ferredoxin) [*Synechocystis sp.*] pir\|S46957\|S46957 glutamate synthase (ferredoxin) (EC 1.4.7.1)-*ynechocystis sp.* | 88 | 84 | 336 |
| 4308 | 1 | 399 | 4 | gi\|146206 | glutamate dehydrogenase [*Bacillus subtilis*] | 88 | 71 | 396 |
| 2 | 5 | 4570 | 6000 | gi\|1535350 | CodX [*Bacillus subtilis*] | 87 | 70 | 1431 |
| 52 | 8 | 6482 | 6183 | gi\|1064791 | function unknown [*Bacillus subtilis*] | 87 | 66 | 300 |
| 73 | 3 | 1584 | 2480 | gi\|142992 | glycerol kinase (glpK) (EC 2.7.1.30) [*Bacillus subtilis*] pir\|B45868\|B45868 glycerol kinase (EC 2.7.1.30-*Bacillus subtilis* sp\|P18157\|GLPK_BACSU GLYCEROL KINASE (EC 2.7.1.30) (ATP: GLYCEROL-PHOSPHOTRANSFERASE) (GLYCEROKINASE) (GK). | 87 | 72 | 897 |
| 98 | 12 | 8813 | 9100 | gi\|467433 | unknown [*Bacillus subtilis*] | 87 | 62 | 288 |
| 124 | 4 | 2988 | 1711 | gi\|556886 | serine hydroxymethyltransferase [*Bacillus subtilis*] pir\|S49363\|S49363 serine hydroxymethyltransferase-*Bacillus ubtilis* | 87 | 77 | 1278 |
| 124 | 6 | 4032 | 3607 | gi\|556883 | Unknown [*Bacillus subtilis*] | 87 | 66 | 426 |
| 148 | 5 | 3741 | 4559 | gi\|467460 | unknown [*Bacillus subtilis*] | 87 | 70 | 819 |
| 164 | 13 | 12710 | 13810 | gi\|39954 | IF2 (aa 1-741) [*Bacillus stearothermophilus*] | 87 | 72 | 1101 |
| 177 | 2 | 1104 | 2126 | gi\|467385 | unknown [*Bacillus subtilis*] | 87 | 78 | 1023 |
| 199 | 1 | 1158 | 334 | gi\|143527 | iron-sulfur protein [*Bacillus subtilis*] | 87 | 77 | 825 |
| 199 | 2 | 2933 | 1149 | pir\|A27763\|A277 | succinate dehydrogenase (EC 1.3.99.1) flavoprotein-*Bacillus subtilis* | 87 | 80 | 1785 |
| 205 | 23 | 11543 | 11304 | gi\|1044972 | ribosomal protein L29 [*Bacillus subtilis*] | 87 | 78 | 240 |
| 205 | 25 | 12607 | 11939 | gi\|1165309 | S3 [*Bacillus subtilis*] | 87 | 75 | 669 |
| 222 | 1 | 1107 | 181 | gi\|1177249 | rec233 gene product [*Bacillus subtilis*] | 87 | 70 | 927 |
| 236 | 3 | 1333 | 1031 | gi\|1146198 | ferredoxin [*Bacillus subtilis*] | 87 | 80 | 303 |
| 246 | 5 | 2292 | 1999 | gi\|467373 | ribosomal protein S18 [*Bacillus subtilis*] | 87 | 77 | 294 |
| 260 | 2 | 3422 | 2655 | gi\|1161382 | IcaC [*Staphylococcus epidermidis*] | 87 | 72 | 768 |
| 320 | 3 | 1696 | 2391 | gi\|312443 | carbamoyl-phosphate synthase (glutamine-hydrolysing) [*Bacillus aldolyticus*] | 87 | 80 | 696 |
| 380 | 4 | 1165 | 1383 | gi\|142570 | ATP synthase c subunit [*Bacillus firmus*] | 87 | 80 | 219 |
| 414 | 4 | 900 | 1073 | gi\|467386 | thiophen and furan oxidation [*Bacillus subtilis*] | 87 | 77 | 174 |
| 425 | 2 | 794 | 585 | gi\|1046166 | pilin repressor [*Mycoplasma genitalium*] | 87 | 69 | 210 |
| 448 | 1 | 722 | 189 | gi\|405134 | acetate kinase [*Bacillus subtilis*] | 87 | 75 | 534 |
| 480 | 1 | 1 | 711 | gi\|142559 | ATP synthase alpha subunit [*Bacillus megaterium*] | 87 | 79 | 71 |
| 481 | 1 | 2 | 352 | sp\|Q06797\|RL1_B | 50S RIBOSOMAL PROTEIN L1 (BL1). | 87 | 72 | 351 |
| 677 | 2 | 359 | 955 | gi\|460911 | fructose-bisphosphate aldolase [*Bacillus subtilis*] | 87 | 78 | 597 |
| 677 | 3 | 934 | 1284 | gi\|460911 | fructose-bisphosphate aldolase [*Bacillus subtilis*] | 87 | 78 | 351 |
| 876 | 1 | 3 | 452 | gi\|1146247 | asparaginyl-tRNA synthetase [*Bacillus subtilis*] | 87 | 79 | 450 |
| 1376 | 1 | 214 | 2 | gi\|3065555 | F46H6.4 gene product [*Caenorhabditis elegans*] | 87 | 75 | 213 |
| 2206 | 1 | 3 | 374 | gi\|215098 | exciaionase [*Bacteriophage 154a*] | 87 | 72 | 372 |
| 2938 | 1 | 3 | 290 | gi\|508979 | GTP-binding protein [*Bacillus subtilis*] | 87 | 69 | 288 |
| 3081 | 2 | 126 | 308 | gi\|467399 | IMP dehydrogenase [*Bacillus subtilis*] | 87 | 72 | 183 |
| 3535 | 1 | 3 | 401 | gi\|1405454 | aconitase [*Bacillus subtilis*] | 87 | 80 | 399 |
| 4238 | 1 | 275 | 3 | gi\|603769 | HutU protein, urocanase [*Bacillus subtilis*] | 87 | 73 | 273 |
| 4 | 8 | 8736 | 7045 | gi\|603769 | HutU protein, urocanase [*Bacillus subtilis*] | 86 | 72 | 1692 |
| 22 | 6 | 3738 | 3286 | gi\|410515 | urease beta subunit [*Staphylococcus xylosus*] | 86 | 73 | 453 |
| 54 | 2 | 1572 | 664 | gi\|289287 | UDP-glucose pyrophosphorylase [*Bacillus subtilis*] | 86 | 70 | 909 |
| 124 | 3 | 1713 | 1090 | gi\|556887 | uracil phosphoribosyltransferase [*Bacillus subtilis*] pir\|S49364\|S49364 uracil phosphoribosyltransferase-*Bacillus ubtilis* | 86 | 74 | 624 |
| 148 | 3 | 1349 | 3448 | gi\|467458 | cell division protein [*Bacillus subtilis*] | 86 | 75 | 2100 |
| 148 | 4 | 3638 | 3859 | gi\|467460 | unknown [*Bacillus subtilis*] | 86 | 73 | 222 |
| 152 | 3 | 1340 | 2086 | gi\|1377835 | pyruvate decarboxylase P-1 alpha subunit [*Bacillus subtilis*] | 86 | 75 | 747 |
| 164 | 18 | 17347 | 119467 | gi\|1184680 | polynucleotide phosphorylase [*Bacillus subtilis*] | 86 | 72 | 2121 |
| 80 | 2 | 554 | 1159 | gi\|143467 | ribosomal protein S4 [*Bacillus subtilis*] | 86 | 80 | 606 |
| 205 | 3 | 2592 | 2218 | gi\|142464 | ribosomal protein L17 [*Bacillus subtilis*] | 86 | 77 | 375 |
| 205 | 126 | 12990 | 112616 | gi\|40107 | ribosomal protein L22-[*Bacillus stearothermophilus*] ir\|S10612\|S10612 ribosomal protein L22-*Bacillus earothermophilus* | 86 | 75 | 375 |
| 246 | 7 | 3140 | 2817 | gi\|467375 | ribosomal protein S6 [*Bacillus subtilis*] | 86 | 70 | 324 |
| 299 | 3 | 1196 | 1540 | gi\|39656 | spoVG gene product [*Bacillus megaterium*] | 86 | 70 | 345 |
| 299 | 7 | 3884 | 4345 | gi\|467440 | 'phosphoribosylpyrophosphate synthetase [*Bacillus subtilis*] gi\|40218 PRPP synthetase (AA 1-317) [*Bacillus subtilis*] | 86 | 78 | 462 |
| 304 | 5 | 2170 | 2523 | gi\|666983 | putative ATP binding subunit [*Bacillus subtilis*] | 86 | 65 | 354 |
| 310 | 2 | 1487 | 1678 | gi\|1177684 | chorismate mutase [*Staphylococcus xylosus*] | 86 | 71 | 192 |
| 331 | 5 | 2086 | 3405 | gi\|487434 | isocitrate dehydrogenase [*Bacillus subtilis*] | 86 | 78 | 1320 |
| 339 | 2 | 1109 | 729 | gi\|1118003 | dihydroneopterin aldolase [*Staphylococcus haemolyticus*] | 86 | 77 | 381 |
| 358 | 2 | 2124 | 3440 | gi\|1146219 | 28.2% of identity to the *Escherichia coli* GTP-binding protein Era; putative [*Bacillus subtilis*] | 86 | 73 | 1317 |

TABLE 2-continued

| | | | | | | | | |
|---|---|---|---|---|---|---|---|---|
| 404 | 2 | 1015 | 2058 | gi\|1303817 | YqfA [*Bacillus subtilis*] | 86 | 78 | 1044 |
| 581 | 2 | 452 | 243 | gi\|40056 | phoP gene product [*Bacillus subtilis*] | 86 | 71 | 210 |
| 642 | 2 | 338 | 1075 | gi\|1176399 | EpiF [*Staphylococcus epidermidis*] | 86 | 72 | 738 |
| 770 | 1 | 347 | 72 | gi\|143328 | phoP protein (put.); putative *Bacillus subtilis*] | 86 | 69 | 276 |
| 865 | 1 | 890 | 3 | gi\|1146247 | asparaginyl-tRNA synthetase ]*Bacillus subtilis*] | 86 | 74 | 888 |
| 868 | 2 | 963 | 1133 | gi\|1002911 | transmembrane protein [*Saccharomyces cerevisiae*] | 86 | 69 | 171 |
| 904 | 1 | 1 | 162 | gi\|1303912 | YqhW[*Bacillus subtilis*] | 86 | 72 | 162 |
| 989 | 1 | 35 | 433 | gi\|1303993 | YqkL[*Bacillus subtilis*] | 86 | 76 | 399 |
| 1212 | 1 | 150 | 4 | gi\|414014 | ipa-90d gene product [*Bacillus subtilis*] | 86 | 70 | 147 |
| 1323 | 1 | 2 | 148 | gi\|40041 | pyruvate dehydrogenase (lipoamide) [*Bacillus stearothermophilus*] ir\|S10798\|DEBSPF pyruvate dehydrogenase (lipoamide) (EC 1.2.4.1) pha chain *Bacillus stearothermophilus* | 86 | 75 | 147 |
| 3085 | 2 | 310 | 80 | gi\|1354211 | PET112-like protein [*Bacillus subtilis*] | 86 | 86 | 231 |
| 3847 | 1 | 1 | 228 | gi\|296464 | ATPase [*Lactococcus lactis*] | 86 | 63 | 228 |
| 4487 | 1 | 240 | 4 | gi\|1022726 | unknown [*Staphylococcus haemolyticus*] | 86 | 73 | 237 |
| 4583 | 1 | 187 | 2 | gi\|1022725 | unknown [*Staphylococcus haemolyticus*] | 86 | 79 | 186 |
| 25 | 5 | 4287 | 5039 | gi\|1502421 | 3-ketoacyl-acyl carrier protein reductase [*Bacillus subtilis*] | 85 | 64 | 753 |
| 56 | 21 | 29395 | 28163 | gi\|1408507 | pyrimidine nucleoside transport protein [*Bacillus subtilis*] | 85 | 69 | 1233 |
| 68 | 2 | 332 | 1192 | gi\|467376 | unknown [*Bacillus subtilis*] | 85 | 74 | 861 |
| 73 | 2 | 880 | 1707 | gi\|142992 | glycerol kinase (glpK) (EC 2.7.1.30) [*Bacillus subtilis*] pir\|B45868\|B45868 glycerol kinase (EC 2.7.1.30)-*Bacillus subtilis* sp\|P18157\|GLPK_BACSU GLYCEROL KINASE (EC 2.7.1.30) (ATP: GLYCEROL-PHOSPHOTRANSFERASE) (GLYCEROKINASE) (GK). | 85 | 72 | 828 |
| 106 | 4 | 1505 | 3490 | gi\|143766 | (thrSv) (EC 6.1.1.3) [*Bacillus subtilis*] | 85 | 74 | 1986 |
| 128 | 2 | 1153 | 2202 | gi\|311924 | glyceraldehyde-3-phosphate dehydrogenase [*Clostridium pasteurianum*] pir\|S34254\|S34254 glyceraldehyde-3-phosphate dehydrogenase (EC .2.1.12)-*Clostridium pasteurianum* | 85 | 75 | 1050 |
| 129 | 4 | 5252 | 4038 | gi\|1064807 | ORTHININE ANINOTRANSFERASE [*Bacillus subtilis*] | 85 | 73 | 1215 |
| 138 | 6 | 3475 | 5673 | gi\|1072419 | glcB gene product [*Staphylococcus carnosus*] | 85 | 74 | 2199 |
| 189 | 1 | 2 | 169 | gi\|467385 | unknown [*Bacillus subtilis*] | 85 | 65 | 168 |
| 205 | 115 | 806 | 7588 | gi\|1044981 | ribosomal protein S5 [*Bacillus subtilis*] | 85 | 75 | 519 |
| 205 | 20 | 110596 | 10264 | pir\|A02819\|R5BS | ribosomal protein L24-*Bacillus stearothermophilus* | 85 | 72 | 333 |
| 220 | 6 | 6101 | 5712 | gi\|48980 | secA gene product [*Bacillus subtilis*] | 85 | 66 | 390 |
| 231 | 4 | 3159 | 1441 | gi\|1002520 | MutS [*Bacillus subtilis*] | 85 | 70 | 1719 |
| 243 | 9 | 8013 | 8783 | gi\|414011 | ipa-87r gene product [*Bacillus subtilis*] | 85 | 72 | 771 |
| 249 | 2 | 3186 | 478 | gi\|1405454 | aconitase [*Bacillus subtilis*] | 85 | 73 | 2709 |
| 302 | 1 | 140 | 475 | gi\|40173 | homolog of *E. coli* ribosomal protein L21 [*Bacillus subtilis*] ir\|S18439\|S18439 Ribosomal protein L21-*Bacillus subtilis* p\|P26908\|RL21_BACSU 50S RIBOSOMAL PROTEIN L21 (BL20). | 85 | 72 | 336 |
| 333 | 1 | 2968 | 491 | gi\|442360 | ClpC adenogine triphosphatase [*Bacillus subtilis*] | 85 | 69 | 2478 |
| 364 | 6 | 6082 | 8196 | gi\|871784 | Clp-like ATP-dependent protease binding subunit [*Bos taurus*] | 85 | 68 | 2115 |
| 448 | 2 | 1339 | 686 | gi\|405134 | acetate kinase [*Bacillus subtilis*] | 85 | 68 | 654 |
| 747 | 1 | 853 | 455 | gi\|1373157 | orf-X; hypothetical protein; Method: conceptual translation supplied by author [*Bacillus subtilis*] | 85 | 73 | 399 |
| 886 | 2 | 159 | 467 | gi\|541768 | hemin permease [*Yersinia enterocolitical*] | 85 | 55 | 309 |
| 1089 | 1 | 606 | 4 | pir\|B47154\|B471 | signal recognition particle 54K chain homolog Ffh-*Bacillus subtilis* | 85 | 71 | 603 |
| 1163 | 1 | 409 | 2 | gi\|304155 | diaminopimelate decarboxylase [*Bacillus methanolicus*] sp\|P41023\|DCDA_BACMT DIAMIMOPIMELATE DECARBOXYLASE (EC 4.1.1.20) DAP DECARBOXYLASE). | 85 | 62 | 408 |
| 1924 | 1 | 251 | 15 | gi\|215098 | excisionase [Bacteriophage 154a] | 85 | 73 | 237 |
| 2932 | 1 | 390 | 4 | gi\|1041099 | Pyruvate Kinage [*Bacillus licheniformis*] | 85 | 71 | 387 |
| 3030 | 1 | 3 | 275 | gi\|42370 | pyruvate formate-lyage (AA 1-760) [*Escherichia coli*] ir\|S01788\|S01788 formate C-acetyltransferase (EC 2.3.1.54)-*cherichia coli* | 85 | 74 | 273 |
| 3111 | 1 | 299 | 3 | gi\|63568 | limb deformity protein [*Gallus gallus*] | 85 | 85 | 297 |
| 3778 | 1 | 316 | 2 | gi\|391840 | beta-subunit of HDT [*Pseudomonas fragi*] | 85 | 67 | 315 |
| 3835 | 1 | 1 | 387 | gi\|1204472 | type I restriction enzyme ECOR124/3 I M protein [*Haemophilus influenzae*] | 85 | 56 | 387 |
| 4042 | 1 | 3 | 386 | gi\|18178 | formate acetyltransferase [*Chlamydomonas reinhardtii*] ir\|S24997\|S24997 formate C-acetyltransferase (EC 2.3.1.54)-*lamydomonas reinhardtii* | 85 | 70 | 384 |
| 4053 | 1 | 35 | 340 | gi\|1204472 | type I restriction enzyme ECOR124/3 I M protein [*Haemophilus influenzae*] | 85 | 56 | 306 |
| 4108 | 1 | 2 | 181 | gi\|1072418 | glcA gene product ]*Staphylococcus carnosus*] | 85 | 61 | 180 |
| 4300 | 1 | 330 | 85 | gi\|151932 | fructose enzyme II [*Rhodobacter capsulatus*] | 85 | 59 | 246 |
| 4392 | 1 | 355 | 83 | gi\|1022725 | unknown [*Staphylococcus haemolyticus*] | 85 | 74 | 273 |
| 4408 | 1 | 2 | 235 | gi\|871784 | Clp-like ATP-dependent protease binding subunit [*Bos taurus*] | 85 | 62 | 234 |
| 4430 | 1 | 291 | 4 | gi\|1009366 | Respiratory nitrate reductase [*Bacillus subtilis*] | 85 | 68 | 288 |
| 4555 | 1 | 2 | 253 | gi\|450688 | hsdM gene of EcoprrI gene product [*Escherichia coli*] pir\|S38437\|S38437 hsdM protein-*Escherichia coli* pir\|S09629\|S09629 hypothetical protein A-*Escherichia coli* (SUB 40–520) | 85 | 52 | 252 |
| 4611 | 1 | 242 | 3 | gi\|1256635 | dihydroxy-acid dehydratase [*Bacillus subtilis*] | 85 | 65 | 240 |
| 4 | 10 | 10061 | 10591 | gi\|46982 | fosB gene product [*Staphylococcus epidermidis*] | 84 | 68 | 531 |
| 13 | 2 | 1172 | 996 | gi\|142450 | ahrC protein [*Bacillus subtilis*] | 84 | 56 | 177 |
| 16 | 4 | 1803 | 4652 | gi\|1277198 | DNA repair protein [*Deinococcus radiodurans*] | 84 | 67 | 2850 |
| 22 | 3 | 1128 | 721 | gi\|511069 | UreF [*Staphylococcus xylosus*] | 84 | 73 | 408 |
| 23 | 7 | 5055 | 5306 | gi\|603320 | Yer082p [*Saccharomyces cerevisiae*] | 84 | 61 | 252 |
| 53 | 11 | 11145 | 10693 | gi\|1303948 | YqiW[*Bacillus subtilis*] | 84 | 68 | 453 |

TABLE 2-continued

| | | | | | | | | |
|---|---|---|---|---|---|---|---|---|
| 53 | 12 | 12770 | 11481 | gi\|142613 | branched chain alpha-keto acid dehydrogenase E2 [*Bacillus subtilis*] gi\|1303944 BfmBB [*Bacillus subtilis*] | 84 | 71 | 1290 |
| 70 | 1 | 982 | 632 | gi\|46647 | ORF (repE) [*Staphylococcus aureus*] | 84 | 68 | 351 |
| 73 | 4 | 2512 | 4311 | gi\|142993 | glycerol-3-phosphate dehydrogenase glpD) (EC 1.1.99.5) [*Bacillus ubtilis*] | 84 | 74 | 1800 |
| 98 | 7 | 4324 | 6096 | gi\|467427 | methionyl-tRNA synthetase [*Bacillus subtilis*] | 84 | 66 | 1773 |
| 100 | 9 | 8680 | 7859 | gi\|340128 | ORF1 [*Staphylococcus aureus*] | 84 | 78 | 822 |
| 117 | 3 | 1934 | 3208 | gi\|1237019 | Srb [*Bacillus subtilis*] | 84 | 68 | 1275 |
| 348 | 6 | 4720 | 5670 | gi\|467462 | cysteine synthetase A [*Bacillus subtilis*] | 84 | 69 | 951 |
| 152 | 4 | 2064 | 2456 | gi\|143377 | pyruvate decarboxylase (E-1) alpha subunit [*Bacillus subtilis*] pir\|B36718\|DEBSPA pyruvate dehydrogenase (lipoamide) (EC 1.2.4.1) lpha chain-*Bacillus subtilis* | 84 | 70 | 393 |
| 169 | 7 | 3634 | 3863 | gi\|1001342 | hypothetical protein [*Synechocystis sp.*] | 84 | 66 | 228 |
| 171 | 4 | 2657 | 2322 | gi\|517475 | D-amino acid transaminase *Staphylococcus haemolyticus*] | 84 | 71 | 336 |
| 186 | 6 | 6216 | 5491 | gi\|467475 | unknown [*Bacillus subtilis*] | 84 | 70 | 726 |
| 205 | 9 | 5692 | 5123 | gi\|216340 | DRF for adenylate kinase [*Bacillus subtilis*] | 84 | 71 | 570 |
| 224 | 2 | 915 | 1391 | gi\|288269 | beta-fructofuranoside [*Staphylococcus xylosus*] | 84 | 70 | 477 |
| 251 | 1 | 92 | 388 | gi\|1303790 | YqeI [*Bacillus subtilis*] | 84 | 65 | 297 |
| 282 | 3 | 1526 | 2836 | gi\|143040 | glutamate-1-semialdehyde 2,1-aminotransferase [*Bacillus subtilis*] pir\|D42728\|D42728 glutamate-1-semialdehyde 2,1-aminoulase (EC .4.3.8)-*Bacillus subtilis* | 84 | 75 | 1311 |
| 307 | 5 | 2959 | 2780 | gi\|1070014 | protein-dependent [*Bacillus subtilis*] | 84 | 62 | 180 |
| 320 | 4 | 2343 | 4229 | gi\|143390 | carbamyl phosphate synthetase [*Bacillus subtilis*] | 84 | 70 | 1887 |
| 372 | 1 | 3 | 296 | gi\|1022725 | unknown [*Staphylococcus haemolyticus*] | 84 | 70 | 294 |
| 413 | 2 | 1341 | 481 | gi\|1256146 | YbbQ [*Bacillus subtilis*] | 84 | 65 | 861 |
| 439 | 1 | 3 | 392 | gi\|1046173 | osmotically inducible protein [*Mycoplasma genitalium*] | 84 | 53 | 390 |
| 461 | 3 | 1362 | 2270 | gi\|40211 | threonine synthase (thrC) (AA 1–352) [*Bacillus subtilis*] ir\|A25364\|A25364 threonine synthase (EC 4.2.99.2)-*Bacillus btilis* | 84 | 69 | 909 |
| 487 | 1 | 3 | 299 | gi\|1144531 | integrin-like protein alpha Intlp [*Candida albicans*] | 84 | 46 | 297 |
| 491 | 2 | 624 | 905 | pir\|S08564\|R3BS | (ribosomal protein S9-*Bacillus stearothermophilus* | 84 | 69 | 282 |
| 491 | 3 | 836 | 1033 | pir\|S08564\|R3BS | (ribosomal protein S9-*Bacillus stearothermophilus* | 84 | 77 | 198 |
| 548 | 1 | 3 | 341 | gi\|431231 | uracil permease [*Bacillus caldolyticus*] | 84 | 74 | 339 |
| 728 | 2 | 1748 | 795 | gi\|912445 | DNA polymerase [*Bacillus caldotenax*] | 84 | 68 | 954 |
| 769 | 1 | 3 | 257 | gi\|1510953 | cobalamin biosynthesis protein N [*Methanococcus jannaschii*] | 84 | 38 | 255 |
| 954 | 1 | 156 | 4 | gi\|1405454 | aconitase [*Bacillus subtilis*] | 84 | 57 | 153 |
| 957 | 1 | 3 | 395 | gi\|143402 | recombination protein (ttg start codon) [*Bacillus subtilis*] gi\|1303923 RecN [*Bacillus subtilis*] | 84 | 68 | 393 |
| 975 | 1 | 3 | 452 | gi\|885934 | ClpB [*Synechococcus sp.*] | 84 | 70 | 450 |
| 1585 | 1 | 3 | 257 | gi\|510140 | ligoendopeptidase F [*Lactococcus lactis*] | 84 | 56 | 255 |
| 2954 | 1 | 3 | 323 | gi\|603769 | HutU protein, urocanase [*Bacillus subtilis*] | 84 | 73 | 321 |
| 2996 | 1 | 348 | 46 | gi\|18178 | formate acetyltransferase [*Chlamydomonas reinhardtii*] ir\|S24997\|S24997 formate C-acetyltransferase (EC 2.3.1.54)-*lamydomonas reinhardtii* | 84 | 65 | 303 |
| 3766 | 1 | 375 | 13 | gi\|517205 | 67 kDa Myosin-crossreactive *streptococcal* antigen [*Streptococcus yogenes*] | 84 | 72 | 363 |
| 4022 | 1 | 2 | 169 | gi\|1148206 | glutamate dehydrogenase [*Bacillus subtilis*] | 84 | 54 | 168 |
| 4058 | 1 | 312 | 4 | gi\|151932 | fructose enzyme II [*Rhodobacter capsulatus*] | 84 | 71 | 309 |
| 4108 | 2 | 106 | 351 | gi\|1072418 | glcA gene product [*Staphylococcus carnosus*] | 84 | 77 | 246 |
| 4183 | 1 | 3 | 308 | gi\|603769 | HutU protein, urocanase [*Bacillus subtilis*] | 84 | 72 | 306 |
| 4726 | 1 | 55 | 234 | gi\|146208 | glutamate synthase large subunit (EC 2.6.1.53) [*Escherichia coli*] pir\|A29617\|A29617 glutamate synthase (NAPPH) (EC 1.4.1.13) large hain-*Escherichia coli* | 84 | 73 | 180 |
| 22 | 4 | 1576 | 1109 | gi\|393297 | urease accessory protein [*Bacillus sp.*] | 83 | 64 | 468 |
| 53 | 13 | 13745 | 12768 | gi\|142612 | branched chain alpha-keto acid dehydrogenase E1-beta [*Bacillus ubtilis*] | 83 | 68 | 978 |
| 57 | 16 | 12872 | 12387 | gi\|143132 | lactate dehydrogenase (AC 1.1.1.27) [*Bacillus caldolyticus*] pir\|B29704\|B29704 L-lactate dehydrogenase (EC 1.1.1.27)-*Bacillus aldolyticus* | 83 | 66 | 486 |
| 66 | 3 | 2274 | 1429 | gi\|1303894 | YqhN [*Bacillus subtilis*] | 83 | 63 | 846 |
| 66 | 5 | 4643 | 3168 | gi\|2212730 | YqhK [*Bacillus subtilis*] | 83 | 68 | 1476 |
| 70 | 3 | 1523 | 1182 | gi\|44095 | replication initiator protein [*Listeria monocytogenes*] | 83 | 73 | 342 |
| 90 | 1 | 377 | 1429 | gi\|155571 | alcohol dehydrogenase I (adhA) (EC 1.1.1.1) [*Zymomonas mobilis*] pir\|A35260\|A35260 alcohol dehydrogenase (EC 1.1.1.1) I-*Zymomonas obilis* | 83 | 70 | 1053 |
| 95 | 2 | 708 | 2162 | gi\|506381 | phospho-beta-glucosidase [*Bacillus subtilis*] | 83 | 70 | 1455 |
| 137 | 1 | 168 | 694 | gi\|467391 | initiation protein of replicaton [*Bacillus subtilis*] | 83 | 77 | 627 |
| 140 | 4 | 2742 | 2275 | gi\|634107 | kdp8 [*Escherichia coli*] | 83 | 65 | 468 |
| 142 | 3 | 2989 | 2510 | gi\|2212776 | lumazine synthase (b-subunit) [*Bacillus amyloliquefaciens*] | 83 | 69 | 480 |
| 161 | 12 | 5749 | 6696 | gi\|903307 | ORF75 [*Bacillus subtilis*] | 83 | 64 | 948 |
| 164 | 9 | 9880 | 11070 | gi\|149316 | ORF2 gene product [*Bacillus subtilis*] | 83 | 66 | 1191 |
| 164 | 14 | 14148 | 14546 | gi\|580902 | ORF6 gene product [*Bacillus subtilis*] | 83 | 60 | 399 |
| 170 | 2 | 2467 | 1790 | gi\|520844 | orf4 [*Bacillus subtilis*] | 83 | 64 | 678 |
| 186 | 2 | 1370 | 711 | gi\|289284 | cysteinyl-tRNA synthetase [*Bacillus subtilis*] | 83 | 72 | 660 |
| 205 | 14 | 7607 | 7392 | gi\|216337 | ORF for L30 ribosomal protein [*Bacillus subtilis*] | 83 | 74 | 216 |
| 237 | 6 | 3683 | 4540 | gi\|1510488 | imidazoleglycerol-phosphate synthase (cyclase) [*Methanococcus jannaschii*] | 83 | 60 | 858 |
| 302 | 1 | 638 | 291 | gi\|467419 | unknown [*Bacillus subtilis*] | 83 | 65 | 348 |
| 302 | 4 | 1421 | 2743 | gi\|508979 | GTP-binding protein [*Bacillus subtilis*] | 83 | 68 | 1323 |
| 321 | 4 | 3571 | 3209 | gi\|139844 | fumarase (citG) (aa 1-462) [*Bacillus subtilis*] | 83 | 68 | 363 |

TABLE 2-continued

| | | | | | | | | |
|---|---|---|---|---|---|---|---|---|
| 367 | 1 | 2 | 352 | gi\|1039479 | ORFU [*Lactococcus lactis*] | 83 | 54 | 351 |
| 387 | 1 | 3 | 662 | gi\|806281 | (DMA polyserase I [*Bacillus stearothermophilus*] | 83 | 70 | 660 |
| 527 | 2 | 916 | 1566 | gi\|396259 | protease [*Staphylococcus epidermidis*] | 83 | 67 | 651 |
| 533 | 1 | 179 | 3 | gi\|142455 | alanine dehydrogenase (EC 1.4.1.1) [*Bacillus stearothermophilus*] pir\|B34261\|B34261 alanine dehydrogenase (EC 1.4.1.1)-*Bacillus tearothermophilus* | 83 | 66 | 177 |
| 536 | 4 | 1438 | 3259 | gi\|143366 | adenlosuccinate lyase (PUR-B) [*Bacillus subtilis*] pir\|C29326\|WZBSDS adenylosuccinate lyase (EC 4.3.2.2)-*Bacillus ubtilis* | 83 | 67 | 180 |
| 652 | 3 | 2 | 859 | gi\|520753 | DNA topoisomerase I [*Bacillus subtilis*] | 83 | 72 | 858 |
| 774 | 2 | 200 | 361 | gi\|1522665 | *M. jannaschii* predicted coding region MJECL28 [*Methanococcus jannaschii*] | 83 | 58 | 162 |
| 897 | 1 | 120 | 296 | gi\|1064807 | ORTHININE AMINOTRANSFERASE [*Bacillus subtilis*] | 83 | 76 | 177 |
| 1213 | 1 | 3 | 491 | gi\|289288 | lexA[*Bacillus subtilis*] | 83 | 67 | 489 |
| 2529 | 1 | 150 | 4 | gi\|143786 | tryptophanyl-tRNA synthetase (EC 6.1.1.2) [*Bacillus subtilis*] pir\|JT0481\|YWBS tryptophan-tRNA ligase (EC 6.1.1.2)-*Bacillus ubtilis* | 83 | 69 | 147 |
| 2973 | 1 | 326 | 3 | gi\|1109687 | ProZ [*Bacillus subtilis*] | 83 | 58 | 324 |
| 3009 | 1 | 366 | 4 | gi\|882532 | ORF_o294 [*Escherichia coli*] | 83 | 65 | 363 |
| 3035 | 2 | 45 | 305 | gi\|950062 | hypothetical yeast protein I [*Mycoplasma capricolum*] pir\|S48578\|S48578 hypothetical protein-*Mycoplasma capricolus* SGC3) (fragment) | 83 | 59 | 261 |
| 3906 | 1 | 67 | 309 | gi\|1353197 | thioredoxin reductase [*Eubacterium acidaminophilum*] | 83 | 61 | 243 |
| 4458 | 1 | 271 | 2 | gi\|397526 | clumping factor [*Staphylococcus aureus*] | 83 | 78 | 270 |
| 4570 | 1 | 223 | 2 | gi\|1022726 | unknown [*Staphylococcus haemolyticus*] | 83 | 74 | 222 |
| 4654 | 1 | 97 | 261 | gi\|1072419 | glcB gene product [*Staphylococcus carnosus*] | 83 | 79 | 165 |
| 16 | 2 | 295 | 1191 | gi\|153854 | uvs402 protein [*Streptococcus pneumoniae*] | 82 | 67 | 897 |
| 16 | 3 | 1193 | 1798 | gi\|153854 | uvs402 protein [*Streptococcus pneumoniae*] | 82 | 70 | 606 |
| 38 | 12 | 8748 | 7804 | gi\|1204400 | N-acetylneuraminate lyase [*Haemophilus influenzae*] | 82 | 58 | 921 |
| 42 | 4 | 988 | 2019 | gi\|841192 | catalase [*Bacteroides fragilis*] | 82 | 70 | 1032 |
| 51 | 6 | 2590 | 3489 | gi\|143607 | sporulation protein [*Bacillus subtilis*] | 82 | 69 | 900 |
| 56 | 11 | 12270 | 13925 | gi\|39431 | oligo-1,6-glucosidase [*Bacillus careus*] | 82 | 60 | 1656 |
| 56 | 15 | 17673 | 18014 | gi\|467410 | unknown [*Bacillus subtilis*] | 82 | 66 | 342 |
| 61 | 2 | 881 | 3313 | gi\|143148 | transfer RNA-Leu synthetase [*Bacillus subtilis*] | 82 | 70 | 2433 |
| 82 | 7 | 9162 | 11318 | gi\|48240 | elongation factor G (AA 1–691) [*Thermus aquaticus thermophilus*] ir\|S15928\|EFTWG translation elongation factor G-*Thermus aquaticus* p\|P13551\|EFG_THETN ELONGATION FACTOR G (EF-G). | 82 | 64 | 2157 |
| 85 | 2 | 3260 | 1050 | gi\|143369 | phosphoribosylformyl glycinamidine synthetase II (PUR-Q) [*Bacillus ubtilis*] | 82 | 66 | 2211 |
| 102 | 6 | 3662 | 5380 | gi\|1256635 | dihydroxy-acid dehydratase [*Bacillus subtilis*] | 82 | 65 | 1719 |
| 117 | 4 | 3242 | 3493 | pir\|A47154\|A471 | orf1 5' of Ffh-*Bacillus subtilis* | 82 | 53 | 252 |
| 128 | 6 | 4377 | 5933 | gi\|460258 | phosphoglycerate mutase [*Bacillus subtilis*] | 82 | 66 | 1557 |
| 129 | 2 | 1229 | 2182 | gi\|403373 | glycerophosphoryl diester phosphodiesterase [*Bacillus subtilis*] pir\|S37251\|S37251 glycerophosphoryl diester phosphodiesterase-*acillus subtilis* | 82 | 62 | 954 |
| 170 | 1 | 2 | 1441 | gi\|1377831 | unknown [*Bacillus subtilis*] | 82 | 67 | 1440 |
| 177 | 3 | 3 | 1094 | gi\|467386 | thiophen and furan oxidation [*Bacillus subtilis*] | 82 | 65 | 1092 |
| 184 | 4 | 3572 | 4039 | gi\|153566 | ORF 19K protein) [*Enterococcus faecalis*] | 82 | 59 | 468 |
| 189 | 8 | 4225 | 3995 | gi\|1001878 | CspL protein [*Listeria monocytogenes*] | 82 | 73 | 231 |
| 206 | 19 | 20707 | 20048 | gi\|473916 | lipopeptide antibiotics iturin A [*Bacillus subtilis*] sp\|P39144\|LP14_BACSU LIPOPEPTIDE ANTIBIOTICS ITURIN A AND SURFACTIN OSYNTHESIS PROTEIN. | 82 | 50 | 660 |
| 221 | 2 | 805 | 1722 | gi\|517205 | 67 kDa Nyosin-crossreactive *streptococcal* antigen [*Streptococcus yoqenes*] | 82 | 63 | 918 |
| 223 | 4 | 3651 | 3436 | gi\|439619 | [*Salmonella typhimurium* IS200 insertion sequence from SABA17, artial.], gene product [*Salmonella typhimurium*] | 82 | 69 | 216 |
| 260 | 3 | 4296 | 3385 | gi\|1161381 | IcaB [*Staphylococcus epidermidis*] | 82 | 61 | 912 |
| 315 | 3 | 2855 | 846 | gi\|143397 | quinol oxidase [*Bacillus subtilis*] | 82 | 67 | 2010 |
| 321 | 10 | 7945 | 7370 | gi\|142981 | ORF5; This ORF includes a region (aa23–103) containing a potential ron-sulphur center homologous to a region of *Rhodospirillum rubrum* nd *Chromatium vinosum*; putative [*Bacillus stearothermophilus*] pir\|PQ0299\|PQ0299 hypothetical protein 5 (gldA 3' region) | 82 | 62 | 576 |
| 331 | 3 | 1055 | 1342 | gi\|436574 | ribosomal protein L1 [*Bacillus subtilis*] | 82 | 71 | 288 |
| 370 | 2 | 262 | 618 | gi\|1303793 | YqeL [*Bacillus subtilis*] | 82 | 59 | 357 |
| 404 | 4 | 3053 | 4024 | gi\|1303821 | YqfE [*Bacillus subtilis*] | 82 | 68 | 972 |
| 405 | 4 | 3073 | 1706 | gi\|1303913 | YqhX [*Bacillus subtilis*] | 82 | 67 | 1368 |
| 436 | 3 | 2864 | 1632 | gi\|149521 | tryptophan synthase beta subunit [*Lactococcus lactis*] pir\|S35129\|S35129 tryptophan synthase (EC 4.2.1.20) beta chain-*actococcus lactis* subsp. *lactis* | 82 | 67 | 1233 |
| 441 | 4 | 2573 | 1752 | gi\|142952 | glyceraldehyde-3-phosphate dehydrogenase [*Bacillus tearothermophilus*] | 82 | 67 | 822 |
| 444 | 12 | 10415 | 11227 | gi\|1204354 | spore germination and vegetative growth protein [*Haemophilus influenzae*] | 82 | 67 | 813 |
| 446 | 1 | 3 | 191 | gi\|143387 | aspartate transcarbamylase [*Bacillus subtilis*] | 82 | 66 | 189 |
| 462 | 3 | 1007 | 1210 | gi\|142521 | deoxyribodipyrimidine photolyase [*Bacillus subtilis*] pir\|A37192\|A37192 uvrB protein-*Bacillus subtilis* sp\|P14951\|UVRC_BACSU EXCINUCLEASE ABC SUBUNIT C. | 82 | 64 | 204 |

TABLE 2-continued

| | | | | | | | |
|---|---|---|---|---|---|---|---|
| 537 | 1 | 784 | 8 | gi\|853767 | UDP-N-acetylglucosamine 1-carboxyvinyltransferase [Bacillus ubtilis] | 82 | 61 | 777 |
| 680 | 2 | 407 | 700 | gi\|426472 | secE gene product [Staphylococcus carnosus] | 82 | 69 | 294 |
| 724 | 2 | 386 | 207 | gi\|143373 | phosphoribosyl aminoimidazole carboxy formyl ormyltransferase/ inosine monophosphate cyclohydrolase (PUR-H)J)) Bacillus subtilis] | 82 | 68 | 180 |
| 763 | 1 | 213 | 4 | gi\|467458 | cell division protein [Bacillus subtilis] | 82 | 35 | 210 |
| 818 | 1 | 283 | 2 | gi\|1064787 | function unknown [Bacillus subtilis] | 82 | 69 | 282 |
| 858 | 1 | 175 | 1176 | gi\|143043 | uroporphyrinogen decarboxylase [Bacillus subtilis] pir\|B47045\|B47045 uroporphyrinogen decarboxylase (EC 4.1.1.37)-acillus subtilis | 82 | 71 | 1002 |
| 895 | 1 | 3 | 599 | gi\|1027507 | ATP binding protein [Borrelia burgdorferi] | 82 | 72 | 597 |
| 939 | 1 | 10 | 399 | gi\|143795 | transfer RNA-Tyr synthetase [Bacillus subtilis] | 82 | 60 | 390 |
| 961 | 1 | 1 | 306 | gi\|577647 | gamma-hemolysin [Staphylococcus aureus] | 82 | 69 | 366 |
| 1192 | 1 | 155 | 3 | gi\|146974 | NH3-dependent NAD synthetase [Escherichia coli] | 82 | 71 | 153 |
| 1317 | 1 | 49 | 375 | gi\|407908 | EIIscr [Staphylococcus xylosus] | 82 | 72 | 327 |
| 1341 | 1 | 1 | 150 | gi\|39962 | ribosomal protein L35 (AA 1–66) [Bacillus stearothermophilus] ir\|S05347\|R5BS35 ribosomal protein L35-Bacillus earothermophilus | 82 | 68 | 150 |
| 2990 | 2 | 349 | 131 | gi\|534855 | ATPase subunit epsilon [Bacillus stearothermophilus] sp\|P42009\|ATPE_BACST ATP SYNTHASE EPSILON CHAIN (EC 3.6.1.34). | 82 | 47 | 219 |
| 3024 | 1 | 45 | 224 | gi\|467402 | unknown [Bacillus subtilis] | 82 | 64 | 180 |
| 3045 | 1 | 139 | 2 | gi\|467335 | ribosomal protein L9 [Bacillus subtilis] | 82 | 60 | 138 |
| 3045 | 2 | 400 | 242 | gi\|467335 | ribosomal protein L9 [Bacillus subtilis] | 82 | 82 | 159 |
| 3091 | 1 | 238 | 2 | gi\|499335 | secA protein [Staphylococcus carnosus] | 82 | 78 | 237 |
| 3107 | 1 | 210 | 4 | gi\|546918 | orfY 3' of comK [Bacillus subtilis, E26, Peptide Partial, 140 aa] pir\|S43612\|S43612 hypothetical protein Y-Bacillus subtilis sp\|P40398\|YNXD_BACSU HYPOTHETICAL PROTEIN IN COMK 3'REGION ORFY) FRAGMENT) | 82 | 64 | 207 |
| 4332 | 1 | 2 | 319 | gi\|42086 | nitrate reductase alpha subunit [Escherichia coli] p\|P09152\|NABG_ECOLI RESPIRATORY NITRATE REDUCTASE 1 ALPHA CHAIN (EC 7.99.4). (SUB 2-1247) | 82 | 75 | 318 |
| 23 | 3 | 2574 | 1873 | gi\|1199573 | spsB [Sphingomonas sp.] | 81 | 64 | 702 |
| 42 | 1 | 321 | 4 | gi\|466778 | lysine specific permease [Escherichia coli] | 81 | 59 | 318 |
| 48 | 5 | 4051 | 4350 | gi\|1045937 | M. genitalium predicted coding region MG246 [Mycoplasma genitalium] | 81 | 62 | 300 |
| 51 | 4 | 1578 | 2579 | pir\|S16649\|S166 | dciAC protein-Bacillus subtilis | 81 | 55 | 1002 |
| 53 | 2 | 364 | 1494 | gi\|1303961 | YqjJ [Bacillus subtilis] | 81 | 67 | 1131 |
| 53 | 8 | 7971 | 6523 | gi\|146930 | 6-phosphogluconate dehydrogenase [Escherichia coli] | 81 | 66 | 1449 |
| 54 | 9 | 10119 | 9481 | gi\|143016 | permease [Bacillus subtilis] | 81 | 65 | 639 |
| 54 | 10 | 11786 | 10212 | gi\|143015 | gluconate kinase [Bacillus subtilis] | 81 | 64 | 1575 |
| 57 | 17 | 13366 | 12749 | pir\|A25805\|A258 | t-lactate dehydrogenase (EC 1.1.1.27)-Bacillus subtilis | 81 | 74 | 618 |
| 81 | 2 | 2237 | 1726 | gi\|1222302 | NifU-related protein [Haemophilus influenzae] | 81 | 54 | 492 |
| 86 | 1 | 374 | 3 | gi\|414017 | ipa-93d gene product [Bacillus subtilis] | 81 | 70 | 372 |
| 103 | 6 | 4863 | 3284 | gi\|971342 | nitrate reductase beta subunit [Bacillus subtilis] sp\|P42176\|NARN_BACSU NITRATE REDUCTASE BETA CHAIN (EC 1.7.99.4). | 81 | 64 | 1578 |
| 120 | 15 | 10845 | 12338 | gi\|1524392 | GbsA [Bacillus subtilis] | 81 | 67 | 1494 |
| 128 | 5 | 3676 | 4413 | gi\|143319 | triose phosphate isomerase [Bacillus megaterium] | 81 | 64 | 738 |
| 131 | 9 | 9280 | 8252 | gi\|299163 | alanine dehydrogenase [Bacillus subtilis] | 81 | 68 | 1029 |
| 143 | 6 | 5471 | 4654 | gi\|439619 | [Salmonella typhimurium IS200 insertion sequence from SARA17, artial.], gene product [Salmonella typhimurium] | 81 | 61 | 618 |
| 169 | 1 | 43 | 825 | gi\|897795 | 30S ribosomal protein [Pediococcus acidilactici] sp\|P49668\|RS2_PEDAC 30S RIBOSOMAL PROTEIN S2. | 81 | 65 | 783 |
| 230 | 1 | 226 | 2 | gi\|1125826 | short region of weak similarity to tyrosine-protein kinase receptors in a fibronectin type III-like domain [Caenorhabditis elegans] | 81 | 54 | 225 |
| 233 | 5 | 2000 | 2677 | gi\|467404 | unknown [Bacillus subtilis] | 81 | 63 | 678 |
| 241 | 2 | 2149 | 1217 | gi\|16510 | succinate-CoA ligase (GDP-forming) [Arabidopsis thaliana] ir\|S30579\|S30579 succinate-CoA ligase (GDP-forming) (EC 6.2.1.4) pha chain-Arabidopsis thaliana (fragment) | 81 | 69 | 933 |
| 256 | 1 | 1 | 981 | pir\|509411\|S094 | spoIIIE protein-Bacillus subtilis | 81 | 65 | 981 |
| 259 | 3 | 2691 | 1630 | sp\|P28367\|RF2_B | PROBABLE PEPTIDE CHAIN RELEASE FACTOR 2 (RF-2) (FRAGMENT). | 81 | 65 | 1062 |
| 275 | 2 | 1728 | 3581 | gi\|726480 | L-glutamine-D-fructose-6-phosphate aminotransferase [Bacillus ubtilis] | 81 | 68 | 1854 |
| 285 | 1 | 735 | 4 | gi\|1204844 | H. influenzae predicted coding region H10594 [Haemophilus influenzae] | 81 | 63 | 732 |
| 296 | 1 | 99 | 1406 | gi\|467328 | adenylosuccinate synthetase [Bacillus subtilis] | 81 | 67 | 1308 |
| 302 | 9 | 5590 | 5889 | gi\|147485 | queA [Escherichia coli] | 81 | 64 | 300 |
| 317 | 2 | 1137 | 1376 | gi\|154961 | resolvase [Transposon Tn917] | 81 | 51 | 240 |
| 343 | 2 | 1034 | 1342 | gi\|405955 | yeeD [Escherichia coli] | 81 | 60 | 309 |
| 360 | 2 | 1404 | 2471 | gi\|1204570 | aspartyl-tRNA synthetase [Haemophilus influenzae] | 81 | 67 | 1068 |
| 364 | 5 | 5706 | 5161 | gi\|1204652 | methylated-DNA-protein-cysteine methyltransferase [Haemophilus influenzae] | 81 | 63 | 546 |
| 372 | 2 | 1135 | 563 | gi\|467416 | unknown [Bacillus subtilis] | 81 | 65 | 573 |
| 392 | 1 | 43 | 603 | pir\|S09411\|S094 | spoIIIE protein-Bacillus subtilis | 81 | 65 | 561 |
| 404 | 9 | 5252 | 6154 | gi\|606745 | Bex [Bacillus subtilis] | 81 | 65 | 903 |
| 426 | 2 | 1119 | 511 | gi\|39453 | Manganese superoxide digmutase [Bacillus caldotenax] ir\|S22053\|S22053 superoxide dissutase (EC 1.15.1.1) (Mn)- Bacillus ldotenax | 81 | 66 | 609 |

TABLE 2-continued

| | | | | | | | | |
|---|---|---|---|---|---|---|---|---|
| 480 | 7 | 5653 | 5889 | pir\|C37083\|C370 | hypothetical protein II (ospH 3' region)-*Salmonella typhimurium* (fragment) | 81 | 57 | 237 |
| 625 | 3 | 1105 | 2070 | gi\|1262360 | protein kinase PknB [*Mycobacterium leprae*] | 81 | 56 | 966 |
| 754 | 2 | 504 | 1064 | gi\|1303902 | YqhU [*Bacillus subtilis*] | 81 | 71 | 561 |
| 842 | 1 | 86 | 430 | gi\|1405446 | transketolase [*Bacillus subtilis*] | 81 | 68 | 345 |
| 953 | 1 | 400 | 2 | gi\|1205429 | dipeptide transport ATP-binding protein [*Haemophilus influenzae*] | 81 | 57 | 399 |
| 961 | 2 | 252 | 401 | gi\|487686 | synergohymenotropic toxin [*Staphylococcus intermedius*] pir\|S44944\|S44944 synergohymenotropic toxin-*Staphylococcus ntermedius* | 81 | 72 | 150 |
| 1035 | 1 | 1 | 189 | gi\|1046138 | M. genitalius predicted coding region MG423 [*Mycoplasma genitalium*] | 81 | 43 | 189 |
| 1280 | 1 | 449 | 228 | gi\|S59164 | helicase [*Autographa californica* nuclear polyhedrosis virus] sp\|P24307\|V143_NPVAC HELICASE. | 81 | 43 | 222 |
| 3371 | 1 | 68 | 241 | gi\|1322245 | mevalonate pyrophosphate decarboxylase [*Rattus norvegicus*] | 81 | 62 | 174 |
| 3715 | 1 | 239 | 3 | gi\|537137 | ORF_f388 [*Escherichia coli*] | 81 | 58 | 237 |
| 3908 | 1 | 2 | 325 | gi\|439619 | *Salmonella typhisurium* IS200 insertion sequence from SARA17, artial.], gene product *Salmonella typhimurium*] | 81 | 68 | 324 |
| 3940 | 1 | 3 | 401 | gi\|296464 | ATPase [*Lactococcus lactis*] | 81 | 69 | 399 |
| 3954 | 1 | 1 | 318 | gi\|1224069 | amidase [*Moraxella catarrhalis*] | 81 | 68 | 318 |
| 4049 | 1 | 170 | 3 | gi\|603768 | HutI protein, imidazolone-5-propionate hydrolase [*Bacillus subtilis*] gi\|603768 HutI protein. imidazolone-5-propionate hydrolase *Bacillus subtilis*] | 81 | 68 | 168 |
| 4209 | 1 | 1 | 324 | gi\|403373 | glycerophosphoryl diester phosphodiesterase [*Bacillus subtilis*] pir\|S37251\|S37251 glycerophosphoryl diester phosphodiesterase-*acillus subtilis* | 81 | 58 | 324 |
| 4371 | 1 | 322 | 17 | gi\|216677 | indolepyruvate docarboxylase [*Enterobacter cloacae*] pir\|S16013\|S16013 indolepyruvate decarboxylase (EC 4.1.1.-)-*nterobacter cloacae* | 81 | 72 | 306 |
| 4387 | 1 | 19 | 228 | gi\|460689 | TVG [*Thermoactinmyces vulgaris*] | 81 | 59 | 210 |
| 4391 | 1 | 306 | 31 | gi\|1524193 | unknown [*Mycobacterium tuberculosis*] | 81 | 67 | 276 |
| 4425 | 1 | 3 | 341 | gi\|143015 | gluconate kinase [*Bacillus subtilis*] | 81 | 66 | 339 |
| 9 | 1 | 847 | 101 | gi\|1064786 | function unknown [*Bacillus subtilis*] | 80 | 62 | 747 |
| 17 | 1 | 311 | 78 | gi\|559164 | helicase [*Autographa californica* nuclear polyhedrosis virus] sp\|P24307\|V143_NPVAC HELICASE. | 80 | 40 | 234 |
| 45 | 2 | 1159 | 2448 | gi\|1109684 | ProV [*Bacillus subtilis*] | 80 | 63 | 1290 |
| 45 | 15 | 4032 | 4733 | gi\|1109687 | ProZ [*Bacillus subtilis*] | 80 | 55 | 702 |
| 54 | 8 | 9502 | 8738 | gi\|563952 | gluconate permease [*Bacillus licheniformis*] | 80 | 62 | 765 |
| 62 | 12 | 7545 | 6238 | gi\|854655 | Na/H antiporter system [*Bacillus alcalophilus*] | 80 | 62 | 1308 |
| 62 | 14 | 8087 | 8683 | gi\|559713 | ORF [*Homo sapiens*] | 80 | 68 | 597 |
| 67 | 16 | 13781 | 14122 | gi\|305002 | ORF_f356 [*Escherichia coli*] | 80 | 65 | 342 |
| 70 | 13 | 10296 | 9097 | gi\|1303995 | YqkN [*Bacillus subtilis*] | 60 | 64 | 1200 |
| 98 | 9 | 6336 | 7130 | gi\|467428 | unknown [*Bacillus subtilis*] | 80 | 68 | 795 |
| 98 | 10 | 7294 | 7833 | gi\|467430 | unknown [*Bacillus subtilis*] | 80 | 64 | 540 |
| 98 | 11 | 7820 | 8737 | gi\|467431 | high level *kasgamycin* resistance [*Bacillus subtilis*] | 80 | 61 | 918 |
| 109 | 16 | 14154 | 14813 | gi\|580875 | ipa-57d gene product *Bacillus subtilis* | 80 | 63 | 660 |
| 112 | 15 | 14294 | 16636 | gi\|1072361 | pyruvate-formate-lyase *Clostridium pasteurianum*] | 80 | 65 | 2343 |
| 139 | 1 | 726 | 4 | gi\|506699 | CapC [*Staphylococcus aureus*] | 80 | 58 | 723 |
| 139 | 2 | 1448 | 717 | gi\|506698 | CapB [*Staphylococcus aureus*] | 80 | 59 | 732 |
| 174 | 4 | 2870 | 2469 | gi\|1146242 | aspartate i-decarboxylase [*Bacillus subtilis*] | 80 | 61 | 402 |
| 177 | 3 | 2102 | 2842 | gi\|467385 | unknown [*Bacillus subtilis*] | 80 | 70 | 741 |
| 184 | 6 | 5912 | 5700 | gi\|161953 | 185-kDa surface antigen [*Trypanososa cruzi*] | 80 | 46 | 213 |
| 186 | 4 | 3875 | 2382 | gi\|289282 | glutamyl-tRNA synthetase [*Bacillus subtilis*] | 80 | 65 | 1494 |
| 205 | 10 | 15140 | 14484 | gi\|40103 | ribosomal protein L4 [*Bacillus stearothermophilus*] | 80 | 66 | 657 |
| 207 | 1 | 140 | 1315 | gi\|460259 | enolase [*Bacillus subtilis*] | 80 | 67 | 1176 |
| 211 | 3 | 1078 | 1590 | gi\|410131 | ORFX7 [*Bacillus subtilis*] | 80 | 61 | 513 |
| 235 | 2 | 1962 | 2255 | gi\|143797 | valyl-tRNA synthetase [*Bacillus stearothermophilus*] sp\|P11931\|SYV_BACST VALYL-TRNA SYNTHETASE (EC 6.1.1.9) VALINE-TRNA LIGASE) (VALRS). | 80 | 55 | 294 |
| 239 | 1 | 1 | 1263 | gi\|143000 | proton glutamate symport protein [*Bacillus stearothermophilus*] pir\|S26247\|S26247 glutamate/aspartate transport protein-*Bacillus tearothermophilus* | 80 | 59 | 1263 |
| 272 | 5 | 2461 | 2198 | gi\|709993 | hypothetical protein [*Bacillus subtilis*] | 80 | 54 | 264 |
| 301 | 3 | 1111 | 776 | gi\|467418 | unknown [*Bacillus subtilis*] | 80 | 58 | 336 |
| 310 | 4 | 4501 | 3305 | gi\|1177686 | acuC gene product [*Staphylococcus cylosus*] | 80 | 67 | 1197 |
| 310 | 6 | 5258 | 7006 | gi\|348053 | acetyl-CoA synthetase [*Bacillus subtilis*] | 80 | 67 | 1749 |
| 310 | 7 | 7410 | 9113 | gi\|1103865 | forsyl-tetrahydrofolate synthetase [*Streptococcus mutans*] | 80 | 67 | 1704 |
| 325 | 3 | 1114 | 1389 | gi\|310325 | outer capsid protein [*Rotavirus sp.*] | 80 | 40 | 276 |
| 337 | 1 | 636 | 4 | gi\|537049 | ORF_o470 [*Escherichia coli*] | 80 | 55 | 633 |
| 374 | 2 | 929 | 1228 | gi\|1405448 | YneF [*Bacillus subtilis*] | 80 | 70 | 300 |
| 375 | 5 | 3062 | 3331 | gi\|467448 | unknown [*Bacillus subtilis*] | 80 | 68 | 270 |
| 388 | 1 | 267 | 587 | gi\|1064791 | function umknown [*Bacillus subtilis*] | 80 | 65 | 321 |
| 394 | 1 | 9 | 659 | gi\|304976 | matches PS00017: ATP_GTP_A and PS00301: EFACTOR_GTP; similar to longation factor G, TetM/TetO tetracycline-resistance proteins [*Escherichia coli*] | 80 | 65 | 653 |
| 456 | 1 | 625 | 1263 | gi\|1141183 | putative [*Bacillus subtilis*] | 80 | 65 | 639 |
| 475 | 1 | 1 | 654 | gi\|288269 | beta-fructofuranoside [*Staphylococcus xylosus*] | 80 | 66 | 654 |
| 544 | 2 | 1449 | 2240 | gi\|529754 | speC [*Streptococcus pyogenes*] | 80 | 50 | 792 |
| 622 | 4 | 1623 | 1871 | gi\|1483545 | unknown [*Mycobacterium tuberculosis*] | 80 | 65 | 249 |
| 719 | 1 | 11 | 1257 | gi\|1064791 | function umknown [*Bacillus subtilis*] | 80 | 68 | 1257 |

TABLE 2-continued

| | | | | | | | | |
|---|---|---|---|---|---|---|---|---|
| 739 | 1 | 107 | 838 | gi\|666983 | putative ATP binding subunit [*Bacillus subtilis*] | 80 | 61 | 732 |
| 745 | 2 | 414 | 247 | gi\|1511600 | coenzyme PQQ synthesis protein III [*Methanococcus jannaschii*] | 80 | 61 | 168 |
| 822 | 1 | 17 | 679 | gi\|410141 | ORFX17 [*Bacillus subtilis*] | 80 | 68 | 663 |
| 827 | 2 | 836 | 681 | gi\|1205301 | leukotoxin secretion ATP-binding protein [*Haemophilus influenzae*] | 80 | 54 | 156 |
| 1044 | 1 | 3 | 149 | gi\|60632 | vp2 [*Marburg virus*] | | | |
| 1220 | 2 | 413 | 255 | pir\|A61072\|EPSG | gallidermin precursor-*Staphylococcus gallinarum* | 80 | 74 | 159 |
| 2519 | 1 | 75 | 275 | gi\|147556 | dpj [*Escherichia coli*] | 80 | 45 | 201 |
| 2947 | 1 | 279 | 55 | gi\|1184680 | polynucleotide phosphorylase [*Bacillus subtilis*] | 80 | 62 | 225 |
| 3120 | 1 | 2 | 226 | gi\|517205 | 67 kDa Myosin-crossreactive streptococcal antigen [*Streptococcus yogenes*] | 80 | 65 | 225 |
| 3191 | 1 | 148 | 2 | gi\|151259 | HMG-COA reductase (EC 1.1.1.88) [*Pseudomonas mevaionii*] pir\|A44756\|A44756 hydroxymethylglutaryl-CoA reductase (EC 1.1.1.88) Pseudomonas sp. | 80 | 59 | 147 |
| 3560 | 2 | 285 | 434 | gi\|217130 | photosystem I core protein B [*Synechococcus vulcanus*] | 80 | 70 | 150 |
| 3655 | 1 | 47 | 346 | gi\|415855 | deoxyribose aldolase [*Mycoplasma hominis*] | 80 | 56 | 300 |
| 3658 | 2 | 324 | 584 | gi\|551531 | 2-nitropropane dioxygenase [*Williopsis saturnus*] | 80 | 54 | 261 |
| 3769 | 1 | 400 | 2 | gi\|1339950 | large subunit of NADN-dependent glutamate synthase [*Plectonema boryanum*] | 80 | 68 | 399 |
| 3781 | 1 | 348 | 4 | gi\|166412 | NADH-glutamate synthase [*Medicago sativa*] | 80 | 62 | 345 |
| 3988 | 1 | 48 | 287 | gi\|1204696 | fructose-permease IIBC component [*Haemophilus influenzae*] | 80 | 69 | 240 |
| 4030 | 1 | 287 | 3 | gi\|1009366 | Respiratory nitrate reductase [*Bacillus subtilis*] | 80 | 60 | 285 |
| 4092 | 1 | 275 | 3 | gi\|1370207 | orf6 [*Lactobacillus sake*] | 80 | 69 | 273 |
| 4103 | 1 | 342 | 4 | gi\|39956 | IIGlc [*Bacillus subtilis*] | 80 | 65 | 339 |
| 4231 | 1 | 348 | 4 | gi\|289287 | UDP-glucose pyrophosphorylase [*Bacillus subtilis*] | 80 | 65 | 345 |
| 4265 | 1 | 299 | 3 | gi\|603768 | HutI protein, imidazolone-5-propionate hydrolase [*Bacillus subtilis*] gi\|603768 HutI protein, imidazolone-5-propionate hydrolase *Bacillus subtilis*] | 80 | 63 | 297 |
| 4504 | 1 | 250 | 2 | gi\|1339950 | large subunit of NADH-dependent glutamate synthase [*Plectonema boryanum*] | 80 | 68 | 249 |
| 2 | 6 | 5998 | 6798 | gi\|535351 | CodY [*Bacillus subtilis*] | 79 | 63 | 801 |
| 4 | 7 | 7051 | 5807 | gi\|603768 | HutI protein, imidazolone-5-propionate hydrolase [*Bacillus subtilis*] gi\|603768 HutI protein, imidazolone-5-propionate hydrolase *Bacillus subtilis*] | 79 | 64 | 1245 |
| 25 | 6 | 5273 | 5515 | pir\|A36728\|A367 | acyl carrier protein-*Rhizobium meliloti* | 79 | 65 | 243 |
| 59 | 2 | 1173 | 1424 | gi\|1147923 | threonine dehydratase 2 (EC 4.2.1.16) [*Escherichia coli*] | 79 | 75 | 252 |
| 60 | 1 | 1 | 204 | gi\|1666115 | orf1 upstream of glucose kinase [*Staphylococcus xylosus*] pir\|S52351\|S52351 hypothetical protein 1-*Staphylococcus xylosua* | 79 | 60 | 204 |
| 81 | 1 | 1590 | 178 | gi\|466882 | pps1; B1496_C2_189 [*Mycobacterium leprae*] | 79 | 64 | 1413 |
| 85 | 7 | 6505 | 5987 | gi\|143364 | phosphoribosyl aminoimidazole carboxylase I (PUR-E) [*Bacillus ubtilis*] | 79 | 60 | 519 |
| 89 | 6 | 4554 | 3448 | gi\|144906 | product homologous to *E. coli* thioredoxin reductase: J. Biol. Chem. 1988) 263: 9015–9019, and to F52a protein of alkyl hydroperoxide eductase from *S. typhimurium*: J. Biol. Chem. (1990) 265: 10535–10540; pen reading frame A [*Clostridium pasteurianum*] | 79 | 35 | 1107 |
| 102 | 11 | 7489 | 8571 | gi\|143093 | ketol-acid reductoisomerase. [*Bacillus subtilis*] sp\|P37253\|ILVC_BACSU KETOL-ACID REDUCTOISDMERASE (EC 1.1.1.86) ACETOHYDROXY-ACID ISOMERDREDUCTASE) ALPHA-RETO-BETA-HYDROXYLACIL EDUCTOISOMERASE). | 79 | 64 | 1083 |
| 102 | 14 | 11190 | 12563 | gi\|149428 | putative [*Lactococcus lactis*] | 79 | 65 | 1374 |
| 127 | 9 | 7792 | 9372 | gi\|458688 | PrfC/RF3 [*Dichelobacter nodosus*] | 79 | 68 | 1581 |
| 139 | 3 | 1983 | 1426 | gi\|506697 | CaPA [*Staphylococcus aureus*] | 79 | 55 | 558 |
| 144 | 2 | 1156 | 668 | gi\|1498296 | peptide methionine sulfoxide reductase [*Streptococcus pneumoniae*] | 79 | 47 | 489 |
| 148 | 2 | 529 | 1098 | gi\|467457 | hypoxanthine-guanine phosphoribosyltransferase [*Bacillus subtilis*] gi\|467457 hypoxenthine-guanine phosphoribosyltransfarase [*Bacillus ubtilis*] | 79 | 59 | 570 |
| 150 | 1 | 591 | 217 | gi\|755602 | unknown [*Bacillus subtilis*] | 79 | 61 | 375 |
| 176 | 1 | 587 | 135 | gi\|297874 | fructose-bisphosphate aldolase [*Staphylococcus carnosus*] pir\|A49943\|A49943 fructose-bisphosphate aldolase (EC 4.1.2.13)-*taphylococcus carnosus* (strain TM300) | 79 | 65 | 453 |
| 186 | 7 | 6874 | 6164 | gi\|1314298 | ORF5; putative Sms protein; similar to Sms proteins from *Haemophilus influenzae* and *Escherichia coli* [*Listeria monocytogenes*] | 79 | 64 | 711 |
| 205 | 16 | 8498 | 8109 | gi\|1044980 | ribosomal protein L18 [*Bacillus subtilis*] | 79 | 70 | 390 |
| 211 | 1 | 1 | 519 | gi\|1303994 | YqkM [*Bacillus subtilis*] | 79 | 62 | 519 |
| 223 | 2 | 2801 | 1419 | gi\|488430 | alcohol dehydrogenase 2 [*Entamoeba histolytica*] | 79 | 60 | 1383 |
| 243 | 8 | 7896 | 6877 | gi\|580883 | ipa-88d gene product [*Bacillus subtilis*] | 79 | 60 | 1020 |
| 279 | 4 | 3721 | 4329 | gi\|413930 | ipa-6d gene product [*Bacillus subtilis*] | 79 | 59 | 609 |
| 300 | 1 | 11 | 1393 | gi\|403372 | glycerol 3-phosphate permease [*Bacillus subtilis*] | 79 | 62 | 1383 |
| 307 | 3 | 1935 | 940 | gi\|950062 | hypothetical yeast protein 1 [*Mycoplasma capricolum*] pir\|S48578\|S48578 hypothetical protein-*Mycoplasma capricolum* SGC3) fragment) | 79 | 60 | 996 |
| 352 | 6 | 8886 | 7666 | gi\|216854 | P47K [*Pseudomonas chlororaphis*] | 79 | 59 | 1221 |
| 412 | 1 | 578 | 3 | gi\|143177 | putative [*Bacillus subtilis*] | 79 | 51 | 576 |
| 481 | 3 | 621 | 1124 | gi\|786163 | Ribosomal Protein L10 [*Bacillus subtilis*] | 79 | 66 | 504 |
| 516 | 1 | 352 | 2 | gi\|805090 | NisF [*Lactococcus lactis*] | 79 | 48 | 351 |
| 525 | 2 | 1426 | 395 | gi\|143371 | phosphoribosyl aminoimidazole synthetase (PUR-M) [*Bacillus subtilis*] pir\|H29326\|AJBSCL phosphoribosylformylglycinamidine cyclo-ligase EC 6.3.3.1)-*Bacillus subtilis* | 79 | 61 | 1032 |

TABLE 2-continued

| | | | | | | | | |
|---|---|---|---|---|---|---|---|---|
| 538 | 4 | 2825 | 2202 | gi\|1370207 | orf6 [*Lactobacillus sake*] | 79 | 67 | 624 |
| 570 | 1 | 2 | 421 | gi\|476160 | arginine permease substrate-binding subunit [*Listeria monocytogenes*] | 79 | 6 | 420 |
| 645 | 8 | 2663 | 3241 | gi\|53898 | transport protein [*Salmonella typhimurium*] | 79 | 62 | 579 |
| 683 | 1 | 75 | 374 | gi\|1064795 | function unknown [*Bacillus subtilis*] | 79 | 62 | 300 |
| 816 | 3 | 3987 | 3274 | gi\|1407784 | orf-1; novel antigen [*Staphylococcus aureus*] | 79 | 62 | 714 |
| 2929 | 1 | 3 | 401 | gi\|1524397 | glycine betaine transporter CpuD [*Bacillus subtilis*] | 79 | 81 | 399 |
| 2937 | 1 | 202 | 47 | pir\|A52915\|S529 | nitrate reductase alpha chain-*Bacillus subtilis* (fragment) | 79 | 58 | 156 |
| 2940 | 1 | 385 | 2 | gi\|149429 | putative [*Lactococcus lactis*] | 79 | 72 | 384 |
| 2946 | 1 | 286 | 2 | gi\|143267 | 2-oxoglutamate dehydrogenase (odhA; EC 1.2.4.2) [*Bacillus subtilis*] | 79 | 61 | 285 |
| 2999 | 1 | 3 | 212 | gi\|710020 | nitrite reductase (nirB) [*Bacillus subtilis*] | 79 | 59 | 210 |
| 3022 | 1 | 322 | 150 | gi\|450686 | 3-phosphoglycerate kinase [*Thermotoga maritima*] | 79 | 61 | 183 |
| 3064 | 1 | 3 | 314 | gi\|1204436 | pyruvate formate-lyase [*Haemophilus influenzae*] | 79 | 60 | 312 |
| 3083 | 1 | 2 | 220 | gi\|1149662 | hypD gene product [*Clostridium perfringens*] | 79 | 56 | 219 |
| 3126 | 1 | 411 | 321 | gi\|1339950 | large subunit of NADH-dependent glutamate synthase [*Plectonema boryanum*] | 79 | 55 | 291 |
| 3181 | 1 | 326 | 45 | gi\|1339950 | large subunit of NADH-dependent glutamate synthase [*Plectonema boryanum*] | 79 | 59 | 282 |
| 3345 | 3 | 3 | 476 | gi\|871784 | Clp-like ATP-dependent protease binding subunit [*Bos taurus*] | 79 | 63 | 474 |
| 3718 | 1 | 270 | 4 | pir\|C36889\|C368 | leuB protein, inactive-*Lactococcus lactis* subsp. *lactis* (strain IL1403) | 79 | 71 | 267 |
| 3724 | 2 | 159 | 401 | gi\|1009366 | Respiratory nitrate reductase [*Bacillus subtilis*] | 79 | 64 | 243 |
| 3836 | 1 | 312 | 16 | gi\|1524193 | unknown [*Mycobacterium tuberculosis*] | 79 | 65 | 297 |
| 3941 | 1 | 2 | 334 | gi\|415855 | deoxyribose aldolase [*Mycoplasma hominis*] | 79 | 54 | 333 |
| 4113 | 1 | 3 | 341 | gi\|143015 | gluconate kinase [*Bacillus subtilis*] | 79 | 63 | 339 |
| 4501 | 1 | 209 | 12 | gi\|1022726 | unknown [*Staphylococcus haemolyticus*] | 79 | 66 | 198 |
| 4612 | 1 | 2 | 238 | gi\|460689 | TVG [*Thermoactinomyces vulgaris*] | 79 | 58 | 237 |
| 2 | 1 | 2 | 1213 | gi\|520753 | DNA topoisomerase I [*Bacillus subtilis*] | 78 | 64 | 1212 |
| 8 | 2 | 1220 | 174 | gi\|216151 | DNA polymerase (gene L; ttg start codon) [Bacteriophage SPO2] gi\|S79197 SPO2 DNA polymerase (aa 1–648) [Bacteriophage SPO2] pir\|A21498\|DJBPS2 DNA-directed DNA polymerase (EC 2.7.7.7)-phage PO2 | 78 | 72 | 1047 |
| 9 | 2 | 1089 | 838 | gi\|1064787 | function unknown [*Bacillus subtilis*] | 78 | 57 | 252 |
| 32 | 8 | 6803 | 7702 | gi\|146974 | NH3-dependent NAD synthetase [*Escherichia coli*] | 78 | 63 | 900 |
| 36 | 4 | 2941 | 3138 | gi\|290503 | glutamate permease [*Escherichia coli*] | 78 | 53 | 198 |
| 53 | 15 | 16221 | 14758 | gi\|1303941 | YqiV [*Bacillus subtilis*] | 78 | 58 | 1464 |
| 57 | 14 | 10520 | 12067 | gi\|3072418 | glcA gene product [*Staphylococcus carnosus*] | 78 | 65 | 1548 |
| 66 | 7 | 5812 | 4826 | gi\|1212729 | YqhJ [*Bacillus subtilis*] | 78 | 67 | 987 |
| 67 | 4 | 4029 | 4376 | gi\|466612 | nikA [*Escherichia coli*] | 78 | 71 | 348 |
| 91 | 9 | 10058 | 10942 | gi\|467380 | stage 0 sporulation [*Bacillus subtilis*] | 78 | 51 | 885 |
| 102 | 12 | 8574 | 10130 | gi\|149426 | putative [*Lactococcus lactis*] | 78 | 61 | 1557 |
| 112 | 6 | 3540 | 4463 | gi\|854234 | cymC gene product [*Klebsiella oxytoca*] | 78 | 56 | 924 |
| 124 | 2 | 1061 | 234 | gi\|405622 | unknown [*Bacillus subtilis*] | 78 | 60 | 828 |
| 130 | 3 | 1805 | 2260 | gi\|1256636 | putative [*Bacillus subtilis*] | 78 | 71 | 456 |
| 133 | 1 | 377 | 3 | gi\|168060 | lamB [*Emericella nidulans*] | 78 | 59 | 375 |
| 166 | 4 | 6163 | 5201 | gi\|451216 | Mannosephosphate Isomerase [*Streptococcus mutans*] | 78 | 63 | 963 |
| 186 | 1 | 795 | 4 | gi\|289284 | cysteinyl-tRNA synthetase [*Bacillus subtilis*] | 78 | 63 | 792 |
| 195 | 4 | 2315 | 1881 | gi\|1353874 | unknown [*Rhodobacter capsulatus*] | 78 | 58 | 435 |
| 199 | 3 | 3623 | 2967 | gi\|143525 | succinate dehydrogenase cytochrome b-558 subunit [*Bacillus subtilis*] pir\|A29843\|DEBSSC succinate dehydrogenase (EC 1.3.99.1) Cytochrome 558-*Bacillus subtilis* | 78 | 57 | 657 |
| 199 | 4 | 5557 | 3905 | gi\|142521 | deoxyribodipyrimidine photolyase [*Bacillus subtilis*] uvrB pir\|A37192\|A37192 protein-*Bacillus subtilis* sp\|P14951\|UVRC_BACSU EXCINUCLEASE ABC SUBUNIT C. | 78 | 62 | 1653 |
| 223 | 3 | 3523 | 3215 | gi\|439596 | [*Escherichia coli* IS200 insertion sequence from ECOR63, partial.], ene product [*Escherichia coli*] | 78 | 47 | 309 |
| 299 | 4 | 1865 | 2149 | gi\|467439 | temperature sensitive cell division [*Bacillus subtilis*] | 78 | 62 | 285 |
| 321 | 9 | 7315 | 6896 | gi\|142979 | ORF3 is homologous to an ORF downstream of the spoT gene of *E. coli*; RF3 [*Bacillus stearothermophilus*] | 78 | 55 | 420 |
| 352 | 4 | 3714 | 3944 | gi\|349050 | actin 1 [*Pneumocystis carinii*] | 78 | 42 | 231 |
| 352 | 5 | 6093 | 4594 | gi\|903587 | NADN dehydrogenase subunit 5 [*Bacillus subtilis*] sp\|P39755\|NDNF_BACSU NADN DEHYDROGENASE SUBUNIT 5 (EC 1.6.5.3) NADN-UBIQUINONE OXIDOREDUCTASE CHAIN 5). | 78 | 58 | 1500 |
| 376 | 1 | 2 | 583 | gi\|551693 | dethiobiotin synthase [*Bacillus sphaericus*] | 78 | 34 | 582 |
| 424 | 2 | 1595 | 1768 | gi\|1524117 | alpha-acetolactate decarboxylase [*Lactococcus lactis*] | 78 | 68 | 174 |
| 450 | 1 | 988 | 62 | gi\|1030068 | AND(P)N oxidoreductase isoflavone reductase homologue [*Solanum tuberosum*] | 78 | 63 | 927 |
| 558 | 1 | 562 | 362 | gi\|1511588 | bifunctional protein [*Methanococcus jannaschii*] | 78 | 60 | 201 |
| 670 | 3 | 1152 | 1589 | gi\|1122759 | unknown [*Bacillus subtilis*] | 78 | 64 | 438 |
| 714 | 1 | 64 | 732 | gi\|143460 | 37 kd minor sigma factor (rpoF, sigB; ttg start codon [*Bacillus ubtilis*] | 78 | 57 | 669 |
| 814 | 1 | 3 | 368 | gi\|1377833 | unknown [*Bacillus subtilis*] | 78 | 59 | 366 |
| 981 | 1 | 692 | 3 | gi\|143802 | GerC2 [*Bacillus subtilis*] | 78 | 64 | 690 |
| 995 | 2 | 727 | 476 | gi\|296947 | uridine kinase [*Escherichia coli*] | 78 | 64 | 252 |
| 1045 | 1 | 3 | 401 | gi\|1407784 | orf-1; novel antigen [*Staphylococcus aureus*] | 78 | 61 | 399 |
| 1163 | 2 | 186 | 4 | gi\|410117 | diaminopimelate decarboxylase [*Bacillus subtilis*] | 78 | 54 | 183 |
| 2191 | 1 | 1 | 399 | gi\|235098 | excisionase [Bacteriophage 154a] | 78 | 65 | 396 |
| 2933 | 1 | 2 | 181 | gi\|1204436 | pyruvate formate-lyase [*Haemophilus influenzae*] | 78 | 73 | 180 |
| 3041 | 2 | 129 | 317 | gi\|624632 | GltL [*Escherichia coli*] | 78 | 53 | 189 |

TABLE 2-continued

| | | | | | | | | |
|---|---|---|---|---|---|---|---|---|
| 3581 | 1 | 105 | 401 | gi\|763186 | 3-ketoacyl-coA thiolase [*Saccharomyces cerevisiae*] | 78 | 55 | 297 |
| 3709 | 1 | 3 | 230 | gi\|460689 | TVG [*Thermoactinomyces vulgaris*] | 78 | 58 | 228 |
| 3974 | 1 | 265 | 2 | gi\|558839 | unknown [*Bacillus subtilis*] | 78 | 65 | 264 |
| 3980 | 1 | 3 | 401 | gi\|39956 | IIGlc [*Bacillus subtilis*] | 78 | 62 | 399 |
| 4056 | 1 | 354 | 61 | gi\|1256635 | dihydroxy-acid dehydratase [*Bacillus subtilis*] | 78 | 55 | 294 |
| 4114 | 1 | 316 | 2 | pir\|S09372\|S093 | hypothetical protein-*Trypanosoma brucei* | 78 | 62 | 315 |
| 4185 | 1 | 3 | 179 | gi\|1339950 | large subunit of NADN-dependent glutamate synthase [*Plectonema boryanum*] | 78 | 58 | 177 |
| 4235 | 1 | 329 | 3 | gi\|558839 | unknown [*Bacillus subtilis*] | 78 | 60 | 327 |
| 4352 | 1 | 302 | 63 | gi\|603768 | HutI protein, imidazolone-5-propionate hydrolase [*Bacillus subtilis*] gi\|603768 HutI protein, imidazolone-5-propionate hydrolase *Bacillus subtilis*] | 78 | 63 | 240 |
| 4368 | 1 | 307 | 2 | gi\|1353678 | heavy-metal transporting P-type ATPase [*Proteus mirabilis*] | 78 | 59 | 306 |
| 4461 | 1 | 216 | 4 | gi\|1276841 | glutamate synthase (GOGAT) [*Porphya purpurea*] | 78 | 36 | 213 |
| 4530 | 1 | 238 | 2 | gi\|39956 | IIGlc [*Bacillus subtilis*] | 78 | 65 | 237 |
| 3 | 2 | 2073 | 1177 | gi\|1109684 | ProV [*Bacillus subtilis*] | 77 | 56 | 897 |
| 12 | 2 | 1965 | 1504 | gi\|467335 | ribosomal protein L9 [*Bacillus subtilis*] | 77 | 59 | 462 |
| 27 | 1 | 2 | 388 | gi\|1212728 | YqhI [*Bacillus subtilis*] | 77 | 63 | 387 |
| 39 | 2 | 590 | 1252 | gi\|40054 | phenylalanyl-tRNA synthetase beta subunit (AA 1-804) [*Bacillus btilis*] | 77 | 60 | 663 |
| 42 | 6 | 2704 | 2931 | gi\|606241 | 30S ribosomal subunit protein S14 [*Escherichia coli*] sp\|P02370\|RS14_ECOLI 30S RIBOSOMAL PROTEIN S14. (SUB 2-101) | 77 | 65 | 228 |
| 46 | 18 | 15459 | 16622 | gi\|297798 | mitochondrial formate dehydrogenase precursor [*Solanum tuberosum*] pir\|JQ2272\|JQ2272 formate dehydrogenase (EC 1.2.1.2) precursor, itochondrial-potato | 77 | 55 | 1164 |
| 100 | 4 | 4002 | 3442 | gi\|1340128 | ORF1 [*Staphylococcus aureus*] | 77 | 54 | 561 |
| 102 | 8 | 5378 | 5713 | gi\|1311482 | acetolactate synthase [*Thermus aquaticus*] | 77 | 57 | 336 |
| 109 | 7 | 4742 | 5383 | gi\|710637 | unknown [*Bacillus subtilis*] | 77 | 56 | 642 |
| 117 | 1 | 2 | 1228 | gi\|1237015 | ORF4 [*Bacillus subtilis*] | 77 | 53 | 1227 |
| 124 | 1 | 7688 | 7053 | gi\|405819 | thymidine kinase [*Bacillus subtilis*] | 77 | 63 | 636 |
| 147 | 3 | 985 | 824 | gi\|849027 | hypothetical 15.9-kDa protein [*Bacillus subtilis*] | 77 | 37 | 162 |
| 152 | 10 | 7354 | 7953 | gi\|1205583 | spermidine/putrescine transport ATP-binding protein [*Haemophilus influenzae*] | 77 | 55 | 600 |
| 169 | 2 | 1004 | 1282 | gi\|473825 | 'elongation factor EF-Ts' [*Escherichia coli*] | 77 | 58 | 279 |
| 184 | 2 | 380 | 1147 | gi\|216314 | esterase [*Bacillus stearothermophilus*] | 77 | 60 | 768 |
| 189 | 7 | 3296 | 3868 | gi\|853809 | ORF3 [*Clostridium perfringens*] | 77 | 48 | 573 |
| 193 | 1 | 132 | 290 | gi\|1303788 | YgeH [*Bacillus subtilis*] | 77 | 54 | 159 |
| 195 | 8 | 8414 | 8088 | gi\|1499620 | *M. jannaschii* predicted coding region MJ0798 [*Methanococcus jannaschii*] | 77 | 44 | 327 |
| 205 | 8 | 5204 | 4980 | gi\|216340 | ORF for adenylate kinase [*Bacillus subtilis*] | 77 | 61 | 225 |
| 205 | 29 | 14502 | 14209 | gi\|786155 | Ribosomal Protein L23 [*Bacillus subtilis*] | 77 | 62 | 294 |
| 211 | 5 | 1908 | 2084 | gi\|410332 | ORFX8 [*Bacillus subtilis*] | 77 | 47 | 177 |
| 217 | 5 | 3478 | 4416 | gi\|496254 | fibronectin/fibrinogen-binding protein [*Streptococcus pyogenes*] | 77 | 54 | 939 |
| 232 | 1 | 267 | 998 | gi\|1407784 | orf-1; novel antigen [*Staphylococcus aureus*] | 77 | 57 | 732 |
| 233 | 2 | 1346 | 873 | gi\|467408 | unknown [*Bacillus subtilis*] | 77 | 61 | 474 |
| 243 | 3 | 2299 | 1937 | gi\|516155 | unconventional myosin [*Sus scrofa*] | 77 | 32 | 363 |
| 299 | 1 | 68 | 769 | gi\|467436 | unknown [*Bacillus subtilis*] | 77 | 54 | 702 |
| 301 | 4 | 1283 | 1098 | gi\|950073 | ATP-bind. pyrimidine kinase [*Mycoplasma capricolum*] pir\|S48605\|S48605 hypothetical protein-*Mycoplasma capricolum SGC3*) (fragment) | 77 | 48 | 386 |
| 302 | 5 | 2741 | 3211 | gi\|508980 | pheB [*Bacillus subtilis*] | 77 | 57 | 471 |
| 302 | 7 | 3835 | 4863 | gi\|147783 | ruvB protein [*Escherichia coli*] | 77 | 60 | 3029 |
| 307 | 9 | 4797 | 4192 | gi\|1070015 | protein-dependent [*Bacillus subtilis*] | 77 | 60 | 606 |
| 312 | 1 | 99 | 1391 | gi\|143165 | malic enzyme (EC 1.1.1.38) [*Bacillus stearothermophilus*] pir\|A33307\|DEBSXS malate dehydrogenase oxaloacetate-decarboxylating) (EC 1.1.1.38)-*Bacillus tearothemophilus* | 77 | 62 | 1293 |
| 312 | 2 | 1541 | 2443 | gi\|1399855 | carboxyltransferase beta subunit [*Synechococcus PCC7942*] | 77 | 58 | 903 |
| 321 | 5 | 4596 | 3526 | gi\|39844 | fumarase (citG) (aa 1–482) [*Bacillus subtilis*] | 77 | 65 | 1071 |
| 354 | 1 | 47 | 568 | gi\|1154634 | YmaB [*Bacillus subtilis*] | 77 | 57 | 522 |
| 365 | 1 | 2 | 1021 | gi\|143374 | phosphoribosyl glycinamide synthetase (PUR-D; gtg start codon) *Bacillus subtilis*] | 77 | 62 | 1020 |
| 374 | 1 | 1 | 708 | gi\|1405446 | transketolase [*Bacillus subtilis*] | 77 | 61 | 708 |
| 385 | 1 | 565 | 2 | gi\|533099 | endonuclease III [*Bacillus subtilis*] | 77 | 63 | 564 |
| 392 | 2 | 594 | 1940 | gi\|556014 | UDP-N-acetyl muramate-alanine ligase [*Bacillus subtilis*] sp\|P40778\|MURC_BACSU UDP-N-ACETYLMURAMATE-ALANINE LIGASE (EC .3.2.8) (UDP-N-ACETYLMURANOYL-L-ALANINE SYNTHETASE) (FRAGMENT) | 77 | 65 | 1347 |
| 405 | 5 | 3570 | 3061 | gi\|1303912 | YqhW [*Bacillus subtilis*] | 77 | 64 | 510 |
| 487 | 4 | 1302 | 1472 | gi\|432427 | ORF1 gene product [*Acinetobacter calcoaceticus*] | 77 | 48 | 171 |
| 522 | 1 | 2 | 562 | pir\|A01379\|SYBS | tyrosine-tRNA ligase (EC 6.1.1.1)-*Bacillus stearothermophilus*] | 77 | 63 | 561 |
| 523 | 2 | 1351 | 1115 | gi\|1387979 | 44% identity over 302 residues with hypothetical protein from Synechocystis sp. accession D64006_CD; expression induced by environmental stress; some similarity to glycosyl transferases; two potential membrane-spanning helices [*Bacillus subtil* | 77 | 48 | 237 |
| 536 | 2 | 612 | 241 | gi\|143366 | adenylsuccinate lyase (PUR-B) [*Bacillus subtilis*] pir\|C29326\|MZBSDS adenylosuccinate lyase (EC 4.3.2.2)-*Bacillus ubtilis* | 77 | 61 | 372 |
| 548 | 2 | 339 | 872 | gi\|143387 | aspartate transcarbamylase [*Bacillus subtilis*] | 77 | 56 | 534 |

TABLE 2-continued

| | | | | | | | | |
|---|---|---|---|---|---|---|---|---|
| 597 | 1 | 2 | 481 | gi\|904198 | hypothetical protein [*Bacillus subtilis*] | 77 | 33 | 480 |
| 633 | 2 | 1313 | 879 | gi\|387577 | ORF1A [*Bacillus subtilis*] | 77 | 64 | 435 |
| 642 | 1 | 85 | 360 | gi\|46971 | epiP gene producer [*Staphylococcus epidermidis*] | 77 | 61 | 276 |
| 659 | 1 | 125 | 1219 | gi\|1072381 | glutamyl-aminopeptidase [*Lactococcus lactis*] | 77 | 62 | 1095 |
| 670 | 4 | 1587 | 1820 | gi\|1122760 | unknown [*Bacillus subtilis*] | 77 | 58 | 234 |
| 789 | 1 | 2 | 391 | gi\|1377823 | aminopeptidase [*Bacillus subtilis*] | 77 | 65 | 390 |
| 815 | 1 | 10 | 573 | gi\|1303861 | YqgN [*Bacillus subtilis*] | 77 | 49 | 564 |
| 899 | 1 | 2 | 225 | gi\|1204844 | H. influenzae predicted coding region HI0594 [*Haemophilus influenzae*] | 77 | 55 | 225 |
| 1083 | 1 | 3 | 188 | gi\|460828 | B969 [*Saccharomyces cerevisiae*] | 77 | 66 | 186 |
| 1942 | 1 | 209 | 3 | gi\|160047 | p101/acidic basic repeat antigen [*Plasmodium falciparum*] pir\|A29232\|A29232 101K malaria antigen precursor-*Plasmodium alciparum* (strain Camp) | 77 | 38 | 207 |
| 2559 | 1 | 1 | 171 | gi\|1499034 | M. jannaschii predicted coding region MJ0255 [*Methanococcus jannaschii*] | 77 | 61 | 171 |
| 2933 | 2 | 243 | 401 | gi\|42370 | pyruvate formate-lyase (AA 1–760) [*Escherichia coli*] ir\|S01788\|S01788 formate C-acetyltransferase (EC 2.3.1.54)-*cherichia coli* | 77 | 72 | 159 |
| 2966 | 1 | 56 | 292 | gi\|1524397 | glycine betaine transporter OpuD [*Bacillus subtilis*] | 77 | 45 | 237 |
| 2976 | 1 | 309 | 4 | gi\|40003 | oxoglutamate dehydrogenase (NADP) [*Bacillus subtilis*] p\|P23129\|ODO1_BACSU 2-OXOGLUTAMATE DEHYDROGENASE E1 COMPONENT (EC 2.4.2) (ALPHA-KETOGLUTARATE) DEHYDROGENASE. | 77 | 60 | 306 |
| 2979 | 2 | 400 | 122 | gi\|1204354 | spore germination and vegetative growth protein [*Haemophilus influenzae*] | 77 | 61 | 279 |
| 2988 | 1 | 377 | 153 | gi\|438465 | Probable operon with orfF. Possible alternative initiation codon, ases 2151–2153. Homology with acetyltransferases.; putative *Bacillus subtilis*] | 77 | 55 | 225 |
| 2990 | 1 | 167 | 3 | gi\|142562 | ATP synthase epsilon subunit [*Bacillus megaterium*] pir\|B28599\|PWBSEN H-transporting ATP synthase (EC 3.6.1.34) psilon chain-*Bacillus megaterium*] | 77 | 63 | 165 |
| 3032 | 1 | 3 | 389 | gi\|488130 | alcohol dehydrogenase 2 [*Entamoeba histolytica*] | 77 | 56 | 387 |
| 3057 | 1 | 1 | 195 | gi\|468764 | mocR gene product [*Rhizobium meliloti*] | 77 | 50 | 195 |
| 4008 | 1 | 400 | 74 | gi\|603768 | HutI protein, imidazolone-5-propionate hydrolase [*Bacillus subtilis*] gi\|603768 HutI protein, imidazolone-5-propionate hydrolase *Bacillus subtilis*] | 77 | 52 | 327 |
| 4048 | 1 | 386 | 69 | gi\|216278 | gramicidin S synthetase [*Bacillus brevis*] | 77 | 55 | 318 |
| 4110 | 1 | 3 | 368 | pir\|S52915\|S529 | nitrate reductase alpha chain-*Bacillus subtilis* (fragment) | 77 | 61 | 366 |
| 4111 | 1 | 1 | 348 | gi\|517205 | 67 kDa Myosin-crossreactive *streptococcal* antigen [*Streptococcus yogenes*] | 77 | 65 | 348 |
| 4225 | 1 | 297 | 4 | gi\|1322245 | mevalonate pyrophosphate decarboxylase [*Rattus norvegicus*] | 77 | 60 | 294 |
| 4611 | 2 | 327 | 160 | gi\|508979 | GTP-binding protein [*Bacillus subtilis*] | 77 | 57 | 168 |
| 4668 | 1 | 182 | 3 | pir\|S52915\|S529 | nitrate reductase alpha chain-*Bacillus subtilis* (fragment) | 77 | 61 | 180 |
| 25 | 1 | 2 | 1627 | gi\|1150620 | MmsA [*Streptococcus pneumoniae*] | 76 | 58 | 1626 |
| 38 | 5 | 1488 | 2537 | pir\|A43577\|A435 | regulatory protein pfoR-*Clostridium perfringens* | 76 | 57 | 1050 |
| 52 | 5 | 2962 | 4041 | gi\|1161061 | dioxygenase [*Methylobacterium extorguens*] | 76 | 62 | 1080 |
| 56 | 20 | 27389 | 27955 | gi\|467402 | unknown [*Bacillus subtilis*] | 76 | 56 | 567 |
| 57 | 15 | 12046 | 12219 | gi\|1206040 | weak similarity to keratin [*Caenorhabditis elegans*] | 76 | 40 | 174 |
| 91 | 2 | 1062 | 2261 | gi\|475715 | acetyl coenzyme A acetyltransferase (thiolase) [*Clostridium cetobutylicum*] | 76 | 57 | 1200 |
| 98 | 2 | 818 | 1624 | gi\|467422 | unknown [*Bacillus subtilis*] | 76 | 62 | 807 |
| 98 | 5 | 2965 | 3228 | gi\|897793 | y98 gene product [*Pediococcus acidilactici*] | 76 | 52 | 264 |
| 98 | 8 | 5922 | 6326 | gi\|467427 | methionyl-tRHA synthetase [*Bacillus subtilis*] | 76 | 53 | 405 |
| 104 | 3 | 1322 | 1885 | gi\|216151 | DNA polymerase (gene L; ttg start codon) [Bacteriophage PSO2] gi\|579197 SP02 DNA polymerase (aa 1–648) [Bacteriophage SPO2] pir\|A21498\|DJBPS2 DNA-directed DNA polymerase (EC 2.7.7.7)-phage PO2 | 76 | 63 | 564 |
| 124 | 9 | 7055 | 5976 | gi\|853776 | peptide chain release factor 1 [*Bacillus subtilis*] pir\|S55437\|S55437 peptide chain release factor 1-*Bacillus ubtilis* | 76 | 58 | 1080 |
| 164 | 5 | 2832 | 3311 | gi\|1204976 | prolyl-tRNA synthetase [*Haemophilus influenzae*] | 76 | 53 | 480 |
| 168 | 2 | 1841 | 1065 | gi\|1177253 | putative ATP-binding protein of ABC-type [*Bacillus subtilis*] | 76 | 58 | 777 |
| 189 | 2 | 163 | 888 | gi\|467384 | unknown [*Bacillus subtilis*] | 76 | 63 | 726 |
| 235 | 3 | 2253 | 3518 | gi\|142936 | folyl-polyglutamate synthetase [*Bacillus subtilis*] pir\|B40646\|B40646 folC-*Bacillus subtilis* | 76 | 53 | 1266 |
| 236 | 1 | 335 | 925 | gi\|1146197 | putative [*Bacillus subtilis*] | 76 | 54 | 591 |
| 237 | 8 | 5323 | 5541 | gi\|1279261 | F13G3.6 [*Caenorhabditis elegans*] | 76 | 47 | 219 |
| 263 | 5 | 4585 | 3680 | gi\|1510348 | dihydrodipicolinate synthase [*Methanococcus jannaschii*] | 76 | 49 | 906 |
| 304 | 3 | 1051 | 1794 | gi\|666982 | putative membrane spanning subunit [*Bacillus subtilis*] pir\|S52382\|S52382 probable membrane spanning protein-*Bacillus ubtilis* | 76 | 60 | 744 |
| 312 | 4 | 3611 | 4624 | gi\|143312 | 6-phospho-1-fructokinase (gtg start codon; EC 2.7.1.11) [*Bacillus tearotheraophilus*] | 76 | 56 | 1014 |
| 343 | 1 | 2 | 1036 | gi\|405956 | yeeE [*Escherichia coli*] | 76 | 59 | 1035 |
| 347 | 1 | 409 | 1701 | gi\|396304 | acetylornithine deacetylase [*Escherichia coli*] | 76 | 72 | 1293 |
| 358 | 1 | 672 | 1907 | gi\|1146215 | 39.0% identity to the *Escherichia coli* S1 ribosomal protein; putative [*Bacillus subtilis*] | 76 | 58 | 1236 |
| 371 | 1 | 1 | 222 | gi\|537084 | alternate gene name mgt; CG Site No. 497 [*Escherichia coli*] pir\|S56468\|S56468 mqtA protein-i Escherichia coli | 76 | 61 | 222 |

TABLE 2-continued

| | | | | | | | | |
|---|---|---|---|---|---|---|---|---|
| 379 | 4 | 4331 | 4858 | gi\|143268 | dihydrolipoamide transsuccinylase (odhB; EC 2.3.1.61) [*Bacillus ubtilis*] | 76 | 61 | 528 |
| 404 | 5 | 4022 | 4492 | gi\|1303823 | YqfG [*Bacillus subtilis*] | 76 | 60 | 471 |
| 411 | 1 | 2 | 307 | gi\|486025 | ORF YKL027w [*Saccharomyces cerevisiae*] | 76 | 55 | 336 |
| 472 | 3 | 2854 | 1352 | gi\|1405464 | AlsT [*Bacillus subtilis*] | 76 | 57 | 1503 |
| 546 | 1 | 273 | 995 | gi\|153821 | *streptococcal* pyrogenic exotoxin type C spec) precursor *Streptococcus pyogenes*] | 76 | 36 | 723 |
| 588 | 1 | 557 | 60 | gi\|1002520 | MutS [*Bacillus subtilis*] | 76 | 61 | 498 |
| 591 | 1 | 16 | 735 | gi\|885934 | ClpB [*Synechococcus sp.*] | 76 | 44 | 720 |
| 602 | 2 | 175 | 798 | gi\|1486422 | OppD homologue [*Rhizobium sp.*] | 76 | 52 | 624 |
| 619 | 2 | 290 | 33 | gi\|330613 | major caprid protein [*Human cytomegalovirus*] | 76 | 47 | 258 |
| 660 | 4 | 2568 | 3302 | gi\|904199 | hypothetical protein [*Bacillus subtilis*] | 76 | 55 | 735 |
| 677 | 1 | 228 | 4 | gi\|40377 | spoOF gene product [*Bacillus subtilis*] | 76 | 58 | 225 |
| 962 | 1 | 24 | 206 | gi\|142443 | adenylosuccinate synthetase [*Bacillus subtilis*] sp\|P29726\|PUEA_BACSU ADENYLOSUCCINATE SYNTHETASE (EC 6.3.4.4) IMP-ASPARTATE LIGASE). | 76 | 67 | 183 |
| 978 | 1 | 580 | 2 | gi\|1511333 | *M. jannaschii* predicted coding region MJ1322 [*Methanococcus jannaschii*] | 76 | 56 | 579 |
| 997 | 1 | 244 | 2 | gi\|467154 | No definition line found [*Mycobacterium leprae*] | 76 | 38 | 243 |
| 1563 | 1 | 266 | 3 | gi\|1303984 | YqkC [*Bacillus subtilis*] | 76 | 52 | 264 |
| 2184 | 1 | 182 | 3 | gi\|506706 | CapJ [*Staphylococcus aureus*] | 76 | 38 | 180 |
| 2572 | 1 | 1 | 387 | gi\|153898 | transport protein [*Salmonella typhimurium*] | 76 | 65 | 387 |
| 2942 | 1 | 29 | 400 | gi\|730020 | nitrite reductase (nirB) [*Bacillus subtilis*] | 76 | 59 | 372 |
| 2957 | 1 | 216 | 55 | gi\|1511251 | hypothetical protein (SP:P42404) [*Methanococcus jannaschii*] | 76 | 47 | 162 |
| 2980 | 1 | 279 | 4 | gi\|1405464 | AlsT [*Bacillus subtilis*] | 76 | 53 | 276 |
| 3015 | 1 | 326 | 3 | gi\|408115 | ornithine acetyltransferase [*Bacillus subtilis*] | 76 | 61 | 324 |
| 3124 | 1 | 13 | 174 | gi\|882705 | ORF_o401 [*Escherichia coli*] | 76 | 65 | 162 |
| 3179 | 1 | 3 | 161 | gi\|168477 | ferredoxin-dependent glutamate synthase [*Zea mays*] pir\|A38596"A38596 glutamate synthase (ferredoxin) (EC 1.4.7.1)-aize | 76 | 53 | 159 |
| 3789 | 1 | 2 | 379 | gi\|39956 | IIGlc [*Bacillus subtilis*] | 76 | 55 | 378 |
| 3892 | 1 | 3 | 314 | gi\|1510398 | ferripyochelin binding protein [*Methanococcus jannaachii*] | 76 | 52 | 312 |
| 3928 | 1 | 400 | 2 | gi\|143016 | permease [*Bacillus subtilis*] | 76 | 59 | 399 |
| 4159 | 1 | 386 | 15 | sp\|P80544\|MRSP_ | METHICILLIN-RESISTANT SURFACE PROTEIN (FRAGMENTS). | 76 | 66 | 372 |
| 4204 | 1 | 17 | 331 | gi\|296464 | ATPase [*Lactococcus lactis*] | 76 | 56 | 315 |
| 4398 | 1 | 249 | 4 | gi\|987255 | Menkes disease gene [*Homo sapiens*] | 76 | 48 | 246 |
| 4506 | 1 | 2 | 313 | gi\|216746 | D-lactate dehydrogenase [*Lactobacillus plantarum*] | 76 | 47 | 312 |
| 4546 | 1 | 247 | 17 | gi\|1339950 | large subunit of NADH-dependent glutamate synthase [*Plectonema boryanum*] | 76 | 61 | 231 |
| 4596 | 1 | 191 | 3 | gi\|560027 | cellulose synthase [*Acetobacter xylinum*] | 76 | 70 | 189 |
| 4 | 5 | 4337 | 3417 | gi\|882532 | ORF_o294 [*Escherichia coli*] | 75 | 59 | 921 |
| 6 | 1 | 164 | 952 | gi\|40960 | [*Escherichia coli*] | 75 | 56 | 789 |
| 12 | 3 | 3944 | 1953 | gi\|467336 | unknown [*Bacillus subtilis*] | 75 | 57 | 1992 |
| 23 | 18 | 17310 | 16348 | gi\|1296433 | O-acetylserine sulfhydrylase B [*Alcaligenes eutrophus*] | 75 | 55 | 963 |
| 25 | 3 | 2356 | 3393 | gi\|1502419 | PlsX [*Bacillus subtilis*] | 75 | 56 | 1038 |
| 36 | 8 | 5765 | 6037 | gi\|1256517 | unknown [*Schizosaccharomyces pombe*] | 75 | 45 | 273 |
| 46 | 13 | 11186 | 32058 | gi\|48972 | nitrate transporter [*Synechococcus sp.*] | 75 | 46 | 673 |
| 51 | 7 | 3474 | 3677 | gi\|143607 | sporulation protein [*Bacillus subtilis*] | 75 | 61 | 204 |
| 53 | 16 | 36590 | 16330 | gi\|143402 | recombination protein (ttg start codon) [*Bacillus subtilis*] gi\|1303923 RecN [*Bacillus subtilis*] | 75 | 51 | 261 |
| 74 | 3 | 2568 | 1564 | gi\|1204847 | ornithine carbamoyltransferase [*Haemophilus influenzae*] | 75 | 61 | 1005 |
| 85 | 3 | 3930 | 3232 | gi\|143368 | phosphoribosylformly glycinasidine synthetase I (PUR-L; gtg start odon) [*Bacillus subtilis*] | 75 | 63 | 699 |
| 85 | 5 | 4878 | 4168 | gi\|143367 | phosphoribosyl aminoidazole succinocarboxamide synthatase (PUR-C; tg start codon) [*Bacillus subtilis*] | 75 | 55 | 711 |
| 85 | 8 | 6625 | 7530 | gi\|1303916 | YqiA [*Bacillus subtilis*] | 75 | 53 | 906 |
| 87 | 3 | 2340 | 3590 | gi\|1064813 | homologous to sp: PNDR_BACSU [*Bacillus subtilis*] | 75 | 56 | 1251 |
| 87 | 6 | 6084 | 6896 | gi\|1064810 | function unknown [*Bacillus subtilis*] | 75 | 61 | 813 |
| 108 | 2 | 1503 | 1162 | gi\|1001824 | hypothetical protein [*Synechocystis sp.*) | 75 | 51 | 342 |
| 110 | 3 | 1748 | 3727 | gi\|1147593 | putative ppGpp synthetase [*Streptomyces coelicolor*] | 75 | 55 | 1980 |
| 110 | 7 | 4353 | 5252 | gi\|1177251 | clwD gene product [*Bacillus subtilis*] | 75 | 75 | 900 |
| 120 | 14 | 10649 | 10032 | gi\|1524394 | ORF-2 upstream of gbsAB operon [*Bacillus subtilis*] | 75 | 55 | 618 |
| 121 | 5 | 2050 | 4221 | gi\|3154632 | NrdE [*Bacillus subtilis*] | 75 | 54 | 2172 |
| 124 | 1 | 143 | 3 | gi\|405622 | unknown [*Bacillus subtilis*] | 75 | 56 | 141 |
| 128 | 1 | 81 | 1139 | gi\|143316 | [gap] gene products [*Bacillus megaterium*] | 75 | 48 | 1059 |
| 130 | 8 | 5760 | 5903 | gi\|1256654 | 54.8% identity with *Neisseria gonorrhoeae* regulatory protein PilB; putative [*Bacillus subtilis*] | 75 | 62 | 144 |
| 136 | 2 | 3185 | 1890 | gi\|467403 | seryl-tRNA synthetase [*Bacillus subtilis*] | 75 | 54 | 1296 |
| 161 | 10 | 5439 | 5798 | gi\|1001195 | hypothetical protein [*Synechocystis sp.*] | 75 | 55 | 360 |
| 172 | 4 | 2995 | 2171 | gi\|755153 | ATP-binding protein [*Bacillus subtilis*] | 75 | 52 | 825 |
| 179 | 1 | 1107 | 190 | gi\|143037 | porphobilinogen deaminase [*Bacillus subtilis*] | 75 | 58 | 918 |
| 195 | 10 | 9374 | 9219 | sp\|P2S745\|YCFB_ | HYPOTHETICAL PROTEIN IN PURB 5'REGION (ORP-15) (FRAGMENT). | 75 | 60 | 156 |
| 200 | 4 | 2605 | 4596 | gi\|142440 | IATP-dependent nuclease [*Bacillus subtilis*] | 75 | 56 | 1992 |
| 206 | 3 | 5620 | 4340 | gi\|1256135 | YbbF [*Bacillus subtilis*] | 75 | 53 | 1281 |
| 216 | 2 | 159 | 389 | gi\|1052800 | unknown [*Schizosaccharomyces pombe*] | 75 | 58 | 231 |
| 229 | 1 | 29 | 847 | gi\|1205958 | branched chain aa transport system II carrier protein [*Haemophilus influenzae*] | 75 | 49 | 819 |

TABLE 2-continued

| | | | | | | | | |
|---|---|---|---|---|---|---|---|---|
| 230 | 2 | 518 | 1714 | gi\|1971337 | nitrite extrusion protein [*Bacillus subtilis*] | 75 | 53 | 1197 |
| 231 | 1 | 1122 | 4 | gi\|1002521 | NutL [*Bacillus subtilis*] | 75 | 54 | 1119 |
| 233 | 3 | 1314 | 1859 | gi\|467405 | unknown[*Bacillus subtilis*] | 75 | 59 | 546 |
| 269 | 1 | 164 | 3 | gi\|1511246 | methyl coenzyme H reductase system, component A2 [*Methanococcus jannaschii*] | 75 | 50 | 162 |
| 292 | 1 | 772 | 155 | gi\|1511604 | *M. jannaschii* predicted coding region MJ1651 [*Methanococcus jannaschii*] | 75 | 46 | 618 |
| 304 | 4 | 1773 | 2261 | gi\|1205328 | surfactin [*Haemophilus influenzae*] | 75 | 55 | 489 |
| 312 | 3 | 2437 | 3387 | gi\|285621 | undefined open reading frame [*Bacillus stearothermophilus*] | 75 | 62 | 951 |
| 312 | 5 | 4622 | 6403 | gi\|1041097 | pyruvate Kinase [*Bacillus psychrophilus*] | 75 | 57 | 1782 |
| 319 | 1 | 353 | 877 | gi\|1212728 | YqhI [*Bacillus subtilis*] | 75 | 54 | 525 |
| 320 | 5 | 4321 | 5031 | gi\|2070361 | OMP decarboxylase [*Lactococcus lactis*] | 75 | 56 | 711 |
| 320 | 6 | 5010 | 5642 | gi\|143394 | OMP-PRPP transferase [*Bacillus subtilis*] | 75 | 60 | 633 |
| 337 | 4 | 2519 | 2088 | gi\|487433 | citrate synthase II [*Bacillus subtilis*] | 75 | 58 | 570 |
| 394 | 2 | 669 | 1271 | gi\|304976 | matches PS00017: ATP_GTP_A and PS00301: EFACTOR_GTP; similar to longation factor G, TetM/TetO tetracycline-resistance proteins *Escherichia coli* | 75 | 51 | 603 |
| 423 | 1 | 127 | 570 | gi\|1183839 | unknown [*Pseudomonas aeruginosa*] | 75 | 59 | 444 |
| 433 | 2 | 1603 | 2929 | gi\|149211 | acetolactate synthase [*Klebsiella pneumoniae*] | 75 | 63 | 327 |
| 446 | 2 | 176 | 1540 | gi\|312441 | dihydroorotase [*Bacillus caldolyticus*] | 75 | 62 | 1365 |
| 486 | 1 | 249 | 4 | gi\|1149682 | potF gene product [*Clostridium perfringens*] | 75 | 55 | 246 |
| 496 | 1 | 3 | 794 | gi\|143582 | spoIIIEA protein [*Bacillus subtilis*] | 75 | 59 | 792 |
| 498 | 2 | 824 | 1504 | gi\|143328 | protein (put.); putative [*Bacillus subtilis*] | 75 | 47 | 681 |
| 499 | 2 | 1061 | 1624 | gi\|1387979 | 44% identity over 302 residues with hypothetical protein from Synechocystis sp, accession D64006_CD; expression induced by environmental stress; some similarity to glycosyl transferases; two potential membrane-spanning helices [*Bacillus subtil* | 75 | 51 | 564 |
| 568 | 1 | 453 | 265 | pir\|JC4110\|JC41 | triacylglycerol lipase (EC 3.1.1.3) 2-*Mycoplasma mycoides* subsp. *mycoides* (SGC3) | 75 | 50 | 189 |
| 613 | 2 | 233 | 36 | gi\|330993 | tegument protein [*Saimiriine herpesvirus* 2] | 75 | 75 | 198 |
| 621 | 1 | 1 | 525 | gi\|529754 | speC [*Streptococcus pyogenes*] | 75 | 43 | 525 |
| 642 | 5 | 1809 | 2474 | gi\|1176401 | EpiG [*Staphylococcus epidermidis*] | 75 | 51 | 666 |
| 646 | 2 | 454 | 657 | gi\|172442 | ribonuclease P [*Saccharomyces cerevisiae*] | 75 | 37 | 204 |
| 657 | 1 | 3 | 347 | gi\|882541 | ORF_o236 [*Escherichia coli*] | 75 | 47 | 345 |
| 750 | 1 | 832 | 2 | gi\|46971 | epiP gene product [*Staphylococcus epidermidis*] | 75 | 57 | 831 |
| 754 | 1 | 2 | 481 | gi\|1303901 | YqhT [*Bacillus subtilis*] | 75 | 57 | 480 |
| 763 | 2 | 393 | 223 | gi\|1205145 | multidrug resistance protein [*Haemophilus influenzae*] | 75 | 51 | 171 |
| 775 | 1 | 482 | 3 | pir\|B36889\|B368 | leuA protein, inactive-*Lactococcus lactis* subsp. *lactis* (strain IL1403) | 75 | 63 | 480 |
| 793 | 1 | 1 | 180 | gi\|143316 | [gap] gene products [*Bacillus megaterium*] | 75 | 57 | 180 |
| 800 | 1 | 160 | 2 | gi\|509411 | NFRA protein [*Azorhizobium caulinodans*] | 75 | 34 | 159 |
| 811 | 1 | 560 | 3 | gi\|143434 | Rho Factor [*Bacillus subtilis*] | 75 | 60 | 558 |
| 940 | 1 | 329 | 165 | gi\|1276985 | arginase [*Bacillus caldovelox*] | 75 | 50 | 165 |
| 971 | 2 | 37 | 252 | gi\|1001373 | hypothetical protein [Synechocystis sp.] | 75 | 58 | 216 |
| 1059 | 1 | 232 | 80 | gi\|726480 | L-glutamine-D-fructose-6-phosphate aminotransferase [*Bacillus ubtilis*] | 75 | 67 | 153 |
| 1109 | 2 | 219 | 374 | gi\|143331 | alkaline phosphatase regulatory protein [*Bacillus subtilis*] pir\|A27650\|A27650 regulatory protein phoR-*Bacillus subtilis* sp\|P23545\|PHOR_BACSU ALKALINE PHOSPHATASE SYNTHESIS SENSOR PROTEIN HOR (EC 2.7.3.-) | 75 | 53 | 156 |
| 1268 | 1 | 137 | 3 | gi\|304135 | ornithine acetyltransferase [*Bacillus stearothermophilus*] sp\|Q07908\|ARGJ_BACST GLUTAMATE N-ACETYLTRAHSFERASE (EC 2.3.1.35) ORHITHINE ACETYLTRANSFERASE) (ORHITHINE TRANSACETYLASE) (QATASE)/MINO-ACID ACETYLTRANSFERASE (EC 2.3.1.1) (N-ACETYLGLUTAMATE YNTHA | 75 | 63 | 135 |
| 1500 | 1 | 163 | 2 | gi\|1205488 | excinuclease ABC subunit B [*Haemophilus influenzae*] | 75 | 57 | 162 |
| 1529 | 1 | 400 | 2 | gi\|1002521 | MutL [*Bacillus subtilis*] | 75 | 54 | 399 |
| 3010 | 1 | 387 | 4 | gi\|1204435 | pyruvate formate-lyase activating enzyme [*Haemophilus influenzae*] | 75 | 54 | 384 |
| 3105 | 1 | 1 | 180 | gi\|1041097 | Pyruvate Kinase [*Bacillus psychrophilus*] | 75 | 57 | 180 |
| 3117 | 1 | 45 | 212 | gi\|899317 | peptide synthetase module [*Microcystis aeruginosa*] pir\|S49111\|S49111 probable amino acid activating domain-icrocystis aeruginosa(fragment) (SUB 144-528) | 75 | 42 | 168 |
| 3139 | 2 | 139 | 345 | gi\|145294 | adenine phosphoribosyl-transferase [*Escherichia coli*] | 75 | 66 | 207 |
| 3880 | 1 | 310 | 2 | gi\|1009366 | Respiratory nitrate reductase [*Bacillus subtilis*] | 75 | 58 | 309 |
| 3911 | 1 | 48 | 401 | gi\|433991 | ATP synthase subunit beta [*Bacillus subtilis*] | 75 | 68 | 354 |
| 3957 | 1 | 2 | 379 | pir\|D36889\|D368 | 3-isopropylmalate dehydratase (EC 4.2.1.33) chain leuC-*Lactococcus lactis* subsp. *lactis* (strain IL1403) | 75 | 65 | 378 |
| 4005 | 1 | 5 | 259 | gi\|216746 | D-lactate dehydrogenase [*Lactobacillus plantarum*] | 75 | 48 | 255 |
| 4080 | 1 | 73 | 333 | gi\|415855 | deoxyribose aldolase [*Mycoplasma hominis*] | 75 | 59 | 261 |
| 4311 | 1 | 1 | 339 | gi\|149435 | putative [*Lactococcus lactis*] | 75 | 57 | 339 |
| 4136 | 1 | 303 | 4 | gi\|450688 | hsdM gene of EcoprrI gene product [*Escherichia coli*] pir\|S38437\|S38437 hsdM protein-*Escherichia coli* pir\|S09629\|S09629 hypothetical protein A-*Escherichia coli* (SUB 40-520) | 75 | 56 | 300 |
| 4144 | 1 | 336 | 4 | gi\|48972 | nitrate transporter [Synechococcus sp.] | 75 | 49 | 333 |
| 4237 | 1 | 374 | 84 | gi\|1339950 | large subunit of NADH-dependent glutamate synthase [*Plectonema boryanum*] | 75 | 55 | 291 |

TABLE 2-continued

| | | | | | | | | |
|---|---|---|---|---|---|---|---|---|
| 4306 | 2 | 73 | 318 | gi\|294260 | major surface glycoprotein [*Pneumocystis carinii*] | 75 | 68 | 246 |
| 4343 | 1 | 359 | 3 | gi\|1204652 | methylated-DNA-protein-cysteine methyltransferase [*Haemophilus influenzae*] | 75 | 52 | 357 |
| 4552 | 1 | 312 | 4 | gi\|296464 | ATPase [*Lactococcus lactis*] | 75 | 55 | 309 |
| 38 | 9 | 5776 | 6126 | gi\|443793 | NupC [*Escherichia coli*] | 74 | 50 | 351 |
| 50 | 8 | 6221 | 5532 | gi\|1239988 | hypothetical protein [*Bacillus subtilis*] | 74 | 55 | 690 |
| 56 | 9 | 10770 | 12221 | gi\|1000451 | TreP [*Bacillus subtilis*] | 74 | 57 | 1452 |
| 64 | 2 | 1622 | 978 | gi\|41015 | aspartate-tRNA ligase [*Escherichia coli*] | 74 | 57 | 645 |
| 66 | 6 | 4848 | 4633 | gi\|1212729 | YqhJ [*Bacillus subtilis*] | 74 | 47 | 216 |
| 67 | 18 | 14334 | 14897 | gi\|1510631 | endoglucanase [*Methanococcus jannaschii*] | 74 | 52 | 564 |
| 102 | 15 | 12563 | 13136 | gi\|149429 | putative [*Lactococcus lactis*] | 74 | 67 | 576 |
| 102 | 16 | 13121 | 14419 | gi\|149435 | putative [*Lactococcus lactis*] | 74 | 57 | 1299 |
| 108 | 4 | 3902 | 2931 | gi\|39478 | ATP binding protein of transport ATPases [*Bacillus firmus*] ir\|S15486\|S15486 ATP-binding protein-*Bacillus firmus* p\|P26946\|YATR_BACFI HYPOTHETICAL ATP-BINDING TRANSPORT PROTEIN. | 74 | 59 | 972 |
| 116 | 5 | 7093 | 5612 | gi\|1205430 | dipeptide transport system permease protein [*Haemophilus influenzae*] | 74 | 49 | 1482 |
| 120 | 7 | 4342 | 4803 | gi\|146970 | ribonucleoside triphosphate reductase [*Escherichia coli*] pir\|A47331\|A47331 anaerobic ribonucleotide reductase-*Escherichia oli* | 74 | 58 | 462 |
| 121 | 7 | 5961 | 6581 | gi\|1107528 | ttg start [*Campylobacter coli*] | 74 | 51 | 621 |
| 128 | 3 | 2320 | 3531 | gi\|143318 | phosphoglycerate kinase [*Bacillus megaterium*] | 74 | 57 | 1212 |
| 130 | 7 | 5237 | 5791 | gi\|1256653 | DNA-binding protein [*Bacillus subtilis*( | 74 | 60 | 555 |
| 136 | 3 | 5150 | 3555 | gi\|143076 | histidase[*Bacillus subtilis*] | 74 | 58 | 1596 |
| 145 | 2 | 664 | 1368 | gi\|407773 | devA gene product [*Anabaena sp.*] | 74 | 45 | 705 |
| 152 | 1 | 277 | 2 | gi\|1377833 | unknown [*Bacillus subtilis*] | 74 | 54 | 276 |
| 164 | 10 | 11064 | 11375 | gi\|580900 | ORF3 gene product [*Bacillus subtilis*] | 74 | 52 | 312 |
| 175 | 2 | 2624 | 2139 | gi\|642656 | unknown [*Rhizobium meliloti*] | 74 | 34 | 486 |
| 175 | 9 | 5612 | 5160 | gi\|854656 | Na/H antiporter system ORF2 [*Bacillus alcalophilus*] | 74 | 46 | 453 |
| 195 | 111 | 10339 | 9332 | gi\|1204430 | hypothetical protein SP: P25745) [*Haemophilus influenzae*] | 74 | 55 | 1008 |
| 205 | 117 | 9059 | 8499 | gi\|1044979 | ribosomal protein L6 []Bacillus subtilis] | 74 | 64 | 561 |
| 236 | 7 | 5574 | 6710 | gi\|1146207 | putative [*Bacillus subtilis*] | 74 | 63 | 1137 |
| 241 | 3 | 3334 | 2147 | gi\|694121 | malate thiokinase [*Methylobacterium extorguens*] | 74 | 52 | 1188 |
| 246 | 6 | 2799 | 2293 | gi\|467374 | single strand DNA binding protein [*Bacillus subtilis*] | 74 | 64 | 507 |
| 249 | 4 | 5313 | 4075 | gi\|1524397 | glycine betaine transporter OpuD [*Bacillus subtilis*] | 74 | 55 | 1239 |
| 261 | 7 | 4081 | 3773 | gi\|809542 | CbrB protein [*Erwinia chrysanthemi*] | 74 | 42 | 309 |
| 278 | 6 | 4665 | 3616 | gi\|1204872 | ATP-binding protein [*Haemophilus influenzae*] | 74 | 54 | 1050 |
| 309 | 1 | 666 | 112 | gi\|1205579 | hypothetical protein GB: U14003_302) [*Haemophilus influenzae*] | 74 | 53 | 555 |
| 315 | 2 | 862 | 251 | gi\|143398 | quinol oxidase [*Bacillus subtilis*] | 74 | 57 | 612 |
| 320 | 1 | 1 | 1065 | gi\|143389 | glutaminase of carbamyl phosphate synthetase [*Bacillus subtilis*] pir\|R39045\|E39845 carbasoyl-phosphate synthase glutamine-hydrolyzing) (EC 6.3.5.5), pyrimidine-repressible, small hain-*Bacillus subtilis* | 74 | 60 | 1065 |
| 380 | 2 | 382 | 1128 | gi\|534857 | ATPase subunit a [*Bacillus stearothermophilus*] | 74 | 56 | 747 |
| 405 | 2 | 1311 | 880 | gi\|11303915 | YqhZ [*Bacillus subtilis*] | 74 | 65 | 432 |
| 433 | 5 | 2503 | 3270 | gi\|473902 | alpha-acetolactate synthase [*Lactococcus lactis*] | 74 | 56 | 768 |
| 452 | 1 | 1 | 942 | gi\|413982 | ipa-58r gene product [*Bacillus subtilis*] | 74 | 52 | 942 |
| 461 | 1 | 3 | 1193 | gi\|558494 | homoserine dehydrogenase [*Bacillus subtilis*] | 74 | 51 | 1191 |
| 461 | 2 | 1174 | 1407 | gi\|40211 | threonine synthase (thrC) (AA 1–352) [*Bacillus subtilis*] ir\|A25364\|A25364 threonine synthase (EC 4.2.99.2)-*Bacillus btilis* | 74 | 56 | 234 |
| 462 | 12 | 402 | 734 | gi\|142520 | thioredoxin [*Bacillus subtilis*] | 74 | 62 | 333 |
| 478 | 1 | 320 | 66 | gi\|1499005 | glycyl-tRNA synthetase [*Methanococcus jannaschii*] | 74 | 52 | 255 |
| 501 | 2 | 739 | 1740 | gi\|217040 | acid glycoprotein [*Streptococcus pyogenes*] | 74 | 58 | 1002 |
| 551 | 2 | 2791 | 1499 | gi\|143040 | glutamate-1-semialdehyde 2,1-aminotransferase [*Bacillus subtilis*] pir\|D42728\|D42728 glutamate-1-semialdehyde 2.1-aminomutase (EC .4.3.8)-*Bacillus subtilis* | 74 | 51 | 1293 |
| 573 | 1 | 1 | 477 | gi\|1006605 | hypothetical protein [Synechocystis sp.] | 74 | 45 | 477 |
| 596 | 2 | 1298 | 816 | gi\|13031853 | YqgF [*Bacillus subtilis*] | 74 | 55 | 483 |
| 618 | 2 | 1758 | 592 | gi\|11146237 | 21.4% of identity to trans-acting transcription factor of *Sacharomyces cerevisiae*; 25% of identity to sucrose synthase of Zea mays; putative [*Bacillus subtilis*] | 74 | 55 | 1167 |
| 659 | 2 | 1269 | 1595 | gi\|1072380 | ORF3 [*Lactococcus lactis*] | 74 | 62 | 327 |
| 724 | 1 | 188 | 3 | gi\|1143374 | phosphoribosyl glycinamide synthetase (PUR-D; gtg start codon) *Bacillus subtilis*] | 74 | 58 | 186 |
| 743 | 2 | 604 | 1209 | gi\|153833 | ORF1; putative [*Streptococcus parasanguis*] | 74 | 50 | 606 |
| 836 | 1 | 2 | 259 | gi\|143458 | ORF V [*Bacillus subtilis*] | 74 | 47 | 258 |
| 989 | 2 | 443 | 724 | gi\|1303994 | YgkM [*Bacillus subtilis*] | 74 | 46 | 282 |
| 1106 | 1 | 1 | 492 | gi\|46970 | epiD gene product [*Staphylococcus epidermidis*] | 74 | 54 | 492 |
| 1135 | 2 | 373 | 528 | gi\|413948 | ipa-24d gene product [*Bacillus subtilis*] | 74 | 48 | 156 |
| 1234 | 1 | 452 | 87 | gi\|495245 | recJ gene product [*Erwinia chrysanthemi*] | 74 | 36 | 366 |
| 2586 | 1 | 2 | 23R | gi\|1149701 | sbcC gene product [*Clostridium perfringens*] | 74 | 62 | 237 |
| 2919 | 1 | 400 | 2 | gi\|1405454 | aconitase [*Bacillus subtilis*] | 74 | 60 | 399 |
| 2962 | 1 | 363 | 76 | gi\|450686 | 3-phosphoglycerate kinase [*Thermotoga maritima*] | 74 | 58 | 288 |
| 2983 | 1 | 3 | 191 | gi\|1303893 | YghL [*Bacillus subtilis*] | 74 | 56 | 189 |
| 3018 | 1 | 2 | 223 | gi\|143040 | glutamate-1-semialdehyde 2,1-aminotransferase [*Bacillus subtilis*] pir\|D42728\|D42728 glutamate-1-semialdehyde 2,1-aminomutase (EC .4.3.8)-*Bacillus subtilis* | 74 | 56 | 222 |
| 3038 | 1 | 256 | 2 | pir\|S52915\|S529 | nitrate reductase alpha chain-*Bacillus subtilis* fragment) | 74 | 57 | 255 |
| 3062 | 1 | 189 | 4 | gi\|2107528 | ttg start [*Campylobacter coli*] | 74 | 51 | 186 |

TABLE 2-continued

| | | | | | | | | |
|---|---|---|---|---|---|---|---|---|
| 4035 | 1 | 184 | 360 | gi\|1022725 | unknown [*Staphylococcus haemolyticus*] | 74 | 64 | 177 |
| 4045 | 1 | 305 | 3 | gi\|1510977 | *M. jannaschii* predicted coding region MJ0938 [*Methanococcus jannaschii*] | 74 | 41 | 303 |
| 4283 | 1 | 304 | 137 | gi\|520844 | orf4 [*Bacillus subtilis*] | 74 | 58 | 168 |
| 4449 | 1 | 3 | 221 | gi\|580910 | peptide-synthetase ORF1 [*Bacillus subtilis*] | 74 | 54 | 219 |
| 4587 | 1 | 231 | 4 | gi\|1370207 | orf6 [*Lactobacillus sake*] | 74 | 59 | 228 |
| 4603 | 1 | 29 | 214 | gi\|146208 | glutamate synthase large subunit (EC 2.6.1.5) [*Escherichia coli*] pir\|A29617\|A29617 glutamate synthase (NADPH) (EC 1.4.1.13) large hain-*Escherichia coli* | 74 | 60 | 186 |
| 4670 | 1 | 184 | 2 | gi\|1256135 | YbbF [*Bacillus subtilis*] | 74 | 61 | 183 |
| 5 | 10 | 7162 | 6371 | gi\|143727 | putative [*Bacillus subtilis*] | 73 | 42 | 792 |
| 11 | 2 | 1372 | 290 | gi\|166338 | dihydroorotate dehydrogenase [*Agrocybe aegerita*] | 73 | 55 | 1083 |
| 14 | 1 | 1020 | 16 | gi\|143373 | phosphoribosyl aminoimidazole carboxy formyl ormyltransferase/ inosine monophosphate cyclohydrolase (PUR-H(J)) *Bacillus subtilis*] | 73 | 54 | 1005 |
| 23 | 5 | 4635 | 3844 | gi\|1468939 | meso-2,3-butanediol dehydrogenase (D-acetoin forming) [*Klebsiella pneumoniae* | 73 | 58 | 792 |
| 23 | 17 | 16360 | 15341 | gi\|297060 | ornithine cyclodeaminase [*Rhizobium meliloti*] | 73 | 37 | 1020 |
| 29 | 2 | 692 | 1273 | gi\|467442 | stage V sporulation [*Bacillus subtilis*] | 73 | 54 | 582 |
| 31 | 5 | 4914 | 3361 | gi\|414000 | ipa-76d gene product [*Bacillus subtilis*] | 73 | 55 | 1554 |
| 37 | 8 | 7402 | 6146 | gi\|1429259 | pepT gene product [*Bacillus subtilis*] | 73 | 59 | 1257 |
| 37 | 9 | 7562 | 7386 | gi\|168367 | alpha-isopropylmalate isomerase (put.); putative [*Rhizomucor ircinelloides*] | 73 | 52 | 177 |
| 38 | 7 | 3931 | 4896 | gi\|405885 | yeiN [*Escherichia coli*] | 73 | 58 | 966 |
| 44 | 6 | 4238 | 3435 | gi\|580895 | unknown [*Bacillus subtilis*] | 73 | 53 | 804 |
| 44 | 11 | 7767 | 8306 | gi\|42009 | moaB gene product [*Escherichia coli*] | 73 | 50 | 540 |
| 45 | 3 | 2439 | 3080 | gi\|1109685 | ProW [*Bacillus subtilis*] | 73 | 47 | 642 |
| 54 | 13 | 13794 | 13552 | gi\|413931 | ipa-7d gene product [*Bacillus subtilis*] | 73 | 61 | 243 |
| 59 | 4 | 1430 | 2248 | gi\|147923 | threonine dehydratase 2 (EC 4.2.1.16) [*Escherichia coli*] | 73 | 53 | 819 |
| 65 | 1 | 730 | 2 | gi\|677944 | AppF [*Bacillus subtilis*] | 73 | 56 | 729 |
| 80 | 2 | 860 | 345 | gi\|5190932 | murD gene product [*Bacillus subtilis*] | 73 | 53 | 516 |
| 102 | 13 | 10124 | 11179 | gi\|580891 | 3-isopropylmalate dehydrogenase (AA)-365) [*Bacillus subtilis*] pir\|A26522\|A26522 3-isopropylmalate dehydrogenase (EC 1.1.1.85)-*acillus subtilis* | 73 | 55 | 1056 |
| 109 | 2 | 2600 | 1707 | gi\|1510849 | *M. jannaschii* predicted coding region MJ0775 [*Methanococcus jannaschii*] | 73 | 40 | 894 |
| 120 | 8 | 4782 | 5756 | gi\|146970 | ribonucleoside triphosphate reductase [*Escherichia coli*] pir\|A47331\|A47331 anaerobic ribonucleotide reductase-*Escherichia oli* | 73 | 56 | 975 |
| 120 | 9 | 5726 | 6223 | gi\|1204333 | anaerobic ribonucleoside-triphosphate reductase [*Haemophilus influenzae*] | 73 | 62 | 498 |
| 132 | 5 | 4151 | 4363 | gi\|871048 | HPSR2-heavy chain potential motor protein [*Giardie intestinalis*] | 73 | 43 | 213 |
| 140 | 6 | 4324 | 2696 | gi\|634107 | kdpB [*Escherichia coli*] | 73 | 59 | 1629 |
| 342 | 6 | 5939 | 4818 | gi\|410125 | ribG gene product [*Bacillus subtilis*] | 73 | 57 | 1122 |
| 149 | 4 | 1717 | 1568 | gi\|460892 | heparin binding protein-44, HBP-44 [mice, Peptide, 360 aa] pir\|JX0281\|JX0281 heparin-binding protein-44 precursor-mouse gi\|220434 ORF [*Mus ausculus*] (SUB 2-360) | 73 | 53 | 150 |
| 158 | 1 | 1 | 1431 | gi\|882504 | oRF_f560 [*Escherichia coli*] | 73 | 57 | 1431 |
| 174 | 6 | 4525 | 3698 | gi\|1146240 | ketopantoate hydroxyaethyltransferase [*Bacillus subtilis*] | 73 | 55 | 828 |
| 175 | 8 | 5178 | 4819 | gi\|854657 | Na/M antiporter system ORF3 [*Bacillus alcalophilus*] | 73 | 56 | 360 |
| 386 | 5 | 5493 | 4393 | gi\|467477 | unknown [*Bacillus subtilis*] | 73 | 48 | 1101 |
| 249 | 6 | 5729 | 5175 | gi\|1524397 | glycine betaine transporter OpuD [*Bacillus subtilis*] | 73 | 56 | 555 |
| 265 | 4 | 1873 | 2280 | gi\|39848 | U3 [*Bacillus subtilis*] | 73 | 41 | 408 |
| 270 | 1 | 328 | 582 | gi\|780461 | 220 kDa polyprotein [*African swine fever virus*] | 73 | 53 | 255 |
| 278 | 4 | 3618 | 2953 | gi\|1208965 | hypothetical 23.3 kd protein [*Escherichia coli*] | 73 | 49 | 666 |
| 279 | 3 | 3593 | 2202 | gi\|1185288 | isochorismate synthase [*Bacillus subtilis*] | 73 | 58 | 1392 |
| 291 | 4 | 1207 | 1575 | gi\|1511440 | glutamine-fructose-6-phosphate transaminase [*Methanococcus jannaschii*] | 73 | 63 | 369 |
| 299 | 2 | 735 | 1166 | gi\|467437 | unknown [*Bacillus subtilis*] | 73 | 58 | 432 |
| 299 | 5 | 2050 | 3234 | gi\|467439 | temperature sensitive cell division [*Bacillus subtilis*] | 73 | 53 | 1185 |
| 334 | 1 | 728 | 219 | gi\|536655 | ORF Y8R244w [*Saccharomyces cerevisiae*] | 73 | 43 | 510 |
| 336 | 2 | 1036 | 245 | gi\|790943 | urea amidolyase [*Bacillus subtilis*] | 73 | 51 | 792 |
| 374 | 3 | 1389 | 1874 | gi\|1405451 | YneJ [*Bacillus subtilis*] | 73 | 55 | 486 |
| 433 | 4 | 1916 | 2554 | gi\|473902 | alpha-acetolactate synthase [*Lactococcus lactis*] | 73 | 54 | 639 |
| 509 | 2 | 1028 | 261 | gi\|467483 | unknown [*Bacillus subtilis* | 73 | 56 | 768 |
| 513 | 1 | 918 | 127 | gi\|1146220 | AND+ dependent glycerol-3-phosphate dehydrogenase [*Bacillus subtilis*] | 73 | 56 | 792 |
| 533 | 2 | 239 | 733 | gi\|1510605 | hypothetical protein [SP: P42297] [*Methanococcus jannaschii*] | 73 | 44 | 495 |
| 546 | 2 | 1248 | 2815 | gi\|41748 | hsdM protein (AA 1–520) [*Escherichia coli*] | 73 | 52 | 1668 |
| 549 | 1 | 382 | 2 | gi\|1324847 | CinA [*Bacillus subtilis*] | 73 | 57 | 381 |
| 567 | 1 | 675 | 4 | gi\|410137 | ORFX13 [*Bacillus subtilis*] | 73 | 58 | 672 |
| 716 | 2 | 654 | 1112 | gi\|1256623 | exodeoxyribonuclease [*Bacillus subtilis*] | 73 | 56 | 459 |
| 772 | 1 | 3 | 677 | gi\|1142010 | shows 70.2% similarity and 48.6% identity to the EnvH protein of *almonella typhimurium* [*Anabaena sp.*] | 73 | 57 | 675 |
| 774 | 1 | 3 | 209 | gi\|409286 | bmrU [*Bacillus subtilis*] | 73 | 52 | 207 |
| 782 | 1 | 1 | 402 | gi\|143320 | [gap] gene products [*Bacillus megaterium*] | 73 | 56 | 402 |
| 789 | 2 | 451 | 762 | gi\|1063246 | low homology to P14 protein of *Haemophilus influenza* and 14.2 kDa protein of *Escherichia coli* [*Bacillus subtilis*] | 73 | 56 | 312 |

TABLE 2-continued

| | | | | | | | | |
|---|---|---|---|---|---|---|---|---|
| 796 | 1 | 3 | 911 | gi\|853754 | ABC transporter [*Bacillus subtilis*] | 73 | 58 | 909 |
| 806 | 3 | 949 | 689 | gi\|143786 | tryptophanyl-tRNA synthetase (EC 6.1.1.2) [*Bacillus subtilis*] pir\|JT0481\|YMBS tryptophan-tRHA ligase (EC 6.1.1.2)-*Bacillus ubtilis* | 73 | 51 | 261 |
| 816 | 2 | 3097 | 1355 | gi\|41748 | hsdM protein (AA 1–520) (*Escherichia coli*) | 73 | 52 | 1743 |
| 839 | 1 | 400 | 2 | gi\|886906 | argininosuccinate synthetase [*Streptomyces clavuligerus*] pir\|S57659\|S57659 argininosuccinate synthase (EC 6.3.4.5)-*treptomyces clavuligerus* | 73 | 59 | 399 |
| 857 | 1 | 3 | 290 | gi\|348052 | acetoin utilization protein [*Bacillus subtilis*] | 73 | 50 | 288 |
| 1008 | 1 | 396 | 6 | gi\|40100 | rodC (tag3) polypeptide (AA 1–746) [*Bacillus subtilis*] ir\|S06049\|S06049 rodC protein-*Bacillus subtilis* p\|P13485\|TAGF_BACSU TECHOIC ACID BIOSYHTHESIS PROTEIN F. | 73 | 41 | 393 |
| 1018 | 1 | 1 | 213 | gi\|529357 | No definition line found [*Caenorhabditis elegans*] sp\|P46975\|STT3_CAEEL OLIGOSACCHARYL TRANSFERASE STT3 SUBUNIT OMOLOG. | 73 | 53 | 213 |
| 1033 | 1 | 3 | 491 | gi\|142706 | comG1 gene product [*Bacillus subtilis*] | 73 | 51 | 489 |
| 1174 | 1 | 204 | 13 | gi\|1149513 | alpha3a subunit of laminin 5 [*Homo sapiens*] | 73 | 60 | 192 |
| 1175 | 1 | 329 | 3 | gi\|473817 | 'ORF' [*Escherichia coli*] | 73 | 57 | 327 |
| 1187 | 1 | 3 | 209 | gi\|580870 | ipa-37d qoxA gene product [*Bacillus subtilis*] | 73 | 52 | 207 |
| 1206 | 1 | 72 | 245 | gi\|144816 | formyltetrahydrofolate synthetase (FTHFS) (ttg start codon) (EC .3.4.3) [*Moorella thermoacetica*] | 73 | 43 | 174 |
| 1454 | 1 | 241 | 59 | gi\|1213253 | unknown [*Schizosaccharomyces pombe*] | 73 | 53 | 183 |
| 1469 | 1 | 260 | 3 | gi\|1303787 | YqeG [*Bacillus subtilis*] | 73 | 55 | 258 |
| 1761 | 1 | 189 | 4 | gi\|9135 | Mst26Aa gene product [*Drosophila simulans*] | 73 | 34 | 186 |
| 1849 | 1 | 243 | 19 | gi\|162307 | DHA topoisomerase II [*Trypanosoma cruzi*] | 73 | 60 | 225 |
| 2055 | 1 | 2 | 400 | gi\|559381 | P47K protein [*Rhodococcus erythropolis*] | 73 | 34 | 399 |
| 2556 | 1 | 2 | 244 | gi\|145925 | fecB [*Escherichia coli*] | 73 | 62 | 243 |
| 2947 | 2 | 400 | 251 | gi\|1184680 | polynucleotide phosphorylase [*Bacillus subtilis*] | 73 | 51 | 150 |
| 2956 | 1 | 375 | 4 | gi\|143397 | quinol oxidase [*Bacillus subtilis*] | 73 | 58 | 372 |
| 3037 | 1 | 329 | 3 | gi\|143091 | acetolactate synthase [*Bacillus subtilis*] | 73 | 55 | 327 |
| 3125 | 1 | 194 | 3 | gi\|323866 | overlapping out-of-phase protein [*Eggplant mosaic virus*] sp\|P20129\|V70K_EPMV 70 KD PROTEIN. | 73 | 53 | 192 |
| 3603 | 2 | 527 | 354 | gi\|1439521 | glutaryl-CoA dehydrogenase precursor [*Mus musclus*] | 73 | 48 | 174 |
| 3743 | 1 | 400 | 2 | gi\|450688 | hsdM gene of EcoprrI gene product [*Escherichia coli*] pir\|S38437\|S38437 hsdM protein-*Escherichia coli* pir\|S09629\|S09629 hypothetical protein A-*Escherichia coli* (SUB 40–520) | 73 | 54 | 399 |
| 3752 | 1 | 359 | 78 | gi\|1524193 | unknown [*Mycobacterium tuberculosis*] | 73 | 59 | 282 |
| 3852 | 1 | 2 | 181 | gi\|216746 | D-lactate dehydrogenase [*Lactobacillus plantarum*] | 73 | 68 | 180 |
| 3914 | 1 | 239 | 3 | pir\|S13490\|S134 | Hydroxymethylglutaryl-CoA synthase (EC 4.1.3.5)-Chicken (fragment) | 73 | 53 | 237 |
| 3914 | 2 | 343 | 116 | gi\|528991 | unknown [*Bacillus subtilis*] | 73 | 38 | 228 |
| 4069 | 1 | 2 | 316 | gi\|40003 | oxoglutarate dehydrogenase (NADP+) [*Bacillus subtilis*] p\|P23129\|ODO1_BACSU 2-OXOGLUTAMATE DEHYDROGENASE E1 COMPONENT (EC 2.4.2) (ALPHA-KETOGLUTARATE DEHYDROGENASE) | 73 | 55 | 315 |
| 4165 | 1 | 365 | 15 | gi\|1439521 | glutaryl-CoA dehydrogenase precursor [*Nus musculus*] | 73 | 48 | 351 |
| 4196 | 1 | 1 | 177 | gi\|809660 | deoxyribose-phosphate aldolase [*Bacillus subtilis*] pir\|S49455\|S49455 deoxyribose-phosphate aldolase (EC 4.1.2.4)-*acillus subtilis* | 73 | 60 | 177 |
| 4202 | 1 | 378 | 184 | gi\|528991 | unknown [*Bacillus subtilis*] | 73 | 38 | 195 |
| 4314 | 1 | 2 | 193 | gi\|436797 | N-acyl-L-amino acid amidohydrolase [*Bacillus stearothermophilus*] sp\|P37112\|ANA_BACST N-ACYL-L-AMINO ACID AMIDOHYDROLASE (EC .5.1.14) (AMINOACYLASE). | 73 | 47 | 192 |
| 4393 | 1 | 3 | 263 | gi\|216267 | ORF2 [*Bacillus megaterium*] | 73 | 47 | 261 |
| 35 | 2 | 903 | 1973 | gi\|1146196 | phosphoglycerate dehydrogenese [*Bacillus subtilis*] | 72 | 53 | 1071 |
| 38 | 22 | 17877 | 16660 | gi\|602031 | similar to trimethylamine DH [*Mycoplasma capricolum*] pir\|S49950\|S49950 probable trimethylamine dehydrogenase (EC .5.99.7)-*Mycoplasma capricolum* (SCC3) (fragment) | 72 | 54 | 1218 |
| 38 | 23 | 18134 | 19162 | gi\|413968 | ipa-44d gene product [*Bacillus subtilis*] | 72 | 54 | 1029 |
| 44 | 19 | 11895 | 12953 | gi\|516272 | unknown [*Bacillus subtilis*] | 72 | 49 | 1059 |
| 48 | 7 | 6248 | 7117 | gi\|43499 | pyruvate synthase [*Halobacterium halobium*] | 72 | 49 | 870 |
| 50 | 7 | 5691 | 4819 | gi\|1205399 | proton glutamate symport protein [*Haemophilus influenzae*] | 72 | 53 | 873 |
| 53 | 19 | 9259 | 7997 | gi\|1303956 | YqjE [*Bacillus subtilis*] | 72 | 52 | 1263 |
| 56 | 23 | 29549 | 129995 | gi\|467471 | unknown [*Bacillus subtilis*] | 72 | 47 | 447 |
| 69 | 4 | 4123 | 2948 | gi\|1354775 | pfos/R [*Treponema pallidum*] | 72 | 46 | 1176 |
| 69 | 5 | 4377 | 4982 | gi\|904198 | hypothetical protein [*Bacillus subtilis*] | 72 | 43 | 606 |
| 73 | 1 | 2 | 856 | gi\|142997 | glycerol uptake facilitator [*Bacillus subtilis*] | 72 | 59 | 855 |
| 98 | 13 | 9371 | 110258 | gi\|467435 | unknown [*Bacillus subtilis*] | 72 | 50 | 888 |
| 127 | 1 | 1 | 1593 | gi\|217144 | alanine carrier protein [*thermophilic bacterium* PS3] pir\|A45111\|A45111 alanine transport protein-*thermophilic acterium* PS-3 | 72 | 56 | 1593 |
| 131 | 1 | 2600 | 3 | gi\|153952 | polymerase III polymerase subunit (dnaE) [*Salmonella typhimurium*] pir\|A45915\|A45915 DNA-directed DNA polymerase (EC 2.7.7.7) III ipha chain-*Salmonella typhimurium* | 72 | 53 | 2598 |
| 141 | 4 | 1040 | 1978 | gi\|1405446 | transketolase [*Bacillus subtilis*] | 72 | 54 | 939 |
| 149 | 8 | 2535 | 2251 | gi\|606234 | secy [*Escherichia coli*] | 72 | 44 | 285 |
| 149 | 17 | 5245 | 5018 | gi\|1304472 | IDNA polymerase [Unidentified phycodnavirus clone OTU4] | 72 | 55 | 228 |
| 154 | 1 | 1 | 210 | gi\|11205620 | ferritin like protein [*Haemophilus influenzae*] | 72 | 40 | 210 |

TABLE 2-continued

| | | | | | | | | |
|---|---|---|---|---|---|---|---|---|
| 155 | 1 | 1320 | 433 | gi\|391610 | farnesyl diphosphate synthase [*Bacillus stearothermophilus*] pir\|JX0257\|JX0257 geranyltranstransferase (EC 2.5.1.10)-*Bacillus tearothermophilus* | 72 | 57 | 888 |
| 180 | 1 | 2 | 328 | gi\|433630 | A180 [*Saccharomyces cerevisiae*] | 72 | 62 | 327 |
| 184 | 3 | 1145 | 3553 | gi\|1205110 | virulence associated protein homolog [*Haemophilus influenzae*] | 72 | 49 | 2409 |
| 195 | 2 | 1279 | 635 | gi\|1001730 | hypothetical protein [Synechocystis sp.) | 72 | 45 | 645 |
| 206 | 13 | 14646 | 15869 | gi\|1064807 | ORTHININE AMINOTRANSFERASE [*Bacillus subtilis*] | 72 | 50 | 1224 |
| 209 | 2 | 462 | 932 | gi\|1204666 | hypothetical protein (GB: X73124_53) [*Haemophilus influenzae*] | 72 | 60 | 471 |
| 215 | 2 | 522 | 280 | gi\|881513 | insulin receptor homolog [*Drosophila melanogaster*] pir\|S57245\|S57245 insulin receptor homolog-fruit fly [*Drosophila elanogaster*] (SUB 46-2146) | 72 | 63 | 243 |
| 224 | 1 | 2 | 790 | gi\|949974 | sucrose repressor [*Staphylococcus xylosus*] | 72 | 54 | 789 |
| 233 | 1 | 765 | 4 | gi\|1408493 | homologous to SwissProt: YIDA_ECOLI hypothetical protein [*Bacillus subtilis*] | 72 | 52 | 762 |
| 240 | 1 | 220 | 1485 | gi\|537049 | ORF_o470 [*Escherichia coli*] | 72 | 52 | 1266 |
| 245 | 1 | 3 | 1340 | gi\|1204578 | hypothetical protein (GB: U06949_1) [*Haemophilus influenzae*] | 72 | 46 | 1338 |
| 259 | 2 | 1245 | 382 | gi\|1340128 | ORF1 [*Staphylococcus aureus*] | 72 | 59 | 864 |
| 304 | 2 | 285 | 1094 | gi\|1205330 | glutamine-binding periplasmic protein [*Haemophilus influenzae*] | 72 | 52 | 810 |
| 307 | 10 | 5039 | 4752 | gi\|1070015 | protein-dependent [*Bacillus subtilis*] | 72 | 53 | 288 |
| 315 | 1 | 260 | 3 | gi\|143399 | quinol oxidase [*Bacillus subtilis*] | 72 | 55 | 258 |
| 316 | 11 | 9308 | 8994 | gi\|1204445 | hypothetical protein (SP:P27857) [*Haemophilus influenzae*] | 72 | 52 | 315 |
| 337 | 3 | 926 | 1609 | gi\|487433 | citrate synthase II [*Bacillus subtilis*] | 72 | 55 | 684 |
| 364 | 7 | 10493 | 8448 | gi\|1510643 | ferrous iron transport protein B [*Methanococcus jannaschii*] | 72 | 53 | 2046 |
| 409 | 2 | 340 | 1263 | gi\|1402944 | orfRM1 gene product [*Bacillus subtilis*] | 72 | 49 | 924 |
| 441 | 3 | 1590 | 1003 | gi\|312379 | highly conserved among eubacteria [*Clostridium acetobutylicum*] pir\|S34312\|S34312 hypothetical protein V-*Clostridium cetobutylicum* | 72 | 48 | 588 |
| 453 | 6 | 2505 | 2356 | pir\|S00601\|BXSA | antibacterial protein 3-*Staphylococcus haemolyticus* | 72 | 70 | 150 |
| 460 | 1 | 2 | 625 | gi\|1016162 | ABC transporter subunit [*Cyanophora paradoxa*] | 72 | 51 | 624 |
| 463 | 1 | 1628 | 3 | gi\|666014 | The polymorphysm (RFLP) of this gene is associated with usceptibility to essential hypertension. The SA gene product has light homology to acetyl-CoA synthetase [Homo sapiens] | 72 | 60 | 1626 |
| 480 | 4 | 3047 | 3466 | gi\|433992 | ATP synthase subunit epsilon [*Bacillus subtilis*] | 72 | 53 | 420 |
| 502 | 1 | 586 | 86 | gi\|310859 | ORF2 [Synechococcus sp.] | 72 | 50 | 501 |
| 519 | 1 | 81 | 1184 | gi\|1303704 | YrkE [*Bacillus subtilis*] | 72 | 54 | 1104 |
| 559 | 1 | 3 | 746 | gi\|1107530 | ceuD gene product [*Campylobacter coli*] | 72 | 56 | 744 |
| 575 | 1 | 573 | 4 | gi\|1303866 | YqgS [*Bacillus subtilis*] | 72 | 56 | 570 |
| 671 | 1 | 2 | 592 | gi\|1204497 | protein-export membrane protein [*Haemophilus influenzae*] | 72 | 44 | 591 |
| 679 | 2 | 295 | 1251 | gi\|563258 | virulence-associated protein E [*Dichelobacter nodosus*] | 72 | 52 | 957 |
| 687 | 2 | 295 | 957 | gi\|1146214 | 44% identical amino acids with the *Escherichia coli* smba supress; putative [*Bacillus subtilis*] | 72 | 49 | 663 |
| 837 | 1 | 1 | 435 | gi\|1146183 | putative [*Bacillus subtilis*] | 72 | 54 | 435 |
| 868 | 1 | 150 | 788 | gi\|1377842 | unknown [*Bacillus subtilis*] | 72 | 55 | 639 |
| 922 | 1 | 130 | 432 | gi\|1088269 | unknown protein [*Azotobacter vinelandii*] | 72 | 58 | 303 |
| 941 | 1 | 2 | 238 | gi\|153929 | NADPH-sulfite reducatase flavoprotein component [*Salmonella yphimurium*] | 72 | 49 | 237 |
| 980 | 1 | 421 | 2 | gi\|853767 | UDP-N-acetylglucosamine 1-carboxyvinyltransferase [*Bacillus ubtilis*] | 72 | 59 | 420 |
| 1209 | 1 | 213 | 43 | gi\|144735 | neurotoxin type B [*Clostrldium botulinum*] | 72 | 44 | 171 |
| 469 | 2 | 474 | 277 | gi\|1205458 | hypothetical protein (GB: D26562190_47) [*Haemophilus influenzae*] | 72 | 63 | 198 |
| 1956 | 1 | 365 | 3 | gi\|154409 | hexosephosphate transport protein [*Salmonella typhimurium*] pir\|P41853\|S41853 hexose phosphate transport system regulatory rotein uhpB *Salmonella typhimurium* | 72 | 44 | 363 |
| 2101 | 1 | 3 | 401 | gi\|1303950 | YqiY [*Bacillus subtilis*] | 72 | 50 | 399 |
| 2503 | 1 | 399 | 229 | gi\|149713 | formate dehydrogenase [*Methanobacterium formicicum*] pir\|A42712\|A42712 formate dehydrogenase (EC 1.2.1.2)-*ethanobacterium formicicum* | 72 | 56 | 171 |
| 2967 | 1 | 3 | 155 | gi\|1212729 | YqhJ [*Bacillus subtilis*] | 72 | 46 | 153 |
| 3004 | 1 | 185 | 3 | gi\|665999 | hypothetical protein [*Bacillus subtilis*] | 72 | 55 | 183 |
| 3109 | 1 | 141 | 4 | gi\|413968 | ipa-44d gene product [*Bacillus subtilis*] | 72 | 45 | 138 |
| 3171 | 1 | 3 | 287 | gi\|515938 | glutamate synthase (ferredoxin) [Synechocystis sp.] pir\|S46957\|S46957 glutamate synthase (ferredoxin) (EC 1.4.7.1-ynechocystia sp. | 72 | 52 | 285 |
| 3771 | 1 | 26 | 367 | gi\|1408501 | homologous to N-acyl-L-amino acid amidohydrolase of *Bacillus stearothermophilus* [*Bacillus subtilis*] | 72 | 63 | 342 |
| 3951 | 1 | 1 | 222 | gi\|1500409 | M. jannaschii predicted coding region MJ1519 [*Methanococcus jannaschii*] | 72 | 38 | 222 |
| 4190 | 1 | 362 | 3 | gi\|39956 | IIGlc [*Bacillus subtilis*] | 72 | 57 | 360 |
| 4444 | 1 | 3 | 347 | gi\|1009366 | Respiratory nitrate reductase [*Bacillus subtilis*] | 72 | 55 | 345 |
| 6 | 2 | 931 | 1200 | gi\|537095 | ornithine carbarsoyltransferase [*Escherichia coli*] | 71 | 55 | 270 |
| 11 | 15 | 10859 | 10368 | gi\|532309 | 25 kDa protein [*Escherichia coli*] | 71 | 47 | 492 |
| 19 | 2 | 1248 | 2435 | gi\|1244574 | D-alanine-D-alanine ligase [*Enterococcus hirae*] | 71 | 52 | 1188 |
| 21 | 2 | 898 | 1488 | gi\|149629 | anthranilate synthase component 2 [*Leptospira biflexa*] pir\|C32840\|C32840 anthranilate synthase (EC 4.1.3.27) component II *Leptospira biflexa* | 71 | 45 | 591 |
| 34 | 1 | 1 | 567 | gi\|1303983 | YqkF [*Bacillus subtilis*] | 71 | 59 | 567 |
| 37 | 3 | 2806 | 2420 | gi\|1209681 | glutamate-rich protein [*Bacillus firmus*] | 71 | 50 | 387 |
| 38 | 18 | 12250 | 12462 | gi\|927645 | arginyl endopeptidase [*Porphyromonas gingivalis*] | 71 | 50 | 213 |

TABLE 2-continued

| | | | | | | | | |
|---|---|---|---|---|---|---|---|---|
| 39 | 3 | 1246 | 4431 | pir\|S0941\|S094 | spoIIIE protein-*Bacillus subtilis* | 71 | 49 | 53186 |
| 53 | 14 | 14760 | 13750 | gi\|142611 | branched chain alpha-keto acid dehydrogenase E1-alpha [*Bacillus ubtilis*] | 71 | 58 | 1011 |
| 54 | 11 | 12625 | 11789 | gi\|143014 | gnt repressor [*Bacillus subtilis*] | 71 | 46 | 837 |
| 57 | 7 | 5860 | 4568 | gi\|508175 | EIIC domain of PTS-dependent Gat transport and phosphorylation *Escherichia coli* | 71 | 48 | 1293 |
| 57 | 18 | 13897 | 14334 | gi\|063247 | high homology to flavohemoprotein (Haemoglobin-like protein) of *Alcaligenes eutrophus* and *Saccharomyces cerevisiae* [*Bacillus subtilis*] | 71 | 56 | 438 |
| 62 | 16 | 9831 | 10955 | gi\|1303926 | YqiG [*Bacillus subtilis*] | 71 | 54 | 1125 |
| 70 | 2 | 8505 | 8966 | gi\|147198 | phnE protein [*Escherichia coli*] | 71 | 38 | 462 |
| 86 | 5 | 2089 | 1784 | gi\|904205 | hypothetical protein [*Bacillus subtilis*] | 71 | 51 | 306 |
| 96 | 7 | 7601 | 8269 | gi\|709991 | hypothetical protein [*Bacillus subtilis*] | 71 | 49 | 669 |
| 100 | 6 | 4822 | 5931 | gi\|1060848 | opine dehydrogenase [*Arthrobacter sp.*] | 71 | 45 | 1110 |
| 103 | 1 | 532 | 2 | gi\|143089 | iep protein [*Bacillus subtilis*] | 71 | 41 | 531 |
| 09 | 18 | 15312 | 15695 | gi\|413985 | ipa-61d gene product [*Bacillus subtilis*] | 71 | 57 | 384 |
| 113 | 1 | 316 | 2 | gi\|663254 | probable protein kinase [*Saccharomyces cerevisiae*] | 71 | 57 | 315 |
| 114 | 5 | 5603 | 4608 | gi\|143156 | membrane bound protein [*Bacillus subtilis*] | 71 | 40 | 996 |
| 133 | 2 | 1723 | 359 | gi\|1303913 | YqhX [*Bacillus subtilis*] | 71 | 53 | 1365 |
| 149 | 19 | 5895 | 5455 | gi\|529650 | G40P [Bacteriophage SPP1] | 71 | 51 | 441 |
| 154 | 5 | 3087 | 2539 | gi\|425488 | repressor protein [*Streptococcus sobrinus*] | 71 | 47 | 549 |
| 164 | 11 | 11354 | 11689 | gi\|49318 | ORF4 gene product [*Bacillus subtilis*] | 71 | 52 | 336 |
| 169 | 5 | 1936 | 2745 | gi\|1403403 | unknown [*Mycobacterium tuberculosis*] | 71 | 56 | 810 |
| 193 | 2 | 272 | 1234 | gi\|1303788 | YqeH [*Bacillus subtilis*] | 71 | 49 | 963 |
| 205 | 2 | 895 | 47 | gi\|1215694 | GlnQ [*Mycoplasma pneumoniae*] | 71 | 46 | 849 |
| 233 | 4 | 1849 | 2022 | gi\|133732 | ORF1 [*Campylobacter jejuni*] | 71 | 50 | 174 |
| 237 | 7 | 4501 | 5189 | gi\|149384 | HisIE [*Lactococcus lactis*] | 71 | 54 | 669 |
| 272 | 4 | 2273 | 1698 | gi\|709993 | hypothetical protein [*Bacillus subtilis*] | 71 | 48 | 576 |
| 274 | 2 | 618 | 496 | gi\|143035 | NAD(P)H: glutamyl-transfer RNA reductase [*Bacillus subtilis*] pir\|A35252\|A35252 5-aminolevulinate synthase (EC 2.3.1.37)-*acillus subtilis* | 71 | 53 | 879 |
| 276 | 5 | 2720 | 2091 | gi\|303562 | ORF210 [*Escherichia coli*] | 71 | 50 | 630 |
| 287 | 1 | 136 | 660 | gi\|310634 | 20 kDa protein [*Streptococcus gordonii*] | 71 | 53 | 525 |
| 288 | 6 | 2771 | 2220 | gi\|1256625 | putative [*Bacillus subtilis*] | 71 | 47 | 552 |
| 301 | 6 | 2461 | 1430 | gi\|467417 | similar to lysine decarboxylase [*Bacillus subtilis*] | 71 | 57 | 1032 |
| 306 | 4 | 5222 | 3837 | gi\|1256618 | transport protein [*Bacillus subtilis*] | 71 | 56 | 1386 |
| 307 | 2 | 925 | 314 | gi\|602683 | orfC [*Mycoplasma capricolum*] | 71 | 45 | 612 |
| 310 | 5 | 5146 | 4499 | gi\|348052 | acetoin utilization protein [*Bacillus subtilis*] | 71 | 51 | 648 |
| 322 | 1 | 2 | 1303 | gi\|1001819 | hypothetical protein [*Synechocystis sp.*] | 71 | 46 | 1302 |
| 333 | 4 | 3995 | 3819 | gi\|467473 | unknown [*Bacillus subtilis*] | 71 | 57 | 177 |
| 350 | 2 | 548 | 922 | gi\|551879 | ORF 1 [*Lactococcus lactis*] | 71 | 55 | 375 |
| 375 | 4 | 1860 | 3071 | gi\|467447 | unknown [*Bacillus subtilis*] | 71 | 57 | 1232 |
| 380 | 5 | 1560 | 2102 | gi\|142557 | ATP synthase b subunit [*Bacillus megaterium*] | 71 | 43 | 543 |
| 414 | 2 | 251 | 637 | gi\|580904 | homologous to E. coli mpA [*Bacillus subtilis*] | 71 | 49 | 387 |
| 424 | 1 | 335 | 1354 | gi\|581305 | L-lactate dehydrogenase [*Lactobacillus plantarum*] | 71 | 57 | 1020 |
| 436 | 4 | 3270 | 2839 | pir\|PN0501\|PN05 | phosphoribosylanthranilate isomerase (EC 5.3.1.24)-*Bacillus subtilis* (fragment) | 71 | 66 | 432 |
| 482 | 1 | 3 | 1280 | gi\|410142 | ORFX18 [*Bacillus subtilis*] | 71 | 49 | 1278 |
| 525 | 3 | 1844 | 1416 | gi\|143370 | phosphoribosylpyrophosphate amidotransferas (PUR-F; EC 2.4.2.14) *Bacillus subtilis*] | 71 | 56 | 429 |
| 529 | 4 | 2047 | 1355 | gi\|606150 | ORF_f309 [*Escherichia coli*] | 71 | 43 | 693 |
| 563 | 1 | 22 | 969 | gi\|1237015 | ORF4 [*Bacillus subtilis*] | 71 | 53 | 948 |
| 581 | 1 | 255 | 4 | gi\|1301730 | T25G3.2 [*Caenorhabditis elegans*] | 71 | 47 | 252 |
| 612 | 2 | 913 | 758 | gi\|353968 | fimbriae Z [*Salmonella typhimurium*] | 71 | 55 | 156 |
| 613 | 1 | 1 | 654 | gi\|466778 | lysine specific permease [*Escherichia coli*] | 71 | 50 | 654 |
| 618 | 1 | 623 | 3 | gi\|1146238 | poly(A) polymerase [*Bacillus subtilis*] | 71 | 52 | 621 |
| 630 | 1 | 586 | 2 | gi\|1486243 | unknown [*Bacillus subtilis*] | 71 | 53 | 585 |
| 691 | 1 | 641 | 156 | gi\|289260 | comE ORF1 [*Bacillus subtilis*] | 71 | 51 | 486 |
| 694 | 2 | 149 | 427 | gi\|12971 | NADH dehydrogenase subunit V (AA 1–605) [*Gallus gallus*] ir\|S10197\|S10397 NADH dehydrogenase (ubiquinone) (EC 1.6.5.3) chain-chicken mitochondrion (SGC1) | 71 | 47 | 279 |
| 715 | 2 | 169 | 777 | gi\|1303830 | YqfL [*Bacillus subtilis*] | 71 | 53 | 609 |
| 746 | 2 | 970 | 467 | gi\|1377843 | unknown [*Bacillus subtilis*] | 71 | 52 | 504 |
| 748 | 1 | 802 | 167 | gi\|1405459 | YneS [*Bacillus subtilis*] | 71 | 49 | 636 |
| 753 | 1 | 524 | 30 | gi\|1510389 | *M. jannaschii* predicted coding region MJ0296 [*Methanococcus jannaschii*] | 71 | 53 | 495 |
| 761 | 1 | 3 | 215 | gi\|475972 | pentafunctional enzyme [*Pneumocystis carinii*] | 71 | 47 | 213 |
| 783 | 1 | 703 | 203 | gi\|536655 | ORF YBR244w [*Saccharomyces cerevisiae*] | 71 | 52 | 501 |
| 800 | 3 | 987 | 682 | gi\|1204326 | tRNA delta(2)-isopentenylpyrophosphate transferase [*Haemophilus influenzae*] | 71 | 48 | 306 |
| 806 | 1 | 116 | 286 | gi\|3419075 | cbiM gene product [*Methanobacterium thermoautotrophicum*] | 71 | 50 | 171 |
| 931 | 1 | 488 | 3 | gi\|893358 | PgsA [*Bacillus subtilis*] | 71 | 56 | 486 |
| 1041 | 1 | 2 | 262 | gi\|1408507 | pyrimidine nucleoside transport protein [*Bacillus subtilis*] | 71 | 45 | 261 |
| 1070 | 1 | 2 | 172 | gi\|709993 | hypothetical protein [*Bacillus subtilis*] | 71 | 46 | 171 |
| 1176 | 1 | 57 | 365 | gi\|151259 | HMG-CoA reductase (EC 1.1.1.88) [*Pseudomonas mevslonii*] pir\|A44756\|A44756 hydroxymethylglutaryl-CoA reductase (EC 1.1.1.88) Pseudomonas sp. | 71 | 49 | 309 |
| 1181 | 1 | 184 | 2 | gi\|46971 | epiP gene product [*Staphylococcus epidermidis*] | 71 | 50 | 183 |
| 1281 | 1 | 3 | 290 | gi\|153016 | ORF 419 protein [*Staphylococcus aureus*] | 71 | 50 | 288 |

TABLE 2-continued

| | | | | | | | | |
|---|---|---|---|---|---|---|---|---|
| 1348 | 1 | 229 | 2 | gi\|602683 | orfC [*Mycoplasma capricolum*] | 71 | 48 | 228 |
| 2002 | 1 | 379 | 2 | gi\|1008177 | ORF YJL046w [*Saccharomyces cerevisiae*] | 71 | 48 | 378 |
| 2119 | 1 | 2 | 217 | gi\|1046088 | arginyl-tRMA synthetase [*Mycoplasma genitalium*] | 71 | 50 | 216 |
| 2418 | 1 | 3 | 320 | gi\|1499771 | M. jannaschii predicted coding region MJ0936 [*Methanococcus jannaschii*] | 71 | 57 | 318 |
| 2961 | 1 | 2 | 187 | gi\|312443 | carbamoyl-phosphate synthase (glutamine-hydrolysing) [*Bacillus aldolyticus*] | 71 | 57 | 186 |
| 2999 | 2 | 67 | 306 | gi\|710020 | nitrite reductase (nirs) [*Bacillus subtilis*] | 71 | 43 | 240 |
| 3033 | 1 | 2 | 184 | gi\|1262335 | YmaA [*Bacillus subtilis*] | 71 | 57 | 183 |
| 3584 | 1 | 3 | 338 | gi\|401716 | beta-isopropylmalate dehydrogenase [*Neurospora crassa*] | 71 | 55 | 336 |
| 3715 | 2 | 399 | 55 | gi\|563952 | gluconatepermease [*Bacillus licheniformis*] | 71 | 59 | 345 |
| 3785 | 1 | 387 | 4 | gi\|47382 | acyl-CoA-dehydrogenase [*Streptomyces purpurascens*] | 71 | 57 | 384 |
| 3875 | 1 | 272 | 3 | gi\|1001541 | hypothetical protein [*Synechocystis sp.*] | 71 | 38 | 270 |
| 4135 | 1 | 320 | 3 | gi\|142695 | S-adenosyl-L-methionine: uroporphyrinpgen III methyltransferase *Bacillus megaterium*] | 71 | 52 | 318 |
| 4249 | 1 | 63 | 239 | gi\|1205363 | deoxyribose aldolase [*Haemophilus influenzae*] | 71 | 63 | 177 |
| 4508 | 1 | 267 | 4 | gi\|1197667 | viteilogenin [*Anolis pulchelius*] | 71 | 46 | 264 |
| 6 | 3 | 1237 | 2721 | gi\|1321788 | arginine ornithine antiporter [*Clostridium perfringens*] | 70 | 54 | 1485 |
| 11 | 11 | 6572 | 7486 | gi\|216854 | P47K [*Pseudomonas chlororaphis*] | 70 | 41 | 915 |
| 12 | 1 | 1481 | 72 | gi\|467330 | replicative DNA helicase [*Bacillus subtilis*] | 70 | 49 | 1410 |
| 15 | 1 | 893 | 30 | gi\|451216 | Mannosephosphate Isomerase [*Streptococcus mutans*] | 70 | 46 | 864 |
| 15 | 2 | 1050 | 823 | gi\|476092 | unknown [*Bacillus subtilis*] | 70 | 50 | 228 |
| 17 | 2 | 1350 | 568 | gi\|145402 | choline dehydrogenase [*Escherichia coli*] | 70 | 52 | 783 |
| 21 | 1 | 2 | 925 | gi\|149516 | anthranilate synthase alpha subunit [*Lactococcus lactis*] pir\|S35124\|S35124 anthranilate synthase (EC 4.1.3.27) alpha chain-*actococcus lactis* subsp. *lactis* | 70 | 50 | 924 |
| 25 | 7 | 5580 | 6251 | gi\|1389549 | ORF3 [*Bacillus subtilis*] | 70 | 52 | 672 |
| 33 | 6 | 6071 | 7423 | gi\|1303875 | YqhB [*Bacillus subtilis*] | 70 | 51 | 1353 |
| 36 | 2 | 959 | 1594 | gi\|500755 | methyl purine glycosylase [*Mus musculus*] | 70 | 47 | 636 |
| 38 | 8 | 4901 | 5860 | gi\|1408507 | pyrimidine nucleoside transport protein [*Bacillus subtilis*] | 70 | 44 | 960 |
| 44 | 8 | 5312 | 5989 | gi\|1006620 | hypothetical protein [*Synechocystis sp.*] | 70 | 49 | 678 |
| 46 | 10 | 8950 | 10020 | gi\|1403126 | czcD gene product [*Alcaligenes eutrophus*] | 70 | 45 | 1071 |
| 52 | 2 | 1900 | 1073 | gi\|1486247 | unknown [*Bacillus subtilis*] | 70 | 53 | 828 |
| 52 | 6 | 4048 | 4656 | gi\|244501 | esterase II = carboxylesterase (EC 3.1.1.1) [*Pseudomonas fluorescens*, eptide, 218 aa] | 70 | 50 | 609 |
| 56 | 8 | 8460 | 9962 | gi\|1339951 | small subunit of NADH-dependent glutamate synthase [*Plectonema boryanum*] | 70 | 51 | 1503 |
| 62 | 1 | 48 | 290 | gi\|142702 | A competence protein 2 [*Bacillus subtilis*] | 70 | 47 | 243 |
| 64 | 1 | 541 | 2 | gi\|1204377 | molybdopterin biosynthesis protein [*Haemophilus influenzae*] | 70 | 47 | 540 |
| 70 | 5 | 3595 | 2051 | gi\|1204834 | 2', 3'-cyclic-nucleotide 2'-phosphodiesterasa [*Haemophilus influenzae*] | 70 | 47 | 1545 |
| 91 | 4 | 5466 | 3139 | gi\|886471 | methionine synthase [*Catharanthus roseus*] | 70 | 56 | 2328 |
| 96 | 5 | 7255 | 5756 | pir\|B39096\|B390 | alkaline phosphatase (EC 3.1.3.1) III precursor-*Bacillus subtilis* | 70 | 54 | 1500 |
| 110 | 2 | 767 | 1300 | gi\|345294 | adenine phosphoribosyl-transferase [*Escherichia coli*] | 70 | 51 | 534 |
| 116 | 6 | 7026 | 7976 | gi\|143607 | sporulation protein [*Bacillus subtilis*] | 70 | 50 | 951 |
| 121 | 8 | 6401 | 6988 | gi\|1107528 | ttg start [*Campylobacter coli*] | 70 | 45 | 588 |
| 131 | 8 | 6842 | 7936 | gi\|1150454 | prolidase PepQ [*Lactobacillus delbrueckii*] | 70 | 48 | 1095 |
| 135 | 1 | 2 | 489 | gi\|311309 | putative membrane-bound protein with four times repetition of ro-Ser—Ala at the N-terminus; function unknown [*Alcaligenes utrophu*] | 70 | 49 | 1488 |
| 138 | 3 | 418 | 714 | gi\|904181 | hypothetical protein [*Bacillus subtilis*] | 70 | 46 | 297 |
| 164 | 8 | 9344 | 9874 | gi\|49315 | ORF1 gene product [*Bacillus subtilis*] | 70 | 47 | 531 |
| 164 | 16 | 15626 | 16618 | gi\|1205212 | hypothetical protein (GB:D10483_18) [*Haemophilus influenzae*] | 70 | 50 | 993 |
| 205 | 2 | 1803 | 871 | gi\|1215695 | peptide transport system protein SapF homolog; SapF homolog [*Mycoplasma pneumoniae*] | 70 | 47 | 933 |
| 209 | 3 | 910 | 1386 | gi\|1204665 | hypothetical protein (G8;X73124_26) [*Haemophilus influenzae*] | 70 | 48 | 477 |
| 246 | 3 | 340 | 756 | gi\|215098 | excisionase [Bacteriophage 154a] | 70 | 46 | 417 |
| 263 | 7 | 6749 | 5622 | gi\|142540 | aspartokinase II [*Bacillus sp.*] | 70 | 51 | 1128 |
| 268 | 3 | 3212 | 4117 | gi\|1340128 | ORF1 [*Staphylococcus aureus*] | 70 | 50 | 906 |
| 302 | 6 | 3201 | 3827 | gi\|147782 | ruvA protein (gtg start) [*Escherichia coli*] | 70 | 46 | 627 |
| 302 | 10 | 5879 | 7051 | pir\|C38530\|C385 | queuine tRNA-ribosyltransferase (EC 2.4.2.29)-*Escherichia coli* | 70 | 55 | 1173 |
| 313 | 1 | 1414 | 308 | gi\|1205934 | aminopeptidase a/i [*Haemophilus influenzae*] | 70 | 46 | 1107 |
| 355 | 2 | 379 | 669 | gi\|1070013 | protein-dependent [*Bacillus subtilis*] | 70 | 48 | 292 |
| 403 | 1 | 629 | 3 | gi\|733147 | GumP [*Xanthomonas campestris*] | 70 | 33 | 627 |
| 444 | 10 | 8770 | 9273 | gi\|1204752 | high affinity ribose transport protein [*Haemophilus influenzae*] | 70 | 52 | 504 |
| 449 | 1 | 2 | 1243 | gi\|619724 | MgtE [*Bacillus firmus*] | 70 | 44 | 1242 |
| 472 | 1 | 320 | 3 | gi\|727145 | open reading frame; putative [*Bacillus amyloliquefaciens*] pir\|B29091\|B29091 hypothetical protein (bg1A region)-*Bacillus myloliquefaciens*] fragment) | 70 | 41 | 318 |
| 480 | 2 | 727 | 1608 | gi\|142560 | ATP synthase gamma subunit [*Bacillus megaterium*] | 70 | 44 | 882 |
| 524 | 1 | 2 | 307 | gi\|602292 | RCH2 protein [*Brassica napus*] | 70 | 45 | 306 |
| 525 | 1 | 413 | 3 | gi\|143372 | phosphoribosyl glycinamide formyltransfetase (PUR-N) [*Bacillus ubtilis*] | 70 | 52 | 411 |
| 565 | 4 | 2552 | 1479 | gi\|881434 | ORFP [*Bacillus subtilis*] | 70 | 51 | 1074 |
| 607 | 4 | 829 | 1284 | gi\|1511524 | hypothetical protein (SP: P37002) [*Methanococcus jannaschii*] | 70 | 50 | 456 |
| 633 | 1 | 703 | 23 | gi\|431231 | uracil permease [*Bacillus caldolyticus*] | 70 | 53 | 681 |
| 646 | 3 | 1309 | 935 | gi\|467340 | unknown [*Bacillus subtilis*] | 70 | 49 | 375 |
| 663 | 1 | 417 | 4 | gi\|1303873 | YqgZ [*Bacillus subtilis*] | 70 | 40 | 414 |

TABLE 2-continued

| | | | | | | | | |
|---|---|---|---|---|---|---|---|---|
| 681 | 1 | 781 | 74 | gi\|1001678 | hypothetical protein [Synechocystis sp.] | 70 | 53 | 708 |
| 708 | 1 | 2 | 448 | sp\|P33940\|YOJH_ | HYPOTHETICAL 54.3 KD PROTEIN IN ECO-ALKB INTERGENIC REGION. | 70 | 51 | 447 |
| 725 | 1 | 51 | 722 | gi\|1001644 | hypothetical protein [Synechocystis sp.] | 70 | 48 | 672 |
| 776 | 1 | 787 | 203 | gi\|145365 | putative [Escherichia coli] | 70 | 47 | 585 |
| 834 | 1 | 250 | 783 | gi\|552971 | NADH dehydrogenase (ndhF) [Vicia faba] | 70 | 47 | 534 |
| 865 | 2 | 1379 | 1173 | gi\|1204636 | ATP-dependent helicase [Haemophilus influenzae] | 70 | 45 | 207 |
| 894 | 1 | 269 | 3 | gi\|467364 | DNA binding protein (probale) [Bacillus subtilis] | 70 | 41 | 267 |
| 919 | 1 | 3 | 317 | gi\|1314847 | CinA [Bacillus subtilis] | 70 | 40 | 315 |
| 944 | 1 | 3 | 572 | gi\|709991 | hypothetical protein [Bacillus subtilis] | 70 | 44 | 570 |
| 988 | 2 | 605 | 438 | gi\|142441 | ORF 3; putative [Bacillus subtilis] | 70 | 50 | 168 |
| 1055 | 1 | 3 | 335 | gi\|529755 | speC [Streptococcus pyogenes] | 70 | 37 | 333 |
| 1093 | 1 | 2 | 904 | gi\|853754 | ABC transporter [Bacillus subtilis] | 70 | 49 | 903 |
| 1109 | 1 | 2 | 310 | gi\|1001827 | hypothetical protein [Synechocystis sp.] | 70 | 42 | 309 |
| 1220 | 1 | 235 | 2 | pir\|S23416\|S234 | epiB protein-Staphylococcus epidermidis | 70 | 40 | 234 |
| 1279 | 1 | 73 | 348 | gi\|153015 | FemA protein [Staphylococcus aureus] | 70 | 47 | 276 |
| 1336 | 1 | 195 | 542 | sp\|P31776\|PBPA | PENICILLIN-BINDING PROTEIN 1A (PBP-1A) (PENICILLIN-BINDING PROTEIN A). | 70 | 50 | 348 |
| 1537 | 2 | 232 | 402 | gi\|1146181 | putative [Bacillus subtilis] | 70 | 50 | 171 |
| 3574 | 1 | 272 | 93 | gi\|219630 | endothelin-A receptor [Homo sapiens] | 70 | 47 | 180 |
| 1640 | 1 | 346 | 2 | gi\|1146243 | 22.4% identity with Escherichia coli DNA-damage inducible protein . . .; putative[Bacillus subtilis] | 70 | 46 | 345 |
| 2504 | 1 | 2 | 286 | gi\|495179 | transmembrane protein [Lactococcus lactis] | 70 | 51 | 285 |
| 3061 | 1 | 301 | 38 | gi\|508175 | EIIC domain of PTS-dependent Gat transport and phosphorylation Escherichia coli | 70 | 44 | 264 |
| 3128 | 1 | 2 | 199 | gi\|1340096 | unknown [Mycobacterium tuberculosis] | 70 | 51 | 198 |
| 3218 | 1 | 3 | 488 | gi\|515938 | glutamate synthase (ferredoxit) [Synechocystis sp.] pir\|S46957\|S46957 glutamate synthase (ferredoxin) (EC 1.4.7.1)-ynechocystis sp. | 70 | 50 | 486 |
| 3323 | 1 | 399 | 4 | gi\|1154891 | ATP binding protein [Phoraidium laminosum] | 70 | 52 | 396 |
| 3679 | 1 | 399 | 199 | gi\|529385 | chromosome condensation protein [Caenorhabditis elegans] | 70 | 30 | 201 |
| 3841 | 1 | 398 | 90 | gi\|1208965 | hypothetical 23.3 kd protein [Escherichia coli] | 70 | 47 | 309 |
| 3929 | 1 | 3 | 401 | gi\|149435 | putative [Lactococcus lactis] | 70 | 49 | 399 |
| 4044 | 1 | 374 | 153 | gi\|602031 | similar to trimethylamine DH [Mycoplasma capricolus] pir\|S49950\|S49950 probable trimethylamine dehydrogenase (EC .5.99.7)- Mycoplasma capricolum (SGC3) (fragment) | 70 | 40 | 222 |
| 4329 | 1 | 280 | 2 | gi\|1339951 | small subunit of NADH-dependent glutamate synthase [Plectonema boryanum] | 70 | 49 | 279 |
| 4422 | 1 | 289 | 2 | gi\|296464 | ATPase [Lactococcus lactis] | 70 | 57 | 288 |
| 4647 | 1 | 200 | 39 | gi\|166412 | NADH-glutamate synthase [Medicago sativa] | 70 | 59 | 162 |
| 16 | 8 | 7571 | 9031 | gi\|1499620 | M. jannaschii predicted coding region MJ0798 [Methanococcus jannaschii] | 69 | 44 | 1461 |
| 16 | 9 | 9080 | 10033 | gi\|1353197 | thioredoxin reductase [Eubacterium acidaminophilum] | 69 | 54 | 954 |
| 30 | 1 | 727 | 2 | gi\|1204910 | hypothetical protein (GB: U14003_302) [Haemophilus influenzae] | 69 | 52 | 726 |
| 38 | 4 | 1023 | 1298 | gi\|407773 | devA gene product [Anabaena sp.] | 69 | 41 | 276 |
| 44 | 9 | 5987 | 6595 | gi\|1205920 | molybdate uptake system hydrophilic membrane-bound protein [Haemophilus influenzae] | 69 | 45 | 609 |
| 62 | 15 | 9104 | 9475 | gi\|385178 | unknown [Bacillus subtilis] | 69 | 44 | 372 |
| 66 | 4 | 2402 | 2803 | gi\|1303893 | YqhL [Bacillus subtilis] | 69 | 51 | 402 |
| 67 | 15 | 33627 | 13130 | gi\|149647 | ORFZ [Listeria monocytogenes] | 69 | 37 | 498 |
| 67 | 17 | 14053 | 14382 | gi\|305002 | ORF_f356 [Escherichia coli] | 69 | 49 | 330 |
| 67 | 19 | 15130 | 15807 | gi\|1109684 | ProV [Bacillus subtilis | 69 | 45 | 678 |
| 78 | 3 | 1447 | 2124 | gi\|1256633 | putative [Bacillus subtilis] | 69 | 53 | 678 |
| 78 | 4 | 3725 | 2937 | gi\|1303958 | YqjG [Bacillus subtilis] | 69 | 32 | 789 |
| 85 | 4 | 4213 | 3905 | pir\|E29326\|E293 | hypothetical protein (pur operon)-Bacillus subtilis | 69 | 32 | 309 |
| 86 | 6 | 2654 | 2055 | gi\|973332 | OrfC [Bacillus subtilis] | 69 | 50 | 600 |
| 95 | 1 | 96 | 710 | gi\|786468 | 4A11 antigen, sperm tail membrane antigen = putative sucrose-specific hosphotransferase enzyme II homolo (mice, testis, Peptide Partial, 72 aa) | 69 | 43 | 615 |
| 100 | 7 | 6023 | 7426 | gi\|1205355 | Na+/H+ antiporter [Haemophilus influenzae] | 69 | 39 | 1404 |
| 102 | 2 | 1650 | 622 | gi\|561690 | sialoglycoprotease [Pasteurella haemolytica] | 69 | 47 | 1029 |
| 103 | 8 | 8537 | 4833 | gi\|1009366 | Respiratory nitrate reductase [Bacillus subtilis] | 69 | 54 | 3705 |
| 103 | 11 | 12552 | 10317 | gi\|710020 | nitrite reductase (nirB) [Bacillus subtilis] | 69 | 5i | 2436 |
| 112 | 11 | 8708 | 10168 | gi\|154411 | hexosephosphate transport protein [Salmonella typhimurius] pir\|D41853\|D41853 hexose phosphate transport system protein uhpT-almonella typhimurius | 69 | 51 | 1461 |
| 112 | 16 | 16644 | 17414 | gi\|1204435 | pyruvate formate-lyase activating enzyme [Haemophilus influenzae] | 69 | 50 | 771 |
| 113 | 2 | 33 | 953 | gi\|290509 | o307 [Escherichia coli] | 69 | 43 | 921 |
| 114 | 2 | 1058 | 579 | pir\|A42771\|A427 | reticulocyte-binding protein 1-Plasmodium vivax | 69 | 39 | 480 |
| 121 | 6 | 4309 | 5310 | gi\|1154633 | NrdF [Bacillus subtilis] | 69 | 53 | 1002 |
| 125 | 2 | 267 | 854 | gi\|413931 | ipa-7d gene product [Bacillus subtilis] | 69 | 43 | 588 |
| 149 | 27 | 10400 | 10134 | pir\|S28089\|S280 | hypothetical protein A-yeast Zygosaccharomyces bisporus plasmid pS53 | 69 | 39 | 267 |
| 161 | 1 | 813 | 28 | gi\|1205538 | hypothetical protein (GB: U14003_302) [Haemophilus influenzae] | 69 | 47 | 786 |
| 165 | 4 | 2222 | 4633 | gi\|40054 | phenylalanyl-tRNA synthetase beta subunit AA 1–804) [Bacillus btilis] | 69 | 52 | 2412 |
| 169 | 3 | 1210 | 1761 | gi\|296031 | elongation factor Ts [Spirulina platensis] | 69 | 45 | 552 |
| 175 | 12 | 8339 | 7992 | gi\|732682 | FimE protein [Escherichia coli] | 69 | 69 | 348 |

TABLE 2-continued

| | | | | | | | | |
|---|---|---|---|---|---|---|---|---|
| 190 | 2 | 484 | 1671 | p|P17731|HIS8_ | HISTIDINOL-PHOSPHATE AMINOTRANSFERASE (EC 2.6.1.9) (IMIDAZOLE ACETOL-PHOSPHATE TRANSAMINASE). | 69 | 48 | 1188 |
| 206 | 1 | 2777 | 3 | gi|41750 | hsdR protein (AA 1–1033) [*Escherichia coli*] | 69 | 49 | 2775 |
| 206 | 4 | 5796 | 5554 | gi|1256135 | YbbF [*Bacillus subtilis*] | 69 | 48 | 243 |
| 249 | 1 | 319 | 2 | gi|1405456 | YneP [*Bacillus subtilis*] | 69 | 50 | 318 |
| 302 | 8 | 4820 | 5776 | gi|1001768 | hypothetical protein [Synechocystis sp.] | 69 | 48 | 957 |
| 324 | 2 | 3893 | 402 | gi|1256798 | pyruvate carboxylase [*Rhizobium etli*] | 69 | 53 | 3492 |
| 351 | 3 | 1808 | 1518 | gi|1491664 | T04H1.4 [*Caenorhabditis elegans*] | 69 | 30 | 291 |
| 369 | 3 | 2075 | 2305 | gi|336458 | ORF [*Balaenoptera acutorostrata*] | 69 | 61 | 231 |
| 392 | 3 | 999 | 2424 | gi|556015 | DRF1 [*Bacillus subtilis*] | 69 | 45 | 426 |
| 410 | 1 | 87 | 779 | gi|155611 | phosphoglyceromutase [*Zysomonas mobilis*] | 69 | 58 | 693 |
| 421 | 1 | 1129 | 173 | gi|1276985 | arginase [*Bacillus caldovelox*] | 69 | 54 | 957 |
| 444 | 8 | 6713 | 7741 | gi|1221782 | purine synthesis repressor [*Haemophilus influenzae*] | 69 | 40 | 1029 |
| 453 | 1 | 415 | 2 | gi|1122758 | unknown [*Bacillus subtilis*] | 69 | 57 | 414 |
| 469 | 2 | 2246 | 1206 | gi|1458228 | mutY homolog [*Homo sapiens*] | 69 | 44 | 1041 |
| 509 | 3 | 1371 | 1012 | gi|49224 | URF 4 [*Synechococcus sp.*] | 69 | 39 | 360 |
| 520 | 5 | 2823 | 2623 | gi|726427 | similar to *D. melanogaster* MST101-2 protein (PIR: S34154) [*Caenorhabditis elegans*] | 69 | 39 | 201 |
| 531 | 1 | 26 | 760 | gi|509672 | repressor protein [Bacteriophage Tuc2009] | 69 | 33 | 735 |
| 589 | 1 | 107 | 253 | gi|169101 | 17.9 kDa heat shock protein (hsp17.9) [*Pisum sativum*] | 69 | 52 | 147 |
| 594 | 2 | 597 | 1391 | gi|142783 | DNA photolyase [Bacillus firmus] | 69 | 48 | 795 |
| 604 | 4 | 2114 | 1752 | gi|413930 | ipa-6d gene product [*Bacillus subtilis*] | 69 | 45 | 363 |
| 607 | 1 | 2 | 313 | gi|1236103 | W08D2.3 [*Caenorhabditis elegans*] | 69 | 47 | 312 |
| 607 | 2 | 312 | 34 | gi|536715 | ORF YBR275c [*Saccharomyces cerevisiae*] | 69 | 39 | 279 |
| 734 | 1 | 433 | 2 | gi|467327 | unknown [*Bacillus subtilis*] | 69 | 44 | 432 |
| 759 | 1 | 3 | 338 | gi|1009367 | Respiratory nitrate reductase [*Bacillus subtilis*] | 69 | 50 | 336 |
| 761 | 2 | 392 | 586 | gi|3508 | Leucyl-tRNA synthetase (cytoplasmic) [*Saccharomyces cerevisiae*] |1370340 ORF YPL160w [*Saccharomyces cerevisiae*] | 69 | 46 | 195 |
| 802 | 1 | 72 | 1013 | gi|143044 | ferrochelatase [*Bacillus subtilis*] | 69 | 55 | 942 |
| 816 | 1 | 1368 | 163 | gi|1510268 | restriction modification system S subunit [*Methanococcus jannaschii*] | 69 | 45 | 1206 |
| 838 | 2 | 133 | 387 | gi|1255371 | coded for by *C. elegans* cDNA yk34a9.5; coded for by *C. elegans* cDNA yk34a9.3; Similar to guanylate kinase [*Caenorhabditis elegans*] | 69 | 46 | 255 |
| 851 | 2 | 745 | 1005 | gi|288998 | aecA gene product [Antithamnion sp.] | 69 | 39 | 261 |
| 867 | 1 | 269 | 3 | gi|1070014 | protein-dependent [*Bacillus subtilis*] | 69 | 47 | 267 |
| 995 | 1 | 478 | 2 | gi|1205569 | transcription elongation factor [*Haemophilus influenzae*] | 69 | 53 | 477 |
| 999 | 1 | 506 | 3 | gi|899254 | predicted trithorax protein [Drosophila virilis] | 69 | 21 | 504 |
| 1127 | 1 | 659 | 3 | gi|1205434 | *H. influenzae* predicted coding region HT1191 [*Haemophilus influenzae*] | 69 | 56 | 657 |
| 1138 | 1 | 248 | 460 | gi|1510646 | *M. jannaschii* predicted coding region M3D568 [*Methanococcus jannaschii*] | 69 | 48 | 213 |
| 2928 | 1 | 3 | 401 | gi|290503 | glutamate permease [*Escherichia coli*] | 69 | 41 | 399 |
| 3090 | 1 | 223 | 2 | gi|1204987 | DNA polymerase III, alpha chain [*Haemophilus influenzae*] | 69 | 36 | 222 |
| 3817 | 1 | 2 | 400 | gi|1483199 | peptide-synthetase [*Amycolatopsis mediterranei*] | 69 | 45 | 399 |
| 3833 | 1 | 335 | 3 | gi|1524193 | unknown [*Mycobacterium tuberculosis*] | 69 | 46 | 333 |
| 4079 | 1 | 400 | 53 | gi|546918 | orfY 3' of comK [*Bacillus subtilis*, E26, Peptide Partial, 140 aa] pir|S43612|S43612 hypothetical protein Y-Bacillus subtilis sp|P40398|YHXD_BACSU HYPOTHETICAL PROTEIN IN COMK 3'REGION (ORFY) FRAGMENT). | 69 | 64 | 348 |
| 4115 | 2 | 215 | 400 | gi|517205 | 67 kDa Myosin-crossreactive *streptococcal* antigen [*Streptococcus yogenes*] | 69 | 59 | 186 |
| 4139 | 1 | 1 | 333 | gi|1208451 | hypothetical protein [Synechocystis sp.] | 69 | 36 | 333 |
| 4258 | 1 | 230 | 3 | gi|496158 | restriction-modification enzyme subunit M1 [*Mycoplasma pulmonis*] pir|S49395|S49395 HsdM1 protein-*Mycoplasma pulmonis* (SGC3) | 69 | 43 | 228 |
| 4317 | 1 | 90 | 374 | gi|413967 | ipa-43d gene product [*Bacillus subtilis*] | 69 | 44 | 285 |
| 4465 | 1 | 3 | 293 | gi|396296 | similar to phosphotransferase systems enzyme II [*Escherichia coli*] sp|P32672|PTNC_ECOLI PTS SYSTEM, FRUCTOSE-LIKE-2 IIC COMPONENT PHOSPHOTRANSFERASE ENZYME II, C COMPONENT). | 69 | 49 | 291 |
| 3 | 1 | 1193 | 84 | gi|1109685 | ProW [*Bacillus subtilis*] | 68 | 46 | 110 |
| 15 | 4 | 2074 | 1556 | gi|807973 | unknown [*Saccharomyces cerevisiae*] | 68 | 45 | 519 |
| 31 | 8 | 6328 | 8772 | gi|290642 | ATPase [*Enterococcus hirae*] | 68 | 48 | 2445 |
| 40 | 2 | 750 | 385 | gi|606342 | ORF_o622; reading frame open far upstreams of start; possible frameshift, linking to previous ORF [*Escherichia coli*] | 68 | 55 | 366 |
| 46 | 9 | 6886 | 8415 | gi|155276 | aldehyde dehydrogenase [*Vibrio cholerae*] | 68 | 44 | 1530 |
| 48 | 3 | 3404 | 3165 | gi|285608 | 241k polyprotein [Apple stem grooving virus] | 68 | 47 | 240 |
| 48 | 4 | 3536 | 4132 | gi|1045937 | *M. genitalium* predicted coding region MG246 [*Mycoplasma genitalium*] | 68 | 39 | 597 |
| 53 | 10 | 10685 | 9699 | gi|1303952 | YqjA [*Bacillus subtilis*] | 68 | 46 | 987 |
| 70 | 9 | 7346 | 8155 | gi|147198 | phnE protein [*Escherichia coli*] | 68 | 40 | 810 |
| 89 | 4 | 1899 | 2966 | gi|145173 | 35 kDa protein [*Escherichia coli*] | 68 | 43 | 1068 |
| 108 | 1 | 1150 | 113 | gi|38722 | precursor (aa −20 to 381) [*Acinetobacter calcoaceticus*] ir|A29277|A29277 aldose 1-epimerase (EC 5.1.3.3-*Acinetobacter lcoaceticus* | 68 | 57 | 1038 |
| 112 | 5 | 2666 | 3622 | gi|153724 | MalC [*Streptococcus pneumoniae*] | 68 | 55 | 957 |
| 116 | 7 | 7865 | 8638 | gi|143608 | sporulation protein [*Bacillus subtilis*] | 68 | 48 | 774 |
| 118 | 3 | 2484 | 3698 | gi|1303805 | YqeR [*Bacillus subtilis*] | 68 | 46 | 3215 |
| 120 | 2 | 1424 | 1594 | sp|P38038|CYSJ_ | SULFITE REDUCTASE (NADPN) FLAVOPROTEIN ALPHA-COMPONENT (EC 1.8.1.2) (SIR-FP). | 68 | 45 | 171 |

TABLE 2-continued

| | | | | | | | | |
|---|---|---|---|---|---|---|---|---|
| 129 | 1 | 1 | 1011 | gi\|396307 | argininosuccinate lyase [*Escherichia coli*] | 68 | 50 | 1011 |
| 132 | 3 | 1867 | 2739 | gi\|216267 | ORF2 [*Bacillus megaterium*] | 68 | 48 | 873 |
| 134 | 2 | 848 | 1012 | gi\|147545 | DNA recombinase [*Escherichia coli*] | 68 | 50 | 165 |
| 141 | 2 | 372 | 614 | gi\|872116 | sti (stress inducible protein) (Glycine max) | 68 | 36 | 243 |
| 149 | 7 | 2260 | 2066 | gi\|145774 | hsp70 protein (dnaK gene) [*Escherichia coli*] | 68 | 48 | 195 |
| 155 | 2 | 1534 | 1292 | gi\|216583 | ORF1 [*Escherichia coli*] | 68 | 36 | 243 |
| 158 | 3 | 1826 | 3289 | sp\|P33940\|YOJH_ | HYPOTHETICAL 54.3 KD PROTEIN IN ECO-ALKB INTERGENIC REGION. | 68 | 51 | 1464 |
| 169 | 6 | 2749 | 3318 | gi\|1403402 | unknown [*Mycobacterium tuberculosis*] | 68 | 46 | 570 |
| 175 | 10 | 7365 | 5572 | gi\|1072395 | phaA gene product [*Rhizobium meliloti*] | 68 | 51 | 794 |
| 188 | 7 | 4184 | 5434 | gi\|1173843 | 3-ketoacyl-ACP synthase II [*Vibrio harveyi*] | 68 | 48 | 1251 |
| 189 | 3 | 907 | 1665 | gi\|467383 | DNA binding protein (probable) [*Bacillus subtilis*] | 68 | 55 | 759 |
| 206 | 5 | 6709 | 5735 | gi\|1256138 | YbbI [*Bacillus subtilis*] | 68 | 48 | 975 |
| 206 | 8 | 10425 | 12176 | gi\|452687 | pyruvate decarboxylase [*Saccharomyces cerevisiae*] | 68 | 48 | 1752 |
| 212 | 8 | 3421 | 3648 | gi\|1369941 | c1 gene product [Bacteriophage B1] | 68 | 39 | 228 |
| 214 | 8 | 5457 | 6482 | gi\|1420467 | ORF YOR196c [*Saccharomyces cerevisiae*] | 68 | 45 | 1026 |
| 237 | 4 | 2507 | 3088 | gi\|149381 | HisH [*Lactococcus lactis*] | 68 | 46 | 582 |
| 243 | 5 | 4542 | 3544 | gi\|3235684 | mevalonate pyrophosphate decarboxylase [*Saccharomyces cerevisiae*] | 68 | 47 | 999 |
| 262 | 1 | 3 | 164 | gi\|150974 | 4-oxalocrotonate tautomerase [*Pseudomonas putida*] | 68 | 42 | 162 |
| 262 | 2 | 1118 | 252 | gi\|1147744 | PSR [*Enterococcus hirae*] | 68 | 49 | 867 |
| 276 | 6 | 3139 | 2576 | sp\|P30750\|ABC_E | (ATP-BINDING PROTEIN ABC (FRAGMENT). | 68 | 50 | 564 |
| 306 | 6 | 5725 | 5105 | gi\|1256617 | adenine phosphoribosyltransferase [*Bacillus subtilis*] | 68 | 53 | 621 |
| 333 | 3 | 3850 | 3101 | gi\|467473 | unknown [*Bacillus subtilis*] | 68 | 45 | 750 |
| 365 | 6 | 4838 | 4659 | gi\|1130643 | T22B3.3 [*Caenorhabditis elegans*] | 68 | 45 | 180 |
| 376 | 2 | 549 | 1646 | gi\|1277026 | DAPA aminotransferase [*Bacillus subtilis*] | 68 | 51 | 1098 |
| 405 | 1 | 872 | 3 | gi\|1303917 | YqiB [*Bacillus subtilis*] | 68 | 47 | 870 |
| 406 | 2 | 539 | 225 | gi\|1511513 | ABC transporter, probable ATP-binding subunit [*Methanococcus jannaschii*] | 68 | 44 | 315 |
| 426 | 6 | 3391 | 3224 | gi\|624632 | GltL [*Escherichia coli*] | 68 | 48 | 168 |
| 438 | 1 | 108 | 329 | gi\|146923 | nitrogenase reductase [*Escherichia coli*] | 68 | 43 | 222 |
| 443 | 1 | 240 | 4 | gi\|535810 | *hippuricase* [*Campylobacter jejuni*] | 68 | 42 | 237 |
| 443 | 2 | 518 | 1015 | gi\|1204742 | H. influenzae predicted coding region HI0491 [*Haemophilus influenzae*] | 68 | 48 | 498 |
| 443 | 1 | 3779 | 3111 | gi\|809660 | deoxyribose-phosphate aldolase [*Bacillus subtilis*] pir\|S49455\|S49455 deoxyribose-phosphate aldolase (EC 4.1.2.4)-*acillus subtilis* | 68 | 55 | 669 |
| 476 | 2 | 240 | 1184 | gi\|971345 | unknown, similar to E. coli cardiolipin synthase [*Bacillus subtilis*] sp\|P45860\|YHIE_BACSU HYPOTHETICAL 58.2 PROTEIN IN NARI-ACDA NTERGENIC REGION. | 68 | 45 | 945 |
| 486 | 2 | 1046 | 216 | gi\|147328 | transport protein [*Escherichia coli*] | 68 | 41 | 831 |
| 517 | 3 | 1764 | 2084 | gi\|1523809 | orf2 [Bacteriophage A2] | 68 | 64 | 321 |
| 572 | 1 | 2 | 571 | sp\|P39237\|Y05L_ | HYPOTHETICAL 6.8 KD PROTEIN IN NRDC-TK INTERGENIC REGION. | 68 | 47 | 570 |
| 646 | 1 | 459 | 4 | gi\|413982 | ipa-58r gene product [*Bacillus subtilisv*] | 68 | 52 | 456 |
| 659 | 3 | 1668 | 1901 | gi\|1107541 | C33D9.8 [*Caenorhabditis elegans*] | 68 | 36 | 234 |
| 864 | 5 | 1510 | 1716 | gi\|145774 | hsp70 protein dnaK gene) [*Escherichia coli*] | 68 | 48 | 207 |
| 920 | 1 | 432 | 4 | gi\|1510416 | hypothetical protein (SP: P31466) [*Methanococcus jannaschii*] | 68 | 54 | 429 |
| 952 | 1 | 611 | 126 | gi\|603456 | reductase [*Leishmania major*] | 68 | 46 | 486 |
| 970 | 1 | 91 | 402 | gi\|1354775 | pfoS/R [*Treponema pallidum*] | 68 | 46 | 312 |
| 1028 | 1 | 534 | 4 | gi\|410117 | diaminopimelate decarboxlase [*Bacillus subtilis*] | 68 | 47 | 531 |
| 1029 | 1 | 216 | 4 | gi\|1335714 | plasmodium falciparum mRHA for asparagine-rich antigen (clone 17Cl) [*Plasmodium falciparum*] | 68 | 31 | 213 |
| 1058 | 1 | 348 | 4 | gi\|581649 | epiC gene product [*Staphylococcus epidermidis*] | 68 | 46 | 345 |
| 1096 | 2 | 465 | 265 | gi\|143434 | Rho Factor [*Bacillus subtilis*] | 68 | 43 | 201 |
| 1308 | 1 | 2 | 694 | gi\|1469939 | group B oligopeptidase PepB [*Streptococcus agalactiae*] | 68 | 50 | 693 |
| 1679 | 1 | 2 | 238 | gi\|517205 | 67 kDa Myosin-crossreactive *streptococcal* antigen [*Streptococcus yogenes*] | 68 | 53 | 237 |
| 2039 | 1 | 3 | 383 | gi\|153898 | transport protein [*Salmonella typhimurium*] | 68 | 51 | 381 |
| 2077 | 1 | 3 | 326 | pir\|C33496\|C334 | hisC homolog-*Bacillus subtilis* | 68 | 47 | 324 |
| 2112 | 1 | 374 | 135 | gi\|64884 | lamin LII [*Xenopus laevis*] | 68 | 50 | 240 |
| 2273 | 1 | 398 | 3 | gi\|581648 | epiB gene product [*Staphylococcus epidermidis*] | 68 | 45 | 396 |
| 2948 | 1 | 2 | 385 | gi\|216869 | branched-chain amino acid transport carrier [*Pseudomonas aeruginosa*]pir\|A38534\|A38534 branched-chain amino acid transport protein braZ *Pseudomonas aeruginosa* | 68 | 41 | 384 |
| 2955 | 1 | 400 | 32 | gi\|904179 | hypothetical protein [*Bacillus subtilis*] | 68 | 49 | 369 |
| 2981 | 1 | 288 | 4 | gi\|508979 | GTF-binding protein [*Bacillus subtilis*] | 68 | 48 | 285 |
| 3014 | 1 | 294 | 4 | gi\|1524394 | ORF-2 upstream of gbgAB operon [*Bacillus subtilis*] | 68 | 45 | 291 |
| 3082 | 3 | 169 | 2 | gi\|1204696 | fructose-permease IIBC component [*Haemophilus influenzae*] | 68 | 53 | 168 |
| 3108 | 1 | 303 | 258 | gi\|217855 | heat-shock protein [*Arabidopsis thaliana*] | 68 | 48 | 156 |
| 3639 | 1 | 461 | 3 | gi\|1510490 | nitrate transport permease protein [*Methanococcus jannaschii*] | 68 | 47 | 459 |
| 3657 | 1 | 1 | 330 | gi\|155369 | PTS enzyme-II fructose [*Xanthomonas campestris*] | 68 | 48 | 330 |
| 3823 | 1 | 391 | 2 | gi\|1603768 | HutI protein, imidazolone-5-propionate hydrolase [*Bacillus subtilis*] gi\|603768 HutI protein, imidazolone-5-propionate hydrolase *Bacillus subtilis*] | 68 | 54 | 390 |
| 3982 | 1 | 2 | 277 | gi\|149435 | putative [*Lactococcus lactis*] | 68 | 47 | 276 |
| 4051 | 1 | 1 | 342 | gi\|450688 | hsdM gene of EcoprrI gene product [*Escherichia coli*] pir\|S38437\|S38437 hsdM protein-*Escherichia coli* pir\|S09629\|S09629 hypothetical protein A-*Escherichia coli* (SUB 40–520) | 68 | 48 | 342 |
| 4089 | 1 | 12 | 209 | gi\|1353678 | heavy-metal transporting P-type ATPase [*Proteus mirabilis*] | 68 | 47 | 198 |

TABLE 2-continued

| | | | | | | | | |
|---|---|---|---|---|---|---|---|---|
| 4143 | 1 | 47 | 187 | gi\|603769 | HutU protein, urocanase [*Bacillus subtilis*] | 68 | 55 | 143 |
| 4148 | 1 | 2 | 352 | gi\|450688 | hsdM gene of EcoprrI gene product [*Escherichia coli*] pir\|S38437\|S38437 hgdM protein-*Escherichia coli* pir\|S09629\|S09629 hypothetical protein A-*Escherichia coli* (SUB 40–520) | 68 | 51 | 351 |
| 4173 | 1 | 2 | 382 | gi\|1041097 | Pyruvate Kinase [*Bacillus psychrophilus*] | 68 | 48 | 381 |
| 4182 | 1 | 250 | 2 | gi\|413968 | ipa-44d gene product [*Bacillus subtilis*] | 68 | 50 | 249 |
| 4362 | 2 | 348 | 318 | gi\|450688 | hsdM gene of EcoprrI gene product [*Escherichia coli*] pir\|S38437\|S38437 hsdM protein-*Escherichia coli* pir\|S09629\|S09629 hypothetical protein A-*Escherichia coli* (SUB 40–520) | 68 | 44 | 171 |
| 5 | 11 | 8300 | 7107 | gi\|143727 | putative [*Bacillus subtilis*] | 67 | 46 | 1194 |
| 31 | 11 | 9833 | 9348 | gi\|216746 | D-lactate dehydrogenase [*Lactobacillus plantarus*] | 67 | 41 | 486 |
| 32 | 3 | 1560 | 3155 | gi\|1098557 | renal sodium/dicarboxylate cotransporter [Homo sapiens] | 67 | 46 | 1596 |
| 32 | 5 | 4145 | 3345 | gi\|1510720 | prephenate dehydratase [*Methanococcus jannaschii*] | 67 | 51 | 801 |
| 36 | 5 | 4268 | 3186 | gi"1146216 | 45% identity with the product of the ORF6 gene from the *Erwinia herbicola* carotenoid biosynthesis cluster; putative [*Bacillus subtilis*] | 67 | 58 | 1083 |
| 44 | 7 | 4492 | 5304 | gi\|1006621 | hypothetical protein [Synechocystis sp.] | 67 | 43 | 813 |
| 56 | 7 | 3943 | 8481 | gi\|304131 | glutamate synthase large subunit precursor [*Azospirillum brasilense*] pir\|B46602\|B46602 glutamate synthase (NADPH) (EC 1.4.1.13) alpha hain - *Azospirillum brasilense* | 67 | 52 | 4539 |
| 56 | 12 | 13923 | 14678 | gi\|1000453 | TreR [*Bacillus subtilis*] | 67 | 48 | 756 |
| 62 | 8 | 4757 | 4422 | gi\|1113949 | orf3 [Bacillus, C-125, alkali-sensitive mutant 18224, Peptide Mutant, 112 aa] | 67 | 45 | 336 |
| 62 | 10 | 6338 | 5106 | gi\|854655 | Na/H antiporter system [*Bacillus alcalophilus*] | 67 | 49 | 1233 |
| 99 | 3 | 2119 | 3321 | gi\|1204349 | hypothetical protein (GB:GB:D90212_3) [*Haemophilus influenzae*] | 67 | 50 | 1203 |
| 102 | 9 | 5695 | 7176 | gi\|149432 | putative [*Lactococcus lactis*] | 67 | 51 | 1482 |
| 103 | 13 | 14049 | 13549 | gi\|1408497 | LP9D gene product [*Bacillus subtilis*] | 67 | 48 | 501 |
| 109 | 15 | 13982 | 13143 | gi\|413976 | ipa-52r gene product [*Bacillus subtilis*] | 67 | 49 | 840 |
| 109 | 17 | 14811 | 15194 | gi\|413983 | ipa-59d gene product [*Bacillus subtilis*] | 67 | 29 | 384 |
| 121 | 4 | 1713 | 2153 | gi\|1262335 | YmaA [*Bacillus subtilis*] | 67 | 54 | 441 |
| 122 | 1 | 1 | 1149 | gi\|143047 | ORFB [*Bacillus subtilis*] | 67 | 35 | 1149 |
| 124 | 5 | 3518 | 2976 | gi\|556885 | Unknown [*Bacillus subtilis*] | 67 | 47 | 543 |
| 131 | 2 | 3589 | 2594 | gi\|1046081 | hypothetical protein (GB:D26185_10) [*Mycoplasma genitalium*] | 67 | 30 | 996 |
| 140 | 3 | 2297 | 1695 | gi\|146549 | kdpC [*Escherichia coli*] | 67 | 45 | 603 |
| 142 | 4 | 4198 | 2987 | gi\|1212775 | GTP cyclohydrolase II [*Bacillus amyloliquefaciens*] | 67 | 55 | 1212 |
| 147 | 5 | 2374 | 1835 | gi\|1303709 | YrkJ [*Bacillus subtilis*] | 67 | 44 | 540 |
| 152 | 8 | 6341 | 6673 | gi\|1377841 | unknown [*Bacillus subtilis*] | 67 | 48 | 333 |
| 161 | 4 | 2720 | 3763 | gi\|496319 | SphX [Synechococcus sp.] | 67 | 47 | 1044 |
| 163 | 6 | 1989 | 3428 | gi\|595681 | 2-oxoglutarate/malate translocator [*Spinacia oleracea*] | 67 | 47 | 1440 |
| 193 | 3 | 1351 | 1626 | gi\|1511101 | shikimate 5-dehydrogenase [*Methanococcus jannaschii*] | 67 | 53 | 276 |
| 200 | 2 | 917 | 2179 | gi\|142439 | ATP-dependent nuclease [*Bacillus subtilis*] | 67 | 48 | 1263 |
| 206 | 10 | 12445 | 12801 | sp\|P37347\|YECD_ | HYPOTHETICAL 21.8 KD PROTEIN IN ASPS 5' REGION. | 67 | 47 | 357 |
| 206 | 11 | 13047 | 14432 | gi\|732813 | branched-chain amino acid carrier [*Lactobacillus delbrueckii*] | 67 | 46 | 1386 |
| 208 | 2 | 809 | 297 | gi\|1033037 | 100 kDs heat shock protein (Hsp100) [Leishmania major] | 67 | 36 | 513 |
| 238 | 3 | 1039 | 2052 | gi\|809542 | CbrB protein [*Erwinia chrysanthem*] | 67 | 42 | 1014 |
| 246 | 2 | 176 | 367 | gi\|215098 | excisionase [Bacteriophage 154a] | 67 | 37 | 192 |
| 276 | 2 | 1412 | 564 | gi\|303560 | ORF271 [*Escherichia coli*] | 67 | 50 | 849 |
| 297 | 6 | 2223 | 3056 | gi\|142784 | CtaA protein [*Bacillus firmus*] | 67 | 46 | 834 |
| 307 | 7 | 4186 | 3152 | gi\|1070013 | protein-dependent [*Bacillus subtilis*] | 67 | 43 | 1035 |
| 316 | 1 | 36 | 1028 | gi\|1161061 | dioxygenase [Methylobacterium extorquens] | 67 | 52 | 993 |
| 324 | 3 | 5030 | 4410 | gi\|1469784 | putative cell division protein ftsW [*Enterococcus hirae*] | 67 | 49 | 621 |
| 336 | 1 | 264 | 4 | gi\|173122 | urea amidolyase [*Saccharomyces cerevisiae*] | 67 | 45 | 261 |
| 360 | 1 | 108 | 1394 | sp\|P30053\|SYH_S | HISTIDYL-TRNA SYNTHETASE (EC 6.1.1.21) (HISTIDINE-- TRNA LIGASE) (HISRS). | 67 | 47 | 1287 |
| 364 | 3 | 3592 | 2294 | gi\|151259 | HMG-CoA reductase (EC 1.1.1.88) [*Pseudomonas mevalonii*] pir\|A44756\|A44756 hydroxymethylglutaryl-CoA reductase (EC 1.1.1.88) Pseudomonas sp. | 67 | 46 | 1299 |
| 365 | 3 | 2113 | 1286 | gi\|1296823 | orf2 gene product [*Lactobacillus helveticus*] | 67 | 47 | 828 |
| 367 | 2 | 325 | 918 | gi\|1039479 | ORFU [*Lactococcus lactis*] | 67 | 47 | 594 |
| 395 | 3 | 666 | 1271 | gi\|1204516 | hypothetical protein (GB:U00014_4) [*Haemophilus influenzae*] | 67 | 55 | 606 |
| 415 | 1 | 901 | 2 | gi\|882579 | CG Site No. 29739 [*Escherichia coli*] | 67 | 46 | 900 |
| 419 | 1 | 903 | 7 | gi\|520752 | putative [*Bacillus subtilis*] | 67 | 48 | 897 |
| 474 | 1 | 2 | 796 | gi\|886906 | arginiosuccinate synthetase [*Streptomyces clavuligerus*] pir\|S57659\|S57659 argininosuccinate synthase (EC 6.3.4.5) - treptomyces clavuligerus | 67 | 49 | 795 |
| 485 | 2 | 1921 | 2226 | gi\|143434 | Rho Factor [*Bacillus subtilis*] | 67 | 43 | 306 |
| 596 | 1 | 865 | 2 | gi\|1303853 | YqgF [*Bacillus subtilis*] | 67 | 47 | 864 |
| 700 | 1 | 218 | 3 | gi\|1204628 | hypothetical protein (SP:P21498) [*Haemophilus influenzae*] | 67 | 47 | 216 |
| 806 | 2 | 249 | 647 | gi\|677947 | AppC [*Bacillus subtilis*] | 67 | 51 | 399 |
| 828 | 2 | 340 | 900 | gi\|777761 | IrrA [Synechococcus sp.] | 67 | 37 | 561 |
| 833 | 1 | 916 | 425 | gi\|142996 | regulatory protein [*Bacillus subtilis*] | 67 | 41 | 492 |
| 856 | 1 | 779 | 3 | gi\|780224 | ZK970.2 [*Caenorhabditis elegans*] | 67 | 38 | 777 |
| 888 | 1 | 850 | 86 | gi\|437315 | TTG start codon [*Bacillus licheniformis*] | 67 | 40 | 765 |
| 1034 | 1 | 597 | 4 | gi\|1205113 | hypothetical protein (GB:L19201_15) [*Haemophilus influenzae*] | 67 | 45 | 594 |
| 1062 | 1 | 319 | 2 | gi\|1303850 | YqgC [*Bacillus subtilis*] | 67 | 41 | 318 |
| 1067 | 1 | 460 | 2 | pir\|A32950\|A329 | probable reductase protein - Leishmania major | 67 | 54 | 459 |
| 1358 | 1 | 3 | 293 | gi\|1001369 | hypothetical protein [Synechocystis sp.] | 67 | 44 | 291 |

TABLE 2-continued

| | | | | | | | | |
|---|---|---|---|---|---|---|---|---|
| 2181 | 1 | 3 | 302 | gi\|1510416 | hypothetical protein (SP:P31466) [*Methanococcus jannaschii*] | 67 | 48 | 300 |
| 3000 | 1 | 1 | 507 | gi\|517205 | 67 kDa Myosin-crossreactive streptococcal antigen [*Streptococcus yogenes*] | 67 | 56 | 507 |
| 3066 | 1 | 234 | 4 | gi\|308861 | GTG start codon [*Lactococcus lactis*] | 67 | 46 | 231 |
| 3087 | 1 | 251 | 48 | gi\|1205366 | oligopeptide transport ATP-binding protein [*Haemophilus influenzae*] | 67 | 44 | 204 |
| 3101 | 1 | 2 | 256 | gi\|1531541 | uroporphyrinogen III methyltransferase [*Zea mays*] | 67 | 55 | 255 |
| 3598 | 1 | 393 | 58 | gi\|151259 | HMG-CoA reductase (EC 1.1.1.88) [*Pseudomonas mevalonii*] pir\|A44756\|A44756 hydroxymethylglutaryl-CoA reductase (EC 1.1.1.88) Pseudomonas sp. | 67 | 56 | 336 |
| 3765 | 2 | 366 | 148 | gi\|557489 | menD [*Bacillus subtilis*] | 67 | 45 | 219 |
| 3788 | 1 | 398 | 138 | pir\|S52915\|S529 | nitrate reductase alpha chain - Bacillus subtilis (fragment) | 67 | 45 | 261 |
| 3883 | 1 | 2 | 265 | gi\|704397 | cystathionine beta-lyase [*Arabidopsis thaliana*] | 67 | 46 | 264 |
| 3926 | 1 | 2 | 340 | gi\|1483199 | peptide-synthetase [*Amycolatopsis mediterranei*] | 67 | 44 | 339 |
| 4417 | 1 | 82 | 396 | gi\|1205337 | ribonucleotide transport ATP-binding protein [*Haemophilus influenzae*] | 67 | 46 | 315 |
| 2 | 3 | 3075 | 3989 | gi\|535348 | CodV [*Bacillus subtilis*] | 66 | 42 | 915 |
| 15 | 6 | 2273 | 2542 | gi\|46491 | SmtB [*Synechococcus PCC7942*] | 66 | 37 | 270 |
| 31 | 9 | 7826 | 7593 | gi\|292046 | mucin [*Homo sapiens*] | 66 | 44 | 234 |
| 31 | 10 | 9034 | 9258 | gi\|1204545 | mercury scavenger protein [*Haemophilus influenzae*] | 66 | 48 | 225 |
| 32 | 6 | 5253 | 4159 | gi\|998342 | inducible nitric oxide synthase [*Gellus gallus*] | 66 | 47 | 1095 |
| 44 | 13 | 8856 | 10124 | gi\|1510751 | molybdenum cofactor biosynthesis moeA protein [*Methanococcus jannaschii*] | 66 | 46 | 1269 |
| 48 | 2 | 1276 | 2868 | gi\|150209 | ORF 1 [*Mycoplasma mycoides*] | 66 | 40 | 1593 |
| 58 | 8 | 7178 | 8428 | gi\|665999 | hypothetical protein [*Bacillus subtilis*] | 66 | 47 | 1251 |
| 62 | 7 | 4370 | 3597 | gi\|1072398 | phaD gene product [*Rhizobium meliloti*] | 66 | 40 | 774 |
| 70 | 14 | 10998 | 10303 | gi\|809660 | deoxyribose-phosphate aldolase [*Bacillus subtilis*] pir\|S49455\|S49455 deoxyribose-phosphate aldolase (EC 4.1.2.4) - acillus subtilis | 66 | 55 | 696 |
| 76 | 1 | 1 | 1305 | gi\|142440 | ATP-dependent nuclease [*Bacillus subtilis*] | 66 | 42 | 1305 |
| 91 | 6 | 8205 | 7174 | gi\|704397 | cystathionine beta-lyase [*Arabidopsis thaliana*] | 66 | 43 | 1032 |
| 102 | 5 | 3265 | 2720 | gi\|1204323 | hypothetical protein (SP:P31805) [*Haemophilus influenzae*] | 66 | 41 | 546 |
| 103 | 4 | 2732 | 2046 | gi\|971344 | nitrate reductase gamma subunit [*Bacillus subtilis*] sp\|P42177\|NARI_BACSU NITRATE REDUCTASE GAMMA CHAIN (EC 1.7.99.4). gi\|1009369 Respiratory nitrate reductase [*Bacillus subtilis*] (SUB −160) | 66 | 48 | 687 |
| 109 | 6 | 4243 | 4674 | gi\|170886 | glucosamine-6-phosphate deaminase [*Candida albicans*] pir\|A46652\|A46652 glucosamine-6-phosphate isomerase (EC 5.3.1.10) - east (*Candida albicans*) | 66 | 45 | 432 |
| 112 | 17 | 17491 | 17712 | gi\|1323179 | ORF YGR111w [*Saccharomyces cerevisiae*] | 66 | 33 | 222 |
| 116 | 2 | 2637 | 607 | gi\|1491813 | gamma-glutamyltranspeptidase [*Bacillus subtilis*] | 66 | 43 | 2031 |
| 150 | 5 | 2989 | 2789 | gi\|1146224 | putative [*Bacillus subtilis*] | 66 | 30 | 201 |
| 172 | 5 | 3264 | 3662 | gi\|755152 | highly hydrophobic integral membrane protein [*Bacillus subtilis*] sp\|P42953\|TAGG_BACSU TEICHOIC ACID TRANSLOCATION PERMEASE PROTEIN AGG. | 66 | 41 | 399 |
| 174 | 5 | 3723 | 2854 | gi\|1146241 | pantothenate synthetase [*Bacillus subtilis*] | 66 | 49 | 870 |
| 175 | 4 | 2880 | 2551 | gi\|642655 | unknown [*Rhizobium meliloti*] | 66 | 29 | 330 |
| 175 | 11 | 7994 | 7245 | gi\|854655 | Na/H antiporter system [*Bacillus alcalophilus*] | 66 | 43 | 750 |
| 190 | 5 | 5727 | 4375 | gi\|451072 | di-tripeptide transporter [*Lactococcus lactis*] | 66 | 40 | 1353 |
| 195 | 15 | 13713 | 13507 | gi\|1322411 | unknown [*Mycobacterium tuberculosis*] | 66 | 42 | 207 |
| 217 | 3 | 2595 | 2368 | gi\|1143542 | alternative stop codon [*Rattus norvegicus*] | 66 | 36 | 228 |
| 233 | 9 | 6135 | 5137 | gi\|1458327 | F08F3.4 gene product [*Caenorhabditis elegans*] | 66 | 47 | 999 |
| 238 | 1 | 43 | 1041 | gi\|809541 | CbrA protein [*Erwinia chrysanthemi*] | 66 | 42 | 999 |
| 241 | 1 | 1053 | 4 | gi\|153067 | peptidoglycan hydrolase [*Staphylococcus aureus*] | 66 | 53 | 1050 |
| 261 | 1 | 648 | 118 | gi\|1510859 | M. jannaschii predicted coding region MJ0790 [*Methanococcus jannaschii*] | 66 | 40 | 531 |
| 263 | 3 | 2973 | 2215 | gi\|1205865 | tetrahydrodipicolinate N-succinyltransferase [*Haemophilus influenzae*] | 66 | 47 | 759 |
| 272 | 8 | 5484 | 4420 | gi\|882101 | high affinity nickel transporter [*Alcaligenes eutrophus*] sp\|P23516\|HOXN_ALCEU HIGH-AFFINITY NICKEL TRANSPORT PROTEIN. | 66 | 44 | 1065 |
| 276 | 3 | 2104 | 1403 | gi\|1208965 | hypothetical 23.3 kd protein [*Escherichia coli*] | 66 | 47 | 702 |
| 278 | 2 | 1784 | 738 | gi\|1488662 | phosphatase-associated protein [*Bacillus subtilis*] | 66 | 48 | 1047 |
| 278 | 3 | 2952 | 2074 | gi\|303560 | ORF271 [*Escherichia coli*] | 66 | 45 | 879 |
| 279 | 2 | 2218 | 542 | gi\|1185289 | 2-succinyl-6-hydroxy-2,4-cyclohexadiene-1-carboxylate synthase [*Bacillus subtilis*] | 66 | 48 | 1677 |
| 288 | 4 | 2275 | 2015 | gi\|1256625 | putative [*Bacillus subtilis*] | 66 | 42 | 261 |
| 292 | 2 | 942 | 751 | gi\|1511604 | M. jannaschii predicted coding region MJ1651 [*Methanococcus jannaschii*] | 66 | 30 | 192 |
| 294 | 1 | 559 | 2 | gi\|216314 | esterase [*Bacillus stearothermophilus*] | 66 | 45 | 558 |
| 297 | 4 | 1978 | 1043 | gi\|994794 | cytochrome a assembly facto [*Bacillus subtilis*] sp\|P24009\|COXX_BACSU PROBABLE CYTOCHROME C OXIDASE ASSEMBLY FACTOR. | 66 | 45 | 936 |
| 316 | 4 | 2053 | 2682 | gi\|1107839 | alginate lyase [*Pseudomonas aeruginosa*] | 66 | 40 | 630 |
| 338 | 4 | 2302 | 2144 | gi\|520750 | biotin synthetase [*Bacillus sphaericus*] | 66 | 58 | 159 |
| 339 | 1 | 735 | 256 | gi\|467468 | 7,8-dihydro-6-hydroxymethylpterin-pyrophosphokinase [*Bacillus ubtilis*] | 66 | 52 | 480 |
| 363 | 1 | 3 | 863 | gi\|581649 | epiC gene product [*Staphylococcus epidermidis*] | 66 | 47 | 861 |
| 366 | 2 | 232 | 483 | gi\|1103505 | unknown [*Schizosaccharomyces pombe*] | 66 | 53 | 252 |

TABLE 2-continued

| | | | | | | | | |
|---|---|---|---|---|---|---|---|---|
| 367 | 4 | 1845 | 1222 | sp\|P20692\|TYRA_ | PREPHENATE DEHYDROGENASE (EC 1.3.1.12) (PDH). | 66 | 50 | 624 |
| 372 | 3 | 1599 | 1048 | gi\|467416 | unknown [*Bacillus subtilis*] | 66 | 38 | 552 |
| 378 | 1 | 212 | 1009 | gi\|147309 | purine nucleoside phosphorylase [*Escherichia coli*] | 66 | 50 | 798 |
| 401 | 1 | 1 | 462 | gi\|388263 | p-aminobenzoic acid synthase [*Streptomyces griseus*] pir\|JN0531\|JN0531 p-aminobenzoic acid synthase - *Streptomyces riseus* | 66 | 46 | 462 |
| 404 | 7 | 4826 | 5254 | gi\|606744 | cytidine deaminase [*Bacillus subtilis*] | 66 | 51 | 429 |
| 411 | 2 | 1103 | 468 | gi\|1460081 | unknown [*Mycobacterium tuberculosis*] | 66 | 44 | 636 |
| 420 | 1 | 2 | 541 | gi\|1046024 | Na+ ATPase subunit J [*Mycoplasma genitalium*] | 66 | 49 | 540 |
| 431 | 1 | 1 | 858 | gi\|1500008 | *M. jannaschii* predicted coding region MJ1154 [*Methanococcus jannaschii*] | 66 | 50 | 858 |
| 443 | 7 | 5299 | 4919 | gi\|852076 | MrgA [*Bacillus subtilis*] | 66 | 46 | 381 |
| 444 | 3 | 2413 | 1421 | gi\|153047 | lysostaphin (ttg start codon) [*Staphylococcus simulans*] pir\|A25881\|A25881 lysostaphin precursor - *Staphylococcus simulans* sp\|P10547\|LSTP_STASI LYSOSTAPHIN PRECURSOR (EC 3.5.1.—). | 66 | 51 | 993 |
| 561 | 1 | 480 | 4 | gi\|1204905 | DNA-3-methyladenine glycosidase I [*Haemophilus influenzae*] | 66 | 45 | 477 |
| 562 | 3 | 1066 | 1383 | gi\|1046082 | *M. genitalium* predicted coding region MG372 [*Mycoplasma genitalium*] | 66 | 52 | 318 |
| 576 | 1 | 11 | 724 | gi\|305014 | ORF_o234 [*Escherichia coli*] | 66 | 43 | 714 |
| 577 | 3 | 903 | 616 | gi\|1001353 | hypothetical protein [*Synechocystis* sp.] | 66 | 52 | 288 |
| 584 | 1 | 2 | 331 | sp\|P24204\|YEBA_ | HYPOTHETICAL 46.7 KD PROTEIN IN MSBB-RUVB INTERGENIC REGION (ORFU). | 66 | 48 | 330 |
| 592 | 1 | 706 | 2 | gi\|928839 | ORF266; putative [*Lactococcus lactis* phage BK5-T] | 66 | 51 | 705 |
| 601 | 1 | 720 | 7 | gi\|1488695 | novel antigen; orf-2 [*Staphylococcus aureus*] | 66 | 55 | 714 |
| 619 | 3 | 468 | 845 | gi\|746573 | similar to *M. musculus* transport system membrane protein, Nramp (PIR:A40739) and *S. cerevisiae* SMF1 protein (PIR:A45154) [*Caenorhabditis elegans*] | 66 | 45 | 378 |
| 706 | 2 | 355 | 149 | gi\|804808 | unknown protein [*Rattus norvegicus*] | 66 | 46 | 207 |
| 734 | 2 | 512 | 351 | gi\|1519085 | phosphatidylcholine binding immunoglobulin heavy chain IgM variable region [*Mus musculus*] | 66 | 60 | 162 |
| 740 | 1 | 3 | 317 | gi\|1209272 | argininosuccinate lyase [*Campylobacter jejuni*] | 66 | 42 | 315 |
| 764 | 1 | 310 | 747 | gi\|435296 | alkaline phosphatase like protein [*Lactococcus lactis*] pir\|S39339\|S39339 alkaline phosphatase-like protein - *Lactococcus actis* | 66 | 42 | 438 |
| 852 | 1 | 171 | 4 | gi\|536955 | CG Site No. 361 [*Escherichia coli*] | 66 | 43 | 168 |
| 886 | 1 | 3 | 158 | gi\|289272 | ferrichrome-binding protein [*Bacillus subtilis*] | 66 | 44 | 156 |
| 889 | 1 | 232 | 2 | gi\|833061 | HCMVUL77 (AA 1-642) [Human cytomegalovirus] | 66 | 66 | 231 |
| 893 | 1 | 2 | 247 | gi\|149008 | putative [*Helicobacter pylori*] | 66 | 45 | 246 |
| 900 | 1 | 733 | 41 | gi\|580842 | F3 [*Bacillus subtilis*] | 66 | 51 | 693 |
| 906 | 2 | 1473 | 646 | gi\|790945 | aryl-alcohol dehydrogenase [*Bacillus subtilis*] | 66 | 53 | 828 |
| 947 | 1 | 79 | 549 | gi\|410117 | diaminopimelate decarboxylase [*Bacillus subtilis*] | 66 | 47 | 471 |
| 950 | 1 | 552 | 4 | gi\|48713 | orf145 [*Staphylococcus aureus*] | 66 | 35 | 549 |
| 955 | 2 | 89 | 475 | gi\|1204390 | uridine kinase (uridine monophosphokinase) [*Haemophilus influenzae*] | 66 | 50 | 387 |
| 981 | 2 | 997 | 686 | gi\|457146 | rhoptry protein [*Plasmodium yoelii*] | 66 | 38 | 312 |
| 986 | 1 | 25 | 315 | gi\|305002 | ORF_f356 [*Escherichia coli*] | 66 | 31 | 291 |
| 1057 | 1 | 3 | 203 | gi\|1303853 | YqgF [*Bacillus subtilis*] | 66 | 40 | 201 |
| 1087 | 1 | 1 | 294 | gi\|575913 | unknown [*Saccharomyces cerevisiae*] | 66 | 53 | 294 |
| 1105 | 1 | 1 | 231 | gi\|1045799 | methylgalactoside permease ATP-binding protein [*Mycoplasma genitalium*] | 66 | 46 | 231 |
| 1128 | 1 | 2 | 574 | gi\|1001493 | hypothetical protein [*Synechocystis* sp.] | 66 | 46 | 573 |
| 1150 | 1 | 250 | 2 | gi\|1499034 | *M. jannaschii* predicted coding region MJ0255 [*Methanococcus jannaschii*] | 66 | 40 | 249 |
| 1180 | 2 | 453 | 199 | gi\|215908 | DNA polymerase (g43) [Bacteriophage T4] | 66 | 46 | 255 |
| 1208 | 1 | 587 | 51 | gi\|1256653 | DNA-binding protein [*Bacillus subtilis*] | 66 | 58 | 537 |
| 1342 | 1 | 1 | 402 | gi\|1208474 | hypothetical protein [*Synechocystis* sp.] | 66 | 53 | 402 |
| 1761 | 2 | 398 | 207 | gi\|215811 | tail fiber protein [Bacteriophage T3] | 66 | 50 | 192 |
| 1983 | 1 | 251 | 3 | gi\|1045935 | DNA helicase II [*Mycoplasma genitalium*] | 66 | 40 | 249 |
| 2103 | 2 | 176 | 400 | gi\|929798 | precursor for the major merozoite surface antigens [*Plasmodium alciparum*] | 66 | 46 | 225 |
| 2341 | 1 | 188 | 3 | gi\|1256623 | exodeoxyribonuclease [*Bacillus subtilis*] | 66 | 38 | 186 |
| 2458 | 1 | 164 | 3 | gi\|1019410 | unknown [*Schizosaccharomyces pombe*] | 66 | 47 | 162 |
| 2505 | 1 | 235 | 2 | gi\|1510394 | putative transcriptional regulator [*Methanococcus jannaschii*] | 66 | 39 | 234 |
| 2525 | 1 | 280 | 2 | gi\|1000695 | cytotoxin L [*Clostridium sordellii*] | 66 | 44 | 279 |
| 2935 | 1 | 3 | 275 | gi\|765073 | autolysin [*Staphylococcus aureus*] | 66 | 47 | 273 |
| 3005 | 1 | 114 | 305 | gi\|1205784 | heterocyst maturation protein [*Haemophilus influenzae*] | 66 | 46 | 192 |
| 3048 | 1 | 80 | 277 | gi\|1303813 | YqeW [*Bacillus subtilis*] | 66 | 42 | 198 |
| 3071 | 1 | 1 | 189 | gi\|1070014 | protein-dependent [*Bacillus subtilis*] | 66 | 41 | 189 |
| 3081 | 1 | 225 | 46 | gi\|984212 | unknown [*Schizosaccharomyces pombe*] | 66 | 44 | 180 |
| 3090 | 2 | 386 | 192 | gi\|1204987 | DNA polymerase III, alpha chain [*Haemophilus influenzae*] | 66 | 48 | 195 |
| 3318 | 1 | 1 | 387 | gi\|1009366 | Respiratory nitrate reductase [*Bacillus subtilis*] | 66 | 49 | 387 |
| 3739 | 1 | 400 | 2 | gi\|1109684 | ProV [*Bacillus subtilis*] | 66 | 47 | 399 |
| 3796 | 1 | 202 | 2 | gi\|853760 | acyl-CoA dehydrogenase [*Bacillus subtilis*] | 66 | 60 | 201 |
| 3924 | 1 | 347 | 99 | gi\|563952 | gluconate permease [*Bacillus licheniformis*] | 66 | 46 | 249 |
| 4240 | 1 | 3 | 350 | gi\|151259 | HMG-CoA reductase (EC 1.1.1.88) [*Pseudomonas mevalonii*] pir\|A44756\|A44756 hydroxymethylglutaryl-CoA reductase (EC 1.1.1.88) *Pseudomonas* sp. | 66 | 51 | 348 |
| 4604 | 1 | 7 | 234 | pir\|A26713\|BHHC | hemocyanin subunit II - Atlantic horseshoe crab | 66 | 46 | 228 |

TABLE 2-continued

| | | | | | | | | |
|---|---|---|---|---|---|---|---|---|
| 4 | 9 | 8845 | 9750 | gi\|145646 | cynR [*Escherichia coli*] | 65 | 35 | 906 |
| 6 | 5 | 2708 | 3565 | gi\|887824 | ORF_o310 [*Escherichia coli*] | 65 | 47 | 858 |
| 13 | 1 | 998 | 3 | gi\|143402 | recombination protein (ttg start codon) [*Bacillus subtilis*] gi\|1303923 RecN [*Bacillus subtilis*] | 65 | 44 | 996 |
| 15 | 7 | 2493 | 3524 | gi\|1403126 | czcD gene product [*Alcaligenes eutrophus*] | 65 | 38 | 1032 |
| 18 | 3 | 1372 | 836 | gi\|349187 | acyltransferase [*Saccharomyces cerevisiae*] | 65 | 50 | 537 |
| 21 | 3 | 1467 | 2492 | gi\|149518 | phosphoribosyl anthranilate transferase [*Lactococcus lactis*] pir\|S35126\|S35126 anthranilate phosphoribosyltransferase (EC .4.2.18) - *Lactococcus lactis* subsp. *lactis* | 65 | 52 | 1026 |
| 25 | 4 | 3374 | 4312 | gi\|1502420 | malonyl-CoA:Acyl carrier protein transacylase [*Bacillus subtilis*] | 65 | 44 | 939 |
| 27 | 2 | 390 | 626 | gi\|1212729 | YqhJ [*Bacillus subtilis*] | 65 | 45 | 237 |
| 31 | 12 | 10387 | 9734 | gi\|509245 | D-hydroxyisocaproate dehydrogenase [*Lactobacillus delbrueckii*] | 65 | 41 | 654 |
| 38 | 24 | 19172 | 19528 | gi\|547519 | H-protein [*Flaveria cronquistii*] | 65 | 41 | 357 |
| 44 | 2 | 790 | 1746 | gi\|405882 | yeiK [*Escherichia coli*] | 65 | 46 | 957 |
| 44 | 12 | 8832 | 8308 | gi\|1205905 | molybdenum cofactor biosynthesis protein [*Haemophilus influenzae*] | 65 | 50 | 525 |
| 45 | 8 | 6635 | 7588 | gi\|493074 | ApbA protein [*Salmonella typhimurium*] | 65 | 46 | 954 |
| 51 | 2 | 580 | 1503 | gi\|580897 | OppB gene product [*Bacillus subtilis*] | 65 | 45 | 924 |
| 52 | 1 | 225 | 953 | gi\|1205518 | NAD(P)H-flavin oxidoreductase [*Haemophilus influenzae*] | 65 | 45 | 729 |
| 55 | 4 | 1058 | 777 | pir\|A44459\|A444 | troponin T beta TnT-5 - rabbit | 65 | 41 | 282 |
| 67 | 9 | 7421 | 8272 | gi\|143607 | sporulation protein [*Bacillus subtilis*] | 65 | 42 | 852 |
| 73 | 5 | 4446 | 5375 | gi\|1204896 | lysophospholipase L2 [*Haemophilus influenzae*] | 65 | 37 | 930 |
| 74 | 1 | 478 | 2 | gi\|1204844 | H. influenzae predicted coding region HI0594 [*Haemophilus influenzae*] | 65 | 50 | 477 |
| 77 | 1 | 2 | 757 | gi\|1046082 | M. genitalium predicted coding region MG372 [*Mycoplasma genitalium*] | 65 | 46 | 756 |
| 77 | 2 | 795 | 1433 | gi\|1222116 | permease [*Haemophilus influenzae*] | 65 | 37 | 639 |
| 81 | 3 | 3454 | 2180 | gi\|1001708 | hypothetical protein [*Synechocystis sp.*] | 65 | 49 | 1275 |
| 91 | 7 | 8357 | 8166 | gi\|1399263 | cystathionine beta-lyase [*Emericella nidulans*] | 65 | 40 | 192 |
| 98 | 3 | 1608 | 1988 | gi\|467423 | unknown [*Bacillus subtilis*] | 65 | 38 | 381 |
| 98 | 4 | 2250 | 2987 | gi\|467424 | unknown [*Bacillus subtilis*] | 65 | 45 | 738 |
| 102 | 3 | 2119 | 1640 | gi\|1511532 | N-terminal acetyltransferase complex, subunit ARD1 [*Methanococcus jannaschii*] | 65 | 39 | 480 |
| 102 | 4 | 2862 | 2077 | gi\|1204637 | H. influenzae predicted coding region HI0388 [*Haemophilus influenzae*] | 65 | 32 | 786 |
| 103 | 9 | 9841 | 8831 | gi\|142695 | S-adenosyl-L-methionine:uroporphyrinogen III methyltransferase [*Bacillus megaterium*] | 65 | 47 | 1011 |
| 103 | 10 | 10119 | 9799 | gi\|710021 | nitrite reductase (nirD) [*Bacillus subtilis*] | 65 | 51 | 321 |
| 106 | 2 | 262 | 1140 | gi\|39881 | ORF 311 (AA 1-311) [*Bacillus subtilis*] | 65 | 44 | 879 |
| 109 | 5 | 3909 | 4268 | gi\|1204399 | glucosamine-6-phosphate deaminase protein [*Haemophilus influenzae*] | 65 | 44 | 360 |
| 109 | 10 | 7165 | 8595 | gi\|536955 | CG Site No. 361 [*Escherichia coli*] | 65 | 41 | 1431 |
| 110 | 4 | 3688 | 3915 | gi\|407881 | stringent response-like protein [*Streptococcus equisimilis*] pir\|S39975\|S39975 stringent response-like protein - *Streptococcus quisimilis* | 65 | 45 | 228 |
| 110 | 5 | 3882 | 4295 | gi\|407880 | ORF1 [*Streptococcus equisimilis*] | 65 | 50 | 414 |
| 110 | 6 | 4231 | 4380 | gi\|1139574 | Orf2 [*Streptomyces griseus*] | 65 | 56 | 150 |
| 112 | 10 | 8840 | 8062 | gi\|1204571 | H. influenzae predicted coding region HI0318 [*Haemophilus influenzae*] | 65 | 52 | 579 |
| 112 | 12 | 11288 | 10527 | gi\|710496 | transcriptional activator protein [*Bacillus brevis*] | 65 | 32 | 762 |
| 125 | 1 | 2 | 202 | gi\|1151158 | repeat organellar protein [*Plasmodium chabaudi*] | 65 | 39 | 201 |
| 126 | 1 | 3 | 422 | gi\|37589 | precursor [*Homo sapiens*] | 65 | 46 | 420 |
| 127 | 11 | 10733 | 12658 | gi\|1064809 | homologous to sp:HTRA_ECOLI [*Bacillus subtilis*] | 65 | 41 | 1926 |
| 143 | 8 | 7004 | 6465 | gi\|216513 | mutator mutT (AT-GC transversion) [*Escherichia coli*] | 65 | 56 | 540 |
| 145 | 5 | 3587 | 3838 | gi\|1209768 | D02_orf569 [*Mycoplasma pneumoniae*] | 65 | 27 | 252 |
| 150 | 4 | 2841 | 2200 | gi\|1146225 | putative [*Bacillus subtilis*] | 65 | 37 | 642 |
| 166 | 1 | 1948 | 38 | gi\|148304 | beta-1,4-N-acetylmuramoylhydrolase [*Enterococcus hirae*] pir\|A42296\|A42296 lysozyme 2 (EC 3.2.1.—) precursor - *Enterococcus irae* (ATCC 9790) | 65 | 50 | 1911 |
| 188 | 6 | 3195 | 4178 | gi\|151943 | ORF3; putative [*Rhodobacter capsulatus*] | 65 | 46 | 984 |
| 189 | 9 | 4785 | 4588 | gi\|58812 | ORF IV (AA 1-489) [*Figwort mosaic virus*] | 65 | 40 | 198 |
| 195 | 6 | 5272 | 2636 | gi\|145220 | alanyl-tRNA synthetase [*Escherichia coli*] | 65 | 49 | 2637 |
| 195 | 7 | 8104 | 5609 | gi\|882711 | exonuclease V alpha-subunit [*Escherichia coli*] | 65 | 38 | 2496 |
| 206 | 16 | 16896 | 18191 | gi\|408115 | ornithine acetyltransferase [*Bacillus subtilis*] | 65 | 53 | 1296 |
| 217 | 4 | 3215 | 2586 | gi\|1205974 | 5' guanylate kinase [*Haemophilus influenzae*] | 65 | 41 | 630 |
| 220 | 4 | 3751 | 2237 | gi\|580920 | rodD (gtaA) polypeptide (AA 1-673) [*Bacillus subtilis*] pir\|S06048\|S06048 probable rodD protein - *Bacillus subtilis* sp\|P13484\|TAGE_BACSU PROBABLE POLY(GLYCEROL-PHOSPHATE) LPHA-GLUCOSYLTRANSFERASE (EC 2.4.1.52) (TECHOIC ACID BIOSYNTHESIS ROTEIN E). | 65 | 40 | 1515 |
| 236 | 5 | 2327 | 3709 | gi\|1146200 | DNA or RNA helicase, DNA-dependent ATPase [*Bacillus subtilis*] | 65 | 46 | 1383 |
| 237 | 3 | 1902 | 2513 | gi\|149379 | HisBd [*Lactococcus lactis*] | 65 | 46 | 612 |
| 241 | 4 | 4195 | 3422 | gi\|1205308 | ribonuclease HII (EC 31264) (RNASE HII) [*Haemophilus influenzae*] | 65 | 50 | 774 |
| 252 | 1 | 940 | 602 | gi\|1204989 | hypothetical protein (BG:U00022_9) [*Haemophilus influenzae*] | 65 | 40 | 339 |
| 261 | 5 | 3794 | 2808 | gi\|145927 | fecD [*Escherichia coli*] | 65 | 43 | 987 |
| 274 | 1 | 3 | 278 | gi\|496558 | orfX [*Bacillus subtilis*] | 65 | 42 | 276 |
| 301 | 2 | 815 | 648 | gi\|467418 | unknown [*Bacillus subtilis*] | 65 | 45 | 168 |

TABLE 2-continued

| | | | | | | | | |
|---|---|---|---|---|---|---|---|---|
| 307 | 4 | 2864 | 2142 | gi\|1070014 | protein-dependent [*Bacillus subtilis*] | 65 | 40 | 723 |
| 335 | 2 | 1399 | 512 | gi\|146913 | N-acetylglucosamine transport protein [*Escherichia coli*] pir\|B29895\|WQEC2N phosphotransferase system enzyme II (EC .7.1.69), N-acetylglucosamine-specific - *Escherichia coli* sp\|P09323\|PTAA_ECOLI PTS SYSTEM, N-ACETYLGLUCOSAMINE-SPECIFIC IIABC OMPONENT (EIIA) | 65 | 50 | 888 |
| 338 | 5 | 3170 | 2220 | gi\|1277029 | biotin synthase [*Bacillus subtilis*] | 65 | 49 | 951 |
| 343 | 3 | 1490 | 2800 | gi\|143264 | membrane-associated protein [*Bacillus subtilis*] | 65 | 48 | 1311 |
| 344 | 4 | 2531 | 2301 | gi\|1050540 | tRNA-glutamine synthetase [*Lupinus luteus*] | 65 | 34 | 231 |
| 358 | 3 | 3421 | 3621 | gi\|1146220 | NAD+ dependent glycerol-3-phosphate dehydrogenase [*Bacillus subtilis*] | 65 | 47 | 201 |
| 364 | 1 | 238 | 699 | gi\|1340128 | ORF1 [*Staphylococcus aureus*] | 65 | 51 | 462 |
| 379 | 1 | 1 | 576 | gi\|143331 | alkaline phosphatase regulatory protein [*Bacillus subtilis*] pir\|A27650\|A27650 regulatory protein phoR - *Bacillus subtilis* sp\|P23545\|PHOR_BACSU ALKALINE PHOSPHATASE SYNTHESIS SENSOR PROTEIN HOR (EC 2.7.3.—). | 65 | 40 | 576 |
| 379 | 3 | 3666 | 4346 | gi\|143268 | dihydrolipoamide transsuccinylase (odhB; EC 2.3.1.61) [*Bacillus ubtilis*] | 65 | 50 | 681 |
| 428 | 1 | 187 | 483 | gi\|1420465 | ORF YOR195w [*Saccharomyces cerevisiae*] | 65 | 45 | 297 |
| 438 | 2 | 272 | 838 | gi\|143498 | degS protein [*Bacillus subtilis*] | 65 | 38 | 567 |
| 444 | 11 | 9280 | 10215 | gi\|1204756 | ribokinase [*Haemophilus influenzae*] | 65 | 47 | 936 |
| 449 | 2 | 1241 | 1531 | gi\|599848 | Na/H antiporter homolog [*Lactococcus lactis*] | 65 | 41 | 291 |
| 478 | 2 | 865 | 278 | gi\|1045942 | glycyl-tRNA synthetase [*Mycoplasma genitalium*] | 65 | 39 | 588 |
| 479 | 1 | 517 | 2 | gi\|1498192 | putative [*Pseudomonas aeruginosa*] | 65 | 40 | 516 |
| 480 | 6 | 4312 | 5637 | gi\|415662 | UDP-N-acetylglucosamine 1-carboxyvinyl transferase [*Acinetobacter alcoaceticus*] | 65 | 48 | 1326 |
| 484 | 1 | 2 | 430 | gi\|146551 | transmembrane protein (kdpD) [*Escherichia coli*] | 65 | 44 | 429 |
| 499 | 1 | 54 | 932 | gi\|603456 | reductase [*Leishmania major*] | 65 | 53 | 879 |
| 505 | 1 | 459 | 4 | gi\|1518853 | OafA [*Salmonella typhimurium*] | 65 | 39 | 456 |
| 571 | 2 | 883 | 257 | gi\|49399 | open reading frame upstream glnE [*Escherichia coli*] ir\|S37754\|S37754 hypothetical protein XE (glnE 5' region) - *cherichia coli* | 65 | 44 | 627 |
| 611 | 2 | 270 | 34 | gi\|10961 | RAP-2 [*Plasmodium falciparum*] | 65 | 40 | 237 |
| 705 | 1 | 283 | 2 | gi\|710020 | nitrite reductase (nirB) [*Bacillus subtilis*] | 65 | 52 | 282 |
| 712 | 1 | 1 | 177 | gi\|289272 | ferrichrome-binding protein [*Bacillus subtilis*] | 65 | 37 | 177 |
| 712 | 2 | 196 | 354 | gi\|289272 | ferrichrome-binding protein [*Bacillus subtilis*] | 65 | 37 | 159 |
| 743 | 1 | 2 | 631 | gi\|310631 | ATP binding protein [*Streptococcus gordonii*] | 65 | 45 | 630 |
| 749 | 2 | 393 | 779 | gi\|467374 | single strand DNA binding protein [*Bacillus subtilis*] | 65 | 29 | 387 |
| 762 | 1 | 850 | 2 | gi\|160399 | multidrug resistance protein [*Plasmodium falciparum*] | 65 | 48 | 849 |
| 788 | 1 | 85 | 315 | gi\|1129096 | unknown protein [Bacillus sp.] | 65 | 35 | 231 |
| 850 | 1 | 1 | 408 | gi\|1006604 | hypothetical protein [Synechocystis sp.] | 65 | 37 | 408 |
| 908 | 1 | 1 | 444 | gi\|1199546 | 2362 [*Saccharomyces cerevisiae*] | 65 | 46 | 444 |
| 925 | 1 | 1 | 174 | gi\|1256653 | DNA-binding protein [*Bacillus subtilis*] | 65 | 54 | 174 |
| 1031 | 1 | 26 | 232 | gi\|238657 | AppC=cytochrome d oxidase, subunit I homolog [*Escherichia coli*, K12, eptide, 514 aa] | 65 | 47 | 207 |
| 1037 | 1 | 262 | 110 | gi\|1491813 | gamma-glutamyltranspeptidase [*Bacillus subtilis*] | 65 | 46 | 153 |
| 1053 | 1 | 175 | 2 | gi\|642655 | unknown [*Rhizobium meliloti*] | 65 | 34 | 174 |
| 1149 | 1 | 752 | 105 | gi\|1162980 | ribulose-5-phosphate 3-epimerase [*Spinacia oleracea*] | 65 | 48 | 648 |
| 1214 | 1 | 495 | 109 | gi\|1205959 | lactam utilization protein [*Haemophilus influenzae*] | 65 | 45 | 387 |
| 1276 | 1 | 276 | 76 | pir\|S35493\|S354 | site-specific DNA-methyltransferase StsI (EC 2.1.1.—) - *Streptococcus sanguis* | 65 | 35 | 201 |
| 1276 | 2 | 577 | 254 | gi\|473794 | 'ORF' [*Escherichia coli*] | 65 | 34 | 324 |
| 2057 | 1 | 138 | 4 | gi\|633699 | TrsH [*Yersinia enterocolitica*] | 65 | 21 | 135 |
| 2521 | 1 | 169 | 2 | gi\|1045789 | hypothetical protein (GB:U14003_76) [*Mycoplasma genitalium*] | 65 | 41 | 168 |
| 2974 | 1 | 297 | 4 | gi\|152052 | enantiomerase-selective amidase [Rhodococcus sp.] | 65 | 45 | 294 |
| 3031 | 1 | 154 | 2 | pir\|JQ1024\|JQ10 | hypothetical 30K protein (DmRP140 5' region) - fruit fly [*Drosophila melanogaster*] | 65 | 45 | 153 |
| 3069 | 1 | 3 | 278 | gi\|144906 | product homologous to *E. coli* thioredoxin reductase: J. Biol. Chem. 1988) 263:9015–9019, and to F52a protein of alkyl hydroperoxide eductase from *S. typhimurium*: J. Biol. Chem. (1990) 265:10535–10540; pen reading frame A [*Clostridium pasteurianum*] | 65 | 46 | 276 |
| 3146 | 1 | 142 | 2 | gi\|49315 | ORF1 gene product [*Bacillus subtilis*] | 65 | 47 | 141 |
| 3170 | 1 | 341 | 3 | gi\|1507711 | indolepyruvate decarboxylase [*Erwinia herbicola*] | 65 | 44 | 339 |
| 3546 | 1 | 1 | 303 | gi\|450688 | hsdM gene of EcoprrI gene product [*Escherichia coli*] pir\|S38437\|S38437 hsdM protein - *Escherichia coli* pir\|S09629\|S09629 hypothetical protein A - *Escherichia coli* (SUB 40–520) | 65 | 42 | 303 |
| 3782 | 1 | 2 | 328 | gi\|166412 | NADH-glutamate synthase [*Medicago sativa*] | 65 | 42 | 327 |
| 3990 | 1 | 189 | 4 | gi\|1009366 | Respiratory nitrate reductase [*Bacillus subtilis*] | 65 | 53 | 186 |
| 4032 | 1 | 308 | 3 | gi\|1323127 | ORF YGR087c [*Saccharomyces cerevisiae*] | 65 | 50 | 306 |
| 4278 | 2 | 364 | 2 | gi\|1197667 | vitellogenin [*Anolis pulchellus*] | 65 | 42 | 363 |
| 19 | 4 | 4259 | 5518 | gi\|145727 | deaD [*Escherichia coli*] | 64 | 45 | 1260 |
| 19 | 6 | 6926 | 6213 | gi\|1016232 | ycf27 gene product [*Cyanophora paradoxa*] | 64 | 36 | 714 |
| 20 | 8 | 6454 | 5855 | gi\|765073 | autolysin [*Staphylococcus aureus*] | 64 | 47 | 600 |
| 31 | 13 | 11537 | 10368 | gi\|414009 | ipa-85d gene product [*Bacillus subtilis*] | 64 | 45 | 1170 |
| 33 | 4 | 2388 | 4364 | gi\|1204696 | fructose-permease IIBC component [*Haemophilus influenzae*] | 64 | 47 | 1977 |
| 36 | 3 | 1871 | 3013 | gi\|290503 | glutamate permease [*Escherichia coli*] | 64 | 40 | 1143 |
| 37 | 6 | 4065 | 4409 | gi\|39815 | orf 2 gene product [*Bacillus subtilis*] | 64 | 46 | 345 |
| 45 | 9 | 7852 | 8760 | gi\|1230585 | nucleotide sugar epimerase [*Vibrio cholerae* O139] | 64 | 53 | 909 |

TABLE 2-continued

| | | | | | | | | |
|---|---|---|---|---|---|---|---|---|
| 53 | 3 | 1540 | 1899 | gi\|1303961 | YqjJ [*Bacillus subtilis*] | 64 | 50 | 360 |
| 56 | 6 | 3855 | 2917 | gi\|457514 | gltC [*Bacillus subtilis*] | 64 | 45 | 939 |
| 56 | 24 | 30002 | 30247 | gi\|470331 | similar to zinc fingers [*Caenorhabditis elegans*] | 64 | 42 | 246 |
| 62 | 4 | 2421 | 2083 | gi\|642655 | unknown [*Rhizobium meliloti*] | 64 | 28 | 339 |
| 85 | 6 | 6027 | 4876 | gi\|457702 | 5-aminoimidazole ribonucleotide-carboxilase [*Pichia methanolica*] pir\|S39112\|S39112 phosphoribosylaminoimidazole carboxylase (EC .1.1.21) - yeast [*Pichia methanolica*] | 64 | 46 | 1152 |
| 96 | 9 | 9251 | 10030 | gi\|1511513 | ABC transporter, probable ATP-binding subunit [*Methanococcus jannaschii*] | 64 | 42 | 780 |
| 100 | 1 | 1 | 600 | gi\|765073 | autolysin [*Staphylococcus aureus*] | 64 | 44 | 600 |
| 106 | 5 | 3868 | 4854 | gi\|466778 | lysine specific permease [*Escherichia coli*] | 64 | 46 | 987 |
| 123 | 2 | 554 | 270 | gi\|467484 | unknown [*Bacillus subtilis*] | 64 | 47 | 285 |
| 127 | 8 | 7514 | 7810 | gi\|210061 | serotype-specific antigen [African horse sickness virus] pir\|S27891\|S27891 capsid protein VP2 - African horse sickness virus | 64 | 28 | 297 |
| 131 | 7 | 6721 | 6308 | gi\|1511160 | *M. jannaschii* predicted coding region MJ1163 [*Methanococcus jannaschii*] | 64 | 46 | 414 |
| 142 | 5 | 4817 | 4179 | gi\|1173517 | riboflavin synthase alpha subunit [*Actinobacillus pleuropneumoniae*] | 64 | 44 | 639 |
| 143 | 1 | 356 | 3 | pir\|A32950\|A329 | probable reductase protein - Leishmania major | 64 | 52 | 354 |
| 149 | 10 | 3295 | 3035 | gi\|398151 | major surface antigen MSG2 [*Pneumocystis carinii*] | 64 | 44 | 261 |
| 154 | 4 | 2307 | 1480 | gi\|984587 | DinP [*Escherichia coli*] | 64 | 50 | 828 |
| 161 | 5 | 3855 | 4880 | gi\|903304 | ORF72 [*Bacillus subtilis*] | 64 | 37 | 1026 |
| 165 | 1 | 33 | 791 | gi\|467483 | unknown [*Bacillus subtilis*] | 64 | 38 | 759 |
| 175 | 6 | 4844 | 3333 | gi\|1072398 | phaD gene product [*Rhizobium meliloti*] | 64 | 42 | 1512 |
| 188 | 3 | 2042 | 2500 | gi\|1001961 | MHC class II analog [*Staphylococcus aureus*] | 64 | 45 | 459 |
| 195 | 14 | 13446 | 13225 | gi\|396380 | No definition line found [*Escherichia coli*] | 64 | 47 | 222 |
| 206 | 15 | 16429 | 16938 | gi\|304134 | argC [*Bacillus stearothermophilus*] | 64 | 49 | 510 |
| 215 | 1 | 282 | 4 | gi\|142359 | ORF 6 [*Azotobacter vinelandii*] | 64 | 39 | 279 |
| 243 | 7 | 6928 | 6038 | gi\|414014 | ipa-90d gene product [*Bacillus subtilis*] | 64 | 49 | 891 |
| 258 | 2 | 845 | 360 | gi\|664754 | P17 [*Listeria monocytogenes*] | 64 | 38 | 486 |
| 259 | 1 | 232 | 2 | gi\|1499663 | *M. jannaschii* predicted coding region MJ0837 [*Methanococcus jannaschii*] | 64 | 52 | 231 |
| 263 | 6 | 5567 | 4569 | gi\|142828 | aspartate semialdehyde dehydrogenase [*Bacillus subtilis*] sp\|Q04797\|DHAS_BACSU ASPARTATE-SEMIALDEHYDE DEHYDROGENASE (EC .2.1.11) (ASA DEHYDROGENASE). | 64 | 48 | 999 |
| 271 | 1 | 3 | 1163 | gi\|467091 | hflx; B2235_C2_202 [*Mycobacterium leprae*] | 64 | 44 | 1161 |
| 280 | 1 | 173 | 1450 | gi\|1303839 | YqfR [*Bacillus subtilis*] | 64 | 43 | 1278 |
| 293 | 1 | 1267 | 2 | gi\|147345 | primosomal protein n' [*Escherichia coli*] | 64 | 45 | 1266 |
| 295 | 2 | 742 | 1488 | gi\|459266 | Potential membrane spanning protein [*Staphylococcus hominis*] pir\|S42932\|S42932 potential membrane spanning protein - taphylococcus hominis | 64 | 39 | 747 |
| 301 | 5 | 1446 | 1267 | gi\|580835 | lysine decarboxylase [*Bacillus subtilis*] | 64 | 35 | 180 |
| 315 | 4 | 3949 | 2834 | gi\|143396 | quinol oxidase [*Bacillus subtilis*] | 64 | 45 | 1116 |
| 321 | 1 | 635 | 6 | gi\|710496 | transcriptional activator protein [*Bacillus brevis*] | 64 | 41 | 630 |
| 333 | 5 | 4239 | 3958 | gi\|1314295 | ORF2; putative 19 kDa protein [*Listeria monocytogenes*] | 64 | 43 | 282 |
| 342 | 1 | 1 | 549 | gi\|142940 | ftsA [*Bacillus subtilis*] | 64 | 38 | 549 |
| 353 | 3 | 2324 | 1770 | gi\|537049 | ORF_o470 [*Escherichia coli*] | 64 | 44 | 555 |
| 379 | 2 | 827 | 3658 | pir\|S25295\|A328 | oxoglutarate dehydrogenase (lipoamide) (EC 1.2.4.2) - *Bacillus subtilis* | 64 | 47 | 2832 |
| 404 | 6 | 4429 | 4839 | pir\|A36933\|A369 | diacylglycerol kinase homolog - Streptococcus mutans | 64 | 35 | 411 |
| 407 | 1 | 1133 | 246 | gi\|969026 | OrfX [*Bacillus subtilis*] | 64 | 41 | 888 |
| 425 | 1 | 591 | 73 | gi\|1146177 | phosphotransferase system glucose-specific enzyme II [*Bacillus subtilis*] | 64 | 44 | 519 |
| 443 | 6 | 4082 | 4798 | gi\|147309 | purine nucleoside phosphorylase [*Escherichia coli*] | 64 | 51 | 717 |
| 450 | 2 | 1035 | 1604 | gi\|606376 | ORF_o162 [*Escherichia coli*] | 64 | 38 | 570 |
| 470 | 5 | 1680 | 6107 | gi\|1369948 | host interacting protein [Bacteriophage B1] | 64 | 45 | 4428 |
| 486 | 4 | 1471 | 1031 | gi\|1205582 | spermidine/putrescine transport system permease protein [*Haemophilus influenzae*] | 64 | 35 | 441 |
| 497 | 1 | 1159 | 101 | sp\|P36929\|FMU_E | FMU PROTEIN. | 64 | 38 | 1059 |
| 501 | 1 | 3 | 410 | gi\|142450 | ahrC protein [*Bacillus subtilis*] | 64 | 38 | 408 |
| 514 | 1 | 3 | 290 | gi\|1204496 | *H. influenzae* predicted coding region HI0238 [*Haemophilus influenzae*] | 64 | 34 | 288 |
| 551 | 4 | 3162 | 3323 | gi\|1204511 | bacterioferritin comigratory protein [*Haemophilus influenzae*] | 64 | 41 | 162 |
| 603 | 4 | 759 | 956 | gi\|755823 | NADH dehydrogenase F [*Streptogyna americana*] | 64 | 35 | 198 |
| 653 | 2 | 746 | 552 | gi\|1213234 | dicarboxylic amino acids Dip5p permease [*Saccharomyces cerevisiae*] | 64 | 41 | 195 |
| 660 | 3 | 2257 | 713 | sp\|P46133_YDAH_ | HYPOTHETICAL PROTEIN IN OGT 5' REGION (FRAGMENT). | 64 | 39 | 1545 |
| 695 | 1 | 11 | 502 | gi\|1001383 | hypothetical protein [Synechocystis sp.] | 64 | 41 | 492 |
| 702 | 1 | 3 | 752 | gi\|142865 | DNA primase [*Bacillus subtilis*] | 64 | 46 | 750 |
| 826 | 1 | 1 | 339 | gi\|971336 | arginyl tRNA synthetase [*Bacillus subtilis*] | 64 | 50 | 339 |
| 838 | 1 | 917 | 3 | gi\|1354775 | pfoS/R [*Treponema pallidum*] | 64 | 41 | 915 |
| 864 | 3 | 675 | 944 | gi\|39833 | cyclomaltodextrin glucanotransferase [*Bacillus stearothermophilus*] i\|39835 cyclomaltodextrin glucanotransferase [*Bacillus earothermophilus*] | 64 | 47 | 270 |
| 887 | 1 | 3 | 677 | gi\|153002 | enterotoxin type E precursor [*Staphylococcus aureus*] pir\|A28179\|A28179 enterotoxin E precursor - *Staphylococcus aureus* sp\|P12993\|ETXE_STAAU ENTEROTOXIN TYPE E PRECURSOR (SEE). | 64 | 46 | 675 |
| 928 | 2 | 963 | 754 | gi\|311976 | fibrinogen-binding protein [*Staphylococcus aureus*] pir\|S34270\|S34270 fibrinogen-binding protein - *Staphylococcus ureus* | 64 | 41 | 210 |

TABLE 2-continued

| | | | | | | | | |
|---|---|---|---|---|---|---|---|---|
| 1049 | 2 | 606 | 412 | gi\|1049115 | Rap60 [*Bacillus subtilis*] | 64 | 42 | 195 |
| 1067 | 2 | 748 | 497 | gi\|1151072 | HhdA precursor [*Haemophilus ducreyi*] | 64 | 50 | 252 |
| 1120 | 1 | 50 | 202 | gi\|142439 | ATP-dependent nuclease [*Bacillus subtilis*] | 64 | 30 | 153 |
| 1125 | 1 | 377 | 3 | gi\|581648 | epiB gene product [*Staphylococcus epidermidis*] | 64 | 44 | 375 |
| 1688 | 1 | 214 | 26 | pir\|A01365\|TVMS | transforming protein K-ras - mouse | 64 | 47 | 189 |
| 2472 | 1 | 2 | 358 | gi\|487282 | Na+ −ATPase subunit J [*Enterococcus hirae*] | 64 | 36 | 357 |
| 2989 | 1 | 356 | 192 | gi\|304134 | argC [*Bacillus stearothermophilus*] | 64 | 50 | 165 |
| 3013 | 1 | 352 | 74 | gi\|551699 | cytochrome oxidase subunit I [*Bacillus firmus*] | 64 | 51 | 279 |
| 3034 | 1 | 274 | 2 | gi\|1204349 | hypothetical protein (GB:GB:D90212__3) [*Haemophilus influenzae*] | 64 | 50 | 273 |
| 3197 | 1 | 308 | 3 | gi\|1009366 | Respiratory nitrate reductase [*Bacillus subtilis*] | 64 | 46 | 306 |
| 3303 | 1 | 90 | 362 | gi\|1107839 | alginate lyase [*Pseudomonas aeruginosa*] | 64 | 43 | 273 |
| 3852 | 2 | 82 | 288 | gi\|216746 | D-lactate dehydrogenase [*Lactobacillus plantarum*] | 64 | 42 | 207 |
| 3868 | 1 | 1 | 312 | gi\|149435 | putative [*Lactococcus lactis*] | 64 | 48 | 312 |
| 3918 | 1 | 331 | 2 | gi\|5532 | acetyl-CoA acyltransferase [*Yarrowia lipolytica*] | 64 | 46 | 330 |
| 4000 | 1 | 112 | 378 | gi\|984688 | unknown [*Saccharomyces cerevisiae*] | 64 | 44 | 267 |
| 4009 | 1 | 81 | 368 | gi\|39372 | grsB gene product [*Bacillus brevis*] | 64 | 41 | 288 |
| 4166 | 1 | 2 | 349 | gi\|149435 | putative [*Lactococcus lactis*] | 64 | 46 | 348 |
| 4366 | 1 | 2 | 307 | gi\|216267 | ORF2 [*Bacillus magaterium*] | 64 | 44 | 306 |
| 4457 | 1 | 2 | 400 | gi\|1197667 | vitellogenin [*Anolis pulchellus*] | 64 | 43 | 399 |
| 11 | 3 | 1539 | 2438 | gi\|438228 | ORF C [*Staphylococcus aureus*] | 63 | 32 | 900 |
| 24 | 7 | 5423 | 5235 | gi\|1369943 | a1 gene product [Bacteriophage B1] | 63 | 34 | 189 |
| 29 | 1 | 1 | 390 | gi\|467441 | expressed at the end of exponential growyh under conditions in which he enzymes of the TCA cycle are repressed [*Bacillus subtilis*] gi\|467441 expressed at the end of exponential growyh under ondtions in which the enzymes of the TCA cycle are repressed Bacil | 63 | 43 | 390 |
| 31 | 6 | 5712 | 5095 | gi\|496943 | ORF [*Saccharomyces cerevisiae*] | 63 | 47 | 618 |
| 44 | 23 | 14669 | 15019 | pir\|A04446\|QQEC | hypothetical protein F-92 - *Escherichia coli* | 63 | 36 | 351 |
| 48 | 6 | 4403 | 6250 | gi\|43498 | pyruvate synthase [*Halobacterium halobium*] | 63 | 42 | 1848 |
| 50 | 5 | 3869 | 4738 | gi\|413967 | ipa-43d gene product [*Bacillus subtilis*] | 63 | 43 | 870 |
| 53 | 6 | 5742 | 4720 | gi\|474176 | regulator protein [*Staphylococcus xylosus*] | 63 | 49 | 1023 |
| 56 | 14 | 15880 | 17607 | gi\|467409 | DNA polymerase III subunit [*Bacillus subtilis*] | 63 | 44 | 1728 |
| 57 | 11 | 7376 | 6807 | gi\|537036 | ORF_o158 [*Escherichia coli*] | 63 | 39 | 570 |
| 62 | 3 | 2114 | 1749 | gi\|642656 | unknown [*Rhizobium meliloti*] | 63 | 41 | 366 |
| 70 | 8 | 6562 | 7353 | gi\|1399821 | PhoC [*Rhizobium meliloti*] | 63 | 46 | 792 |
| 75 | 2 | 223 | 927 | gi\|149376 | HisG [*Lactococcus lactis*] | 63 | 45 | 705 |
| 78 | 5 | 4403 | 3894 | gi\|413950 | ipa-26d gene product [*Bacillus subtilis*] | 63 | 42 | 510 |
| 91 | 5 | 7220 | 5364 | gi\|466997 | metH2; B2126_C1_157 [*Mycobacterium leprae*] | 63 | 41 | 1857 |
| 91 | 8 | 9448 | 8330 | gi\|1204344 | cystathionine gamma-synthase [*Haemophilus influenzae*] | 63 | 45 | 1119 |
| 120 | 1 | 21 | 1508 | gi\|882657 | sulfite reductase (NADPH) flavoprotein beta subunit [*Escherichia oli*] | 63 | 46 | 1488 |
| 120 | 4 | 2722 | 4125 | gi\|665994 | hypothetical protein [*Bacillus subtilis*] | 63 | 34 | 1404 |
| 127 | 7 | 6064 | 7566 | gi\|40162 | murE gene product [*Bacillus subtilis*] | 63 | 44 | 1503 |
| 149 | 6 | 2106 | 1891 | gi\|148503 | dnaK [*Erysipelothrix rhusiopathiae*] | 63 | 40 | 216 |
| 149 | 26 | 10170 | 9895 | gi\|4870 | ORF 2, has similarity to DNA polymerase [*Saccharomyces kluyveri*] r\|S15961\|S15961 hypothetical protein 2 - yeast [*Saccharomyces yveri*] plasmid pSKL | 63 | 42 | 276 |
| 164 | 2 | 507 | 1298 | gi\|145476 | CDP-diglyceride synthetase [*Escherichia coli*] | 63 | 44 | 792 |
| 166 | 6 | 8164 | 6419 | gi\|151932 | fructose enzyme II [*Rhodobacter capsulatus*] | 63 | 41 | 1746 |
| 169 | 4 | 1704 | 1886 | gi\|152886 | elongation factor Ts (tsf) [*Spiroplasma citri*] | 63 | 48 | 183 |
| 188 | 5 | 2951 | 2757 | gi\|1334547 | GIY COI i14 grp IB protein [*Podospora anserina*] | 63 | 42 | 195 |
| 195 | 13 | 11767 | 12804 | gi\|606100 | ORF_o335 [*Escherichia coli*] | 63 | 40 | 1038 |
| 201 | 2 | 607 | 2283 | gi\|433534 | arginyl-tRNA synthetase [*Corynebacterium glutamicum*] pir\|A49936\|A49936 arginine--tRNA ligase (EC 6.1.1.19) - orynebacterium glutamicum | 63 | 46 | 1677 |
| 206 | 14 | 15893 | 16489 | gi\|580828 | N-acetyl-glutamate-gamma-semialdehyde dehydrogenase [*Bacillus ubtilis*] | 63 | 49 | 597 |
| 220 | 5 | 5766 | 3763 | gi\|216334 | secA protein [*Bacillus subtilis*] | 63 | 42 | 2004 |
| 221 | 1 | 74 | 907 | gi\|677945 | AppA [*Bacillus subtilis*] | 63 | 42 | 834 |
| 227 | 3 | 944 | 1708 | gi\|1510558 | cobyric acid synthase [*Methanococcus jannaschii*] | 63 | 46 | 765 |
| 261 | 2 | 804 | 1070 | gi\|486511 | ORF YKR054c [*Saccharomyces cerevisiae*] | 63 | 45 | 267 |
| 269 | 2 | 1960 | 314 | gi\|148221 | DNA-dependent ATPase, DNA helicase [*Escherichia coli*] pir\|JS0137\|BVECRQ recQ protein - *Escherichia coli* | 63 | 42 | 1647 |
| 278 | 8 | 6176 | 4935 | gi\|699273 | cystathionine gamma-synthase [*Mycobacterium leprae*] sp\|P46807\|METB_MYCLE CYSTATHIONINE GAMMA-SYNTHASE (EC 4.2.99.9) O-SUCCINYLHOMOSERINE (THIOL-LYASE). | 63 | 41 | 1242 |
| 287 | 2 | 738 | 1733 | gi\|405133 | putative [*Bacillus subtilis*] | 63 | 38 | 996 |
| 295 | 1 | 2 | 748 | gi\|1239983 | hypothetical protein [*Bacillus subtilis*] | 63 | 41 | 747 |
| 328 | 3 | 2148 | 3134 | gi\|45302 | carrier protein (AA 1–437) [*Pseudomonas aeruginosa*] ir\|S11497\|S11497 branched-chain amino acid transport protein braB - eudomonas aeruginosa | 63 | 36 | 987 |
| 362 | 2 | 1216 | 806 | sp\|P35136\|SERA_ | D-3-PHOSPHOGLYCERATE DEHYDROGENASE (EC 1.1.1.95) (PGDH). | 63 | 38 | 411 |
| 404 | 1 | 326 | 1051 | gi\|1303816 | YqeZ [*Bacillus subtilis*] | 63 | 35 | 726 |
| 405 | 3 | 1715 | 1329 | gi\|1303914 | YqhY [*Bacillus subtilis*] | 63 | 42 | 387 |
| 406 | 1 | 227 | 3 | gi\|142152 | sulfate permease (gtg start codon) [Synechococcus PCC6301] pir\|A30301\|GRYCS7 sulfate transport protein - Synechococcus sp. (PCC 7942) | 63 | 43 | 225 |

TABLE 2-continued

| | | | | | | | | |
|---|---|---|---|---|---|---|---|---|
| 415 | 2 | 1048 | 2718 | gi\|1205402 | transport ATP-binding protein [*Haemophilus influenzae*] | 63 | 41 | 1671 |
| 426 | 4 | 2679 | 1783 | gi\|393268 | 29-kiloDalton protein [*Streptococcus pneumoniae*] sp\|P42362\|P29K_STRPN 29 KD MEMBRANE PROTEIN IN PSAA 5' REGION ORF1). | 63 | 39 | 897 |
| 505 | 3 | 1347 | 2195 | gi\|1418999 | orf4 [*Lactobacillus sake*] | 63 | 40 | 849 |
| 507 | 1 | 2 | 574 | gi\|546917 | comK [*Bacillus subtilis*, E26, Peptide, 192 aa] | 63 | 35 | 573 |
| 562 | 2 | 146 | 1084 | gi\|43985 | nifS-like gene [*Lactobacillus delbrueckii*] | 63 | 45 | 939 |
| 675 | 1 | 215 | 3 | gi\|1510994 | serine aminotransferase [*Methanococcus jannaschii*] | 63 | 29 | 213 |
| 686 | 1 | 3 | 230 | gi\|517356 | nitrate reductase (NADH) [*Lotus japonicus*] | 63 | 52 | 228 |
| 701 | 1 | 3 | 392 | gi\|881940 | NorQ protein [*Paracoccus denitrificans*] | 63 | 41 | 390 |
| 720 | 1 | 2 | 400 | gi\|47168 | open reading frame [*Streptomyces lividans*] | 63 | 35 | 399 |
| 779 | 1 | 287 | 3 | gi\|1261932 | unknown [*Mycobacterium tuberculosis*] | 63 | 41 | 285 |
| 907 | 1 | 22 | 321 | gi\|149445 | ORF1 [*Lactococcus lactis*] | 63 | 27 | 300 |
| 972 | 1 | 399 | 4 | gi\|1511235 | *M. jannaschii* predicted coding region MJ1232 [*Methanococcus jannaschii*] | 63 | 27 | 396 |
| 1085 | 1 | 618 | 82 | gi\|1204277 | hypothetical protein (GB:U00019_14) [*Haemophilus influenzae*] | 63 | 38 | 537 |
| 1094 | 1 | 3 | 542 | gi\|790943 | urea amidolyase [*Bacillus subtilis*] | 63 | 39 | 540 |
| 1108 | 1 | 3 | 482 | pir\|S49892\|S498 | regulation protein - Bacillus subtilis | 63 | 44 | 480 |
| 1113 | 1 | 617 | 3 | gi\|493017 | endocarditis specific antigen [*Enterococcus faecalis*] | 63 | 45 | 615 |
| 1300 | 1 | 3 | 695 | sp\|P33940\|YOJH_ | HYPOTHETICAL 54.3 KD PROTEIN IN ECO-ALKB INTERGENIC REGION. | 63 | 46 | 693 |
| 1325 | 1 | 1 | 204 | gi\|928989 | p100 protein [*Borrelia burgdorferi*] | 63 | 30 | 204 |
| 1814 | 1 | 3 | 245 | gi\|1303914 | YqhY [*Bacillus subtilis*] | 63 | 34 | 243 |
| 2021 | 1 | 250 | 2 | pir\|C33496\|C334 | hisC homolog - Bacillus subtilis | 63 | 46 | 249 |
| 2325 | 1 | 2 | 193 | gi\|436132 | product is similar to TnpA of transposon Tn554 from *Staphylococcus ureus* [*Clostridium butyricum*] | 63 | 40 | 192 |
| 2335 | 1 | 1 | 195 | gi\|1184298 | flagellar MS-ring protein [*Borrelia burgdorferi*] | 63 | 47 | 195 |
| 2406 | 1 | 227 | 3 | gi\|1041785 | rhoptry protein [*Plasmodium yoelii*] | 63 | 33 | 225 |
| 2961 | 2 | 136 | 360 | gi\|312443 | carbamoyl-phosphate synthase (glutamine-hydrolysing) [*Bacillus aldolyticus*] | 63 | 52 | 225 |
| 2965 | 1 | 1 | 402 | gi\|1407784 | orf-1; novel antigen [*Staphylococcus aureus*] | 63 | 50 | 402 |
| 2987 | 1 | 293 | 3 | gi\|1224069 | amidase [*Moraxella catarrhalis*] | 63 | 35 | 291 |
| 2994 | 1 | 135 | 4 | gi\|836646 | phosphoribosylformimino-praic ketoisomerase [*Rhodobacter phaeroides*] | 63 | 51 | 132 |
| 3043 | 1 | 252 | 64 | gi\|1480237 | phenylacetaldehyde dehydrogenase [*Escherichia coli*] | 63 | 40 | 189 |
| 3078 | 1 | 400 | 191 | gi\|1487982 | intrinsic membrane protein [*Mycoplasma hominis*] | 63 | 36 | 210 |
| 3139 | 1 | 2 | 217 | gi\|439126 | glutamate synthase (NADPH) [*Azospirillum brasilense*] pir\|A49916\|A49916 glutamate synthase (NADPH) (EC 1.4.1.13) - zospirillum brasilense | 63 | 47 | 216 |
| 3625 | 1 | 398 | 3 | gi\|623073 | ORF360; putative [Bacteriophage LL-H] | 63 | 48 | 396 |
| 3658 | 1 | 1 | 399 | gi\|1303697 | YrkA [*Bacillus subtilis*] | 63 | 37 | 399 |
| 3659 | 1 | 3 | 395 | gi\|1256135 | YbbF [*Bacillus subtilis*] | 63 | 48 | 393 |
| 3783 | 1 | 361 | 2 | gi\|1256902 | Pyruvate decarboxylase isozyme 2 (Swiss Prot. accession number P16467) [*Saccharomyces cerevisiae*] | 63 | 34 | 360 |
| 3900 | 1 | 171 | 4 | sp\|P10537\|AMYB_ | BETA-AMYLASE (EC 3.2.1.2) (1,4-ALPHA-D-GLUCAN MALTOHYDROLASE). | 63 | 54 | 168 |
| 4309 | 1 | 3 | 176 | pir\|A37967\|A379 | neural cell adhesion molecule Ng-CAM precursor - chicken | 63 | 57 | 174 |
| 4367 | 1 | 1 | 195 | gi\|1321932 | Per6p gene product [*Pichia pastoris*] | 63 | 30 | 195 |
| 4432 | 1 | 1 | 312 | gi\|151259 | HMG-CoA reductase (EC 1.1.1.88) [*Pseudomonas mevalonii*] pir\|A44756\|A44756 hydroxymethylglutaryl-CoA reductase (EC 1.1.1.88) Pseudomonas sp. | 63 | 51 | 312 |
| 4468 | 1 | 6 | 308 | gi\|296464 | ATPase [*Lactococcus lactis*] | 63 | 36 | 303 |
| 33 | 3 | 1411 | 2400 | gi\|153675 | tagatose 6-P kinase [*Streptococcus mutans*] | 62 | 44 | 990 |
| 36 | 9 | 5985 | 6218 | gi\|1490521 | hMSH3 [*Homo sapiens*] | 62 | 51 | 234 |
| 37 | 1 | 2 | 721 | gi\|1107531 | ceuE gene product [*Campylobacter coli*] | 62 | 33 | 720 |
| 38 | 15 | 10912 | 11589 | gi\|1222058 | *H. influenzae* predicted coding region HIN1279 [*Haemophilus influenzae*] | 62 | 38 | 678 |
| 38 | 25 | 19526 | 20329 | gi\|695280 | ORF2 [*Alcaligenes eutrophus*] | 62 | 41 | 804 |
| 57 | 2 | 1780 | 1037 | gi\|471234 | orf1 [*Haemophilus influenzae*] | 62 | 55 | 744 |
| 57 | 9 | 6350 | 6054 | gi\|508174 | EIIB domain of PTS-dependent Gat transport and phosphorylation [*Escherichia coli*] | 62 | 35 | 297 |
| 58 | 1 | 2 | 559 | gi\|755152 | highly hydrophobic integral membrane protein [*Bacillus subtilis*] sp\|P42953\|TAGG_BACSU TEICHOIC ACID TRANSLOCATION PERMEASE PROTEIN AGG. | 62 | 34 | 558 |
| 67 | 10 | 8250 | 9014 | gi\|470683 | Shows similarity with ATP-binding proteins from other ABC-transport perons, Swiss Prot Accession Numbers P24137, P08007, P04285, P24136 [*Escherichia coli*] | 62 | 34 | 765 |
| 69 | 8 | 7494 | 6673 | gi\|46816 | actVA 4 gene product [*Streptomyces coelicolor*] | 62 | 44 | 822 |
| 80 | 3 | 1320 | 847 | gi\|39993 | UDP-N-acetylmuramoylalanine--D-glutamate ligase [*Bacillus subtilis*] | 62 | 43 | 474 |
| 87 | 7 | 7034 | 9205 | gi\|217191 | 5'-nucleotidase precursor [*Vibrio parahaemolyticus*] | 62 | 48 | 2172 |
| 100 | 3 | 3089 | 2127 | gi\|1511047 | phosphoglycerate dehydrogenase [*Methanococcus jannaschii*] | 62 | 42 | 963 |
| 102 | 1 | 2 | 520 | gi\|153655 | mismatch repair protein [*Streptococcus pneumoniae*] pir\|C28667\|C28667 DNA mismatch repair protein hexA - Streptococcus neumoniae | 62 | 34 | 519 |
| 112 | 2 | 466 | 1068 | gi\|153741 | ATP-binding protein [*Streptococcus mutans*] | 62 | 37 | 603 |
| 114 | 7 | 6855 | 7562 | gi\|1204866 | L-fucose operon activator [*Haemophilus influenzae*] | 62 | 38 | 708 |

TABLE 2-continued

| | | | | | | | | |
|---|---|---|---|---|---|---|---|---|
| 116 | 4 | 5633 | 4443 | gi\|677947 | AppC [*Bacillus subtilis*] | 62 | 37 | 1191 |
| 124 | 8 | 6004 | 5153 | gi\|853777 | product similar to *E. coli* PRFA2 protein [*Bacillus subtilis*] pir\|S55438\|S55438 ywkE protein - *Bacillus subtilis* sp\|P45873\|HEMK_BACSU POSSIBLE PROTOPORPHYRINOGEN OXIDASE (EC .3.3.—). | 62 | 44 | 852 |
| 148 | 1 | 24 | 554 | gi\|467456 | unknown [*Bacillus subtilis*] | 62 | 50 | 531 |
| 149 | 20 | 6725 | 5859 | gi\|1205807 | replicative DNA helicase [*Haemophilus influenzae*] | 62 | 41 | 867 |
| 163 | 3 | 1153 | 803 | gi\|40067 | X gene product [*Bacillus sphaericus*] | 62 | 42 | 351 |
| 164 | 15 | 14673 | 15632 | gi\|42219 | P35 gene product (AA 1–314) [*Escherichia coli*] | 62 | 38 | 960 |
| 165 | 2 | 1166 | 1447 | gi\|403936 | phenylalanyl-tRNA synthetase alpha subunit (Gly294 variant) [unidentified cloning vector] | 62 | 38 | 282 |
| 166 | 2 | 2084 | 5089 | gi\|308861 | GTG start codon [*Lactococcus lactis*] | 62 | 44 | 3006 |
| 171 | 1 | 614 | 3 | gi\|1046053 | hypothetical protein (SP:P32049) [*Mycoplasma genitalium*] | 62 | 41 | 612 |
| 183 | 1 | 1310 | 99 | gi\|143045 | hemY [*Bacillus subtilis*] | 62 | 45 | 1212 |
| 200 | 1 | 3 | 956 | gi\|142439 | ATP-dependent nuclease [*Bacillus subtilis*] | 62 | 32 | 954 |
| 237 | 2 | 935 | 1966 | gi\|41695 | hisC protein [*Escherichia coli*] | 62 | 44 | 1032 |
| 261 | 3 | 2605 | 1202 | gi\|143121 | ORF A; putative [*Bacillus firmus*] | 62 | 42 | 1404 |
| 299 | 8 | 4477 | 4719 | gi\|467441 | expressed at the end of exponential growyh under condtions in which he enzymes of the TCA cycle are repressed [*Bacillus subtilis*] gi\|467441 expressed at the end of exponential growyh under ondtions in which the enzymes of the TCA cycle are repressed Bacil | 62 | 47 | 243 |
| 304 | 6 | 3819 | 2620 | gi\|153015 | FemA protein [*Staphylococcus aureus*] | 62 | 43 | 1200 |
| 324 | 1 | 2 | 262 | gi\|142717 | cytochrome aa3 controlling protein [*Bacillus subtilis*] pir\|A33960\|A33960 cta protein - *Bacillus subtilis* sp\|P12946\|CTAA_BACSU CYTOCHROME AA3 CONTROLLING PROTEIN. | 62 | 30 | 261 |
| 325 | 2 | 269 | 1207 | gi\|581088 | methionyl-tRNA formyltransferase [*Escherichia coli*] | 62 | 39 | 939 |
| 332 | 6 | 4631 | 4368 | gi\|1499960 | uridine 5'-monophosphate synthase [*Methanococcus jannaschii*] | 62 | 36 | 264 |
| 355 | 1 | 2 | 370 | gi\|145925 | fecB [*Escherichia coli*] | 62 | 32 | 369 |
| 365 | 8 | 6628 | 6804 | gi\|413943 | ipa-19d gene product [*Bacillus subtilis*] | 62 | 54 | 177 |
| 369 | 2 | 1626 | 508 | pir\|A43577\|A435 | regulatory protein pfoR - *Clostridium perfringens* | 62 | 42 | 1119 |
| 370 | 1 | 34 | 264 | gi\|40665 | beta-glucosidase [*Clostridium thermocellum*] | 62 | 37 | 231 |
| 415 | 3 | 2709 | 3176 | gi\|1205401 | transport ATP-binding protein [*Haemophilus influenzae*] | 62 | 35 | 468 |
| 429 | 1 | 790 | 2 | gi\|1046024 | Na+ ATPase subunit J [*Mycoplasma genitalium*] | 62 | 40 | 789 |
| 444 | 2 | 704 | 1369 | gi\|581510 | nodulation gene; integral membrane protein; homology to *Rhizobium eguminosarum* nodI [*Rhizobium loti*] | 62 | 37 | 666 |
| 477 | 2 | 751 | 1869 | pir\|A48440\|A484 | ring-infected erythrocyte surface antigen 2, RESA-2 - *Plasmodium falciparum* | 62 | 44 | 1119 |
| 485 | 1 | 241 | 1707 | gi\|17934 | betaine aldehyd dehydrogenase [*Beta vulgaris*] | 62 | 43 | 1467 |
| 487 | 3 | 1141 | 1311 | gi\|149445 | ORF1 [*Lactococcus lactis*] | 62 | 31 | 171 |
| 494 | 2 | 1134 | 1313 | gi\|166835 | ribulose bisphosphate carboxylase/oxygenase activase [*Arabidopsis haliana*] | 62 | 37 | 180 |
| 518 | 1 | 193 | 882 | gi\|153491 | O-methyltransferase [*Streptomyces glaucescens*] | 62 | 39 | 690 |
| 534 | 2 | 369 | 2522 | gi\|1480429 | putative transcriptional regular [*Bacillus stearothermophilus*] | 62 | 35 | 2154 |
| 551 | 6 | 4371 | 4820 | gi\|511113 | ferric uptake regulation protein [*Campylobacter jejuni*] | 62 | 37 | 450 |
| 574 | 1 | 1 | 570 | gi\|153000 | enterotoxin B [*Staphylococcus aureus*] | 62 | 43 | 570 |
| 590 | 2 | 344 | 1171 | gi\|40367 | ORFC [*Clostridium acetobutylicum*] | 62 | 37 | 828 |
| 655 | 1 | 396 | 830 | gi\|147195 | phnB protein [*Escherichia coli*] | 62 | 44 | 435 |
| 656 | 1 | 2 | 478 | gi\|1205451 | cell division inhibitor [*Haemophilus influenzae*] | 62 | 36 | 477 |
| 676 | 1 | 348 | 4 | gi\|1511613 | methyl coenzyme M reductase system, component A2 [*Methanococcus jannaschii*] | 62 | 36 | 345 |
| 687 | 1 | 248 | 3 | gi\|49272 | Asparaginase [*Bacillus licheniformis*] | 62 | 48 | 246 |
| 700 | 2 | 267 | 944 | gi\|1205822 | hypothetical protein (GB:X75627_4) [*Haemophilus influenzae*] | 62 | 40 | 678 |
| 840 | 2 | 1041 | 367 | gi\|1045865 | *M. genitalium* predicted coding region MG181 [*Mycoplasma genitalium*] | 62 | 36 | 675 |
| 864 | 4 | 898 | 1491 | gi\|1144332 | deoxyuridine nucleotidohydrolase [*Homo sapiens*] | 62 | 38 | 594 |
| 916 | 1 | 35 | 400 | gi\|413931 | ipa-7d gene product [*Bacillus subtilis*] | 62 | 45 | 366 |
| 1071 | 1 | 1 | 771 | gi\|1510649 | aspartokinase I [*Methanococcus jannaschii*] | 62 | 40 | 771 |
| 1084 | 1 | 19 | 609 | gi\|688011 | AgX-1 antigen [human, infertile patient, testis, Peptide, 505 aa] | 62 | 39 | 591 |
| 1103 | 1 | 3 | 203 | gi\|581261 | ORF homologous to *E. coli* metB [*Herpetosiphon aurantiacus*] pir\|S14030\|S14030 Hypothetical protein - *Herpetosiphon aurantiacus* (fragment) | 62 | 51 | 201 |
| 1217 | 1 | 233 | 3 | gi\|460025 | ORF2, putative [*Streptococcus pneumoniae*] | 62 | 41 | 231 |
| 1533 | 1 | 414 | 184 | gi\|413968 | ipa-44d gene product [*Bacillus subtilis*] | 62 | 48 | 231 |
| 1537 | 1 | 3 | 257 | gi\|1510641 | alanyl-tRNA synthetase [*Methanococcus jannaschii*] | 62 | 29 | 255 |
| 2287 | 1 | 3 | 161 | gi\|485956 | mrpC gene product [*Proteus mirabilis*] | 62 | 45 | 159 |
| 2386 | 1 | 3 | 245 | gi\|285708 | nontoxic component [*Clostridium botulinum*] | 62 | 31 | 243 |
| 2484 | 1 | 167 | 3 | gi\|142092 | DNA-repair protein (recA) [*Anabaena variabilis*] | 62 | 35 | 165 |
| 2490 | 1 | 400 | 2 | gi\|581648 | epiB gene product [*Staphylococcus epidermidis*] | 62 | 42 | 399 |
| 3016 | 1 | 300 | 4 | gi\|710022 | uroporphyrinogen III [*Bacillus subtilis*] | 62 | 51 | 297 |
| 3116 | 1 | 1 | 213 | gi\|466883 | nifS; B1496_C2_193 [*Mycobacterium leprae*] | 62 | 44 | 213 |
| 3297 | 1 | 413 | 3 | gi\|475715 | acetyl coenzyme A acetyltransferase (thiolase) [*Clostridium cetobutylicum*] | 62 | 42 | 411 |
| 3609 | 1 | 31 | 276 | gi\|1408501 | homologous to N-acyl-L-amino acid amidohydrolase of *Bacillus stearothermophilus* [*Bacillus subtilis*] | 62 | 48 | 246 |
| 3665 | 2 | 402 | 220 | gi\|151259 | HMG-CoA reductase (EC 1.1.1.88) [*Pseudomonas mevalonii*] pir\|A44756\|A44756 hydroxymethylglutaryl-CoA reductase (EC 1.1.1.88) Pseudomonas sp. | 62 | 40 | 183 |
| 3733 | 1 | 3 | 374 | gi\|1353197 | thioredoxin reductase [*Eubacterium acidaminophilum*] | 62 | 42 | 372 |

TABLE 2-continued

| | | | | | | | | |
|---|---|---|---|---|---|---|---|---|
| 3898 | 1 | 1 | 237 | gi\|153675 | tagatose 6-P kinase [*Streptococcus mutans*] | 62 | 45 | 237 |
| 4027 | 1 | 143 | 3 | gi\|330705 | homologue to gene 30 (aa 1–59); putative [Bovine herpesvirus 4] | 62 | 43 | 141 |
| 4109 | 1 | 365 | 3 | gi\|41748 | hsdM protein (AA 1–520) [*Escherichia coli*] | 62 | 45 | 363 |
| 4303 | 1 | 1 | 303 | gi\|1303813 | YqeW [*Bacillus subtilis*] | 62 | 43 | 303 |
| 4380 | 1 | 267 | 4 | gi\|1235684 | mevalonate pyrophosphate decarboxylase [*Saccharomyces cerevisiae*] | 62 | 55 | 264 |
| 4494 | 1 | 2 | 256 | gi\|510692 | enterotoxin H [*Staphylococcus aureus*] | 62 | 34 | 255 |
| 4598 | 1 | 223 | 35 | gi\|763513 | ORF4; putative [*Streptomyces violaceoruber*] | 62 | 45 | 189 |
| 4624 | 1 | 1 | 222 | gi\|41748 | hsdM protein (AA 1–520) [*Escherichia coli*] | 62 | 45 | 222 |
| 5 | 5 | 3932 | 3576 | gi\|928831 | ORF95; putative [*Lactococcus lactis* phage BK5-T] | 61 | 36 | 357 |
| 11 | 1 | 162 | 4 | pir\|C33356\|C333 | prothymosin alpha homolog (clone 32) - human (fragment) | 61 | 33 | 159 |
| 16 | 11 | 10991 | 11938 | gi\|1205391 | hypothetical protein (SP:P33995) [*Haemophilus influenzae*] | 61 | 44 | 948 |
| 32 | 1 | 283 | 801 | gi\|1066504 | exo-beta 1,3 glucanase [*Cochliobolus carbonum*] | 61 | 50 | 519 |
| 38 | 3 | 616 | 1107 | gi\|1510864 | glutamine transport ATP-binding protein Q [*Methanococcus jannaschii*] | 61 | 41 | 492 |
| 45 | 4 | 3082 | 4038 | gi\|1109686 | ProX [*Bacillus subtilis*] | 61 | 45 | 957 |
| 48 | 8 | 7118 | 7504 | gi\|498839 | ORF2 [*Clostridium perfringens*] | 61 | 33 | 387 |
| 51 | 9 | 4605 | 5570 | gi\|388269 | traC [Plasmid pAD1] | 61 | 42 | 966 |
| 60 | 6 | 1689 | 2243 | gi\|1205893 | hypothetical protein (GB:U00011_3) [*Haemophilus influenzae*] | 61 | 32 | 555 |
| 62 | 9 | 5122 | 4685 | gi\|854656 | Na/H antiporter system ORF2 [*Bacillus alcalophilus*] | 61 | 38 | 438 |
| 67 | 5 | 4330 | 5646 | gi\|466612 | nikA [*Escherichia coli*] | 61 | 36 | 1317 |
| 74 | 2 | 1504 | 608 | gi\|1204846 | carbamate kinase [*Haemophilus influenzae*] | 61 | 40 | 897 |
| 85 | 1 | 1101 | 4 | gi\|1498756 | amidophosphoribosyltransferase PurF [*Rhizobium etli*] | 61 | 41 | 1098 |
| 86 | 4 | 1582 | 1169 | gi\|1499931 | *M. jannaschii* predicted coding region MJ1083 [*Methanococcus jannaschii*] | 61 | 44 | 414 |
| 97 | 1 | 74 | 649 | gi\|1518679 | orf [*Bacillus subtilis*] | 61 | 44 | 576 |
| 99 | 2 | 1990 | 1526 | gi\|413958 | ipa-34d gene product [*Bacillus subtilis*] | 61 | 18 | 465 |
| 124 | 7 | 5123 | 4023 | gi\|556881 | Similar to *Saccharomyces cerevisiae* SUA5 protein [*Bacillus subtilis*] pir\|S49358\|S49358 ipc-29d protein - *Bacillus subtilis* sp\|P39153\|YWLC_BACSU HYPOTHETICAL 37.0 KD PROTEIN IN SPOIIR-GLYC NTERGENIC REGION. | 61 | 46 | 1101 |
| 125 | 4 | 1668 | 2531 | gi\|1491643 | ORFA gene product [*Chloroflexus aurantiacus*] | 61 | 43 | 864 |
| 132 | 1 | 627 | 4 | pir\|PQ0259\|PQ02 | hypothetical protein I - *Enterococcus faecalis* plasmid pAM-beta-1 (fragment) | 61 | 43 | 624 |
| 149 | 9 | 3075 | 2533 | gi\|1144332 | deoxyuridine nucleotidohydrolase [*Homo sapiens*] | 61 | 40 | 543 |
| 149 | 22 | 7869 | 7048 | gi\|160047 | p101/acidic basic repeat antigen [*Plasmodium falciparum*] pir\|A29232\|A29232 101K malaria antigen precursor - *Plasmodium alciparum* (strain Camp) | 61 | 35 | 822 |
| 168 | 3 | 1915 | 2361 | gi\|1499694 | HIT protein, member of the HIT-family [*Methanococcus jannaschii*] | 61 | 41 | 447 |
| 171 | 9 | 7948 | 6221 | gi\|467446 | similar to SpoVB [*Bacillus subtilis*] | 61 | 38 | 1728 |
| 174 | 3 | 1042 | 2340 | gi\|216374 | glutaryl 7-ACA acylase precursor [*Bacillus laterosporus*] | 61 | 49 | 1299 |
| 190 | 4 | 4111 | 3188 | gi\|409286 | bmrU [*Bacillus subtilis*] | 61 | 37 | 924 |
| 216 | 1 | 2 | 190 | gi\|415861 | eukaryotic initiation factor 2 beta (eIF-2 beta) [*Oryctolagus uniculus*] | 61 | 29 | 189 |
| 227 | 7 | 4161 | 5048 | gi\|216341 | ORF for methionine amino peptidase [*Bacillus subtilis*] | 61 | 41 | 888 |
| 238 | 4 | 1959 | 3047 | gi\|809543 | CbrC protein [*Erwinia chrysanthemi*] | 61 | 38 | 1089 |
| 247 | 1 | 2 | 694 | gi\|537231 | ORF_f579 [*Escherichia coli*] | 61 | 38 | 693 |
| 247 | 2 | 678 | 1034 | gi\|142226 | chvD protein [*Agrobacterium tumefaciens*] | 61 | 40 | 357 |
| 257 | 2 | 2627 | 1731 | gi\|699379 | glvr-1 protein [*Mycobacterium leprae*] | 61 | 40 | 897 |
| 268 | 2 | 3051 | 2683 | gi\|40364 | ORFA1 [*Clostridium acetobutylicum*] | 61 | 41 | 369 |
| 275 | 4 | 4621 | 4827 | gi\|1204848 | hypothetical protein (GP:M87049_57) [*Haemophilus influenzae*] | 61 | 36 | 207 |
| 277 | 1 | 1 | 1845 | gi\|784897 | beta-N-acetylhexosaminidase [*Streptococcus pneumoniae*] pir\|A56390\|A56390 mannosyl-glycoprotein ndo-beta-N-acetyl-glucosaminidase (EC 3.2.1.96) precursor - treptococcus pneumoniae | 61 | 45 | 1845 |
| 278 | 9 | 7032 | 6061 | gi\|467462 | cysteine synthetase A [*Bacillus subtilis*] | 61 | 43 | 972 |
| 278 | 10 | 8535 | 7192 | gi\|1205919 | Na+ and Cl− dependent gamma-aminobutryic acid transporter [*Haemophilus influenzae*] | 61 | 38 | 1344 |
| 283 | 1 | 1 | 366 | gi\|755607 | polyA polymerase [*Bacillus subtilis*] | 61 | 36 | 366 |
| 288 | 2 | 1496 | 1074 | gi\|388108 | cell wall enzyme [*Enterococcus faecalis*] | 61 | 43 | 423 |
| 291 | 1 | 86 | 334 | gi\|454265 | FBP3 [*Petunia hybrida*] | 61 | 38 | 249 |
| 318 | 1 | 694 | 284 | gi\|290531 | similar to beta-glucoside transport protein [*Escherichia coli*] sp\|P31451\|PTIB_ECOLI PTS SYSTEM, ARBUTIN-LIKE IIB COMPONENT PHOSPHOTRANSFERASE ENZYME II, B COMPONENT) (EC 2.7.1.69). | 61 | 47 | 411 |
| 330 | 2 | 1190 | 468 | gi\|1001805 | hypothetical protein [*Synechocystis sp.*] | 61 | 41 | 723 |
| 385 | 2 | 1025 | 537 | gi\|533098 | DnaD protein [*Bacillus subtilis*] | 61 | 42 | 489 |
| 426 | 1 | 399 | 4 | gi\|1303853 | YqgF [*Bacillus subtilis*] | 61 | 44 | 396 |
| 438 | 3 | 810 | 1421 | gi\|1293660 | AbsA2 [*Streptomyces coelicolor*] | 61 | 36 | 612 |
| 454 | 1 | 792 | 4 | gi\|733522 | phosphatidylinositol-4,5-diphosphate 3-kinase [*Dictyostelium iscoideum*] | 61 | 30 | 789 |
| 464 | 2 | 560 | 336 | gi\|1123120 | C53B7.5 gene product [*Caenorhabditis elegans*] | 61 | 38 | 225 |
| 470 | 8 | 6077 | 7357 | gi\|623073 | ORF360; putative [Bacteriophage LL-H] | 61 | 47 | 1281 |
| 509 | 1 | 279 | 4 | gi\|467484 | unknown [*Bacillus subtilis*] | 61 | 45 | 276 |
| 555 | 3 | 1296 | 676 | gi\|141800 | anthranilate synthase glutamine amidotransferase [*Acinetobacter alcoaceticus*] | 61 | 42 | 621 |
| 569 | 1 | 857 | 3 | gi\|467090 | B2235_C2_195 [*Mycobacterium leprae*] | 61 | 47 | 855 |
| 585 | 2 | 803 | 645 | sp\|P36686\|SURE_ | SURVIVAL PROTEIN SURE HOMOLOG (FRAGMENT). | 61 | 33 | 159 |
| 592 | 3 | 1422 | 1150 | gi\|1221602 | immunity repressor protein [*Haemophilus influenzae*] | 61 | 32 | 273 |

TABLE 2-continued

| | | | | | | | | |
|---|---|---|---|---|---|---|---|---|
| 603 | 1 | 43 | 357 | gi\|507738 | Hmp [*Vibrio parahaemolyticus*] | 61 | 33 | 315 |
| 669 | 1 | 1235 | 3 | gi\|1146243 | 22.4% identity with *Escherichia coli* DNA-damage inducible protein . . .; putative [*Bacillus subtilis*] | 61 | 37 | 1233 |
| 675 | 3 | 805 | 1101 | gi\|403373 | glycerophosphoryl diester phosphodiesterase [*Bacillus subtilis*] pir\|S37251\|S37251 glycerophosphoryl diester phosphodiesterase - acillus subtilis | 61 | 36 | 297 |
| 703 | 1 | 829 | 2 | gi\|537181 | ORF_f470 [*Escherichia coli*] | 61 | 32 | 828 |
| 728 | 1 | 816 | 4 | gi\|806281 | DNA polymerase I [*Bacillus stearothermophilus*] | 61 | 39 | 813 |
| 821 | 1 | 61 | 318 | gi\|709992 | hypothetical protein [*Bacillus subtilis*] | 61 | 38 | 258 |
| 856 | 2 | 1567 | 821 | gi\|609310 | portal protein gp3 [*Bacteriophage HK97*] | 61 | 40 | 747 |
| 923 | 1 | 542 | 3 | gi\|143213 | putative [*Bacillus subtilis*] | 61 | 38 | 540 |
| 1124 | 1 | 59 | 370 | gi\|1107541 | C33D9.8 [*Caenorhabditis elegans*] | 61 | 26 | 312 |
| 1492 | 1 | 276 | 4 | gi\|406397 | unknown [*Mycoplasma genitalium*] | 61 | 32 | 273 |
| 1602 | 1 | 46 | 318 | gi\|733522 | phosphatidylinositol-4,5-diphosphate 3-kinase [*Dictyostelium iscoideum*] | 61 | 34 | 273 |
| 2500 | 1 | 290 | 3 | gi\|1045964 | hypothetical protein (GB:U14003_297) [*Mycoplasma genitalium*] | 61 | 31 | 288 |
| 2968 | 1 | 2 | 808 | gi\|397526 | clumping factor [*Staphylococcus aureus*] | 61 | 55 | 807 |
| 3076 | 1 | 3 | 248 | gi\|149373 | ORF 1 [*Lactococcus lactis*] | 61 | 41 | 246 |
| 3609 | 2 | 207 | 401 | gi\|1408501 | homologous to N-acyl-L-amino acid amidohydrolase of *Bacillus stearothermophilus* [*Bacillus subtilis*] | 61 | 39 | 195 |
| 3662 | 1 | 740 | 3 | gi\|1303813 | YqeW [*Bacillus subtilis*] | 61 | 42 | 738 |
| 3672 | 1 | 2 | 442 | gi\|784897 | beta-N-acetylhexosaminidase [*Streptococcus pneumoniae*] pir\|A56390\|A56390 mannosyl-glycoprotein ndo-beta-N-acetyl-glucosaminidase (EC 3.2.1.96) precursor - treptococcus pneumoniae | 61 | 50 | 441 |
| 3724 | 1 | 2 | 220 | gi\|1009366 | Respiratory nitrate reductase [*Bacillus subtilis*] | 61 | 41 | 219 |
| 3728 | 1 | 3 | 398 | gi\|677943 | AppD [*Bacillus subtilis*] | 61 | 46 | 396 |
| 3884 | 1 | 3 | 401 | gi\|784897 | beta-N-acetylhexosaminidase [*Streptococcus pneumoniae*] pir\|A56390\|A56390 mannosyl-glycoprotein ndo-beta-N-acetyl-glucosaminidase (EC 3.2.1.96) precursor - treptococcus pneumoniae | 61 | 47 | 399 |
| 3971 | 1 | 3 | 383 | gi\|784897 | beta-N-acetylhexosaminidase [*Streptococcus pneumoniae*] pir\|A56390\|A56390 mannosyl-glycoprotein ndo-beta-N-acetyl-glucosaminidase (EC 3.2.1.96) precursor - treptococcus pneumoniae | 61 | 45 | 381 |
| 4038 | 1 | 359 | 57 | gi\|1339950 | large subunit of NADH-dependent glutamate synthase [*Plectonema boryanum*] | 61 | 24 | 303 |
| 4041 | 1 | 274 | 2 | gi\|413953 | ipa-29d gene product [*Bacillus subtilis*] | 61 | 48 | 273 |
| 4047 | 1 | 1 | 402 | gi\|528991 | unknown [*Bacillus subtilis*] | 61 | 42 | 402 |
| 4102 | 1 | 1 | 345 | gi\|976025 | HrsA [*Escherichia coli*] | 61 | 46 | 345 |
| 4155 | 1 | 1 | 336 | gi\|784897 | beta-N-acetylhexosaminidase [*Streptococcus pneumoniae*] pir\|A56390\|A56390 mannosyl-glycoprotein ndo-beta-N-acetyl-glucosaminidase (EC 3.2.1.96) precursor - treptococcus pneumoniae | 61 | 50 | 336 |
| 4268 | 1 | 233 | 3 | gi\|450688 | hsdM gene of EcoprrI gene product [*Escherichia coli*] pir\|S38437\|S38437 hsdM protein - *Escherichia coli* pir\|S09629\|S09629 hypothetical protein A - *Escherichia coli* (SUB 40–520) | 61 | 38 | 231 |
| 4374 | 1 | 273 | 4 | gi\|784897 | beta-N-acetylhexosaminidase [*Streptococcus pneumoniae*] pir\|A56390\|A56390 mannosyl-glycoprotein ndo-beta-N-acetyl-glucosaminidase (EC 3.2.1.96) precursor - treptococcus pneumoniae | 61 | 50 | 270 |
| 4389 | 1 | 2 | 172 | gi\|147516 | ribokinase [*Escherichia coli*] | 61 | 35 | 171 |
| 4621 | 1 | 2 | 268 | gi\|784897 | beta-N-acetylhexosaminidase [*Streptococcus pneumoniae*] pir\|A56390\|A56390 mannosyl-glycoprotein ndo-beta-N-acetyl-glucosaminidase (EC 3.2.1.96) precursor - treptococcus pneumoniae | 61 | 47 | 267 |
| 4663 | 1 | 27 | 227 | gi\|976025 | HrsA [*Escherichia coli*] | 61 | 50 | 201 |
| 4 | 6 | 5536 | 4409 | gi\|1408501 | homologous to N-acyl-L-amino acid amidohydrolase of *Bacillus stearothermophilus* [*Bacillus subtilis*] | 60 | 43 | 1128 |
| 11 | 6 | 3426 | 3725 | gi\|410748 | ring-infested erythrocyte surface antigen [*Plasmodium falciparum*] pir\|A25526\|A25526 ring-infected erythrocyte surface antigen recursor - *Plasmodium falciparum* (strain FC27/Papua New Guinea) sp\|P13830\|RESA_PLAFF RING-INFECTED ERYTHROCYTE SURFACE ANTIGEN RE | 60 | 24 | 300 |
| 11 | 14 | 10313 | 9591 | gi\|1217651 | carbonyl reductase (NADPH) [*Rattus norvegicus*] | 60 | 28 | 723 |
| 16 | 12 | 11917 | 12930 | gi\|1001453 | hypothetical protein [*Synechocystis sp.*] | 60 | 37 | 1014 |
| 33 | 1 | 26 | 469 | gi\|388109 | regulatory protein [*Enterococcus faecalis*] | 60 | 41 | 444 |
| 37 | 13 | 9834 | 8854 | gi\|1336656 | Orf1 [*Bacillus subtilis*] | 60 | 40 | 981 |
| 39 | 4 | 4364 | 4522 | gi\|4872 | ORF 4 [*Saccharomyces kluyveri*] | 60 | 47 | 159 |
| 41 | 1 | 1025 | 3 | gi\|142822 | D-alanine racemase cds [*Bacillus subtilis*] | 60 | 39 | 1023 |
| 43 | 4 | 2474 | 3607 | gi\|468046 | para-nitrobenzyl esterase [*Bacillus subtilis*] | 60 | 40 | 1134 |
| 44 | 10 | 6756 | 7769 | gi\|414234 | thiF [*Escherichia coli*] | 60 | 52 | 1014 |
| 45 | 10 | 8874 | 9074 | gi\|343949 | var1 (40.0) [*Saccharomyces cerevisiae*] | 60 | 44 | 201 |
| 56 | 18 | 26430 | 25018 | gi\|468764 | mocR gene product [*Rhizobium meliloti*] | 60 | 35 | 1413 |
| 60 | 2 | 173 | 388 | gi\|1303864 | YqgQ [*Bacillus subtilis*] | 60 | 33 | 216 |
| 63 | 2 | 357 | 1619 | gi\|467124 | ureD; B229_C3_234 [*Mycobacterium leprae*] | 60 | 43 | 1263 |
| 69 | 1 | 395 | 3 | gi\|1518853 | OafA [*Salmonella typhimurium*] | 60 | 36 | 393 |
| 88 | 1 | 1 | 1188 | gi\|1480429 | putative transcriptional regulator [*Bacillus stearothermophilus*] | 60 | 30 | 1188 |
| 92 | 6 | 3881 | 3027 | gi\|349227 | transmembrane protein [*Escherichia coli*] | 60 | 37 | 855 |
| 92 | 7 | 4923 | 3850 | gi\|466613 | nikB [*Escherichia coli*] | 60 | 38 | 1074 |
| 93 | 1 | 476 | 3 | gi\|1510925 | coenzyme F420-reducing hydrogenase, beta subunit [*Methanococcus jannaschii*] | 60 | 27 | 474 |
| 96 | 6 | 7366 | 7578 | gi\|972715 | accessory protein [*Carnobacterium piscicola*] | 60 | 30 | 213 |
| 98 | 6 | 3212 | 4069 | gi\|467425 | unknown [*Bacillus subtilis*] | 60 | 42 | 858 |

TABLE 2-continued

| | | | | | | | | |
|---|---|---|---|---|---|---|---|---|
| 102 | 10 | 7158 | 7430 | gi|143092 | acetolactate synthase small subunit [Bacillus subtilis] sp|P37252|ILVN_BACSU ACETOLACTATE SYNTHASE SMALL SUBUNIT (EC .1.3.18) (AHAS) (ACETOHYDROXY-ACID SYNTHASE SMALL SUBUNIT) (ALS). | 60 | 37 | 273 |
| 109 | 11 | 9127 | 10515 | gi|1255259 | o-succinylbenzoic acid (OSB) CoA ligase [Staphylococcus aureus] | 60 | 28 | 1389 |
| 109 | 12 | 10499 | 11656 | gi|141954 | beta-ketothiolase [Alcaligenes eutrophus] | 60 | 41 | 1158 |
| 119 | 2 | 3134 | 1638 | gi|1524280 | unknown [Mycobacterium tuberculosis] | 60 | 45 | 1497 |
| 121 | 9 | 6957 | 7646 | gi|1107529 | ceuC gene product [Campylobacter coli] | 60 | 35 | 690 |
| 140 | 7 | 6013 | 4322 | gi|146547 | kdpA [Escherichia coli] | 60 | 45 | 1692 |
| 145 | 1 | 2 | 703 | gi|1460077 | unknown [Mycobacterium tuberculosis] | 60 | 23 | 702 |
| 150 | 3 | 2216 | 1623 | gi|1146230 | putative [Bacillus subtilis] | 60 | 40 | 594 |
| 157 | 2 | 961 | 533 | gi|1303975 | YqjX [Bacillus subtilis] | 60 | 30 | 429 |
| 158 | 5 | 4769 | 4413 | gi|1449288 | unknown [Mycobacterium tuberculosis] | 60 | 36 | 357 |
| 159 | 1 | 257 | 3 | gi|580932 | murD gene product [Bacillus subtilis] | 60 | 43 | 255 |
| 160 | 1 | 159 | 1187 | gi|1204532 | hypothetical protein (GB:L19201_29) [Haemophilus influenzae] | 60 | 34 | 1029 |
| 161 | 14 | 7866 | 7483 | gi|1496003 | ORF3; PepY; putative oligoendopeptidase based on homology with Lactococcus lactis PepF (GenBank Accession Number Z32522) [Caldicellulosiruptor saccharolyticus] | 60 | 34 | 384 |
| 172 | 3 | 1331 | 2110 | gi|485280 | 28.2 kDa protein [Streptococcus pneumoniae] | 60 | 33 | 780 |
| 173 | 2 | 2460 | 838 | gi|1524397 | glycine betaine transporter OpuD [Bacillus subtilis] | 60 | 41 | 1623 |
| 173 | 4 | 4953 | 3943 | gi|1100737 | NADP dependent leukotreine b4 12-hydroxydehydrogenase [Sus scrofa] | 60 | 44 | 1011 |
| 198 | 1 | 3 | 995 | gi|413943 | ipa-19d gene product [Bacillus subtilis] | 60 | 42 | 993 |
| 201 | 4 | 3641 | 4573 | sp|P37028|YADT_ | HYPOTHETICAL 29.4 KD PROTEIN IN HEML-PFS INTERGENIC REGION PRECURSOR. | 60 | 37 | 933 |
| 203 | 3 | 2415 | 1561 | gi|927798 | D9719.34p; CAI: 0.14 [Saccharomyces cerevisiae] | 60 | 43 | 855 |
| 206 | 9 | 12234 | 12515 | sp|P37347|YECD_ | HYPOTHETICAL 21.8 KD PROTEIN IN ASPS 5' REGION. | 60 | 47 | 282 |
| 212 | 4 | 1213 | 1410 | gi|332711 | hemagglutinin-neuraminidase fusion protein [Human parainfluenza irus 3] | 60 | 34 | 198 |
| 214 | 1 | 65 | 1153 | gi|1204366 | hypothetical protein (GB:U14003_130) [Haemophilus influenzae] | 60 | 36 | 1089 |
| 237 | 1 | 2 | 937 | gi|149377 | HisD [Lactococcus lactis] | 60 | 40 | 936 |
| 241 | 6 | 4998 | 4300 | gi|1046160 | hypothetical protein (GB:U00021_5) [Mycoplasma genitalium] | 60 | 37 | 699 |
| 260 | 6 | 5919 | 6485 | gi|431950 | similar to a B. subtilis gene (GB: BACHEMEHY_5) [Clostridium asteurianum] | 60 | 35 | 567 |
| 264 | 1 | 1218 | 4 | gi|397526 | clumping factor [Staphylococcus aureus] | 60 | 53 | 1215 |
| 267 | 1 | 3 | 1409 | gi|148316 | NaH-antiporter protein [Enterococcus hirae] | 60 | 27 | 1407 |
| 275 | 3 | 3804 | 4595 | pir|F36889|F368 | leuD 3'-region hypothetical protein - Lactococcus lactis subsp. lactis (strain IL1403) | 60 | 35 | 792 |
| 291 | 3 | 860 | 1198 | gi|1208889 | coded for by C. elegans cDNA yk130e12.5; contains C2H2-type zinc fingers [Caenorhabditis elegans] | 60 | 33 | 339 |
| 307 | 6 | 3176 | 2931 | gi|1070014 | protein-dependent [Bacillus subtilis] | 60 | 36 | 246 |
| 316 | 8 | 4957 | 5823 | gi|413952 | ipa-28d gene product [Bacillus subtilis] | 60 | 41 | 867 |
| 328 | 4 | 2996 | 3484 | gi|1204484 | membrane-associated component, branched amino acid transport system [Haemophilus influenzae] | 60 | 39 | 489 |
| 332 | 5 | 4363 | 3839 | gi|1205449 | colicin V production protein (pur regulon) [Haemophilus influenzae] | 60 | 37 | 525 |
| 357 | 1 | 532 | 2 | gi|887842 | single-stranded DNA-specific exonuclease [Escherichia coli] | 60 | 41 | 531 |
| 375 | 2 | 96 | 362 | gi|4857 | adenylyl cyclase gene product [Saccharomyces kluyveri] r|JQ1145|OYBYK adenylate cyclase (EC 4.6.1.1) - yeast (ccharomyces kluyveri) | 60 | 47 | 267 |
| 397 | 1 | 66 | 416 | gi|709999 | Glucarate dehydratase [Bacillus subtilis] | 60 | 37 | 351 |
| 409 | 1 | 2 | 163 | gi|499700 | glycogen phosphorylase [Saccharomyces cerevisiae] | 60 | 35 | 162 |
| 453 | 4 | 914 | 1237 | gi|1196899 | unknown protein [Staphylococcus aureus] | 60 | 36 | 324 |
| 453 | 7 | 3620 | 3402 | sp|P12222|YCF1_ | HYPOTHETICAL 226 KD PROTEIN (ORF 1901). | 60 | 31 | 219 |
| 470 | 2 | 622 | 945 | pir|S30782|S307 | integrin homolog - yeast [Saccharomyces cerevisiae] | 60 | 31 | 324 |
| 500 | 1 | 118 | 606 | gi|467407 | unknown [Bacillus subtilis] | 60 | 36 | 489 |
| 503 | 3 | 752 | 982 | gi|167835 | myosin heavy chain [Dictyostelium discoideum] | 60 | 34 | 231 |
| 505 | 4 | 2238 | 3563 | gi|1510732 | NADH oxidase [Methanococcus jannaschii] | 60 | 26 | 1326 |
| 523 | 1 | 3 | 1043 | gi|143331 | alkaline phosphatase regulatory protein [Bacillus subtilis] pir|A27650|A27650 regulatory protein phoR - Bacillus subtilis sp|P23545|PHOR_BACSU ALKALINE PHOSPHATASE SYNTHESIS SENSOR PROTEIN HOR (EC 2.7.3.—]. | 65 | 41 | 1041 |
| 543 | 1 | 1 | 465 | gi|1511103 | cobalt transport ATP-binding protein O [Methanococcus jannaschii] | 60 | 40 | 465 |
| 545 | 1 | 1 | 726 | gi|1498192 | putative [Pseudomonas aeruginosa] | 60 | 40 | 726 |
| 556 | 1 | 2 | 1054 | gi|1477402 | tex gene product [Bordetella pertussis] | 60 | 42 | 1053 |
| 578 | 1 | 489 | 4 | gi|1205129 | H. influenzae predicted coding region HI0882 [Haemophilus influenzae] | 60 | 42 | 486 |
| 594 | 1 | 1 | 624 | gi|1212755 | adenylyl cyclase [Aeromonas hydrophila] | 60 | 45 | 624 |
| 604 | 1 | 3 | 530 | gi|145925 | fecB [Escherichia coli] | 60 | 42 | 528 |
| 620 | 1 | 465 | 4 | gi|1205483 | bicyclomycin resistance protein [Haemophilus influenzae] | 60 | 33 | 462 |
| 630 | 2 | 871 | 1122 | gi|1486242 | unknown [Bacillus subtilis] | 60 | 41 | 252 |
| 645 | 2 | 425 | 276 | gi|1205136 | serine hydroxymethyltransferase (serine methylase) [Haemophilus influenzae] | 60 | 28 | 150 |
| 684 | 1 | 843 | 604 | gi|1205538 | hypothetical protein (GB:U14003_302) [Haemophilus influenzae] | 60 | 39 | 240 |
| 786 | 1 | 485 | 3 | gi|1402944 | orfRM1 gene product [Bacillus subtilis] | 60 | 46 | 483 |
| 844 | 1 | 346 | 104 | gi|790943 | urea amidolyase [Bacillus subtilis] | 60 | 40 | 243 |
| 851 | 1 | 1 | 726 | gi|159661 | GMP reductase [Ascaris lumbricoides] | 60 | 41 | 726 |

TABLE 2-continued

| | | | | | | | | |
|---|---|---|---|---|---|---|---|---|
| 871 | 1 | 874 | 2 | gi\|1001493 | hypothetical protein [*Synechocystis sp.*] | 60 | 39 | 873 |
| 896 | 1 | 839 | 120 | gi\|604926 | NADH dehydrogenase, subunit 5 [*Schizophyllum commune*] sp\|P50368\|NU5M_SCHCO NADH-UBIQUINONE OXIDOREDUCTASE CHAIN 5 (EC .6.5.3). | 60 | 39 | 720 |
| 908 | 2 | 448 | 753 | gi\|662880 | novel hemolytic factor [*Bacillus cereus*] | 60 | 31 | 306 |
| 979 | 1 | 2 | 595 | gi\|1429255 | putative; orf1 [*Bacillus subtilis*] | 60 | 30 | 594 |
| 1078 | 1 | 502 | 335 | gi\|581055 | inner membrane copper tolerance protein [*Escherichia coli*] gi\|871029 disulphide isomerase like protein [*Escherichia coli*] pir\|S47295\|S47295 inner membrane copper tolerance protein - scherichia coli | 60 | 40 | 168 |
| 1112 | 1 | 620 | 90 | gi\|407885 | ORF3 [*Streptomyces griseus*] | 60 | 34 | 531 |
| 1135 | 1 | 275 | 66 | gi\|1171407 | Vps8p [*Saccharomyces cerevisiae*] | 60 | 36 | 210 |
| 1146 | 1 | 17 | 562 | gi\|1239981 | hypothetical protein [*Bacillus subtilis*] | 60 | 36 | 546 |
| 1291 | 1 | 360 | 4 | pir\|S57530\|S575 | carboxyl esterase - *Acintobacter calcoaceticus* | 60 | 30 | 357 |
| 1332 | 1 | 169 | 2 | gi\|1222056 | aminotransferase [*Haemophilus influenzae*] | 60 | 44 | 168 |
| 1429 | 1 | 3 | 146 | gi\|1205619 | ferritin like protein [*Haemophilus influenzae*] | 60 | 39 | 144 |
| 1722 | 1 | 286 | 2 | gi\|240052 | dihydroflavonol-4-reductase, DFR [*Hordeum vulgare*=barley, cv. Gula, eptide, 354 aa] | 60 | 36 | 285 |
| 2350 | 1 | 200 | 15 | gi\|497626 | ORF 1 [Plasmid pAQ1] | 60 | 20 | 186 |
| 2936 | 1 | 310 | 101 | gi\|508981 | prephenate dehydratase [*Bacillus subtilis*] | 60 | 48 | 210 |
| 3027 | 1 | 302 | 36 | gi\|1146199 | putative [*Bacillus subtilis*] | 60 | 37 | 267 |
| 3084 | 1 | 20 | 208 | gi\|1407784 | orf-1; novel antigen [*Staphylococcus aureus*] | 60 | 51 | 189 |
| 3155 | 1 | 2 | 226 | gi\|1046097 | cytadherence-accessory protein [*Mycoplasma genitalium*] | 60 | 34 | 225 |
| 3603 | 1 | 186 | 4 | gi\|510108 | mitochondrial long-chain enoyl-CoA hydratase/3-hydroxycyl-CoA ehydrogenase alpha-subunit [*Rattus norvegicus*] | 60 | 42 | 183 |
| 3665 | 1 | 244 | 2 | gi\|151259 | HMG-CoA reductase (EC 1.1.1.88) [*Pseudomonas mevalonii*] pir\|A44756\|A44756 hydroxymethylglutaryl-CoA reductase (EC 1.1.1.88) Pseudomonas sp. | 60 | 42 | 243 |
| 3747 | 1 | 3 | 146 | gi\|474192 | iucC gene product [*Escherichia coli*] | 60 | 36 | 144 |
| 3912 | 1 | 3 | 335 | gi\|1488695 | novel antigen; orf-2 [*Staphylococcus aureus*] | 60 | 44 | 333 |
| 4072 | 1 | 3 | 272 | gi\|405879 | yeiH [*Escherichia coli*] | 60 | 33 | 270 |
| 4134 | 1 | 352 | 194 | gi\|780656 | chemoreceptor protein [*Rhizobium leguminosarum* bv. *viciae*] gi\|780656 chemoreceptor protein [*Rhizobium leguminosarum* bv. iciae] | 60 | 28 | 159 |
| 4207 | 2 | 402 | 127 | gi\|602031 | similar to trimethylamine DH [*Mycoplasma capricolum*] pir\|S49950\|S49950 probable trimethylamine dehydrogenase (EC .5.99.7) - *Mycoplasma capricolum* (SGC3) (fragment) | 60 | 41 | 276 |
| 4243 | 1 | 127 | 324 | gi\|899317 | peptide synthetase module [*Microcystis aeruginosa*] pir\|S49111\|S49111 probable amino acid activating domain - icrocystis aeruginosa (fragment) (SUB 144–528) | 60 | 42 | 198 |
| 4310 | 1 | 313 | 2 | gi\|508980 | pheB [*Bacillus subtilis*] | 60 | 28 | 312 |
| 4345 | 1 | 173 | 3 | gi\|510108 | mitochondrial long-chain enoyl-CoA hydratase/3-hydroxycyl-CoA ehydrogenase alpha-subunit [*Rattus norvegicus*] | 60 | 42 | 171 |
| 4382 | 1 | 280 | 62 | gi\|47382 | acyl-CoA-dehydrogenase [*Streptomyces purpurascens*] | 60 | 48 | 219 |
| 4474 | 1 | 53 | 223 | gi\|510108 | mitochondrial long-chain enoyl-CoA hydratase/3-hydroxycyl-CoA ehydrogenase alpha-subunit [*Rattus norvegicus*] | 60 | 42 | 171 |
| 23 | 4 | 3523 | 2528 | gi\|426446 | VipB protein [*Salmonella typhi*] | 59 | 39 | 996 |
| 33 | 2 | 707 | 1483 | pir\|S48604\|S486 | hypothetical protein - *Mycoplasma capricolum* (SGC3) (fragment) | 59 | 33 | 777 |
| 33 | 5 | 4651 | 5853 | gi\|6721 | F59B2.3 [*Caenorhabditis elegans*] | 59 | 33 | 1203 |
| 37 | 2 | 2299 | 1370 | gi\|142833 | ORF2 [*Bacillus subtilis*] | 59 | 37 | 930 |
| 38 | 21 | 16593 | 16402 | gi\|912576 | BiP [*Phaeodactylum tricornutum*] | 59 | 40 | 192 |
| 52 | 3 | 2349 | 2050 | gi\|536972 | ORF_o90a [*Escherichia coli*] | 59 | 44 | 300 |
| 54 | 12 | 13402 | 12623 | gi\|483940 | transcription regulator [*Bacillus subtilis*] | 59 | 37 | 780 |
| 57 | 3 | 3339 | 2281 | gi\|508176 | Gat-1-P-DH, NAD dependent [*Escherichia coli*] | 59 | 40 | 1059 |
| 66 | 1 | 495 | 4 | gi\|1303901 | YqhT [*Bacillus subtilis*] | 59 | 34 | 492 |
| 67 | 7 | 6552 | 7460 | gi\|912461 | nikC [*Escherichia coli*] | 59 | 37 | 909 |
| 70 | 7 | 5383 | 6366 | gi\|1399822 | PhoD precursor [*Rhizobium meliloti*] | 59 | 46 | 984 |
| 78 | 1 | 1 | 1449 | gi\|971345 | unknown, similar to *E. coli* cardiolipin synthase [*Bacillus subtilis*] sp\|P45860\|YWIE_BACSU HYPOTHETICAL 58.2 PROTEIN IN NARI-ACDA NTERGENIC REGION. | 59 | 39 | 1449 |
| 82 | 10 | 14329 | 15534 | gi\|490328 | LORF F (unidentified) | 59 | 44 | 1206 |
| 89 | 2 | 958 | 314 | gi\|642801 | unknown [*Saccharomyces cerevisiae*] | 59 | 32 | 645 |
| 96 | 4 | 4940 | 5473 | gi\|1333802 | protein of unknown function [*Rhodobacter capsulatus*] | 59 | 33 | 534 |
| 98 | 1 | 2 | 820 | gi\|467421 | similar to *B. subtilis* DnaH [*Bacillus subtilis*] | 59 | 34 | 819 |
| 119 | 1 | 166 | 1557 | gi\|143122 | ORF B; putative [*Bacillus firmus*] | 59 | 36 | 1392 |
| 120 | 10 | 6214 | 6756 | gi\|15354 | ORF 55.9 [Bacteriophage T4] | 59 | 39 | 543 |
| 120 | 16 | 12476 | 13510 | gi\|1086575 | BetA [*Rhizobium meliloti*] | 59 | 44 | 1035 |
| 123 | 1 | 195 | 4 | gi\|984737 | catalase [*Campylobacter jejuni*] | 59 | 38 | 192 |
| 130 | 1 | 370 | 645 | gi\|1256634 | 25.8% identity over 120 aa with the Synenococcus sp. MpeV protein; putative [*Bacillus subtilis*] | 59 | 31 | 276 |
| 131 | 4 | 5278 | 5712 | gi\|1510655 | hypothetical protein (SP:P42297) [*Methanococcus jannaschii*] | 59 | 39 | 435 |
| 164 | 1 | 3 | 509 | gi\|1001342 | hypothetical protein [*Synechocystis sp.*] | 59 | 41 | 507 |
| 164 | 4 | 1529 | 2821 | gi\|1205165 | hypothetical protein (SP:P37764) [*Haemophilus influenzae*] | 59 | 35 | 1293 |
| 164 | 19 | 19643 | 21376 | gi\|1001381 | hypothetical protein [*Synechocystis sp.*] | 59 | 34 | 1734 |
| 173 | 3 | 3717 | 2707 | gi\|1184121 | auxin-induced protein [*Vigna radiata*] | 59 | 50 | 1011 |
| 179 | 2 | 1688 | 1158 | gi\|143036 | unidentified gene product [*Bacillus subtilis*] | 59 | 33 | 531 |
| 195 | 12 | 11503 | 10337 | gi\|762778 | NifS gene product [*Anabaena azollae*] | 59 | 41 | 1167 |

TABLE 2-continued

| | | | | | | | |
|---|---|---|---|---|---|---|---|
| 201 | 5 | 4702 | 5670 | gi\|1510240 | hemin permease [*Methanococcus jannaschii*] | 59 | 32 | 969 |
| 201 | 7 | 5719 | 6315 | gi\|1511456 | *M. jannaschii* predicted coding region MJ1437 [*Methanococcus jannaschii*] | 59 | 34 | 597 |
| 209 | 1 | 102 | 461 | gi\|1204666 | hypothetical protein (GB:X73124_53) [*Haemophilus influenzae*] | 59 | 42 | 360 |
| 214 | 3 | 1050 | 2234 | gi\|551531 | 2-nitropropane dioxygenase [*Williopsis saturnus*] | 59 | 36 | 1185 |
| 214 | 5 | 3293 | 4135 | gi\|1303709 | YrkJ [*Bacillus subtilis*] | 59 | 32 | 843 |
| 217 | 2 | 2167 | 953 | gi\|290489 | dfp (CG Site No. 18430) [*Escherichia coli*] | 59 | 44 | 1215 |
| 237 | 5 | 3078 | 3785 | gi\|149382 | HisA [*Lactococcus lactis*] | 59 | 38 | 708 |
| 251 | 2 | 376 | 960 | gi\|1303791 | YqeJ [*Bacillus subtilis*] | 59 | 34 | 585 |
| 286 | 1 | 812 | 3 | gi\|146551 | transmembrane protein (dkpD) [*Escherichia coli*] | 59 | 31 | 810 |
| 316 | 5 | 3860 | 2742 | gi\|405879 | yeiH [*Escherichia coli*] | 59 | 32 | 1119 |
| 370 | 3 | 600 | 761 | gi\|1303794 | YqeM [*Bacillus subtilis*] | 59 | 35 | 162 |
| 382 | 1 | 506 | 3 | gi\|547513 | orf3 [*Haemophilus influenzae*] | 59 | 34 | 504 |
| 391 | 3 | 1273 | 926 | gi\|152901 | ORF 3 [*Spirochaeta aurantia*] | 59 | 37 | 348 |
| 406 | 3 | 1705 | 605 | gi\|709992 | hypothetical protein [*Bacillus subtilis*] | 59 | 34 | 1101 |
| 426 | 5 | 3245 | 2688 | gi\|1204610 | iron(III) dicitrate transport ATP-binding protein FECE [*Haemophilus influenzae*] | 59 | 36 | 558 |
| 429 | 2 | 1148 | 783 | gi\|1064809 | homologous to sp:HTRA_ECOLI [*Bacillus subtilis*] | 59 | 42 | 366 |
| 460 | 2 | 708 | 1301 | gi\|466882 | pps1; B1496_C2_189 [*Mycobacterium leprae*] | 59 | 37 | 594 |
| 461 | 4 | 2212 | 3135 | gi\|1498295 | homoserine kinase homolog [*Streptococcus pneumoniae*] | 59 | 37 | 924 |
| 473 | 1 | 1607 | 285 | gi\|147989 | trigger factor [*Escherichia coli*] | 59 | 40 | 1323 |
| 480 | 8 | 5862 | 6110 | gi\|1205311 | (3R)-hydroxymyristol acyl carrier protein dehydrase [*Haemophilus influenzae*] | 59 | 40 | 249 |
| 521 | 1 | 14 | 1354 | pir\|A25620\|A256 | staphylocoagulase - *Staphylococcus aureus* (fragment) | 59 | 32 | 1341 |
| 534 | 4 | 2994 | 4073 | gi\|153746 | mannitol-phosphate dehydrogenase [*Streptococcus mutans*] pir\|C44798\|C44798 mannitol-phosphate dehydrogenase Mt1D - treptococcus mutans | 59 | 36 | 1080 |
| 535 | 1 | 1 | 954 | gi\|1469939 | group B oligopeptidase PepB [*Streptococcus agalactiae*] | 59 | 33 | 954 |
| 551 | 3 | 2836 | 3186 | gi\|1204511 | bacterioferritin comigratory protein [*Haemophilus influenzae*] | 59 | 45 | 351 |
| 573 | 2 | 449 | 940 | gi\|386681 | ORF YAL022 [*Saccharomyces cerevisiae*] | 59 | 36 | 492 |
| 650 | 1 | 5 | 748 | gi\|396400 | similar to eukaryotic Na+/H+ exchangers [*Escherichia coli*] sp\|P32703\|YJCE_ECOLI HYPOTHETICAL 60.5 KD PROTEIN IN SOXR-ACS NTERGENIC REGION (O549). | 59 | 30 | 744 |
| 664 | 1 | 285 | 4 | gi\|1262748 | LukF-PV like component [*Staphylococcus aureus*] | 59 | 33 | 282 |
| 670 | 1 | 3 | 455 | gi\|1122758 | unknown [*Bacillus subtilis*] | 59 | 42 | 453 |
| 674 | 3 | 543 | 929 | gi\|293033 | integrase [Bacteriophage phi-LC3] | 59 | 46 | 387 |
| 758 | 1 | 176 | 3 | gi\|1500472 | *M. jannaschii* predicted coding region MJ1577 [*Methanococcus jannaschii*] | 59 | 37 | 174 |
| 771 | 2 | 1461 | 652 | gi\|522150 | bromoperoxidcase BPO-A1 [*Streptomyces aureofaciens*] sp\|P33912\|BPA1_STRAU NON-HAEM BROMOPEROXIDASE BPO-A1 (EC 1.11.1.—) (BROMIDE PEROXIDASE) (BPO1). (SUB 2–275) | 59 | 44 | 810 |
| 825 | 1 | 1097 | 3 | gi\|397526 | clumping factor [*Staphylococcus aureus*] | 59 | 47 | 1095 |
| 1052 | 2 | 723 | 352 | gi\|289262 | comE ORF3 [*Bacillus subtilis*] | 59 | 36 | 372 |
| 1152 | 1 | 188 | 3 | gi\|1276668 | ORF238 gene product [*Porphyra purpurea*] | 59 | 37 | 186 |
| 1198 | 1 | 247 | 2 | gi\|142439 | ATP-dependent nuclease [*Bacillus subtilis*] | 59 | 26 | 246 |
| 1441 | 1 | 235 | 2 | gi\|1045942 | glycyl-tRNA synthetase [*Mycoplasma genitalium*] | 59 | 37 | 234 |
| 2103 | 1 | 1 | 186 | gi\|459250 | triacylglycerol lipase [*Galactomyces geotrichum*] | 59 | 33 | 186 |
| 2205 | 1 | 398 | 3 | gi\|1303794 | YqeM [*Bacillus subtilis*] | 59 | 38 | 396 |
| 2578 | 1 | 284 | 84 | gi\|258003 | insulin-like growth factor binding protein complex acid-labile ubunit [rats, liver, Peptide, 603 aa] | 59 | 48 | 201 |
| 2967 | 2 | 145 | 348 | gi\|1212730 | YqhK [*Bacillus subtilis*] | 59 | 44 | 204 |
| 3012 | 1 | 3 | 248 | gi\|773571 | neurofilament protein NF70 [*Helix aspersa*] | 59 | 31 | 246 |
| 3544 | 1 | 3 | 401 | gi\|1055218 | crotonase [*Clostridium acetobutylicum*] | 59 | 42 | 399 |
| 3548 | 1 | 3 | 401 | gi\|1055218 | crotonase [*Clostridium acetobutylicum*] | 59 | 42 | 399 |
| 3580 | 1 | 351 | 4 | gi\|1055218 | crotonase [*Clostridium acetobutylicum*] | 59 | 42 | 348 |
| 3720 | 1 | 363 | 4 | gi\|1408494 | homologous to penicillin acylase [*Bacillus subtilis*] | 59 | 36 | 360 |
| 4171 | 1 | 3 | 296 | gi\|1055218 | crotonase [*Clostridium acetobutylicum*] | 59 | 42 | 294 |
| 4305 | 1 | 310 | 2 | gi\|1524193 | unknown [*Mycobacterium tuberculosis*] | 59 | 39 | 309 |
| 18 | 1 | 622 | 2 | gi\|146913 | N-acetylglucosamine transport protein [*Escherichia coli*] pir\|B29895\|WQEC2N phosphotransferase system enzyme II (EC .7.1.69), N-acetylglucosamine-specific - *Escherichia coli* sp\|P09323\|PTAA_ECOLI PTS SYSTEM, N-ACETYL-GLUCOSAMINE-SPECIFIC IIABC OMPONENT (EIIA) | 58 | 43 | 621 |
| 20 | 7 | 5845 | 4670 | gi\|50502 | collagen alpha chain precursor (AA −27 to 1127) [*Mus musculus*] | 58 | 50 | 1176 |
| 21 | 5 | 3234 | 3626 | gi\|1054860 | phosphoribosyl anthranilate isomerase [*Thermotoga maritima*] | 58 | 32 | 393 |
| 23 | 2 | 1669 | 497 | gi\|1276880 | EpsG [*Streptococcus thermophilus*] | 58 | 29 | 1173 |
| 23 | 10 | 8090 | 6879 | pir\|A31133\|A311 | diaminopimelate decarboxylase (EC 4.1.1.20) - *Pseudomonas aeruginosa* | 58 | 37 | 1212 |
| 38 | 29 | 22555 | 22884 | gi\|973249 | vestitone reductase [*Medicago sativa*] | 58 | 37 | 330 |
| 44 | 1 | 2 | 406 | gi\|289272 | ferrichrome-binding protein [*Bacillus subtilis*] | 58 | 33 | 405 |
| 45 | 1 | 1 | 552 | gi\|29464 | embryonic myosin heavy chain (1085 AA) [*Homo sapiens*] ir\|S12460\|S12460 myosin beta heavy chain - human | 58 | 33 | 552 |
| 55 | 2 | 538 | 317 | gi\|158852 | glucose regulated protein [*Echinococcus multilocularis*] | 58 | 32 | 222 |
| 62 | 13 | 8068 | 7643 | gi\|975353 | kinase-associated protein B [*Bacillus subtilis*] | 58 | 35 | 426 |
| 63 | 3 | 1553 | 1717 | gi\|166926 | [*Arabidopsis thaliana* unidentified mRNA sequence, complete cds.], ene product [*Arabidopsis thaliana*] | 58 | 35 | 165 |
| 67 | 13 | 11229 | 10441 | gi\|1228083 | NADH dehydrogenase subunit 2 [*Chorthippus parallelus*] | 58 | 41 | 789 |

TABLE 2-continued

| | | | | | | | | |
|---|---|---|---|---|---|---|---|---|
| 96 | 8 | 8208 | 9167 | gi\|709992 | hypothetical protein [*Bacillus subtilis*] | 58 | 42 | 960 |
| 107 | 2 | 1364 | 663 | gi\|806327 | *Escherichia coli* hrpA gene for A protein similar to yeast PRP16 and RP22 [*Escherichia coli*] | 58 | 37 | 702 |
| 112 | 7 | 4519 | 5613 | gi\|155588 | glucose-fructose oxidoreductase [*Zymomonas mobilis*] pir\|A42289\|A42289 glucose-fructose oxidoreductase (EC 1.1.—.—) recursor - *Zymomonas mobilis* | 58 | 38 | 1095 |
| 114 | 6 | 6503 | 5688 | gi\|1377843 | unknown [*Bacillus subtilis*] | 58 | 38 | 816 |
| 143 | 2 | 1395 | 529 | pir\|A45605\|A456 | mature-parasite-infected erythrocyte surface antigen MESA - *Plasmodium falciparum* | 58 | 31 | 867 |
| 151 | 2 | 717 | 950 | gi\|1370261 | unknown [*Mycobacterium tuberculosis*] | 58 | 31 | 234 |
| 154 | 6 | 4627 | 3239 | gi\|1209277 | pCTHom1 gene product [*Chlamydia trachomatis*] | 58 | 41 | 1389 |
| 154 | 16 | 13541 | 12801 | gi\|146613 | DNA ligase (EC 6.5.1.2) [*Escherichia coli*] | 58 | 39 | 741 |
| 155 | 3 | 1892 | 1515 | gi\|1303917 | YqiB [*Bacillus subtilis*] | 58 | 34 | 378 |
| 174 | 1 | 529 | 2 | gi\|904198 | hypothetical protein [*Bacillus subtilis*] | 58 | 26 | 528 |
| 189 | 4 | 1533 | 1769 | gi\|467383 | DNA binding protein (probable) [*Bacillus subtilis*] | 58 | 25 | 237 |
| 201 | 3 | 2669 | 3307 | gi\|1511453 | endonuclease III [*Methanococcus jannaschii*] | 58 | 34 | 639 |
| 208 | 1 | 2 | 238 | gi\|1276729 | phycobilisome linker polypeptide [*Porphyra purpurea*] | 58 | 29 | 237 |
| 220 | 11 | 13058 | 11541 | gi\|397526 | clumping factor [*Staphylococcus aureus*] | 58 | 51 | 1518 |
| 231 | 3 | 1474 | 1319 | gi\|1002520 | MutS [*Bacillus subtilis*] | 58 | 45 | 156 |
| 233 | 6 | 3497 | 2793 | gi\|1463023 | No definition line found [*Caenorhabditis elegans*] | 58 | 39 | 705 |
| 243 | 10 | 9303 | 10082 | gi\|537207 | ORF_f277 [*Escherichia coli*] | 58 | 32 | 780 |
| 257 | 1 | 331 | 1143 | gi\|1340128 | ORF1 [*Staphylococcus aureus*] | 58 | 44 | 813 |
| 302 | 2 | 460 | 801 | gi\|40174 | ORF X [*Bacillus subtilis*] | 58 | 34 | 342 |
| 307 | 11 | 6127 | 5270 | gi\|1303842 | YqfU [*Bacillus subtilis*] | 58 | 30 | 858 |
| 321 | 3 | 1914 | 2747 | gi\|1239996 | hypothetical protein [*Bacillus subtilis*] | 58 | 41 | 834 |
| 342 | 4 | 2724 | 3497 | gi\|454838 | ORF 6; putative [*Pseudomonas aeruginosa*] | 58 | 41 | 774 |
| 348 | 1 | 1 | 663 | gi\|467478 | unknown [*Bacillus subtilis*] | 58 | 36 | 663 |
| 401 | 2 | 384 | 605 | gi\|143407 | para-aminobenzoic acid synthase, component I (pab) [*Bacillus ubtilis*] | 58 | 53 | 222 |
| 437 | 1 | 325 | 1554 | gi\|1303866 | YqgS [*Bacillus subtilis*] | 58 | 35 | 1230 |
| 445 | 1 | 105 | 1442 | gi\|581583 | protein A [*Staphylococcus aureus*] | 58 | 32 | 1338 |
| 453 | 3 | 789 | 965 | gi\|1009455 | unknown [*Schizosaccharomyces pombe*] | 58 | 34 | 177 |
| 453 | 5 | 2047 | 1346 | gi\|537214 | yjjG gene product [*Escherichia coli*] | 58 | 40 | 702 |
| 479 | 2 | 731 | 1444 | gi\|1256621 | 26.7% of identity in 165 aa to a *Thermophilic bacterium* hypothetical protein 6; putative [*Bacillus subtilis*] | 56 | 36 | 714 |
| 490 | 1 | 547 | 185 | gi\|580920 | rodD (gtaA) polypeptide (AA 1–673) [*Bacillus subtilis*] pir\|S06048\|S06048 probable rodD protein - *Bacillus subtilis* sp\|P13484\|TAGE_BACSU PROBABLE POLY(GLYCEROL-PHOSPHATE) LPHA-GLUCOSYLTRANSFERASE (EC 2.4.1.52) (TECHOIC ACID BIOSYNTHESIS ROTEIN E). | 58 | 36 | 363 |
| 517 | 1 | 1 | 1164 | sp\|P47264\|Y018_ | HYPOTHETICAL HELICASE MG018. | 58 | 30 | 1164 |
| 517 | 6 | 4182 | 4544 | gi\|453422 | orf268 gene product [*Mycoplasma hominis*] | 58 | 29 | 363 |
| 546 | 3 | 2802 | 4019 | gi\|886052 | restriction modification system S subunit [*Spiroplasma citri*] gi\|886052 restriction modification system S subunit [*Spiroplasma itri*] | 58 | 37 | 1218 |
| 562 | 1 | 3 | 179 | gi\|43831 | nifS protein (AA 1–400) [*Klebsiella pneumoniae*] | 58 | 34 | 177 |
| 600 | 2 | 1156 | 965 | gi\|1183839 | unknown [*Pseudomonas aeruginosa*] | 58 | 48 | 192 |
| 604 | 2 | 1001 | 771 | gi\|1001353 | hypothetical protein [*Synechocystis* sp.] | 58 | 41 | 231 |
| 619 | 1 | 1 | 504 | gi\|903748 | integral membrane protein [*Homo sapiens*] | 58 | 43 | 504 |
| 625 | 1 | 2 | 364 | gi\|1208474 | hypothetical protein [*Synechocystis* sp.] | 58 | 43 | 363 |
| 635 | 1 | 755 | 18 | gi\|1510995 | transaldolase [*Methanococcus jannaschii*] | 58 | 41 | 738 |
| 645 | 1 | 1 | 846 | gi\|677882 | ileal sodium-dependent bile acid transporter [*Rattus norvegicus*] gi\|677882 ileal sodium-dependent bile acid transporter [*Rattus orvegicus*] | 58 | 33 | 846 |
| 645 | 3 | 906 | 1556 | gi\|1239999 | hypothetical protein [*Bacillus subtilis*] | 58 | 41 | 651 |
| 665 | 1 | 532 | 293 | gi\|1204262 | hypothetical protein (GB:L10328_61) [*Haemophilus influenzae*] | 58 | 39 | 240 |
| 674 | 1 | 327 | 19 | gi\|498817 | ORF8; homologous to small subunit of phage terminases [*Bacillus ubtilis*] | 58 | 39 | 309 |
| 675 | 2 | 806 | 300 | gi\|42181 | osmC gene product [*Escherichia coli*] | 58 | 28 | 507 |
| 745 | 1 | 310 | 2 | gi\|1205432 | coenzyme PQQ synthesis protein III (pqqIII) [*Haemophilus influenzae*] | 58 | 32 | 309 |
| 799 | 2 | 242 | 1174 | gi\|1204669 | collagenase [*Haemophilus influenzae*] | 58 | 36 | 933 |
| 800 | 2 | 614 | 132 | gi\|171963 | tRNA isopentenyl transferase [*Saccharomyces cerevisiae*] sp\|P07884\|MOD5_YEAST TRNA ISOPENTENYLTRANSFERASE (EC 2.5.1.8) ISOPENTENYLDIPHOSPHATE: TRNA ISO-PENTENYLTRANSFERASE) (IPP RANSFERASE) (IPPT). | 58 | 37 | 483 |
| 854 | 1 | 605 | 102 | gi\|466778 | lysine specific permease [*Escherichia coli*] | 58 | 44 | 504 |
| 885 | 1 | 242 | 3 | gi\|861199 | protoporphyrin IX Mg-chelatase subunit precursor [*Hordeum vulgare*] | 58 | 33 | 240 |
| 891 | 1 | 3 | 527 | gi\|1293660 | AbsA2 [*Streptomyces coelicolor*] | 58 | 31 | 525 |
| 942 | 1 | 467 | 3 | gi\|405567 | traH [Plasmid pSK41] | 58 | 30 | 465 |
| 1002 | 1 | 521 | 90 | gi\|577649 | preLUKM [*Staphylococcus aureus*] | 58 | 34 | 432 |
| 1438 | 1 | 1 | 261 | gi\|581558 | isoleucyl tRNA synthetase [*Staphylococcus aureus*] sp\|P41368\|SYIP_STAAU ISOLEUCYL-TRNA SYNTHETASE, MUPIROCIN RESISTANT (EC 6.1.1.5) (ISOLEUCIN--TRNA LIGASE) (ILERS) (MUPIROCIN RESISTANCE ROTEIN). | 58 | 30 | 261 |
| 1442 | 1 | 2 | 463 | gi\|971394 | similar to Acc. No. D26185 [*Escherichia coli*] | 58 | 34 | 462 |
| 1873 | 1 | 241 | 2 | gi\|1339951 | small subunit of NADH-dependent glutamate synthase [*Plectonema boryanum*] | 58 | 38 | 240 |
| 1876 | 1 | 3 | 158 | gi\|529216 | No definition line found [*Caenorhabditis elegans*] sp\|P46503\|YLX7_CAEEL HYPOTHETICAL 7.3 KD PROTEIN F23F12.7 IN HROMOSOME III. | 58 | 33 | 156 |

TABLE 2-continued

| | | | | | | | | |
|---|---|---|---|---|---|---|---|---|
| 1989 | 1 | 108 | 401 | gi\|1405458 | YneR [Bacillus subtilis] | 58 | 29 | 294 |
| 2109 | 1 | 3 | 401 | gi\|1001801 | hypothetical protein [Synechocystis sp.] | 58 | 31 | 399 |
| 2473 | 1 | 145 | 2 | gi\|510140 | ligoendopeptidase F [Lactococcus lactis] | 58 | 38 | 144 |
| 2523 | 1 | 228 | 4 | gi\|644873 | catabolic dehydroquinate dehydratase [Acinetobacter calcoaceticus] | 58 | 37 | 225 |
| 3041 | 1 | 2 | 211 | gi\|1205367 | oligopeptide transport ATP-binding protein [Haemophilus influenzae] | 58 | 39 | 210 |
| 3094 | 1 | 3 | 263 | gi\|1185288 | isochorismate synthase [Bacillus subtilis] | 58 | 38 | 261 |
| 3706 | 1 | 3 | 383 | gi\|456614 | mevalonate kinase [Arabidopsis thaliana] | 58 | 48 | 381 |
| 3854 | 1 | 1 | 402 | gi\|808869 | human gcp372 [Homo sapiens] | 58 | 32 | 402 |
| 4082 | 1 | 51 | 224 | gi\|508551 | ribulose-1,5 bisphosphate carboxylase large subunit - methyltransferase [Pisum sativum] | 58 | 37 | 174 |
| 4278 | 1 | 3 | 206 | gi\|180189 | cerebellar-degeneration-related antigen (CDR34) [Homo sapiens] gi\|182737 cerebellar degeneration-associated protein [Homo sapiens] pir\|A29770\|A29770 cerebellar degeneration-related protein - human | 58 | 37 | 204 |
| 19 | 7 | 7363 | 6908 | gi\|1001516 | hypothetical protein [Synechocystis sp.] | 57 | 31 | 456 |
| 23 | 11 | 8872 | 8081 | gi\|606066 | ORF_f256 [Escherichia coli] | 57 | 29 | 792 |
| 31 | 1 | 2402 | 3 | gi\|153146 | ORF3 [Streptomyces coelicolor] | 57 | 32 | 2400 |
| 38 | 14 | 10796 | 9981 | gi\|144859 | ORF B [Clostridium perfringens] | 57 | 31 | 816 |
| 46 | 14 | 12063 | 13046 | gi\|1001319 | hypothetical protein [Synechocystis sp.] | 57 | 25 | 984 |
| 51 | 3 | 1187 | 963 | pir\|B33856\|B338 | hypothetical 80K protein - Bacillus sphaericus | 57 | 38 | 225 |
| 54 | 1 | 1 | 453 | gi\|684950 | staphylococcal accessory regulator A [Staphylococcus aureus] | 57 | 31 | 453 |
| 75 | 1 | 3 | 239 | gi\|1000470 | C27B7.7 [Caenorhabditis elegans] | 57 | 42 | 237 |
| 92 | 5 | 3061 | 2267 | gi\|143607 | sporulation protein [Bacillus subtilis] | 57 | 35 | 795 |
| 96 | 3 | 4006 | 4773 | gi\|144297 | acetyl esterase (XynC) [Caldocellum saccharolyticum] pir\|B37202\|B37202 acetylesterase (EC 3.1.1.6) (XynC) - Caldocellum accharolyticum | 57 | 34 | 768 |
| 107 | 3 | 1480 | 2076 | gi\|460955 | TagE [Vibrio cholerae] | 57 | 42 | 597 |
| 109 | 8 | 5340 | 5933 | gi\|1438846 | Unknown [Bacillus subtilis] | 57 | 41 | 594 |
| 112 | 9 | 6679 | 7701 | gi\|1486250 | unknown [Bacillus subtilis] | 57 | 33 | 1023 |
| 114 | 4 | 4108 | 1832 | gi\|871456 | putative alpha subunit of formate dehydrogenase [Methanobacterium hermoautotrophicum] | 57 | 37 | 2277 |
| 126 | 2 | 430 | 1053 | gi\|288301 | ORF2 gene product [Bacillus megaterium] | 57 | 37 | 624 |
| 131 | 5 | 6277 | 6017 | gi\|1511160 | M. jannaschii predicted coding region MJ1163 [Methanococcus jannaschii] | 57 | 38 | 261 |
| 133 | 3 | 2201 | 1734 | gi\|1303912 | YqhW [Bacillus subtilis] | 57 | 40 | 468 |
| 133 | 4 | 2784 | 2185 | gi\|1221884 | (urea?) amidolyase [Haemophilus influenzae] | 57 | 37 | 600 |
| 147 | 4 | 1694 | 1224 | gi\|467469 | unknown [Bacillus subtilis] | 57 | 33 | 471 |
| 160 | 2 | 1060 | 827 | gi\|558604 | chitin synthase 2 [Neurospora crassa] | 57 | 28 | 234 |
| 163 | 8 | 4764 | 3841 | gi\|145580 | rarD gene product [Escherichia coli] | 57 | 38 | 924 |
| 168 | 6 | 4336 | 5325 | gi\|39782 | 33 kDa lipoprotein [Bacillus subtilis] | 57 | 32 | 990 |
| 170 | 5 | 3297 | 3455 | gi\|603404 | Yer164p [Saccharomyces cerevisiae] | 57 | 37 | 159 |
| 221 | 6 | 6809 | 5592 | gi\|1136221 | carboxypeptidase [Sulfolobus solfataricus] | 57 | 32 | 1218 |
| 228 | 3 | 1348 | 1791 | gi\|288969 | fibronecin binding protein [Streptococcus dysgalactiae] pir\|S33850\|S33850 fibronecin-binding protein - Streptococcus ysgalactiae | 57 | 32 | 444 |
| 263 | 4 | 3686 | 2961 | gi\|1185002 | dihydrodipicolinate reductase [Pseudomonas syringae pv. tabaci] | 57 | 42 | 726 |
| 276 | 1 | 255 | 16 | gi\|396380 | No definition line found [Escherichia coli] | 57 | 40 | 240 |
| 283 | 2 | 335 | 1324 | gi\|773349 | BirA protein [Bacillus subtilis] | 57 | 32 | 990 |
| 297 | 1 | 236 | 3 | gi\|1334820 | reading frame V [Cauliflower mosaic virus] | 57 | 46 | 234 |
| 342 | 3 | 1993 | 2805 | gi\|1204431 | hypothetical protein (SP:P33644) [Haemophilus influenzae] | 57 | 35 | 813 |
| 375 | 6 | 3340 | 3741 | gi\|385177 | cell division protein [Bacillus subtilis] | 57 | 26 | 402 |
| 433 | 6 | 3286 | 4011 | gi\|1524117 | alpha-acetolactate decarboxylase [Lactococcus lactis] | 57 | 40 | 726 |
| 470 | 3 | 903 | 1145 | gi\|804819 | protein serine/threonine kinase [Toxoplasma gondii] | 57 | 30 | 243 |
| 487 | 5 | 1391 | 1723 | gi\|507323 | ORF1 [Bacillus stearothermophilus] | 57 | 28 | 333 |
| 498 | 1 | 274 | 852 | gi\|1334549 | NADH-ubiquinone oxidoreductase subunit 4L [Podospora anserina] | 57 | 34 | 579 |
| 503 | 1 | 173 | 3 | gi\|1502283 | organic cation transporter OCT2 [Rattus norvegicus] | 57 | 30 | 171 |
| 505 | 2 | 1284 | 949 | gi\|466884 | B1496_C2_194 [Mycobacterium laprae] | 57 | 40 | 336 |
| 519 | 2 | 1182 | 2549 | gi\|1303707 | YrkH [Bacillus subtilis] | 57 | 34 | 1368 |
| 522 | 2 | 1945 | 656 | gi\|1064809 | homologous to sp:HTRA_ECOLI [Bacillus subtilis] | 57 | 36 | 1290 |
| 538 | 2 | 909 | 1415 | gi\|153179 | phosphorinothyrcin n-acetyltransferase [Streptomyces coelicolor] pir\|JH0246\|JH0246 phosphinothricin N-acetyltransferase (EC 2.3.1.—) Streptomyces coelicolor | 57 | 40 | 507 |
| 547 | 1 | 486 | 4 | gi\|467340 | unknown [Bacillus subtilis] | 57 | 50 | 483 |
| 599 | 1 | 532 | 2 | sp\|P20692\|TYRA_ | PREPHENATE DEHYDROGENASE (EC 1.3.1.12) (PDH). | 57 | 41 | 531 |
| 620 | 2 | 572 | 387 | gi\|1107894 | unknown [Schizosaccharomyces pombe] | 57 | 38 | 186 |
| 622 | 2 | 1130 | 660 | gi\|173028 | thioredoxin II [Saccharomyces cerevisiae] | 57 | 39 | 471 |
| 625 | 2 | 362 | 1114 | gi\|1262366 | hypothetical protein [Mycobacterium leprae] | 57 | 34 | 753 |
| 680 | 1 | 1 | 204 | gi\|143544 | RNA polymerase sigma-30 factor [Bacillus subtilis] pir\|A28625\|A28625 transcription initiation factor sigma H - acillus subtilis | 57 | 30 | 204 |
| 690 | 1 | 3 | 629 | gi\|466520 | pocR [Salmonella typhimurium] | 57 | 29 | 627 |
| 696 | 1 | 2 | 433 | gi\|413972 | ipa-48r gene product [Bacillus subtilis] | 57 | 33 | 432 |
| 704 | 1 | 36 | 638 | gi\|1499931 | M. jannaschii predicted coding region MJ1083 [Methanococcus jannaschii] | 57 | 36 | 603 |
| 732 | 1 | 1621 | 926 | gi\|1418999 | orf4 [Lactobacillus sake] | 57 | 37 | 696 |
| 746 | 1 | 227 | 3 | gi\|392973 | Rab3 [Aplysia californica] | 57 | 42 | 225 |
| 757 | 1 | 20 | 466 | gi\|43979 | L. curvatus small cryptic plasmid gene for rep protein [Lactobacillus rvatus] | 57 | 45 | 447 |
| 862 | 1 | 2 | 295 | gi\|1303827 | YqfI [Bacillus subtilis] | 57 | 21 | 294 |
| 1049 | 1 | 455 | 3 | gi\|1510108 | ORF-1 [Agrobacterium tumefaciens] | 57 | 35 | 453 |

TABLE 2-continued

| | | | | | | | | |
|---|---|---|---|---|---|---|---|---|
| 1117 | 1 | 695 | 3 | gi\|896286 | NH2 terminus uncertain [*Leishmania tarentolae*] | 57 | 28 | 693 |
| 1136 | 1 | 2 | 322 | gi\|1303853 | YqgF [*Bacillus subtilis*] | 57 | 38 | 321 |
| 1144 | 2 | 611 | 189 | gi\|310083 | voltage-activated calcium channel alpha-1 subunit [*Rattus orvegicus*] | 57 | 46 | 423 |
| 1172 | 1 | 738 | 4 | gi\|1511146 | *M. jannaschii* predicted coding region MJ1143 [*Methanococcus jannaschii*] | 57 | 28 | 735 |
| 1500 | 2 | 558 | 370 | gi\|142780 | putative membrane protein; putative [*Bacillus subtilis*] | 57 | 35 | 189 |
| 1676 | 1 | 399 | 139 | gi\|313777 | uracil permease [*Escherichia coli*] | 57 | 31 | 261 |
| 2481 | 1 | 2 | 400 | gi\|1237015 | ORF4 [*Bacillus subtilis*] | 57 | 23 | 399 |
| 3099 | 1 | 3 | 230 | gi\|1204540 | isochorismate synthase [*Haemophilus influenzae*] | 57 | 39 | 228 |
| 3122 | 1 | 181 | 2 | gi\|882472 | ORF_o464 [*Escherichia coli*] | 57 | 40 | 180 |
| 3560 | 1 | 2 | 361 | gi\|153490 | tetracenomycin C resistance and export protein [*Streptomyces laucescens*] | 57 | 37 | 360 |
| 3850 | 1 | 434 | 12 | gi\|155588 | glucose-fructose oxidoreductase [*Zymomonas mobilis*] pir\|A42289\|A42289 glucose-fructose oxidoreductase (EC. 1.1.—.—) recursor - *Zymomonas mobilis* | 57 | 40 | 423 |
| 3931 | 1 | 354 | 4 | gi\|413953 | ipa-29d gene product [*Bacillus subtilis*] | 57 | 36 | 351 |
| 3993 | 1 | 1 | 384 | gi\|151259 | HMG-CoA reductase (EC 1.1.1.88) [*Pseudomonas mevalonii*] pir\|A44756\|A44756 hydroxymethylglutaryl-CoA reductase (EC 1.1.1.88) Pseudomonas sp. | 57 | 39 | 384 |
| 4065 | 1 | 398 | 3 | pir\|JV0037\|RDEC | nitrate reductase (EC 1.7.99.4) alpha chain - *Escherichia coli* | 57 | 31 | 396 |
| 4100 | 1 | 300 | 4 | gi\|1086633 | T06C10.5 gene product [*Caenorhabditis elegans*] | 57 | 47 | 297 |
| 4163 | 1 | 287 | 3 | gi\|21512 | patatin [*Solanum tuberosum*] | 57 | 50 | 285 |
| 4267 | 2 | 335 | 39 | gi\|1000365 | SpoIIIAG [*Bacillus subtilis*] | 57 | 38 | 297 |
| 4358 | 1 | 3 | 302 | gi\|298032 | EF [*Streptococcus suis*] | 57 | 32 | 300 |
| 4389 | 2 | 108 | 290 | gi\|405894 | 1-phosphofructokinase [*Escherichia coli*] | 57 | 37 | 183 |
| 4399 | 1 | 2 | 232 | gi\|1483603 | Pristinamycin I synthase I [*Streptomyces pristinaespiralis*] | 57 | 35 | 231 |
| 4481 | 1 | 288 | 4 | gi\|405879 | yeiH [*Escherichia coli*] | 57 | 44 | 285 |
| 4486 | 1 | 258 | 4 | gi\|515938 | glutamate synthase (ferredoxin) [Synechocystis sp.] pir\|S46957\|S46957 glutamate synthase (ferredoxin) (EC 1.4.7.1) - ynechocystis sp. | 57 | 42 | 255 |
| 4510 | 1 | 242 | 3 | gi\|1205301 | leukotoxin secretion ATP-binding protein [*Haemophilus influenzae*] | 57 | 38 | 240 |
| 4617 | 1 | 256 | 44 | gi\|1511222 | restriction modification enzyme, subunit M1 [*Methanococcus jannaschii*] | 57 | 35 | 213 |
| 4 | 11 | 11524 | 10847 | gi\|149204 | histidine utilization repressor G [*Klebsiella aerogenes*] pir\|A36730\|A36730 hutG protein - *Klebsiella pneumoniae* (fragment) sp\|P19452\|HUTG_KLEAE FORMIMINOGLUTAMASE (EC 3.5.3.8) (FORMIMINOGLUTAMATE HYDROLASE) (HISTIDINE UTILIZATION PROTEIN G) (FRAGMENT). | 56 | 31 | 678 |
| 22 | 8 | 4248 | 5177 | gi\|1322222 | RACH1 [*Homo sapiens*] | 56 | 33 | 930 |
| 38 | 28 | 21179 | 22264 | gi\|1480705 | lipoate-protein ligase [*Mycoplasma capricolum*] | 56 | 34 | 1086 |
| 44 | 3 | 1861 | 2421 | gi\|490320 | Y gene product [unidentified] | 56 | 31 | 561 |
| 44 | 15 | 10103 | 10606 | gi\|1205099 | hypothetical protein (GB:L19201_1) [*Haemophilus influenzae*] | 56 | 39 | 504 |
| 50 | 6 | 4820 | 5161 | gi\|209931 | fiber protein [Human adenovirus type 5] | 56 | 48 | 342 |
| 53 | 4 | 2076 | 2972 | gi\|623476 | transcriptional activator [*Providencia stuartii*] sp\|P43463\|AARP_PROST TRANSCRIPTIONAL ACTIVATOR AARP. | 56 | 30 | 897 |
| 67 | 6 | 5656 | 6594 | gi\|466613 | nikB [*Escherichia coli*] | 56 | 32 | 939 |
| 89 | 3 | 1810 | 1256 | gi\|482922 | protein with homology to pail repressor of *B. subtilis* [*Lactobacillus elbrueckii*] | 56 | 39 | 555 |
| 96 | 1 | 203 | 913 | gi\|145594 | cAMP receptor protein (crp) [*Escherichia coli*] | 56 | 35 | 711 |
| 109 | 21 | 17846 | 17442 | gi\|1204367 | hypothetical protein (GB:U14003_278) [*Haemophilus influenzae*] | 56 | 27 | 405 |
| 112 | 8 | 5611 | 6678 | gi\|155588 | glucose-fructose oxidoreductase [*Zymomonas mobilis*] pir\|A42289\|A42289 glucose-fructose oxidoreductase (EC 1.1.—.—) recursor - *Zymomonas mobilis* | 56 | 40 | 1068 |
| 131 | 3 | 5100 | 3796 | gi\|619724 | MgtE [*Bacillus firmus*] | 56 | 30 | 1305 |
| 138 | 2 | 65 | 232 | gi\|413948 | ipa-24d gene product [*Bacillus subtilis*] | 56 | 31 | 168 |
| 138 | 4 | 823 | 1521 | gi\|580868 | ipa-22r gene product [*Bacillus subtilis*] | 56 | 31 | 699 |
| 146 | 2 | 447 | 154 | gi\|1046009 | *M. genitalium* predicted coding region MG309 [*Mycoplasma genitalium*] | 56 | 37 | 294 |
| 149 | 2 | 1067 | 495 | gi\|945380 | terminase small subunit [Bacteriophage LL-H] | 56 | 35 | 573 |
| 163 | 1 | 2 | 223 | gi\|143947 | glutamine synthetase [*Bacteroides fragilis*] | 56 | 30 | 222 |
| 166 | 5 | 6449 | 6153 | gi\|405792 | ORF154 [*Pseudomonas putida*] | 56 | 26 | 297 |
| 187 | 1 | 31 | 393 | gi\|311237 | H(+)-transporting ATP synthase [*Zea mays*] | 56 | 30 | 363 |
| 190 | 1 | 2 | 373 | gi\|1109686 | ProX [*Bacillus subtilis*] | 56 | 35 | 372 |
| 191 | 8 | 9943 | 8348 | gi\|581070 | acyl coenzyme A synthetase [*Escherichia coli*] | 56 | 35 | 1596 |
| 195 | 1 | 647 | 3 | gi\|1510242 | collagenase [*Methanococcus jannaschii*] | 56 | 34 | 645 |
| 230 | 3 | 2072 | 1821 | gi\|40363 | heat shock protein [*Clostridium acetobutylicum*] | 56 | 39 | 252 |
| 238 | 5 | 3383 | 3775 | gi\|1477533 | sarA [*Staphylococcus aureus*] | 56 | 31 | 393 |
| 270 | 2 | 813 | 1712 | gi\|765073 | autolysin [*Staphylococcus aureus*] | 56 | 41 | 900 |
| 290 | 1 | 1632 | 43 | gi\|547513 | orf3 [*Haemophilus influenzae*] | 56 | 34 | 1590 |
| 297 | 5 | 1140 | 1373 | gi\|1511556 | *M. jannaschii* predicted coding region MJ1561 [*Methanococcus jannaschii*] | 56 | 40 | 234 |
| 321 | 2 | 1799 | 651 | gi\|1001801 | hypothetical protein [Synechocystis sp.] | 56 | 31 | 1149 |
| 359 | 2 | 641 | 3 | gi\|46336 | nolI gene product [*Rhizobium meliloti*] | 56 | 26 | 639 |
| 371 | 2 | 360 | 1823 | gi\|145304 | L-ribulokinase [*Escherichia coli*] | 56 | 39 | 1464 |
| 391 | 4 | 1762 | 2409 | gi\|1001634 | hypothetical protein [Synechocystis sp.] | 56 | 34 | 648 |
| 402 | 1 | 192 | 4 | gi\|1438904 | 5-HT4L receptor [*Homo sapiens*] | 56 | 48 | 189 |
| 416 | 4 | 2109 | 1738 | gi\|1408486 | HS74A gene product [*Bacillus subtilis*] | 56 | 31 | 372 |
| 424 | 3 | 1756 | 2334 | gi\|142471 | acetolactate decarboxylase [*Bacillus subtilis*] | 56 | 32 | 579 |

TABLE 2-continued

| | | | | | | | | |
|---|---|---|---|---|---|---|---|---|
| 457 | 1 | 1017 | 127 | gi\|1205194 | formamidopyrimidine-DNA glycosylase [*Haemophilus influenzae*] | 56 | 36 | 891 |
| 458 | 2 | 1812 | 1201 | gi\|15466 | terminase [Bacteriophage SPP1] | 56 | 37 | 612 |
| 504 | 2 | 1283 | 414 | gi\|1142681 | Lpp38 [*Pasteurella haemolytica*] | 56 | 38 | 870 |
| 511 | 1 | 1 | 1284 | gi\|217049 | brnQ protein [*Salmonella typimurium*] | 56 | 37 | 1284 |
| 604 | 3 | 1099 | 1701 | gi\|467109 | rim; 30S Ribosomal protein S18 alanine acetyltransferase; 229_C1_170 [*Mycobacterium leprae*] | 56 | 43 | 603 |
| 660 | 5 | 3547 | 3774 | gi\|1229106 | ZK930.1 [*Caenorhabditis elegans*] | 56 | 30 | 228 |
| 707 | 1 | 35 | 400 | gi\|153929 | NADPH-sulfite reductase flavoprotein component [*Salmonella yphimurium*] | 56 | 38 | 366 |
| 709 | 2 | 1095 | 805 | gi\|1510801 | hydrogenase accessory protein [*Methanococcus jannaschii*] | 56 | 38 | 291 |
| 718 | 1 | 1 | 495 | gi\|413948 | ipa-24d gene product [*Bacillus subtilis*] | 56 | 35 | 495 |
| 744 | 1 | 87 | 677 | gi\|928836 | repressor protein [*Lactococcus lactis* phage BK5-T] | 56 | 35 | 591 |
| 790 | 1 | 399 | 22 | gi\|1511513 | ABC transporter, probable ATP-binding subunit [*Methanococcus jannaschii*] | 56 | 33 | 378 |
| 795 | 1 | 3 | 407 | gi\|1205382 | cell division protein [*Haemophilus influenzae*] | 56 | 34 | 405 |
| 813 | 1 | 19 | 930 | gi\|1222161 | permease [*Haemophilus influenzae*] | 56 | 28 | 912 |
| 855 | 1 | 3 | 515 | gi\|1256621 | 26.7% of identity in 165 aa to a *Thermophilic bacterium* hypothetical protein 6; putative [*Bacillus subtilis*] | 56 | 33 | 513 |
| 968 | 1 | 2 | 466 | gi\|547513 | orf3 [*Haemophilus influenzae*] | 56 | 37 | 465 |
| 973 | 2 | 732 | 415 | gi\|886022 | MexR [*Pseudomonas aeruginosa*] | 56 | 31 | 318 |
| 1203 | 1 | 5 | 223 | gi\|184251 | HMG-1 [*Homo sapiens*] | 56 | 34 | 219 |
| 1976 | 1 | 237 | 22 | gi\|9806 | lysine-rich aspartic acid-rich protein [*Plasmodium chabaudi*] r\|S22183\|S22183 lysine/aspartic acid-rich protein - *Plasmodium baudi* | 56 | 33 | 216 |
| 2161 | 1 | 2 | 400 | gi\|1237015 | ORF4 [*Bacillus subtilis*] | 56 | 27 | 399 |
| 2958 | 1 | 183 | 4 | gi\|466685 | No definition line found [*Escherichia coli*] | 56 | 26 | 180 |
| 2979 | 1 | 212 | 3 | gi\|1204354 | spore germination and vegetative growth protein [*Haemophilus influenzae*] | 56 | 40 | 210 |
| 2994 | 2 | 326 | 126 | gi\|836646 | phosphoribosylformimino-praic ketoisomerase [*Rhodobacter phaeroides*] | 56 | 29 | 201 |
| 3026 | 1 | 179 | 328 | gi\|143306 | penicillin V amidase [*Bacillus sphaericus*] | 56 | 30 | 150 |
| 3189 | 1 | 146 | 3 | gi\|1166604 | Similar to aldehyde dehydrogenase [*Caenorhabditis elegans*] | 56 | 37 | 144 |
| 3770 | 1 | 63 | 401 | gi\|1129145 | acetyl-CoA C-acyltransferase [*Mangifera indica*] | 56 | 43 | 339 |
| 4054 | 2 | 361 | 2 | gi\|1205355 | Na+/H+ antiporter [*Haemophilus influenzae*] | 56 | 31 | 360 |
| 4145 | 1 | 1 | 324 | gi\|726095 | long-chain acyl-CoA dehydrogenase [*Mus musculus*] | 56 | 36 | 324 |
| 4200 | 1 | 254 | 3 | gi\|155588 | glucose-fructose oxidoreductase [*Zymomonas mobilis*] pir\|A42289\|A42289 glucose-fructose oxidoreductase (EC 1.1.—.—) recursor - *Zymomonas mobilis* | 56 | 40 | 252 |
| 4273 | 1 | 355 | 35 | gi\|308861 | GTG start codon [*Lactococcus lactis*] | 56 | 33 | 321 |
| 1 | 3 | 3436 | 2777 | gi\|5341 | Putative orf YCLx8c, len:192 [*Saccharomyces cerevisiae*] r\|S53591\|S53591 hypothetical protein - yeast [*Saccharomyces evisiae*] | 55 | 25 | 660 |
| 11 | 12 | 8505 | 7633 | gi\|216773 | haloacetate dehalogenase H-1 [*Moraxella sp.*] | 55 | 32 | 873 |
| 12 | 4 | 4534 | 3935 | gi\|467337 | unknown [*Bacillus subtilis*] | 55 | 26 | 600 |
| 19 | 5 | 5404 | 5844 | gi\|1001719 | hypothetical protein [*Synechocystis sp.*] | 55 | 25 | 441 |
| 23 | 13 | 12339 | 10591 | gi\|474190 | iucA gene product [*Escherichia coli*] | 55 | 30 | 1749 |
| 32 | 7 | 5368 | 6888 | gi\|1340096 | unknown [*Mycobacterium tuberculosis*] | 55 | 37 | 1521 |
| 34 | 3 | 1808 | 1047 | gi\|1303968 | YqjQ [*Bacillus subtilis*] | 55 | 39 | 762 |
| 34 | 5 | 3412 | 2864 | gi\|1303962 | YqjK [*Bacillus subtilis*] | 55 | 33 | 549 |
| 36 | 1 | 647 | 3 | gi\|606045 | ORF_o118 [*Escherichia coli*] | 55 | 27 | 645 |
| 36 | 6 | 5243 | 4266 | gi\|1001341 | hypothetical protein [*Synechocystis sp.*] | 55 | 31 | 978 |
| 47 | 3 | 3054 | 3821 | gi\|1001819 | hypothetical protein [*Synechocystis sp.*] | 55 | 21 | 768 |
| 49 | 1 | 1127 | 189 | gi\|403373 | glycerophosphoryl diester phosphodiesterase [*Bacillus subtilis*] pir\|S37251\|S37251 glycerophosphoryl diester phosphodiesterase - acillus subtilis | 55 | 36 | 939 |
| 67 | 11 | 8966 | 9565 | gi\|153053 | norA1199 protein [*Staphylococcus aureus*] | 55 | 23 | 600 |
| 75 | 3 | 881 | 1273 | gi\|41698 | L-histidinol: NAD+ oxidoreductase (EC 1.1.1.23) (aa 1–434) [scherichia coli] | 55 | 33 | 393 |
| 82 | 9 | 14194 | 13001 | gi\|1136221 | carboxypeptidase [*Sulfolobus solfataricus*] | 55 | 35 | 1194 |
| 87 | 4 | 3517 | 4917 | gi\|1064812 | function unknown [*Bacillus subtilis*] | 55 | 26 | 1401 |
| 88 | 2 | 1172 | 1636 | gi\|882463 | protein-N(pi)-phosphohistidine-sugar phosphotransferase [*Escherichia oli*] | 55 | 35 | 465 |
| 92 | 1 | 127 | 516 | gi\|1377832 | unknown [*Bacillus subtilis*] | 55 | 36 | 390 |
| 100 | 2 | 836 | 2035 | gi\|1370274 | zeaxanthin epoxidase [*Nicotiana plumbaginifolia*] | 55 | 36 | 1200 |
| 100 | 5 | 4658 | 4179 | gi\|396660 | unknown open reading frame [*Buchnera aphidicola*] | 55 | 29 | 480 |
| 108 | 3 | 2986 | 1706 | gi\|1499866 | M. jannaschii predicted coding region MJ1024 [*Methanococcus jannaschii*] | 55 | 31 | 1281 |
| 114 | 3 | 1834 | 1052 | gi\|1511367 | formate dehydrogenase, alpha subunit [*Methanococcus jannaschii*] | 55 | 29 | 783 |
| 144 | 3 | 1476 | 1147 | gi\|1100787 | unkown [*Saccharomyces cerevisiae*] | 55 | 35 | 330 |
| 165 | 5 | 5508 | 4804 | gi\|1045884 | M. genitalium predicted coding region MG199 [*Mycoplasma genitalium*] | 55 | 27 | 705 |
| 189 | 5 | 2205 | 2576 | gi\|142569 | ATP synthase a subunit [*Bacillus firmus*] | 55 | 35 | 372 |
| 191 | 6 | 6857 | 4578 | gi\|559411 | B0272.3 [*Caenorhabditis elegans*] | 55 | 39 | 2280 |
| 194 | 2 | 364 | 636 | gi\|1145768 | K7 kinesin-like protein [*Dictyostelium discoideum*] | 55 | 34 | 273 |
| 209 | 4 | 1335 | 1676 | gi\|473357 | thi4 gene product [*Schizosaccharomyces pombe*] | 55 | 35 | 342 |
| 211 | 2 | 1145 | 597 | gi\|410130 | ORFX6 [*Bacillus subtilis*] | 55 | 37 | 549 |
| 213 | 2 | 644 | 1372 | gi\|633692 | TrsA [*Yersinia enterocolitica*] | 55 | 28 | 729 |
| 214 | 7 | 4144 | 5481 | gi\|1001793 | hypothetical protein [*Synechocystis sp.*] | 55 | 30 | 1338 |
| 221 | 7 | 9197 | 6921 | gi\|466520 | pocR [*Salmonella typhimurium*] | 55 | 32 | 2277 |
| 233 | 8 | 4817 | 3726 | gi\|1237063 | unknown [*Mycobacterium tuberculosis*] | 55 | 38 | 1092 |
| 236 | 4 | 1375 | 2340 | gi\|1146199 | putative [*Bacillus subtilis*] | 55 | 32 | 966 |

TABLE 2-continued

| | | | | | | | | |
|---|---|---|---|---|---|---|---|---|
| 243 | 2 | 380 | 1885 | gi\|459907 | mercuric reductase [Plasmid pI258] | 55 | 29 | 1506 |
| 258 | 1 | 394 | 2 | gi\|455006 | orf6 [Rhodococcus fascians] | 55 | 36 | 393 |
| 281 | 1 | 126 | 938 | gi\|1408493 | homologous to SwissProt:YIDA_ECOLI hypothetical protein [Bacillus subtilis] | 55 | 35 | 813 |
| 316 | 3 | 1323 | 2102 | gi\|1486447 | LuxA homologue [Rhizobium sp.] | 55 | 30 | 780 |
| 326 | 5 | 2744 | 2520 | gi\|1296824 | proline iminopeptidase [Lactobacillus helveticus] | 55 | 36 | 225 |
| 351 | 2 | 1429 | 536 | gi\|1204820 | hydrogen peroxide-inducible activator [Haemophilus influenzae] | 55 | 28 | 894 |
| 353 | 4 | 2197 | 2412 | gi\|1272475 | chitin synthase [Emericella nidulans] | 55 | 50 | 216 |
| 380 | 1 | 14 | 379 | gi\|142554 | ATP synthase i subunit [Bacillus megaterium] | 55 | 37 | 366 |
| 383 | 1 | 232 | 2 | gi\|289272 | ferrichrome-binding protein [Bacillus subtilis] | 55 | 36 | 231 |
| 386 | 1 | 3 | 938 | gi\|1510251 | DNA helicase, putative [Methanococcus jannaschii] | 55 | 30 | 936 |
| 410 | 2 | 1208 | 1891 | gi\|1205144 | multidrug resistance protein [Haemophilus influenzae] | 55 | 27 | 684 |
| 483 | 2 | 411 | 833 | gi\|413934 | ipa-10r gene product [Bacillus subtilis] | 55 | 26 | 423 |
| 529 | 3 | 1433 | 1089 | gi\|606150 | ORF_f309 [Escherichia coli] | 55 | 33 | 345 |
| 555 | 1 | 585 | 82 | gi\|143407 | para-aminobenzoic acid synthase, component I (pab) [Bacillus ubtilis] | 55 | 28 | 504 |
| 565 | 1 | 202 | 2 | gi\|1223961 | CDP-tyvelose epimerase [Yersinia pseudotuberculosis] | 55 | 41 | 201 |
| 582 | 1 | 452 | 153 | gi\|1256643 | 20.2% identity with NADH dehydrogenase of the Leishmania major mitochondrion; putative [Bacillus subtilis] | 55 | 36 | 300 |
| 645 | 5 | 2057 | 1854 | gi\|210824 | fusion protein F [Bovine respiratory syncytial virus] pir\|JQ1481\|VGNZBA fusion glycoprotein precursor - bovine espiratory syncytial virus (strain A51908) | 55 | 25 | 204 |
| 672 | 2 | 957 | 2216 | gi\|1511333 | M. jannaschii predicted coding region MJ1322 [Methanococcus jannaschii] | 55 | 36 | 1260 |
| 730 | 1 | 479 | 3 | gi\|537007 | ORF_f379 [Escherichia coli] | 55 | 30 | 477 |
| 737 | 1 | 945 | 31 | gi\|536963 | CG Site No. 18166 [Escherichia coli] | 55 | 30 | 915 |
| 742 | 2 | 228 | 572 | gi\|304160 | product unknown [Bacillus subtilis] | 55 | 38 | 345 |
| 817 | 2 | 903 | 595 | gi\|1136289 | histidine kinase A [Dictyostelium discoideum] | 55 | 29 | 309 |
| 819 | 1 | 355 | 128 | gi\|558073 | polymorphic antigen [Plasmodium falciparum] | 55 | 22 | 228 |
| 832 | 2 | 724 | 296 | gi\|40367 | ORFC [Clostridium acetobutylicum] | 55 | 32 | 429 |
| 840 | 1 | 386 | 3 | gi\|1205875 | pseudouridylate synthase I [Haemophilus influenzae] | 55 | 39 | 384 |
| 1021 | 1 | 23 | 529 | gi\|48563 | beta-lactamase [Yersinia enterocolitica] | 55 | 38 | 507 |
| 1026 | 1 | 60 | 335 | gi\|47804 | Opp C (AA 1–301) [Salmonella typhimurium] | 55 | 26 | 276 |
| 1525 | 1 | 1 | 282 | gi\|1477533 | sarA [Staphylococcus aureus] | 55 | 29 | 282 |
| 1814 | 2 | 224 | 985 | gi\|1046078 | M. genitalium predicted coding region MG369 [Mycoplasma genitalium] | 55 | 38 | 762 |
| 3254 | 1 | 254 | 81 | gi\|413968 | ipa-44d gene product [Bacillus subtilis] | 55 | 30 | 174 |
| 3695 | 1 | 345 | 4 | gi\|216773 | haloacetate dehalogenase H-1 [Moraxella sp.] | 55 | 32 | 342 |
| 3721 | 1 | 1 | 312 | gi\|42029 | ORF1 gene product [Escherichia coli] | 55 | 31 | 312 |
| 3799 | 1 | 3 | 272 | gi\|42029 | ORF1 gene product [Escherichia coli] | 55 | 38 | 270 |
| 3889 | 1 | 22 | 423 | gi\|1129145 | acetyl-CoA C-acyltransferase [Mangifera indica] | 55 | 45 | 402 |
| 3916 | 1 | 2 | 385 | gi\|529754 | speC [Streptococcus pyogenes] | 55 | 38 | 384 |
| 3945 | 1 | 4 | 198 | gi\|476252 | phase 1 flagellin [Salmonella enterica] | 55 | 36 | 195 |
| 4074 | 1 | 246 | 4 | gi\|42029 | ORF1 gene product [Escherichia coli] | 55 | 38 | 243 |
| 4184 | 1 | 2 | 343 | gi\|1524267 | unknown [Mycobacterium tuberculosis] | 55 | 28 | 342 |
| 4284 | 1 | 14 | 208 | gi\|1100774 | ferredoxin-dependent glutamate synthase [Synechocystis sp.] | 55 | 36 | 195 |
| 4457 | 2 | 378 | 112 | gi\|180189 | cerebellar-degeneration-related antigen (CDR34) [Homo sapiens] gi\|182737 cerebellar degeneration-associated protein [Homo sapiens] pir\|A29770\|A29770 cerebellar degeneration-related protein - human | 55 | 38 | 267 |
| 4514 | 1 | 2 | 244 | gi\|216773 | haloacetate dehalogenase H-1 [Moraxella sp.] | 55 | 32 | 243 |
| 4599 | 1 | 217 | 2 | gi\|1129145 | acetyl-CoA C-acyltransferase [Mangifera indica] | 55 | 42 | 216 |
| 4606 | 1 | 210 | 4 | gi\|386120 | myosin alpha heavy chain (S2 subfragment) [rabbits, masseter, eptide Partial, 234 aa] | 55 | 27 | 207 |
| 5 | 8 | 4932 | 4516 | gi\|536069 | ORF YBL047c [Saccharomyces cerevisiae] | 54 | 27 | 417 |
| 12 | 7 | 6165 | 5164 | gi\|1205504 | homoserine acetyltransferase [Haemophilus influenzae] | 54 | 30 | 1002 |
| 23 | 16 | 15326 | 13566 | gi\|474192 | iucC gene product [Escherichia coli] | 54 | 31 | 1761 |
| 35 | 1 | 2 | 979 | gi\|48054 | small subunit of soluble hydrogenase (AA 1–384) [Synechococcus sp.] ir\|S06919\|HQYCSS soluble hydrogenase (EC 1.12.—.—) small chain - nechococcus sp. (PCC 6716) | 54 | 36 | 978 |
| 37 | 11 | 8667 | 7897 | gi\|537207 | ORF_f277 [Escherichia coli] | 54 | 38 | 771 |
| 37 | 12 | 8165 | 8332 | gi\|1160967 | palmitoyl-protein thioesterase [Homo sapiens] | 54 | 37 | 168 |
| 46 | 15 | 13025 | 13804 | gi\|438473 | protein is hydrophobic, with homology to E. coli ProW; putative [Bacillus subtilis] | 54 | 28 | 780 |
| 56 | 2 | 203 | 736 | gi\|1256139 | YbbJ [Bacillus subtilis] | 54 | 34 | 534 |
| 57 | 13 | 10179 | 9241 | gi\|1151248 | inosine-uridine preferring nucleoside hydrolase [Crithidia fasciculata] | 54 | 32 | 939 |
| 66 | 2 | 516 | 1133 | gi\|1335781 | Cap [Drosophila melanogaster] | 54 | 29 | 618 |
| 70 | 10 | 8116 | 8646 | gi\|1399823 | PhoE [Rhizobium meliloti] | 54 | 31 | 531 |
| 70 | 15 | 11801 | 11046 | sp\|P02983\|TCR_S | TETRACYCLINE RESISTANCE PROTEIN. | 54 | 29 | 756 |
| 87 | 5 | 4915 | 5706 | gi\|1064811 | function unknown [Bacillus subtilis] | 54 | 33 | 792 |
| 92 | 4 | 2289 | 1573 | gi\|1205366 | oligopeptide transport ATP-binding protein [Haemophilus influenzae] | 54 | 33 | 717 |
| 103 | 2 | 1556 | 516 | gi\|710495 | protein kinase [Bacillus brevis] | 54 | 33 | 1041 |
| 105 | 2 | 2095 | 605 | gi\|143727 | putative [Bacillus subtilis] | 54 | 30 | 1491 |
| 112 | 4 | 2337 | 2732 | gi\|153724 | MalC [Streptococcus pneumoniae] | 54 | 41 | 396 |
| 127 | 2 | 1720 | 2493 | gi\|144297 | acetyl esterase (XynC) [Caldocellum saccharolyticum] pir\|B37202\|B37202 acetylesterase (EC 3.1.1.6) (XynC) - Caldocellum accharolyticum | 54 | 34 | 774 |
| 138 | 5 | 1600 | 3306 | gi\|42473 | pyruvate oxidase [Escherichia coli] | 54 | 36 | 1707 |
| 152 | 2 | 525 | 1172 | gi\|1377834 | unknown [Bacillus subtilis] | 54 | 23 | 648 |
| 161 | 9 | 4831 | 5469 | gi\|903305 | ORF73 [Bacillus subtilis] | 54 | 28 | 639 |

TABLE 2-continued

| | | | | | | | | |
|---|---|---|---|---|---|---|---|---|
| 161 | 13 | 6694 | 7251 | gi\|1511039 | phosphate transport system regulatory protein [*Methanococcus jannaschii*] | 54 | 32 | 558 |
| 164 | 6 | 3263 | 4543 | gi\|1204976 | prolyl-tRNA synthetase [*Haemophilus influenzae*] | 54 | 34 | 1281 |
| 164 | 20 | 21602 | 22243 | gi\|143582 | spoIIIEA protein [*Bacillus subtilis*] | 54 | 32 | 642 |
| 171 | 6 | 4250 | 2817 | gi\|436965 | [malA] gene products [*Bacillus stearothermophilus*] pir\|S43914\|S43914 hypothetical protein 1 - *Bacillus tearothermophilus* | 54 | 37 | 1434 |
| 206 | 18 | 19208 | 19720 | gi\|1240016 | R09E10.3 [*Caenorhabditis elegans*] | 54 | 38 | 513 |
| 218 | 2 | 1090 | 1905 | gi\|467378 | unknown [*Bacillus subtilis*] | 54 | 26 | 816 |
| 220 | 1 | 663 | 4 | gi\|1353761 | myosin II heavy chain [*Naegleria fowleri*] | 54 | 22 | 660 |
| 220 | 13 | 12655 | 13059 | pir\|S00485\|S004 | gene 11-1 protein precursor - *Plasmodium falciparum* (fragments) | 54 | 35 | 405 |
| 221 | 3 | 2030 | 3709 | gi\|1303813 | YqeW [*Bacillus subtilis*] | 54 | 34 | 1680 |
| 272 | 7 | 4219 | 3383 | gi\|62964 | arylamine N-acetyltransferase (AA 1–290) [*Gallus gallus*] ir\|S06652\|XYCHY3 arylamine N-acetyltransferase (EC 2.3.1.5) (clone NAT-3) - chicken | 54 | 33 | 837 |
| 316 | 7 | 4141 | 4701 | gi\|682769 | mccE gene product [*Escherichia coli*] | 54 | 31 | 561 |
| 316 | 10 | 6994 | 8742 | gi\|413951 | ipa-27d gene product [*Bacillus subtilis*] | 54 | 28 | 1749 |
| 338 | 3 | 2214 | 1051 | gi\|490328 | LORF F [unidentified] | 54 | 28 | 1164 |
| 341 | 4 | 3201 | 3614 | gi\|171959 | myosin-like protein [*Saccharomyces cerevisiae*] | 54 | 25 | 414 |
| 346 | 1 | 912 | 4 | gi\|396400 | similar to eukaryotic Na+/H+ exchangers [*Escherichia coli*] sp\|P32703\|YJCE_ECOLI HYPOTHETICAL 60.5 KD PROTEIN IN SOXR-ACS NTERGENIC REGION (O549). | 54 | 34 | 909 |
| 348 | 2 | 623 | 1351 | gi\|537109 | ORF_f343a [*Escherichia coli*] | 54 | 34 | 729 |
| 378 | 2 | 1007 | 1942 | sp\|P02983\|TCR_S | TETRACYCLINE RESISTANCE PROTEIN. | 54 | 31 | 936 |
| 408 | 6 | 4351 | 5301 | gi\|474190 | iucA gene product [*Escherichia coli*] | 54 | 29 | 951 |
| 444 | 9 | 7934 | 8854 | gi\|216267 | ORF2 [*Bacillus megaterium*] | 54 | 32 | 921 |
| 463 | 2 | 2229 | 1741 | gi\|304160 | product unknown [*Bacillus subtilis*] | 54 | 50 | 489 |
| 502 | 2 | 1133 | 570 | gi\|1205015 | hypothetical protein (SP:P10120) [*Haemophilus influenzae*] | 54 | 38 | 564 |
| 505 | 6 | 5357 | 4452 | gi\|1500558 | 2-hydroxyhepta-2,4-diene-1,7-dioate isomerase [*Methanococcus jannaschii*] | 54 | 41 | 906 |
| 550 | 1 | 1522 | 308 | gi\|40100 | rodC (tag3) polypeptide (AA 1–746) [*Bacillus subtilis*] ir\|S06049\|S06049 rodC protein - *Bacillus subtilis* p\|P134585\|TAGF_BACSU TECHOIC ACID BIOSYNTHESIS PROTEIN F. | 54 | 35 | 1215 |
| 551 | 5 | 3305 | 4279 | gi\|950197 | unknown [*Corynebacterium glutamicum*] | 54 | 34 | 975 |
| 558 | 2 | 958 | 560 | gi\|485090 | No definition line found [*Coenorhabditis elegans*] | 54 | 32 | 399 |
| 580 | 1 | 91 | 936 | gi\|331906 | fused envelope glycoprotein precursor [Friend spleen focus-forming irus] | 54 | 45 | 846 |
| 603 | 3 | 554 | 757 | gi\|1323423 | ORF YGR234w [*Saccharomyces cerevisiae*] | 54 | 36 | 204 |
| 617 | 1 | 25 | 249 | gi\|219959 | ornithine transcarbamylase [*Homo sapiens*] | 54 | 40 | 225 |
| 622 | 3 | 1097 | 1480 | gi\|1303873 | YqgZ [*Bacillus subtilis*] | 54 | 25 | 384 |
| 623 | 1 | 3 | 404 | gi\|1063250 | low homology to P20 protein of *Bacillus lichiniformis* and bleomycin acetyltransferase of *Streptomyces verticillus* [*Bacillus subtilis*] | 54 | 45 | 402 |
| 689 | 1 | 1011 | 475 | gi\|552446 | NADH dehydrogenase subunit 4 [*Apis mellifera ligustica*] pir\|S52968\|S52968 NADH dehydrogenase chain 4 - honeybee itochondrion (SGC4) | 54 | 30 | 537 |
| 725 | 2 | 686 | 1441 | gi\|987096 | sensory protein kinase [*Streptomyces hygroscopicus*] | 54 | 26 | 756 |
| 956 | 1 | 1 | 249 | pir\|S30782\|S307 | integrin homolog - yeast [*Saccharomyces cerevisiae*] | 54 | 24 | 249 |
| 978 | 2 | 859 | 581 | gi\|1301994 | ORF YNL091w [*Saccharomyces cerevisiae*] | 54 | 33 | 279 |
| 1314 | 1 | 3 | 281 | gi\|1001108 | hypothetical protein [Synechocystis sp.] | 54 | 33 | 279 |
| 2450 | 1 | 1 | 228 | gi\|1045057 | ch-TOG [*Homo sapiens*] | 54 | 32 | 228 |
| 2934 | 1 | 1 | 387 | gi\|580870 | ipa-37d qoxA gene product [*Bacillus subtilis*] | 54 | 36 | 387 |
| 2970 | 1 | 251 | 3 | sp\|P37348\|YECE_ | HYPOTHETICAL PROTEIN IN ASPS 5' REGION (FRAGMENT). | 54 | 42 | 249 |
| 3002 | 1 | 1 | 309 | gi\|44027 | Tma protein [*Lactococcus lactis*] | 54 | 33 | 309 |
| 3561 | 1 | 9 | 464 | gi\|151259 | HMG-CoA reductase (EC 1.1.1.88) [*Pseudomonas mevalonii*] pir\|A44756\|A44756 hydroxymethylglutaryl-CoA reductase (EC 1.1.1.88) Pseudomonas sp. | 54 | 35 | 456 |
| 3572 | 1 | 72 | 401 | gi\|450688 | hsdM gene of EcoprrI gene product [*Escherichia coli*] pir\|S38437\|S38437 hsdM protein - *Escherichia coli* pir\|S09629\|S09629 hypothetical protein A - *Escherichia coli* (SUB 40–520) | 54 | 36 | 330 |
| 3829 | 1 | 400 | 2 | gi\|1322245 | mevalonate pyrophosphate decarboxylase [*Rattus norvegicus*] | 54 | 29 | 399 |
| 3909 | 1 | 1 | 273 | gi\|29865 | CENP-E [*Homo sapiens*] | 54 | 30 | 273 |
| 3921 | 1 | 3 | 209 | pir\|S24325\|S243 | glucan 1,4-beta-glucosidase (EC 3.2.1.74) - *Pseudomonas fluorescens* subsp. *cellulosa* | 54 | 34 | 207 |
| 4438 | 1 | 285 | 4 | gi\|1196657 | unknown protein [*Mycoplasma pneumoniae*] | 54 | 30 | 282 |
| 4459 | 1 | 3 | 272 | gi\|1046081 | hypothetical protein (GB:D26185_10) [*Mycoplasma genitalium*] | 54 | 38 | 270 |
| 4564 | 1 | 3 | 221 | gi\|216267 | ORF2 [*Bacillus megaterium*] | 54 | 38 | 219 |
| 23 | 12 | 10685 | 8832 | gi\|474192 | iucC gene product [*Escherichia coli*] | 53 | 35 | 1854 |
| 23 | 14 | 13579 | 12317 | gi\|42029 | ORF1 gene product [*Escherichia coli*] | 53 | 32 | 1263 |
| 24 | 3 | 3940 | 3440 | gi\|369947 | c2 gene product [Bacteriophage B1] | 53 | 36 | 501 |
| 26 | 4 | 3818 | 4618 | gi\|1486247 | unknown [*Bacillus subtilis*] | 53 | 37 | 801 |
| 38 | 6 | 2856 | 3998 | gi\|405880 | yeiI [*Escherichia coli*] | 53 | 40 | 1143 |
| 38 | 10 | 7806 | 6232 | gi\|1399954 | thyroid sodium/iodide symporter NIS [*Rattus norvegicus*] | 53 | 29 | 1575 |
| 56 | 10 | 12100 | 11876 | pir\|A54592\|A545 | 110k actin filament-associated protein - chicken | 53 | 32 | 225 |
| 57 | 6 | 4583 | 4119 | pir\|A00341\|DEZP | alcohol dehydrogenase (EC 1.1.1.1) - fission yeast (*Schizosaccharomyces pombe*) | 53 | 39 | 465 |

TABLE 2-continued

| | | | | | | | | |
|---|---|---|---|---|---|---|---|---|
| 57 | 12 | 8932 | 7349 | gi\|1480429 | putative transcriptional regulator [*Bacillus stearothermophilus*] | 53 | 30 | 1584 |
| 67 | 12 | 9496 | 10218 | gi\|1511555 | quinolone resistance norA protein protein [*Methanococcus jannaschii*] | 53 | 31 | 723 |
| 69 | 3 | 2382 | 1639 | gi\|1087017 | arabinogalactan-protein, AGP (*Nicotiana alata*, cell-suspension culture filtrate, Peptide, 461 aa) | 53 | 30 | 744 |
| 79 | 1 | 3 | 1031 | gi\|1523802 | glucanase [*Anabaena variabilis*] | 53 | 32 | 1029 |
| 80 | 1 | 338 | 3 | gi\|452428 | ATPase 3 [*Plasmodium falciparum*] | 53 | 36 | 336 |
| 88 | 4 | 1910 | 2524 | gi\|537034 | ORF_o488 [*Escherichia coli*] | 53 | 25 | 615 |
| 88 | 5 | 2467 | 3282 | gi\|537034 | ORF_o488 *Escherichia coli*] | 53 | 29 | 816 |
| 92 | 8 | 5505 | 5140 | gi\|399598 | amphotropic murine retrovirus receptor [*Rattus norvegicus*] | 53 | 33 | 366 |
| 94 | 5 | 3239 | 2061 | gi\|173038 | tropomyosin (TPM1) [*Saccharomyces cerevisiae*] | 53 | 25 | 1179 |
| 99 | 5 | 4207 | 5433 | sp\|P28246\|BCR_E | BICYCLOMYCIN RESISTANCE PROTEIN (SULFONAMIDE RESISTANCE PROTEIN). | 53 | 30 | 1227 |
| 120 | 3 | 1639 | 2262 | gi\|576655 | ORF1 [*Vibrio anguillarum*] | 53 | 35 | 624 |
| 120 | 11 | 7257 | 8897 | gi\|1524397 | glycine betaine transporter OpuD [*Bacillus subtilis*] | 53 | 33 | 1641 |
| 127 | 6 | 5685 | 4477 | gi\|1256630 | putative [*Bacillus subtilis*] | 53 | 32 | 1209 |
| 147 | 2 | 255 | 557 | gi\|581648 | epiB gene product [*Staphylococcus epidermidis*] | 53 | 34 | 303 |
| 158 | 4 | 4256 | 3807 | gi\|151004 | mucoidy regulatory protein AlgR [*Pseudomonas aeruginosa*] pir\|A32802\|A32802 regulatory protein algR - *Pseudomonas aeruginosa* sp\|P26275\|ALGR_PSEAE POSITIVE ALGINATE BIOSYNTHESIS REGULATORY ROTEIN. | 53 | 32 | 450 |
| 171 | 7 | 5421 | 5125 | gi\|1510669 | hypothetical protein (GP:D64044_18) [*Methanococcus jannaschii*] | 53 | 34 | 297 |
| 191 | 9 | 11483 | 9879 | gi\|298085 | acetoacetate decarboxylase [*Clostridium acetobutylicum*] pir\|B49346\|B49346 butyrate--acetoacetate CoA-transferase (EC .8.3.9) small chain - *Clostridium acetobutylicum* sp\|P33752\|CTFA_CLOAB BUTYRATE-ACETOACETATE COATRANSFERASE SUBUNIT (EC 2.8.3.9) (COAT A) | 53 | 31 | 1605 |
| 203 | 5 | 3763 | 4326 | gi\|143456 | rpoE protein (ttg start codon) | 53 | 29 | 564 |
| 206 | 17 | 18204 | 18971 | gi\|304136 | acetylglutamate kinase [*Bacillus stearothermophilus*] sp\|Q07905\|ARGB_BACST ACETYLGLUTAMATE KINASE (EC 2.7.2.8) (NAG INASE) (AGK) (N-ACETYL-L-GLUTAMATE 5-PHOSPHOTRANSFERASE). | 53 | 36 | 768 |
| 212 | 10 | 4021 | 4221 | gi\|9878 | protein kinase [*Plasmodium falciparum*] | 53 | 28 | 201 |
| 231 | 2 | 1350 | 1120 | gi\|537506 | paramyosin [*Dirofilaria immitis*] | 53 | 34 | 231 |
| 272 | 6 | 2719 | 3249 | pir\|A33141\|A331 | hypothetical protein (gtfD 3' region) - *Streptococcus mutans* | 53 | 34 | 531 |
| 308 | 3 | 927 | 2576 | gi\|606292 | ORF_o696 [*Escherichia coli*] | 53 | 33 | 1650 |
| 320 | 7 | 5645 | 5884 | gi\|160596 | RNA polymerase III largest subunit [*Plasmodium falciparum*] sp\|P27625\|RPC1_PLAFA DNA-DIRECTED RNA POLYMERASE III LARGEST UBUNIT (EC 2.7.7.6). | 53 | 33 | 240 |
| 327 | 1 | 218 | 901 | gi\|854601 | unknown [*Schizosaccharomyces pombe*] | 53 | 31 | 684 |
| 341 | 2 | 212 | 2500 | gi\|633732 | ORF1 [*Campylobacter jejuni*] | 53 | 31 | 2289 |
| 351 | 1 | 383 | 3 | sp\|P31675\|YABM_ | HYPOTHETICAL 42.7 KD PROTEIN IN TBPA-LEUD INTERGENIC REGION (ORF104). | 53 | 32 | 381 |
| 433 | 7 | 4731 | 4375 | gi\|1001961 | MHC class II analog [*Staphylococcus aureus*] | 53 | 30 | 357 |
| 454 | 2 | 980 | 720 | pir\|A60328\|A603 | 40K cell wall protein precursor (sr 5' region) - *Streptococcus mutans* (strain OMZ175, serotype f) | 53 | 27 | 261 |
| 470 | 4 | 1123 | 1761 | gi\|516826 | rat GCP360 [*Rattus rattus*] | 53 | 30 | 639 |
| 483 | 1 | 217 | 2 | gi\|1480429 | putative transcriptional regulator [*Bacillus stearothermophilus*] | 53 | 33 | 216 |
| 544 | 1 | 516 | 1259 | gi\|46587 | ORF 1 (AA 1–121) (1 is 2nd base in codon) [*Staphylococcus aureus*] ir\|S15765\|S15765 hypothetical protein 1 (hlb 5' region) - aphylococcus aureus (fragment) | 53 | 38 | 744 |
| 558 | 10 | 3754 | 3551 | gi\|15140 | res gene [Bacteriophage P1] | 53 | 32 | 204 |
| 603 | 2 | 339 | 620 | gi\|507738 | Hmp [*Vibrio parahaemolyticus*] | 53 | 26 | 282 |
| 693 | 1 | 941 | 213 | gi\|153123 | toxic shock syndrome toxin-1 precursor [*Staphylococcus aureus*] pir\|A24606\|XCSAS1 toxic shock syndrome toxin-1 precursor - taphylococcus aureus | 53 | 38 | 729 |
| 766 | 1 | 2 | 673 | gi\|687600 | orfA2; orfA2 forms an operon with orfA1 [*Listeria monocytogenes*] | 53 | 43 | 672 |
| 781 | 1 | 335 | 3 | gi\|1204551 | pilin biogenesis protein [*Haemophilus influenzae*] | 53 | 26 | 333 |
| 801 | 1 | 3 | 545 | gi\|1279400 | SapA protein [*Escherichia coli*] | 53 | 25 | 543 |
| 803 | 1 | 2 | 910 | gi\|695278 | lipase-like enzyme [*Alcaligenes eutrophus*] | 53 | 30 | 909 |
| 872 | 1 | 590 | 3 | gi\|298032 | EF [*Streptococcus suis*] | 53 | 30 | 588 |
| 910 | 1 | 2 | 184 | gi\|1044936 | unknown [*Schizosaccharomyces pombe*] | 53 | 29 | 183 |
| 943 | 1 | 399 | 4 | gi\|290508 | similar to unidentified ORF near 47 minutes [*Escherichia coli*] sp\|P31436\|YICK_ECOLI HYPOTHETICAL 43.5 KD PROTEIN IN SELC-NLPA NTERGENIC REGION. | 53 | 30 | 396 |
| 988 | 1 | 504 | 4 | gi\|142441 | ORF 3; putative [*Bacillus subtilis*] | 53 | 28 | 501 |
| 1064 | 1 | 3 | 434 | gi\|305080 | myosin heavy chain [*Entamoeba histolytica*] | 53 | 26 | 432 |
| 1366 | 1 | 3 | 452 | gi\|308852 | transmembrane protein [*Lactococcus lactis*] | 53 | 33 | 450 |
| 1758 | 1 | 397 | 2 | gi\|1001774 | hypothetical protein [*Synechocystis* sp.] | 53 | 30 | 396 |
| 1897 | 1 | 1 | 447 | gi\|1303949 | YqiX [*Bacillus subtilis*] | 53 | 27 | 447 |
| 2381 | 1 | 400 | 2 | gi\|1146243 | 22.4% identity with *Escherichia coli* DNA-damage inducible protein . . . ; putative [*Bacillus subtilis*] | 53 | 37 | 399 |
| 3537 | 1 | 1 | 327 | gi\|450688 | hsdM gene of EcoprrI gene product [*Escherichia coli*] pir\|S38437\|S38437 hsdM protein - *Escherichia coli* pir\|S09629\|S09629 hypothetical protein A - *Escherichia coli* (SUB 40–520) | 53 | 35 | 327 |
| 3747 | 2 | 137 | 397 | gi\|1477486 | transposase [*Burkholderia cepacia*] | 53 | 53 | 261 |
| 11 | 5 | 3049 | 3441 | gi\|868224 | No definition line found [*Caenorhabditis elegans*] | 52 | 33 | 393 |
| 15 | 5 | 2205 | 2369 | gi\|215966 | G41 protein (gtg start codon) [Bacteriophage T4] | 52 | 34 | 165 |

TABLE 2-continued

| | | | | | | | | |
|---|---|---|---|---|---|---|---|---|
| 19 | 3 | 2429 | 3808 | gi\|1205379 | UDP-murnac-pentapeptide synthetase [*Haemophilus influenzae*] | 52 | 31 | 1380 |
| 24 | 1 | 3462 | 4 | gi\|579124 | predicted 86.4 kd protein; 52 Kd observed [Mycobacteriophage 15] pir\|S30971\|S30971 gene 26 protein - Mycobacterium phage L5 sp\|Q05233\|VG26__BPML5 MINOR TAIL PROTEIN GP26. (SUB 2–837) | 52 | 32 | 3459 |
| 37 | 5 | 3015 | 3935 | gi\|1500543 | P115 protein [*Methanococcus jannaschii*] | 52 | 25 | 921 |
| 38 | 13 | 8795 | 9703 | gi\|46851 | glucose kinase [*Streptomyces coelicolor*] | 52 | 29 | 909 |
| 44 | 16 | 10617 | 11066 | gi\|42012 | moaE gene product [*Escherichia coli*] | 52 | 36 | 450 |
| 46 | 1 | 3 | 521 | gi\|1040957 | NADH dehydrogenase subunit 6 [*Anopheles trinkae*] | 52 | 25 | 519 |
| 51 | 10 | 5531 | 6280 | gi\|388269 | traC [Plasmid pAD1] | 52 | 32 | 750 |
| 56 | 5 | 2826 | 1684 | gi\|181949 | endothelial differentiation protein (edg-1) [*Homo sapiens*] pir\|A35300\|S35300 G protein-coupled receptor edg-1 - human sp\|P21453\|EDG1__HUMAN PROBABLE G PROTEIN-COUPLED RECEPTOR EDG-1. | 52 | 23 | 1143 |
| 57 | 5 | 4173 | 3496 | gi\|304153 | sorbitol dehydrogenase [*Bacillus subtilis*] | 52 | 27 | 678 |
| 62 | 5 | 2870 | 2376 | gi\|1072399 | phaE gene product [*Rhizobium meliloti*] | 52 | 25 | 495 |
| 62 | 6 | 3651 | 2857 | gi\|46485 | NADH dehydrogenase [*Synechococcus* PCC7942] | 52 | 27 | 795 |
| 67 | 14 | 11355 | 12962 | gi\|1511365 | glutamate synthase (NADPH), subunit alpha [*Methanococcus jannaschii*] | 52 | 30 | 1608 |
| 67 | 21 | 16935 | 18158 | gi\|1204393 | hypothetical protein (SP:P31122) [*Haemophilus influenzae*] | 52 | 25 | 1224 |
| 70 | 4 | 1997 | 1809 | gi\|7227 | cytoplasmic dynein heavy chain [*Dictyostelium discoideum*] r\|A44357\|A44357 dynein heavy chain, cytosolic - slime mold (ctyostelium discoideum) | 52 | 36 | 189 |
| 96 | 10 | 10005 | 10664 | gi\|1408485 | B65G gene product [*Bacillus subtilis*] | 52 | 26 | 660 |
| 103 | 5 | 3351 | 2716 | gi\|1009368 | Respiratory nitrate reductase [*Bacillus subtilis*] | 52 | 42 | 636 |
| 109 | 3 | 3350 | 2598 | gi\|699274 | lmbE gene product [*Mycobacterium leprae*] | 52 | 39 | 753 |
| 109 | 19 | 15732 | 17300 | gi\|1526981 | amino acid permease YeeF like protein [*Salmonella typhimurium*] | 52 | 30 | 1569 |
| 121 | 3 | 981 | 550 | gi\|732931 | unknown [*Saccharomyces cerevisiae*] | 52 | 32 | 432 |
| 125 | 3 | 865 | 1680 | gi\|1296975 | puT gene product [*Porphyromonas gingivalis*] | 52 | 38 | 816 |
| 130 | 2 | 659 | 1807 | gi\|1256634 | 25.8% identity over 120 aa with the Synenococcus sp. MpeV protein; putative [*Bacillus subtilis*] | 52 | 36 | 1149 |
| 149 | 1 | 583 | 2 | gi\|1225943 | PBSX terminase [*Bacillus subtilis*] | 52 | 33 | 582 |
| 149 | 14 | 4415 | 4143 | gi\|1510368 | *M. jannaschii* predicted coding region MJ0272 [*Methanococcus jannaschii*] | 52 | 35 | 273 |
| 167 | 1 | 216 | 1001 | gi\|146025 | cell division protein [*Escherichia coli*] | 52 | 43 | 786 |
| 188 | 1 | 120 | 1256 | gi\|474915 | orf 337; translated orf similarity to SW: BCR__ECOLI bicyclomycin esistance protein of *Escherichia coli* [*Coxiella burnetii*] pir\|S44207\|S44207 hypothetical protein 337 - Coxiella burnetii (SUB –338) | 52 | 26 | 1137 |
| 195 | 9 | 8760 | 8359 | gi\|3028 | mitochondrial outer membrane 72K protein [*Neurospora crassa*] r\|A36682\|A36682 72K mitochondrial outer membrane protein - rospora crassa | 52 | 25 | 402 |
| 200 | 3 | 2065 | 2607 | gi\|142439 | ATP-dependent nuclease [*Bacillus subtilis*] | 52 | 35 | 543 |
| 203 | 4 | 2776 | 3684 | gi\|1303698 | BltD [*Bacillus subtilis*] | 52 | 25 | 909 |
| 227 | 8 | 5250 | 5651 | gi\|305080 | myosin heavy chain [*Entamoeba histolytica*] | 52 | 24 | 402 |
| 242 | 1 | 21 | 1424 | gi\|1060877 | EmrY [*Escherichia coli*] | 52 | 32 | 1404 |
| 249 | 5 | 4526 | 4753 | pir\|C37222\|C372 | cytochrome P450 1A1, hepatic - dog (fragment) | 52 | 23 | 228 |
| 255 | 1 | 1055 | 3 | gi\|143290 | penicillin-binding protein [*Bacillus subtilis*] | 52 | 28 | 1053 |
| 276 | 7 | 3664 | 3365 | gi\|1001610 | hypothetical protein [*Synechocystis* sp.] | 52 | 30 | 300 |
| 276 | 8 | 4055 | 3654 | gi\|416235 | orf L3 [*Mycoplasma capricolum*] | 52 | 26 | 402 |
| 289 | 2 | 1449 | 1042 | gi\|150900 | GTP phosphohydrolase [*Proteus vulgaris*] | 52 | 34 | 408 |
| 325 | 1 | 1 | 279 | gi\|1204874 | polypeptide deformylase (formylmethionine deformylase) [*Haemophilus influenzae*] | 52 | 33 | 279 |
| 340 | 1 | 1010 | 3 | gi\|1215695 | peptide transport system protein SapF homolog; SapF homolog [*Mycoplasma pneumoniae*] | 52 | 33 | 1008 |
| 375 | 3 | 340 | 1878 | gi\|467446 | similar to SpoVB [*Bacillus subtilis*] | 52 | 28 | 1539 |
| 424 | 4 | 3262 | 2420 | gi\|1478239 | unknown [*Mycobacterium tuberculosis*] | 52 | 34 | 843 |
| 430 | 1 | 3 | 575 | pir\|A42606\|A426 | orfA 5' to orf405 - *Saccharopolyspora erythrea* (fragment) | 52 | 28 | 573 |
| 444 | 4 | 3712 | 2696 | gi\|1408494 | homologous to penicillin acylase [*Bacillus subtilis*] | 52 | 31 | 1017 |
| 465 | 1 | 903 | 4 | gi\|143331 | alkaline phosphatase regulatory protein [*Bacillus subtilis*] pir\|A27650\|A27650 regulatory protein phoR - Bacillus subtilis sp\|P23545\|PHOR__BACSU ALKALINE PHOSPHATASE SYNTHESIS SENSOR PROTEIN HOR (EC 2.7.3.—). | 52 | 36 | 900 |
| 469 | 5 | 4169 | 3633 | gi\|755152 | highly hydrophobic integral membrane protein [*Bacillus subtilis*] sp\|P42953\|TAGG__BACSU TEICHOIC ACID TRANSLOCATION PERMEASE PROTEIN AGG. | 52 | 32 | 537 |
| 495 | 1 | 633 | 4 | gi\|1204607 | transcription activator [*Haemophilus influenzae*] | 52 | 25 | 630 |
| 505 | 7 | 5762 | 5520 | gi\|142440 | ATP-dependent nuclease [*Bacillus subtilis*] | 52 | 28 | 243 |
| 517 | 2 | 1162 | 1614 | gi\|166162 | Bacteriophage phi-11 int gene activator [*Staphylococcus acteriophage* phi 11] | 52 | 35 | 453 |
| 543 | 2 | 444 | 1295 | gi\|1215693 | putative orf; GT9_orf434 [*Mycoplasma pneumoniae*] | 52 | 25 | 852 |
| 586 | 1 | 1 | 336 | gi\|581648 | epiB gene product [*Staphylococcus epidermidis*] | 52 | 36 | 336 |
| 773 | 1 | 426 | 4 | gi\|1279769 | FdhC [*Methanobacterium thermoformicicum*] | 52 | 30 | 423 |
| 1120 | 2 | 100 | 330 | gi\|142439 | ATP-dependent nuclease [*Bacillus subtilis*] | 52 | 35 | 231 |
| 1614 | 1 | 347 | 3 | gi\|289262 | comE ORF3 [*Bacillus subtilis*] | 52 | 28 | 345 |
| 2495 | 1 | 1 | 324 | gi\|216151 | DNA polymerase (gene L; ttg start codon) [Bacteriophage SPO2] gi\|579197 SP02 DNA polymerase (aa 1–648) [Bacteriophage SPO2] pir\|A21498\|DJBPS2 DNA-directed DNA polymerase (EC 2.7.7.7) - phage PO2 | 52 | 34 | 324 |

TABLE 2-continued

| | | | | | | | | |
|---|---|---|---|---|---|---|---|---|
| 2931 | 1 | 285 | 4 | gi\|1256136 | YbbG [Bacillus subtilis] | 52 | 30 | 282 |
| 2943 | 1 | 320 | 63 | gi\|41713 | hisA ORF (AA 1–245) [Escherichia coli] | 52 | 35 | 258 |
| 2993 | 1 | 295 | 2 | gi\|298032 | EF [Streptococcus suis] | 52 | 34 | 294 |
| 3667 | 1 | 307 | 2 | gi\|849025 | hypothetical 64.7-kDa protein [Bacillus subtilis] | 52 | 36 | 306 |
| 3944 | 1 | 260 | 42 | gi\|1218040 | BAA [Bacillus licheniformis] | 52 | 36 | 219 |
| 3954 | 2 | 347 | 81 | gi\|854064 | U87 [Human herpesvirus 6] | 52 | 50 | 267 |
| 3986 | 1 | 90 | 401 | gi\|1205919 | Na+ and Cl− dependent gamma-aminobutryic acid transporter [Haemophilus influenzae] | 52 | 33 | 312 |
| 4002 | 1 | 3 | 389 | gi\|40003 | oxoglutarate dehydrogenase (NADP+) [Bacillus subtilis] p\|P23129\|ODO1_BACSU 2-OXOGLUTARATE DEHYDROGENASE E1 COMPONENT (EC 2.4.2) (ALPHA-KETOGLUTARATE DEHYDROGENASE). | 52 | 42 | 387 |
| 4020 | 1 | 1 | 249 | gi\|159388 | ornithine decarboxylase [Leishmania donovani] | 52 | 47 | 249 |
| 4098 | 1 | 220 | 2 | gi\|409795 | No definition line found [Escherichia coli] | 52 | 32 | 219 |
| 4248 | 1 | 3 | 212 | gi\|965077 | Adr6p [Saccharomyces cerevisiae] | 52 | 40 | 210 |
| 7 | 1 | 3 | 575 | gi\|895747 | putative cel operon regulator [Bacillus subtilis] | 51 | 28 | 573 |
| 21 | 4 | 2479 | 3276 | gi\|1510962 | indole-3-glycerol phosphate synthase [Methanococcus jannaschii] | 51 | 32 | 798 |
| 22 | 9 | 5301 | 5966 | gi\|1303933 | YqiN [Bacillus subtilis] | 51 | 25 | 666 |
| 43 | 3 | 1283 | 1050 | gi\|1519460 | Srp1 [Schizosaccharomyces pombe] | 51 | 31 | 234 |
| 44 | 17 | 11042 | 11305 | gi\|42011 | moaD gene product [Escherichia coli] | 51 | 35 | 264 |
| 51 | 11 | 6453 | 6731 | gi\|495471 | vacuolating toxin [Helicobacter pylori] | 51 | 37 | 279 |
| 52 | 4 | 2537 | 2995 | gi\|1256652 | 25% identity to the E. coli regulatory protein MprA; putative [Bacillus subtilis] | 51 | 32 | 459 |
| 57 | 10 | 6843 | 6355 | gi\|508173 | EIIA domain of PTS-dependent Gat transport and phosphorylation [Escherichia coli] | 51 | 32 | 489 |
| 59 | 1 | 29 | 1111 | gi\|299163 | alanine dehydrogenase [Bacillus subtilis] | 51 | 33 | 1083 |
| 67 | 20 | 15791 | 16576 | gi\|1510977 | M. jannaschii predicted coding region MJ0938 [Methanococcus jannaschii] | 51 | 24 | 786 |
| 69 | 2 | 1218 | 877 | gi\|467359 | unknown [Bacillus subtilis] | 51 | 34 | 342 |
| 71 | 1 | 3 | 1196 | gi\|298032 | EF [Streptococcus suis] | 51 | 32 | 1194 |
| 78 | 2 | 176 | 3 | gi\|1161242 | proliferating cell nuclear antigen [Styela clava] | 51 | 28 | 174 |
| 99 | 4 | 3357 | 4040 | gi\|642795 | TFIID subunit TAFII55 [Homo sapiens] | 51 | 25 | 684 |
| 109 | 1 | 1428 | 4 | gi\|580920 | rodD (gtaA) polypeptide (AA 1–673) [Bacillus subtilis] pir\|S06048\|S06048 probable rodD protein - Bacillus subtilis sp\|P13484\|TAGE_BACSU PROBABLE POLY(GLYCEROL-PHOSPHATE) LPHA-GLUCOSYLTRANSFERASE (EC 2.4.1.52) (TECHOIC ACID BIOSYNTHESIS ROTEIN E). | 51 | 27 | 1425 |
| 109 | 9 | 6007 | 6693 | gi\|1204815 | hypothetical protein (SP:P32662) [Haemophilus influenzae] | 51 | 23 | 687 |
| 112 | 3 | 1066 | 2352 | pir\|S05330\|S053 | maltose-binding protein precursor - Enterobacter aerogenes | 51 | 42 | 1287 |
| 112 | 13 | 12855 | 11278 | gi\|405857 | yehU [Escherichia coli] | 51 | 29 | 1578 |
| 114 | 9 | 8967 | 8209 | gi\|435098 | orf1 [Mycoplasma capricolum] | 51 | 30 | 759 |
| 115 | 1 | 1 | 912 | gi\|1431110 | ORF YDL085w [Saccharomyces cerevisiae] | 51 | 25 | 912 |
| 127 | 10 | 9647 | 10477 | gi\|1204314 | H. influenzae predicted coding region HI0056 [Haemophilus influenzae] | 51 | 37 | 831 |
| 152 | 9 | 6814 | 7356 | gi\|431929 | MunI regulatory protein [Mycoplasma sp.] | 51 | 38 | 543 |
| 154 | 2 | 575 | 1153 | gi\|1237044 | unknown [Mycobacterium tuberculosis] | 51 | 36 | 579 |
| 154 | 7 | 5634 | 4681 | gi\|409286 | bmrU [Bacillus subtilis] | 51 | 27 | 954 |
| 171 | 8 | 6236 | 5529 | gi\|1205484 | hypothetical protein (SP:P33918) [Haemophilus influenzae] | 51 | 32 | 708 |
| 184 | 1 | 1 | 291 | gi\|466886 | B1496_C3_206 [Mycobacterium leprae] | 51 | 33 | 291 |
| 212 | 5 | 1501 | 2139 | pir\|A45605\|A456 | mature-parasite-infected erythrocyte surface antigen MESA - Plasmodium falciparum | 51 | 23 | 639 |
| 228 | 2 | 707 | 1378 | gi\|8204 | nuclear protein [Drosophila melanogaster] | 51 | 27 | 672 |
| 236 | 8 | 7481 | 6825 | gi\|49272 | Asparaginase [Bacillus licheniformis] | 51 | 31 | 657 |
| 243 | 4 | 3546 | 2455 | gi\|1511102 | melvalonate kinase [Methanococcus jannaschii] | 51 | 29 | 1092 |
| 257 | 4 | 3373 | 3206 | gi\|1204579 | H. influenzae predicted coding region HI0326 [Haemophilus influenzae] | 51 | 22 | 168 |
| 258 | 3 | 1609 | 821 | gi\|160299 | glutamic acid-rich protein [Plasmodium falciparum] pir\|A54514\|A54514 glutamic acid-rich protein precursor - Plasmodium alciparum | 51 | 34 | 789 |
| 265 | 5 | 2419 | 3591 | gi\|580841 | F1 [Bacillus subtilis] | 51 | 32 | 1173 |
| 298 | 2 | 518 | 748 | gi\|1336162 | SCPB [Streptococcus agalactiae] | 51 | 34 | 231 |
| 316 | 9 | 5817 | 7049 | gi\|413953 | ipa-29d gene product [Bacillus subtilis] | 51 | 39 | 1233 |
| 332 | 2 | 2057 | 339 | gi\|1209012 | mutS [Thermus aquaticus thermophilus] | 51 | 26 | 1719 |
| 364 | 4 | 3816 | 4991 | gi\|528991 | unknown [Bacillus subtilis] | 51 | 32 | 1176 |
| 440 | 2 | 448 | 684 | gi\|2819 | transferase (GAL10) (AA 1–687) [Kluyveromyces lactis] r\|S01407\|XUVKG UDPglucose 4-epimerase (EC 5.1.3.2) - yeast (uyveromyces marxianus var. lactis) | 51 | 32 | 237 |
| 495 | 2 | 1177 | 1001 | gi\|297861 | protease G [Erwinia chrysanthemi] | 51 | 41 | 177 |
| 495 | 3 | 1718 | 1149 | gi\|1513317 | serine rich protein [Entamoeba histolytica] | 51 | 25 | 570 |
| 506 | 1 | 421 | 2 | gi\|455320 | cII protein [Bacteriophage P4] | 51 | 33 | 420 |
| 600 | 1 | 983 | 492 | gi\|587532 | orf, len: 201, CAI: 0.16 [Saccharomyces cerevisiae] pir\|S48818\|S48818 hypothetical protein - yeast (Saccharomyces erevisiae) | 51 | 30 | 492 |
| 607 | 3 | 479 | 934 | gi\|1511524 | hypothetical protein (SP:P37002) [Methanococcus jannaschii] | 51 | 40 | 456 |
| 686 | 2 | 127 | 600 | gi\|493017 | endocarditis specific antigen [Enterococcus faecalis] | 51 | 30 | 474 |
| 726 | 1 | 33 | 230 | gi\|1353851 | unknown [Prochlorococcus marinus] | 51 | 45 | 198 |
| 861 | 1 | 176 | 652 | gi\|410145 | dehydroquinate dehydratase [Bacillus subtilis] | 51 | 34 | 477 |

TABLE 2-continued

| | | | | | | | |
|---|---|---|---|---|---|---|---|
| 869 | 1 | 393 | 4 | gi\|40100 | rodC (tag3) polypeptide (AA 1–746) [*Bacillus subtilis*] ir\|S06049\|S06049 rodC protein - *Bacillus subtilis* p\|P13485\|TAGF_BAQCSU TECHOIC ACID BIOSYNTHESIS PROTEIN F. | 51 | 23 | 390 |
| 1003 | 1 | 322 | 2 | gi\|1279707 | hypothetical phosphoglycerate mutase [*Saccharomyces cerevisiae*] | 51 | 39 | 321 |
| 1046 | 2 | 624 | 382 | gi\|510257 | glycosyltransferase [*Escherichia coli*] | 51 | 29 | 243 |
| 1467 | 1 | 352 | 2 | gi\|1511175 | *M. jannaschii* predicted coding region MJ1177 [*Methanococcus jannaschii*] | 51 | 32 | 351 |
| 2558 | 1 | 230 | 3 | sp\|P10582\|DPOM_ | DNA POLYMERASE (EC 2.7.7.7) (S-1 DNA ORF 3). | 51 | 26 | 228 |
| 3003 | 1 | 399 | 19 | gi\|809543 | CbrC protein [*Erwinia chrysanthemi*] | 51 | 27 | 381 |
| 3604 | 1 | 1 | 399 | pir\|JC4210\|JC42 | 3-hydroxyacyl-CoA dehydrogenase (EC 1.1.1.35) - mouse | 51 | 37 | 399 |
| 3732 | 1 | 2 | 316 | gi\|145906 | acyl-CoA synthetase [*Escherichia coli*] | 51 | 33 | 315 |
| 3791 | 1 | 2 | 274 | gi\|1061351 | semaphorin III family homolog [*Homo sapiens*] | 51 | 37 | 273 |
| 3995 | 1 | 46 | 336 | gi\|216346 | surfactin synthetase [*Bacillus subtilis*] | 51 | 38 | 291 |
| 4193 | 1 | 307 | 2 | gi\|42749 | ribosomal protein L12 (AA 1–179) [*Escherichia coli*] ir\|S04776\|XXECPL peptide N-acetyltransferase rimL (EC 2.3.1.—) - cherichia coli | 51 | 25 | 306 |
| 4539 | 1 | 185 | 3 | gi\|1408494 | homologous to penicillin acylase [*Bacillus subtilis*] | 51 | 40 | 183 |
| 4562 | 1 | 239 | 36 | gi\|1458280 | coded for by *C. elegans* cDNA cm01e7; Similar to hydroxymethyl-glutaryl-CoA synthase [*Caenorhabditis elegans*] | 51 | 35 | 204 |
| 1 | 4 | 3576 | 4859 | gi\|559160 | GRAIL score: null; cap site and late promoter motifs present pstream; putative [*Autographa californica* nuclear *polyhedrosis irus*] | 50 | 44 | 1284 |
| 11 | 7 | 4044 | 5165 | gi\|1146207 | putative [*Bacillus subtilis*] | 50 | 35 | 1122 |
| 11 | 13 | 9496 | 8483 | gi\|1208451 | hypothetical protein [Synechocystis sp.] | 50 | 39 | 1014 |
| 19 | 1 | 1018 | 2 | gi\|413966 | ipa-42d gene product [*Bacillus subtilis*] | 50 | 29 | 1017 |
| 20 | 11 | 8407 | 8228 | gi\|1323159 | ORF YGR103w [*Saccharomyces cerevisiae*] | 50 | 28 | 180 |
| 24 | 5 | 4824 | 4240 | gi\|496280 | structural protein [Bacteriophage Tuc2009] | 50 | 29 | 585 |
| 34 | 4 | 1926 | 2759 | gi\|1303966 | YqjO [*Bacillus subtilis*] | 50 | 36 | 834 |
| 38 | 30 | 22865 | 23440 | gi\|1072179 | Similar to dihydroflavonol-4-reductase (maize, petunia, tomato) [*Caenorhabditis elegans*] | 50 | 32 | 576 |
| 47 | 2 | 1705 | 2976 | gi\|153015 | FemA protein [*Staphylococcus aureus*] | 50 | 29 | 1272 |
| 56 | 13 | 15290 | 15841 | gi\|606096 | ORF_f167; end overlaps end of o100 by 14 bases; start overlaps f174, ther starts possible [*Escherichia coli*] | 50 | 30 | 552 |
| 57 | 1 | 1077 | 19 | gi\|640922 | xylitol dehydrogenase [unidentified hemiascomycete] | 50 | 29 | 1059 |
| 58 | 2 | 628 | 1761 | gi\|143725 | putative [*Bacillus subtilis*] | 50 | 29 | 1134 |
| 88 | 6 | 3884 | 3375 | gi\|1072179 | Similar to dihydroflavonol-4-reductase (maize, petunia, tomato) [*Caenorhabditis elegans*] | 50 | 32 | 510 |
| 89 | 5 | 3356 | 3012 | gi\|1276658 | ORF174 gene product [*Porphyra purpurea*] | 50 | 25 | 345 |
| 141 | 1 | 3 | 239 | gi\|476024 | carbamoyl phosphate synthetase II [*Plasmodium falciparum*] | 50 | 33 | 237 |
| 151 | 1 | 186 | 626 | gi\|1403441 | unknown [*Mycobacterium tuberculosis*] | 50 | 35 | 441 |
| 166 | 7 | 9623 | 8181 | gi\|895747 | putative cel operon regulator [*Bacillus subtilis*] | 50 | 32 | 1443 |
| 201 | 6 | 5096 | 4908 | gi\|160229 | circumsporozoite protein [*Plasmodium reichenowi*] | 50 | 42 | 189 |
| 206 | 22 | 29555 | 28326 | gi\|1052754 | LmrP integral membrane protein [*Lactococcus lactis*] | 50 | 24 | 1230 |
| 211 | 4 | 1523 | 1927 | gi\|410131 | ORFX7 [*Bacillus subtilis*] | 50 | 29 | 405 |
| 214 | 4 | 2411 | 3295 | sp\|P37348\|YECE_ | HYPOTHETICAL PROTEIN IN ASPS 5' REGION (FRAGMENT). | 50 | 37 | 885 |
| 228 | 7 | 4406 | 3744 | gi\|313580 | envelope protein [Human immunodeficiency virus type 1] pir\|S35835\|S35835 envelope protein - human immunodeficiency virus ype 1 (fragment) (SUB 1–77) | 50 | 35 | 663 |
| 272 | 2 | 1723 | 398 | gi\|1408485 | B65G gene product [*Bacillus subtilis*] | 50 | 22 | 1326 |
| 273 | 2 | 984 | 352 | gi\|984186 | phosphoglycerate mutase [*Saccharomyces cerevisiae*] | 50 | 28 | 633 |
| 328 | 2 | 1605 | 703 | gi\|148896 | lipoprotein [*Haemophilus influenzae*] | 50 | 26 | 903 |
| 332 | 4 | 3802 | 2135 | gi\|1526547 | DNA polymerase family X [*Thermus aquaticus*] | 50 | 27 | 1668 |
| 342 | 5 | 3473 | 3931 | gi\|456562 | G-box binding factor [*Dictyostelium discoideum*] | 50 | 35 | 459 |
| 352 | 1 | 741 | 4 | gi\|288301 | ORF2 gene product [*Bacillus megaterium*] | 50 | 29 | 738 |
| 408 | 7 | 5299 | 5523 | gi\|11665 | ORF2136 [*Marchantia polymorpha*] | 50 | 27 | 225 |
| 420 | 3 | 650 | 1825 | gi\|757842 | UDP-sugar hydrolase [*Escherichia coli*] | 50 | 30 | 1176 |
| 464 | 1 | 1 | 591 | gi\|487282 | Na+ –ATPase subunit J [*Enterococcus hirae*] | 50 | 29 | 591 |
| 472 | 2 | 864 | 310 | gi\|551875 | BglR [*Lactococcus lactis*] | 50 | 23 | 555 |
| 520 | 1 | 23 | 541 | gi\|567036 | CapE [*Staphylococcus aureus*] | 50 | 27 | 519 |
| 529 | 1 | 6 | 410 | gi\|1256652 | 25% identity to the *E. coli* regulatory protein MprA; putative [*Bacillus subtilis*] | 50 | 34 | 405 |
| 534 | 5 | 6059 | 4392 | gi\|295671 | selected as a weak suppressor of a mutant of the subunit AC40 of DNA ependant RNA polymerase I and III [*Saccharomyces cerevisiae*] | 50 | 18 | 1668 |
| 647 | 1 | 1497 | 4 | gi\|405568 | TraI protein shares sequence similarity with a family of opoisomerases [Plasmid pSK41] | 50 | 31 | 1494 |
| 664 | 3 | 711 | 289 | gi\|410007 | leukocidin F component [*Staphylococcus aureus*, MRSA No. 4, Peptide, 23 aa] | 50 | 32 | 423 |
| 678 | 1 | 1 | 627 | gi\|298032 | EF [*Streptococcus suis*] | 50 | 29 | 627 |
| 755 | 3 | 947 | 1171 | gi\|150572 | cytochrome c1 precursor (EC 1.10.2.2) [*Paracoccus denitrificans*] gi\|45465 cytochrome c1 (AA 1–450) [*Paracoccus denitrificans*] pir\|C29413\|C29413 ubiquinol--cytochrome-c reductase (EC 1.10.2.2) ytochrome c1 precursor - *Paracoccus denitrificans* sp\|P13627\|CY1 | 50 | 37 | 225 |
| 827 | 1 | 683 | 3 | gi\|142020 | heterocyst differentiation protein [Anabaena sp.] | 50 | 21 | 681 |
| 892 | 1 | 3 | 752 | gi\|1408485 | B65G gene product [*Bacillus subtilis*] | 50 | 27 | 750 |
| 910 | 2 | 438 | 887 | gi\|1204727 | tyrosine-specific transport protein [*Haemophilus influenzae*] | 50 | 25 | 450 |
| 933 | 1 | 524 | 760 | gi\|1205451 | cell division inhibitor [*Haemophilus influenzae*] | 50 | 32 | 237 |
| 973 | 1 | 236 | 48 | gi\|886947 | orf3 gene product [*Saccharomyces cerevisiae*] | 50 | 40 | 189 |
| 1009 | 1 | 429 | 205 | gi\|153727 | M protein [group G streptococcus] | 50 | 28 | 225 |

TABLE 2-continued

| | | | | | | | | |
|---|---|---|---|---|---|---|---|---|
| 1027 | 1 | 257 | 3 | gi\|413934 | ipa-10r gene product [*Bacillus subtilis*] | 50 | 25 | 255 |
| 1153 | 2 | 326 | 96 | gi\|773676 | nccA [*Alcaligenes xylosoxydans*] | 50 | 36 | 231 |
| 1222 | 1 | 400 | 2 | gi\|1408485 | B65G gene product [*Bacillus subtilis*] | 50 | 21 | 399 |
| 1350 | 1 | 399 | 106 | gi\|289272 | ferrichrome-binding protein [*Bacillus subtilis*] | 50 | 32 | 294 |
| 2945 | 1 | 184 | 2 | gi\|171704 | hexaprenyl pyrophosphate synthetase (COQ1) [*Saccharomyces erevisiae*] | 50 | 34 | 183 |
| 2968 | 2 | 804 | 4 | gi\|397526 | clumping factor [*Staphylococcus aureus*] | 50 | 33 | 801 |
| 2998 | 2 | 394 | 131 | gi\|495696 | F54E7.3 gene product [*Caenorhabditis elegans*] | 50 | 40 | 264 |
| 3046 | 2 | 306 | 106 | pir\|S13819\|S138 | acyl carrier protein - *Anabaena variabilis* (fragment) | 50 | 32 | 201 |
| 3063 | 1 | 275 | 3 | gi\|474190 | iucA gene product [*Escherichia coli*] | 50 | 29 | 273 |
| 3174 | 1 | 3 | 146 | gi\|151900 | alcohol dehydrogenase [*Rhodobacter sphaeroides*] | 50 | 31 | 144 |
| 3792 | 1 | 314 | 3 | gi\|1001423 | hypothetical protein [*Synechocystis* sp.] | 50 | 35 | 312 |
| 3800 | 1 | 2 | 262 | gi\|144733 | NAD-dependent beta-hydroxybutyryl coenzyme A dehydrogenase [*Clostridium acetobutylicum*] | 50 | 28 | 261 |
| 3946 | 1 | 188 | 3 | gi\|576765 | cytochrome b [*Myrmecia pilosula*] | 50 | 38 | 186 |
| 3984 | 1 | 291 | 4 | sp\|P37348\|YECE__ | HYPOTHETICAL PROTEIN IN ASPS 5' REGION (FRAGMENT). | 50 | 37 | 288 |
| 37 | 10 | 7885 | 7520 | gi\|1204367 | hypothetical protein (GB:U14003__278) [*Haemophilus influenzae*] | 49 | 30 | 366 |
| 46 | 16 | 13802 | 14848 | gi\|466860 | acd; B1308__F1__34 [*Mycobacterium leprae*] | 49 | 24 | 1047 |
| 59 | 5 | 2267 | 3601 | gi\|606304 | ORF_o462 [*Escherichia coli*] | 49 | 27 | 1335 |
| 112 | 18 | 17884 | 18615 | gi\|559502 | ND4 protein (AA 1–409) [*Caenorhabditis elegans*] | 49 | 25 | 732 |
| 138 | 9 | 6973 | 7902 | gi\|303953 | esterase [*Acinetobacter calcoaceticus*] | 49 | 29 | 930 |
| 217 | 6 | 4401 | 5138 | gi\|496254 | fibronectin/fibrinogen-binding protein [*Streptococcus pyogenes*] | 49 | 31 | 738 |
| 220 | 12 | 11803 | 12657 | gi\|397526 | clumping factor [*Staphylococcus aureus*] | 49 | 31 | 855 |
| 228 | 4 | 1842 | 2492 | pir\|S23692\|S236 | hypothetical protein 9 - *Plasmodium falciparum* | 49 | 24 | 651 |
| 268 | 1 | 2614 | 212 | gi\|143047 | ORFB [*Bacillus subtilis*] | 49 | 26 | 2403 |
| 271 | 2 | 1164 | 1373 | gi\|1001257 | hypothetical protein [*Synechocystis* sp.] | 49 | 38 | 210 |
| 300 | 3 | 3180 | 2020 | gi\|1510796 | hypothetical protein (GP:X91006__2) [*Methanococcus jannaschii*] | 49 | 26 | 1161 |
| 381 | 1 | 1142 | 3 | gi\|396301 | matches PS00041: Bacterial regulatory proteins, araC family ignature [*Escherichia coli*] | 49 | 29 | 1140 |
| 466 | 1 | 3 | 947 | gi\|1303863 | YqgP [*Bacillus subtilis*] | 49 | 26 | 945 |
| 666 | 1 | 191 | 3 | gi\|633112 | ORF1 [*Streptococcus sobrinus*] | 49 | 29 | 189 |
| 670 | 2 | 403 | 1014 | gi\|1122758 | unknown [*Bacillus subtilis*] | 49 | 32 | 612 |
| 709 | 1 | 795 | 157 | gi\|143830 | xpaC [*Bacillus subtilis*] | 49 | 29 | 639 |
| 831 | 1 | 473 | 3 | gi\|401786 | phosphomannomutase [*Mycoplasma pirum*] | 49 | 29 | 471 |
| 1052 | 1 | 213 | 4 | gi\|1303799 | YqeN [*Bacillus subtilis*] | 49 | 21 | 210 |
| 1800 | 1 | 172 | 2 | gi\|216300 | peptidoglycan synthesis enzyme [*Bacillus subtilis*] sp\|P37585\|MURG__BACSU MURG PROTEIN UPD-N-ACETYLGLUCOSAMINE--N-ACETYLMURAMYL-(PENTAPEPTIDE) PYROPHOSPHORYLUNDECAPRENOL N-ACETYLGLUCOSAMINE (RANSFERASE). | 49 | 28 | 171 |
| 2430 | 1 | 2 | 376 | sp\|P27434\|YFGA__ | HYPOTHETICAL 36.2 KD PROTEIN IN NDK-GCPE INTERGENIC REGION. | 49 | 26 | 375 |
| 3096 | 1 | 273 | 4 | gi\|516360 | surfactin synthetase [*Bacillus subtilis*] | 49 | 25 | 270 |
| 32 | 4 | 3100 | 2429 | gi\|1217963 | hepatocyte nuclear factor 4 gamma (HNF4gamma) [*Homo sapiens*] | 48 | 36 | 672 |
| 38 | 1 | 1 | 609 | gi\|1205790 | *H. influenzae* predicted coding region HI1555 [*Haemophilus influenzae*] | 48 | 28 | 609 |
| 45 | 6 | 5021 | 6427 | gi\|1524267 | unknown [*Mycobacterium tuberculosis*] | 48 | 20 | 1407 |
| 59 | 14 | 16346 | 31096 | gi\|1197336 | Lmp3 protein [*Mycoplasma hominis*] | 48 | 28 | 14751 |
| 61 | 1 | 3 | 608 | gi\|1511555 | quinolone resistance norA protein protein [*Methanococcus jannaschii*] | 48 | 30 | 606 |
| 61 | 3 | 3311 | 3646 | gi\|1303893 | YqhL [*Bacillus subtilis*] | 48 | 29 | 336 |
| 114 | 1 | 98 | 415 | gi\|671708 | su(s) homolog; similar to *Drosophila melanogaster* suppressor of able (su(s)) protein, Swiss-Prot Accession Number P22293 [*Drosophila virilis*] | 48 | 25 | 318 |
| 121 | 1 | 610 | 89 | gi\|1314584 | unknown [*Sphingomonas* S88] | 48 | 29 | 522 |
| 136 | 1 | 1280 | 546 | gi\|1205968 | *H. influenzae* predicted coding region HI1738 [*Haemophilus influenzae*] | 48 | 23 | 735 |
| 171 | 10 | 8220 | 9557 | gi\|1208454 | hypothetical protein [*Synechocystis* sp.] | 48 | 34 | 1338 |
| 175 | 1 | 1814 | 3 | gi\|396400 | similar to eukaryotic Na+/H+ exchangers [*Escherichia coli*] sp\|P32703\|YJCE__ECOLI HYPOTHETICAL 60.5 KD PROTEIN IN SOXR-ACS NTERGENIC REGION (O549). | 48 | 29 | 1812 |
| 194 | 1 | 2 | 385 | gi\|1510493 | *M. jannaschii* predicted coding region MJ0419 [*Methanococcus jannaschii*] | 48 | 25 | 384 |
| 197 | 1 | 452 | 3 | gi\|1045714 | spermidine/putrescine transport ATP-binding protein [*Mycoplasma genitalium*] | 48 | 25 | 450 |
| 203 | 1 | 1 | 396 | gi\|940288 | protein localized in the nucleoli of pea nuclei; ORF; putative [*Pisum sativum*] | 48 | 29 | 396 |
| 204 | 1 | 698 | 33 | gi\|529202 | No definition line found [*Caenorhabditis elegans*] | 48 | 25 | 666 |
| 206 | 20 | 27760 | 20705 | gi\|511490 | gramicidin S synthetase 2 [*Bacillus brevis*] | 48 | 27 | 7056 |
| 212 | 1 | 2 | 166 | gi\|295899 | nucleolin [*Xenopus laevis*] | 48 | 34 | 165 |
| 220 | 10 | 11426 | 10200 | gi\|44073 | SecY protein [*Lactococcus lactis*] | 48 | 23 | 1227 |
| 243 | 6 | 5491 | 4532 | gi\|1184118 | mevalonate kinase [*Methanobacterium thermoautotrophicum*] | 48 | 30 | 960 |
| 264 | 4 | 3308 | 1182 | gi\|1015903 | ORF YJR151c [*Saccharomyces cerevisiae*] | 48 | 26 | 2127 |
| 441 | 1 | 768 | 4 | gi\|142863 | replication initiation protein [*Bacillus subtilis*] pir\|B26580\|B26580 replication initiation protein - *Bacillus ubtilis* | 48 | 23 | 765 |
| 444 | 5 | 3898 | 5298 | gi\|145836 | putative [*Escherichia coli*] | 48 | 24 | 1401 |
| 484 | 2 | 388 | 1110 | gi\|146551 | transmembrane protein (kdpD) [*Escherichia coli*] | 48 | 18 | 723 |
| 542 | 3 | 1425 | 2000 | pir\|S28969\|S289 | N-carbamoylsarcosine amidohydrolase (EC 3.5.1.59) - *Arthrobacter* sp. | 48 | 27 | 576 |

TABLE 2-continued

| | | | | | | | | |
|---|---|---|---|---|---|---|---|---|
| 566 | 1 | 3 | 1019 | gi\|153490 | tetracenomycin C resistance and export protein [*Streptomyces laucescens*] | 48 | 24 | 1017 |
| 611 | 1 | 2 | 730 | gi\|1103507 | unknown [*Schizosaccharomyces pombe*] | 48 | 38 | 729 |
| 624 | 1 | 665 | 75 | gi\|144859 | ORF B [*Clostridium perfringens*] | 48 | 26 | 591 |
| 846 | 1 | 508 | 2 | gi\|537506 | paramyosin [*Dirofilaria immitis*] | 48 | 27 | 507 |
| 1020 | 1 | 66 | 950 | gi\|1499876 | magnesium and cobalt transport protein [*Methanococcus jannaschii*] | 48 | 30 | 885 |
| 1227 | 1 | 1 | 174 | gi\|493730 | lipoxygenase [*Pisum sativum*] | 48 | 35 | 174 |
| 1266 | 1 | 1 | 405 | gi\|882452 | ORF_f211; alternate name yggA; orf5 of X14436 [*Escherichia coli*] gi\|41425 ORF5 (AA 1–197) [*Escherichia coli*] (SUB 15–211) | 48 | 24 | 405 |
| 2071 | 1 | 381 | 55 | gi\|1408486 | HS74A gene product [*Bacillus subtilis*] | 48 | 25 | 327 |
| 2398 | 1 | 233 | 3 | gi\|1500401 | reverse gyrase [*Methanococcus jannaschii*] | 48 | 40 | 231 |
| 2425 | 1 | 246 | 16 | pir\|H48563\|H485 | G1 protein - fowlpox virus (strain HP444) (fragment) | 48 | 40 | 231 |
| 2432 | 1 | 225 | 4 | gi\|1353703 | Trio [*Homo sapiens*] | 48 | 33 | 222 |
| 2453 | 1 | 399 | 4 | gi\|142850 | division initiation protein [*Bacillus subtilis*] | 48 | 29 | 396 |
| 2998 | 1 | 236 | 3 | gi\|577569 | PepV [*Lactobacillus delbrueckii*] | 48 | 31 | 234 |
| 3042 | 1 | 14 | 280 | gi\|945219 | mucin [*Homo sapiens*] | 48 | 35 | 267 |
| 3686 | 1 | 1 | 405 | gi\|145836 | putative [*Escherichia coli*] | 48 | 25 | 405 |
| 4027 | 2 | 301 | 110 | pir\|S51177\|S511 | trans-activator protein - Equine infectious anemia virus | 48 | 32 | 192 |
| 4 | 2 | 2232 | 823 | gi\|1303989 | YqkI [*Bacillus subtilis*] | 47 | 24 | 1410 |
| 24 | 2 | 599 | 1084 | gi\|540083 | PC4-1 gene product [*Bradysia hygida*] | 47 | 28 | 486 |
| 36 | 10 | 6925 | 6326 | gi\|1209223 | esterase [*Acinetobacter lwoffii*] | 47 | 26 | 600 |
| 43 | 2 | 196 | 1884 | gi\|1403455 | unknown [*Mycobacterium tuberculosis*] | 47 | 27 | 1689 |
| 44 | 22 | 15108 | 14098 | gi\|1511555 | quinolone resistance norA protein protein [*Methanococcus jannaschii*] | 47 | 31 | 1011 |
| 69 | 7 | 6710 | 6279 | gi\|438466 | Possible operon with orfG. Hydrophilic, no homologue in the atabase; putative [*Bacillus subtilis*] | 47 | 29 | 432 |
| 81 | 4 | 4279 | 3536 | gi\|466882 | pps1; B1496_C2_189 [*Mycobacterium leprae*] | 47 | 24 | 744 |
| 120 | 12 | 8863 | 8591 | gi\|927340 | D9509.27p; CAI: 0.12 [*Saccharomyces cerevisiae*] | 47 | 38 | 273 |
| 142 | 1 | 1174 | 326 | gi\|486143 | ORF YKL094w [*Saccharomyces cerevisiae*] | 47 | 32 | 849 |
| 168 | 1 | 1093 | 8 | gi\|1177254 | hypothetical EcsB protein [*Bacillus subtilis*] | 47 | 29 | 1086 |
| 263 | 1 | 943 | 2 | gi\|142822 | D-alanine racemase cds [*Bacillus subtilis*] | 47 | 34 | 942 |
| 279 | 1 | 561 | 13 | gi\|516608 | 2 predicted membrane helices, homology with B. subtilis men Orf3 Rowland et. al. unpublished Accession number (M74183), approximately 1 minutes on updated Rudd map; putative [*Escherichia coli*] sp\|P37355\|YFBB_ECOLI HYPOTHETICAL 26.7 KD PROTEIN IN MEND–MENB | 47 | 31 | 549 |
| 345 | 2 | 1676 | 732 | gi\|1204835 | hippuricase [*Haemophilus influenzae*] | 47 | 28 | 945 |
| 389 | 2 | 152 | 400 | gi\|456562 | G-box binding factor [*Dictyostelium discoideum*] | 47 | 32 | 249 |
| 391 | 1 | 1 | 831 | gi\|1420856 | myo-inositol transporter [*Schizosaccharomyces pombe*] | 47 | 19 | 831 |
| 404 | 3 | 2072 | 2773 | gi\|1255425 | C33G8.2 gene product [*Caenorhabditis elegans*] | 47 | 17 | 702 |
| 529 | 5 | 2145 | 3107 | gi\|1303973 | YqjV [*Bacillus subtilis*] | 47 | 29 | 963 |
| 565 | 2 | 1257 | 193 | gi\|142824 | processing protease [*Bacillus subtilis*] | 47 | 28 | 1065 |
| 654 | 1 | 483 | 4 | gi\|243353 | ORF 5' of ECRF3 [herpesvirus saimiri HVS, host-squirrel monkey, eptide, 407 aa] | 47 | 23 | 480 |
| 692 | 1 | 115 | 633 | gi\|150756 | 40 kDa protein [Plasmid pJM1] | 47 | 25 | 519 |
| 765 | 1 | 819 | 4 | gi\|1256621 | 26.7% of identity in 165 aa to a *Thermophilic bacterium* hypothetical protein 6; putative [*Bacillus subtilis*] | 47 | 28 | 816 |
| 825 | 2 | 211 | 1023 | gi\|397526 | clumping factor [*Staphylococcus aureus*] | 47 | 32 | 813 |
| 914 | 1 | 1 | 615 | gi\|558073 | polymorphic antigen [*Plasmodium falciparum*] | 47 | 29 | 615 |
| 1076 | 1 | 1 | 753 | gi\|1147557 | Aspartate aminotransferase [*Bacillus circulans*] | 47 | 33 | 753 |
| 1351 | 1 | 398 | 3 | gi\|755153 | ATP-binding protein [*Bacillus subtilis*] | 47 | 20 | 396 |
| 4192 | 1 | 3 | 293 | gi\|145836 | putative [*Escherichia coli*] | 47 | 24 | 291 |
| 5 | 6 | 4361 | 4014 | gi\|305080 | myosin heavy chain [*Entamoeba histolytica*] | 46 | 30 | 348 |
| 11 | 4 | 2777 | 3058 | gi\|603639 | Ye1040p [*Saccharomyces cerevisiae*] | 46 | 28 | 282 |
| 46 | 11 | 10300 | 10082 | gi\|1246901 | ATP-dependent DNA ligase [*Candida albicans*] | 46 | 28 | 219 |
| 61 | 4 | 3941 | 7930 | gi\|298032 | EF [*Streptococcus suis*] | 46 | 35 | 3990 |
| 132 | 4 | 4093 | 3158 | gi\|1511057 | hypothetical protein SP:P45869 [*Methanococcus jannaschii*] | 46 | 25 | 936 |
| 170 | 4 | 3652 | 2585 | pir\|S51910\|S519 | G4 protein - *Sauroleishmania tarentolae* | 46 | 26 | 1068 |
| 191 | 7 | 8284 | 7025 | gi\|1041334 | F54D5.7 [*Caenorhabditis elegans*] | 46 | 25 | 1260 |
| 253 | 1 | 1 | 396 | gi\|1204449 | dihydrolipoamide acetyltransferase [*Haemophilus influenzae*] | 46 | 35 | 396 |
| 264 | 3 | 437 | 973 | gi\|180189 | cerebellar-degeneration-related antigen (CDR34) [*Homo sapiens*] gi\|182737 cerebellar degeneration-associated protein [*Homo sapiens*] pir\|A29770\|A29770 cerebellar degeneration-related protein - human | 46 | 29 | 537 |
| 273 | 1 | 285 | 85 | gi\|607573 | envelope glycoprotein C2V3 region [Human immunodeficiency virus type] | 46 | 35 | 201 |
| 350 | 1 | 3 | 563 | gi\|537052 | ORF_f286 [*Escherichia coli*] | 46 | 35 | 561 |
| 384 | 1 | 2 | 862 | gi\|1221884 | (urea?) amidolyase [*Haemophilus influenzae*] | 46 | 31 | 861 |
| 410 | 4 | 1876 | 2490 | gi\|1110518 | proton antiporter efflux pump [*Mycobacterium smegmatis*] | 46 | 24 | 615 |
| 432 | 1 | 1455 | 247 | gi\|1197634 | orf4; putative transporter; Method: conceptual translation supplied by author [*Mycobacterium smegmatis*] | 46 | 27 | 1209 |
| 458 | 1 | 1211 | 3 | gi\|15470 | portal protein [Bacteriophage SPP1] | 46 | 30 | 1209 |
| 517 | 5 | 2477 | 4192 | gi\|1523812 | orf5 [Bacteriophage A2] | 46 | 23 | 1716 |
| 540 | 3 | 1285 | 1058 | gi\|215635 | pacA [Bacteriophage P1] | 46 | 30 | 228 |
| 587 | 2 | 649 | 1242 | gi\|537148 | ORF_f181 [*Escherichia coli*] | 46 | 29 | 594 |
| 1218 | 1 | 391 | 35 | gi\|1205456 | single-stranded-DNA-specific exonuclease [*Haemophilus influenzae*] | 46 | 30 | 357 |

TABLE 2-continued

| | | | | | | | | |
|---|---|---|---|---|---|---|---|---|
| 3685 | 1 | 1 | 402 | gi\|450688 | hsdM gene of EcoprrI gene product [*Escherichia coli*] pir\|S38437\|S38437 hsdM protein - *Escherichia coli* pir\|S09629\|S09629 hypothetical protein A - *Escherichia coli* (SUB 40–520) | 46 | 33 | 402 |
| 4176 | 1 | 338 | 3 | gi\|951460 | FIM-C.1 gene product [*Xenopus laevis*] | 46 | 31 | 336 |
| 37 | 7 | 4813 | 5922 | gi\|606064 | ORF_f408 [*Escherichia coli*] | 45 | 24 | 1110 |
| 38 | 16 | 11699 | 12004 | gi\|452192 | protein tyrosine phosphatase (PTP-BAS, type 2) [*Homo sapiens*] | 45 | 24 | 306 |
| 87 | 2 | 1748 | 2407 | gi\|1064813 | homologous to sp:PHOR_BACSU [*Bacillus subtilis*] | 45 | 23 | 660 |
| 103 | 12 | 13385 | 12588 | gi\|1001307 | hypothetical protein [*Synechocystis sp.*] | 45 | 22 | 798 |
| 112 | 14 | 13811 | 12831 | gi\|1204389 | *H. influenzae* predicted coding region HI0131 [*Haemophilus influenzae*] | 45 | 23 | 981 |
| 145 | 4 | 3461 | 2439 | gi\|220578 | open reading frame [*Mus musculus*] | 45 | 20 | 1023 |
| 170 | 6 | 4965 | 3601 | gi\|238657 | AppC=cytochrome d oxidase, subunit I homolog [*Escherichia coli*, K12, eptide, 514 aa] | 45 | 27 | 1365 |
| 206 | 2 | 4346 | 3462 | gi\|1222056 | aminotransferase [*Haemophilus influenzae*] | 45 | 27 | 885 |
| 228 | 1 | 60 | 716 | gi\|160299 | glutamic acid-rich protein [*Plasmodium falciparum*] pir\|A54514\|A54514 glutamic acid-rich protein precursor - *Plasmodium alciparum* | 45 | 23 | 657 |
| 288 | 1 | 2 | 1015 | gi\|1255425 | C33G8.2 gene product [*Caenorhabditis elegans*] | 45 | 23 | 1014 |
| 313 | 3 | 3128 | 1917 | gi\|581140 | NADH dehydrogenase [*Escherichia coli*] | 45 | 30 | 1212 |
| 332 | 1 | 459 | 4 | gi\|870966 | F47A4.2 [*Caenorhabditis elegans*] | 45 | 20 | 456 |
| 344 | 1 | 3 | 221 | gi\|171225 | kinesin-related protein [*Saccharomyces cerevisiae*] | 45 | 26 | 219 |
| 441 | 2 | 1073 | 645 | gi\|142863 | replication initiation protein [*Bacillus subtilis*] pir\|B26580\|B26580 replication initiation protein - *Bacillus ubtilis* | 45 | 27 | 429 |
| 672 | 1 | 2 | 982 | gi\|1511334 | *M. jannaschii* predicted coding region MJ1323 [*Methanococcus jannaschii*] | 45 | 22 | 981 |
| 763 | 3 | 851 | 357 | gi\|606180 | ORF_f310 [*Escherichia coli*] | 45 | 24 | 495 |
| 886 | 3 | 379 | 846 | gi\|726426 | similar to protein kinases and *C. elegans* proteins F37C12.8 and 37C12.5 [*Caenorhabditis elegans*] | 45 | 30 | 468 |
| 948 | 1 | 3 | 473 | gi\|156400 | myosin heavy chain (isozyme unc-54) [*Caenorhabditis elegans*] pir\|A93958\|MWKW myosin heavy chain B - *Caenorhabditis elegans* sp\|P02566\|MYSB_CAEEL MYOSIN HEAVY CHAIN B (MHC B). | 45 | 25 | 471 |
| 1158 | 1 | 2 | 376 | gi\|441155 | ransmission-blocking target antigen [*Plasmodium falciparum*] | 45 | 35 | 375 |
| 2551 | 1 | 4 | 285 | gi\|1276705 | ORF287 gene product [*Porphyra purpurea*] | 45 | 28 | 282 |
| 3967 | 1 | 42 | 374 | gi\|976025 | HrsA [*Escherichia coli*] | 45 | 28 | 333 |
| 52 | 7 | 5846 | 4761 | gi\|467378 | unknown [*Bacillus subtilis*] | 44 | 22 | 1086 |
| 138 | 8 | 6475 | 6849 | gi\|173028 | thioredoxin II [*Saccharomyces cerevisiae*] | 44 | 28 | 375 |
| 221 | 5 | 5617 | 4202 | gi\|153490 | tetracenomycin C resistance and export protein [*Streptomyces laucescens*] | 44 | 21 | 1416 |
| 252 | 2 | 1122 | 913 | gi\|1204989 | hypothetical protein (GB:U00022_9) [*Haemophilus influenzae*] | 44 | 30 | 210 |
| 263 | 2 | 2093 | 921 | gi\|1136221 | carboxypeptidase [*Sulfolobus solfataricus*] | 44 | 26 | 1173 |
| 365 | 4 | 3524 | 2085 | gi\|1296822 | orf1 gene product [*Lactobacillus helveticus*] | 44 | 31 | 1440 |
| 543 | 3 | 1315 | 1833 | gi\|1063250 | low homology to P20 protein of *Bacillus lichiniformis* and bleomycin acetyltransferase of *Streptomyces verticillus* [*Bacillus subtilis*] | 44 | 24 | 519 |
| 544 | 4 | 3942 | 4892 | gi\|951460 | FIM-C.1 gene product [*Xenopus laevis*] | 44 | 32 | 951 |
| 792 | 1 | 613 | 2 | gi\|205680 | high molecular weight neurofilament [*Rattus norvegicus*] | 44 | 28 | 612 |
| 44 | 18 | 11303 | 11911 | gi\|1511614 | molybdopterin-guanine dinucleotide biosynthesis protein A [*Methanococcus jannaschii*] | 43 | 27 | 609 |
| 59 | 8 | 3665 | 5128 | gi\|153490 | tetracenomycin C resistance and export protein [*Streptomyces laucescens*] | 43 | 21 | 1464 |
| 59 | 10 | 5536 | 7527 | gi\|153022 | lipase [*Staphylococcus epidermidis*] | 43 | 22 | 1992 |
| 99 | 1 | 681 | 16 | gi\|1419051 | unknown [*Mycobacterium tuberculosis*] | 43 | 21 | 666 |
| 310 | 8 | 9402 | 12134 | gi\|397526 | clumping factor [*Staphylococcus aureus*] | 43 | 21 | 2733 |
| 432 | 3 | 2303 | 1824 | pir\|A60540\|A605 | sporozoite surface protein 2 - *Plasmodium yoelii* (fragment) | 43 | 29 | 480 |
| 519 | 3 | 2547 | 3122 | sp\|Q06530\|DHSU_ | SULFIDE DEHYDROGENASE (FLAVOCYTOCHROME C) FLAVOPROTEIN CHAIN PRECURSOR (EC 1.8.2.—) (FC) (FCSD). | 43 | 23 | 576 |
| 4 | 13 | 12053 | 13321 | gi\|295671 | selected as a weak suppressor of a mutant of the subunit AC40 of DNA ependant RNA polymerase I and III [*Saccharomyces cerevisiae*] | 42 | 18 | 1269 |
| 94 | 2 | 1091 | 414 | gi\|501027 | ORF2 [*Trypanosoma brucei*] | 42 | 31 | 678 |
| 127 | 4 | 4550 | 3309 | gi\|42029 | ORF1 gene product [*Escherichia coli*] | 42 | 21 | 1242 |
| 297 | 3 | 1036 | 557 | gi\|142790 | ORF1; putative [*Bacillus firmus*] | 42 | 25 | 480 |
| 344 | 6 | 3525 | 2953 | gi\|40320 | ORF 2 (AA 1–203) [*Bacillus thuringiensis*] | 42 | 30 | 573 |
| 512 | 1 | 1115 | 63 | gi\|405957 | yeeF [*Escherichia coli*] | 42 | 23 | 1053 |
| 631 | 1 | 1223 | 12 | gi\|580920 | rodD (gtaA) polypeptide (AA 1–673) [*Bacillus subtilis*] pir\|S06048\|S06048 probable rodD protein - *Bacillus subtilis* sp\|P13484\|TAGE_BACSU PROBABLE POLY(GLYCEROL-PHOSPHATE) LPHA-GLUCOSYLTRANSFERASE (EC 2.4.1.52) (TECHOIC ACID BIOSYNTHESIS ROTEIN E). | 42 | 24 | 1212 |
| 685 | 3 | 1739 | 1119 | gi\|1303784 | YqeD [*Bacillus subtilis*] | 42 | 19 | 621 |
| 4132 | 1 | 395 | 3 | gi\|1022910 | protein tyrosine phosphatase [*Dictyostelium discoideum*] | 42 | 25 | 393 |
| 86 | 2 | 884 | 393 | gi\|309506 | spermidine/spermine N1-acetyltransferase [*Mus saxicola*] pir\|S43430\|S43430 spermidine/spermine N1-acetyltransferase - spiny ouse [*Mus saxicola*] | 41 | 30 | 492 |
| 191 | 12 | 14075 | 13353 | gi\|1124957 | orf4 gene product [*Methanosarcina barkeri*] | 41 | 22 | 723 |
| 212 | 6 | 2150 | 3127 | gi\|15873 | observed 35.2 Kd protein [*Mycobacteriophage 15*] | 41 | 26 | 978 |

TABLE 2-continued

| | | | | | | | | |
|---|---|---|---|---|---|---|---|---|
| 213 | 3 | 1263 | 2000 | gi\|633692 | TrsA [*Yersinia enterocolitica*] | 41 | 18 | 738 |
| 408 | 4 | 2625 | 3386 | gi\|1197634 | orf4; putative transporter; Method: conceptual translation supplied by author [*Mycobacterium smegmatis*] | 41 | 24 | 762 |
| 542 | 1 | 3 | 1103 | gi\|457146 | rhoptry protein [*Plasmodium yoelii*] | 41 | 21 | 1101 |
| 924 | 1 | 2 | 475 | pir\|JH0148\|JH01 | nucleolin - rat | 41 | 30 | 474 |
| 1562 | 1 | 1 | 402 | gi\|552184 | asparagine-rich antigen Pfa35-2 [*Plasmodium falciparum*] pir\|S27826\|S27826 asparagine-rich antigen Pfa35-2 - *Plasmodium alciparum* (fragment) | 40 | 20 | 402 |
| 2395 | 1 | 261 | 4 | pir\|S42251\|S422 | hypothetical protein 5 - fowlpox virus | 40 | 18 | 258 |
| 4077 | 1 | 3 | 305 | gi\|1055055 | coded for by *C. elegans* cDNA yk37g1.5; coded for by *C. elegans* cDNA yk5c9.5; coded for by *C. elegans* cDNA yk1a9.5; alternatively spliced form of F52C9.8b [*Caenorhabditis elegans*] | 39 | 21 | 303 |
| 958 | 1 | 503 | 3 | gi\|1255425 | C33G8.2 gene product [*Caenorhabditis elegans*] | 37 | 25 | 501 |
| 59 | 12 | 8294 | 10636 | gi\|535260 | STARP antigen [*Plasmodium reichenowi*] | 36 | 24 | 2343 |
| 63 | 5 | 3550 | 8079 | gi\|298032 | EF [*Streptococcus suis*] | 36 | 19 | 4530 |
| 544 | 3 | 2507 | 3601 | gi\|1015903 | ORF YJR151c [*Saccharomyces cerevisiae*] | 35 | 22 | 1095 |
| 63 | 4 | 1949 | 3574 | gi\|552195 | circumsporozoite protein [*Plasmodium falciparum*] sp\|P05691\|CSP_PLAFL CIRCUMSPOROZOITE PROTEIN (CS) (FRAGMENT). | 32 | 27 | 1626 |

TABLE 3

*S. aureus* - Putative coding regions of novel proteins not similar to known proteins

| Contig ID | ORF ID | Start (nt) | Stop (nt) |
|---|---|---|---|
| 4 | 1 | 692 | 150 |
| 4 | 3 | 1712 | 2278 |
| 4 | 4 | 3032 | 2361 |
| 4 | 14 | 12585 | 12097 |
| 5 | 2 | 1601 | 663 |
| 5 | 3 | 1532 | 1771 |
| 5 | 7 | 4550 | 4359 |
| 5 | 9 | 6422 | 4905 |
| 5 | 12 | 8547 | 8383 |
| 6 | 4 | 1982 | 1605 |
| 8 | 1 | 176 | 3 |
| 11 | 8 | 5144 | 5983 |
| 11 | 9 | 5968 | 6498 |
| 11 | 10 | 6284 | 6096 |
| 11 | 16 | 10954 | 11271 |
| 12 | 5 | 4942 | 4532 |
| 12 | 6 | 4596 | 4862 |
| 15 | 3 | 1650 | 1405 |
| 16 | 10 | 10835 | 10407 |
| 18 | 2 | 917 | 741 |
| 20 | 9 | 7764 | 6403 |
| 20 | 10 | 8230 | 7889 |
| 20 | 12 | 8803 | 8405 |
| 20 | 13 | 10470 | 8782 |
| 23 | 1 | 339 | 4 |
| 23 | 6 | 5485 | 4832 |
| 23 | 8 | 5942 | 5508 |
| 23 | 9 | 6881 | 6111 |
| 23 | 15 | 12618 | 12830 |
| 24 | 4 | 4185 | 3814 |
| 24 | 6 | 5241 | 4840 |
| 25 | 2 | 1824 | 2402 |
| 31 | 2 | 505 | 849 |
| 31 | 3 | 1177 | 1524 |
| 31 | 4 | 2454 | 3005 |
| 32 | 2 | 765 | 1388 |
| 32 | 9 | 7952 | 8575 |
| 32 | 10 | 8591 | 8728 |
| 32 | 11 | 9379 | 9020 |
| 32 | 12 | 10087 | 9377 |
| 34 | 2 | 1049 | 783 |
| 36 | 7 | 5226 | 5801 |
| 36 | 11 | 7261 | 6947 |
| 36 | 12 | 7424 | 7621 |
| 37 | 4 | 2964 | 2770 |
| 38 | 2 | 980 | 375 |
| 38 | 11 | 6425 | 6868 |
| 38 | 20 | 16371 | 15760 |
| 38 | 26 | 20253 | 20804 |
| 38 | 27 | 20722 | 21264 |
| 39 | 1 | 1 | 627 |
| 40 | 1 | 404 | 3 |
| 43 | 1 | 428 | 60 |
| 44 | 4 | 2324 | 1974 |
| 44 | 5 | 2484 | 3263 |
| 44 | 14 | 10129 | 9671 |
| 44 | 20 | 13536 | 13348 |
| 44 | 21 | 13596 | 13994 |
| 45 | 7 | 6297 | 6019 |
| 46 | 8 | 6365 | 6520 |
| 46 | 12 | 10449 | 10976 |
| 46 | 17 | 15032 | 15424 |
| 47 | 1 | 288 | 1079 |
| 48 | 9 | 7620 | 7778 |
| 50 | 1 | 962 | 312 |
| 50 | 2 | 1316 | 1011 |
| 51 | 1 | 370 | 2 |
| 51 | 5 | 2245 | 1970 |
| 53 | 1 | 287 | 132 |
| 53 | 7 | 6319 | 5933 |
| 54 | 7 | 8709 | 8404 |
| 55 | 1 | 326 | 60 |
| 55 | 3 | 786 | 520 |
| 56 | 1 | 1 | 261 |
| 56 | 3 | 1228 | 905 |
| 56 | 4 | 1560 | 1150 |
| 56 | 17 | 18712 | 18332 |
| 57 | 4 | 3521 | 3348 |
| 57 | 8 | 5436 | 5822 |
| 58 | 9 | 8553 | 8221 |
| 59 | 3 | 1366 | 1509 |
| 59 | 6 | 2802 | 2578 |
| 59 | 7 | 3570 | 3370 |
| 59 | 9 | 4563 | 4180 |
| 59 | 11 | 7518 | 8378 |
| 59 | 13 | 10401 | 16403 |
| 62 | 2 | 1521 | 346 |
| 62 | 11 | 5440 | 5757 |
| 63 | 1 | 1 | 336 |
| 67 | 1 | 900 | 1781 |
| 67 | 2 | 1774 | 2610 |
| 67 | 3 | 2591 | 3904 |
| 67 | 8 | 6955 | 6800 |
| 68 | 1 | 78 | 326 |

TABLE 3-continued

S. aureus - Putative coding regions of novel proteins not similar to known proteins

| Contig ID | ORF ID | Start (nt) | Stop (nt) |
|---|---|---|---|
| 70 | 6 | 5199 | 3637 |
| 70 | 11 | 8645 | 8355 |
| 77 | 3 | 1192 | 794 |
| 79 | 2 | 1228 | 947 |
| 79 | 3 | 1411 | 1791 |
| 83 | 1 | 2 | 403 |
| 85 | 9 | 8300 | 8653 |
| 85 | 10 | 8781 | 8593 |
| 86 | 3 | 1232 | 1038 |
| 87 | 8 | 9187 | 9366 |
| 88 | 3 | 1620 | 1922 |
| 89 | 1 | 3 | 161 |
| 89 | 7 | 4878 | 4714 |
| 91 | 1 | 550 | 2 |
| 91 | 3 | 3141 | 2344 |
| 92 | 2 | 449 | 928 |
| 92 | 3 | 1467 | 976 |
| 92 | 9 | 5638 | 6024 |
| 94 | 1 | 332 | 3 |
| 94 | 3 | 1813 | 1181 |
| 94 | 4 | 2197 | 1811 |
| 96 | 11 | 10601 | 11050 |
| 99 | 6 | 4523 | 4374 |
| 99 | 7 | 4784 | 4554 |
| 100 | 8 | 7287 | 6916 |
| 102 | 7 | 4368 | 4039 |
| 103 | 3 | 2035 | 1574 |
| 104 | 1 | 2 | 694 |
| 104 | 2 | 699 | 1277 |
| 105 | 1 | 693 | 151 |
| 105 | 3 | 2655 | 2077 |
| 106 | 1 | 3 | 221 |
| 106 | 3 | 1209 | 1355 |
| 107 | 1 | 542 | 3 |
| 109 | 4 | 3651 | 3277 |
| 109 | 13 | 11625 | 11996 |
| 109 | 14 | 11981 | 12268 |
| 109 | 20 | 17401 | 17688 |
| 110 | 1 | 2 | 760 |
| 114 | 10 | 8764 | 9384 |
| 116 | 1 | 1 | 309 |
| 116 | 3 | 4462 | 2651 |
| 116 | 8 | 9976 | 8903 |
| 116 | 9 | 10158 | 10003 |
| 120 | 5 | 3320 | 2937 |
| 120 | 6 | 3869 | 3468 |
| 120 | 13 | 9290 | 9844 |
| 121 | 2 | 417 | 569 |
| 126 | 3 | 818 | 546 |
| 127 | 3 | 2648 | 3196 |
| 127 | 5 | 4084 | 4395 |
| 131 | 6 | 6438 | 6103 |
| 132 | 2 | 715 | 1695 |
| 134 | 1 | 2 | 667 |
| 135 | 2 | 258 | 4 |
| 135 | 3 | 729 | 334 |
| 138 | 1 | 3 | 152 |
| 138 | 7 | 6008 | 6463 |
| 140 | 1 | 1032 | 4 |
| 140 | 2 | 1513 | 1007 |
| 140 | 5 | 2387 | 2743 |
| 142 | 2 | 1360 | 2388 |
| 142 | 7 | 7586 | 6342 |
| 143 | 7 | 6502 | 5714 |
| 144 | 1 | 640 | 53 |
| 146 | 1 | 2 | 511 |
| 146 | 3 | 502 | 1350 |
| 146 | 4 | 2540 | 1407 |
| 146 | 5 | 2874 | 3071 |
| 147 | 1 | 1 | 339 |
| 149 | 11 | 3615 | 3274 |
| 149 | 12 | 3785 | 3534 |
| 149 | 13 | 4145 | 3783 |
| 149 | 15 | 4610 | 4413 |
| 149 | 16 | 5049 | 4603 |
| 149 | 18 | 5491 | 5243 |
| 149 | 21 | 7054 | 6692 |
| 149 | 23 | 8521 | 7826 |
| 149 | 24 | 9106 | 8531 |
| 149 | 25 | 9897 | 9115 |
| 150 | 2 | 1587 | 871 |
| 154 | 3 | 1508 | 1221 |
| 154 | 8 | 6398 | 6210 |
| 154 | 14 | 12147 | 11590 |
| 154 | 15 | 12803 | 12075 |
| 156 | 1 | 315 | 593 |
| 157 | 3 | 1183 | 2232 |
| 158 | 2 | 1064 | 657 |
| 159 | 3 | 452 | 808 |
| 161 | 2 | 876 | 1808 |
| 161 | 6 | 4279 | 3905 |
| 161 | 7 | 4540 | 4277 |
| 161 | 8 | 4717 | 4538 |
| 161 | 11 | 5638 | 5459 |
| 163 | 2 | 840 | 76 |
| 163 | 5 | 2344 | 1892 |
| 163 | 7 | 2647 | 2342 |
| 163 | 9 | 4905 | 5132 |
| 164 | 3 | 1147 | 956 |
| 166 | 3 | 4854 | 4495 |
| 168 | 4 | 2500 | 2868 |
| 168 | 5 | 3595 | 4158 |
| 170 | 3 | 2517 | 2777 |
| 171 | 2 | 1450 | 623 |
| 171 | 11 | 11125 | 9674 |
| 172 | 1 | 3 | 278 |
| 172 | 2 | 1149 | 358 |
| 173 | 1 | 708 | 127 |
| 173 | 5 | 6114 | 5227 |
| 174 | 2 | 593 | 1105 |
| 175 | 3 | 2552 | 2890 |
| 175 | 5 | 3335 | 2850 |
| 175 | 7 | 4342 | 4506 |
| 182 | 4 | 4986 | 4495 |
| 184 | 5 | 5702 | 5361 |
| 188 | 2 | 1210 | 1755 |
| 188 | 4 | 2647 | 2994 |
| 189 | 6 | 2614 | 3039 |
| 190 | 3 | 1998 | 2564 |
| 191 | 1 | 1 | 153 |
| 191 | 2 | 669 | 388 |
| 191 | 10 | 11786 | 13039 |
| 191 | 11 | 12363 | 11824 |
| 192 | 1 | 91 | 426 |
| 195 | 3 | 1932 | 1558 |
| 195 | 5 | 2606 | 2313 |
| 198 | 2 | 1016 | 1591 |
| 201 | 1 | 170 | 625 |
| 203 | 2 | 783 | 1466 |
| 206 | 6 | 7815 | 6700 |
| 206 | 12 | 13636 | 13325 |
| 206 | 21 | 27960 | 27712 |
| 212 | 2 | 170 | 817 |
| 212 | 3 | 796 | 1167 |
| 212 | 7 | 3128 | 3436 |
| 212 | 9 | 3749 | 4075 |
| 213 | 1 | 1 | 705 |
| 214 | 2 | 570 | 64 |
| 214 | 6 | 3738 | 3412 |
| 214 | 9 | 6600 | 6995 |
| 214 | 10 | 7469 | 7074 |
| 217 | 1 | 965 | 3 |
| 218 | 1 | 178 | 657 |
| 218 | 3 | 1776 | 2156 |
| 220 | 2 | 1369 | 887 |
| 220 | 3 | 2262 | 1273 |

TABLE 3-continued

*S. aureus* - Putative coding regions of novel proteins not similar to known proteins

| Contig ID | ORF ID | Start (nt) | Stop (nt) |
|---|---|---|---|
| 220 | 7 | 7208 | 6141 |
| 220 | 8 | 8661 | 7078 |
| 220 | 9 | 10216 | 8636 |
| 221 | 4 | 2613 | 2131 |
| 221 | 9 | 10757 | 10086 |
| 226 | 1 | 3 | 659 |
| 226 | 2 | 1459 | 722 |
| 226 | 3 | 1476 | 1961 |
| 227 | 1 | 2 | 487 |
| 227 | 2 | 460 | 975 |
| 227 | 4 | 1855 | 2121 |
| 227 | 5 | 2052 | 2345 |
| 227 | 6 | 3768 | 2776 |
| 227 | 9 | 5591 | 6367 |
| 228 | 5 | 2503 | 2877 |
| 228 | 6 | 2846 | 3526 |
| 233 | 7 | 3762 | 3580 |
| 236 | 2 | 579 | 349 |
| 238 | 2 | 1391 | 807 |
| 239 | 2 | 905 | 393 |
| 241 | 5 | 4334 | 4173 |
| 242 | 2 | 1363 | 1049 |
| 243 | 1 | 127 | 576 |
| 244 | 1 | 647 | 3 |
| 244 | 2 | 1962 | 889 |
| 245 | 2 | 1258 | 902 |
| 246 | 1 | 69 | 215 |
| 246 | 4 | 738 | 1733 |
| 249 | 3 | 3712 | 3518 |
| 250 | 1 | 249 | 4 |
| 254 | 1 | 1 | 156 |
| 256 | 2 | 956 | 1144 |
| 257 | 3 | 3227 | 2754 |
| 260 | 4 | 4580 | 4254 |
| 261 | 4 | 2196 | 2606 |
| 261 | 6 | 3214 | 3681 |
| 264 | 2 | 155 | 439 |
| 264 | 5 | 4533 | 3814 |
| 264 | 6 | 4739 | 5107 |
| 267 | 2 | 931 | 539 |
| 268 | 4 | 4700 | 4260 |
| 272 | 1 | 446 | 30 |
| 272 | 3 | 1200 | 1439 |
| 272 | 9 | 4691 | 4909 |
| 272 | 10 | 6035 | 5601 |
| 276 | 4 | 1746 | 1901 |
| 278 | 1 | 224 | 553 |
| 278 | 5 | 3299 | 3448 |
| 278 | 7 | 4849 | 5127 |
| 285 | 2 | 551 | 736 |
| 288 | 3 | 1756 | 1950 |
| 288 | 5 | 2055 | 2276 |
| 289 | 1 | 1055 | 3 |
| 290 | 2 | 1932 | 1630 |
| 291 | 2 | 332 | 622 |
| 291 | 5 | 1545 | 2051 |
| 295 | 3 | 1349 | 1092 |
| 295 | 4 | 2141 | 1554 |
| 295 | 5 | 2220 | 2762 |
| 297 | 2 | 465 | 142 |
| 298 | 1 | 2 | 205 |
| 300 | 2 | 1928 | 1476 |
| 301 | 7 | 2624 | 2454 |
| 304 | 1 | 3 | 194 |
| 306 | 1 | 109 | 654 |
| 306 | 5 | 4036 | 4257 |
| 307 | 1 | 339 | 4 |
| 307 | 8 | 3645 | 3995 |
| 308 | 1 | 1 | 654 |
| 308 | 2 | 599 | 78 |
| 308 | 4 | 2332 | 2021 |
| 313 | 2 | 1919 | 1524 |
| 314 | 1 | 10 | 702 |
| 316 | 2 | 982 | 1341 |
| 316 | 6 | 2758 | 3165 |
| 317 | 1 | 2 | 1114 |
| 317 | 3 | 3458 | 2346 |
| 321 | 6 | 5217 | 4789 |
| 321 | 7 | 6140 | 5961 |
| 321 | 8 | 6794 | 6138 |
| 322 | 2 | 543 | 259 |
| 326 | 2 | 165 | 1112 |
| 326 | 3 | 1117 | 1467 |
| 328 | 1 | 469 | 2 |
| 328 | 5 | 3276 | 3100 |
| 329 | 1 | 3 | 719 |
| 329 | 2 | 781 | 1212 |
| 329 | 3 | 1471 | 1833 |
| 330 | 1 | 289 | 2 |
| 330 | 3 | 1447 | 1623 |
| 332 | 3 | 2204 | 2055 |
| 332 | 7 | 4971 | 5138 |
| 333 | 2 | 3128 | 2961 |
| 335 | 1 | 433 | 2 |
| 337 | 2 | 95 | 526 |
| 340 | 2 | 1356 | 1054 |
| 341 | 1 | 3 | 281 |
| 341 | 3 | 2476 | 3192 |
| 341 | 5 | 3618 | 3944 |
| 341 | 6 | 3929 | 4558 |
| 344 | 5 | 2889 | 2581 |
| 345 | 1 | 768 | 4 |
| 346 | 2 | 221 | 592 |
| 350 | 3 | 1410 | 1598 |
| 352 | 2 | 1765 | 1352 |
| 352 | 3 | 4596 | 1876 |
| 352 | 7 | 7967 | 8404 |
| 352 | 8 | 8906 | 9247 |
| 352 | 9 | 9854 | 9537 |
| 359 | 1 | 1 | 546 |
| 362 | 1 | 3 | 656 |
| 364 | 2 | 1808 | 1458 |
| 364 | 8 | 10714 | 10454 |
| 365 | 2 | 1313 | 1014 |
| 365 | 5 | 4090 | 3500 |
| 365 | 7 | 4980 | 6239 |
| 366 | 3 | 520 | 1719 |
| 367 | 3 | 906 | 1085 |
| 368 | 1 | 494 | 240 |
| 375 | 1 | 2 | 136 |
| 380 | 3 | 1097 | 843 |
| 389 | 1 | 1 | 276 |
| 390 | 1 | 2 | 877 |
| 390 | 2 | 1373 | 1549 |
| 391 | 2 | 560 | 369 |
| 395 | 1 | 197 | 3 |
| 396 | 1 | 1068 | 4 |
| 398 | 3 | 1141 | 938 |
| 399 | 1 | 178 | 669 |
| 401 | 3 | 566 | 847 |
| 402 | 2 | 100 | 465 |
| 404 | 8 | 5370 | 5179 |
| 408 | 2 | 2269 | 1031 |
| 408 | 3 | 2672 | 2469 |
| 408 | 5 | 3524 | 4423 |
| 410 | 3 | 1890 | 1669 |
| 413 | 1 | 488 | 96 |
| 416 | 1 | 320 | 33 |
| 416 | 2 | 578 | 847 |
| 416 | 3 | 1590 | 985 |
| 417 | 1 | 3 | 179 |
| 417 | 2 | 161 | 616 |
| 420 | 2 | 513 | 238 |
| 422 | 2 | 357 | 677 |
| 431 | 2 | 856 | 1407 |
| 432 | 2 | 446 | 1084 |

TABLE 3-continued

*S. aureus* - Putative coding regions of novel proteins not similar to known proteins

| Contig ID | ORF ID | Start (nt) | Stop (nt) |
|---|---|---|---|
| 433 | 1 | 1 | 417 |
| 433 | 3 | 2033 | 1755 |
| 434 | 1 | 535 | 128 |
| 434 | 2 | 1235 | 381 |
| 440 | 1 | 1 | 450 |
| 442 | 2 | 1269 | 3320 |
| 443 | 3 | 1520 | 1167 |
| 444 | 1 | 1 | 696 |
| 444 | 7 | 6366 | 5971 |
| 451 | 1 | 614 | 288 |
| 453 | 2 | 636 | 376 |
| 453 | 8 | 3833 | 4786 |
| 453 | 9 | 4512 | 4306 |
| 453 | 10 | 4731 | 4525 |
| 455 | 1 | 219 | 4 |
| 455 | 2 | 472 | 930 |
| 459 | 1 | 265 | 687 |
| 462 | 1 | 2 | 247 |
| 466 | 2 | 907 | 320 |
| 467 | 1 | 349 | 44 |
| 468 | 1 | 2 | 250 |
| 469 | 1 | 925 | 362 |
| 469 | 3 | 2386 | 3372 |
| 469 | 4 | 3464 | 3706 |
| 470 | 1 | 77 | 538 |
| 470 | 6 | 3694 | 3290 |
| 470 | 7 | 5686 | 5042 |
| 470 | 9 | 7351 | 8181 |
| 470 | 10 | 8175 | 9773 |
| 471 | 1 | 500 | 60 |
| 471 | 2 | 1017 | 472 |
| 476 | 1 | 70 | 267 |
| 477 | 1 | 2 | 760 |
| 477 | 3 | 1764 | 2081 |
| 477 | 4 | 2066 | 2332 |
| 480 | 5 | 4016 | 4261 |
| 481 | 2 | 480 | 4 |
| 486 | 3 | 613 | 774 |
| 487 | 6 | 1795 | 2112 |
| 488 | 1 | 359 | 3 |
| 492 | 1 | 127 | 675 |
| 493 | 1 | 2 | 520 |
| 493 | 2 | 496 | 1242 |
| 502 | 3 | 1149 | 1571 |
| 504 | 1 | 346 | 2 |
| 505 | 5 | 4150 | 3734 |
| 511 | 2 | 1232 | 723 |
| 512 | 2 | 583 | 747 |
| 515 | 1 | 609 | 812 |
| 517 | 4 | 2179 | 2511 |
| 520 | 4 | 2097 | 2360 |
| 520 | 6 | 3669 | 3430 |
| 527 | 1 | 1 | 498 |
| 528 | 1 | 335 | 33 |
| 529 | 2 | 1104 | 529 |
| 530 | 7 | 5298 | 5534 |
| 536 | 1 | 156 | 4 |
| 538 | 1 | 736 | 110 |
| 538 | 3 | 2203 | 2880 |
| 538 | 5 | 3121 | 2711 |
| 538 | 6 | 3731 | 3114 |
| 540 | 1 | 664 | 332 |
| 540 | 2 | 1031 | 567 |
| 541 | 1 | 89 | 433 |
| 541 | 2 | 432 | 145 |
| 542 | 2 | 1048 | 1272 |
| 545 | 2 | 734 | 456 |
| 551 | 1 | 1129 | 113 |
| 555 | 2 | 704 | 516 |
| 558 | 3 | 1154 | 951 |
| 558 | 4 | 1458 | 1156 |
| 558 | 5 | 1821 | 1537 |
| 558 | 6 | 2020 | 1874 |
| 558 | 7 | 2322 | 2008 |
| 558 | 8 | 2802 | 2551 |
| 558 | 9 | 3453 | 2920 |
| 560 | 1 | 475 | 921 |
| 565 | 3 | 1485 | 1264 |
| 571 | 1 | 156 | 4 |
| 571 | 3 | 994 | 1206 |
| 577 | 1 | 2 | 199 |
| 577 | 2 | 163 | 453 |
| 579 | 1 | 1 | 477 |
| 579 | 2 | 1200 | 616 |
| 583 | 1 | 996 | 4 |
| 585 | 1 | 539 | 132 |
| 587 | 1 | 22 | 573 |
| 588 | 2 | 1372 | 848 |
| 588 | 3 | 1554 | 1366 |
| 590 | 1 | 47 | 334 |
| 592 | 2 | 1141 | 827 |
| 593 | 1 | 2 | 775 |
| 593 | 2 | 817 | 1122 |
| 595 | 1 | 87 | 890 |
| 596 | 3 | 1435 | 1277 |
| 602 | 1 | 8 | 169 |
| 603 | 5 | 1071 | 1469 |
| 606 | 1 | 322 | 768 |
| 607 | 5 | 1226 | 1008 |
| 610 | 1 | 541 | 53 |
| 612 | 1 | 3 | 500 |
| 616 | 1 | 650 | 309 |
| 617 | 2 | 491 | 246 |
| 622 | 1 | 36 | 347 |
| 625 | 4 | 2046 | 2549 |
| 627 | 1 | 67 | 210 |
| 628 | 1 | 452 | 3 |
| 631 | 3 | 4004 | 3219 |
| 634 | 1 | 759 | 70 |
| 636 | 1 | 189 | 368 |
| 636 | 2 | 1063 | 197 |
| 637 | 2 | 1994 | 1665 |
| 638 | 1 | 227 | 1081 |
| 639 | 1 | 261 | 4 |
| 639 | 2 | 811 | 245 |
| 641 | 1 | 118 | 444 |
| 642 | 3 | 1331 | 1047 |
| 642 | 4 | 1847 | 1434 |
| 643 | 1 | 3 | 608 |
| 645 | 4 | 1534 | 1758 |
| 645 | 6 | 2025 | 2321 |
| 645 | 7 | 2488 | 2036 |
| 648 | 1 | 2 | 1045 |
| 660 | 1 | 77 | 601 |
| 660 | 2 | 576 | 872 |
| 661 | 1 | 961 | 197 |
| 664 | 2 | 89 | 304 |
| 667 | 1 | 3 | 413 |
| 668 | 1 | 1 | 330 |
| 671 | 2 | 516 | 220 |
| 673 | 1 | 3 | 338 |
| 674 | 2 | 584 | 303 |
| 679 | 1 | 1 | 237 |
| 679 | 3 | 1589 | 1906 |
| 688 | 1 | 835 | 434 |
| 688 | 2 | 1077 | 802 |
| 694 | 1 | 3 | 143 |
| 696 | 2 | 432 | 46 |
| 706 | 1 | 224 | 81 |
| 709 | 3 | 1183 | 1449 |
| 711 | 1 | 3 | 908 |
| 715 | 1 | 3 | 167 |
| 716 | 1 | 2 | 637 |
| 721 | 1 | 133 | 570 |
| 722 | 1 | 383 | 3 |
| 723 | 1 | 829 | 2 |

TABLE 3-continued

S. aureus - Putative coding regions of novel proteins not similar to known proteins

| Contig ID | ORF ID | Start (nt) | Stop (nt) |
|---|---|---|---|
| 723 | 2 | 1112 | 726 |
| 727 | 1 | 2 | 472 |
| 729 | 1 | 268 | 441 |
| 731 | 1 | 130 | 828 |
| 735 | 1 | 2 | 214 |
| 736 | 1 | 3 | 782 |
| 738 | 1 | 2 | 298 |
| 742 | 1 | 3 | 230 |
| 745 | 3 | 780 | 412 |
| 748 | 2 | 282 | 464 |
| 749 | 1 | 344 | 3 |
| 751 | 1 | 452 | 3 |
| 755 | 1 | 97 | 522 |
| 755 | 2 | 520 | 918 |
| 758 | 2 | 400 | 137 |
| 764 | 2 | 746 | 459 |
| 767 | 1 | 1 | 405 |
| 768 | 1 | 2 | 373 |
| 771 | 1 | 534 | 10 |
| 778 | 1 | 902 | 69 |
| 785 | 1 | 1023 | 256 |
| 787 | 1 | 631 | 2 |
| 791 | 1 | 3 | 224 |
| 799 | 1 | 15 | 260 |
| 804 | 1 | 304 | 711 |
| 805 | 1 | 3 | 680 |
| 808 | 1 | 219 | 842 |
| 810 | 1 | 1112 | 3 |
| 810 | 2 | 1442 | 1110 |
| 812 | 1 | 38 | 979 |
| 817 | 1 | 358 | 2 |
| 818 | 2 | 487 | 1104 |
| 819 | 2 | 1032 | 535 |
| 819 | 3 | 1419 | 1090 |
| 820 | 1 | 195 | 1064 |
| 828 | 1 | 255 | 4 |
| 829 | 1 | 48 | 800 |
| 830 | 1 | 291 | 4 |
| 832 | 1 | 298 | 2 |
| 835 | 1 | 320 | 796 |
| 840 | 3 | 491 | 709 |
| 845 | 1 | 457 | 2 |
| 850 | 2 | 303 | 449 |
| 853 | 1 | 359 | 3 |
| 860 | 1 | 2 | 256 |
| 864 | 1 | 18 | 410 |
| 864 | 2 | 383 | 715 |
| 864 | 6 | 1676 | 1828 |
| 870 | 1 | 1 | 588 |
| 873 | 1 | 454 | 2 |
| 875 | 1 | 294 | 4 |
| 877 | 1 | 1020 | 379 |
| 878 | 1 | 544 | 107 |
| 879 | 1 | 785 | 3 |
| 881 | 1 | 1 | 243 |
| 882 | 1 | 389 | 604 |
| 890 | 1 | 2 | 508 |
| 905 | 1 | 398 | 3 |
| 906 | 1 | 544 | 236 |
| 912 | 1 | 188 | 3 |
| 913 | 1 | 3 | 290 |
| 913 | 2 | 547 | 2 |
| 915 | 1 | 6 | 161 |
| 915 | 2 | 169 | 402 |
| 921 | 1 | 126 | 386 |
| 927 | 1 | 808 | 38 |
| 928 | 1 | 2 | 385 |
| 929 | 1 | 2 | 400 |
| 932 | 1 | 2 | 400 |
| 934 | 1 | 1 | 384 |
| 936 | 1 | 528 | 4 |
| 937 | 1 | 2 | 616 |
| 945 | 1 | 220 | 645 |
| 945 | 2 | 649 | 1242 |
| 946 | 1 | 950 | 198 |
| 949 | 1 | 1 | 270 |
| 951 | 1 | 3 | 362 |
| 955 | 1 | 3 | 143 |
| 960 | 1 | 400 | 77 |
| 963 | 1 | 1 | 162 |
| 965 | 1 | 346 | 2 |
| 966 | 1 | 606 | 133 |
| 969 | 1 | 3 | 302 |
| 971 | 1 | 12 | 170 |
| 974 | 1 | 161 | 3 |
| 976 | 1 | 348 | 4 |
| 977 | 1 | 2 | 211 |
| 982 | 1 | 982 | 38 |
| 984 | 1 | 296 | 3 |
| 987 | 1 | 3 | 467 |
| 993 | 1 | 1 | 525 |
| 994 | 1 | 549 | 178 |
| 1004 | 1 | 318 | 79 |
| 1014 | 1 | 313 | 2 |
| 1015 | 1 | 2 | 463 |
| 1016 | 1 | 145 | 2 |
| 1019 | 1 | 660 | 115 |
| 1022 | 1 | 474 | 109 |
| 1024 | 1 | 299 | 3 |
| 1024 | 2 | 276 | 431 |
| 1030 | 1 | 338 | 3 |
| 1032 | 1 | 179 | 3 |
| 1040 | 1 | 399 | 4 |
| 1043 | 1 | 3 | 269 |
| 1044 | 2 | 115 | 399 |
| 1047 | 1 | 1 | 159 |
| 1051 | 1 | 354 | 4 |
| 1051 | 2 | 733 | 233 |
| 1063 | 1 | 2 | 400 |
| 1069 | 1 | 2 | 148 |
| 1069 | 2 | 533 | 297 |
| 1075 | 1 | 399 | 91 |
| 1077 | 1 | 97 | 405 |
| 1081 | 1 | 58 | 438 |
| 1086 | 1 | 1 | 384 |
| 1087 | 2 | 246 | 431 |
| 1088 | 1 | 3 | 374 |
| 1096 | 1 | 238 | 2 |
| 1098 | 1 | 509 | 3 |
| 1100 | 1 | 511 | 2 |
| 1100 | 2 | 1158 | 796 |
| 1101 | 1 | 353 | 3 |
| 1102 | 1 | 194 | 3 |
| 1107 | 1 | 2 | 580 |
| 1114 | 1 | 3 | 422 |
| 1115 | 1 | 2 | 268 |
| 1119 | 1 | 22 | 267 |
| 1129 | 1 | 40 | 342 |
| 1132 | 1 | 181 | 2 |
| 1133 | 1 | 376 | 143 |
| 1144 | 1 | 225 | 4 |
| 1147 | 1 | 280 | 2 |
| 1153 | 1 | 1 | 153 |
| 1154 | 1 | 3 | 818 |
| 1159 | 1 | 1 | 330 |
| 1161 | 1 | 186 | 31 |
| 1164 | 1 | 254 | 81 |
| 1171 | 1 | 19 | 240 |
| 1171 | 2 | 108 | 299 |
| 1183 | 1 | 2 | 379 |
| 1195 | 1 | 179 | 3 |
| 1196 | 1 | 1 | 189 |
| 1200 | 1 | 33 | 197 |
| 1203 | 2 | 129 | 464 |
| 1222 | 2 | 105 | 401 |
| 1232 | 1 | 1 | 387 |

TABLE 3-continued

S. aureus - Putative coding regions of novel proteins not similar to known proteins

| Contig ID | ORF ID | Start (nt) | Stop (nt) |
|---|---|---|---|
| 1240 | 1 | 2 | 175 |
| 1247 | 1 | 311 | 102 |
| 1271 | 1 | 221 | 30 |
| 1286 | 1 | 2 | 595 |
| 1295 | 1 | 1 | 165 |
| 1306 | 1 | 185 | 3 |
| 1314 | 2 | 158 | 631 |
| 1316 | 1 | 58 | 570 |
| 1359 | 1 | 193 | 2 |
| 1370 | 1 | 1 | 402 |
| 1371 | 1 | 1 | 345 |
| 1374 | 1 | 357 | 4 |
| 1378 | 1 | 2 | 400 |
| 1392 | 1 | 3 | 413 |
| 1411 | 1 | 202 | 432 |
| 1433 | 1 | 167 | 3 |
| 1450 | 1 | 2 | 256 |
| 1453 | 1 | 149 | 3 |
| 1471 | 1 | 398 | 75 |
| 1477 | 1 | 639 | 409 |
| 1502 | 1 | 399 | 4 |
| 1518 | 1 | 126 | 449 |
| 1534 | 1 | 143 | 3 |
| 1546 | 1 | 3 | 401 |
| 1547 | 1 | 255 | 4 |
| 1583 | 1 | 3 | 350 |
| 1587 | 1 | 3 | 563 |
| 1602 | 2 | 170 | 679 |
| 1629 | 1 | 1 | 402 |
| 1665 | 1 | 235 | 2 |
| 1760 | 1 | 314 | 3 |
| 1762 | 1 | 3 | 200 |
| 1876 | 2 | 119 | 286 |
| 1895 | 1 | 2 | 379 |
| 1931 | 1 | 400 | 2 |
| 1976 | 2 | 383 | 51 |
| 2055 | 2 | 252 | 401 |
| 2056 | 1 | 167 | 3 |
| 2150 | 1 | 263 | 3 |
| 2157 | 1 | 399 | 4 |
| 2164 | 1 | 283 | 2 |
| 2175 | 1 | 218 | 400 |
| 2212 | 1 | 331 | 170 |
| 2338 | 1 | 367 | 2 |
| 2342 | 1 | 3 | 167 |
| 2352 | 1 | 166 | 2 |
| 2352 | 2 | 398 | 174 |
| 2355 | 1 | 47 | 352 |
| 2356 | 1 | 341 | 3 |
| 2359 | 1 | 152 | 3 |
| 2421 | 1 | 150 | 4 |
| 2422 | 1 | 306 | 43 |
| 2443 | 1 | 263 | 99 |
| 2454 | 1 | 3 | 158 |
| 2463 | 1 | 253 | 2 |
| 2485 | 1 | 3 | 374 |
| 2557 | 1 | 246 | 4 |
| 2575 | 1 | 2 | 355 |
| 2582 | 1 | 3 | 284 |
| 2607 | 1 | 1 | 294 |
| 2930 | 1 | 17 | 400 |
| 2939 | 1 | 242 | 18 |
| 2944 | 1 | 3 | 359 |
| 2945 | 2 | 399 | 97 |
| 2952 | 1 | 2 | 190 |
| 2953 | 1 | 399 | 61 |
| 2964 | 1 | 166 | 2 |
| 2969 | 1 | 144 | 4 |
| 2977 | 1 | 2 | 373 |
| 2981 | 2 | 334 | 167 |
| 2986 | 1 | 7 | 279 |
| 2991 | 1 | 363 | 118 |
| 2995 | 1 | 1 | 321 |
| 3007 | 1 | 191 | 39 |
| 3017 | 1 | 308 | 48 |
| 3018 | 2 | 136 | 351 |
| 3025 | 1 | 197 | 3 |
| 3040 | 1 | 180 | 4 |
| 3046 | 1 | 185 | 13 |
| 3049 | 1 | 278 | 3 |
| 3050 | 1 | 3 | 314 |
| 3052 | 1 | 253 | 2 |
| 3065 | 1 | 2 | 157 |
| 3070 | 1 | 190 | 23 |
| 3075 | 1 | 222 | 4 |
| 3080 | 1 | 1 | 285 |
| 3092 | 1 | 162 | 4 |
| 3093 | 1 | 250 | 89 |
| 3100 | 1 | 52 | 237 |
| 3103 | 1 | 47 | 298 |
| 3118 | 1 | 174 | 4 |
| 3123 | 1 | 2 | 145 |
| 3127 | 1 | 1 | 147 |
| 3138 | 1 | 169 | 2 |
| 3142 | 1 | 203 | 18 |
| 3144 | 1 | 386 | 108 |
| 3151 | 1 | 170 | 3 |
| 3155 | 2 | 202 | 384 |
| 3168 | 1 | 12 | 176 |
| 3205 | 1 | 145 | 2 |
| 3282 | 1 | 1 | 150 |
| 3303 | 2 | 239 | 400 |
| 3371 | 2 | 211 | 399 |
| 3558 | 1 | 2 | 148 |
| 3558 | 2 | 36 | 401 |
| 3568 | 1 | 377 | 3 |
| 3595 | 1 | 380 | 3 |
| 3618 | 1 | 2 | 238 |
| 3618 | 2 | 130 | 402 |
| 3622 | 1 | 86 | 358 |
| 3622 | 2 | 398 | 132 |
| 3642 | 1 | 439 | 2 |
| 3649 | 1 | 398 | 15 |
| 3651 | 1 | 314 | 3 |
| 3664 | 1 | 467 | 637 |
| 3674 | 1 | 55 | 402 |
| 3677 | 1 | 311 | 3 |
| 3704 | 1 | 1 | 402 |
| 3726 | 1 | 269 | 3 |
| 3765 | 1 | 256 | 2 |
| 3779 | 1 | 357 | 160 |
| 3794 | 1 | 135 | 4 |
| 3794 | 2 | 377 | 87 |
| 3796 | 2 | 375 | 112 |
| 3801 | 1 | 262 | 50 |
| 3806 | 1 | 298 | 143 |
| 3807 | 1 | 42 | 389 |
| 3815 | 1 | 400 | 2 |
| 3827 | 1 | 3 | 320 |
| 3842 | 1 | 392 | 3 |
| 3853 | 1 | 399 | 127 |
| 3855 | 1 | 1 | 324 |
| 3857 | 1 | 2 | 235 |
| 3861 | 1 | 297 | 4 |
| 3865 | 1 | 399 | 103 |
| 3897 | 1 | 3 | 173 |
| 3897 | 2 | 143 | 400 |
| 3898 | 2 | 225 | 401 |
| 3921 | 2 | 103 | 342 |

TABLE 3-continued

*S. aureus* - Putative coding regions of novel proteins not similar to known proteins

| Contig ID | ORF ID | Start (nt) | Stop (nt) |
|---|---|---|---|
| 3927 | 1 | 70 | 375 |
| 3930 | 1 | 76 | 234 |
| 3946 | 2 | 382 | 113 |
| 3951 | 2 | 105 | 377 |
| 3965 | 1 | 344 | 42 |
| 3973 | 1 | 400 | 5 |
| 3981 | 1 | 3 | 311 |
| 3998 | 1 | 3 | 356 |
| 4001 | 1 | 296 | 111 |
| 4003 | 1 | 90 | 335 |
| 4018 | 1 | 2 | 259 |
| 4018 | 2 | 186 | 401 |
| 4021 | 1 | 1 | 345 |
| 4043 | 1 | 3 | 344 |
| 4054 | 1 | 3 | 344 |
| 4066 | 1 | 1 | 150 |
| 4070 | 1 | 1 | 324 |
| 4072 | 2 | 187 | 390 |
| 4073 | 1 | 1 | 285 |
| 4077 | 2 | 127 | 372 |
| 4083 | 1 | 3 | 359 |
| 4090 | 1 | 27 | 368 |
| 4101 | 1 | 103 | 297 |
| 4105 | 1 | 1 | 306 |
| 4107 | 1 | 286 | 2 |
| 4119 | 1 | 339 | 49 |
| 4121 | 1 | 372 | 4 |
| 4123 | 1 | 3 | 230 |
| 4127 | 1 | 3 | 341 |
| 4128 | 1 | 2 | 331 |
| 4130 | 1 | 415 | 62 |
| 4146 | 1 | 97 | 381 |
| 4157 | 1 | 3 | 206 |
| 4186 | 1 | 254 | 3 |
| 4224 | 1 | 256 | 2 |
| 4239 | 1 | 1 | 348 |
| 4242 | 1 | 356 | 3 |
| 4252 | 1 | 296 | 3 |
| 4253 | 1 | 1 | 174 |
| 4256 | 1 | 323 | 78 |
| 4258 | 2 | 334 | 170 |
| 4267 | 1 | 144 | 4 |
| 4271 | 1 | 2 | 304 |
| 4287 | 1 | 163 | 23 |
| 4289 | 1 | 319 | 167 |
| 4302 | 1 | 153 | 305 |
| 4304 | 1 | 1 | 186 |
| 4304 | 2 | 96 | 314 |
| 4306 | 1 | 2 | 151 |
| 4318 | 1 | 289 | 2 |
| 4322 | 1 | 5 | 148 |
| 4331 | 1 | 221 | 3 |
| 4331 | 2 | 364 | 200 |
| 4338 | 1 | 399 | 70 |
| 4346 | 1 | 277 | 83 |
| 4367 | 2 | 117 | 311 |
| 4373 | 1 | 2 | 268 |
| 4381 | 1 | 326 | 78 |
| 4384 | 1 | 309 | 4 |
| 4397 | 1 | 9 | 311 |
| 4402 | 1 | 1 | 249 |
| 4403 | 1 | 328 | 50 |
| 4406 | 1 | 3 | 317 |
| 4411 | 1 | 2 | 280 |
| 4411 | 2 | 398 | 99 |
| 4412 | 1 | 2 | 364 |
| 4418 | 1 | 3 | 230 |
| 4424 | 1 | 398 | 195 |
| 4443 | 11 | 215 | 3 |
| 4471 | 1 | 323 | 3 |
| 4478 | 1 | 271 | 2 |
| 4482 | 1 | 50 | 289 |
| 4489 | 1 | 302 | 3 |
| 4491 | 1 | 12 | 206 |
| 4495 | 1 | 3 | 179 |
| 4496 | 1 | 252 | 4 |
| 4500 | 1 | 130 | 306 |
| 4511 | 1 | 248 | 3 |
| 4518 | 1 | 1 | 246 |
| 4526 | 1 | 241 | 2 |
| 4527 | 1 | 2 | 163 |
| 4532 | 1 | 3 | 239 |
| 4542 | 1 | 11 | 175 |
| 4567 | 1 | 36 | 200 |
| 4573 | 1 | 1 | 231 |
| 4578 | 1 | 322 | 2 |
| 4619 | 1 | 1 | 180 |
| 4620 | 1 | 176 | 3 |
| 4662 | 1 | 1 | 246 |
| 4669 | 1 | 2 | 157 |
| 4680 | 1 | 28 | 183 |
| 4690 | 1 | 174 | 4 |

SEQUENCE LISTING (5256 sequences)

SEQ ID NO: 1 - DNA, 5895 bp; double-stranded, linear
tccattatgaagtcacaagtactataagctgcgatgttaccaatgttttttaaaatcccagtaataaaatcaaaaaataagttaaataatgtattcattttaagtcctccttaataaagaaaataggtaataatgtaatagcttctattatgatgcctaattgaatgaattgggcaaatggctctttgatgataagtgtgataatgaaaagggttaaactaacaataatcgcataatatttttttcgtttaataagtcgcacaggaatgggcttctttttagttgctgcaggagcatatactgagattacacctaaagaaataactgttaaaataatcataattaaaaagttaatatgaaaatttactattactaaaggtaaaagtataaatagtataatactttctacataacaccaaaaagaagaaggtgcatgtgcaccatgtgcatgtcttcttattaaataaaatgttaaattcgtaattaacgtaaacagaaaaatgtttaaaatataggcaatagtatacataacaattaatttacctatatttttagctaagacctgcatccctaatcgtacttgcaaaaattgaatatgatctaagttatttctcttttgaagatacgtggcaaactggtcaattttattatcaaaataattcaattttacaccactctcctcactgtcattatacgatttagtacaatcttttatcattatattgcctaactgtaggaaataaatacttaactgttaaatgtaatttgtatttaatattttaacataaaaaaatttacagttaagaataaaaaacgactagttaagaaaaattggaaaataaatgcttttagcatgttttaatataactagatcacagagatgtgatggaaaatagttgatgagttgtttaattttaagaatttttatcttaattaaggaaggagtgatttcaatggcacaagatatcatttcaacaatcggtgacttagtaaaatggattatcgacacagtgaacaaattcactaaaaaataagatgaataattaattactttcattgtaaatttgttatcttcgtatagtactaaaagtatgagttattaagccatcccaacttaataaccatgtaaaattagcaagtgagtaacatttgctagtagagttagtttccttggactcagtgctatgtatttttcttaattatcattacagataattatttctagcatgtaagctatcgtaaacaacatcgatttatcattatttgataaataaaatttttttcataattaataacatccccaaaaatagattgaaaaaataactgtaaaacattcccttaataataagtatggtcgtgagcccctcccaagctcgcggccttttttgtaatgaagaagggatgagttaatcatcattatgagacccgccgttaaaatatatgaataagtctaatgttggaaaaggtcaaaaaattaatcaatttaattaagaaaatcattcatttgcaaagggcgaaatgggttcttactgagttatctattataaaaaaataaacatagacttatgaaaaatctctcataaatctatgtttagtcatgacatgtgttaaatattatttcgggcgcttcttatttatacaaatctaatttaatacttttaaatacaggtatattttcgcgttgctgttctacttcatttaagtttaaatctacagtcaaaatatctgcggattcatttaattctccaactaaatctccatttgggtttataactatcgaatgaccagcatattctgtgttaccatcgaatccagtgctattagttccaatgacaaacatattattttcaattgcacgtgcctttagtaatgaatgccaatgttgaagacgtgacataggccattgcgccacataaaatgcaattttagcaccactacgagcaggatatcttaataattctggaaaacgtaaatcataacagataagttgggtcacataagtaccgtcagacaattgaaagggttcagctacgtattcgccagcggttaaaaattcatgctctcttaacataggaactaaatgaactttgtcgtattcattaatcagctggccacttttattcacactaaaagctgtattaaatatttgattgtttctaatgttagaaactgacccagctacgatatcgactttatatttttcagctaaatgtttaataaatgaaaaactttgtcctagattattatctgctttttcatttaaatgctctaaatcatagccattattccacatttcaggtaaaacgactacatctacttcagcattcatatttttttcgaaccattgcgttatttgagtttcatttttagaactatctccaaaaacaatcggtaattgataaatttggactttcataacatcacatccttgatagatcttatatataacttactaaaagttatgttgaaacgcaaaaaacgagcacaagacataaaatcaaagtcctaggctctacaaagttatattgacagtagttgatggggccccaacatagagaaattggaacaccaatttctacagacaatgcaagttggggtgggctctaacataaagaaatactttttctttagaaattagtatttcttatacatgagttttactcatgtattcctattcttaagtgcacattagcagcggctaatgtgtaagaactactacataatgaataactaatgattctttatcatttctgtcccattcctaacaatatattgattatttttttattacgaaacgatcttccactggattaaatgttttttcgccagcagcttcacgaatatcaccaaatggcatttgagcaataagtttccaacttttaggaatattaaattcatttgaagtcatctcatcaacaagtggattatagtgttgtaatgaagcacctatgcctttagtagctaatgcagtccaaattgcaaattgatgcatggcatttgtttgagttgaccatattgcaaaattatcatagtagtttggcatttgttcttgtaaaccacttacaacatcttgatcttcataaaacaaaattgtaccgtatgaatgtttgaagttatcaattttttgttcagttggctcgaaatcacgattctctcccatgacttcttttaaaattgcttttgtgttatcccaaaatttattattgttgtcatttaacaagagaacaattctagttgattgagaattaaatgatgaaggaacatgtttaactgcatgtgcaatcattgattctaattcgtcatcgctaattgatatcgaatctttcaaattatatattgaacgtctttcttccattgcattgtcaaaagtcattgcttttttatcttttttaaataagcccataattattgctccttctttagtaaagaatacttaatagactaagtataaaatttatactcgtacttgtaaagcaatatttacgaaaatttcaagaatattaatattcattttcaaattccaaatataaatgcattttcaacgcatatttattatacttagattaatacttacatgaaaaagggaggtgtctcgtgaaatgtcatatcattggtttaagaaaatgttactttcaacaagtattttaattttaagtagtagtagtttagggcttgcaacgcacacagttgaagcaaaggataacttaaatggagaaaaaccaactactaatttgaatcataatataacttcaccatcagtaaatagtgaaatgaataataatgagactgggacacctcacgaatcaaatcaaacgggtaatgaaggaacaggttcgaatagtcgtgatgctaatcctgattcgaataatgtgaagccagactcaaacaaccaaaacccaagtacagattcaaaaccagacccaaataaccaaaactcaagtccgaatcctaaaccagatccagataacccgaaaccaaaaccggatccaaaaccagacccagataaaccaaagccaaatccggatccaaaaccagatccagataacccgaaaccaaatccagatccaaaaccagacccagataaaccaaagccaaatccggatccaaaaccagatccagataaaccaaagccaaatccgaatccaaaaccagaccctaataagccaaatcctaacccgtcaccagatcccgatcaacctggggattccaatcattctggtggctcgaaaaatggggggacatggaacccaaatgcttcagatggatctaatcaaggtcaatggcaaccaaatgggaatcaaggaaactcacaaaatcctactggtaatgattttgtatcccaacgatttttagccttggcaaatggggcttacaagtataatccgtatattttaaatcaaattaataagttgggcaaagattatggagaagttactgatgaagacatttataatattattcgaaaacaaaatttcagcggaaatgcatatttaaatggattacaacagcaatcgaattactttagattccaatatttcaatccattgaaatcagaaaggtactatcgtaatttagatgaacaagtactcgcattaattactggtgaaattggatcaatgccagatttgaaaaagcccgaagataagccggattcaaaacaacgctcatttgaaccgcatgaaaaagacgattttacagtagttaaaaaacaagaagataataagaaaagtgcgtcaactgcatatagtaaaagttggctagcaattgtatgttctatgatggtggtattttcaatcatgctattcttatttgtaaagcgaaataaaaagaaaaataaaaacgaatcacagcgacgataatccgtgtgtgattcgttttttttattatggaataaaaatgtgatatataaaattcgcttgttccgtggcttttttcaaagcctcaggattaagtaattggaatataacgacaaatccgttttgtaacatatggataataattggaacagcaagccgttttgtccaaacatatgctaatgaaaaaatgacacccataccaaaataaactggaataaatttgaaatcattatgtgctaatgcaaatattaatgaacttactgttgtagcaataataaatgccacgatacgattacctttaatcgcattaaataattctccaaagattacttttctgaatacatattcttctaataaaggaccaataatagatacaaagaagataaatataggtatttttcgagcaataataattagcttttctgtattaggacttacttgttgtccaccataaatttgcgttaatacaatgctcactaccatttgataaatcattaccaatgcaaatccaagcaatgcccatggaatgatatattttttaggttctttaacttctaattctaattttgttggatttttaatttttaaattaattaaaataatcgtcgtggcggcgattaaaaatagaacaagttgtatgtaaatgactgctttagtcagttctatgccactatattgtacaaatggtaatttttttacaatgagaagcggtaaaaattgagacaatatataaataataacagttagcaatgatgcccataatcttgtcataattttcctccaaatatttgtttataatttattttatcgtaaataacttgaagttacaaaacttaattaaaaggttatgacttgaaattttgaccaaatttgattattataaatgtatgttagcactctttaatgttaagtgctaaactttaggttttttaaggaggaacaatcatgctaaaaccaattggaaatcgtgtgattattgagaaaaaagaacaagaacaaacaactaaaagtggnattgtttaactgatagtgctaaaga

SEQ ID NO: 2 - DNA, 6796 bp; double-stranded, linear
tttgaaaaaacaaggtacgattggtttaataacatatatgagaaccgattctacacgtatttcagatactgccaaagttgaagcaaaacagtatataactgataaatacggtgaatcttacacttctaaacgtaaagcatcagggaaacaaggtgaccaagatgcccatgaggctattagaccttcaagtactatgcgtacgccagatgatatgaagtcatttttgacgaaagaccaataccgattatacaaattaatttgggaacgatttgttgctagtcaaatggctccagcaatacttgatacagtctcattagacataacacaaggtgacattaaatttagagcgaatggtcaaacaatcaagtttaaaggatttatgacactttatgtagaaactaaagatgatagtgatagcgaaaaggaaaataaactgcctaaattagagcaaggtgataaagtcacagcaactcaaattgaaccagctcaacactatacacaaccacctccaagatatactgaggcgagattagtaaaaacactagaagaattgaaaattgggcgaccatcaacttatgcaccgacaatagatacgattcaaaagcgtaactatgtcaaattagaaagtaagcgttttgttcctactgagttgggagaaatagttcatgaacaagtgaaagaatacttcccagagattattgatgtggaattcacagtgaatatggaaacgttacttgataagattgcagaaggcgacattacatggaggaaagtaatcgacggtttctttagtagctttaaacaagatgttgaacgtgctgaagaagagatggaaaagattgaaatcaaagatgagccagccggtgaagactgtgaaatttgtggttctcctatggttataaaaatgggacgctatggtaagttcatggcttgctcaaacttcccggattgtcgtaatacaaaagcgatagttaagtctattggtgttaaatgtccaaaatgtaatgatggtgacgtcgtagaaagaaaatctaaaaagaatcgtgtcttttatggatgttcgaaatatcctgaatgcgactttatctcttgggataagccgattggaagagattgtccaaaatgtaaccaatatcttgttgaaaataaaaaaggcaagacaacacaagtaatatgttcaaattgcgattataaagaggcagcgcagaaataatatttttatttcctagatacattttaagattgttaaatagaatcattagtgaatcttattttaaagatagtaaaggattaatctaaataagtgcggataatataaacataacaacataattaamagacataaatgacaataaaaggagtatagaaatgactcaaactgtaaatgtaataggtgctggtcttgccggttcagaagcggcatatcaattagctgaaagaggaattaaagttaatctaatagagatgagacctgttaaacaaacaccagcgcaccatactgataaatttgcggaacttgtatgttccaattcattacgcggaaatgctttaactaatggtgtgggtgttttaaaagaagaaatgagaagattgaattctataattattgaagcggctgataaggcacgagttccagctggtggtgcattagcagttgatagacacgatttttcaggttatattactgaaacacttaaaaatcatgaaaatatcacagttattaatgaagaaattaatgccattccagatggatacacaattatcgcaacaggaccacttactacagaaacccttgcgcaagaaatagtggacattactggtaaagatcaactttatttctatgatgcggctgctccaattattgaaaaagaatctattgatatggataaagtttacttaaagtcccgttatgataaaggtgaagctgcatatttaaactgtcctatgactgaggatgaatttaatcgcttttatgatgcagtattagaagctgaagttgcgcctgtaaattcatttgaaaaagaaaaatatttcgagggttgtatgccttttgaagtaatggcagaacgcggacgcaagacattactatttggaccaatgaaaccagtaggattagaagatccaaagactgggaaacgtccttatgcggtggttcaattaagacaagatgacgctgctggtacactctacaatattgttggcttccaaacgcatttaaaatggggagctcaaaaagaagtcattaaattaattccaggcttagaaaatgttgatattgttagatatggtgtgatgcatagaaataccttcattaattcaccggacgtattaaacgagaaatatgaattgatttcacaaccaaacatacagtttgcgggacaaatgactggtgttgaaggttatgtagaaagcgcagctagcggcttagttgcaggtatcaatcttgcgcataaaatattaggcaagggtgaggtagtatttccgagagaaacaatgattggaagtatggcttactatatttctcatgctaaaaacaataagaatttccaacctatgaatgctaacttcgggttattaccatctttagaaactagaattaaagataaaaaagaacgctatgaagcacaagctaatagagctttggattacttagaaaatttcaaaaaaactttataaaatagttagaaagactagatatgctattcattcttaagtcatcaacgagtaagtaatgactttctaaatggaaaatacttatcctagtctttttaattttggaattgttacgtatttctgacaatttagaattcgcattcaaaaaatatctaaataaataacacgcaataagttgattgatgtaacatgtaagagaatgttttaaataaactttatttaaaaggcaatgaaataataaatggcaaggctattaataaagacttttagtaattaatttaaaaaagaggtattctaattaacaggttttccgattagttacaattatttaattctcaaaagatttagaattgattatcaaattactgtaagccctttgctgtatatgctacaattcttattgatggagggtaaatgtattgaatcatattcaagatgcgtttttaaatacattgaaagttgaacggaatttttcggaacacacattgaaatcatatcaagatgacttaattcagtttaatcaatttttagaacaagaacatttagagttgaatacttttgaatacagagatgctagaaattatttgagctatttatattcaaatcatttgaaaagaacatctgtttctcgtaaaatctcaacgttaagaactttctatgaatattggatgacgcttgatgagaacattattaatccatttgttcaattagtacatccgaaaaaagaaaaatatcttccgcaattcttttacgaagaagaaatggaagcgttattcaaaactgtagaagaggacacttcaaaaaatttacgggatcgagttattcttgaattgttgtatgctacaggcatccgtgtttcggaattagtaaatattaaaaaacaagatatagatttttacgcgaatggtgttaccgtattaggaaaagggagcaaagagcgctttgtaccgtttggtgcttattgtagacaaagcatcgaaaattatttagaacatttcaaaccaattcagtcatgcaatcatgattttcttattgtaaatatgaagggtgaagcaatcactgaacgcggtgtacgatatgttttaaatgatattgttaaacgaacagcaggcgtaagtgagattcatccccacaagctcagacatacatttgcaacgcatttattgaatcaaggtgcagacctaagaacagtacaatcgttattaggtcatgttaatttgtcaacaactggtaaatatacacacgtatctaaccaacaattaagaaaagtgtatctaaatgcacatcctcgagcgaaaaaggagaatgaaacatgagtaatacaacattacatgcaacaacaatttatgctgtaagacataatgggaaagcagctatggctggagatgggcaagtaacgcttggtcaacaagtcatcatgaaacaaacggcaagaaaagtgcgacgtttatatgaaggtaaagtgttagctggtttcgcaggtagtgtagcagatgcgtttacgttatttgaaaaattcgaaacaaaattacaacagtttagtggtaacttagaaagagctgctgttgaattggcacaagaatggcgaggcgataaacaattacgtcaattagaagctatgctaattgtaatggataaagatgctattttagttgtcagtggaactggcgaagttattgctccagatgatgaccttatcgctattggatcaggaggcaactacgcattaagcgcaggacgtgcattgaaacgccatgcatcgcatttgtctgctgaagaaatggcatatgagagcttgaaagtagcggctgatatttgtgtctttaccaacgataatattgttgtcgaaacactataataatcagagcacgataaataattacgagcaattaattttagttaaaagacggaggaatgaaattaatggatacagctggaataagattaactccaaaagaaatcgtatctaaattaaatgaatacatcgttggacaaaatgatgctaaacgtaaagtggcaattgccctacgtaatcgatacagaagaagtttattagatgaggaatcaaagcaagaaatttcacctaaaaatattttgatgattggaccaaccggcgttggtaaaactgaaattgcaagaagaatggccaaagttgtcggcgcgccatttataaaagtagaagctactaaatttactgaggtaggttatgtaggacgagatgttgaaagtatggttagagatcttgttgatgtttcagtaagattagtcaaggcgcagaaaaaatcattggtacaagatgaagcaacagctaaggccaatgaaaaacttgttaagttattagttccaagtatgaaaaagaaagcgtctcaaacgaataatcctttagagtcacttttcggaggtgcaattccaaatttcggacaaaataacgaagatgaagaagaaccacctactgaggaaattaaaacaaaacgttctgaaattaagagacagctagaagaaggcaaacttgaaaaagaaaaggtaagaattaaagtcgaacaagatcctggtgctttaggtatgctaggtacaaatcaaaatcagcaaatgcaagagatgatgaatcaattaatgcctaaaaagaaagttgagcgagaagttgctgttgagacggcaaggaaaatcttagctgatagttatgcggatgaactaattgatcaagaaagcgctaaccaagaagcgcttgaattagcagaacaaatgggtatcatctttatagatgaaatcgacaaagttgcgacgaataatcataatagtggtcaagatgtctcaagacaaggtgttcaaagagatattttacctatacttgaaggtagcgttattcaaaccaaatatggtactgtgaatactgaacatatgctgtttataggtgctggagctttccatgtatctaagccgagtgacttgataccagaattgcaaggtcgttttccgattagagttgaacttgatagtttatcggtagaagattttgtaagaattttgacagaaccaaaattgtcattaattaaacaatatgaagcattgcttcaaacagaagaagttactgtaaactttaccgatgaagcaattactcgcttagctgagattgcttatcaagtaaatcaagatacagacaacattggtgcacgtcgacttcatacaattttagaaaagatgctagaagatttatcattcgaagcaccaagtatgccgaatgcagttgtagatattaccccacaatatgttgatgataaattaaaatcaatttcaacaaataaagatttaagtgcatttattctataaaaatatacaaaaggagaaaaattcatgagcttattatctaaaacgagagagttaaacacgttacttcaaaaacacaaaggtattgcggttgattttaaagatgtagcacaaacgattagtagcgtaactgtaacaaatgtatttattgtatcgcgtcgaggtaaaattttaggatcgagtctaaatgaattattaaaaagtcaaagaattattcaaatgttggaagaaagacatattccaagtgaatatacagaacgattaatggaagttaaacaaacagaatcaaatattgatatcgacaatgtattaacagtattcccacctgaaaacagagaattattcatagatagtcgtacaactatcttcccaattttaggtggaggggaaagattaggtacattagtacttggtcnagtacatgatgattttaatgaaaatgatttggtactaggtgaatatgctgctacagttattggtatggaaatcttacgtgagaagcatagtgaagtagaaanagaagcgcgcgataaagctgctattacaatggcaattaattcattatcttattctgaaaaagaagcgattgaacatatctttgaagaacttggcggtacggaaggcctattaatcgcatcaaaagttgcagatagagttggtattactagatctgtaattgtaaatgcactacgtaaattagaaagtgctggtgtaattgaatcacgttctttaggaatgaaaggtactttcattaaagttaaaaaagaaaaattcttagatgaattagaaaaaagtaaat

SEQ ID NO: 3 - DNA, 2073 bp; double-stranded, linear
atcctaaaattnaaaattatcacgccttttgaacagctttgtaaccatctggacgatcatkaaattccaatgtaaatcctggtttaaagttgatctttaaccttatttaaaycaccaattgtacgtatattatgttgtttagcaaaatcacgttttacagctaaagcatacgtattgttatacttcattggttttaacatagtcatttgatatttcttttcaagactttgcttagcttgttcataaacttttttctcttcttttgacttcaatggttcttttgttaattcacctaaaactgttccagtaaattctaaatacccatctatatcgtcagattttaaagcattaaataaaaatgctgttttgcccataccatctttcacttctacagtatttttggtctcttcttctattaaaattttatacatatttgtaataatcgatggctcggagccaagctttccagctaacgtaattttatcacctttttgtgcaaacataggaatagcgatagccagtataataatcatcactataacacctaacgtcatcaataactttttataagataatttagccataaatcttaaaattaaatcaaatataattgccaataaggctgctggaattgcacctaataatatcaacgatgcattgttacggtctatacctaataaaattaaatctcctagtccgcctgcaccaattaatgctgctagtgttgctgtacctataattaataccatagccgttcttacaccagccattataacaggcattgctatcggaagttcgactttagttaaacgtctaaatggtttcatacctatacctttagccgcttcaatgagtgatggatcaacttctttaattccagtatacgtattccttaaaattggtaacaacgcatacactacaagtgcaataattgctggcacacgaccgataccaaataaaggaatcattaaacctaataatgccaacgatggtatggtttgaagaattgccgcaatattcattacgatttcagatatcgttttagtcttcgttaataaaatacctaatggtaccgcaatagcagttgcaatcaataatgcgataaatgatatttgaatatgttctatcattgtcgaaaagagttgccccttacgttcactcaatatgtcgaaaaagttagtcatgttgagctacctcctttttctgggacaaatatttgaagatatctttcctatcaataacatattgacctacgctatcttcttgcatgacaatgacacgctcgctctctgataaaagttgatacaatacttcaattggttgattgtcataaacaattggataagcgctcatagatgtaacctcatcgattggtttcataatatccaagtcacggataattgcgttctcttcaacacatggcgcatcatcttctaaatgactacccataaattgtttaacaaattcactttgaggattatttttaaatccttctggtgtgtcaatttgttcaatatgcccttcattcaaaagacaaatcttatcaccaagtttcatcgcctcttgaatatcatgtgtaacaaatatgattgtcttcttaattttagtttgtaattcaattaaatcatcttgaagtttttctcggctgattgggtctaatgcactaaacggttcatccattaaaataactggtggatcagctgctaacgcacgtataactcctacacgttgtcgttgcccccctgacaattcatcaggttttctgtttttatatttttcaggttctaatccaaccatttcaagtaattcatctactcttttatctatatctttttctttccactttttcatttgtggcacttgtgcaatattttctttgawtgtcatatgtgggaataatgcaatctgctgcaatacgtatccaatatcccaackcatttcgtatactggataatcacttattggtttatctttaaaataaatataaccttcacttaagtgaatgagtcgattaatcatttttaatgtcgtagtttttccacaacctgaaggtccaattagcacaaaaaattc

SEQ ID NO: 4 - DNA, 13321 bp; double-stranded, linear
actattctagcttcatcagttatcatatattctttgaaacacttgtaagaaaatataatgagtatttactacataatgatatttcaaattagaaaaaaggaagttatgatttaatggccttgagcctatcataacttccttttatcattttattgttgtgttgatgtttcgataacgtggtacatcttatcaaacatcaattcgaaaccatgcaccatggcatcatgatattcttttttcttttgcttgtattctaaattagtaaatcgtctttctttttcaactaatgaacgataataaaatagcatttgggtgccacctgtttcacgttcaaaaaattctacctcaatgacatcttgcgtttcacttagtccaggcataccgatagtcatcttaacgtattcatccataactaaagattcataaatgccttcaatcacatttactttgccattacgttgttgatctacaatacgatatttaccgccttctttaacgtccgcttcaatctctttattcgttctggctgatgtcataaaccattgtttcaacaaatctttctttgtccaagcttcgtatactaactctggagaaaatttataaagcttttcaatttcaacttcgacatgttcattctctacattaaattttgccactgttgtccacccactttcgctcttacttttattttaacgtatttttgctcagttccaaacatagatgatcatcatttttaaaagattagcgttatacggtgagtacaacatgatctgttaatataacaagccaccttacttggctacatcgatatattgttaagcattaatgtttcatttcttgactagtgttcttttttagctttggaaaattaaataaaatcgcaataagtccgcatacacctaataatataggataaatgctgtatgggaataacattaacggtgaaataccagctacaccagccgctgaaatgacttgcgggctatatggtaataaaccttggaagcagcctccaaatatatcaagaatacttgctgatttccttgaatctacatcatattcatctgcaatatttttagctaaaggacctgacataataatagagatggtgttgtttgccgtggcaatatctgcgacacttaccaaactagcaattcctaattctgcgccacgctttgatttcactttagagcgaacaaattgcaacaaccattcaataccaccattgtgttgaataataccgactaaaccaccaattagcaacgcaatcatagcaatatcttccatgcttataatacctttggacactgcatctagtagccccatccaaccgaatgaaccatctatgagaccaatgattccggctaataatgttccgccaatcaatacgataatgacatttacacctaataatgctaataccaatactaagatatacggtacaactttaattagattataatcatagtttttagcatgatttaaagaaatgccattcgttaagaaatacagaataataatcgttaaaatagcacctggcaatacaattttaaagtttactctgaatttatctttcattttcgtatgttgtgttctaaccgcagcaattgttgtatctgaaatcattgatagattatcgccgaacattgcacctccaacaactgtagccattgctagcgcagttggtacatctgtcgcttgtgcaaatccgtaaccaacaggtgctattgcagcaacagttcctacagacgtccccatagatatagaaacaaacatacaaatcacaaacaatcctacaataattaaattttctgggattaatgatagtcctaaattaactgtcgactttacgccacccattttttcagctgtatttgaaaatgcacctgctaaaataaaaatcaacatcattaaaacaatgtttgaatggcctgcacctttcgtgaagacctcaacttttttagcaaatgattcttttcgattcattaataacgccacaattaccgttatcgtaattgcaacatttaatggcattgaagtaaaatcacctgtgataatacctacgcctaaaaacaacgccacaaataataacaaggggaataatgcccaagcattgctctttttatgtacttccatcctttttacctgctttccaattaaaaatacctctttctcacaaacgatgaagaaagaggttttcatgtgctttacctgcttatcttcaaaccattacggttactggaattggcacattcgagatgttgccgaggcttcatagggccagtccctccacctctctagataagtgatgcttatttacgtttacgttacaagataatccttagtacgtcaatcataaattaatcaggagtcgtataatatttttcataaacaatcattgctactgtaataataatcaaaacaataatgctaataacaagtaaaagccaccatttaagcattaatgcaataaaaatgaacacgatagacacacttactaatattaatgatatgactttaaattgctgaacacgttgcttggagatgactttcaactgtttgtttgatagacgcgtattttttatactgattcccagtatattttctaatatttgaaccaatacgatacttattgcaaatataataattggtaaaacatcatagctccctatagttaatgtataaattacaaatccaatgtaaagtaaccctgagacaaaggataaaaagtatgcgacgtatttgttaaacttaatgatatgctttttaacgttttgatgtgtaaaccatacattcgaaacgatcgcaactgctacaaataatgtgaatactatatataatggtaatttttgttcaggaaaaacagtcgctattccaaaagctaatgctaaaatcaaaaataatatagctctagatactattaatgccataataacaacccctttgtttaatatcgagtttgcaaatttacgtttatcagcgtttctatgatcagtacttctacgggtagcgtttctatgtaatttacatcatcttaacatataaatacttcgctatttaattgaaaacatatcctattattctttgtccgttctgacgtttaatatctagccttaggcatttcacttgttaatgaatttaactttcttccactaaccgtccctaaacccaatcccgcaacagtttttaactttttcgttgttgtcctgacatcctcattaagaaagtttattctgcttaaaacttataatccacaccctgagcaaacgctccttatgacagagtattaaaataagccgataaagatacacacctttaccgactatttaaaatacacttcaccaattcattttaatttaatggattgaagtaactaaattaatattatgttgttcaattaaaagcttcatacaaacctaatctatttgcactccaccgctaacaccgaacacttgtccggttgtataacttgattcttctgacgctaatagcacataagttccacataactcaacaggttgacctgcacgacctaaaggtgttttttgaccaaatgttgggattttactttgaggttgtccaccagaaatttgtaatggtgaccagaatggaccaggcgctacacagttcactctaattccttttggtcctaattcttctgaaaaacttttagttaatgaaataattgctgcttttgaagcggcataatcatgaagaataggactaggattataaccttgtacagatgatgtcgttgtaattgacgcacccggttttaaatattccaatgctttttgaactgtccaaaatagcggatagacattcgtttcaaatgtttctgtaaatgcctcagttgtaaatccatgaatatcatcatgatactgttgatgtccagcaactaaagtaacattatctaagccacctaattgttgatatgcttgttcaacaaggtcatagttgaactgttcatctcttatatcaccaggaattaacactgccttttgaccactttcttcaatcacttggcgtacttcttgtgcatcttgttcttcactcggaagatagttaatcgctacatctgcaccttctttagcatacgcaattgctgctgcacgccctattgctgagtcaccacctgtgactaatattttatagccttgtaagcgttgatgaccttggtaagacgtttcgccacaatcgggtgctggcgtcatttcagattgtaaacccggtacctcttgttcttgtttttcataatccgttgttttaaattttgttctaggatcttgagctgccatttttttacatctccttattcgcttaatggttattatttacccaatcttcctaggaacttaatcatgattacactaaaaattactttcttctttataaaaacaagctcgaattattcatgcaatagtctctttacaaattcaacaaaatactcaggtactttttccagaatcctttcatccggtttatattgaggatgatgtaaatcatattcactatgagaaccaattaacgcaaatacacttggaaaatgttgactataacctgaaaaatcttctccaatcgtaagcggctgttccatcattcccaccttatatccaacatgttgggctactgcaattgctttatgcgtcaatgcctcatcattcatcacagcgccaggtaaatgcgtataatttaaattaattttcatattatatgcttgagccaatccgtccgcaatatcttgtaatcgtgtttctacaagctttcgtaccacaggatcaaaactacgcactgtgccttgtacatacgcatgatcagcaatgacattccaagtattaccacatgatatttgtccaattgttactaccgcttcatcaaacgcagatagatttctactaactatggattgaatactattaatcaattgcgccaacacaataactggatcgttgcattgttctggctttgcagcatgaccacccacgcctttaatatgaaactcaaaacgatctactgctgatgtaattgcccctgttttgattgcaaatgtacctaccgaacgcgatgggtcattatgaaaacccaatactgcttgtacatcttttaatgcatgtgtttcaataattttaaaagcgccatgtcctagttcttctgctgattgaaaaatgaatttaacacgcccagtaagagtgccctcaatttcttttaattttacagctgtagccaaaatactagccatgtgaatatcatgaccacacgcatgcataacaccttcattttcagatttaaaatcctgttcaacaagctcttgaatcggtaaagcatcaatgtcagcccgaacagctatacaactcagaccttgtcccacttcagcaacaagcccagtcgcaagtggtaagtctaatattctaatatgatgttctgttaaaatatctttaattttttgtgtagtcttaaattctttatcggatagttctggaaattgatgaaaataccttctccaggtaacagcttgatcttttaatcccatcggtcattccccttccttaagtcaatgatatgttgtctaccctacgatgatcatctttgactattaaacgatgatttcacaacaatgtactcttgttaattgctttcgttaatgatagacagttgtttaataatatcgtaacactgttgtcaaactattctaacttttataattgagactctatacaaaaacgtgttctcgaatatacttgtttttacaaaccacaaaaagctctaaacattagtttaaaccaatgcttagagctttctaattattttatgctttaaaagatactgtgttatctacgatgaccttaccgtctttaataactttttctgcgtgattgataccaaaatgatatggaatatattcatgatttggtgcatcccaaattactaaattagccttatcacctgtgttaattgtacccgcgttaatgtctattgctttagcagcattgaccgtaacagcattccaaacttcattaggtgatagctttaatttcaaggctgcaatcgccataacaagttgtaagttgtttgtgacactactaccagggttataatcagttgctaatgcaatcgcaccgttattgtcaagcatgcctcttgcatctgcataatcttctttacctaaatagaacgtcgttgcaggtaagaggacagctacagtatcactatttcgcaacttttcttttcctttatcactagaagctactaagtggtctgctgatattgcttgttcatcaattgctaattccagtccgcctaacggatcaatttcatccgcatgtattttcactttaaaacctgcttctttggctttttgcatataatgttgcgattgttctattgtaaatacacctgtttcacagaaaatatccgcaaagtctgcatattgttttacttccggaagtaacgcaatcatttcttctaaaaatgcctcatttgaacttgcctctttaggtacagcatgaggccctaggaaagtatgtttcatgtctaaatcatatttctcagctaaacgattagacactttcaattgcttcagttcattttctctatctaatccataaccactcttactttcaactgcaagcacgccgtgtttaatcatagtaagcaaatcatgctctgcttttttaaacaagtcatcttcggatgtttctctagtagcattaacggtagataatatgccaccacccatttctaatatttcaaggtaagacttaccttgacgttttaatgacatctcatgttctcgagatccaccaaatgttaaatgggtatgtgcatctactaatgctggggacactaccttcccactagcatcaatcgtctcagtcgcatcgtagtcatctgtatgtgttccagcatatacaattttgccatctttaatgacaactgtaccatttttcacaacatttaattcatctaattccttacccttcaaaggtttatctgttgatctcggtaaaattaattctgctatatgattaattattaaatcattcattacttatcacctgctttatcaatcattggaatatgaatacctttttctttagctgtttgaatagcgatgtcatagccagcatcaacatgtcgggcaacacccatacctgggtcagtcgtcaatacacgttccaatcttctttcagcacgctctgatccatctgctacaacaaccatacccgcatgaagtgaatatcccatgccaacaccgccaccgtgatggaatgaaatccatgaaccacctgcagctgtgttaatgagtgcattcaatacagcccaatcaccaaccgcgtcactaccatctttcatactttctgtttcacggttaggactagcaactgaaccagcatctaaatggtctcgtccaataacaattggtgctgaaatttcaccgtcacgtacaagacgatttaaagctaagcccattttcgctctttctccatagcctaaccaagcaatacgtgatggtagtccttgatatgaaattttttcttcagctaaatcaagccatcttaataacttttcattttctgggaaaagtttgcgcatttcttcatccgcacgctcgatatcttttggatcaccactcaacgcagcaaagcggaatggccctttaccttcacagaataatggtctaatgtaagctggtacaaagcctgggaagtcaaaagcatttttcactccgttattgaaggctacttgacgaatattgttaccataatcaaatgctacagcgccacgtttttggaattcaagcattaattcaacatgctttgccattgaagcttgtgacagttcaacatattttttcggatctttttcacgcaatactttcgcttcttctacagagtatccttgtggcacatatccatttagcggatcatgtgcacttgtttggtcagtaataatgtcaattttaaatcctttttctagaatcgcttgatggatgtctacagcatttccaactaacccgattgataatccttctccacgttctttcgcctcttctgctaattttaatgcttcatctaaatcagctgttttaacatcacagtatttcgtatcaattcgcttatcaacacgtgtttcatcaacatccacgcaaattgctaccccatgattcatagtaattgctaacggttgcgcaccacccataccacctaaacctgctgtcagtgtaacagtgcctgctaaatctccattaaagtgttgattacctagctcggcaaatgtctcataagtaccttgcacaataccttgagaaccaatatatatccaactaccggctgtcatctgtccatacatgattaaaccttttttatctaattcattaaaatgatcccagtttgcccattcaggcactaatactgaatttgaaattaatacacgtggcgcttcttcatgtgttttaaatacagcaactggctttcctgattgtactaacattgtctcatctgattctaattctcgtaacgttttctctattgcttcaaaagcttcccaattacgtgctgcttttccaataccaccataaacaactaaatcttctggtctttcagcaacttctgggtctaaattgttgtataacattctaagtactgcttcttgttcccaacctttacactcaatactcaaacctttttttgcttgaatttttctcataaaattcgctcctgttcttttaagaagttaattccactaaatttaaaacgcttacattattatcttcaatattcattatagtatgttaaaatatagccaacaaatataaataaactaattatccatagcttgaatctataaataaaaggagcaaaacacatgaaaattattcagttagaatacttcttggctatcgtgaaatataatagttttactaaagctgcacaatttttacatattagccagccatctttaactgctacgattaaaaaaatggaagcagatttaggttatgacttatttacacgttcaacaaaagacatcaagattaccgaaaaaggaatacagttttatcgttatgcgagcgaattagttcaacaatatcgatccacgatggaaaaaatgtatgatttaagcgttacatcagaaccaaggataaaaattgggactcttgaatctacgaatcaatggattgcgaatttaattcgaaagcaccattccgactaccctgaacagcaatatcgtttatatgaaatacatgataaacatcaatctatagagcaattactgaattttaatattcatttagctataacaaatgaaaaaataacccacgaagatataagatccattcctttatatgaggaatcttacattttattagcacccaaggaaacatttaaaaatcaaaattgggtagatgttgaaaatttgccactcatattaccaaacaaaaattctcaagtgcgcaaacacttagatgactattttaatagaagaaatattcgtccaaatgtcgttgtagaaacagatcgattcgaatcagcagttggatttgttcatctcggcttaggttacgctatcattccgagattttattaccaatcatttcacacgtctaatttagaatataaaaaaattcgtccaaacttaggccgaaaaatttatatcaattaccataaaaaacgcaaacactccgaacaagtacatacattcgtacaacaatgccaagattatttatatggacttttagaggctctttaacttaagttattagagcctcttatgcagttgctcagtcaactgtataccttttgcctttaacttaagttattagagcctcttatgcagttgctcagtcaactgtataccttttgcctttaacttaagttattagagcctcttatgcagttgctcagtcaactgtatacctttttcctttaacttaagttattagagcctcttatgcagttgctcagtcaactgtataccttttgcctttaacttaagttattagtgcctcttatgtagttgcgtagtcaactgtataccttttgcctttaacttaagttattagagcctcttatgcagttgcgcagatcatcgtataaaaattaatgacgtcatttcaaaaatcgatacaaaaataatttattataaaaattctaagaaagaagtgaagcagatgttaaaatctattaatcatatatgcttttcagtcagaaatttaaacgattcaatacatttttatagagatattttacttgggaaattgctattgactggtaaaaaaactgcttattttgagcttgcaggcctatggattgctttaaatgaagaaaaagatataccacgtaatgaaattcacttttcatatacacatatagctttcactatagatgacagcgaatttaaatattggcatcagaggttaaaagataataacgtgaatattttagaaggaagagttagagatattagagatagacaatcaatttactttaccgaccctgatggtcataagctagaattacatactggcacacttgagaacagattaaattattataaagaggctaaaccacatatgacattttacaaataaggtgtcattataaaaaggcctcttgaactccgttaaaattttaattaattattatataataagagaacttttcaaacaatacagttgttatttttgctatttcaacaaacataaataagcagtaagatgactacaacttaagagtcttcttactgcaattatttttcaaatatatcaacgttaatataacttctattaagaaatactcacattctgccctgcaatgcaaatctcgtcacatataaatatttttaattattttaaaaaatgatgcactaaattagcaacgagcttagcagttctattgtcagcgtcatatgttggattcatctcagcaatactaactgaagacaccttatcacttggaataatacgttttgctaattcaagaacagtatgtggatacaaacctaacactgccggcgcacttaccccaggcgcaaacgcactatcaatgacatccatacaaatcgtaaacataatgacatcatgttcatgtacaaaacgttcaatcatatctttaattgttggtgatacgtgactcaataattcatctgcaaagacataatcaatctttttctctttagcataatcaaataaactttgcgtattaccaccttgagcaataccaagcactaaataatctgtgttttcatcttcttctaaaatttgtctaaagctcgttccagatgtagattgttgttcagcacgtgtatcaaaatgcgcatcaatatttatcacaccaatagattgtgttggatagactttacgtgttgctaaatattgagcatacgcaatatcatgtccaccacctaataaaaatgtttgtctatgattagcaattgacttcgctgcaagcatagcaaattctttttgagtatcaattaattcctcatgatcatgataaacatttccgtaatcgactaaagttcacattgattcaaatccggcaaacctgcaaatgcttgtttaatcgcatctggtccttcttttgcaccaatgcgccccttgtttaaagcaacacctttgtcaacagcatagcctaatataccgacccctgatggcatactactcttttccagcttagacaaatcttcaaatgttactgtttgaaaatgtctaaattttttcgggtctgtttcactatctaaccttccagtccataaatttggttcaccttgcttgtacacagcatttccccctcttatttatgtggcttattaacaattaaagtataacgtataggaaattttgaattcaattcatagttaaatccgtatcttaaaaatacttatctacattacttttacccctattttctatgtaataacgaatacttagctgatttatgttaataaaatacgtcaagactattacattttcattaatattgacatagacaatttatctctcggcttgtaatatgtataattgttactaaaagatattttgcttgttacctaatggaggttacatataatgaagaacaataaaatttctggttttcaatgggcaatgacgattttcgtcttctttgtcattacaatggcgttatccattatgctcagagatttccagtctataattggtgtcaaacactttatatttgaagttacagatctagcaccattaattgctgcaatcatttgtatactcgttttcaaatataaaaaggtccaacttgcaggtttaaaattctcaatcagcctgaaagtaattgaacgtctattgctagctttaattttacctttaattattctaattattggtatgtacagctttaatacatttgcagatagctttattttattacaatcaacaggcttatcagtacctattacacacattctgattggacatattctgatggcgttcgtagtagaattcggattccgttcatacttacaaaatattgttgaaacgaaaatgaacacgttctttgcaagtattgttgttggtttgatgtattcagttttctcagcaaatacaacttatggtacagaatttgctgcttataacttcctttatacattctcattctctatgattcttggtgaattaattagagcgactaaaggacgtacaatttatattgcaacgacattccatgcttcaatgacattcggacttattttcttgtttagcgaagaaatcggcgatctattttcaatcaaagtcatcgccatttcaacagcaatcgttgcagtaggatacattggtttaagcttaattatccgaggtattgcatatttaacaacaagacgaaaccttgaagaacttgagcctaataattatttagaccatgtcaatgacgatgaagaaactaatcatactgaggctgaaaaatcttcttcaaatattaaagatgctgaaaaaacaggtgtagctactgcatcaacggttggtgttgctaaaaatgatactgaaaatacagtggctgacgaaccaagcattcatgaaggtactgaaaaaacagaacctcaacatcacataggtaatcaaactgaatctaatcatgatgaagatcatgacatcacttcggagtcagtagaatcagcmgaatcagttaaacaagcaccacmaagtgacgatttaacaaacgattcaaatgaagatgaaatagagcaatcattanaagaacctgcgacttataaagaagacagacgtncatcagttgtaattgatgcagaaaaacatatcgaaaaagctgaagancaatcttcagataaa

SEQ ID NO: 5 - DNA, 8549 bp; double-stranded, linear
atgtgttgtaaacttttatgttgaaaaagctacttatctcaatgaaaacaagtagcatttaataaattaattagtatacagctagtttttctaattgttctttaacttgaattaagtttgaccgtattagagaggcagattgatccatcgtttgaattgcttgtccttcattttcgttcaagccattacaaacaacttcaaactgttgtgccatttgatcaagacgcgcatgagcttgtgtgtttaaaataaacatatcgtcataatgtgatggcgaatagataattcgtcgttgtatacaaacgtataaaaaccttgtcatatcaacggttttggcatttttaaacctctgtgttttccacgcatgtttgcccttatttaaataatttgcccttttttcgccccgaaaaaaaaacacaaaaaaataaccacactcctaaattaataggtggtgtggttttgttgattgtaggggtataaaaataaccgcattattaaagatacggttactctgttatctgtaaatataatagtagtttaaaaattagtcgttattgttagttctttttttatctgattcttttgtttctcctaattcgcaaacaggactccacataaaaatcaactcctttatataccataatgatactatattttctagtttatttcaatttttcagtttttaaaaatgagtttctgtttttatttatacgcttttctgttttctttttaaattttatctttttgttattccattcattgtaaaattctattaaattaacataaaatttttcatgccctattttatttgttgatgagatatcaatgtaaagactcaatattgtttttaaatagatttgatgcaacgactgataaaccgtattactatctgctatgttattggtaaaatgcatagaaaaatattctaatttattcatgcaatatatatgggtttcattatacttcttaatgagtgtatttataccttgcaatacgtcattacttttaataacaatttctttttcacctgtcgaaaaagtccactgtttatctcctatattttctttaattgttttcttgttgtcaaattctaaaattatagcccgtaaacactcttctttataattctcgttcttgaaagtacgaagcaaaatttttataaattcggtattggtgacttttttataagtgtgatattttgcaatctctttatcagtaaagactgttcttagttcgtgattatcaaaacttaaattcatcttattctctaattcattaattttatcttgcaaaccaacattttctaaaattttcttgtttatctcccctatatcaaaactccttttcgaaattaattttgaaaactcgtctgccatttcaacagccttttctttccttttataccttttgttaaatttatgaaccaccgttgcagcataatacgatatcccaccagataaaatagatgatattatcggtatgtatatatcacctttcatatttccacctcttttaacacaattaagtattatgatacacaacttgcgcaaaaagatgtagacagaacataatggcgaacaaaaacaaccacccagtaactagtatgggtggcgtagactataacaactctatgttatcaagatatatgtatcgagtgatggcaaggaagaagtctcctgcgggaccaacagtcagatatatggcctctgccgggctatatagttcactcctactatataaaagtaagtataacataaaaagcaccccgtaaactgttatacgggaatgctaaagtcatatatactacggggagtagtatgaaaactatgctctctatcgtaagaaaaaacacccagtgacatgcttgggtgaacaaggatagatgtaaatagttgatgcatgtgtacacatcataacaaaaaactagcccgaagctagctataacataaaaaaataggcaagtaccgaagtacctgccagttacgcacatttaaatcttgagagtaatgttaaaaagtgtataggaatattaacatccatccaaatagttatttaataactgtaagattccctataattaatgtagcaaaatttttattctaagtaaatactaaatcgtgctaaacttaccaaaactacttattctattacctgccttgtctacctctcctgtcgctatataacgacgttgtccactattagcaatataagtaatccatctatagccattgatgcaatatgcgccgtcatatttaattgttgcgttattaggtaatacacctgtaattcttgaattagttgaatagccgtcccttacgttattacctttaacattggcaactgtgtaataaccagtctcttttttatacggtacattgtttttatcaagtgtataacctgctggcactggtggatttttttggtttttagctgatgttttaacattaccagctaccaaaccacctataggcttaccatgaatcgcaccggctattaatttagaatacaagtcatagtttttcttaatccaatccatatcatttttattagtaataaaacctaattcagataaacgatagtttatatttatttctgctgatacattaacgtttagtaaatcattacgaggtgttacacctcttatttgtcctaagttatttttaataacatcttgtatacttttatcaatagtatctgcattgaattgacttgaaataataacatgcccaccacttgcactttctcctgctgcgtctaaatgaatctctagaacaatgtcatacccatgtgatttaacccaatataagccataatctttattatttcctacattaacaccgtaagcagtatcttgatacatatcttgtgattgacttgagccaccatataatgcaacttcgtgacctgcatgtcttaaatacttagcgatatttggtgttatatatttacggataaaatcacgttcatttgttccgtttccgactgctccaggatcgttataaccatgaccggctacaagcataatttttttaggtttaattactgcttgctttttggcagttgcttgcttaataacgcttttagctttatctccaacacttactttatctgggaaatttaatctaataaaatacattgggtcatcgtaataatgaacatgtcttgtaacggtttcgggaccccaaccaggttgcgcaacgccatttgtccaacctttaccattccaattttggccaaacgatgtgaaagtgtttagattagcgctctcaacaatttcaacatgtccagctccgccaccatactttgacgggaaaacgacaatgtccaacttttgcggtaaaaagctatcatagtttttaattatttgcccgtatttttcaatccttgctttattatcaaatggaatattataagcgtataaaccttgtaacctttcgcctgttgctatcataaaaaacatatttgcgtaatcgtaacactgaaatccataaaacaaatcaggattgaactgcttccctaatgaattatcaaaccatttttctgcttggttttttgttatcaacattggtcaacacctaccctaaatcatttgtgtcgttcatattcgtaggtgtcattacttctttaattggcgcttgccctgttgcttttctatacttgttttcagctttatatttctttagcttttgatttgcccatttaccttcttgagatgttggattatctttatatgtagtatataaagcaacaactgttaagataatcgatgaaacactttcttcatctactggtatcggacttatacctttattcgctaaaaactgattgactaatgctaagatcaatacgatgtatcttgttattacttttgcatccatttgtttgctccttttatccaaaataaaaagccagtgccgaagcactgactcttaactattacttacacttactaaaccagaaacacgaccaaaagctatatcctaaaattcccttaagcatggtaatcacctcctttaaatgccaaaaatagtttttaacaaggctataacaaatgtacttagaatcgtccctattaatcctagaatccacatcttgatgtctctaatatttttagcatttttctctttatttttttcatcttcttctttgtcacgccttagttcttcgaaatttctatctaacttgtcataaattttttcttgcgttctcagactgtcttctattctgtcgaatttttcaaacatagtcttatcattttcttctaatcgcgttaaacgccaatcttgttcgtgtcgtttggtaaatccaaacattacaccacccactttattcaaattaaaaagccataagattataacctatgactctagattttctggatacttttctcctgtaataattgcatattcctctttatctataacttccatatctacataccacgctatatcttctttactatattctttcaattgataccatgttttaatatcttcgaatgttggtgaaattaatttaagcattttcagtctctcctttaacctcttctaattttttattaagtgtcacaagttgttttgccattagtgcattttgcttattaacttgcatcgataactttgtactttgaacaacttgtttctgcatactagcaaccatttttcgtaagatgtcatcagaagcgactgtgttttgttcttcactgtcaatctgttgatgcaagtcatctttttcttctgaataatcttcgttaaaaactatttccccatttgaatatttaaaggctttaggtctaaaaacttgagagaaattttctggtaaattttcaatatcaataccttcttcaaagccaccaatgatagcgtatgaaattatctcattacgcttgttaactaatatttgcattattttctcactcctataattttgttaattgtccctctatttgcgttcgcaccagagcctctttgacttcctaagtcgaaatagacatcgtttgatatagttaaagatgtacgactagatttagttaatccaaactcataaacacctccaccatttccatcaccatctggaagatttgagggattcaatgaaatctttcctcctccaaaaggactgccaaactctgtaaagtcaccacctggaaaagtcccataaaaaattaataaaataaattggtctaaactctcatttaagtacaatgtagagcccacaccatttgctgttccatcaaaaataaccgaataccttttattaaacttgtcatctgcgtataatttagcgttactttcggccatattagcttttgattgggcactttgaacagtttcaaaaggtgtattgtaatcattaatagctaattctgaccactcagaccatgaacccgcttcttttcttttaacaaatactttatttgtaccgttcggtcgataagtcatacgcttgtaatctgaagttactactaaatattcgacagtaccgttagtactaacacctcttggataatttatagcttgcgaaacataaataaattgggttgaatcacctattctttgttctggattattaaaatcaaatccagtaatctgcattatcttaccatcatctttagtaatcttagctttttgccaatttgaagtagaaccacttgtgactaaaccaccactattcactgactgcttgaaggcttcatgtttctcatccatatatcgcttttgctcatcgaatgttcttgaatatgcttgcgctttattttccaaatcagatatatggctattagcaagttgctttaattcatctatacttgaagattttgctatttgaatatctgatagacctttttctttagctttttcaatcagactcgcataatcttcaccattttttatagcctcgtccattgctttcgcacgatccataatagttttttctaattcctgaaattcaacaatatagtgtaattttgtttcagatggaatcatgctaaacaaacttttttcaacgttaaatgtgatagttctctcgacaactaccacgtctgaattacctaattctgcaaccgaaacttgagcttgataacttccatctcgtttaattacatcattaggtaattgaaattttaaaatacctttaaatggatctaatatttctagtggagcaactaccatgactcctttacctcgaatcgctattcgtgckttgatattttcttcactcaataataacggttgattatttttagtgatattaaaaagaagaacagaagaatcactctctcctgttctaaaagttatatctagatttgaaatatttccataatgcgctgtgttttctaaatttatagctacagatttctctaaattactcattaacttataattctcccttcgtgtaaagtccatggccctgaacttgttttactatcataatttttcaatagtatctcagcagatgctgtaacactattacgaactagcctatgaacaaagccacctgtgtttgaagcttctacatataagttccaaccagctacccctttacgttcagttggaaaatctgtaaaacgttttgtatcatccgtagttaaataaaacgacatgcctactatgttaatatctgacatttttgtgatgaatgaaggtactctctcccatttaccactatttttaggcacataattccagtccgaaatgtctccagttcttccagaaagcaccctttcaaaagtcatcatattccttgcataactattacgcgtcaatatctgaattacatcaccgccagtttgtggtggcttaacttccaagaaccaacctgcatcacgccattctcttggtaatgggaaatcatcgatttgaactgtatgatcagtgtataaatagtaaagacctggctctgttaacatcccaagattcttaagtttatcaggcctcattggtaaaggtttaactctaccacctgtgtcactcatgataaaaggaacgcctcttgagtgaagtatttctaaaatacctctttgcccaatcatgaaaatacgatgtgttctatttccatcaccaccgacagtaacacctagcatcaaagcttttttaccactatctttgtcatagtatatttgcaaacctttctgcttccgcaaattcgccaggaaatgaatctagtgttccaccatagtcagcattaacctgatacgcttcttctcctgtttctaaatcgaaagccgttaaatagtttctattatttggattactgtctcctgtataccaatacaagtatttttcatcaaaagtcacaccctgcattggttgggtttcgtttgttagtctcatagggatactgattttatgcaaaactttatcaatatttttatcaacatcgtctaaacttcttatctctatataantcattgagttttcaagttcccactgacttctaggtctctcaattctgtatagaattttattttctttttcatttatgacaggggtgatgtagggtttttctgggtgtcctgtaaatacatcttgcataccatacttgccatagctaatttccacattaggcgtatacttgaaacgaactaatgtattctcattattaccatttaagataaaactataaatccataactcatcatcaatatatctataaccgttatgtgtaccatgacccccacctacaatcaatgagctgtctataaattgaccattaggtcttagacgacttagcatatagccattatttctagcttgtgtcatgtatactatgcctgttctattatcaaaccagaaggattgcattactgcatttgtaagaggtgcaagttctgtcacaaataaaaattcttgcttatcaggttcaaaacgatactcgatatcaagaatttcttgtttggtcttatttaattctcttatagtttcctctttattaatttgagttttggtttcccaatcgtctaaatgttcttttaatgtgtcaaaggtttcgccgtttacattaactcgagcttgaacaatctcattagcactgttattacgtggtgccacaacaagtgcgttaatttgactttgtaaagatttgtttactgctgcttgcgatctaccattataataaatttgctcagcgaagtgttgaattgttttagctytctgatgcaacttaaactctgttgtcaagccaagcgcaaattgctctattctttgtaagttttgtatttccttagctctataatctcgacctgctaaagctcccaaatcctttattaaatacaaattttccataatgcaccttcctttctaataaaatagcactgtaccaagtttcccactatcgtcaactgttattttccacaatttaccgtttggggatttctgtacaatgctattttgaataattgcctgcttcgcctatttttaaattatctaatttatttktatcatttaccgaaatgataccgtcttgaggcaatccatcaatancactactgcctgcataaggtatcccatttatagctttccaatgtgtagctggaaagtactgtttatcgt

SEQ ID NO: 6 - DNA, 3601 bp; double-stranded, linear
aggcgtgtagtgacttacggntaggaaactatgtatccgaatgatttattgagaccaaaaaggcattaaagtccattgaaatatcnggtagcgmgttggtacgtggacgtgggggccctagatgtatgagtcaaccattattcagagaggacatttaacgtaataaattatagamacgagggtgaaaataatgacagaaattcaaaaaccgtatgatttaaaaggcagatcattattaaaagaaagtgattttaccaaagcagaattcgaaggacttattgattttgcaattacattaaaagagtataagaaaaacggtattaagcatcactacttatctggaaaaaatattgcactactattcgaaaagaattcgacgagaacgcgtgctgcgtttacagttgcgtctattgatttaggtgcgcatccagaatttttaggaaaaaatgatattcaattaggcaaaaaagaatctgtagaggatactgcgaaagtattaggtagaatgttcgatggtattgaattccgtggtttttcacaacaagctgttgaagatttagcgaagttctctggtgtaccggtgtggaatggattaacagacgattggcatcctacacaaatgttagctgattttatgacaataaaagagaattttggatatctagaaggaataaacttaacttacgttggagatggacgtaataatattgcgcattcattaatggtagcaggtgctatgttaggtgttaatgtaagaatttgtacacctaaatcattaaatccaaaagaggcatatgttgatattgcaaargaaaaagcgagtcaatatggtggtycagtcatgattacggataatattgcagarccagttgaaaatwcmgatgctatatatmcagatgtttgggtatcgatgggtgaagaaagtgaatttgaacacgtattaatttattaaaagactatcaagtgaatcaacagatgtttgatttaacaggtaaagattcaacgatattcttacattgtttaccagcattccatgatacaaatacactttatggacaagaaatttatgaaaaatatggattagctgaaatggaagttacagaccaaatctttagaagtgaacattcaaaagtgtttgatcaagctgaaaatagaatgcatacaattaaggcagtaatggcagcaacattggggagttaatcactaaatggaacgatatgaatatgatgtgtctgatgatataagtgtcatgtacagacacctcatattggtattaaaggagaaatgaatatgaacgaatcaggagataacaaactcagtaaatcttctttaattggactagttataggatccatgattggtggcggtgcgttcaatataatgtctgatatgggcggtaaagccggtggattagccattattattggttggattattacagctataggaatgatttcattagcgttcgtatttcaaaatttaaccaatgaacggccggagctagacggtggtatttatagttatgmtcaagcaggatttggcgattttgtaggatttatcagtgmttggggatattggttctcagcgtttttaggcaatgttgcctatgcaacactattgatgtcagcagtaggtaactttttcccgatttttaaaggaggcaacacattaccaagtgttattgtcgcctcgttactactctggggtgtccatttcttgattttaaaaggcgttgaaacagcagcatttatcaatagtattgttactgttgcaaagttaataccgattttacttgtaatcatatgcatgataattgcattcaattttgacacttttaaaacaggctttttcagtatgacgtcagagggtgtattgccatttagttgggcgagcacaatgagccaagttaaaagtacgrtgctagtgacagtttgggtgtttatcggtatcgaaggtgcagtaattttttctagtagagctnaaaatgagaaagatgtaggtagtgccacggttataggacttatatcagttttaattatctatytcttattaactgtattagctcaaggcgtgattttgcaaaatcatatttcgcaattagattcgccaagtatggcacaggtgcttgcaactattgtaggtggttggggatctacacttgtaaatattggtttaattatttcggtactaggtgcatggttaggatggacactgcttgctggtgaattacctttcattgttgcaaaagatggattatttccaaaatggtttgctaaagaaaataaaaatggagcacctgtaaatgcactgcttattaccaatatattagtacaattatttttaataagtatgctatttacacagagtgcgtatcaatttgcattttcactagcatcaagtgctattttatacccttacatgttcagtgcattttaccaagttaaatacactttagagcatcgacagcaagcaactactaaacaatggacgattggtatcatagcctcaatttatgctatatggcttatatatgcagcaggtatcaattacttattattgacgatgttactttatattccagctcttcttgtttatacaatcgktcmaaagratwatcagacacgtttgattaaatcagrctatattctttttatgattattatcgtacttgcagttatcgggttaattaagttattgatgggaacgataaatgttttttaaaaggagcgacaaaaatatgaaagagaaaattgtcattgcattaggcggtaatgcgatacagacaacagaagcaacagctgaagcacaacaaacagctattagatgtgcgatgcaaaaccttaaacctttatttgattcaccagcgcgtattgtcatttcacatggtaatggtccacaaattggaagtttattaatccaacaagctaaatcgaacagtgacacaacgccggcaatgccattggatacttgtggtgcaatgtcacagggtatgataggctattggttggaaactgaaatcaatcgcattttaactgaaatgaatagtgatagaactgtaggcacaatcgttacacgtgtggaagtagataaagatgatccacgatttgataacccaactaaaccaattggtcctttttatacgaaagaagaagttgaagaattacaaaaagaacagccagactcagtctttaaagaagatgcaggacgtggttatagaaaagtagttgcgtcaccactacctcaatctatactagaacaccagttaattcgaactttagcagacggtaaaaatattgtcattgcatgcggtggtggcggtattccagttataaaaaaagaaaatacctatgaaggtgttgaagcggttatagataaagattttgctagtgagaaattagcaacgctgattgaagcagataccttaatgattcttacgaatgtagaaaatgtatttattaactttaatgaacctaatcaacaacaaatcgatgatattgatgtagcaacactgaaaaaatacgcggcacaaggtaagtttgtggaaggatcgtgttgccaaaaatagaagctgcgtacgtttgttgaaagtggggaaaccaaa

SEQ ID NO: 7 - DNA, 573 bp; double-stranded, linear
cgacactattaaatgaattagagcacaatctaacaaatcaaattcatttttcaaaagatgaacgactcacacatatcgctttaaagttattcgaaacaaccgatcctgtttcaacaaagcaacttgcgcaagatgttaatgtttcgcgtcggacaattgcagatgatattaaaatgattcaagcccaactagatcaataccatttaaagttaaattatgtccacaataaaggattcaatattattggtgaggaagatcattatcgtaaagcgtatgcacactttatacatcaatatatgaaacaagctgcaccttttatagaggcggatatctttaattcagaatcaatcgcattggttcgccgtgccattattaagacattaaatagtgaaaattatcatttagttcagtcggctatcgatggcttaatctatcatatactcattgccattcagcgtttaaatgaaaatttttcgttcgatatacctatcaatgaaattgataaatggcgacatactaatcagtatgcnattgcttcaaaaatgatagaaaacttagaacgcagtgtaatgt

SEQ ID NO: 8 - DNA, 1221 bp; double-stranded, linear
ttgatatttataacgttatattttaatagttcacctggattattaaataaatagtccgccaaattttctttttctttatcaatctgatkgtaattaacactttcgacttctgtaggaattctaatgtcaacagaagcattgatataagcttgatgttgcatgcaatcacactcctaatccttcatmtmaaacggagaagtaaacccgtcactattcaaattcaatccttttgcccaatcaacaggcttattcatgatagtttcgatttccttaagtccatttgaacctctaggtatttctacaattacttcatcatggacatggccaactattttaaaacctaatgcttcaagccttgctatagaaatcgcaagtaaatcccttgcagttgcttgaacaatattctcgactaacttcccaccatacgtttttaactttgaccatttacggttaagatctaaccccataaattcaacaacttgactaccccaactattttcaccaactaaagcttttggataagctaaagctcttccactaggcagttcaatcattagaaaaccttttttcatataaaatctaagtccatgtgtatgatgcgtctttcgggattttacagtattaattgcagcctcttggcaagccttccaaaaattaactatgttaggatttgcgttacgccaactatcaactaaaccttgtaactcgttttcttcaatgcccatttccaatgcacccattgcttttaaagctccagcgccaccttgatagcctaaagctaattcggacacttttcctttttgtctgagagggtcgcctttagttatgctttctaccggtacattaaacatttgagaagccgatgcttcatatatctttccgtgtgtgttgaatacatctaaacgccattgttcttttgcataccatgctatgactcttgcctctattgcagaaaaatcacttactgctagttcattaccttcttcagcagtaaatgtcgtcctaactaattgacttaataagtcttgaggatgaacattgagtaataaatctaaatcatcaaaacgttgttctttaataagatctcttgctatttctaattcagtatctgaaatataatgctttgttaaattctgaagttgtacacctctacctgcccatcttccagtaccggcaccgtaaaattgaaacagacctcttacccgttcatcactgcacatc

SEQ ID NO: 9 - DNA, 1090 bp; double-stranded, linear
ttttgtttggtatgaggtagcaatgacgacgtgtcattggtggagattgtaaaaatacataataaaaagaagcggcaatgtataccgctccttttttatactacataccgattttcaaccatctctttctacttagtaataagacaatagtattaactataaatagaagaacgaagaatgatactatatttataatttcagtaggacacataaatgttgactcgttattcaatattttttctacggcacgatacatcgtattgctcgcctcaaatggagcaacgataccaaatatatttttattaatggcaactaagatgactgaaccaatccaatatacaatgctgatacctaagctgattaaaatgttaggtgaaaccatactaatcgttccaacaactaagatatattgtaagataacgagtgaaaataagattattaatagtaagtaatgtgagaaatccgaatatataattgaaataatagtgatacttagaattatgaacactaaacattcaaaaaataacactgctacctttttatagaagaaggtaaagatattatcgccaatcaatttataaaacaggatatttttattcgaatactctttattaataaaatatgcaataacaaatgaaaatagtaagaaccctaattgcgttgcaacagtatatgaactgaagaaaaactggctatagcttaaacttttaactttgtctatacctattggtaaaaaatacccaagtaagaaaaggaatgtgaatagcacaacaagcgtgtaaataattttattggaaatactttttttaaattctaatttcaaagtggacacctcaattataaattaatgtaatcatttatgacttcttcttttgattggtactcttctatttgaaggtctttaaaaataaagtatttacccggcaaagcacttaaatcggataaattatgtgtaatattgataatagttttagtttgatggctttgaataaaatcatttaaaaattcataaatttcattaactgttttcttgtctaaagcgtttgtaacttcatctaatatgattaaatcatgatcttccaataagaaa

SEQ ID NO: 10 - DNA, 904 bp; double-stranded, linear
ttaggactattttatcatattcatttaaattacggctaaaaattttaaaaacggggattaatatatggaattaagctatgaaagttaattgatacttgcattttacgctgatttatataagaataactattgtatagttttaaaaacgaacgtacgtttgcaggaggcgaaatcattggcaatgaataaacaaaataattattcagatgattcaatacaggttttagaggggttagaagcagttcgtaaaagacctggtatgtatattggatcaactgataaacggggattacatcatctagtatatgaaattgtcgataactccgtcgatgaagtattgaatggttacggtaacgaaatagatgtaacaattaataaagatggtagtatttctatagaagataatggacgtggtatgccaacaggtatacataaatcaggtaaaccgacagtcgaagttatctttactgttttacatgcaggaggtaaatttggacaaggcggctataaaacttcaggtggtcttcacggtgttggtgcttcagttgtaaatgcattgagtgaatggcttgaagttgaaatccatcgagatggtaatatatatcatcaaagttttaaaaacggtggttcgccatcttctggtttagtgaaaaaaggtaaaactaagaaaacaggtaccaaagtaacatttaaacctgatgacacaatttttaaagcatctacatcatttaattttgatgttttaagtgaacgactacaagagtctgcgttcttattgaaaaatttaaaaataacgcttaatgatttacgcnwgggtaaagagcgtcaagagcattaccattatgaagaagggatcaaagrgttgttagtatgtccaatgarggaaaagaagttttgcctgacg

SEQ ID NO: 11 - DNA, 11271 bp; double-stranded, linear
gatttctaaatcaagatctgttttacgataaccattcaaaccttgacgttcatcttcttcaggttgattttgttgctgtgtgtctttgttgtcagaagtcgctactgtttttttattatctgtttctttagtcataacaaacgcctccgttataaaacgctatatttaatgatatgtgatatttaagccattattttgaaaaatggtgataaatatatcttcttgagttatatcataattttaataagacgattcagcaagttttaaagtattatttgactatgttggattaggcatctagtcctataatatcactgacattgtcaaaatgatgatcttttaagtaacgtgcgatgcctttgttcattttcttagttaaacctgggccttcaataacaagtgatgaataaatttgaataagtgacgcaccgtgacgcatcattttgattgcatcttcagtactgaatacgccgcctgtacctataattaaaaattcaccatttgtttgctgataagcatacttaatcaattttaaattacgttcaaataatggacgaccactcaaaccgccttcttcgactttattagcagaagttaaaccatctcgttgtcgcgttgtgtttgctaagatgataccgtcaaatgtctcagtaatcgctggtaatagtgcttttaagccatcgaaatccatatcagacgttagttttaaataaattggcactgttacatcatgttgttttttaaatgctgttaaagcttggcataacattgaaaattcatctttatcatggaagttttgaagattttcagtatttggagaactgatgttgactgtgaaaaatgaaacgtcgtgtttaaacgtatcaataacctttatataatcttgataacgcgcttcataaggtgtcattttattcacaccaacattgataccaacaggtacttgataagcatttttacgcaaatgacttagtgctttgttcataccaatattattgaagcccattcgatttatcaaggcgtcatcttctaataatctaaacatgcgtggttgagggttacccggttgaggtttaggtgtgataccacctaattctaaagcaccgaatccaaggtgttccaatgcttttggtacttcgcaagatttgtcgaaaccagctgctaagccaattggattgtcgtacgtattaccttgtatcgtttgtgataacgttggattcttataagtaaatagtttatcgacgactgggaataaaaccggaaacttttgtaacgtttttaatgcatcgatagttagtccgtgtgctttttcgggttcgattttgaataagaaaggtttaattaatttgtacatgagtatgctcctatttcattatatttgaggcttactatcctcaacttaatatatgtgaaatatattcttttaatagactagcatttccatacataatttcctagttaaaactaaaaagttttgaaaattgacgcaagtttgaataacgtttttaagattaaatcatcctaattaggcaatattatagtataaagtaagtagattggaaggtgtttgtatgaatgaacaatggttagagcatttacctttaaaagatattaaagagatttcaccagtgagtggtggtgatgtaaacgaagcatatcgagtcgaaacagatacggatacatttttcttacttgtccaacgtggacgtaaagaatcattttatgctgcagaaattgcaggtttaaatgaatttgaacgtgcaggtatcacggcacctagagtaattgcaagtggcgaggttaacggtgatgcgtatttagtgatgacgtatttagaagaaggggcttcagggagtcaacgccaattagggcaactcgtagctcaattacacagtcagcaacaagaagaaggcaaatttggcttctcattaccttatgaaggtggcgatatttcttttgataatcattggcaagacgattggtgtaccatttttgtcgacaaacgcttggaccatttgaaagatgagttgctaaatagagggctatgggatgccaacgatatcaaagtatatgacaaagtgcgacgtcaaattgtggcggaattagaaaagcatcaaagtaaaccgtctttattacatggtgacctatggggtggtaattatatgttcttacaagatggtcgtccggcgttatttgatccagcgccattatatggtgacagagaattcgatatcggtattacaacggtatttggtggttttacgagcgaattttatgatgcgtataataaacattatccactcgcaaaaggtgcatcctatagacttgaattttatcgtttatatttattgatggtccatttattgaaatttggtgagatgtaccgtgatagtgttgcgcattctatggataagattttacaagatacaacaagttagttaagacgttagattgagataaatagataatatgcacagatatttttacaatgagaagcgatacagctgcctcaataaaaatatttgtgcgtttttattgttggaaaataaaattttaatcgctattgttaatttctgtaatgtaaaacaaggttgagttacaataaaagtgattttataactttttgttcaataaaattctaggaatgatacatatttattgatacaataattttgaatataatcataaaacaatatttaagtataattgaatgtttgaatatcatatattgatacagtttctaataattttaaaataatttaaatggagagaggtgtaaatgatgagtacagttcaaagtgatatttttaagaccaatagtgcatcatcatctattaaaagcgctgttgaaacatgtaataatgtgtcgaaaccggataaagatgaaagtacaacagtaagtggaaataataatgctcatagtgtgatagatgatttgatgagtaagaatcaatctgttgctgaagcaatacgaactgcgagcgataatatacaaaaagttggtgaggcttttgaccaaactgacgtaatgattggtaatgaaattggtaaaaattaaaacgtggtgaaatgatgtcgaataaactggatgaaatcaataaaataatcacagcgaaacatgagcaaatggatgacttatatgatgaaaagcgagaggttaaagcattgatagatgaaagtgatgcgcttaatcattcgatagatcaattatatcaacatttaggtgagcgttattatagtagcaatatggctagtcgtatggaacagttccgcgatgaatttcattttgcgaaacgacgttcaacggaagcgttatacgagcagcaacagcaaattcaacatggcattcgtaaagtggaagaagagatgattgacttggaaatgcgaaggaatgttgaaattgagacggtgacaaaggaggaaaataaatggaaacaataggaagcattatttatttaaaagaaggttcgcaaaagttaatgattattaatagaggmccaattgtagaaattgaaaatcaaaagtatatgtttgactattctgcatgtaaatatccgattggtgttgtagaagatgaaatttattattttaacgaggaaaatatagattcagttatttttaaaggttattctgatcaagatgaggttagatttcaagagttgtttgaaaatatgaaacaaaatttggatagtgaaatacaacgtggagaagttacacaacaataaagaaatactttttctttattggggtgggacgacgaaataaattttgtaaaaatatgatttctgtctcaccgccaaaatgttatctccaagtactgaggctggatgataccatgaaatgtcattcataatcatttgaactaaacgtagcagccttaaattttaaaaaaagacacataccaacttccgaaatgtagatgaattctctacaataacggaagtttttcttttaatattgaaatttctcaaggataggtctatactttataaatcgtaattattacgatttataatcaaaaacaataacttgaaatagatcattgagggagtgttaatatgcaacatcataaagtggctattatcggtgccggtgctgcaggtataggtatggccattaccttaaaagatttcggtataacagatgtcattattttagaaaaaggaacagtaggacattcatttaaacattggccgaaatcgacccgtacgatcacgccatcatttacgtctaatggatttggcatgcctgatatgaatgcaatttccatggatacttcaccagcatttacatttaatgaagaacatatttccggagaaacatatgctgaatatttacaagtggttgccaaccattacgagctgaatatctttgaaaatacagttgtcacaaatatatctgtagatgatgcatattatacgattgcaacgacaacagagatatatcacgcggattatatctttgtcgcaacaggtgattataatttccctaaaaagccatttaaatatggtattcattatagtgaaattgaagactttgataactttaataaggggcaatatgtggttatcggaggtaatgaaagtggctttgatgctgcatatcaacttgcaaaaaatggctctgacatcgcactttatactagcacaaccggtttaaatgatccggatgctgatcctagtgttagattgtcaccttatacacgtcagcgactaggtaatgtcattaagcaaggtgctcgcatcgaaatgaatgtacattatacagttaaagatattgattttaacaatggacagtatcatatcagttttgatagcggacaaagtgtgcttacacctcatgaaccaatactagcaactggctttgatgcaacaaaaaatccaatcgttcaacaattatttgtgacaacaaatcaagatattaaattaacaacacatgatgaatcgacacgttatccgaatatttttatgattggtgcaacagttgaaaatgataatgccaaattatgctatatctataaatttagagcgcgatttgcagtacttgcacatcttttaacacagcgggaaggcttaccagctaaacaagatgtcattgaaaattatcaaaaaaatcaaatgtatttagatgattattcatgttgtgaagtgtcatgcacatgttagaagtgaaatatgatatgagaactgggcattatacgcccatacctaatgaacctcattatttggttattagtcatgcggataaacttaccgcaacagaaaaagcgaaattaagattattaatcataaaacagaaattagatatttcattggcagaaagtgtagtttcttcgcctatagcgagtgaacatgtgatagaacaattgacactatttcaacatgagcgacgacatttaagacctaaaataagtgcgacatttttagcctggttgttgatatttttaatgtttgcattgccaatcggtatcgcttatcaattttcagattggtttcaaaatcagtatgtgtcagcatggatagaatatttaactcaaacaacattgctcaatcacgatatattacagcatatattatttggtgattatggtgtgctatcacttggaacatattcgctcgtatgggcattgccggttgtaatattgattagtttatcaactgctataattgatcaaacaggactcaaatcatggatgatatgggcaattgaaccgtcaatgttatggataggattacaaggtaatgatatcgtgccactattagaagggtttggatgtaatgcagcagctatttcacaagcagcacaccaatgccatacctgcacgaagacacagtgtatgagtttaataagctttggtagttcttgtagttatcaaataggtgcgacattatctatttttagtgtagctggaaagtcatggctatttatgccgtacttaatattagtacttttaggtggcatcttacataaaggatatggttgaaaaagaatgatcaacaacttagcgttccgctaccttatgataggcaattacatatgccaaatatacgtcaaatgttgctacaaatgtggcaaaatatacaaatgtttatcgttcaagcgctacctatttttatcacaatctgtcttattgttagtattttatcactaacgccaattttgaatgttttatcacaaatatttacacctatattatcgttattaggcatctcgtcagaattgtcaccagggattttattttcaatgattcgaaaagacggcatgctcttgtttaatttgcatcagggcgccttattacaaggaatgacagcaacacagttactactacttgtgttttttagttcaacatttacagcgtgctcggtcacaatgacgatgcttttgaaacatttaggtggtcagtcagcactaaaattaattggaaagcaaatggtgacatcattgtctttagttattggtgtaggcatcattgttaaaatagtaatgctgattatttaaaaaaaatgaactataactgaatatagagtcatgtcagtcaataggagatctatcttggaatatgctattcatatgaagtataagaggagagtcgcagatgaaaatagttattataggtgggtttttaggtggcggtaaaacgactgtcttaaatcatttgctcgctgaatcattaaaggaatcgctgaaaccagcagtcatcatgaatgaatttgggaaaatgagtgttgatggtgccttagtatctgaagacatacctttaagtgaactgacagaggggtgtatctgttgtgcaatgaaagcagatgtatcagaacagttacatcaattatatttaaaagagcaaccagacattgtatttattgaatgtagtgggattgcagaaccggtctctgtcttagatgcttgtttaacgcctattttagctccgtttacaacaattacacatatgattggtgtaatagacgcaagcatgtataaacacattaaatcattccctaaagacatccaaggcttattttatgagcaattagcatattgttctgtcttatttgttaataaaatagattcagcagatgttgaaacaacgagcaaactattgaaagatttagaagttattaacccagaggccgatatacaagtcggtatgcatggcagcgtcactttgccaatatcagttagacaaatgacagcaacttctgacaataaacataagtctttacatcaaatgattaatcatcaatttgtgcaatcaccagtcaaatgtactaaagcagagtttataaaacgtttagcatgccttccgtctcatatttataggttgaaagggtttatgacatttgaagacaccgcacatacgtatctcattcaatttacacaaggacaatatgaattaacacctgtagcattttcaaaaaaagtgccagaatatttggtgcttatcggaaagggtatttcaaaagaagactatcaatgtttggaacagtagtgttttcagtggaagagaatggttaacatgccttcatgtataataacgagttgatttgaacgtttaagcgtaaataaaaataagcttggtcagccatcaaatataatttgaaaactgtccaagctgttttattagagaacaatcaattaaccccacatatttaataatacatcagcaaagccttcaggtttttgaatataacctaagtgaccgcctggaatatctacaataggtatgccagtttctttatttatataaaagttaacatcttgtgggaaggagcctctagaatctgtcccatttagtagggtgattttatcgctgtattttgtgaaatcatccaaagtaatatctgaatgcgtatattgtctaatttcaaattctgaccagaacatcgtacgtttgtactgttctatacgtccttcttcagtatcagcaggttgagacatcatttttgcatcaattggtgcgatatttaatgtttcgccaaatgttttcatgcctttttctaagccttctgttaaaatttgatgcacaatgtcatcatttttatctttccaataagtactgtctggtaaaaatgtattaattggtggttcgtgaaatgcaatctttttaacgacttcagggtaatcttttaacacatgcatcgcaacgattgaacctgaacttgaacctaatatatagacaggttcatcacttaatgactttgcaagttcggcaatgtcctgtgcgtcgcgtttgacacgataatcactgtcagggtttgaagcggaatcagggagtggttcagttaactcgctttctccataatcacgacgatcaacggctacaacagtaaaatggtcttttaactgttctgcaagaggcagaaaaatgtctccggtaccgtttgcaccaggaataaagatgagcacgggtccttgtccgacttggtggtatcgtaatttagcgccttgtaattctaaagtttccatattcaatgacctccatttgttaattgttaggtgataaacctaataatttagcaccatttgtataacttattttctctttttcttcatctgttaaacccagttcatctaaaaatacacctaatttttcaggctcaatatatggataatcagcagcataaagaattctatcaatacctacttctttcttgactaaatcaaactgtggcttcgttaacatgccactcggtgtgatataaaaattatttttaaagtaatagcttacagggtggttcaaatgttcagcgaataaagcttcatccatacgttctaagaagaatgggataaactcaccccaatgtccaataatcatatttaactttggataacgatcaaaaataccagataatactagatgtattgtatgaatgccgacatcaatgtgccaaccataaccaaaacaagcaaatgttgccgcagttacttcaggataatttcctttatagtatgattgataaatgtcactgttaactggcgcgggatgtagataaatcggtacgtctaaattttcagctgttttgaaaataatgtcatatttgtcttgatcaagaaaaccatcttgtgcacgtcccataatgagcgcacctttgaatcctaaatcattgatgcaacgttcgaattctcgcgctgcggcttcaggctcattgataggtaaagttgcaaagcctacaaagcgattgggatattgtgcaatatagtttgccaattgatcatttgctttttgacataattcaatggctttctgaccaaccaaatttgaaggagaaccatttccataagataagacttgaatttgaacgtcttgattattcataaattggatacgttcatcatgatgtgataattcgtcggcatttgtaaaacctgtctttttttcaaggccttctaacattactttcatcggtacacctttaggatctgctgatatcgcattcatcgtttctttttgaatatcttcaatgacataatgttcttcaaacgtaatacttttcatttacttcgcctccatattgtattgcatgtttattgcatctattgcagaagcattttttatatacctctaatttcaatgtttgtaacataaaattgatctaccaaggcatctctccatcgccattaataaatgtacctgttgggccatctgcaccaatcgttgctaattgaatgattggcttgattccttcagaaacgtgtttggaattattactaaaatcaccaactaaatcagtatttgtagcgcctggatcagcagcattgatttgcatgttaggtaatcctttagcgtattgtagcgttagcattgttactgccgatttagacgaacaataagctaatgaattcactttagattcagctgtttcggggtttgtaaccattccaaatgaacctaaaccacttgatacgttgacgacaacaggttgttcagatttttctaagagagggacgaatgtattcatcattcgtacgataccgaatacattcgtttgatatacttcttcaacgtcacgaggtgtcaatttggaaggtgctgaaaattgaccagatatacctgcattgttaatgaggatatcaagacggccttctttttcagcaatcatgttataagcatttttgactgagtagtcacttgtaacatctaattgtacataatgaacacctaatttttgtgatgcttgttgtcctcttacatcattccgagaacctatataaactttgtaacccaatgctttaagtgcctctgcacttgcatagcctaaccctttattgcctcctgtgattaacacaattttagtcattacgtcccacctcatctaaataaatgtttaataaataatttctgtacgcttcaattgaaatatggcgatgctctatttggaaggcaaatacactagttgataatgattgcaacagcatatctgttttgaattcgtgtaagtgtcgtcatcgcttttaaataagtcataataaaaatcaaataattcttgataaaatgcgctttggtaaaaacgtaatttattgttgcctgcttcaatacattgcagtagtgccttattatcgattttaaattgtaaaagataatctaacgacacttgcataacctcataattagaatgatagtcatctttaatttgcttaaaatgagtgataaaaatatcaaggtctctttgtatgacgtagtagcataaatcgcttttatctttgaaatgtcgatacaatgtccccataccgatacctagttctttagcaatacgattcatactaatgttttcaacgccttcttcatcaaaaagtttgtgcgctatttcttcaattcgttgcctattctcttttgcatcttttcgcatgattacacctacttaaaattctctaaaattgacaaacggataactctccgtttattataaaacgtgttaagaaagttagcaatgaatttgcaataactattaaatatcataaaagaaaagagtgttgataatgtctttaaataaagagcaaagacgcatcacagctgaagagttgcaagcacatttcgaagcatctaccttatcggttcaaatgattgctgaaaaactgaatgtcactacagaagatgtggaaaaagtattagctatgacagcgccactaggcatttttagtcatcaattacaacgatttattcatttagtatgggatgtcagagatgtaataaacgacaatattaaaggaaatggacaaacaccagaaccatatacgtatttaaaaggtgaaaaagaggactattggtttttaaga

SEQ ID NO: 12 - DNA, 6261 bp; double-stranded, linear
caacccgttcagaacaaaataaaaaccgtacaattttatcatcttaatgattattgtacggaaaaacttttttacatcatatctgcatgtgcataatcgatatcggtaaatttattatattgtttcataaaatgtaacttaactgtgcctgttggaccgttacgttgcttagcaatgataatttcaatttcaccgttttcatcattcgtttgtggctcgaaaccaccatcatcgtcatcatcttcatcgccgccacggttatagtaatcatcacggtataagaatgcaacgatatcggcatcttgctcaatcgaaccagattcacgaatatcactcatcattggacgtttatcttgtcgttgttcaacaccacgagataactgacttaatgcgataactggacattttaattcacgggctaatgcttttaatgtacgagagatttcagaaacttcctgttgtctgttatcggacgcacgtgaaccactaccttgaatcaactgtaagtagtcaatcacaatcatgtctaagccatgttcttgctttaatcgacgacatttagaacgtaaatcattaattcgaatacccggtgtatcatcaataaaaatcttcgtacgtgataatttacctaccgctatagtaaaacgactccaatcttcctcagtcatagtacccgttcttaagcggtttgagtcaacatttccagaactacaaatcatacgtgtggctaactgatcagcacccatctctagcgagaaaataccaactgtatacatatcttcatgcgttgcaactttttgtgcaatattaagtgcgaacgcagtcttacctacagatggacgcgctgcaaggataattaaatcatttcggttgaaccctgctgtcatttggtctaaatctcgatatcctgtaggtatacctggtgtttgaccactattttgatcaagctcttcagctgtttcatacacttgtcctaagacgtctcgaatgtctttaaagccatcgctttcacgagaagatgatagctctaaaattcgacgttctgcatcacttaaaatcgcatctagttcaagttcatcattatatccatcattggcaatactatctgcagtttgaatcaatctacgttttaatgcatgcttagaaacgatatcagtataatactgaacatttcgcgtcgttggtacatttgtagataactctgcaagatattgcgggccacccgcttcattcaacgtaccttccgtcgataattgatccatcaatgttacaacatcaatttctttattatcttcatttaagtgcatcattgcacggaaaatatgttgatgggcacccctataaaacgactcaggaagcaaaacttcctgagtagtattaatcaattctggatctataataattgaacctaagacagactgttcagcttcattgttatgcggcatttgattttgctcatacattctatccatgaatggttacacctcttatttcaatccaactttattgttcaactgtgtgtacgcgaattgtaccttcaacttctttatctaatttaacaggtacattcgtatatcctagggaatgaattccatttggtaaatccattttacgtttatcaattttaatatcatgttgtgcttttagtgcttcggcaatttgttttgtacttactgacccaaacaatttaccaccttcaccagtttttgctgatacttcaacttcaatgtttgataacgtttcttttaatgctttagcatcttcaatttcttgttggcgttcttgttttgcacgttttttctgtaactctaattgtttaaggttacctggtgttgcttctacagcataattctttttcaataagaagttatttgcataacctactggtacttctttaacttcaccttttttacctttacctttacctttaacatcttgtgtaaaaattactttcatgcatcttcactcctacttaattgttctgtaattgcttgttgtaattgtgctatcgcctcttcgactgtcacacctttaagttgtgttgccgcattggttaaatgtccaccgccaccaagtgcttccattgttaactggacatttactgaaccgagtgaacgcgcagatataccaatcagattatcttcacgtctcgcaacaacatatgatgcttcaataccttctaaacttaacagttcatctgctgcttgtgcaactgttactggatgataaattttatcgtctgaaccatgcgcaatggctatgccattatcttcaacttttacagttcgaattaattcagatcgattaatgtaagtatccacatcatcttttaagaaatgttgcgttaaaatcgtatctgcaccatgtgcacgtaaataactcgctgcatcgaatgttcttgatcctgttcgtaatgtaaagtttcttgtatctacaataatacctgcatacatcactgttgattcaagacgtgttaaacgttgttctgttggttgatattccagtaactctgttaccaattcagctgtcgaacttgcgtatggttccatatatatcaacaatggattagagatgaagctttcaccacgtctatgatgatcgataacaactttacggtttgctttatttaagacattttcatctaaaaccagttccggtttatgcgtatcaacaatcactacggttgtcttagatgtcatcatatcccaagcatcatctgatgtaataaatcgctctcttaactctggctttttatctatttcgttcatcacgcgtcgtaatgttggatcaatgtcagtctcatttaatacgatgtatgcttctaaattattcatcattgcaaatctagacacaccgattgctgcaccaattgcatctaagtcaggacgtttatgtcccatgataatgactttgtcaccctctgcaaggatatcttttaacgcatgtgagatcacacgtgctcttacacgagtacgtttctccatcgggtcagtcttaccgccatagaaacgcacattaccattaatacttttaattgcaacttggtcgccaccgcgtcctaatgctaagtctaggcctgattgtgataattcacctaagtcgattaaattttcagtaccttcaccaacaccgatacttaatgttaattgggcacgataaccaacacttttttcacgtaattgactcaagatatcaaatttagattcttctaagtcagctaatattttttgatttaaataggctacgaattgatcggaactgtatcttttgaaaaatatattatactcagttgcccatcgactaatgacacgcgttaccattgagttgatttccgaacgctgcgtatcattcatattttgcgtaatctcatcgtagttatctaaaaataatgtcgcaatgattggtttagaattttcatatagttcatttgtttgtacttgttcagttatatcaaagaaatagaggcagtgatcattctcagaataacgtacttggaaatgatactgattatattctatttcaacggatttcactctatctaattgctttaaaatgtttggaaatacttcatttacagattcagaaatgacattcgcttccatatgatctgtcataaattggttaacccattcgatgtgatcattttcatctaaaacaatgataccaattggtaaatgtttgattgctttattatttgttgttgaaatttgagcactcaaaccatctacataactatccattttcattaaagcttgtctgaataaaatgatgctaacaataatcatcacgacaagaacgatagatgcaattagtgctataagactattaaagataaaccatacacccattaaaacaattgctgtgatgatcatgatgacaaatggtattagtaaagctttcttagtggactgccgattcattattccacctctattcactttttagaattatttttcatgattcgcttcaaattcaaacttaaatcgataacaccaagtagtcctacaatatgtgtcgtaggtgtcagtattgtaccgataaccaatagtaaaatcgttactgcattcggcaaacctttcgctttaccaaagaaatgaataacacttaaaccttgaatatacattactaatgataacacaagttggaagtttaaaagaatgctctggaacacactcggttgacctgtaaataataaacatatgataacaataatgtatatccataataaaataccgctcatttgccacgcgaaaagtggcttaaatacaggtgtagcgattttaaattttcgtaaaatcggaaatgtaacgattaagttaattaagacgattaaaaatgtaatgataatgatgaaacctggtaattgaacggtcgcttgtctaaacccttcttctaatatttgggtcatattcgcatcggcaccgctcatcgtaatcgcttcatgtaatgtttgcttgaaaggttttactatgctcgctgatggtggaatccttccgaatgtttgtagtaacataaaagcgattaatgaaattnarctcatcgctactgttgttacgtataatattctttctttagacgttctttctttgagcaattgaccaataattaaacttgcaattaagactaatatgatggcacttaaaacgaaagtattacctaaaacagttgttataattactgtaataagtgcactaatcccgaaagattgtattgatttattccataaaacgatacctggtatggttgcaaataatgcaaatattagtcctaaaccaggcactagatataaagctaaagcgacaaataccaacgcaatcgttgcaattattgttgctttaggttgtatttttgaaaacacataagccactcccatatttttaactatagctattattttaacctctttaatgaaaattaacaatttatagattgtatgcttctatttcatttaattgaataataactttcatgttttataagtaattaacatactcatttgaatcgcttttgtgtgctttcattttcaacatgattatttaatcccactacatagcaatcaagcttgatttagatttacaatacatttccactctcatgtactctagatgtttttgaatatgataactgtgatttagtggcttcattctttgaaaatatatattattacttacgcttaaaatgctttaaatttaagaaatgatataagttaggtgcccaggtactaaagtttagtaggaatccatcatgcccaacattatcaggcacgaagaaatgacgatgatatttaaaacgttcacctaatgcacgaacttgatcatccggatatagcaaatcatctatgaaccccatcgttaacacttttgtttctaaatttttaaaaacatgcgttacgtctgtgcgacctcggtcaatgttgtgactatccaatacatctagcagtgtcagataacaattcaaatcaaaatgttctttaaatttattaccttgatgttgttggtatgcgactacttcatccggcgtaaaacgttcatcataactttttgatgatcgatatgtcaaaaaacctaattggcgtgcaatacttagaccttccttaccaccaagatgaatggcttgccttgcaatttcattgaaagctctactataagatgatgttcgacttgttgcagcaaggataatggctttatctacttcaaactgttgattgtagagtagttccattgcttgcatacctccaagacttccccctattaaaatattaatcttatcataaccaagggcttgtatacctcgttcattcgctctgactatatctcttaatgttaattttttaggaaaatgagggtcgtttaaaggtgaacttgaaccgaaaggactaccaataacatcaaatgttaaaaattgataatcgtgaatgggtatatatcccccatcaataatttctcgccaccaacccggataatcatctgttccatatgttaaatgattgccagttaatgcatgacaaactacaactaatggttgtccatgataaccgacatgctcatatctcaaacgcaagtnatctatgacttccccagattctgtaataaattcccctaaatttaaagtatctactgtgtaatttgtcattgttctttcctccttaaacaaaaaaacttctcaccctattgaaaagtaagaagtctttatacttatcattcgagtaactcgttggttttagcaccgtgctataaagtcggttgctgaagtatcacaggg

SEQ ID NO: 13 - DNA, 1222 bp; double-stranded, linear
atgcgattaactctggaaatatcttttccatatttacgtnttaaattattcagcaaattcatacgagattcatactcgttyaacacttgttcgtcgaattctgtattagccatttcatcatataactcatgttttgcatcttctaaaatgtagtaaaattgatcaatatcttcttttaatttgtcatatttgtttggaactatatcgtttattgttaacaaatggttgcttagttcatataaacgatcagtgatagcattttcatccgttaatgtcatatatgcgttattaagcgctaagcttaatttttcagagttttgaatgcgtttaatatctatttcaagttgctctatttcgccttcttttagatgtgcttcagacaattcttctaattggaatttcattaaatctaaacgctgtagcaatgcttggtctgctgattctaaatcttctaactcttgctttttggctttataattttgaaaagtttggtgatatttatccaacaaatcttgataacgtgattctgcgtaattatccaataatgttaaatggtatttttgtttcaacaaagactgcgtttcatgttggccatgaatatctaataattcttgcataacttttcgtaaatcttgtaaagtaactgtttgattattaattttacaaagacttttaccagagctgaaaatttcccgtttaactaataaaaaatcttcatctacatcaatatccatatttttcaatatatgtatagcatctttactctcgtcaatatcaaatataccttcgatgacagcctttttttcaccatgtcttacaaaatcagatgaagctctcattccaattaattgtccaattgcatctataataattgacttacctgaacccgtttcaccacttaaaacagttaaaccatcagaaaattgaatttctaattcttcaataatagcaaattgcttgattgataaggtttgtaacataaactcatcgcatccttataacaaattgaaaattcttgacttgatttcatcacttgcctctttgcttcgacaaataattaaacaagtatcatcaccacaaattgtgcctagtacttcttcccaattgatttggtctaatatagctccaatagattgtgcattaccaggtatgtttttagaacaagtaaattatcagtaccatctatattaacaaaggaatccattaaataacgtcccaattt

SEQ ID NO: 14 - DNA, 1021 bp; double-stranded, linear
tttgttattattacntnaaataattgcattactttttactgatggtacaactttccatcctaataacattgcttcccattgttcatctgtaggtgctacttctgtaacaactttcatttcttcttttggcacgacataattgtctttatcttgaactaaatatccgccagatactgaaacaaactcttcttcgttactgtctatagtcatatcaatttctaataatcttacattcttcttttgttttaaaatatctaatgcttcatctgtaaattttggtgcaataatgacttccaaaaagatactatgcaattgctctgctaactcaggtgttacagctcggtttaatgcaacaattccaccaaatattgattgactatccgcttcatacgcatgttgaaatgcttgttctatcgtgtcaccgataccaacaccacatggattcatgtgtttaaccgcaactgtagcaggtgtatcaaactttttaactaaagctagtgtagcatctgcatctttaatattgttatagcttaattgtttcccatgtaattgtttagcgcctgcaatcgtgtgcttagcattcgaagttctcacaaaatacgctgattgttgtggattttctccatatcttaaagtttctttatcccctttaaagaaacgtacaatcgcttcatcatattctgcagtatgctcaaaaactttaatcattaatgattgtctatatgactcatctaacgaatcgtttcttaatcgcgtcaatacttcttgataatctgccggatgtacaattgttgttacatgtttatagtttttagctgcagcacgtaacattgttggaccaccaatatcaatattttcaattgcttcgtccatcgtcacatcagggtttgcaacagtttgttggaatggatataaattaactactaccatatcaattaaatctatatgttgttctgataattcatttaaatgctgcggtttatttcgatcagctaaaatgccaccatgaacagccggatgt

SEQ ID NO: 15 - DNA, 3759 bp; double-stranded, linear
tcattcactcctaaattgttattacactattacacatagctaatcatcaatgtgaaatcaccttcaaagacactatccaaatcttcagaagtcaaaataaagtttgtaccagtagtcagtttgaaaatttcaccatcgacaatcatttgcccttcgccttccaacactgtaactaaacagaactctctaggcttcatataatttaacgtgccagaaatttcccatttaaccaatgtaaagaaatcattcgatacaatgtgtgtacacttatggttttcaataatttcgctttcaggcaaaatattaggtaatggtgcattgtactgaataacgtctaaagctttttcaatatttaacggtctatcattatattgattatcttgacgattgaaatcataaagtctatatgtaatgtctgacgattgcatcgtttcgtatgctaatattcctgaagaaatagtatgtactgttcctgctggaataaaatagaattcyccaggktttactttaatatatcyaagtatcgactctatcgttccgtgttgaacatgattcgcaacttcttctctagactctgctaatgtccctataactatttctgcatcttcttctgcatctataatataccaacattcagatttgccatattgcccgttttcatgctcataagcataagaattatcagggtgcacatgaatagaaagtgattctcttgcatccactattttagttagaagcggaaaatctttgcttgggaaatcaccaaacaattcacgatgttctgaccaaatacggtctaatgtttgaccttgatatggtccattaataatctcgctcgtaccatttggatgtgctgacacacaccaacattcccccagttgtatcattgtctaattgatatccaaactcacttagacgttgaccgccccataattttgtttttaaaattggttgtaaaaataatggcattgttgcacctccattgtgattaagtaagcaatagaactctgatgttgttgttccattatattttgattttgttctcatttacatcgtattattaacttccacatttcaaattaactattagtgattgtaccatatttactaacattgcagtactgccaattaaaagngcttcacttaaatttacagtactttaacattttcaaaaatttatagcatagagattatatctctcttacatttgtacatatttccctttaaatttactcgcccattataccaattaataaacaactttaatagttgtgccatacattgttcaaattctttgtaaaacgcatagacaatacgtacttattcatacttataattcatcattttcaaaaaataacgagttacgaaaaagtaacccgcttcaaatcatatttactatccttattaatccgtttcattttcaaattgagttaaagcatctttaatgtcctgatcaccactaataatttgaaactcttggtgattaaaatgattggatgtgacaatttcttttaatactgtcgcaacatcttctctaggaatttcacctttaccatcaaaatattgtgcagcttctatctttccagatcctgctgcatttgtaagtgcccctggatgtaaaattgtataattcaaacctgnaacgtcttaaatagtcatcagcgtaatgtttagctattgtatatggctttaaatcaccgctatcatcaaaagcctgacgtctcgaatcatatgttgaaaccatgacatagtgtttaatattggcctctttactcgcaatcattgatttaacagcaccatctaaatcgacaataattgttttatctgcacccgtgttccctccagaacctactgaaaagataactttatcgaatggtttaaacgtctcagttaaagtctctattgaatcattttcaacatcaacaagaattgctttcataccttgtgattttaacgcattaagttgatctgattgcctaacaccagcagtaaatggtacattttcttttgctaattgttgcactagtaacgaacctacaccgccattagcacctataaccaaaatattcatttacaacactctcctatktattattctctatgccataccactttatgagatatgtaaaacttgttacaactataaaaatcaattgacatactactgggaacgtattaaattaatatatgaacaaatattcatatgaaaggattgtcatataatgtcagaacaatattcagaaataaatacagatacattagaacgcgtaactgaaattttcaaggcattagcgattacaatcgaatacgtatcatggaattgttatcagtcagcgaagcaagtgttggtcacatttcacatcaattgaatttatctcaatcaaatgtctcgcaccaattaaaattacttaaaagtgtgcatcttgtgaaagcaaaacgacaaggccaatcaatgatttattcattagatgacatccacgtagcaactatgttaaagcaagccatacatcacgcgaatcatcctaaagaaagtgggttataatatgtctcattcacatcatcatcatgaccatatgcatagtcatgtaactacaaataataagaaagtattgtttatatcgtttttaataatcggtctatatatgtttatcgaaatcatcggcggtctccttgctaacagcttggcattactatctgacggtatccatatgtttagcgacacattctcattaggtgttgcacttgtcgcatttatttatgctgaaaagaatgccacaactacaaaaacatttggttataaacgtttcgaagtactcgcagcgttatttaacggtgtaacgctttttgtaataagtattttgattgtttttgaagcgattaaacgtttctttgttccttctgaagttcaatcaaaagaaatgttaatcattagtattatcggtttaattgtcaatatcgttgttgcattctttatgtttaaaggcggcgacacttcacacaatttaaatatgcgtggtgcttttctacatgttatcggagacttattaggttcagttggcgccattactgcagctaktttaatttgggcatttggatggacaatcgccgatcctatcgcaagtattttagtttccgttattattttaaaaagtgcttggggtatcacaaaatcttcaattaacattttaatggaaggcacaccaagtgatgttgatatagatgaagttataactactattaaaaaggattcacgaatacaaagtgtgcatgattgccatgtttggacaatttcaaatgatatgaatgcattgagttgtcatgttgttgtagaccatacattgacaatgaaagaatgtgaattattattagaaaacattgagcatgatttattacatttaaatattcaccatatgactattcaattagaaacgcctaatcacaaacatgatgaatcgattatatgttcaggaacacatagtcattcacataaccatcatgctcatcatcacgcgcatgtacattaataattttaacctactgccattgcatcgattaaacttttcaatggcagtaggttttttatgtctttatggcgacttgtttggtctttgatgatgcaatgtttattaacaaattttcaactattatttcttacattagtcatatttttgacaatttactattataattctctaactttagtcactttaattaatttttattagatattaatatgaaaataacgtgttttttgttatt

SEQ ID NO: 16 - DNA, 13086 bp; double-stranded, linear
taattatcgcgcataacaaaacattagcaggacaattatatagtgagtttaaagaattttttcctgaaaacagggtggaatactttgtaagttactatgattattatcanccagaggcatacgtaccgtctactgacacttttattgaaanagatgcctcaatcantgatgaaattgatcaactacgacattctgctacaagtgcattatttgaacgcgatgatgtaattattattgctagtgtaagttgtatatatggtttaggtaatcctgaagaatataaagatttagtagtaagtgttcgagttggtatggaaatggatagaagtgaattacttagaaaacttgtcagatgtgcaatatacacgaaatgacatcgatttccaacgaggaacgtttcgagtgcgtggtgatgtagtggaaatattcccagcctctaaagaagaactttgtataagggttgagtttttcggcgatgagattgaccgtatccgagaagttaactacctaacaggtgaagtgttgaaagaaagagaacattttgcgatattcccagcttctcacttcgtaacacgtgaagaaaagttgaaagttgcgattgaacgtattgaaaaagaattggaagaacgattgaaagaattacgagatgagaataaattactagaagcgcaaaggttagaacagcgtaccaactatgatttagaaatgatgcgagagatgggattctgttcaggaattgaaaactattccgtacatttaactttgcgaccactgggttcgacaccatatactttattggattactttggcgatgattggttagtaatgattgatgaatcacatgtgacattaccgcaagttcgaggcatgtataacggagacagagcgcgtaaacaagttttggtggatcatgggtttagattaccgagtgcattagataaccgtccacttaaatttgaagaatttgaagmaaagacaaaacaacttgtgtatgtatctgcaacgcctggaccatacgaaattgaacatacggataagatggttgaacaaattattcgtcctactggtttactggatcctaagattgaggttagacctactgaaaatcaaattgacgatttattaagtgaaattcaaacaagagtgagcgtaatgaacgcgtacttgttacaacgctcactaaaaagatgagtgaagattaaccacatacatgaaagaagcgggtattaaagttaattatctgcattcagaaatcaagacattagaacgaattgaaataattagagacttacgaatgggtacatatgatgttatcgtaggtattaatttattaagagagggtattgatataccagaagtttctctagttgtcatattagatgcagataaagaagggtttttacgttctaaccgctcattaattcaaacaataggtagagctgcgcgtaacgataaaggtgaagtcattatgtatgccgataaaatgactgattcgatgaagtatgcaattgatgagacacaacgtcgtcgagaaatacagatgaaacataatgaaaaacatggtattacacctaaaacaattaataaaaaaatacatgatttaattagtgctactgttgaaaatgacgaaaataatgacaaagcacaaactgtgatacctaagaagatgacgaaaaaagaacgtcaaaagacaatcgacaatatagaaaaagaaatgaaacaagcagcgaaagatttagatttcgagaaagctacagaattaagagatatgttatttgaattaaaagcagaagggtgacaagtaaatgaaagaaccatccatagtagtaaaaggtgctcgtgcgcataacttgaaagatattgatatcgaactacctaaaaataaattaattgttatgacaggtttatctgggtcaggtaaatcgtcattagcattcgatactatatatgctgaaggacaacgacgttatgttgaatcattaagtgcctatgcgcgtcaatttttaggccaaatggacaaaccagatgttgatacaattgaaggattatcgccagcaatttcaatagatcaaaaaacaacaagtaaaaatccaagatcaactgtagcaacagtaacagaaatatatgattatatacgtttgttatatgcacgtgttggtaaaccttactgtccaaatcacaatatagaaattgaatcgcaaacagtacaacaaatggttgaccgcattatggaattagaggcacgtacaaagattcaattattagcacctgtcatcgctcatcgtaaaggtagtcatgaaaagctaatcgaagatattggtaaaaaaggttatgtacgtttaagaatcgatggcgaaattgttgatgtaaatgatgtacctactttagataagaacaagaatcatacaatagaagttgttgtagaccgattagttgttaaagatggaattgaaacacgactagctgactctatagaaactgccttagagctttcagaaggacaattaacagtcgatgtcattgacggggaagaccttaagttttcagaaagccatgcttgtcctatatgtggattttcaatcggagagttagaaccaagaatgtttagctttaacagtccttttggtgcttgtccgacatgtgatggcttaggccaaaagttaacagtcgatgtagacttggttgttcccgacaaagataagacgctaaacgaaggtgcaatagaaccttggataccgacgagttctgatttttatccaacattgttaaaacgtgtttgtgaagtttataaaatcaatatggataaaccttttaaaaagttaacagaacgtcaacgtgatattttattgtatggttctggtgacaaagaaattgaatttacatttacacaacgtcaaggtggtactagaaaacgaacaatggttttcgagggtgtagttcctaatataagtagacgattccatgaatctccttcagaatatacacgtgaaatgatgagtaaatatatgactgaactaccttgcgaaacttgtcatggaaagcgattgagtcgtgaagckttatctgtttatgtaggtggtttaaatattggtgaagtagtcgaatattcaatcagtcaagcgctgaactattataaaaacattgatttgtcagaacaagatcaagcgattgcaaatcaaatattgaaagaaattatttcccgactcacttttttaaataatgtgggacttgaatatttaacgttaaacagagcttcaggtacactttcaggtggtgaagcacaacgtattcgattagcaacgcaaattgggtcgcgtttgactggtgtcttatatgtattagatgagccatcaattggactgcatcaaagagataatgatcgattaattaatacacttaaagaaatgagagatttaggaaatactttaattgtagttgaacacgatgatgatacaatgcgtgcggctgattacttagtggatataggtcctggtgctggtgaacatggagggcagattgtgtctagtggtactcctcaaaaggtaatgaaagataaaaaatcattaacaggacaatacttgagtggtaagaaacgtattgaagtacctgaatatcgcagaccggcttcagatcgtaaaatttctatacgtggagctagaagcaacaatcttaaaggggttgatgtggacataccactatcaatcatgacggttgttacaggtgtatcaggttctggtaaaagctcattagtaaatgaagtattatacaaatcattagctcaaaaaattaataaatctaaagtaaagccaggattgtacgataagattgaaggtattgatcaacttgataaaattattgatattgatcaatcaccaataggtagaacgccacgctctaatccagcaacatatactggtgtgtttgatgatatacgtgatgtgtttgcgcaaacaaatgaagctaaaattcgaggatatcaaaaagggcgttttagttttaatgtaaaaggtggacgctgtgaagcttgtaaaggtgacggtattattaaaattgaaatgcattttttacctgatgtttatgttccttgtgaagtgtgtgatggtaaacgatataatcgtgagacactagaggttacttacaaaggtaaaaatattgctgacattttagaaatgactgttgaagaagcaacacaattttttgaaaatattcctaagattaagcgcaagttacaaacactagttgatgttggtcttggatacgtcacattaggtcaacaagctacaacgttatcaggtggtgaggctcaacgtgtgaaacttgcatctgaacttcataaacgttcaactggtaaatctatttatatcctagatgaaccgacaacagggttacatgttgacgatattagtagattattaaaagtattaaaccgattagttgaaaatggtgatactgttgtaattattgaacataacctagatgttatcaaaacagcagactatattatagacttaggtcctgaaggtggtagtggcggtggtactattgttgcgactggcacacccgaagatattgctcagacaaagtcatcatatacaggaaagtatttaaaagaagtacttgaacgagataaacaaaatactgaagataaataagattaaaagaagtgaaggatgttataaatttatccttcgcttctttttattaatttagtaatgaatagtagaaagaaaagatgcgtaaaaagaattatgttaagatagggtcaatctagagtagttaaacataaatcgaactgggagtgggacagaaatgataaagaatcactaatgatttattatgtagtggttctttgtcattagccacagctattgtgtacttaaaaataggaatgcatgagtgcaactcatgcataagaaatactaatttctaaagaaaaagtatttctttatgttggggccccgccaacttgcattgtttgtagaatttcttttcgaaattctttatgttggggccccgccaacttgcattgtttgtagaatttcttttcgaaattctttatgttggggccccgccaactaattccaatatatcattgtagagcttaggtcattgatttttggctcggacttttatggcgatatgaaccatgtaaattaagcaagcaataaattaatgattgatattgacttgtaaaataataacaataatgaacaattaatatttattttagcttttcaatgtagattggtgttatatttttgatatgataagaagagatgtaagagtagggataaatacaattgaggtgaacccatgttaacgacagaaaaactagttgaaacattaaagttagatttaatcgctggtgaagaaggactatcgaagccaattaaaaatgctgatatatcaagaccgggcttagagatggcaggttatttttcacattatgcgtcagatagaatacaactattaggaacaacggaactatcgttttacaatttattaccagataaggatcgcgcaggtcgtatgcgtaaactatgcagaccagaaacgcctgcaattattgtgacacgtggattgcagccaccagaagaattagttgaagctgcaaaagaattaaataccccacttatagttgctaaagatgcgactacaagtttaatgagtcgcttaacaacgtttttagagcatgcacttgcaaagacgacatctttacatggtgttttagtagatgtttacggtgttggtgtactaattaccggtgattcaggaataggtaaaagtgagactgcgttggaattagttaaacgtgggcatagattagtagcagatgataatgtagaaatacgtcaaattaataaagatgaactaatagggaaaccaccaaagttaatagaacatctattagaaatacgtggactaggtattatcaatgttatgactttatttggcgcgggttcaatattaactgaaaaacgaattagattaaatattaatttggaaaactggaacaagcaaaagttatatgaccgcgtaggtcttaatgaagagacgctaagtattttagatactgaaatcactaaaaaaacaatacctgtaagacctggtagaaatgttgcggtaattattgaggtcgctgcaatgaactatcgattaaatatcatgggcattaacacggccgaagaatttagtgaaagattaaatgaagaaattatcaagaacagtcataagagtgaggagtaggttgaatgggtattgtatttaactatatagatcctgtggcatttaacttaggaccactgagtgtacgatggtatggaattatcattgctgtcggaatattacttggttactttgttgcacaacgtgcactagttaaagcaggattacataaagatactttagtagatattattttttatagtgcactatttggatttatcgcggcacgaatctattttgtgattttccaatggccatattacgcggaaaatccaagtgaaattattaaaatatggcatggtggaatagcaatacatggtggtttaataggtggctttattgctggtgttattgtatgtaaagtgaaaaatttaaacccatttcaaattggtgatatcgttgcgccaagtataattttagcgcaaggaattggacgctggggtaactttatgaatcacgaggcacatggtggatcggtgtcacgcgcttttttagaacaattacatttgcctaattttataatagaaaatatgtatattaacggccaatattatcatccaacattcttatatgaatccatttgggatgtcgctggatttattatcttagttaatattcgtaaacatttaaaattaggagaaacattctttttatatttaacttggtattcaattggtcgattctttatagaaggattacgtacagatagcttaatgctcacaagtaatattagagttgcacaattagtatcaattcttttaattttaataagtataagtttaattgtatatagaaggattaagtataatccaccgttgtatagcaaagttggggcgcttccatggccaacaaaaaaagtgaagtagtgatagtttgaggaaatttttatcaaaaacacatcatcatacaaaccctttatggcgtgtataccgtcttgttaaattttcgaaagtttttaagaatgtaattatcattgaattttcgaaatttattccaagtatggtactgaaaagacatatatataaacaacttttaaatattaatatcggtaatcaatcgtcgatagcttataaagtaatgttagatattttttacccagaactgattacgattggtagtaacagtgttattggttacaatgtaacaattttgacgcatgaagcattagttgatgaatttcgttatggaccagtgacgataggatctaacactttgattggtgcaaatgctaccattttacccggtataacgattggtgacaatgtaaaagttgcagctggtacggttgtttcaaaagatataccggataatggatttgcatatggcaaccctatgtatataaaaatgattaggaggtgacaattttatggcgcaaaagaataataatgtaattccaatgacttttgatgatgcattttatcgtaaaatggctaaacagaagtttaaacaaagagaatataaacgagctgctgaatactttgaaaaagtgttagaattgtcacctgatgatctggaaattcaaattgattatgcacaatgtctagtgcaacttggtattgctaaaaaagcagaacatttattttatgacaatattatttataataggcatctagaagatagcttttatgaattgagtcagctcaacattgaagttaacgaaccaaacaaggcattcttgtttggtattaattatgttattgttagcgacgaccaagattatagagatgaattagatcaaatgtttgatgtgaaatatcaaagtgaagaacaaattgaacttgaagctcaattgtttgtagttcaaatactattccaatatcttttttctcaaggtcgattaaaagatgcaaagaattatgtcttacatcaaccacaagaagttcaagatcatcgtgtagtacgtaatttattggcaatgtgttatttatatctcggtgaatatgatacggctaaagcattgtacgaagcactattacaagaggatagtacagatatatatgcattatgccattatactttgctactttataacactaaggaaaatgaacaatatcaaaaatatttaaaaatattaaacaaagttgtacctatgaatgacgatgaaagttttaaattaggtattgtattaagttatttaaagcagtatcgtgcatcacaacaattgttgtaccctttatataaaaaagggaaatttttatcaattcaaatgtacaatgctttagcatataattattattatttaggtgaagaagacgaaagtcattactactgggataaattgaagcaaatttctaaagtggaaattggacatgcgccttgggtaattgaaaatagcaaagaagtttttgaccaacatattttgccattacttcaaagtgatgacagtcattatcgtttatatggtatttttttattggatcaattaaatggtaaagaaattgtgatgacggaaagtatttggcaggttttggaaaatctaaataattatgagaaattgtatttaacgtatttagttcaaggtttaacgctcaataaattagacttcattcatcgcggcttattaacgctttaccataatgaattatttgtaagtgaaaatgatgtaatggttgcatggattaatcaaggtgaactcataattgctgaaaaagtagatttaactgatgttgagccatatatcggtgcgtttatttatttgtattttaaaaatcaacctcgaaacgttacaaagaagcaaattacaacatggttaggcataacacaatataaactgaacaaaatgattgaatttctcttgagcatatagatttatgaaaagttagatttattatataatgcgcataatgattaataatgaggaggcgttaataaaatgactgaaatagattttgatatagcaattatcggtgcaggtccagctggtatgactgctgcagtatacgcatcacgtgctaatttaaaaacagttatgattgaaagaggtattccaggcggtcaaatggctaatacagaagaagtagagaacttccctggtttcgaaatgattacaggtccagatttatctacaaaaatgtttgaacacgctaaaaagtttggtgcagtttatcaatatggagatattaaatctgtagaagataaaggcgaatataaagtgattaactttggtaataaagaattaacagcgaaagcggttattattgctacaggtgcagaatacaagaaaattggtgttccgggtgaacaagaacttggtggacgcggtgtaagttattgtgcagtatgtgatggtgcattctttaaaaataaacgcctattcgttatcggtggtggtgattcagcagtagaagagggaacattcttaactaaatttgctgacaaagtaacaatcgttcaccgtcgtgatgagttacgtgcacagcgtattttacaagatagagcattcaaaaatgataaaatcgactttatttggagtcatactttgaaatcaattaatgaaaaagacggcaaagtgggttctgtgacattaacgtctacaaaagatggttcagaagaaacacacgaggctgatggtgtattcatctatattggtatgaaaccattaacagcgccatttaaagacttaggtattacaaatgatgttggttatattgtaacaaaagatgatatgacaacatcagtaccaggtatttttgcagcaggagatgttcgcgacaaaggtttacgccaaattgtcactgctactggcgatggtagtattgcagcgcaaagtgcagcggaatatattgaacatttaaacgatcaagcttaattcgaagtcgaattaagatgttgagctgtaaattatttggatatttattttaatagtgtcatcacagcgttaaaataatgtcttacttttaaattaaagcaaattatatagaaaactagaacttagtacgtatcatttgtgcgtttcaatgagttctagtttttttatatgttatattaaacttataactttatgggagtgggacagaaatgataaagagccactaatgatttattatgtagtggttcttaaacattagccacagctaatgtgtacttaaaaataggaatacatgagtaaaactcatgcataagaaatactaatttctatagaaaaagtattactttatcgttgtcccaccccaacttgcacattattgtaagctgactttccgccagcttctgtgttggggccccgccaacttgcacattattgtaagctgacttttcgtcagcttctgtgttggggccccgccaacttgcacattattgtaagctgacttttcgtcagcttctgtgttggggccccgccaacttgcattgtctgtagaaattgggaatccaatttctctatgttggggcccacaccccaactcgcattgcctgtagaatttcttttcgaaattctctgtgttggggcccacaccccaactcgcattgcctgtagaatttcttttcgaaattctctgtgttggggcccacaccccaactcgcattgcctgtagaatttcttttcgaaattctctgtgttggggcccctgactagagttgaaaaaagcttgttgcaagcgcattttcattcagtcaactactagcaatataatattatagaccctaggacattgatttatgtcccaagctccttttaaatgatgtatatttttagaaatttaatctagacatagttggaaataaatataaaacatcgttgcttaattttgtcatagaacatttaaattaacatcatgaaattcgttttggcggtgaaaaaataatggataataatgaaaaagaaaaaagtaaaagtgaactattagttgtaacaggtttatctggcgcaggtaaatctttggttattcaatgtttagaagacatgggatatttttgtgtagataatctaccaccagtgttattgcctaaatttgtagagttgatggaacaaggaaatccatccttaagaaaagtggcaattgcaattgatttaagaggtaaggaactatttaattcattagttgcagtagtggataaagtcaaaagtgaaagtgacgtcatcattgatgttatgtttttagaagcaagtactgaaaaattaatttcaagatataaggaaacgcgtcgtgcacatcctttgatggaacaaggtaaaagatcgttaatcaatgcaattaatgatgagcgagagcatttgtctcaaattagaagtatagctaattttgttatagatactacaaagttatcacctaaagaattaaaagaacgcattcgtcgatactatgaagatgaagagtttgaaacttttacaattaatgtcacaagtttcggttttaaacatgggattcagatggatgcagatttagtatttgatgtacgatttttaccaaatccatattatgtagtagatttaagacctttaacaggattagataaagacgtttataattatgttatgaaatggaaagagacggagattttctttgaaaaattaactgatttgttagattttatgatacccgggtataaaaaagaagggaaatctcaattagtaattgccatcggttgtacgggtggacaacatcgatctgtagcattagcagaacgactaggtaattatctaaatgaagtatttgaatataatgtttatgtgcatcatagggacgcacatattgaaagtggcgagaaaaaatgagacaaataaaagttgtacttatcggtggtggcactggcttatcagttatggctaggggattaagagaattcccaattgatattacggcgattgtaacagttgctgataatggtgggagtacagggaaaatcagagatgaaatggatataccagcaccaggagacatcagaaatgtgattgcagctttaagtgattctgagtcagttttaagccaactttttcagtatcgctttgaagaaaatcaaattagcggtcactcattaggtaatttattaatcgcaggtatgactaatattacgaatgatttcggacatgccattaaagcattaagtaaaattttaaatattaaaggtagagtcattccatctacaaatacaagtgtgcaattaaatgctgttatggaagatggagaaattgtttttggagaaacaaatattcctaaaaaacataaaaaaattgatcgtgtgtttttagaacctaacgatgtgcaaccaatggaagaagcaatcgatgctttaagggaagcagatttaatcgttcttggaccagggtcattatatacgagcgttatttctaacttatgtgtgaatggtatttcagatgcgttaattcattctgatgcgcctaagctatatgtttctaatgtgatgacgcaacctggggaaacagatggttatagcgtgaaagatyatatcgatgcgattcatagacaagctggacaaccgtttattgattatgtcatttgtagtacacaaactttcaatgctcaagttttgaaaaaatatgaagaaaaacattctaaaccagttgaagttaataaggctgaacttgaaaaagaaagcataaatgtaaaaacatcttcaaatttagttgaaatttctgaaaatcatttagtaagacataatactaaagtgttatcgacaatgatttatgacatagctttagaattaattagtactattcctttcgtaccaagtgataaacgtnaataatatagaacgtaatcatattatgatatgataatagagctgtgaaaaaaatgaanatagacagtggttctaaggtgaatcatgttttaaataagaaaggaatgactgtacgatgagctttgcatcagaaatgaaaaatgaattaactagaatagacgt

SEQ ID NO: 17 - DNA, 1350 bp; double-stranded, linear
cattagtcatgaaaatagccgacaacttcatctgtgaaatcaccggccttttattttagctaactttatttctgattttacgattttaattgatcatacagagaaagtgatctttttacaatttctaaaaactcatgatctatattggacatttgatgaaaataagacaaaatgttttctgttagcttctcttgttttgggaatgaatcatcttctttaatccaaatcgctaattcgcctaatggtgttttatcatctttaaatgtttgtatatattcgtaaaagctcatagtattccttctctcaatttacttatataaatcctaccacgaaagctttcaagaaaacacaattaaatgtctatttagtgaactttttaaggttgtgcactcttttaatgtctgccaattaggtcaattaatcatcacaatgtacaattaactctattttcagttcatatactcacacaccgtttttgaacaacacattaacttctcatttagataaaacgcaaaaaagcctggcaccaatacaatagatgccagactaagagtctactatataaatttatttagcgtatggttttacttcgattgcaccttcattttcatcatgaacaccatgcttataataatcaatatattgtggctctaaaggctttctgccacgtataatgtctgctgctttttcagctaacattaaaacaggtgcgtgtatattgccatttgtcgtacgtggcatagctgatgcatcaactacacgtaaattttccataccgtggactttcattgttaacgggtcaactactgccattggatctgaagcaggacccattttagcactacaagatgggtgtaatgctgtttcaccatctctacgaacccaatcaagaatttcttcgtctgtttgcacttctggtcctggtgaaatttctccaccattgaatggatccattgctttttgagataagatatttcttgctacacgaattgcttctacccattcttttttatcttcttctgttgataaataattaaagcggatacttggtttttcgaatggatctttagatttgattttcaagctaccacgagagtttgaatacattggtcctacgtgaacttgataaccatgtgcgaccgctgccttttgaccatcatatcttacagctattggtaagaaatggaacattaagttaggataatcaacttcgttatttgaacgtacaaatccgccaccttcaaaatggttagatgctgctgcacctgtacgtgtgaaaatccattgtaaaccaataaatggcatgcgcttgatatctaagcttggctgtaatgatacaggttccttaca

SEQ ID NO: 18 - DNA, 1376 bp; double-stranded, linear
taatgctattggcaacaccatatatgaaanctccaaacgatcctaaaccgactatagattcaccaaatttnacaatccatgaataaagtagtggccataagaataacaatatgacaactaaaaatgtacagtaaaatgcagtcataattggaactagacgtttaccactaaaaaatgataatgctaatggtaattctgtttcactaaacttattgtatgcataagctgctattaaacctattacaataccaacaaagacattgccattattcatcttttcaaaagctgaatttatttccgargctttcattcctaataaaggcgctaatttcattggtgataatacaactgtaactaaaaaatatcctaacgtrgctgcargcgsgactgcaccatcatttttctttgccattcctatagctacaccaattgcaaataaaatacctaattgctctaaaatcgtagtacctaccgtagtaaagaacattgcgattttcggcgtcgcatgaagtgcatttaacgtattaccaattccggcaataattgctgcagccggtaaaatggcaactggtaacattaacgaacgccctaaattttggaaaaatttatacattgaatgtcatccttcttaaaataatgtagaaatataaagattactaatgtaactagaataactacttcgatactccgttatagtcacctaggcttactaaccagctatatttctacctcaagttattttataaactttttacaatttcatgcaattcttgttgtaactttgctgttcgtgtttcaatctcttttgtaatataatcgatacgctcgtttcgttttaaatctttaggtaaatcgttaatatcgattggktgccaatatttatgtatgcttgtcctgttaaaagaccgtgaatcttagtaggaccaacataagcaacaggtaatattggtgacttacttaacattgcaattgttgaagcaccacgtttcaaaggtgcaccttcttgcgatgtgcgagaacctgttgggaagataccaactgtcttattatctttcaacaaattgattgggcgttttaaagtactaggtcctggattttcacgatctacaggaaatgcatttaaagacgttaaaaatttaccaatccatttatttttgaataattcttttttagccatataatgaatttgattaggatataatgccatacctagcataatgacttcgttataactttcatgcgtacaagttacgacatatttactatccttaggaatattatctttaccgattacgtataatgattttgacattttaactaaaatgaaattcaaaatcttactaatcactgaatacattgtgccacctacttaactt

SEQ ID NO: 19 - DNA, 7363 bp; double-stranded, linear
ttgtcataccaatattttgtaaaatatggaacacaagtaaagtgacgaaaccaacgataaagattttgttaaattgatcttcaattttcgcagctaatcttattagatggaagattaaaaataaaaatattaagatcaatatgacagaaccgataaagccaagttcctctccaatcactgaaaagataaagtcagtatgattttcaggtatataaacttcaccgtgattgtatcctttacctagtaactgtccagaaccgatagctttaagtgattcagttaaatgatagccatcaccactactatatgtataggggtcaagccatgaattgattcgtcccatttgatacagttggacacctaataaattttcaattaatgcgggtgcatatagaatacctaaaatgactgtcattgcaccaacaatacctgtaataaagataggtgctaagatacgccatgttataccacttactaacatcacacctgcaataatagcagctaatactaatgtagttcctaggtcattttgcagtaatattaaaatacttggtactaacgagacaccaataattttgaaaaataataacaaatcactttggaatgatttattgaatgtgaattgattatgtctagaaacgacacgcgctaatgctaaaattaaaataattttcatgaattcagatggctgaatactgatagggccaaacgtgtaccaacttttggcaccattgataataggtgtaataggtgactcaggaataacgagcaagcctattaataatagacagattaagaaatacaataaatatgtataatgtttaatctttttaggtgaaataaacatgatgatacctgcaaaaattgcacctaaaatgtaataaaaaatttgtctgataccgaaattagcactgtattgaccaccgcccattgccgagttaataagcagaacactgaaaattgctaaaacagctatagtggctactaatacccagtctactttgcgaancaatgcttatccggctgttgacgagatgaataattcattgcaaactccttttatactcactaatgtttatatcaattttacatgactttttaaaaattagctagaatatcacagtgatatcagctatagatttcaatttgaattaggaataaaatagaagggaatattgttctgattataaatgaatcaacatagatacagacacataagtcctcgtttttaaaatgcaaaatagcattaaaatgtgatactattaagattcaaagatgcgaataaatcaattaacaataggacyaaatcaatattaatttatattaaggtagcaaaccctgatatatcattggaggaaaacgaaatgacaaaagaaaatatttgtatcgtttttggagggaaaagtgcagaacacgaagtatcgattctgacagcacaaaatgtattaaatgcaatagataaagacaaatatcatgttgatatcatttatattaccaatgatggtgattggagaaagcaaaataatattacagctgaaattaaatctactgatgagcttcatttagaaaatggagaggcgcttgagatttcacagctattgaaagaaagtagttcaggacaaccatacgatgcagtattcccattattacatggtcctaatggtgaagatggcacgattcaagggctttttgaagttttggatgtaccatatgtaggaaatggtgtattgtcagctgcaagttctatggacaaacttgtaatgaaacaattatttgaacatcgagggttaccacagttaccttatattagtttcttacgttctgaatatgaaaaatatgaacataacattttaaaattagtaaatgataaattaaattacccagtctttgttaaacctgctaacttagggtcaagtgtaggtatcagtaaatgtaataatgaagcggaacttaaagaaggtattaaagaagcattccaatttgaccgtaagcttgttatagaacaaggcgttaacgcacgtgaaattgaagtagcagttttaggaaatgactatcctgaagcgacatggccaggtgaagtcgtaaaagatgtcgcgttttacgattacaaatcaaaatataaagatggtaaggttcaattacaaattccagctgacttagacgaagatgttcaattaacgcttagaaatatggcattagaggcattcaaagcgacagattgttctggtttagtccgtgctgatttctttgtaacagaagacaaccaaatatatattaatgaaacaaatgcaatgcctggatttacggctttcagtatgtatccaaagttatgggaaaatatgggcttatcttatccagaattgattacaaaacttatcgagcttgctaaagaacgtcaccaggataaacagaaaaataaatacaaaattgactaactgaggttgttattatgattaatgttacattaaagcaaattcaatcatggattccttgtgaaattgaagatcaatttttaaatcaagagataaatggagtcacaattgattcacgagcaatttctaaaaatatgttatttataccatttaaaggtgaaaatgttgacggtcatcgctttgtctctaaagcattacaagatggtgctggggctgctttttatcaaagagggacacctatagatgaaaatgtaagcgggcctattatatgggttgaagacacattaacggcattacaacaattggcacaagcttacttgagacatgtaaaccctaaagtaattgccgtcacagggtctaatggtaaaacaacgactaaagatatgattgaaagtgtattgcataccgaatttaaagttaagaaaacgcaaggtaattacaataatgaaattggtttacctttaactattttggaattagataatgatactgaaatatcaatattggagatggggatgtcaggtttccatgaaattgaatttctgtcaaacctcgctcaaccagatattgcagttataactaatattggtgagtcacatatgcaagatttaggttcgcgcgaggggattgctaaagctaaatctgaaattacaataggtctaaaagataatggtacgtttatatatgatggcgatgaaccattattgaaaccacatgttaaagaagttgaaaatgcaaaatgtattagtattggtgttgctactgataatgcattagtttgttctgttgatgatagagatactacaggtatttcatttacgattaataataaagaacattacgatctgccaatattaggaaagcataatatgaaaaatgcgacgattgccattgcggttggtcatgaattaggtttgacatataacacaatctatcaaaatttaaaaaatgtcagcttaactggtatgcgtatggaacaacatacattagaaaatgatattactgtgataaatgatgcctataatgcaagtcctacaagtatgagagcagctattgatacactgagtactttgacagggcgtcgcattctaattttaggagatgttttagaattaggtgaaaatagcaaagaaatgcatatcggtgtaggtaattatttagaagaaaagcatatagatgtgttgtatacgtttggtaatgaagcgaagtatatttatgattcgggccagcaacatgtcgaaaaagcacaacacttcaattctaaagacgatatgatagaagttttaataaacgatttaaaagcgcatgaccgtgtattagttaaaggatcacgtggtatgaaattagaagaagtggtaaatgctttaatttcatagagattagtcgagggaccttttacttataaaaatgatttgaattaatactaaaagattacaaagaagaggtggttttgtgtgtaaatacaaaattgcctttttctttttatgttaaatctataaatttgaaactaaatcaaggttaattctatgtacacactttatataggaagtagtttgaatgtttatataatgttttacaaaaagatgtagtattataatgtctaatttcacatgtgtttcagtaaaatttgttgtggaatgttaacgatatacgtattttataaaaaattttttataatgattattcgaatgatgcgtaacgcttacatcttatctaatgctagctttttgacaaaaatatgacaatcaattaatgtgattctaataaatattcgcaaattgctttattgcgattaaatttttttggtggtactatatagaagttgatgaaatattaatgaacttatatgcaaaagtatattgagaaataaacaggtaaaaaggagaattattttgcaaaattttaaagaactagggatttcggataatacggttcagtcacttgaatcaatgggatttaaagagccgacacctatccaaaaagacagtatcccttatgcgttacaaggaattgatatccttgggcaagctcaaaccggtacaggtaaaacaggagcattcggtattcctttaattgagaaagtagtagggaaacaaggggttcaatcgttgattttagcacctacaagagaattggcaatgcaggtagctgaacaattaagagaatttagccgtggacaaggtgtccaagttgttactgtattcggtggtatgcctatcgaacgccaaattaaagccttgaaaaaaggcccacaaatcgtagtcggaacacctgggcgtgttatcgaccatttaaatcgtcgcacattaaaaacggacggaattcatactttgattttagatgaagctgatgaaatgatgaatatgggattcatcgatgatatgagatttattatggataaaattccagcagtacaacgtcaaacaatgttgttctcagctacaatgcctaaagcaatccaagctttagtacaacaatttatgaaatcaccaaaaatcattaagacaatgaataatgaaatgtctgatccacaaatcgaagaattctatacaattgttaaagaattagagaaatttgatacatttacaaatttcctagatgttcatcaacctgaattagcaatcgtattcggacgtacaaaacgtcgtgttgatgaattaacaagtgctttgatttctaaaggatataaagctgaaggtttacatggtgatattacacaagcgaaacgtttagaagtattanagaaatttaaaaatgaccaaattaatattttagtcgctactgatgtagcagcaagaggactagatatttctggtgtgagtcatgtttataactttgatatacctcaagatactgaaagctatacacaccgtattggtcgtacgggtcgtgctggtaaagaaggtatcgctgtaacgtttgttaatccaatcgaaatggattatatcagacaaattgaagatgcaaacggtagaaaaatgagtgcaytcgtccaccacatcgtaaagaagtacttcaagcacgtgaagatgacatcaaagaaaaagttgaaaactggatgtctaaagagtcagaatcacgcttgaaacgcatttctacagagttgttaaatgaatataacgatgttgatttagttgctgcacttttacaagagttagtagaagcaaacgatgaagttgaagttcaattaacttttgaaaaaccattatctcgcaaaggccgtaacggtaaaccaagtggttctcgtaacagaaatagtaagcgtggtaatcctaaatttgacagtaagagtaaacgttcaaaaggatactcaagtaagaagaaaagtacaaaaaaattcgaccgtaaagagaagagcagcggtggaagcagacctatgaaaggtcgcacatttgctgaccatcaaaaataatttatagattaagagcttaaagatgtaatgtcttgagctcttttttgttttcaataattgattctctgtagatatcaaagtactaacgttttaaaggttaaatatttaattggattgagatctgtatgcggttatatcattctgtgtaaatatggttctccaccaaatgtggtgagtatataatttaaagaactatttttaaattaagaataatcgaacataaataaactttatgaaatttcagtatcatgttcttataaaaaacaatagggctttttgctgacgctagtgcgcgataaataataagttgaatataaaaaagatcactgccaatcattcgtttaatggcagcgatcttttttatttaattatttctctttccactgcaacatttgataaccaatgcgtggatgtgttttaataatatcttttgcgtcctcatgacattgtgaaagtttttgtcttaatgatgtcatatgcactcttaaactaggcatttcagtcttattaacatagccatatattcgttttaatatcatctcataagtgagtacttttcctttatgatttgacaatagttctaacaagctaaattcatttggcgtcaaatgtacctcctgattattaataacaacagatttggagccaaagtcgatgcttagcaaaccgttagtaaatacaatgttagtttcttgatgtgacttagcgattctctcgatgactcgtattcgtgcccgaagctcatcaacattaaaaggtttagtcatatagtcattcgcaccgttatctaaagcttgaataattgtttgttcttcttgtcttgcacttattacaatgataggaatgtcagtatgttgcctgatttctgaaatcaaacataatccatctttatctggtaaacctaaatctaataaaatgacatctggtttatcaatttgaattttaaagtgtgcttgtgtggcattgtcggctgtagttacattgtaataatctaaagttaatgcaacatcaagtaaatgtgtgattgcgtgatcatcttcaattatcaatattttagattgcattatacgtctccttcgttaaagtctgtatatatattgaaatagaatatactgccgtgtggttggttcggtttatattgtaagtttgattgatgtttgtgtaggatagtctgtactaaatataagcctagtcccatgctttctttttggttatctttaaaatatttatttgatcctgtgtaaaaaggctcgaatatcttttgttgttcttctaaactaattccaggtccttcgtctataacggcaaattcgatttgttcatagctagcataacgaatagataaattgattttggtgtcagtagaagtgtgtttaactgcattttcaatcaaattgaataaagcttgtaaaatcaacttactgtcaatgtgtataaactgtaaatttactgaggatgatacagttatacgcttttttaaatggcgacgttctaaaatacatatcgatttcttatacta

SEQ ID NO: 20 - DNA, 10470 bp; double-stranded, linear
ttaacaatcgataaccacaatacttctattgtaattgtttaacgatttcncgattaaaatcatctaaatcgtctggtactcgacttgttacaatattgttgtctacactactgactcatcaactacatgtgcgcctgcatttgataaatctttgcgtacatttaatactgctgttaacgtacgaccttttaaatcgtctgtatctattagtatttgtggcccatgacaaatggcaaatgttggtacatcatttttagtaaagtatttagcaaatgtgccatatcgaccttctgtatctccacgtaaatgatctggtgaaaatcctccaggaattaataatgcatcataatcttctggtttagcttctgcaatgcctacatcgacagtaactttttcaccgtgtttaccaacaacttcactatttgcagtatctccaatcactacagtattaaagcctgcattctctaatgcctctttagggcttgaatattctatatcttcaaattcgtttgctagaataattgctacttttttagtcattgaaaatcacctttctatatatcattgatataattactatagacaagtaaatcagtgattaaacatacaagatataaaaaatattaagcgactgtcgcgatatctaaccctaacacatcttatgtggcatttacttagatactaatttaaccttttcttcaagctgatctaacaatccaatccattcatctatatcttcaacacgtacttcatcaggatttacatgatcgatatcctcaataaacttatttaaacgcgcttttatctgttcgattgtttgctgttcattcataaaaagttaactccttttattttgttttctttttcattattatcctaacagaaattgcgttaaagcgatataatcttagctatatttatgacattcaaattattttgacttttaaaaatccccttttcaattaactaaaattaagagataatttgttacgagtgataatacgaagkggtatcataccgatatgaaccaaatagaaagaaggaagtttaagacgatgaatagcgtcaaattgaagcaacctgttagcatttacaatgatccatgggaagtgaaatttatatacatttaaatttcatgagacaataaacgttgatttaatgcgtttttttgccttttttattttccttattttttctgttttacaacaaaatggtatcaaaaatggtatcatttgtagttattttagcttcacatattaaaacaaccacactcctaaattaataggtggtgtggttttgttggttgtgtggggataaaaataaccgcatcagttaagatgcggttatctagcaagggccacgtatttataaatacgtttagaatctcttcggcaactttgctatagacagtctatgctgttactaaattataccaccacacaaacctactcccattcaggaacacagagctttgtcgctcgtcagcaacgtcatatgaattctcagttcatgttgtggtgacactttaaacggtctgtgccagtagcgaccgagtcatttcaagaatgaccatttcacatttatattataacacttgtcgtgcgtaactgtatagtttttcagttgtatttaaagttaagttatctacttcgcgctttccttgccttaattgtgaaattacatattgcgctacgccagtttgtttgtgaatttggtaacctgttatatcacttttgatcaattcaattatttttaatttataatcactcatattatctacgtccattctttttatctaaacaataaaaatgtgtctttctcccgataaataataacaatggtaggcttaataaaaacaatattaaatacatttgttctgtcataattgaaaacctccaaataatattatattatataagtgtaaggaggagccatcaggctccaagcataatgttaatctttgttgtttggctttcggtctaggtagccgagatgccattctctaagttgttttaacacttctggaattatcagtactgccaatacttgatgttctagaagtgtttttattatgtctagcatgaggcttttcacctccttacacataatttgtaagtcatcaactaacctacaaatataattatactaaacaaatgtttattagtaaagtgttttttaaaatttgcataaaaaaataggcaagtaccgtagtacctgcctgttatctacatttaaatcttgagagaaatgttaaaaagttctagtaaaataatagcacattttatctttaaatgtaaatagaaagcaggtatgtaacgcacctgcttaaatagacatgactatgtcattctaactgatttctccccataagtcacctaatatctgattaggtggggcagaaccattccatgttctaataggcaagtaataacgttgcccctcccatgtatatcctacccaaacatgaccatcttgtaacatcacttctgtataatcacaatacccaccaggttggaactgataacccactggacaagataagaatggccccacttttcttactgtgattggttgattgccgtttgtgaatctagcactttcttccatgtagtaagtaccatatttattacgtttccatgcacttgcaactggtttaactgtattacttgaagcgcttgactcattagagacagtggcaaccggtattttaccatccatgtacgccctaatctgcttgataaagtagtctttaagttgcaaccgcttgtcttctggcaatagaccgcgagttactgggtcaaaaccagtgtgtaaaaccgaacttctatgagggcatgatgttgaagtaaattcattgtgcaatctgattgtatttctgtttgctggtaatccccattttttcaacaatctagcgcattcttggaaagttgcctgttcattttttaagaatgtcgcgttatctgcgcccattgattgacatacttcaataccgtaataatatttattacctatttgattagcggtatgccaacctacttgtgattcatctaaggcttgccaaactgtgttgcctgatacgtaactatgcgcaatgcccgcttctaatcttgataaaggtgcatttactaatccgttacgatatgcttcagcagtcgcccctttgctccctgcgtcgttgtgtataactatacctttagggttactaccacgcttaggtaggtcataacctttaaccacatctttgatgattttaagttctactgctttaggttgtggcttagctgtttcttttttaggtgcttgtgtaggagattgaactgatcgtggcgctgtctcacttttaaaattcggacggataaaccacatagggaaatcataagcatgttgtcgtcttgtaactttttcccaaccccagccgggttgttcgattccgtcagtccagccaccgcctagccaattctgctcatatacaatgatgtaatctaaagttgcttcaattacccatgcaacgtgaccatatccagcaccgtagttgctaccgaataccaccatgtcgccaggttgtgctaagaagtccggtgtattttggtatacagtagctaatccgtcgaagttgttagcgaacggaatatcttttgcacctaaaccttttagaagtaatccaaacaaaactttccaaccagcattggcataatcaaagcattgaaatccataccataagtccacattgaattgttttccctcagaagttttcaaccactctataaactcatttttagttaattttgcttgcattgtcgccacctccatgatgatactcattcacatcaaagccaacatcgttagaggcgtctgtgaaaggttgtgatgtatcatattcttttggtgctttcgcgcttaattccggcgttaaactactgtcttgtgatgatttccacgtaacttgttgttcttcttttttgctatctctaggcgcttgatatgtctgtgctatagatgaatctgagacgccttttgacgttgggtcagtaataacgccaatacctgtaagtaacgtgaggatagcgcctataattgcgctagcttgatttaattgagtagataaatctaatccgaataaatccgtgacttgcttgataaatagcaacaatgctccaactaaaccagttagtactgctttgtttttgaatctcaatttccagttaatatccatttgtttgctccttttatccaaaataaaaaaacgactaaaaattagtcgtttaaaattattcaatggtcaatgtcggagatcctgaataaacatcacttatagtgacgtacaacatccctgaaggattactaaagttgatatttttacttgcaactccgctattgactcctgatattcctaaatcacttgaccctaaattagtttgcgaaatcctcattataccgctacgtacattttctattgtcacctgataacttttattgggttcaactccatttattgtccattttgctgttgattcttctatgctatccggatatttatttttaggtaagggttttattacaaaagatgaaggctttttccatacttggatatttccagcatatacttttgtatattcttcaccttcgtaaataaacttctttacatttttaaaattaccttccataaaaatcaccctttaattaaatataacgtattcgggtctttttgatatatatagttatattcattttctgttcctgtccaaattttaaccgtcggttgagatgcgctttttagttgatataaattatccgcttgttgtttagtaaaagcttgagatgacaaaacataccgctcgtcatgattatgattttttggagcatataaatcatttagtgtttgtttgaattcctcaaaatcttctgtattaacttttgagccaatctgttgcaatacactttctgaaatagagttgttttgtattgcttctgctaattctcttaatgtgttcatagattcaggcgcgctatcaactagttcagcaatttttgtatccgtatacgttttagagtcgttgagagttgtatctttgattttttcaacttcttgcaatttattttctaacccttcaacatttgcgatattgattttgtccaataactcaggttctgctttgatatctgtatctttaccatcaatttgccacattttagtgtcaggattgattgatactacagtaccgtttttaccgggtgcgccttgttctccttttttacctgcttcaccttttgctccaggttgtcccggttcacctttatcacctttcgcacctttaaatctactttcattcttttcgatgtaagaaatgacatctttatctattttctctttaaagtctttgctcaataaatctgtcgcgttatcttttaaaattctcgtaatagcatcatctaccaatttaacatcgatttcttttgctacagcagattcaataccactatcaacgatattgaaagaaaagtttgcgacatgtattttttcttcttctttctctaaaaacagcttacagcgaacataaccagcgtgtttgataacctttttaggtatcttgtaggtaaggaaaccttttacaacatcgtcgataataaggggctcatttttgaatatagagccatcttccataaacaaatgtaatctaggtgttaagccatgtgcttttagatcgatacgaccttgtttgtcattgatacctattcttatagatgctgtattttcatcttcagtgtaaaatcgacagccaatgtcacctaagtcaacaccatcattttttattctcgtttcaacatcttttattttgtacatttacacacctctttatttatatttatcccttgtgaagtagataccttttaagccgatttgtttatataacttagcgattgtacttgcttgatgttggcaccactctatagcagtagcgtattggtgggtagctggattcttaggattccatctaattcggtacaatgtgttttgacctttattgatgtaatcctttcttacgaagctagcaccgcccatgattgcttttgctggagatgtccaacctttattccttgcaaacgtcattgcgtagttaggattgttgtcgtaagcgccaatgccgaagtagttgtatactccatcttttccgttagcgaagttacttgttccatatccactttctaagaaagcatgcgcgattaaataaatttcattaatgttgtgctttttacaagcttctgcgaacgctttaccttgattattcaatgttcccttacctttaagtatcttattaagtgcgctaactgaaacaccttgatacttgcctaaattaagcatttggtagcattgtgtgttactttcccatatacgctttacattcattgctgaactcgtttgtgctcgtgtagcgttasccaaccccaagcattagattttttcgggttacctcttgccatttgtttatccagtgcttgtttgaatgtataaggactcgtttctgttatgatctgcggttgtttagatgccgaaccattgttggctgttggtgacgagtctcttacattagctatatcagcgtttttattatctaccataacttttattctagattttgttactgttggcttagttatagaatttaataatttttctctgtttttaaatatattaagtaatgccttttctaatgcttcgtatttatctttaggaggaacaccgttgtcaatcatattccaattaacatgttccaacattgaacgccaaatgctgtcgtctacttttaaattttcaatacttagaggtatctcatatttggccatcatatctacagctacaaccattgcgtgaatctcattaaaaataaattcatttttactcgcactataatcttcacatacgtctataactatataatcaggttcattaggaacttcaaatacagctcttctaggtgcccaaatattatgtctatcaacataaaagtggggatattctacatcctgtttgtatttcttcctactgttatataaactttctaccgagctcatcgtttgtgcgtttctaatcattattcctttaggtttttcgagtcgtcgattaccttctactataaagtgataaatatattctggataattaacctcttggctagaaatagtgtactttatagttgttacatctttccaaattggaacttttttattatttttttcgttatcatcactatcatcttctggtttaggtgccggtgtagttttgtctggatgatatggtggtctaacaaaatatttaacccctccacctggtccatcatgataagagtgtttaattttataaggtggacttcctgttgcgttatttgtataccagttttgatctacgccataccaatagtcttttgtgcatggtcccactacaatgtttacatgtcctgcccaaccaccagtccaaacaccccagtcgcctggttgtggtacaaaatcttttgtatttctaattatcttgaaatctctacctctataattggatttttgagccatagcatcagcatttccccatgttctaaacccccaatatttatcgagtaaataattaggtaaatcccagcattgtgctcccattccagaaccaggtacatcaatagctattttgtttttagcgatatataacgcccattcaaccacttcactagctgtgggctttctatttttcggattaggtaatcccatgtatgcacctcatttcaatcaaaataaaaagccagtgccgaagcactgactcttaactgttatttacatttaccaaaccagaagcacgcccagaagctatatcctaaaatccctttaagcatggtaatcacctcctttaaataccaaaaacagttcttagtaaagctatgacaatcgtactgaagatagtccctatcaaacctagaatccacatttttatgtctctaatattcttggcattcttttctttattcttttcatcttctaccttgtcgcgctttaattcttcaaaatttctatctaatttgtcataaatcttttcttgcgctctaagactatcttctattctgtcgaatttttcaaacatagtcttatcattttcttctaatcgcgttaaacgccaatcttgttcatgtcgtttggtaaatccaaacattatgccacccactttattcaaattaaaaagccacaagcattacacctgtgacttttcatcttttgtttctggatatttttctccagtgattaaagcgtattcttctttatcgattaaacccttgtctacgtaccacttaatttgctcgtttttatagtaaccccaaacataaaaagttttaatgtctttaaaagttggataaatcatcttcattatttaaacgtccccctcagtacttgttttgttagttttcagttcagtcaactgttgtgttaacatagcgttttgttgagctaattccattgttaatacgtttacttgtgccacctgcatttgcatactcgcaaccattccgcgaagttcctcatcacttaaatctgacgcactttgttggtttgatgcattcggtacgtcttctttttcgaaattgctattgtatttaatttcgccgttagtgaaaacaaactttctaggttcgaactcttctttaaatttaataggcacattgttatcatctacatctaaactattgcgtaaaccgccagtattaacgaatccgataacttcgtttttatcgtttactgtgattttcattatttccaccccataattttagttatagtaactttgttggcattcgctccagaacctgatgttttacctaaatcaaagtacacatcgttatctattcttaaagtagtgctacttgttttggatagtaagcactcataaataccgccaccgttgccgtctgagtcaactacattcgctttactcaattgaatcgcgttaggtaatgcggttagtccgaatccctcaataacgccacctggataagttccacttaccaacaaaatagaatagtttgtgtacggttcagttagattgattgttgtacctacaccatttgcgccaccgtcgaacaataccgttgatttatgttcattaggaactgtccactgttgctcaagtctgccgtttgtgattgatcgtgtgtaaatctttttagagttataaggtgtgaagttaaatagcttgtttgtatcatctttaacgaataccgataaataaccctcataactttcaacgctacctggtaaatccggcactcttgttgcatagtaattaccagcagttaaatatcccaaatcgccttgcgcattatttaagttaacttgaattgattgaccattcgcctctgtcatcttatgttgttgccagctcgttgttccgaatttatcatctacatactgcttagcttgatttaaagcgttgttagacgtttcttcaacaaattgcttagttaagtttccatcattctttttataaaacgggtaccatgtgccgtagattttgtattttgtgtactcatcgtttgaatcgtctgggtaccatgttgcacgagcagtattattatcaacaacataaacaactaacacaccagatttgcttgatgtataagttgattcatcgaacgaagaaccgtcatcaacaccatcttgtccaggcttctctaacgtgcctatatccgtcttttctggcgcatctgttgcattagtaatatgaataatcctagatgtgttaactgcgcttaaaacgctatctatggactgctcatacgattcaattgctttaccgtaatcatctgtaagtttagacttttgccaattcgttgttgaattacctttaacaaggtcagcgccattgatttgttgttcaacttcgttaacacgttcaaaaatcgcttgctctttttcaactattttatcgaattcagctgtaacagcttgtgttgcactagtttgcgtcgcagtaatagcttgtatagcttcgttttgcttgatttcgatttgttgaatgccttttgtcgcactatcattcacttttgctattaacgtttgtgtatcagccatattttgctttaattggttaaaatctttaccgacagcttcgatagtatcttgaatagatttgatataaacaagctttgttataccatcaaacccactaactaaatcattttcaatattgaagctaaattgacgttcaacaacaacattattactcccgttttgtgtaaagaatgcctgagcatgcaccttgcctgaatgttttaaaaattcattcggtatcacatactgcaaacgcccattaattgcgtctactatcgttaattcgtctgaaatataagcgcctctatctacgttataatcatcggtttttaanacgatagatgttttaacatgttcagaacttatagataagggtctgttatncttagt

SEQ ID NO: 21 - DNA, 3647 bp; double-stranded, linear
atcagatcttgagaatcgagttattaagtctatcgaagacttaactaaaatccaaccattcatgcctacacaagattttgattttaaaactaaagaaattcaatcaaacatttctgaagaaagatttatcgaaatgattcagtatttcaaagagaaaataacagaaggggatatgttccaagttgtgccatcaagaatttacaaatatgcgcatcatgctagtcagcatttaaatcaactttcgtttcaactgtatcaaaatttaaaacgacaaaacccaagtccatatatgtattatcttaatatcgatcaaccatatattgtcggtagttctcccgaaagtttcgtaagtgtcaaagatcaaattgtaacaactaatcctattgcaggtacgattcaacgtggtgagacgacacaaatagataatgagaatatgaaacaactacttaatgatccaaaagaatgcagcgaacatcgtatgctagttgatttaggacgtaatgatattcatagagtaagtaaaatcggtacctcaaaaattactaaattaatggttattgaaaaatatgaacatgttatgcatatcgtaagtgaagtcacaggtaaaataaatcaaaatttatcgccaatgacagttattgcgaatttattaccaacaggtaccgtttcaggtgcaccaaaattacgtgcaattgaaagaatatatgaacaatatccacataaacggggcgtttatagtggtggtgttggatacataaattgtaatcataacttagattttgcattagcaattcgaacgatgatgatagatgagcagtatatcaacgtagaagctggttgtggcgttgtatatgattctattcctgaaaaagaactgaatgaaacgaaattgaaagctaaaagcttattggaggtgagcccatgatcttagttgtagataattatgattcctttacatataacctagtggatattgttgctcaacatactgacgtcattgttcaataccctgatgatgataatgtgctgaatcaatcggtggacgctgttattatatctcctggtccagggcatccattagacgatcaacagttaatgaaaatcatatcaacctatcaacacaaacccattttaggtatttgtttaggggctcaggcactgacttgttactacggtggagaagtcattaaaggcgacaaggttatgcacggcaaagttgatacactaaaggttatatcgcatcatcaacatctgttatatcaagatataccagaacagttttcaattatgagatatcattcattaataagtaaccctgacaattttccagaagaattgaaaattactggacgtaccaaagattgtatacagtcattcgagcataaagaaagaccgcattatggtattcagtaccatcctgaatcatttgctacagactatggtgtcaaaataattacaaatttcattaatctagtgaaggaaggatgaaaaccatgacattactaacaagaataaaaactgaaactatattacttgaaagcgacattaaagagctaatcgatatacttatttctcctagtattggaactgatattaaatatgaattacttagttcctattcggagcgagaaatccaacaacaagaattaacatatattgtacgtagcttaattaatacaatgtatccacatcaaccatgttatgaaggggctatgtgtgtgtgcggcacaggtggtgacaagtcaaatagtttcaacatttcaacgactgttgcttttgttgtagcaagtgctggcgtaaaagttataaaacatggtaataaaagtattacctcaaattcaggtagtacggatttgttaaatcaaatgaacatacaaacaacaactgttgatgatacacctaaccaattaaatganaaagaccttgtattcattggtgcaactgaatcatatccaatcatgaagtatatgcaaccagttagaaaaatgattggaaagcctacaatattaaaccttgtgggtccattaattaatccatatcacttaacgtatcaaatggtaggcgtctttgatcctacaaagttaaagttagttgctaaaacgattaaagatttaggtagaaaacgtgcaatcgttttacatggtgcaaatggtatggatgaagcaacactatctggtgataatttgatatatgaattgactgaagatggagaaatcaaaaattacacattaaatgcgactgattatggtttgaaacatgcgccgaatagtgattttaaaggcggttcacctgaagaaaatttagcaatctcccttaatatcttgaatggtaaagatcagtcaagtcgacgtgatgttgtcttactaaatgcgggtttaagcctttatgttgcagagaaartggataccatcgcagaaggcatagaacttgcaactacattgattgataatggtgaagcattggaaaaataccatcaaatgagaggtgaataatatgacgattttatcagaaattgttaaatataaacagtcacttttacaaaatggctattatcaagacaaacttaataccttgaaaagtgtgaagattcagaataaaaaatcttttataaacgcaattgagaaagaaccaaagctagcaattattgcagaaattaaatcgaagagtcctacagttaatgacttacctgaacgagatttatcgcaacaaatctcagattatgaccaatatggtgcaaatgccgtgtccattttaactgatgaaaagtactttggtggtagttttgaaagattacaagcattgacgacaaaaacaacattacccgtattatgcaaagactttattatagacccgcttcaaattgatgttgctaaacaagctggtgcatctatgattttattgatcgttaacatcttatctgataaacaattgaaagatttatataactacgctatatcgcaaaatctagaagtgttagttgaagtacatgatcgccatgaattagaacgtgcctataaggttaatgctaaattgattggtgtaaataacagggacttaaaacgatttgttacaaatgtggaacatacaaatactattttagaaaataaaaaaacaaatcattattatatttctgaaagtggtattcacgatgcatctgatgtaagaaaaatcttgcatagtggtatcgatggcttactaataggtgaggcgcttatgcgttgtgacaatctatctgaatttttaccacaactgaaaatgcaaaaggtgaagtcatgatgaaattgaaattttgtggctttacatcaataaaggatgttacagcggccagtcaattacctattgatgcgataggtttcatccattatgaaaaaagtaaaaggcatcaaacaattacccaaataaaaaagttagcgtctgctgttccaaatcatatcgataaagtatgtgtcatggtaaatcctgatttaacaacaattgaacacgtattaagcaatacgtcaattaacacaatacagttacacggcacagaatctattgattttatacaggaaattaaaaagaaatattcaagcattaaaatcactaaagctttagctgcagatggaaaacmtwatcccaaacattaatnaatnttagggggtccgtgg

SEQ ID NO: 22 - DNA, 5966 bp; double-stranded, linear
ccaccttgaccacctttacgtggaatcttttcmcctkgagcaacatcgataatatatattgaaagtcaacaagttctggactaaatgttgctgctaagttatcgccaccagattctatgaaaattagttctatatcgtcatgacgttctaataattcgtctattgctgcaaagttcatagatgcatcttcacgaatcgcagtatgaggacatccaccagtttcaacaccaatgatacgactttcaggtagaactcctgaatttactaatatcttttcgtcttcttttgtatatatatcatttgtaataacgccgatactcatttcttttgaaagacgttttacaactttttcaattaattgtgttttacctgcacctacaggaccaccaataccaattttaatcggatttgccacaattataacctcctatgatatgaaattctaacattgacgttctcatgcgccatttgatttagttctaaaccaggcgctgtcatgccaaaatctgcttcttttaattcgaaaatctgctttcttgttccttctatataaggaatcatgtgagtaactatcttttgaccagcagtttgtccaagtggaatagcacgaacagcattttgagttaaacttgaaacattttgatataaatagtaatcaataatcgtttcaatatctacacctaaatgatggcctagcatagtaaaacaaatagctggatttnactttgctttcttatcttgcatttgttgatgataccaagcaatccatgggctattataaagttctaaagccaatttaaccatgcgagtccccatttgtkttgcaccaacacgtgtttctttaggtaagttttgracaracatcagtttatctatgtgtaatactttttgtgtatcatcattttccaatgcatcataaactaaacgcatggctaaaccatcagaataggtaagttgctcttgtaaaaacatttttaaccaagcaataaaagtatgatcgtcatgaattatatttcgttgaatatatgtttcaagaccaaatgaatgactgaaagcacctgttggaaactgtgaatcacagaactgaaataatcttaagtgtgtatgatcaatcatgagaatgccctatatgtctgaaagccttattaactttacggtcttctcgaacatatgggatgcctaaactttttaataaatcttcaactaaataatcatattgtactagcatttcagtctctgtaaattgtgctggcaaatgacgatttcctaattgatgggctatatctcccatttcttgcaatgttcttggttgaatcactaaaagatcttctgaattaacatccacaataatcatattatggtcatctgcgtataaaatatctccatattgtaagtcaataggttgttttaaacgaatgcctatttcagtgccatggtctgtaacgactctttgaatacgtttaacaagatctgaattttcaaggtatactttttcgacgtgcttttgtttttctgaatttgacaaattggcaatattgccttggatttcttcaacaatcattctatgttcctcctagaataagaagtatctttgagttaatggtaactcagttgctgcattacttgtaattttttctccatctacatatacttcatatgtttgtggatcaacgtctaatttaggtgttgcactgttatttttcatatctgctttagataattgtctaatatttttaactggacgcaccatgcgttttaaatttaatgcacgattgataccattttcataagcagttttagacacgaatgtcattgacgtacttgtaaggtttccgccgtattgaccatacattttacggtacttcatcggttcagatgtaggtatagaaccatttgcatcgccatttacggcagagttaattaatccgccctttacaactaattcaggtttaaccccaaagaaaattgggtcccataagacaatgtcagctagtttgcccggctcgatagatcctacatattcagaaataccatgtgtaattgctgggttaattgtatatttagcgatataacgtttgatgcgattattatcattatgttcaaaatcaccatctaaaggaccacgttgttctttcatgcgatgtgctacttgccatgttcgtgtaattacttcacctacacggcccattgcttgtgaatcggaactaatcatactgaatacacccatatcttgcagaacatcttctgctgcaatcgtttctttacgaatacgtgaatctgcgaatgcgatatcttcaggaatagccgcatttaaatggtgagtaatcattaccatatctaaatgttcatctacagtattatgtgtataaggcaaagttggatttgtagatgaaggtaaaatatttgaaaatgcagcggatttaattaaatcaggcgcatgaccgccaccagcaccttcagtatggtacatatgaagtacacggtctttaacagcagccattgtgtcttccataaatcctgcttcatttaaagtatctgcatgtaatgcaatttgaacatcaaattcatcagcaacatctaatgcatgactcaaagcagatggtgttgcaccccagtcttcatgtacttttaatccaattgctccggcattgatttgttcaatgagtgcagttggatttgttgcttgtcctttacctgtaaaaccgacattaatcggtaaaccttcggcagcttctaacattctatgaatatgccatggacctggagttacagttgttgctttagaaccttctgaagcaccagtaccaccaccaatatgagtcgtaataccactttctaatgcgacctctgcttgttcaggattaataaaatgaacatgagtatcaataccaccagcagtgacgattttaccttcagcggcaatgatatctgttgttgaacctataataatgtcgacattatccattatatctgggttgccggcattacctatggcgaaaatataaccatttttaatgcctatatcagctttaaccactttatcgtaatcgataataacggcattagaaatgacaaggtctgcaacgttcacgtcatcacgtgttacacgaggattttgcgccataccgtctctaatagatttaccaccaccaaaagtagcttcttcaccataaaccgcatagtctttttctatttgagcaaatagattcgtatcacctaaacgaatggaatctccaacagttggaccgtataagctcgtatattgattttgcgtcattttaaagctcatgatctttttcctccttttttattcacgttttcagcaccgttatctccgaatacacctgcatattcatcattttcatcagttgggcgatagacacgtgactcatcgataggaccattgaccataccacgaaaaccaaaaattttacgtttgccagcatattcaactaattgaacttcttttttatccccaggttcaaatcgaacagctgctccagctggaatatctaaatgttttccatatgccatttcacgttcgaaatctaatgctgcatttgcttcataaaaatgaaaatgtgagcccacttgaattggtcgatctcctgtattttcaacttcgataactgtttcaggatgatggttattaatttcaacctctgtactttttgtaataatttctcctggtatcatttgactgcctcctttaaacaatagggtgatgtactgtgattaacttagtaccatcggggaacgtagcctcgatttcgatatctgtaatcatgtgttcgacaccatccatgacatcttctttgtttagaatttgtctaccataactcattaactctgcaacggtcttaccatcgcgtgcaccttctaataattcatcgctgattaaagctaatgcctcaggatgatttagtttcaaaccacgtgctttacgacgacgtgcaacttccgccgccactacaatcattaatttgtcttgctctcgttgtgtaaaatgcaaattaaaacccccaatttcatattagatacaatttacaaaatttatattaatcctaattgttgtgataaacaagtaatatacaaagttcaatgtgtaattagaaaattatatttttagcatatccgatattgaagcaaacaatctaatcgaaaacaaatagtggaatatatttatgtaaaaaccaaaatagtttttaatataacttttcatagaatagtagtatattaatgagtaatgattcaaaggaaaggtgaaagatttgaagataatagatgtgcttttgaaaaatatatctcaggttgtgttaattagtaataaatggacaggattatttatcttaataggattatttgtagccgattggacaattggattagcggctattgtaggtagcatcatcgcctatacttttgcgcgttttataaattatagtgaggcagagattaatgatgggttagctggatttaatccagtgctaactgccattgcgttaacaatctttttagataagtcaggattagatattgttataacaatgatagcaactttattaacgttaccagttgctgctgcagtgagagaagttttaagaccatataaagttccgatgctgacgatgccttttgtcattgtgacttggtttacaattttactttcaggacaggttaaatttgtagatacatcgttaaagttaatgcctcaaaacattgaaacggttaattttagcaacaatgatagaatacatttcattcagtcattatttgaaggattcagtcaagtatttatcgaagcgagtgtaattggtggcgtatgtattttaatcggcatattgatagcatcaagaaaagcaacactcttagctgttatagctagtttgttaagctttatcattgtagctctattaggtggtaattatgatgatattaatcagggattattcggttataactttgtattaatggcaatcgcactaggatatacatttaaaacagcgattaacccttatatttcgacttttttaggtgtgttattaacagtagtggtgcaactaggtacaacaacattgcttgaaccgtttggcttacctgcattaacattgccatttattatcgtgacatggattttattatttgctggtattaaacatgacaaagtagatgcttgatagttaaatcaaacctaatattgtttgaatatcaccttaaactatacagcgaattgtatagtttaaggtgtatttttatggataaaattaagtgcatacttaatcgaattatcagttttcttttaattgttcacagcacgttcctttttatttttaaagtcgagtgttaaactaggaataaataatttatattgtgtgttgtgtggggtgactaatatgaatgatatggataattcctttttaataacaacggaaattcaaagaaaatggattgaaaaattcaaagtaattagagatacatttaaggctaaagctgaatataatgatcaacatagccaatttccatataaaaatattgaatggttaattaaagaaggttatggaaaattaacgttaccaaaagcatatggtggtgaaggtgcgaccatagaagacatggttattttgcaatcatttttaggcgaacttgatggtgccacagcattatctattggttggcatgtgagtgtcgtaggacaaatttatgaacagaaattatggtctcaagatatgttggagcaatttgctgttgaaattaataatggtgcattagttaatagagcagttagtgaagctgaaatgggtagtccaacaagagggggaagaccaagtacacatgctgttaaagctgatgatgggtatattttaaatggtgtgaagacatatacatcaatgagtaaagcactaacacatattattgttgctgcttatatagaagaattagaaagtgttggttttttcttagtagac

SEQ ID NO: 23 - DNA, 17310 bp; double-stranded, linear
ctgtgtcatcgcgaaatagttagggtcattcattaatccttttgaacgtatttcatcaaaatataacaatttcattagtaaaggggacttgttcaaaccagctataatacaaaatagacctatagtcacactgcttataatataagaggtaacgatcacttttttgctattacctaacttaaagatgatcatccctaaatagaaataaatgactacaaatgcatatttaactgtagatgcaagaacttccttaaccgtaataaatatcaaatcatcaaaaaatagcaaacaargcgtaataatcatacgatatgtatacaaaataatgamaaactgtmaaaaatgatttgcctttaataaatggttagcgaaaaacagtaaataaactaatattagtaatgtgataaagtcagctatagaaacattcacaccggcaataaccgaagattgctgaataaaaaccgctaaaccgataagtaacaatgttagtaatttactattgtgttgattttccattataaacgtcttccacttctttaatcattttctcctcagtaaaacattctaaataacgttttctagattgattactcattttgatgtaatcactgtctattaaatatttttccaggactttagcaatagtttcgggttggttgttcatcatacatataccattatcagctactaattctgaaataccgccaacatgactggctataacaggcaaacctgtagccatagcttctataatgctaattggcaaaccttcatgcttacttattaaaataaacgtatcgtattgtgataataaatgactcgcattaatgacattgcccaaaaatgtgacatcattttctaacccagcttgtacaacttgttgctgacaatcatttaatgtaggtccatcgcctataaatgtaaaatgcgcatgattactgttatgtaatttcaatatctctattgccgcgattagattttgtggcaattttggataagcaaatcttgcaatcataacaaattgatgctttgtcggggcattaatctgtaaatcttgtttattaggcaacattccaactacttcgccaatattgttatgtgattggctttttagcgtttgcttaacagcgggaacatctgcaataccattatgtattgtggttaatttcaatcgattaaatcgatattttaacgctaactgtttatcgaaatctgaaacacaaataatgctatctgtaataagtgacattaatttttcgataactaaatatagaaattttttagctggtttaacaccctctgtaaaagcccatccatgtgcagtaaaaactatacgtgtgtctttcgatttcgaaatgaacttcgcaattcgtccgaccgttccagctttggaagaatgtaaatggataacatcaggtttaattttcgagaataactgtgctaacactttgacagctaaaatatcttgtttaaagtcaattggacctactaaatgttcgataataattacattaactcttgcatctagttgttcaatcattggtccatgattgcctacaatgacataaacatcattgtgtacgcaaaaatggttggcgagttgaatgagatgtgtttgtgcaccaccattgtctgctttagtaatacaatatataattttcaactgttacaaacccctttaatgctatactttcaatttcttaacatggctatctcatcagatgaatagtatttatagccatgcaaatcaatgatggcacatatttcttaatgccatttgatactgtctcaagggattcctcgttatactgtaacaattggtcacaatctttaaaatataacttttatttgaacttattaagtaaattaagactaccttgagccttcccctgtaataacaaccatcaatgttctaattgatatatatagttccatcattaaactacctttatgtatatatttcatgtcatatttcagtttttgttgcggtgttaagtcatatccaccttgaatttgcgcaagtcctgttaaccctggtgtaacaagacatctttgctcgaaacctatcacttctgaactaaataattctacaaattccggacgttccgggcgtggtccaataaaactcatttcccctttaacaacattaattagttgtggtaattcatcaatgcgtgttttacgaataaacttcccgacatttgttatacgatcatcatctttatcagcccattgcgcaccgtttttctctgcgtttttgcacatcgaacgtaatttgtatattttaattaatttacccatcttcccaactctaacctgactataaatagggtttcctggcgaatctatgacgatagcaatggcgaatataaccataatcggtaaagttaaaaataataaaacaatgcttaaaattaagtcaatcgcacgtttaattgggtaatagctttttctcacttcttctagtttgtctaattttctttgataggcataacccttattattatggacagcttcaatgtcattttcacgacatttccacttctttagctgtaacttcttcaatattatctacctcaaaattaaagtaatcctttaaacctgtttctactgtatatttaggaacaaatcctaatgcctttaagttagaaatatctgcataagaatgcttaatatctccttttcgtgcttctttaaattcatgctcgactgattttccatataattcaccaataatacgataaacctctaataaattagtaaaagtgcctgtaccaatgttataaccgtgtccaattgcatctttgtgttccataattaagcgtacagattgaacaacatcatatacatatacaaaatctctagtttgcagtccgtcaccaaaaaatgtaaatggcttgttatgctcaaatgaatcgaacatctttgaaatcacacctgaatattgtgacttaggatcctgtcttggcccaaatacattaaaaaatttaacaaccgctgttggtatgttatataacgaacaataatttaatgtcgtccgttcgccgtaatatttatctattgcatatggtgataatggtaagattaatgattgatcacttttaggcaaatcaggaagatcaccataaacagctgctgacgaagcaaagataaaacgttttatatgattattatattttttaatgatttctaacaatcttaatgttgctacgacgtttatttcttgagataagataggtttctcaaccgactcagcaacactaactaatgctgctaaatgaataacataatcaaattgatatgtcttcatgatttgttcaactgcatcatattcacgaatatctaattcaaacacatgatcgtcagccaaacttttaatattttctcgtttacctgttctatagttatctagaacataaacatcataatcttgttgtaaatcatctactaaatgcgacccaataaaaccagccccaccagttatcaaaactctttccaaatcttccacctcatttatacattaaaaatatatcataaaaacataaagtattgtaagctttttatcgatattttttatttataaaaataaaatgagataactttgtgaatttttattgagataaattagatagtggtgtttttgtgatgttttataatatcttgggtgtgttaatactaataatgctttcaactgatgcattagactgtgacatcataactcacttaagaacttcgcttattaattttctaccaatacactcccttctaagtgcactaaaaaatccttactgctaagtgattaaacttaacaataaggatttatttatcattagtggatgattattaacggaatctcataccaccatctacaataattgtttgtccagtaatgtaatcagagtctttaccagctaagaagctcactacatttgaaacatcttctggttgagaaactctgcccaaagcaatctgacttgtaaattgttcccaaccccatgcttcaggtttacctgcttcttcggctgttgccactgcgatactttccatcattggtgtttgaacgataccaggtgcgaatgcattcacagtaataccttcagacgctaaatcttgtgcggctacttgtgttaaacctcgcactgcgaattttgtactgcaatataaagacaagcctgggttaccctcaacgcctgcttgagatgttgcattgataattttaccgccatgattgaattttttaaattgttcatgtgcggcttgaataccccatagcacacctgcaacgttcacgccatatactgttttaaactgttcttcagtaattgtatcgattggtgttgttggtccaaggccggcattgttaaccatgacatggaaatcgccaaattgcgcggcagtttgtcttactgcgttaaatacatcatcacggtttgatacatctgctttgatagcaatagcttttgtaccatcacttgataatttaagtgcagctgcttttgccccttcttcattgaaatcaacaactgctactttgaaaccatcttccactaaacgttctgcaattttaaaaccaatcccttgtgctccgccagttactaatgctactttgttgtttgtcataaagatcactcctcaaatttctttcctttaattacattttactcctcttcatttgaatagtacaacaaaggtagctccatttaacaaaatattcagatatttaaggtatagttaaacgcactaccattagtgattggcaatgcgtttaaatgtcgttttaaaagttcttatgttgaatattatttttttaagtctctcgattagtttgtcatcaatcttttttcgagacatggtcttttgattcaataggcggttccgtgttatcactgacaactttagttgtagcttcatctttatgtatttcttcgttaaatccttcaaggtttttagtcgtgggatttttaacctcaggatgttccatcatgtcttgactatcaagttcctttttacacgtgtctttatgtgatgcttgatttgcgttccctttacttttttgaatagtggtagtatctgctgcagctactaatttttttctacctaaaatagatatggctgaaacaaaccagagtattgcagatacaaagttgcataatactaaagcgataatagccaatacaattaatatgacaccttttgaaatcctttctttaaataagtcagatgccaatacgatgacaggtacgattgaaagtataattacaaatatagaaattattgccgatataactattgttactattaaataatcagctctgctacctgataataaatagaaaaggccgaaaattagtccatagcaaattacaaacccacataaagttatagccatgagtactatataagctatttgaaaatataaacctatctttatgaatgatttttctacatttttttccatgtctattccccatttatttaaaatttatactttaccttaaatattctctttattctttagtgattttatctttagattcaaattgattctctgtactttcaatatcaactttttcattttcgtctgtcgattcatcttttgagtatttattccaaatcagcaaaataccaccaatcagccataaaattgacgaaaggaaattatataaacacagtgcaataatagcataaacaataaaaagtgcacctccgattacagagtaactttccatataaatcgcagtaaagatggttggtaaaacagtgaaaagagccaatattaatcctaataaaaaaattgtttcgtaatcagatcctccagcaatattaatagatatcatcctaacaaaaacgacactaaaatatatttgagctacgatgcctatccaaattgctatttttcctataattgagctcatactcattccccatttatttaaaatttatactttaccttaatataccttattttatttaatttttatatgcaaaatacaaaaatggagaacttcaatatttataaaatatcaaaagttctccacactatattgttttattatattttcgctatcaatacgctaaatcatcatatttccctcaacatcacagtaaaactattgctccaccaagtatactttttcagtatagcatctcatattggcaaacttatctgctaaaaactgcttccaattgcgcagttgttcaacatcatcatcttgtttaagtaatgccagtggtacttgaagattaagacatcgtcctgaaatattaaagcgtgtcacacctgctggcacagtttcccctttatgaacaaccgcttcaatttccttataactcaatggctgatacttcatgagtacatcttgttgagaaagacaaggatatgtaccttgtgcaattctctctacagaacaacaaccactataacttgcgacaaccttttcccatacttgaaaatgtgcttcgcctaaatcttttgtatacaaatattgttctgtatcaccatgacacattgtaataaatggcgcttcttgtcttgtctcagtagtccatggcaagcgatgttcttgttgtaacgtttcccaccacacaccaaatggaactttatgttgccatgtactaattgaatattgtgtttcatggatttcttgcactggaactttcttacatcctaacgctttcaaacttgtataccgatgcacaccatctataaccatatatctaccatgttgcatcgctgtcactaaaataggatgacgtataaaatcatctgcttcaatactacttttcgttttttccaatcttaaaggttcgaatgtttcgtgaagatcaatcttatctactggtaccaattttaaatgttcatgaatatgattcaatagttattcatcctcctttgtttgtgttaaataaataaattcaggatgtggatggcttaagaaatcgtgatgtgaaatagaccatccgtatgcacctgcatatttgaaaacaataacgtcgcctgtactgattgcgtctatctgtacttctctagcaaagacatctttcggtgtacataattgaccgactaacgttgtgtcctgtctcgaaattgaaactttttcaaatgaatatggattgtccttatagcgataaatgtcaaaaggatggttatgttgccaagataccggcagtctaaattgttgcgtacctcctcttaatatggcataccaagcaccatgtactttcttaatgtctagcacttctgtcacatagtaaccaatatgtgccacaataaagcgcccacattcaaagttcaatgtcacatcttccatttcttgctcaacgataagtgttttaaaacgttctacaaaattatcccattcaaattggttagttaaatctgcatagttaacgcctatgccaccaccaagattgatatgtttgagtggaaatcgatgtttttcagaccatgcctttgcttttttaaaataaagtttcactacatcgacatgtaaattcgagtctaaattgttagaaatagaatgaaaatgaaatccatctagatgaatctttggcattgcgagcgcagcttcaatgacatcatcaacttcgtcttcagaaataccaaattgtgttgggcgtcctgccatatgcaacgttgcattgggaaatggtcctgctaaattaacacgcaataaaatgtgttgtgtcttatcttcatcttctaagatggcatttagccgttgtaattcatgcatactttcaacatgaatacgctgaacaccttcacttactgcatatcttagttcctcgtctgtcttaccagggccaccaaaaataatatgatttgctggtttaaaagcaagaccttttgctatttcaccttgagatgcaacttcgaatccttcaacatactgactaattgtatctaggatttttcgttcactatttgctttcattgcatagtacatttgacaattactcggcaatgacgatgtaatatgttgcaaatgatgttccagtccgactaaatcatagatataatgacaaactggatgagattgtgcttttaattgttcaataacaggttgaactatacgcattagccttcatcccctttctgtttagacgtcgctagagatgcacttaaatggcgatatatttttccgcgatcatcacctaaaataaatgtttgtacaccttgtgcctgccattttgcaatatcttcatcttcacgtggtaatgcacaaaaatgtttaccatgtgcattcacaacttcaaaaatatgttgaacatgtgatgttacttgatcatcacgcgtttgccatggtatgccaagtgactgcgataaatctgcggcaccttcgactatcatgtctaaaccttcgacttgtgctatatcgtcaatggccataaccccttcaacatcttctatcatggcaatcaccataatatgctcattagccatctccattgcatcaagtaatggtgtacgtccaaatcttgccatgcgaccaccattcaaacttcttaatccttgcgggtaataacgacttaatttcacaatatgctcaactgtctcacgatctttaacgtgtggcacaataatacctctcgcacccatatccaacactttaatgatatctctatctatcactgcagtgacacgtacaattggtataatatgcgctgcttcagctgcacgaattaaatgcgctagtgtctcatcattaatcgccacgtgttctgtatcaatcacaacaaagtcatacccgcttgctgcgataacctcgatcatcaatgggtccggtatagaattaaaaatgccataaactgaatcaccattgtttaatctatgtttcagagatagttgttgcatcattgatacctcctacacctaatggatttgtaacatgatgaattcttaactcggagtcacttaataatcgacgtgtcgttaacttttcaacttgaatcgtaggttcaaacaaatcgaaatgttgatagttattcaactctggaaatgcttcttgatacgcctcgatgatgcctttaacccattgccattgcagctcctcatcgataccatattgcttttcaataaataagatgatttcggcgatattaataaagaaaaatgcatcatgtaaaaagtcgcgtactaaacgttcgtcatctgtttcaataaatgaattactattcacttttttatgtgcttctggcattggctttaatgtcaggtgtgaagcagcttcacttaaatgctcacgcttaaaacgaacaccatcatggaaatcttttaaggcaatacgtgtaggccaaccattttcatgaatgagcatcatattttgtgcatgcgattcaaaggcaataccgtgataataaagcatatgaatcattggacgaatcgctacagctaaaaattgctttgtccaagcttcagaaccatattgtttaatccaattttcaatgaatggtacaccatccttatcacttgcataaagtgcattaaatggtatcgcatcctcttcatcgattaacatatgatatatattttcacgccatataacacctaacgcaccataaacttgagtttgtttataaggcgaaagttgtgtatttaaataagactgtcctaagacttcccctagaaaaactgtctttaattcatcttttaaatacatatcttgttgctgtatctgctttaaccaatccgtaatttgcgctgcattttcaattgtatgaggcgccaacactcgtttcgttgaagtgttcgttatacttattggtacctttaaataatattttgtcgtgtctattggcgacatcgtacgaatcgattgttgagggtgatatagctcatcactttcccctaaccatagtactgtgccattaagcctttcttcagccaaatcaacttggatgacatgttcaaactgccatgggtgtacaggtatcatctcaacatcatttacatgtttgccagatgcttcaatttgctgtacaaaatgttcataagtcttatcgccaacttgttgacgtaacatttcgttaactacaacatttcttgataccgtcgtttctactttatctttgtcgatagctaaccactgcagtttaacgtttggtacaaaatcaggaccaaatttcaaattatcactcaacgtaaatcctaaacgtgatttgtaacttggatgatactgatgcccttccatcgcataaaattcatagtcgttaaatgtctcaggtgttgctggtgggtttgattctcgatactgcatactttgcgtatcttttaattctgtctgtaataactcgacaataaattgttctagcttttcatcatttttaggaaatgtaaatacaacctctctcaataattgtgtatagtctgttgttgtatctgcctcatctcctacgacacgctcaattggtgatgtgatacgtatacgatcaaagctatgtgtcttttcagcagtaaaacgatactctgaatcatgtccttctattgtaaaatgaccgacaccgtcttgatatgacgctttatacacaacaatattctcataaataagtgatgataccagttggtgcatcactctagtctttacacgattaagaattgtttgattcacaatacgatacctccttgttatgacaaattggatttggtatatgtgtataaatagggtttgcaccacaatcattcaatttactcatcaaattcgctttagccgcaatggtcggcgtttgatataaatcttctacacagtcaacaaatactgcgttattcgcgtattcttttttccaagtcataagacgatgcgctacaagttgccataacacaacttcatttctagtcgctttaccaatagttgatactaaatgtcctaagtgatttactacaacgtaatatttaagacgatgccatgcttcatcatgtgcatatacaacagggcttgatgctgccacaacatttggcacaagctgtttttcagtagcaatcgttctagatagacaaatgccttcaagatctctgacaaagcatacgtcgggtatgccatcttttaattcaattaatgtattttgtacatgtgcttctagactaatgcctgtgttactaaacagctttaatatcggcaataatgtacgattcaaataacattcaagccatgcttctggtgctaaaccactttgctcaatcacttgtgataacttagacatcggtgaatcaggcatcgtttcaaataatgacgccaatacatgaatatctttatcagcatggtaattcggtatcccttcacgaacaatcatggcactatttgttaataaatccatttcaggttcaactgtttgccctaatggattcggtaacaatgcacgatatccttcttcaaacatcaatttaaaatggggtgtttcaacctcatctttgactgatgcgataacttgcgcggcatcaattgtccgttcaatctgttcaaggtcattcgtacgtataaaattagtgattttaacgtgtatcggtaattttaaataaatgtttaatgcttttgaaaatacagttctaaccgaagacgtcgggtacactgaatcaccggaaacgccaaggtcttttattaaaccttgttcactatattgcatatactgtggatgctgtcgcaacacattgatttgataaggatgtgttggtaataaaataaaatctttgggtatctctgatatatctatgtctgctaattgatacaacactttctcaacctgatcttctttaccttctacatagcgcgtgagcagaacatcttgatgcacagctaaataatgcaattggaatgatgtatgacattcgggtgcatatttctctaaatctgcttctgaaaacccacttgcactcttaggagtcggatgaaatggatgacctaagtataaagattgttctgaaacgatataacgatcctctacgtagtctattgtgttactttgcaaataacgtgccgtgcgatgaatgctattatcgatgtcagacataatttgcgccatatgttgttgcactgccgtttgattatctgcactttgagccatatgttgcaaaatacgcgcaattgcttctttataagttgttatttttttactttttccatcgataagccatacctctggatgatacatatgatgccccatcgcagaccaatagcgaaattcacccgttaaagtttcgagctctgataattgtatagaccattgatgattttgaggtggtacttgatataaattttcttctctaaaatattcatttaaaatgcgttcgatagccgcatacgctgcatgttgtattaattctttattttgcacttttttgtttcaactcccataatttcattaatgtgtgatcgttgatttgattagtgatggttgaacaaattaaaaataaactacttactgcaaatactacgcccataacgataaacgtagtagctggtgtagtataacttgtaatggcagcgccactaagactgccaataatttgaccaacaactaacatactgttcgtcgttccaacaaatgtgcctttaagttgttgatgacacgcattcacgacaacaaacatgacactttgaatcaatgcactatatgttaatccttgaagtattcttgcagccattaaaaactctatattcgtcgctaaaccttgcagtatcgcactacaaccacatgcaatcgtggcaaatatatatactgatttaacatatgatttatcattaaagcgtccccataaaggcgcgcttaatatcgaagccgtccaaaatgcggactgtaaaaatccaatcacactacggtcatctatcgctgtatgattcactgatgaagcaagtggtgataatgcagttagcatgccatacatagcaaagtttgctaaaacgccaacgataataaatcgacatgtttgttgtgtgcataatagacattgaaatgaacggcgaatacctttattaatatttggtgtttgtgattttggcatatgtgtcgtttcaatcaattttaatgcaccgaaaatacagacaataaaagtaataacggcaatactcatcagtaacgcactaaaacctaatatcgaagctgtaacaccgccaattaatggccccacaagagaccctgcgctgactgaactttgcagtcttcctaatacctttccacgatcttcagctggcgcctctgcactcgcaaacgcacttgatgcatcaacaacaccaccaaatagtccctgcaataacctcacaagtacaaactgtaatggtgtcgtacacaatgccattaaaaataagcataccgccaaaccaagtaacgctcttaacaccatccattttcggctgatcttatcacctagcttcccccatatcggcgaagctatcatcgtcgttacagctggagcagcaatcgctataccactccacaactgtatttctacgactgatagattttgtagtgatgccatataaattggcaataatggcacaagtactgtcagtccagcaatcgctataaactgactgagccataaaatgcgaaagttactgcgccatatagactgattaatcatatgtcaccattggatttggtacggtagttaaacctgaaggcatactacctccaccactatcacgttgatatagcaatggtaataaaatttgtttgaatggccacgtctgtttatcaaataaaatgtgtctgacagctagctgatcagttgtaacccaggaaatagttgccacttcattttttaaaatttgttttaacaacgacataagttcatgctcacttacaccaaataaatcttgaattgcatcaataatggcatatagatttaccgatacagctaatgtttgaaaataagcaaagaatgtttccaaatcctcattaattagcgtattaggtgtatcttctctgacgacatacttcggcaatgaaagctgatgtgctgttagccatggtttataaattctgacagtatcatgatcacgtaacacgcatttttgtacacgtccatcttcaaatgacaacaatatattttgaccatgcaactctggtaatgcgccgtattgcataaatgatagtgttacctttaaaaagacttgcgcgatatcttcaaataacgtcatgacatcatttttagaaatattatcttttccacaaatcatttgatataaagtgcgatcatttgccgcgagtgctgccattgacactagctgttgcgtatcatttttggctagcacttcgggatactttcttagctgaacagttagatgacctaattgatctttgaaaatatcattatcttgacccatatatgaccaccaagctgtttcatcacaaaccatgacatacttagctagtgcttcatctttttctataagctgacgtaataattgttctgcttgttctccgtttttcatgtaacgcgtaggcgttagccttaatgcgcctaatgactgcattgcaaatggtactttgacatggttatacggtgcgccaatatcaattaatgaacgcatacttgaagacgacagataatctccaaattttaacggtaatagtacaaccaacttttcactaatctctttcgcaaagacgttcggcagaatatgctgatattgccaaggatgtaccggaaatagtacatagtcatctattgataacccttgatcatttaacatgtctgtcgcttgttcttttataggtactgtcaaattttctaattcatcgatatttgcagtatcgccatgaatcatatgtgtctttttaactgctgcaaccattaaaggaaatgattgatttaattcagcttgatacacttgataatccgcttctcttaatcctcttttttctttagctaatggatgaaatggacgatcttttaaacttgcaaactgctctgacatcacaaaaggatgtgacgctaaatctaattctgataattgtttagcaagctgtgtggcagcagtagtcagtccttcttcaacgcgagccacttcccattcatgacttagatcacaattcatattagcaattgtttgccaaaattcagctgccgttaaaggttgcttagacacccttccctctatcgtaattggttgtgaactttcgtaacgaaacatatttaaagcactaaaataaacaggtatctttatttgttgtgtttcacgttcgtatatcaaaagcgtttgtccgttttctttagtaatctcactattcgatacaattccggctatatcttcaaataataatgcatcaactaaatctcttaatattatcgcttgtgctgtattgactgctgtatgattctgcaatgttcagacacctcgcattcttaatataggttcaatgttgtcccaatattttgttgttgtgcctgttgataaataaaataagcacttgaaatatcttcgatagccatacccatcggattaagtaatatgatctcatcatcgtcttcacgtcctggtatgtcacctgtcacaagttgtcctagttcagcatgaagagcttctttgctgaatttaccttctaacaccaattggttaatagttttcttttctcgattacattgtgaccagtcatctactacgactttgtcagctttaataaagacttctttatgcacatccatgatagaaatgttgctaataaatgcacccttttgtaaccaatcatattcaatgtatggttgatccgttacggtacatgtaatgactacttcaccatttgatactgcttctttagcattttctgtcgcaataaaattaatttccggacgctgttgttgccatctatcaacaaagcgtgcacatgcttcagagaattgatcgtaaacaaacacgcgttcaatatgatcgaattgctctaacatactttgtaattgcttgtctccgattagcccgcatccaatgattgttaagtctttaaatccttttttagccaaatgctttgctgcaatcactgaaactgctgcagtacgcatactactaattaaacttgcttccataactgcaattggataattcgtttctggatcattcaaaataatgacgccacttgcacgctccatattacgtttcgatggattgtcgtgcttactacctatccacttaatacctgaaattgcgtgttcaccaccgatatgacttggcattgcaataattcgatctgcgatgtgtccattttcaggatcctgtcttaaatacggcttaagcggttgtacaaaatcattgtgcgcatgggctgttaatgcttctgttaatgcgtccacataaacttgtgaatgattacctcccgcttgttcaatatctgatctatttaaatacaacatctctctattcattctgatttaactccttgtcttgatttcattttttctaaccatgtatctgaataaactaaatctaagtaacgatcgcctcgatctggtaaaatcgtgacaattgttgcaccttcttcaattgacgttatcaactgctcaatcgctgcaataatcgaacctgttgaacctccggcaaatatgccttcataatcaatcagttttcgacagcccaaagcagattgataatcatctacatggatcacttgattaatttctgatctattcaatatttcgggtacacgactagcaccgataccaggtaattctctattaataggtttgtcaccaaaaatgactgaccctttcgcatcaacagcaacaatttgtgcgtttggatgcacttcttttatttttctactcatacccataatgctacctgtcgtgctgactggcgcgacaaaataatctataggttgcttaattgtttcaacaatctctgtgcctgcaccatgataatgggattgccaatttaactcattcgcatattgattaatccaatatgcatcgtcaatagtggctaacagttcttgcacctttgcaatacgagtcattaaataacccccatgtgcatcaggttcttcaaccatttctacattggcaccataacttttaataattttcaaatttgttggtgatattttaggatcaacaacacacgtgagttttaatcccttgattttagctatcattgccaacgcaatgcctaaattaccagaagtactttcaattaaatgtgtattctcagtgattaaaccatgtttaataccatgttcaatgatgtacttggcaggtcgatctttcatgctgcctccaggattcatatactctaactttgcaaacacttcatgtttcggaaatagttgatgaagttgaaccataggtgtttgccctacagaatctaacaatgaatcgtgcacatg

SEQ ID NO: 24 - DNA, 5423 bp; double-stranded, linear
atactagtaagcgcatcggttattgacatcgaattcaactttaacagttttcatgttcggtgatgtttcaatagaatgtgtgtgttgtacttgcgcatttatatttccacctaaattacttaagtttcctgtaatactagaaatgtcaggtgcgtttaatgtaggttgaaatgcatcaactactttatctgcaacattagaaacattacggataactttacttgaatgattatctatacctttaacgaaacctaacattgaatacataccaacatccatgaattcacgtgaaggtgagtgaatacctagcgctcttttggctgcatttaaagcaccttttgctacactagctgctttttcagctaagtctctagccatattaccaatacctctcatcaaaccacggatcatatcagcacctgctgatacaaagtcatccacaaagcttttaactttatttactgcatttgtcataccttgactaactttgtttacaacattaacgaatccttgaacaactctattaacaargttaattagcgtacttgttatagtagatacccatngcatacctttagtgacmatgaagttccaagcttgagacattttgtctgatatagttgaaacaacttgtgtgaatatgcttacaactttattccaaattgtcgttaatataccagataagaaactccaaatcgtattccatatattagaaataaaactccatgccgcttgtaacgcagtagatatagctgtagtgatagcgttccaaaccttagttgccacagtaactatagtgttccacaacgtttgtaagaacgtccaaatagcgttccaaattgttattgcgatagtcataattgtggtaaacactgtagttattacagtgactaacaaattccaaatcgtagtagcgattgtaattatcgtattccagattgtacttaagaacgtccaaatagctgtccatatcgtcataactattgtcattatcgtcgtgaaaacagttgtaatgattgtaactaaaaggttccatactgttgttgcaatagcgataattccattccatagcccttgtaaataagcgactatttgattccaaacaatcattataaaattgtaaacattcgatactgctgtagtgatagctgttaaaatagcattccatacaaccgaagctacagcttttaatacattccaaacattaaccataaacgtttttatcgcattccaagcatttataataaagtttctgaatccttcatttttattccacaataaaacgaatatagctattaatgcagcaattacaccaattactattgttattggaccgcctaaaataccaaacacagttactagtcctgtgatagcatttctaattaatccaatcttaccgaataacaattggaatataactgatataatttttaatggtccttttaataacatgaacgcaccttttaaaattgttaatcccgctcttaataaaccgaacttacttactaatgcaatgrttctacctattaatccgccacccataaagttagatacagcaagaataatcggtattaaaaatctaaatgcaccaactaaagttataatgacaccaactaattgtgctgtagctggatgcgcctcaaacaagttagctatccaaccagttattgcaactgcaacgcgtaatactgcactagctataggagccattgctgttgcgaatgcarmtaatcctcttgcgatgtttccaatcaattgcattattagtggtccatttgtttgtatataactgacaaagtctttaaacccttgagattgtcctacttgttcagaccattccctaaacttagctgtcatttgttcaagagattggaatatgccagttgatgatccgctgaatgcattcatcaaattgttaattccaacgaaaacatttttgaaaatattaccaatgataggtaagtttgtttttgtgtattcaataaaacgagttatcgaattttctccagctgcactattagcccagttagagaaagattgacctaatctatccaaccaatcagccgaccattgaaacagtggtgctaattgcgtgaatacattgactaatccgtcaccaaaaccacctgcagcacttaatagcttgttaaataccgaaacacccgttgtattcatcatattaaagaatcttgaagctacactgctattttcagcccatttaagcacgctttgagacgcttcttccattcctcttgaaataccactaaaaaacggttgtaagctctgcattgcagttttaacagtatttaaaccatttgcaagagttgtgaagatagcggattgattttgctttataatatcagtccatgctgactttacgccatctaacgcttttttgtattcgtttgttgctgagctagcttgtaaagtgccatcattaagcatctttatagcgctgatagccattgcgccaaacgctacaaatcctgctcccgctattgctacggcaccacctaaagcaagtacaccaccagttaacactttgatagcgtttaatagcgcaaatactacaggtactacgctcgctattacaggtattaagatactaaaagatgatgtaagtaatccaccaaccatattagaacctacagtaccgaacacacggaacatattagctaaattccccatctgtctttgaaaattgtcatttgcttttattatgtaggcataagctttctttaaaccattagtatcgacatctacctttgttgtttttttgttcggcaatgcgtctaatgattttttaaacgcataaatagttggtatagaaagccctgtatctacatcaagtcgagatctagttttgttcggaatacttttaagttcttctttagtacgtttgattttagagttagcaacaccattgtccacgtctataatagctttggctttagacctatttaatgcttcgagactagctttagatacttttaacactcgattgaatttactgttatctgcattgacgtcaatattgacacgtttcttttctaattctgataatttagcttctgtttcagcgatatctttaatcaacttttgtttttgcaacttaacttctggtgtaacttctttagagtttagtttgtctagttcaaaattcgattctagtaccttttgttgtaaatcttgtatactagcatctaatttagcttttacatttttgttactaaaggcatctaaagactttttagcaactttgatagttttttgtaaatttttatcgttagcgtttaattcaacatctttagtttgatctgctactcgtttaaatctttgcacagacttaaccgcactatcaatttgccttttgaatttggctacactagcttcaatagtcgctttaattttatattccgtcacattaacacctctctttctattgcttattaaattctgctataactttaaagaattcattattttgtggttcgtattcatcacgttcgctactaaatcttatatctttaccttcgttaagccgttggatattttcttcataaggcaatacgtcgtttgcattgttaaaaacatattcctctttaggtttattttctgtcccaacatttttagtagctgcagcatcacgaatagcaaacgcaagtttgtaacgttcgaattcttgggttagcatttcatactctttcgcatacattcgatagttatattctgttaatgtcatttgctcaataacgttcaaatctgtaataccaagtgttgacatacaagttataacgattctgtcgtaagttattaggcttccgctggtttttcttccgtttccactacttcgactaggtttcgggtcataggtcgctttcccaactccgttaaaatatccgaaccgaattcttctagtccgatattttctgcgatttcatctaatgcttcatcaatgttattaatagtaattgcttgtttttttaagtgagatgtagctgcgattaaaacttcgccaatcacaaccggatttccactttctaaacctacaggcaacattgatacaccttgaccgatagaagcttgttcaacttttaaacctaatcggttatcgatttctcttaaaaatttaaaaccaaaacttaattctaatgactttccgttaatttctacattcataacttaaaatctccattcataattaatttaaacaaaataaamargcttaacgccctatttttatacctctcttggtgcaaccggtggtgaatctactttaggttgtggaattgctgttaaatcttcgccagttaatgcatctgcttttgtagtgtcgtggaatctgtatccagtcgccttaagtttctttgttacagcctcaggtagtgttgcaaatccacgttggaaacgaccattcactccatattcatattcatattcatcaataccgttagcttctgcttttaattcaaatttattgtggaaaccttggaaatatttcgctttaaatttagcggaatccccatttttgcctggtattctactttcaacttcccaagcttcatacaatacgcgatctacaactgcatcttcaatttcatctgcaaaatcgtcaccataaaacattttagcagtaccagacattgttgactcaacagaaccaccagtgttataagaaccgtccattgtatcctctgtatctgtatcagcttcatgtgataagccgtattcagttaaaaaaagcattttagtagcatctactttttcgccagcttttctaaataaaataatacgatcattactatttttcatatttgccattcaatattcctccgttttttaaaatgttttgtaagatatcgttactgatgtgtgtagcaattcttgattggtagtatcatcaactaactgtgtgatgttagtatcttcttcttcaaagtcataatcgtttgttttaacgctaggtgttaaatcatcaatacatcttttaacaagtccgtcatgatgtcctaaatcatcgcttacactccaaatatcaataactaaattcgtatcgccagaataactatcaaacgtgtacttacttctatttgactccggcatttttattacaaaaaaaggatacggaatctcttgttgcatctctttacgagaaataacagggaatccatatccttgtagcgtttcatacgctttattataaagttgtaagttcggtgtcatgcttttatctcctattcaaacaacgctttcaattcttctacagttgatttcctaatcacttcgtataccggccacataaaaggttcagcctccatgtatcgagtaccaaattctaagaaaccactataagctgcgtgcgatgtgatagtgtattgcaaatcgccagtttttttatatctgatattgcgtgataaattacc

SEQ ID NO: 25 - DNA, 6251 bp; double-stranded, linear
aaacgcagatgttcaattagaaccagtctatcgtattaaggaaggtattaaacaaaagcaaatacgagaccaaattagacaagcgttaaatgatgtgacaattcatgaatggttaactgatgaactaagagaaaaatataaattagagaccttggactttactttgaacacattacatcatcctaaaagtaaagaggatttattacgtgctcgtagaacctatgcatttactgaactgtttttattcgaattacgtatgcaatggctaaatagattagaaaagtcatctgacgaagcaattgaaattgattatgacatagaccaagttaaatcatttattgatcgtttaccttttgaactaactgaagcacagaaatccagtgttaatgaaatttttagagatttaaaagcaccaatacgtatgcatcgattacttcaaggtgatgtaggttcaggaaaaacagtagttgctgcaatttgtatgtatgcgttaaaaactgctggttatcaatcagcattgatggtaccaactgaaattttagcagagcaacatgctgaaagtttaatggctttatttggagattctatgaacgttgcattgttaactgggtcagtaaaaggtaagaaacgaaagatacttttagaacaacttgaaaatggtacgattgattgtttaattggaacccatgctttgattcaagatgatgtgattttccataatgttggtttagtaattacagatgaacaacatcgatttggtgtgaatcaacgccagcttttaagagaaaaaggtgcaatgacgaatgtgttatttatgacagcaacgccgataccaagaacactagcaatatcagtttttggtgagatggatgtgtcttcaattaaacaattaccaaaaggtcgtaaacctatcattactacttgggcaaagcatgagcaatacgataaagttttgatgcaaatgacctcagagttgaaaaaaggtcgtcaagcatatgtcatttgcccgctaatagaaagttctgagcatctcgaagatgttcaaaatgttgtcgcattgtacgagtctttacaacagtattatggtgtttcccgtgtagggttattgcatggtaagttatctgccgatgaaaaagatgaggtcatgcaaaagtttagtaatcatgagataaatgttttagtttctactactgttgttgaagtaggtgttaatgtaccgaatgcaacttttatgatgatttatgatgcggatcgctttggattatcaactttacatcagttacgcggtcgtgtaggtagaagtgaccagcaaagttactgtgttttaattgcatcccctaaaacagaaacaggaattgaaagaatgacaattatgacacaaacaacggatggatttgaattgagtgaacgagacttagaaatgcgtggtcctggagatttctttggtgttaaacaaagtggattgccagatttcttagttgccaatttagttgaagattatcgtatgttagaagttgctcgtgatgaagcagctgaacttattcaatctggcgtattctttgaaaatacgtatcaacatttacgtcattttgttgaagaaaatttattacatcgtagttttgactaattgccatgctgatttgtcaatttgagtgcaacacttcgttaattgagtgatatgacacttgaactatttaaatgtaaagtggtattttaacaatttataaattttcgactaaataatagctaaatattacagttatttgttgagtcggttaaatagaaagtgttatgatatgtgaggaatgtttaagactaggtactaaaaaatgaggggtgagacgttgaaactaaagaaagataaacgtagagaagcaatcagacaacaaattgatagcaatcccttcatcacagaccatgaactaagcgacttatttcaagtgagtatacaaacaattcgtttagatcgcacttatttaaacataccagaattaaggaagcgtattaaattagttgctgaaaagaattatgaccaaataagttctattgaagaacaagaatttattggtgatttgattcaagtcaatccaaatgttaaagcgcaatcaattttagatattacatcggattctgtttttcataaaactggaattgcgcgtggtcatgtgctgtttgctcaggcaaattcgttatgtgttgcgctaattaagcaaccaacagttttaactcatgagagtagcattcaatttattgaaaaagtaaaattaaatgatacggtaagagcagaagcacgagttgtaaatcaaactgcaaaacattattacgtcgaagtaaagtcatatgttaaacatacattagttttcaaaggaaattttaaaatgttttatgataagcgaggataaaattatggttaaattagcaattgatatgatgggtggcgacaatgcgcctgatatcgtattagaagccgtacaaaaggctgttgaagactttaaagatctagaaattatacttttcggtgacgaaaaaaagtataatctgaaccatgaacgaatcgaatttagacattgttctgaaaagattgaaatggaagatgagcctgttagagcgattaaacgtaaaaaagatagctcaatggtaaaaatggctgaagctgtgaaatctggtgaagcagatggatgtgtgtcagcaggtaatactggtgctttaatgtcagctggtttattcattgttggacgtattaaaggtgtagctagaccggctttagtagtaacattgccaacgattgatggaaaaggttttgtctttttagacgttggtgcaaatgctgatgctaaacctgaacacttattacagtatgcgcaactaggggatatttatgctcaaaaaattagaggtattgataatccgaaaatctcattattaaatataggaaccgagccagctaaaggtaatagtttaacgaaaaaatcatatgagttattaaatcatgatcattcattgaattttgttgggaatattgaagcgaagacattaatggatggcgatacagatgttgtagttaccgatggctatactgggaacatggtccttaaaaatttagaaggtactgcaaaatcaatcggtaaaatgttaaaagatacgattatgagtagtactaaaaataaattagcaggtgcaatattgaagaaagatttagctgaattcgctaaaaagatggattactcagaatacggtggttccgtattattaggattggaaggtactgtagttaaagcacacggtagttcaaatgctaaagctttttattctgcaattagacaagcgaaaatcgcaggagaacaaaatattgtacaaacaatgaaagagactgtaggtgaatcaaatgagtaaaacagcaattatttttccgggacaaggtgcccaaaaagttggtatggcgcaagatttgtttaacaacaatgatcaagcaactgaaattttaacttcagcagcgaacacattagactttgatattttagagacaatgtttactgatgaagaaggtaaattgggtgaaactgaaaacacacaaccagctttattgacgcatagttcggcattattagcagcgctaaaaaatttgaatcctgattttactatggggcatagtttaggtgaatattcaagtttagttgcagctgacgtattatcatttgaagatgcagttaaaattgttagaaaacgtggtcaattaatggcgcaagcatttcctactggtgtaggaagcatggctgcagtattgggattagattttgataaagtcgatgaaatttgtaagtcattatcatctgatgacaaaataattgaaccagcaaacattaattgcccaggtcaaattgttgtttcaggtcacaaagctttaattgatgagctagtagaaaaaggtaaatcattaggtgcaaaacgtgtcatgcctttagcagtatctggaccattccattcatcgctaatgaaagtgattgaagaagatttttcaagttacattaatcaatttgaatggcgtgatgctaagtttcctgtagttcaaaatgtaaatgcgcaaggtgaaactgacaaagaagtaattaaatctaatatggtcaagcaattatattcaccagtacaattcattaactcaacagaatggctaatagaccaaggtgttgatcattttattgaaattggtcctggaaaagttttatctggcttaattaaaaaaataaatagagatgttaagttaacatcaattcaaactttagaagatgtgaaaggatggaatgaaaatgactaagagtgctttagtaacaggtgcatcaagaggaattggacgtagtattgcgttacaattagcagaagaaggatataatgtagcagtaaactatgcaggcagcaaagagaaagctgaagcagtagtcgaagaaatcaaagctaaaggtgttgacagttttgcgattcaagcaaatgttgccgatgctgatgaagttaaagcaatgattaaagaagtagttagccaatttggttctttagatgttttagtaaataatgcaggtattactcgcgataatttattaatgcgtatgaaagaacaagagtgggatgatgttattgacacaaacttaaaaggtgtatttaactgtatccaaaaagcaacaccacaaatgttaagacaacgtagtggtgctatcatcaatttatcaagtgttgttggagcagtaggtaatccgggacaagcaaactatgttgcaacaaaagcaggtgttattggtttaactaaatctgcggcgcgtgaattagcatctcgtggtatcactgtaaatgcagttgcacctggttttattgtttctgatatgacagatgctttaagtgatgagcttaaagaacaaatgttgactcaaattccgttagcacgttttggtcaagacacagatattgctaatacagtagcgttcttagcatcagacaaagcaaaatatattacaggtcaaacaatccatgtaaatggtggaatgtacatgtaatatatttgagctaaagctcattgacgcagtggttgactggtcatccaatggagaattgtctgacctagtcaactttgcgggggaaattctaagcaacctagataaggttccagaatttctccctaagaaacactaatcaataaattgwtaagtgtttctaaaatttctacttgttttttagaatttaaaatgggaaaatatagtagtctatgtataggcatttttaaaggaggtgaatcgacgtggaaaatttcgataaagtaaaagatatcatcgttgaccgtttaggtgtagacgctgataaagtaactgaagatgcatctttcaaagatgatttaggcgctgactcacttgatatcgctgaattagtaatggaattagaagacgagtttggtactgaaattcctgatgaagangctgaaaaaatcaacactgttggtgatgctgttaaatttattaacagtcttgaaaaataataaatcttacatctgggtcgtcagtattgtcgactcagtttttttctttaattatcaatagttttaacgtaaaattaaagatgattcaagagcaacacataaaggagataaaataatgtctaaacaaaagaaaagtgagatagttaatcgttttagaaagcgctttgatactaaaatgacagagttaggctttacttatcaaaatattgatttataccaacaagcattttcgcattcgagttttattaatgattttaatatgaatcgtttagaccataatgagcgtttagagtttttgggtgatgcggtattagaattgacggtttcacgatatttatttgataaacatcccaacttgccagaagggaatttaacaaaaatgcgtgccactattgtatgtgagccctcactkgtaatatttgcgaataaaattggattgaacgaaatgattttacttggtaaaggtgaagagaaaacagggggacgtacaagaccatcattaatatcagatgcattcgaagcatttattggggcattgtatttggatcaaggactagatatagtttggaaatttgctgagaaagtcattttcccacatgtagaacaaaatgagttattaggcgtggtagattttaaaacacaattccaagaatatgtgcaccagcaaaataaaggtgatgtaacctataatttaataaaagaagagggaccggcacatcatcgtctattcacttca

SEQ ID NO: 26 - DNA, 4920 bp; double-stranded, linear
acctactgaagttgctaattttttggagcaactaagcactgaaattgaacgtcttaaagaagataaaaaacaacttgaaaaagtaatcgaagagagagatactaatattaagtcttatcaagacgtggcatcaatctgtaagtgatgctttgatacaagctcaaaaagctggtgaagaaactaagcaagctgcagagaaacaagctgaagcgattatagctaaggcagaagcgcaagctaatcaaatggttggtgacgcggtagaaaaagcacgccgtttagcattccagactgaagatatgaaacgtcaatcaaaagtatttagatcgcgtttccgtatgttagttgaagcgcaattagacttattaaaaaacgaagattgggattacttgttgaattatgatttagacgctgaacaagtgacgcttgaaaatattcatcatttgcatgaaaatgatttaaagccagatgaagttgcagcaaatgcacaaaataatgcatcaaatacaccagacaataatcaacaatccaatgattcagaaacaactaagaagtaagaattaaataaagacagacgcgtaatatacatttaacttttcacagcgaattaggtaatggtgagagcctagtaaaagcatgtatgttatatcactggctttttaatatttaaataatgtaatgagagaactctaagttgagttaataagggtggtaccgcgagcaatcgtcccttttaatttaacttagagttttttaaatttttaaggagtgaaaaaaatggattacaaagaaacgttattaatgcctaaaacagatttcccaatgcgaggtggtttaccaaacaaggaaccgcaaattcaagaaaaatgggatgcagaagatcaataccataaagcgttagaaaaaaataaaggtaacgaaacattcattttacatgatggcccaccatacgcgaatggtaacttacatatgggacatgccttgaacaaaattttaaaagactttattgtacgttataaaactatgcaagggttctatgcaccatacgtaccaggttgggatacacatggtttaccaattgaacaagcattaacgaaaaaaggtgttgaccgaaagaaaatgtcaacagctgaattccgtgagaaatgtaaagaatttgctttagaacaaattgaattacagaaaaaagattttagacgtttaggtgttcgtggtgactttaatgatccatatattacattaaaacctgaatacgaagctgcacaaattcgtatttttggagaaatggcagataaaggtttaatttataaaggtaaaaagccagtttattggtctccttcaagtgagtcttcattagcagaagcagaaattgaatatcacgataaacgttcagcatcaatttacgttgcatttgacgttaaagatgacaaaggtgtcgttgatgcagatgctaaatttattatctggacaacaacgccatggacaattccatcaaatgttgcgattaccgttcatcctgaattaaaatatggtcaatacaatgtaaatggcgaaaaatatattattgcagaagccttgtctgacgctgtagcagaagcactggattgggataaagcatcaatcaaattagaaaaagaatacacaggtaaagaattagagtatgttgtagcacaacatccattcttagacagagaatcgttagtgattaatggtgatcatgttactacagatgctggtacaggttgtgtacatacagcaccaggtcacggggaagatgactatattgttggtcaaaaatatgaattgccagtaattagtccaatcgatgataaaggtgtatttactgaagaaggcggccaatttgaagggatgttctatgataaagctaataaagccgttactgatttattaacagaaaaaggtgcactattaaaattagactttattacacatagctatccacacgactggagaacaaaaaaacctgtaatcttccgtgctacaccacaatggtttgcctcaatcagtaaagtaagacaagatattttagatgcaatcgaaaatacaaacttcaaagtaaattggggtaaaacacgtatttacaatatggttcgtgaccgtggcgaatgggttatttctcgtcaacgtgtgtggggtgtaccgttaccagtattttatgctgaaaatggcgaaattatcatgacgaaagaaacagtgaatcatgttgctgatttatttgcagaacacggttcaaatatttggtttgaaagagaagcgaaagacttactaccagaaggatttacacatccaggcagccctaacggtacatttactaaagaaacagacattatggacgtttggtttgattctggttcatcacaccgtggcgtgttggaaacaagaccggaattaagtttcccagcggatatgtatttagaaggtagtgaccaatatcgtggttggttcaactcttctatcacaacttcagttgctacaagaggagtatcaccttataaattcttactttctcatggttttgttatggacggtgaaggtaagaaaatgagtaaatctttaggtaatgtgattgtacctgaccaagtggttaaacaaaaaggtgctgatattgcgagactttgggtaagtagtacggactatttagctgatgttagaatttctgatgaaattttaaaacaaacatctgatgtttatcgtaaaatcagaaatacattaagatttatgttaggtaacattaacgatttcaatcctgacacagatagcattcctgaatcagagttattagaagtggatcgttacttgctaaatcgtttacgtgaatttactgcaagtacgattaacaactatgaaaactttgactacttaaatatttatcaagaagttcaaaactttatcaatgttgagttaagtaatttctatttggattacggtaaagatattttatatattgaacaacgtgattctcatatccgtcgtagtatgcaaacagtgttatatcaaattttagttgatatgacgaagttgttagcaccaatcttagtgcatacagctgaagaagtttggtctcatacaccacatgttaaagaagaaagtgttcacttagcagacatgcctaaagttgtagaagtagatcaagctttattggataaatggcgtacatttatgaatttacgtgatgatgtgaaccgtgcattagaaactgctcgtaatgaaaaagttattggtaaatcattagaagctaaagttacgattgctagtaacgataaatttaatgcatctgaattcttaacttcatttgatgcattacatcaattatttatcgtgtcacaagttaaagttgtagataagttagacgatcaggcaacagcttatgaacatggtgatattgtcatcgaacatgcagatggtgaaaaatgtgaaagatgttggaactattcagaggatcttggtgctgttgatgaattgacgcatctatgtccacgatgccaacaagttgtaaaatcacttgtataattgaaattgtataaagtactcatacagatgatataaattaaagctctcttcataatcatgttgtagtttttgttgacatgatgaagagagtttttttgtgaataaaaaaatgaccaagttaccggtcatatatgtaaaaaatgtgcgatttactaaaataaaaattattcaggaatggtacaaattctctgaggcatataaatgcgttatagttgctattctcaattatgttcgcgataattttaagtaaaagtaagcacagatattgaatttgataggagttaattgaatgtatcataacagtaacgcaaactttgtcaatggtatcactttaaatgtgagagataagaatgaattaaagccattttatgaggacatattaggattaaatattataaatgagacattaacatcgatacaatatgaagtaggtcaaaataatcatgtcattacacttgttgaattacaaaatggacgtgaacctttaatgtccgaagcgggactgtttcatatcgcaattaaactacctcaaattagtgatttagctaatttactaattcatttaagcgaatatgatattccagttaacggaggtatacagcctgcttcgttatcattattttttgaagacccggaaggaaacggttttaaattttatgttgataaagacgaagcgcaatggacgaggcaaaataatttagtaaaaattgatattagaccattaaatgtaccgagattagtgagtcatgcaacaaaattgttatggttaggtattccagatgacgctattataggtgcattgcatattaagacaattcatttatcagaggtaaaagagtactacctcgattattttggattagagcaatcggcatatatggatgattattcaatatttttagcatcgaatggctattatcaacatttggccatgaatgattgggtatcagcaacgaaacgtgtagaaaattttgatacgtatggattagcaattgttgactttcattatcctgaaacaacacatttaaatttacaaggtccggatggtatctattatcgctttaatcatatcgaagttgaagattagtatatactttgaatggacgaaccatataatgaatcgtttttaatgatctttttatacaagttatgaaggaggctgggacattaagttcttaggcaatgtaaaaagctgatttctattaattatttgatagaaatcagcttttttgatatgtattttataatgtacagctcgttgagctgctattttccttatattaattgccattaatacaaaacctagctctcgtttaactttatttattcctcgaactgacattcgngtgaactcaaaatngcctacttncttaaattaccaatatctat

SEQ ID NO: 27 - DNA, 626 bp; double-stranded, linear
tggattgccattacatggacaagatttaactgaatcaattacaccatatgaaggtggtatcgcttttgcaagtaaaccattaattgatgctgattttattggtaaatctgtattaaaagatcaaaaagaaaatggtgcaccaagaagaacagtgggattagaattacttgaaaaaggaattgcaagaactggttatgaagttatggatttagatggaaatattattggagaagtaacttcaggaacacagtctccatcatcaggaaaatcaattgcacttgcaatgataaaaagagatgagtttgaaatgggtagagagttgcttgttcaagttcgtaagcgtcaattaaaagcgaaaattgttaagaaaaatcaaattgataaataattaaaaaggggtgtgcattgtgagtcatcgttatatacctttaactgaaaaagacaagcaagaaatgttacaaacaattggtgcaaaatctataggagaattattcggtgatgtaccaagtgacattttattaaatagagatttaaatattgctgaaggcgaacggagaacaacgttacttagaagattnaatcgcattgcaagcaagagtatcactagaggaacgcgtacatcgttt

SEQ ID NO: 28 - DNA, 1126 bp; double-stranded, linear
nggaagtggtgtatatatttgtaatgagtgtattgaattatgctcagaaatcgtcgaagaagaattagctcaaaacacttctgaagcgatgacagaattacctactcctaaagaaattatggatcatttaaacgaatatgttattggtcaagaaaaagctaaaaaatctttagctgtagctgtttataaccactataagcgtattcaacaattaggaccaaaagaagatgatgttgaattacaaaaaagtaacattgcattaattgggccaacaggtagtggtaaaacattattagctcaaaccttagccaagacgttgaatgtaccatttgcaattgcagatgcgacaagtttaactgaagctggttatgtaggcgatgatgttgaaaatatcttgttgagattaattcaagcagctgactttgacattgataaagccgaaaaaggtattatttatgtagatgaaattgataaaattgcacgtaaatctgaaaacacatctataacacgtgacgtttcaggtgaaggtgttcaacaagcattgcttaaaatcttagaaggtacgactgcaagtgttccgccacaaggtggacgcaaacatccaaaccaagaaatgattcaaattgatacaacaaatatcttatttattcttggtggtgcctttgatggtattgaagaagtgattaagcgccgtcttggtgaaaaagttattggtttctcaagcaatgaagctgataaatatgacgaacaagcattattagcacaaattcgcccagaagatttgcaagcctatggtttgattcctgaatttatcggacgtgtgccaattgtagctaatttagaaacattagatgtaactgcgttgaaaaacatcttaacgcaacctaaaaatgcacttgtgaaacaatatactaaaatgctggaattagatgatgtggatttagagttcactgaagaagctttatcagcaattagtgaaaaagcaattgaaagaaaaacaggtgcgcgtggtttacgttcaatcatagaagaatcgttaatcgatattatgtttgatgtgccttctaacgaaaatgtaacgaaggtagttattacagcacaaacmattaatgragaactgaaccag

SEQ ID NO: 29 - DNA, 4392 bp; double-stranded, linear
attgacttcttagcaatnaatatgagtgaagaacgtactgttgaagtaccagttcaattagttggtgaagcagtaggcgctaaagaaggcggcgtagttgaacaaccattattcaacttagaagtaactgctactccagacaatattccagaagcaatcgaagtagacattactgaattaaacattaacgacagcttaactgttgctgatgttaaagtaactggcgacttcaaaatcgaaaacgattcagctgaatcagtagtaacagtagttgctccaactgaagaaccaactgaagaagaaatcgaagctatggaaggcgaacaacaaactgaagaaccagaagttgttggcgaaagcaaagaagacgaagaaaaaactgaagagtaattttaatctgttacattaaagtttttatactttgtttaacaagcactgtgcttattttaatataagcatggtgctttttgtgttattataaagcttaattaaactttattactttgtactaaagtttaattaattttagtgagtaaaagacattaaactcaacaatgatacatcataaaaattttaatgtactcgattttaaaatacatacttactaagctaaagaataatgataattgatggcaatggcggaaaatggatgttgtcattataataataaatgaaacaattatgttggaggtaaacacgcatgaaatgtattgtaggtctaggtaatataggtaaacgttttgaacttacaagacataatatcggctttgaagtcgttgattatattttagagaaaaataatttttcattagataaacaaaagtttaaaggtgcatatacaattgaacgaatgaacggcgataaagtgttatttatcgaaccaatgacaatgatgaatttgtcaggtgaagcagttgcaccgattatggattattacaatgttaatccagaagatttaattgtcttatatgatgatttagatttagaacaaggacaagttcgcttaagacaaaaaggaagtgcgggcggtcacaatggtatgaaatcaattattaaaatgcttggtacagaccaatttaaacgtattcgtattggtgtgggaagaccaacgaatggtatgacggtacctgattatgttttacaacgcttttcaaatgatgaaatggtaacgatggaaaaagttatcgaacacgcagcacgcgcaattgaaaagtttgttgaaacatcacgatttgaccatgttatgaatgaatttaatggtgaagtgaaataatgacaatattgacaacgcttataaaagaagataatcattttcaagaccttaatcaggtatttggacaagcaaacacactagtaactggtctttccccgtcagctaaagtgacgatgattgctgaaaaatatgcacaaagtaatcaacagttattattaattaccaataatttataccaagcagataaattagaaacagatttacttcaatttatagatgctgaagaattgtataagtatcctgtgcaagatattatgaccgaagagttttcaacacaaagccctcaactgatgagtgaacgtattagaactttaactgcgttagctcaaggtaagaaagggttatttatcgttcctttaaatggtttgaaaaagtggttaactcctgttgaaatgtggcaaaatcaccaaatgacattgcgtgttggtgaggatatcgatgtggaccaatttcttaacaaattagttaatatggggtacaaacgggaatccgtggtatcgcatattggtgaattctcattgcgaggaggtattatcgatatctttccgctaattggggaaccaatcagaattgagctatttgataccgaaattgattctattcgggattttgatgttgaaacgcagcgttccaaagataatgttgaagaagtcgatatcacaactgcaagtgattatatcattactgaagaagtgatcagccatcttaaagaagagttaaaaactgcatatgaaaatacaagacccaaaatagataaatcagtgcgcaatgatttgaaagaaacgtatgaaagctttaaattattcgaaagtacatactttgatcatcaaatactacgtcgcttagtagcgtttatgtatgaaacaccttcgacaattattgagtatttccaaaaagatgcaatcattgcagttgatgaatttaatcgtattaaagaaactgaagaaagtttaacagtagagtctgattcgtttattagcaatattattgaaagtggtaatggatttataggacaaagttttataaaatatgatgattttgaaacattgattgaaggctatcctgtcacttatttttcattattcgctacaacaatgccgataaaactaaatcatattattaaattttcatgtaaacctgtccaacaattttatgggcaatatgacattatgcgttctgaatttcaacgatatgttaatcaaaactatcatatcgtggttttggtcgaaaccgaaactaaagttgaacgtatgcaagcgatgttaagtgaaatgcatattccatcaataacaaaattgcatcgctcaatgtcatcggggcaagcagtgattattgaaggcagtttatctgaaggatttgaactacctgatatgggattagttgtcattactgagcgtgagctttttaaatcaaaacagaaaaagcaacgaaaacgtacgaaagctatctcaaatgctgaaaaaattaagtcttaccaagatttaaatgtgggagattatattgttcatgtgcatcatggtgttggtagatatttaggtgttgagacgctcgaagtggggcaaacgcatcgtgattatattaaattgcaatataaaggtacggatcaactatttgttccagtagatcaaatggatcaagttcaaaaatatgtagcttcggaagataagacgccaaaattaaataaactcggtggcagtgaatggaaaaaaacaaaagctaaagttcaacaaagtgttgaagatattgctgaagagttgattgatttatataaagaaagagaaatggcagaaggttatcaatatggggaagacacagctgagcaaacaacatttgaattagattttccatatgaacttacgcctgaccaagctaaatctatcgatgaaattaaagatgacatgcaaaaatcgcgtccaatggatcgcttgctatgtggtgatgttggttatggtaaaactgaagttgcagtgagagcagcattcaaagctgtaatggaaggaaagcaggttgcatttttagttcctacaactattttagctcagcaacattatgagacgttaattgagcgtatgcaagattttcctgttgaaattcaattaatgagtcgttttagaacgcctaaagagataaaacaaactaaggaaggacttaaaactggatttgttgacatagttgttggtacacacaaattacttagtaaagatatacagtataaagatttagggctgttgattgtagatgaagaacaacgatttggtgtacgccataaagagcgtattaaaacattaaaacataatgtagatgtactaacattgactgcaaccccaatacctagaacattgcatatgagtatgctaggtgtgcgggatttgtcagtgattgaaacgccgccagaaaatcgtttcccagttcaaacatatgtattagaacagaacatgagttttatcaaagaagctttagaaagagaactatcccgtgatggccaagtgttttatctttataataaagtgcaatccatttatgaaaaacgagaacaactccagatgttaatgccagatgctaacattgcagttgctcatggacaaatgacagagcgcgatttagaagaaacgatgttaagttttatcaataatgaatatgatattttagtaacgacgacgattattgaaacaggtgtcgatgtcccaaatgcaaatactttgatcattgaagatgcagatcgctttggattgagtcagttgtatcaattaagaggtcgtgttggtcgttcaagtcgtattggttatgcatacttcttacatccagcaaataaggtactaactgagactgcagaagatcgattacaagcgattaaagaatttacggagttaggctcaggatttaagattgcgatgcgtgatttgaacattcgtggtgctggtaatttgttaggtaaacaacagcacggctttattgatacagttggatttgatttgtacagtcaaatgttagaagaagctgtaaatgaaaaacgtggtattaaggaaccagaatctgaggtgccagaagtcgaagttgatttaaacttggatgcatatttgccaacagaatatattgcaaatgaacaagctaaaattgaa

SEQ ID NO: 30 - DNA, 729 bp; double-stranded, linear
tttcttttgaatctatatcgaggtggttggtaggttcatctaaaataagtacattgtcacgttgcaacataagtagtgctagttgtaaacgtgctttttcaccaccagataaatcattaattatctttttaacatcgtcttgtacaaataagaaacgtccaagaactgctcgaatatctttttcattcattaacggatattgatcccacacataatctaaaatcgttttactagatttaaattctgcttgcttttgatcataataaccaatttgtaaatttgcgccgaaagtaatatcgccattaagcgctttttgttgattagcaatagttttaattaaggtcgattttccaataccatttggcccaatgattgctatatgatcgcctttagagacctctatactcataggtttggtaattgcagtttgataaccgatttctaaattttttacatgcatgacgtcattacctgtattccggtcaaagccaaattgaatatttgcacttttggcatctaacattggtttatcaatgcgttccattttttctaaaatcttacgtctactttttgccattccacttgttgaagcacgggtaatatttttctcaacaaaagtttctaatcgttttatttctgcttgttgactttcatattcttgcattcgtttttgataatataaatcccgttgctgtataaattcctcgtaattaccaacatagcgtttga

SEQ ID NO: 31 - DNA, 13856 bp; double-stranded, linear
aatgccatcgttttatcatctagtactattgaatgtgcatcatcttgcccatgtgcatcttgatgtttcgatacatttgttgcaccttgtggatatactttaaaggttgtgtcgtatgtttccttactatctttagcttcagattcctgtgattcaaccgttttatatttttcaagtgcatgtccttcaatatcaactcgtggaataatgcgattcaaccatgctggtaaataccacgaaccttttccaaacaatttcgttaatgcaggaattaacatcattctgactacgaaggcatcaaagagtacaccaaacgctaatgccatacccattgatttaatcatgacatcttcttggaatacaaacgcaaagaagacactaaacataattaatgcagctgctacaataacaggaccgctttctttcaatcctactttgatagaataatcattatcccctgttttactatmyycttcatgrattcgcgacataaggaagacttcataatccatcgctaatccaaataagatacctatagtaataaccggtaaaaatgctagcattggtcctgtcgtttcaataccaaacagacctttcataaaaccatcttgcattactaatgttgtaaatcctaatgttgccattaatgacaagacgaatcctaaaactgcttttaatggtattagaattgaacggaagacaatcattaataagaaaaatgctaatacaacaatgactgaggcaaataaaggtatcgcctcatttaactttttagacatatcaatattaatgacactttgtcccgaaatctccgttttgaacccatatttatcttgtgcatctttatgataatctcgtaaatcatgcactaaatcatttgtactctctgcattaggcccttgcttaggtatcacgaccatcaaagcgtaatcattatctttactcatttgtggtggcgtaacgatatctacatttttcttatctttaatatctttatatacagactgtaaatcttgttgtaatccttgtggatcatcctttttatctttcacatttatcaacatcggtatttggccattaaatccttcaccaaatttatccgagataatatcgtaagcttttttctgtgtagaatctgctggtttaacaccgtcatctggaataccaagtcgcatatgactaactggtattgcagctgctactaatatgattaaacctagtaatactgccgcaagtgcatttcctgtaataaatttagaccatggcgtatcaatatcttttttgaatttagactgtaatttattcactttaatgcgtttatggaaaatgcttattaatgcaggtaataaagttaaagcgctaagtactgcaaaaacaacactaattgccgaagcaaatcccattaccgctaagaagtcaatgcctactaatgataaaccacatactgcaattacaactgttacaccagcaaaaacaactgcactacctgctgttcctattgcaagaccaatgcctttaatgtaatctgtttcagttttcataacttgtcgatatctgaataaaataaataatgcataatcgataccaactgctagtccaatcattacggctaatgtcagtgtgacatttggtatatcgaatgcataagttaacaaactgataatacctacaccagaggctagaccaatcaatgcacttataattggtaatcctgcagcaatgactgaaccgaatgtgattaacagtacaacaaatgcaacaataataccaactagttcagaattaccgcctacttctgtagatgtcattcctgtaccagttaactctgtttgtacattatgattgtcacgtaagtctttcaaatgacttttaacattatctctagagccatcttttaaagatgtttgactaacgtcatatgtgatatctgcaaatgcagttgttttatctttactaatttgcttattttcataaggatctgatattttatcaatgtgcttgtcatcttttttaatatcatctaacgttttcttaatatctttagtaatgttcggttgcacaataccatcatctttagtcgtcttaaagacaacacgtatttgtgccttttcactatcttgattaaaatgtttttcaatctttttattcgtatctaacgactctaatcctgtcattttaatatcattgtcaaatttcggtgcatttgtagcaagtggtatcaatattgcagctacaatcactatccatgcaatgaccgcggaccatttatgttttgcgatgaatgtccccatcttatataaaaattttgccaaagtatattgcctccttttaaaatcaacgttatagtttaaatatacagtgtagattattgttcgattatagtatctatccccgacctcttaaagaatcaattggaaaattttgtatattaaactacacacaaaggagaaatgtagatgaaagagactgatttacgagttataaagacaaaaaaagcattgtcgagtagcttgctacaattgttagaacagcaattattccaaacgattactgtcaatcaaatttgcgacaacgcactcgtacaccgtacaacattttataaacatttttatgataaatatgatcttctagagtacttgttcaatcaattgactaaagactactttgctagagatatcagtgaccgtcttaatcatccattccaaacgatgagtgatacgattaataataaagaggatttgagagaaatcgcagaattccaagaagaagacgctgaatttaataaagtattaaaaaatgtctgcattaaaattatgcataacgatatcaaaaataatagagaccgtatcgatattgacagcgacatcccagataatctcatattttatatttatgactcgttgattgaaggttttatacattggataaaagatgaaaaaattgattggcctggcgaagatattgataacattttccatagattaatcaatattaagattaaatagtagatgagaaactcatgagcgttaccaacattcataataaaaacgatagtgkacacgttaatgaattcgtgtactactatcgttttttatttttatcgtgcttatcgctattaaaacaactgatacacaacacataaactatgaagaaaaaaataaatccgctatctaaatgactttgactcagttgtttaaatgaccaaattgctaatacaattcccattattattgaaataacgtatctcacattcttatacctataatccttttctaaaaatatggttgctattacttaatttttaaagttataaataaaaagagccaaccgcaatggatggcccttgttcattatgaagcattagaacatttctgaaacaaccttttgttctaagaagtgtaataagtagtctggactacctgttttagcgtccgtacctgacattttgaaaccaccaaatggatggtatccaacaactgctgaagtacagcctctgttaaggtataaattgcctacatcaaattcgtttaccgctttaatccaatgctcgcgattatttgtaatcactgcaccagttaaaccgtaatctgtatcatttgcaacctcaattgcttcatcaaaatcgttaactttcacaaagccaacaactggaccaaaaatttcttcttgcatgattctatctttagatttaagtcctgaaatgattgttggttctacaaagtaaccttttgaatcatcagtgccgccaccttgttctaatttaccttcttctttaccaatctcaatataatttttaatcttatcaaattgttttttattaataactgggcccatatacgtattgtctacagtattgcccaacgttaattcttttgttaatttgattgatttctctaatacttcgtcataaacgtctttatgcacaattgcacgtgaacatgctgaacatttttgaccagaaaaaccaaatgctgacgttacaatagcttctgctgccatatctgtatcaatattttcatcaactacaatggcatctttaccacccatttcagcgataacacgtttcaagaagttttgaccttcttgaacaacggcactacgttcataaattctagtacctgtcgcacgtgatcctgtaaatgtaacgaaatgcgtatctttatgatcaactaagtaatcaccaatttctttcggatcaccaggaacaaagttaactacgccttttggtaatcctgcttcttctaaaatttccattaatttataagcgatataaggtgtatcctcagcaggtttcaataacactgtattacctgccacaactggtgctaaagttgtaccagccataatcgcaaacgggaagttccacggcggaattgtaacacctgtaccaattgatttatagaaatatttattgtgttcaccttcacgatcaagtactggcttaccttgagccaagtccatcattgaacgtgcatagtattcaataaaatcaataccttcagctgcatcaccaactgcttcatcccatggcttacctgcttcataaaccataattgctgcaatttccgcttttcgacgacgaataattgccgaaacacgtaacataagctctgcacgatcatttgctgaccatgttttccaagatttataagcttcgtttgctgctttaaacgcatcttcaacatcttgttttgttgcctttgatgcatttgcaatcacttgtgatgtgtctgcaggattgattgatttaattttgtcatctttgaaaatcttctctccattaatcactaatggtatgtcttgacctaattctttttccacgtctttcaatgctttcttaaacatatccacattttcttggactgaaaaatcgtaaccaggttcatttttaaattctactaccatgtacacttaccccctataaattttgaaagtggtttaaccctttgatttaatgatataacatcatttaaactcattttactatgattaaggttagttttgcaatcgctttcatttttatgttttatcacttattctcaagtattttgaaattgattggttactttttaaaatttatatgggtcgcaactgctactttatcgtttcgtcatttaatgtttcggatggtaggtcattatcaattttacgaacgactttacaagggtttccaaccgctaagctgtgtggcggaatatctttagtgacaacactaccagcaccaatcacactgccttctccaatcgtcacccctggtaacacggctacatgaccgccaaaccaagtattactgccaatatgaatgggtccggctttttcaaaaccttcatttctatgatggaaattaagtggatgtgtcgctgtgtagaatccacaattaggtcctataaaaacattatcgccaattgtaatctgtccaccatccataaagtaacaattggtgtttacatagacattttttcctagtttaacgttccaaccataatctgtatcaaaaggaatcgaaatacttacattgtctgttgttgtttgaaataattgatcaattaattcctttcttttatttgtagcactcggtcttgtatgatttaattcaaagcaaatatctttcgctcgtgcacgttcattgattaagtattgatcaaagtttgcatcgtaccatttttctgctaacattttttctttttcagtcattacacctttcaactcctaataacttatttacttgtttaaaagttaatcaaataaaccttcgcctatgcaactaatacgctataacattatgaaatcatgaccttatcacccttatctatacaattctcgcatcaaatactgctaaagtagtagataaattcaatactacagacgcattcattttttaatctattaacgtacaatgtgagtaagagaaatataaaggagtatgatagcgatgagaatattaattacaggcacagttgctatcttaatcattctaggtttggtcaaaacgatacaagattacgaaatgacaaacgacacgagtcgtcagttgtcagacaacaaagatgatgataaagtcatccatcttaataattttaaaaatttacatgcgaaagaatttaacccatctgatttcttttaagtcacctaagaattgcaaatccagaagtcatttaagttttacctttcattcatacatcctttaatattaattacgacttcttttatatagatgctaagtagagagattgttgtgcaatgtttgcacggcaatctctctttttctttttaaaattggtaaaagtaaaacgcaacgattgacttatatacctatagggggtacattagacgtgtaacaatgaatcacagggaggcaataatgtggctaatacgaaaaaaacaacattagatatcactggtatgacttgtgccgcatgttcaaatcgtatcgaaaagaaactgaataaacttgatgacgttaatgcccaagtgaatttaactacagagaaagcaactgttgagtataaccctgatcaacatgatgtccaagaatttattaatacgattcaacatttaggttacggtgtcgctgtagaaactgtcgaattagacattacaggtatgacttgtgctgcatgctcaagccgtattgaaaaagtgttaaataaaatggacggcgttcaaaatgcaacggtcaatttaacaacagagcaagctaaagttgactattatcctgaagaaacagatgctgataaacttgtcactcgcattcaaaaattaggttatgacgcgtctattaaagataacaataaagatcaaacgtcacgcaaagctgaagcgctacaacataaattgattaagcttatcatatcagcagtattatctttaccactattaatgttaatgtttgtacatcttttcaatatgcatataccagcactatttacgaatccatggttccaatttattttagctacacctgtacaatttattattggatggcaattttatgtaggtgcttataaaaacttaagaaatggtggcgccaatatggatgtacttgttgctgttggtacaagtgcagcatatttttacagtatttatgaaatggttcgttggctaaatggctcaacaacgcaaccgcatttatactttgaaacaagcgccgtactaattaccttaatcttattcggtaagtatttagaagctagagcgaagtctcaaacaaccaatgcgcttggcgaattattaagtttacaagctaaagaagcacgcattttaaaagatggtaatgaagtgatgattcctctaaatgaagtacatgttggagatacacttatcgttaaaccaggtgaaaagatacctgttgatggcaaaattattaaaggtatgactgccatcgacgaatctatgttaacaggtgaatctatccctgttgagaagaatgttgatgatactgtaattggttcaacgatgaacaaaaacggtactattactatgacagcaacaaaagttggcggggacactgcgttggcaaatattattaaagttgtcgaagaagctcaaagttctaaagcgccgattcaacgattggcagatattatttctggttatttcgttcctatcgttgttggtatcgcactattaacatttatcgtgtggattactttagttacaccaggtacatttgaacctgcacttgttgcgagtatttccgttctcgtcattgcttgtccatgcgcattgggacttgctacaccaacttctattatggtaggtactggtcgcgctgctgaaaatggtattttatttaaaggtggcgagtttgttgaacgcacacatcaaattgataccatcgttttagataagacgggtaccattacaaatggtcgtccagtcgtgacagattatcatggtgacaatcaaacgctacaactacttgctactgctgaaaaagattctgaacacccattggcagaagccattgtcaattatgcaaaagaaaagcaattaatattaactgagacaacaacatttaaagcagtacctggccatggtattgaagcaacgattgatcatcaccatatattggttggtaaccgtaaattaatggctgacaatgatattagcttgcctaagcatatttctgatgatttaacacattatgaacgagatggtaaaactgctatgctcattgctgttaattattcattaactggtatcatcgcagtggcagatactgtcaaagatcatgccaaagatgctataaaacaattgcatgatatgggcattgaagttgccatgttaactggcgataataaaaacactgctcaagccattgcaaaacaagtaggcatagatactgttattgcagatattttaccagaagaaaaagctgcacaaattgcgaaactacagcaacaaggtaagaaggttgcgatggttggtgacggtgtaaatgatgcacctgcattagttaaagctgatatcggtatcgccattggtacaggtacagaagttgccattgaagcagctgatattactattcttggtggcgacttgatgcttattcctaaagccatttatgcaagtaaagcaaccattcgtaatattcgtcaaaatctattttgggcattcggctataatattgccggtatccctatagctgcattgggcttacttgcgccatgggttgctggtgctgcaatggcactaagttcagtaagtgttgtcacaaacgcacttagattgaaaaagatgcgattagaaccacgccgtaaagatgcctagattccttaataatgaaggattcgttggtgattctgagataggctagtgattggctctataatgtcgcggtttayagttggatcttcgctccaactgcatatatagtnacacttttcgcttggcgaattagtgtatcttacctaatagctccgcctattaggttccatcattattataaataataagtacactacggtttacagttggatcttcgctccaactgcataagagccactaattattataaataataagtggcyctaaaaggaggtgaatgctatgtcacaagaaattttaaatgttgaaggtatgagctgtggtcactgcaaaagtgctgttgaatctgcattaaataatattgacggtgtcacttcagctgacgttaaccttgaaaatggtcaagtaagtgttcaatatgatgacagtaaagttgctgtatctcaaatgaaagacgcaattgaagatcaaggttacgatgtcgtttaattaggcaatattcaacgtcatcaacaccaaattaaaaaatcgaactgatgagaatcccaacaatccaaattatctcatcagttcgatttttaatttactcgtaacctagtatctccagtctgcaatacatctaatgttgcatctaatgcatcgacaattagatttttaactgcagcttcagtataaaacgcaatatgtggtgttaatatgacatcttccctgtcaatcaacgattctaacaatggatcgttcagtgttttgcccctttgatcacttgggaaaagtttgcgttcaaattcatacgtatcaagtgctgcacctttaatcacaccattgtctaatgcgtctaataacgccttagtatctactaaagaacctctcgcacaattgacaaatactgcgccctttttaaaatgtttaaataattcagcattaaatagataatgattatatttcgttgcaggtacatgtaatgtcacgatatcagcaccttcaaccgcttcctcaatcgtatctttgtaatcgacatacgttgcaattttagcattaggaaacggtcgtatgcgaccacatcactttgataaccattggcaaatatatcggctactacacggccaattcgacctgtaccaataacagctacttttaaatctttaatggatttcgataaaatagtaggttcccatctaaaatcatgctcccgcactttcgtttgaatttgattaaaatgacgaaccacattaatagcctggttcacagcaaactccgcaattgaattcggagagtatgacggcacatttgacacaataaagttatacttgtttgctaactccaaatcatatgtatcaaatccagcactacgttgtgcgatttgtttaatacctagttcatttaatcgtttataaacatgctctgataatggtatttgttgtgatagcgataagccatcataaccagcgacaccttcaacattgtcatcagttaatgcttctttagtaatatctacctcaacatgatgtttctctgcccacgccttgatataaggcatatcttcatcacgtacactcatgattttaatttttgtcattttaacatcacccttaactttattattcatataaatatgctagttctgttaatcttattgcagcttcgtctaatttctggtcatctaacgccaatgaaattctcacataacgattaccattctctccaaatggtttccctggagcaacaagtattgacttctcttgcactaaaaattgctcaaattgctcgctgtcataaccaggcggtgtttccaaccatacatatatgccacctttagcatgaacaaatggcaaatcagcttttgcaagcatggcttcgaatcggtcacgacgtgttttaaatacattgctttgttcttctaaaaaatcatcataatgattcaaagcatatattgcggcatcttgtaatgcaccaaacatcccagcatttgtgtgcgtttggtactttttcaaagcttgaatcatatctttattaccaactgcaaaaccgactctaaaacctgacatgttataacctttagacaaggaataaatttcaatcgcaacatctttcccattttccgaagcaagtatactaggatttttagcgtcgaaaccgaaagcaccataagcaaaatcatgcacgattttagtgtctgtacctttaaatttagctatcgcttcatcaaaaacttctttcgtagctgtcgatccagttggattatttggatacgttaaataaatgagttttgttttatctattatttgtgaatcaactttggaccaatctggcaaataatgtggcggttctaaattaagcgggactggcttgccatcagctaaaagtacacctgctaaataatccgtgtagcctggatcaggtagtaatacatagtctcctggattgataacacatgttggtactgccactaatccattttttgtaccatataaaatgcatacttcatcttctttatctaacgtcacattatattgtctttgataaaaatctacaatagcttgcttgaacgcttctttaccatgaaaagcaccatatttttgattttcaggaatagttagtgctttttgaaaatgatcaataataccttgtggcgtgggcccatcagggattccaactgccatattaattaatggcaatggtccatgttcgattttacgtcccatcgttttcccgaaataactatcagggatatttgctaatttgttagagatcatcaaattcctcctctatcattaaacatagcctgggcgactatcataatcctaacaacttgtatcactctcatttagatggttacaatgacatcgccattcaccgttatgttcaacagaacttatgacacacgttgtattgaatgaatttattttcattttaggtaggtataatattattgtcaatattaggaattttcagattaatatgcactcaatcgttatgatttaactgtcatgcatatccgcatgcgcaaccagttagatatgcttatataaagtataacgcccatcaaggtacgtattcaaacgtgaaccttaacaggcgtcattcattgttaaataaaacttcttaagcacatacttatttcactatgccttttacgttccccttatacttttctcacatctttctcttagactactcccttatacgccccgctcaatatctttaatcatttcatctacagttattttcgcactcgttaagacaataggaacgcctgcacctggatgcgtacttgcacctgcaaaatataaatctttataatctcgcgatacattttgtggacgataataattactttgcgctaaagttggcattaaaccgaatgccgaaccaaatttcgcatgatacgtttgctcaaaatcatttggcgtaaagattgtttctgaaacaatatgcgattttatatcttcaaatacttcaatcgttgctaatttacgataaataatttcctttatttgttgcgtcaaagcttcatctgaccaatcgattccgctacctgttttaagttccggcgtcggcattagcacataaataccagttttgccttctggcgcaagtgatttatcagcgaccgctggtacatacacataaatagaaggatcatatgataaacgtccctcaaatatttcttcaatattgcctctaaagtcatctgaaaaaataacattatgaagtctcacttgatctgtcacatcaatatctataccgatatacattaaaaatgctgaacaagagtaatctaagtctgcaattttatgtggtggatactttttaataggtgcaaaatctggcattaatgattccgcaacactagggaaatcagccgtacataaaattttatcaaattttcttatgtcaccattcacttttatcgcatcggcccgtttgaatttaggatcaataataatttgctcaatttcagcatttagttcaatattaacgcctaagtctttatttaattgcgctagcccttgagccatgccatacataccgcctttaataaaatgcacaccaaacatcatttcaatcataggaataattgaatatagtgacgggcctcgttttggatcaattcctatgtataacgtttgaaacgctaaaagcttttgtatcttttcgttatcaatataatgttcaattagctgatctgcatgatttaacgtttttaacttagcaccttgcacaagtgacgtcatattataaaagtcactcggtttgcgatacgttctttctaagaaatagcgacgtgcaatttcatattttttataaacatccgttaaaaaggacataaaaccatgcgttgaaccaggttctatactttctagcatttgctgtaattcagctaaatctgtaggcaccgttatacgatcatcgtggtcaaaatacacatcgtaaatataacgtaattgtctcaattcaatataatcttcataatttttaccacacgctgtaaaaacatctttataaacatctggcatcatgacaattgtgggacccatatcaaatgtaaagccgtctttctttaattgattcatacgcccgcctacattattatttttttcaaatatcgtcacttcatgaccttgagaagcaatacgggctgccgctgctaatcctgtgacacctgcaccaattactgcaatcttcattattcaaccacctatattctatgatatttactatttatttcatgaaacaactttgcctttttcctcttatccacaaaaacacgttcatgtaatgtatagttagcctgtctcacttcgtccagtatttcaatatatatacgtgctgctaattctatgattggttgtgcttcaatactaaatactttgatttgatccataacatcttgaaaatctttttctgcgatagctgcataatattcccataagtcaatataatgattattaacaccattttggtacacttcagcaatatcaacttcatattgctttaatcgttgcttactaaaatatatccgttcattgtcaaaatcttcaccgacatctcttaatatattaangggatcctctagagtcgacctg

SEQ ID NO: 32 - DNA, 10088 bp; double-stranded, linear
atatataaatatagattaagtatatagattaatcaacttttttggaagagcaaatcacgcaatcaacaaataatataagaagtttttgcgatagttttaaaatagctgtaatagaatactaaatgtgacaaacttagaactaatatcaagtgttgatgttttgaatataaaaatgctaatagatggcatcacgagatttatgactatctgttaaatcaacctaacacgattataatttgaataattggttaatatatgagtaattagaaaatagacaaaggatgacgatttatgtatatcaatatgaaagattatgggttaacaggcataaacaaaactaaagatactcgagcaatacaacgtgcgttaaatcgtggaagatgtaaaccaacgacagtttatataccgaaagggacgtatgatatttgcaaaccattaacgatatatggcaatacaacacttttgttagataatgaaactattttacgccgatgtcattctggtcctttattaaaaaatggtcgtcgctttggtttttatcgtggttataatggacacagtcatattcatattaaaggcggcaagtttgatatgaatggtgtatcgtatccttataacaatacagctatgtgcattgggcatgctgaagatattcaattaataggtgtgaccattaagaatgtagtgagtggtcatgcaattgatgcttgtgggattaacggactctatattaaaagctgttcatttgaaggattcatagactatagtggcgaaccttttattctgaagcaatacaattagacattcaagtacctggtgcttttccaaaattcggaacgacagatggtacgataacgaaaaatgtcattatcgaagattgttattttggaccttcagaattgcccgaaatgggaagttggaatcgtgctattggctcacatgcaagtagacataatcgatactatgagaatattcatattagaaataatatatttgaagatatacaaggttatgcattaactcccttgaagtataaagatgctttcattattaataataagtttattaactgtgagggtggcattagatatttaggagttagagatggtaaaaatgcagcagatgtgatgacaggaaaagacttaggttcccaagcaggcataaatatgaatataattggaaatgaatttaaaggatcaatgtctaaagatgcgatacatgtacgtaattataataatgttaaacataaagatgtattaatcgttgggaatacattcaataattcgactcaatcaattcatttagaagatattgatacagtgtttttaagtcctgttgaagcgggtattcaagttactacaatcaatgtagatgaaataaaaaagtaaaaagtttcgcatgacattaggattaagaatagtagataatttttgaaagcgcattcataaaacggtataaatatgctataataaacccaattatctgataaaaggggtattttgacggtaatgataatacaagatagacaactttctatactctaatatagtgagttgaagtagcttgtcataatcatcatgagggggaaatttatggcttatttcaatcaacatcaatcaatgatatcgaaaaggtatttaacattcttttcaaaatcaaagaaaaagaaaccgtttagtgcgggacaacttattggactaatattaggtccattacttttcctattaacattattattctttcatccacaagacttaccttggaaaggcgtctatgttttagcgattactttatggattgcgacttggtggattactgaagcaattcctattgcagcaacgagcttattaccaattgtgttattaccattaggtcatatacttacaccagaacaagtatcatccgaatatggcaatgatattatctttttgtttttaggtggatttattttggcaattgcaatggaaagatggaatttacatacgagagtagcgttgacaattattaatttgattggtgcaagcacttcaaaaatattacttggattcatggtggcaacaggattcttatctatgtttgtatcgaacactgcagctgtaatgattatgattccgattggtttagcaattattaaggaagcacatgatttacaagaagccaatacgaatcaaacaagtattcaaaagtttgaaaaatctctagttttagcaattggctatgcaggtacgattggtggcttgggtacattaatcggaaccccgccattaattattttaaaaggacaatacatgcaacattttggacatgaaattagttttgctaaatggatgattgtagggattccaacggtcattgttttgttaggtattacttggctctatttaagatatgttgcgtttagacatgatttgaaatatttacctggtggtcagacgttaattaaacaaaagttagacgagcttggcaaaatgaagtatgaagaaaaggtagtacaaactatctttgtacttgctagcttattatggattacaagagagtttcttctgaaaaaatgggaagttacgtcatctgttgcagatggtacgattgctatttttatatcaatattattatttattattccagctaaaaatactgaaaaacatcgccgtatcattgactgggaagttgcaaaagagctcccttggggtgtattaattttatttggtggcggtttagcattagcgaaaggtatttctgaaagtggtttagcaaaatggttaggcgaacagttgaaatcattaaatggtgttagtccgattcttattgtaattgtcataacaatctttgtcttatttttaactgaagtgacatctaatactgcaactgcaacgatgattttaccgattttagcaacgttgtctgttgctgttggagtgcatccattactacttatggcacctgcagctatggcggctaactgtgcatacatgttaccagtagggacaccaccgaatgcaattatctttggttctggtaaaatatctatcaaacaaatggcatcagtaggattctgggtaaacttaatcagtgcaataattattattttagtcgtgtattatgtaatgcctatagttttaggtattgatataaatcaaccactgccattgaaatagtaattgcagattagaacgaaaaataaaaggttacattagcaattgcttggacgagtggtaacgaaacgtataccgcagcatcgtgtaaaaacaatacaaacaaaagaaagtcaaccaaggatggattcctattttaatccttggttgactctttattttatttaaattgtagaacctagaaaataaagtttaattaaaagcaccaatcatttctactttgaaatctaaggtttctaaaatagcaatgactttctttatatcggttgtaattgcagaatcagcctgaacgaaaaatcgatacatacctaattgtgtttttaaaggacgagactcaatccaggataaattaatattaaacaaagcaaatgtattaagcacacttgctaacaacccaggtttatcatgcattggtgtaattaaaaacatcaatgatgtcgcattttgatcaaattgctgctgattttttataactaaaaaacgtgtcacgttatgtggatagtcttcaatatgtgtatcaataggtgtaaaaccataagcttcgccactacctaaaggtgcaattgctgcaacgccattttcaattttagtcaaactttgaattgtactgtcgacataatcatagtcaaattgatgttgatgtatgtaatttgttgtttgactgattgctggtgcaatagaatacacttttttaatatcagaaatggaatctgttccattaccatataatgcaaagttaatatctaaacgtatttcaccgtgtgcaaagacatcttgctgtgcaagtgcatctgccacaatgttgattgttccttctatagaattttcaatagggacaacaccaatcgatgtgtcatcatctgcaactgccttgatgacttcaaataaatttgactttggttgaaaagttgcttcattttcagaaaaatactgacgacaagccaaatatgaaaatgtacctttagggcctaaataatataattgcatatgctacacctctactaacttaatgatggaaagggcactggttagcatttgattctttctttttatagaaaaagtttggatcttttactgtattgtcatatccgtgatgataatttgacgtcaatgttggagataatggcggtgctagccaagaccattttccggtaacttgacgaccttgttgtgcttcgttacgttcgaatagttcgaattgctttgcagcggtcaaatgatcgacaattgatacgccttcttttttaaaggaatgatacacagcatagttcaattcaacaagtgctcgatctttattaaatgaattatttttaagtgtatcaaattcaaacgcatctgcaactttttctagtaaattgtaacggtaatcatcaataaagttacgtacgccaatttcagttaccatataccaaccgttaaagggtgcagttggatatacaatgccaccgatttttaagtccatattggaaatgatagggactgcataccattttaagttcaattttcttaattttggataatgattatgttcaataggtacttctttaattaatgaagtaggatattcgtaaaatttaactgactcattaggtaattggtaaatcagtggtaacacgtcaaaattagtaccttttcctttccaacctaagtgatttgctaagcgtgtaacttctttttcagcaggatcaccacaattgtcatagccagcatagcgaattaattgattgttgaaaattttaggtccatcctttggagcatatatagtaatatacggctttaatttaccttcatttgtagcctgtgtaatatgataagtaattgatgataagaacgatgcttcgtcagtaacatctcttgcatcaatgacatttaacgaatcccaaaataaacgaccaatgcaacgatttgaattacgccaagccattttagcaccataaataagttcttcttctgtatgtgtatatgtcccagtttcttttatttctagttcaatgtcatgtaaacgtttattgataatttgcgtttcataatgacactctttatacatgttttctatgaaagcttgagcctctttaaataacattaacaacacctcgctttatattatagtctacattattaaaatactcttaaaaattatgtatatgtcattaaattgttggttgattttaattaaaagtatggaaattaaggggctcttatgtatataaaaaaatgaattatgataaaatgtaagaaaatatttaggtcgattggagagatacaagtgtaccaattagaagacgacagtttaatgttacataatgacttatatcaaataaatatggctgaaagttattggaatgataatattcatgaaaaaatggctgtatttgatttgtattttagaaaaatgccatttaatagtggctatgctgtttttaatggtttaaaacgcgtcattgattttatagaacattttggattttcagaatctgatttggaatatttaaagtctattggctacaaggatgatttcttatcatatttaaaagatttaaaattcacaggcagcatccgttcgatgcaagaaggcgaattatgctttggtaacgaaccattgttacgcgtagaagcaccattgattcaagcgcaattaatagaaacaattttattaaacattgtaaatttccatacattaattacaacaaaggctagcagaattcgtcaaattgcatcaaatgataaattaatggagtttggtacacgtcgtgcgcaagaaattgatgcagcattgtggggcgctagagctgcttacatcgggggctttgattctacaagtaatgttagggcggggaaattatttggtatacctgtgtctggtacacatgcacatgcatttgtccaaacttatggagacgaatatgttgccttcaaaaaatatgctgaaagacataaaaattgtgtgttcctagtagatacattccatactttaaaatctggcgtgccaaatgcaataaaagttgcaaaagaattaggtgacaaaattaactttgtaggtattcgattagattctggagatatcgcttatttatctaaagaggcaagacgtatgcttgatgaagcaggatttactgaaactaaaattatcgcgtctaatgatttggatgaagaaacgattacgagtttgaaagcacaaggtgcaaaagtagattcttggggcgttggtacaaagctgattacaggatacgatcaaccagcattaggtgcagtatataaacttgtagctattgaaaatgaagatggttcatatagtgatcgtattaaattatcaaataacgctgaaaaggttacgacgccaggtaagaaaaatgtatatcgcattataaacaagaaaacaggtaaggcagaaggcgattatattactttggaaaatgaaaatccatacgatgaacaacctttaaaattattccatccagtgcatacttataaaatgaaatttataaaatctttcgaagccattgatttgcatcataatatttatgaaaatggtaaattagtatatcaaatgccaacagaagatgaatcacgtgaatatttagcactaggattacaatctatttgggatgaaaataagcgtttcctgaatccacaagaatatccagtcgatttaagcaaggcatgttgggataataaacataaacgtatttttgaagttgcggaacacgttaaggagatggaagaagataatgagtaaattacaagacgttattgtacaagaaatgaaagtgaaaaagcgtatcgatagtgctgaagaaattatggaattaaagcaatttataaaaaattatgtacaatcacattcatttataaaatctttagtgttaggtatttcaggaggacaggattctacattagttggaaaactagtacaaatgtctgttaacgaattacgtgaagaaggcattgattgtacgtttattgcagttaaattaccttatggagttcaaaaagatgctgatgaagttgagcaagctttgcgattcattgaaccagatgaaatagtaacagtcaatattaagcctgcagttgatcaaagtgtgcaatcattaaaagaagccggtattgttcttacagatttccaaaaaggaaatgaaaaagcgcgtgaacgtatgaaagtacaattttcaattgcttcaaaccgacaaggtattgtagtaggaacagatcattcagctgaaaatataactgggttttatacgaagtacggtgatggtgctgcagatatcgcacctatatttggtttgaataaacgacaaggtcgtcaattattagcgtatcttggtgcgccaaaggaattatatgaaaaaacgccaactgctgatttagaagatgataaaccacagcttccagatgaagatgcattaggtgtaacttatgaggcgattgataattatttagaaggtaagccagttacgccagaagaacaaaaagtaattgaaaatcattatatacgaaatgcacacaaacgtgaacttgcatatacaagatacacgtggccaaaatcctaatttaattttttcttctaacgtgtgacttaaattaaatatgagttagaattaataacattaaaccacattcagctagactacttcagtgtataaattgaaagtgtatgaactaaagtaagtatgttcatttgagaataaatttttatttatgacaaattcgctatttatttatgagagttttcgtactatattatattaatatgcattcattaaggttaggttgaagcagtttggtatttaaagtgtaattgaaagagagtggggcgccttatgtcattcgtaacagaaaatccatggttaatggtactaactatatttatcattaacgtttgttatgtaacgtttttaacgatgcgaacaattttaacgttgaaaggttatcgttatattgctgcatcagttagttttttagaagtattagtttatatcgttggtttaggtttggttatgtctaatttagaccatattcaaaatattattgcctacgcatttggtttttcaataggtatcattgttggtatgaaaatagaagaaaaactggcattaggttatacagttgtaaatgtaacttcagcagaatatgagttagatttaccgaatgaacttcgaaatttaggatatggcgttacgcactatgctgcgtttggtagagatggtagtcgtatggtgatgcaaattttaacaccaagaaaatatgaacgtaaattgatggatacgataaaaaatttagatccgaaagcatttatcattgcgtatgaacctcgaaacatacatggtggattctggactaaaggcattcgtcgtagaaagcttaaagattatgaaccagaagaactggaaagtgtagtagaacatgaaattcmaagtaaatgagaatgaamcaattgctgattgtttgtcacgaatgaaatgcaagggtatatgccggtaaaacgtattgaaaaacccgtgtttcaagagcaaaaagatggcacggttgaagtatcacatcaagaaatcgtttttgtaggtaagaaaatccaataacataatccaatttaaataaagactatttgaagaggaaaggctattcaaagtttgagtaattttactttgaatagcctatttgtttatacatgcaagatgctcgatccatattgtatgagaaacccccagcaagctatataaagcatatgctgggggttcttaatattttaaaaattattgttagattatatatatcgtcgctttttctaaaacaatctcatcgcatgaaattttttcttcctagagacctttaataagattaatagtttacttaatcatatctagatagtcttatgacttatgcttaatgaaagtcattctaggagaagttcccaaagcttctgtgttcataattgttagtagtattttattatcatttggtataaatatttcaataacaattgagctattatttttattatataatgtgagttgtttgtgttctgtatttatatatttgcaaatgtaatcagaatcgtctgaggtactgagaataaattttaaaggactatcatttaaatcttgaggatgccattctccctcaataatattaagataatacttagcctctgaattacatttgaatttatcaatactaaataattcaatttgttccataatattatttacctttctaaaatacaaattttaataaccataaatagatgaataccatcgataatggtcgccattggatactggaataacattgtttttagcatcttgagtcataaaaccattatcccatggattccatataattataacctcttgtccattatctaatttagcgttcccaacaactgccatggcatgccctgcgtgcataccatttcttgattctactctactacctaaaacagcaattcctttattatttttagtaagattgtcaacttcattatatgtagtcattctattaagaagttgtggacttcttccctgagtttgtccaaaataaatcatctctcttggcgttaaaccagtaaattggaatcgttgtccttgtaagtttgggtgtaaaaatctcatcacagcttctgcatgatatttgttagtattataagtcgcatttagtaattcagacatcgtatagcctgcacaccaaccattgttaccttgagtttctcttatcttgaaattctcaagtttatttatatattgstcgttgtaagtataattattacttttaaattgactagttggcatagtgacagaagctttttgctttagttgcgttacattattgccagtaggtatactctcagtctttntnaactntntatcttctagacgtggtgtttttagtactagtttagctttatgattttgagtaccacatagtaaccttttgagttgt

SEQ ID NO: 33 - DNA, 7563 bp; double-stranded, linear
cggaaacgnacccnatgcgtatgcttgacgtgccaaaattaaatacgaagttcatagctttgaggtaccagaagaacatttatctggtcaagaagtcgcagnactcatacaagcaaatgttaaaacagtatttaaaacgcttgttctagaaaatacaaaacatgaacattttgtatttgttatcccagtaagtgaaactttagatatgaaaaaggcagctgctttggttggagagaagaaattgcagcttatgcctttagataatttgaaaaatgtaacgggatacattcgtggtgggtgttcgcctgttggtatgaaaacattgtttccaacagtcgttgacaaatcgtgtgaaaattatagtcatatcagtgtgagtggtgggcttcgaacaatgcaaatcacaatagctgttgaggatttgattacaataactaaaggcaaaattggagcagttatccatgaatgattaataacaacaaaaagtatggggcaagattaggagtgtgacagagatgaaatttttataaaattcatttctgccacactcctttttgattgaattagcattttacgatcataaacagtcattataattgagtatttgaacataaaaatgtaattttatcgtaacaatttgagtgtttgtgattgtttttggtaatttatgattgaaaagtgaaagcgtactcattataatacaaagtgagatggggtgatgatgataattactgaaaaaagacacgagttaatattagaagaactttcgcacaaagattttttgactttacaagaattaatagatcgaactggttgcagtgcttcaacaatacgargagatttatctaaactacaacaattagggaaattgcaacgtgtgcatggtggtgcaatgttaaaagaaaatcgtatggttgaggcgaatttaactgaaaaattagcaacgaatcttgatgaaaagaaaatgattgctaaaatagcagctaatcaaatcaacgataatgaatgcttatttatcgatgctggttcatctacattggagctaattaaatatattcaagcgaaagatatcattgtggtaaccaatggtttaacacatgtagaagctttacttaaaaaaggtattaaaacaattatgctaggtggtcaagttaaagaaaatacacttgctacgattggttctagtgctatggagatattaagacgatattgtttcgataaagcttttatcgggatgaatggattagatattgaacttggattaactactcccgatgagcaagaggcattagttaaacaaacagcaatgtcattagccaatcaatcatttgtacttatagatcattctaagtttaataaagtatattttgctcgtgtacctttgctagaaagtacgacaatcatcacatctgaaaaagcattaaatcaagaatcgttaaaagaataccaacaaaagtatcactttataggagggactttatgatttatacagtgactttcaatccttcaattgactatgtcatttttacgaatgattttaaaattgatggtttgaacagagcaacagcaacatataaattcgctggggggaaaggtattaatgtctcgcgcgtcttaaagacattggatgttgagtcaactgccttgggatttgcaggtggatttcctgggaaattcattatagatacattaaataacagtgcaattcaatcgaattttattgaagttgatgaagatacacgtattaatgtgaaattaaaaacaggacaagaaacagaaatcaatgcaccgggtcctcatataacgtcaacacaatttgaacaactgttacaacaaattaaaaatacaacaagcgaagatatagttattgttgctggaagtgtaccaagtagtattccaagcgatgcgtatgcgcaaattgcacaaattacagcacagacaggtgctaaattagtagtcgacgctgaaaaagaattggctgaaagcgttttaccatatcatccactatttattaaacctaataaagatgaattagaagtgatgtttaatacaacagtgaactcagacacagatgttattaaatatggtcgtttgttagttgataaaggtgcgcaatctgttattgtctcgcttggcggtgatggtgctatttatattgataaagaaatcagtattaaagcagttaatccacaagggaaagtggttaatacagttggctctggtgatagtacagttgcaggcatggtggctggaattgcttcaggtttaacgattgaaaaagcattccaacaagcagtcgcatgcggtactgccacggcatttgatgaggacttagcaacacgggacgctatagaaaaaataaaatcacaagttacgattagcgtacttgatggggagtgaaaataatgagagtaacagagttattaacaaaagatacaatagcaatggatttaatggcaaatgacaaaaatggtgttattgatgagttagtaaatcaattagacaaagcaggtaaattaagtgatgtcgcgtcatttaaggaagcgattcacaatcgagaatcacaaagtacaactggtatcggcgaaggtattgccattccacatgccaaagtggccgcagttaagtcaccagctattgcgtttggtaaatctaaagcaggcgtagattatcaaagtttggatatgcaaccagcacacttattctttatgattgcagcgccagaaggtggcgcccaaacacatctagatgctttagctaagttgtctggtattttaatggatgaaaatgtacgtgagaaattattacatgcttcatcacctgaagaagtactagcgatcatagatgaggctgatgatgaagtgacaaaagaagaagaggcagaagctgaagcacaacaagttgcaactgcagaacaatcatctaaacaatctaatgagccatatgtgttagcagtaactgcttgtccaacaggtattgcacacacatatatggcacgtgatgcattgaaaaagcaagcggataaaatgggtattaaaattaaagtagaaacgaatggttcaagcggcattaaaaaccatttaactgaacaagatattgaaaatgcaacaggtatcattgttgctgctgatgttcatgttgagacggatcgcttcgatggtaaaaatgtcgtagaagtaccagtagcagatggtattaaacgcccagaagaattaattaataaagcattagatacaagtcgtaaaccttttgttgcccgtgatggtcaaagaaaaggtaactcaaatgacagtcaagaaaaattaagcccaggtaaagcattctataaacacttaatgaacggtgtttctaacatgttgccacttgtaatatctggtggtattttaatggcaattgtatttttatttggagcaaattcatttaatccaaaaagctcagagtacaatgcgtttgcagagcagctttggaacattggtagtaaaagtgcattcgcgttaatcattccaattttatctggattcattgcacgtagtattgcggataaacctggtttcgcttcaggtcttgtaggtggtatgttagcaatttcaggtggttcaggatttattggtggtattattgcaggtttcttagcaggttacttaacacaaggtgttaaagccatgacacgtaagttaccacaagcattagagggattaaagccaacattaatttatccactattaacagtgacggctacaggcttattgatgatttatgcctttaatccaccagcatcttggttaaatcatttgttattagatggattaaacaatttatcaggttctaatattgtattattaggtttagttattggcgctatgatggcgattgatatgggcggtccattcaacaaagcggcatatgtttttgcaacaggtgcgttgattgaaggtaatgcagcaccaattacagctgcaatgattggtggtatgattccaccgttagcaattgcgacagcgatgttaatttttagacgtaaatttacaaaagaacaacgtggttcaattatccctaactatgtgatgggtatgtcatttattacagaaggtgcgattccatttgcagctgccgatccattacgtgttattccttcaatgatgattggttcaggtataggtggcgcaattgctttaggcttaggttcacgaattactgcgccacatggtggtattattgtaattgttggtactgatggtgcacacttacttcaaactcttattgcacttctagttggcacattagtttcagcattaatttacggtttaatcaaaccaaagttaactgaaacagaaatcgaagcttcaaaatcaatggacgagtagttttaatgatgtaaaatgattgttagcaaagagcttcatattaagttgtatgttcaatgaatatatgttagttttatatatcgtgttaacggtagcttatacaaagctgtaaaaacactttctattaattcagtttttatgaattgatatgaaagtgtttttatttttagataaatgaatgaagaaatagacaccacaaatgtatagacttttttaatattttgcaaaaagttatgccaaacgaagcagatatagtaaaatatgagtgtcttaaagtgaaaatttataaataaagaagggtttatacgtgtcagaattaattatatataacggcaaagtttatactgaagatggcaaaatcgataatggttacattcatgtgaaagatggacagattgttgcaattggagaagtggatgataaagcagcaattgataatgatacgacaaataaaattcaagtgattgatgctaaaggtcatcatgtattaccaggttttattgatatacatattcatggtggttatggtcaagatgcaatggatgggtcatacgatggcttaaaatatctatccgaaaatttgttgtctgaagggacgacatcatacttggccactacaatgacgcaatcgactgataaaatagataatgcacttacaaatattgctaaatatgaagcggagcaagatgttcacaatgcagcggaaattgtaggtatacatttagaaggaccatttatatctgaaaataaagttggtgctcaacatccgcaatacgttgtacgcccatttatcgataaaattaaacattttcaagagactgctaacggattaataaagattatgacgtttgcacctgaaattgaaggtgcaaaagaagcgcttgaaacgtataaagatgacattattttttcaattggtcatacagtagcaacatacgaagaagcagttgaagctgttgagcgaggagctaaacatgtcacgcatttatataatgcagcgacgccattccaacatagagaaccaggtgtttttggagcagcatggttgaatgatgctctacataccgaaatgattgttgatggcactcattctcatccggcatcggttgcaattgcttaccgtatgaaaggtaatgaacgtttttatttaattaccgatgcaatgcgtgcaaaaggtatgcctgaaggagaatatgatttgggtggacaaaaagtaactgttcaatcgcaacaagcacgtcttgcaaatggtgcgcttgctggtagtattttaaaaatgaatcatgggttacgtaacttaatatcatttacaggtgatacattagatcatttatggcgagtaacaagtttaaatcaagccattgcattaggtatcgatgatagaaaaggtagtattaaagtaaataaggatgcagatcttgttattctagatgatgatatgaatgtaaaatctacaataaaacaaggcaaggttcacacatttagctaataaataatcataattaaatgtatgcaatagatttaatctgttaacataagcactttatattatgataaaatagaagcaataacatttttttctgggggtgtctaaatgggaaggcgataacatgtagttgtaatttaagtcatagtgataaatttgaatgcgtgttacccatgagtgacacatataacatggaggtgaatccctagaaatagggaattaattggaaacttcgaccataattagtttgattatatttattctattaattgcattaaccactgtatttgttggttcagaatttgcattagtaaaaattagagcaacaagaattgaacagctagcagatgaaggaaataaacctgctaaaatagtaaaaaagatgattgctaatctagattattatctttctgcttgtcagttaggtataacagtaacatctttagggttaggttggcttggtgaaccaacgtttgaaaagctattacacccaatatttgaagcaatcaatttaccaactgcattaacgacgacgatttcgtttgcagtgtcatttataatcgttacgtatttgcatgtagtacttggtgaattagcgcctaaatctatagctattcaacatactgaaaagcttgctttagtatatgcaagaccattgttctatttcggtaacattatgaaaccattgatttggctgatgaatggttctgcacgtgttattattagaatgtttggtgtaaatcctgatgcccaaactgatgcaatgtcagaagaagaaatcaaaattattattaacaatagttataatggtggagaaatcaaccaaactgaattggcatatatgcaaaatatcttttcattcgatgaaagacatgcaaaagatataatggtacctagaactcaaatgattacactaaatgaaccttttaatgtagacgaattactagaaacaataaaagaacatcaatttacgcgttatccaattactgatgatggtgataaagaccacattaaaggatttattaacgtcaaagaatttttaactgaatacgcttctggaaaaacgattaaaatagcaaactatatacatgagttgccaatgatttcagagacaacacgtatcagtgatgcattaattagaatgcaacgtgaacatgtacatatgagtcttattatagatgaatatggtggaacggcaggtattttaacgatggaagatattttagaagaaatcgttggagaaattcgtgatgaatttgatgatgatgaagtgaatgatatcgttaaaattgataataagacattccaagtaaatggcagagtactattggatgatttaactgaagagttcggtatagaatttgatgactctgaggatattgatacgataggtggatggttacaatctcgtaataccaatttacaaaaagatgattacgtggatacaacttatgatcgctgggttgtttcagaaatcgataaccaccaaattatttgggtgatattaaactatgaatttaatgaagcgagacctactatcggacagtctgatgaagatgaaaaatcagaatagatattaatatataaaccaactaagaatgatttaattcatttttggttggttatttttttgactaaaattaangaaaagtgaaaatagtattggaactcaatatctttaatgatttaatgaataanttttattgaaagcga

SEQ ID NO: 34 - DNA, 3492 bp; double-stranded, linear
ttatatcaacttcatggcggaaccattgatgacccattagacgaaacaataagcgcatttsatgaattgaaacaagaaggaattatacgtgcttacggtatttcttctattcgcccaaatgtaattgattattatttaaaacatagtcaaatcgaaacgataatgtctcaattcaatttgattgataatcgtccagaatcattattagatgcaattcacaacaatgatgttaaagtattggcaagaggacctgtgtctaaaggattattaacttcaaacagtgttaatgtgctcgacaataaatttaaagatggtatttttgattattctcatgatgaattgggtgaaacaatagcctctattaaagaaattgaaagtaatttatctgcattgacatttagttatttaacatcacatgacgtgcttggttccatcattgtaggtgcaagtagcgtcgaccaattaaaagaaaatattgaaaactatcatactaaagttagtttagatcagattaaaacagcaagagctcgtgtaaaggatttggaatataccaatcatttagtgtagaagtcattttcagtaataaaaacagcagcatgaggcgtttcattataaaaatgccttactgctgttgtttatgtacaattcgctataatttatgattatgattactcacttatgatagaaattaaagcgttgtcctcacgcatcagtatttagtaatttcgccttgcggcattgccttaagcaaacttctgccacttcatctcttaataattttattaaaacatctttctatatttcacttcgcatgttgattcatcattattagttattatttgtacacccagcacatttccttgcaacacaagtagtttgaatttttcacaagtataatataatgtaccgtctgaaatttggtctacagaaatatcgcctaaaatatccagcactgtaaattcttcaaatactgatagttgttccgcatatcgtacacaaagtcttaccacactctccgattgacagttcattgccatcccacctatttatgctttatttttaaataatttagggaaacatcgttcaaaaaatctaggcgcaatttgatacattttcaacgcatgatgcatccatttaggccgattaatttccaattgttttgttttaatgccataaatgatatcttctgcaagctgattagcatcaagcataatttcccccatctttttagcatacttcattgatgggtcggctttttgatgaaaaggtgtatcaatcgggccaacattaactgtcatgatatgtaagtttggtgactctagtcttaaagcattcattaatgcataaaaccctgctttcgatgccccataatgtgcagcatttgcttgtgtggaaaatgcagcttgacttgaaatacctacaatatgtgcgttagatgttaaatatggtctcaacacagtatataaaacattaaaactaattaaattaagctgatacgtttcaatcatttctgaaaaactatggtctgaaatagatttgaaataacctaaacctgcactataaatgaatccatcgaatgatgtattgtcttcaaattgcagtgcctgtatcgacttcaaatcatttaagtcacaaggaataacatttatagttttccccaattcctgttcaaagattctagttgctttatcaacatcacgcaccaacaacgttacatgcactttattttctagtaactttcggacaatcgataaacctaaaccactcgtaccaccagtcactataaaatgttgtcctttcatcaattaaccttccttttcaattatatagaatgcaatttatcaactttacataattgagacaagttgattatctttcctaatatatatacaataataagaaaatataacatacaaatcaaaaactaaagggatgtgacgttaatgraactcgtattttatggagctggtaatatggcacaagctatatttacaggrattattaactcmagcaacttagatgccaatgatatatatttaacaaataaatctaatgaacaagctttaaaagcattcgctgaaaaactaggtgttaactatagttatgatgatgcgacattattaaaagatgcagaytatgtatttttaggtaccaaaccacatgactttgatgctctagcaacacgcatcaaaccacatattacaaaagwcaattgcttcatttcaattatggcaggtattccgattgattatattaaacaacaattagaatgccaaaatccagttgctagaattatgccaaacacaaatgcgcaagttggacactctgttactggcattagtttttcaaacaactttgaccctaaatctaaagatgaaattaacgatttagttaaagcatttggttctgtaattgaagtatcagaagatcatttacatcaagtaacagctatcaccggaagcggcccagcatttttatatcatgtattcgagcaatatgttaaagctggtacsaaacttggtctagaaaaagaacaagttgaagaatctatacgcaaccttattataggtacaagtaagatgattgaacgttcagatttgagcatggctcaattaagaaaaaatattacctctaaaggtggtacgacacaagctggccttgatacattgtcacaatatgatttagtatctattttcgaagattgtctaaacgctgccgtcgaccgtagtattgaactttctaatatagaagaccaataaaaacaaacccgccaacacatgtatgcatcatcgcaagcactgtgtttgacgggttatttttataatttattgttatttggcaagcattgtttattactttgtcattagattttaaaactatcaaaatcttttacaaaattaaaattaggtgtatcttcattttgtatcaatgtttgataaatttcatttatatcttctgtattatagcgattgctcaaatgtgtaatcaacgtacgtttaacattggcttcttttatcaatgcaaatacgtcttcaatatggctatgatgataattgttggctaaatgcttttcaccatctatataggtcgcttcatgtaccatcacatcagcatctctagaaatcacacgttcattagaacatggttttgtatcaccaaaaattgctacaactggaccctgtttggactcacctctaaaatcttttgattgataaacttgaccattatgttcaaatgtatcatgagattttacttcttgatatttaggacctggttcaagaccaatgttttttaacgcttcaacattgattgtacctgtagtttcaggtgccattactctatatccatatgatggaataccatgattaagtaaatgcgcctctacagtaaaaccatccatgatgatatgtcagatgatcatcgatttcaatatatgtaattggatagtttaaatgtgactctgataaattcatagacatttccacatatgct

SEQ ID NO: 35 - DNA, 1973 bp; double-stranded, linear
atctagcggtacaagcgtcttggaggctagtatgttgaacattgtaaaccctgaagatcacttcgttgtcattgtttcaggtgcctttggtaaccgatttaaacaaattgcacaaacttattacaaaaatgtgcatatttatgacgtaacatggggagaagctgtagatgtcaaagatttcatcaatttcctttcaactttaaatgttgaagttaaagcagtatttagtcaatattgcgaaacatctacgacagtgctacaccctattcacgagttaggaaatgccattaatcaatttaatagtaatatttattttgtagttgacggcgtaagttgcattggtgctgttgatgttgacattaacaaagataaaattgatgtacttgtttctggtagtcaaaaagcaattatgttacctccaggattagcttttgtagcttatagccaccgtgcaaaagaacatttcaaagaagtaactacgccaaaattttatctagacttaaataaatacatttcgtcacaagctgacaattctacaccgttcacaccaaatgtgtctttatttagaggtgtaaatgcatacgttgaaaccgtaaaagcagaaggtttcaatcacgtaatagcacgacactatgcaattagaaatgcattaagaagcgccttaaaagcattagatttaactttattagtcaatgataaagatgcatctccaacggttacagcattcaaacctaatacaaatgatgaagtgaaaataatcmaagatgaacttaaaaatngctttaaaataacaattgcnggtggtcaaggccatcttaaaggtcaaattttnagaattggtcatatggggaaaattagtcctttcgatattttatcggtagtatctgctttagaaattattttaactgaacaccgtaaagttaactatatcggtaaaggtatatcaaaatatatggaggttattcatgaagcaatttaatgtactcgttgcagatcccatatcaaaagatggtatcaaagcattattagatcacgaacaattcaatgtagatattcaaactggcttgtccgaagaagcattaatcaaaattataccttcataccatgctttaatcgttcgtagtcaaactacggttactgaaaatatcataaatgctgctgattctttaaaagtaatcgcacgcgccggtgttggtgtagataatattaatattgatgctgcaacattaaaaggtattttagttattaatgccccagatggtaatacgatttcagctactgaacatacactggcaatgttattatcaatggcacgaaatattccgcaagcacaccaatcacttacaaataaagaatggaatcgaaatgcatttaaaggtactgagctttatcataaaacattaggtgtcattggtgctggtagaattggtttaggtgttgctaaacgtgcgcaaagtttcggaatgaaaatactagcttttgacccttacttaacggatgaaaaagcaaaatctttaagcattacgaaggcaacagttgatgagattgcccaacattctgatttcgttacattacatacaccactaacacctaaaacaaaaggcttaattaatgctgtcttttttgccaaagcaaaacctagtttgcaaataatcaatgtggcacgtggtggtattattgatgaaaaggcgctaataaaagcattagacgaaggacaaattagtcgggcagctatcgatgtgtttgaacatgaacctgcaactgactcgcctcttgttgcacatgataaaattattgttacacctcatttgggtgcttcaacagtcgaagctcaagaaaaagtggcaatttctgtttcaaatgaaatcatcgaaattttaattgatggtactgtaacgcatgcagtgaatgcacctaaaatggacttaagcaatatagatgatactgtaaaatcattcatcaatttaagccaa

SEQ ID NO: 36 - DNA, 7620 bp; double-stranded, linear
ggtgtttcagatgtcactggttgatttttaattgtagacgggtattttgggctttcgccatatttatttgccggcttactgtcaaagcataggaatactatcataacaattgttaggcctaaataaacaaaataaagaagtactaacaaaatattaagacccatcggcattaatgtaaaatcactgtcataataactatcgataatctgtaatactatataaaatataatactgaatactgtcataatcattggaaataacattgttcttgatatatcgtgaaatcttcgaacgcacaacgctaaatttggaataaacgttgccaaactatagacaaaagtatacacagatgtaaggataatcatcaatatactcataactattaatgtttcgttatccgccgctatagaaataaagaatagaaataggtttattattagcacacacacagctggaaccataagtatcaaatgccatagtgccatataccaatattcactacgtcttgatctccccttaaaatttacataatttttccaaaataaaacgaatgatttcataaaacctacttgaggtaattgttccattgtaatctccctttcgttaatcatatttatatttttaattattgttaccgttataatttacaagattcattatcaagccacttcatttcaatcgtcaatcactttggaaaatgaactttatatttcatcactagtaaaatgaaaacccgctacaagtacacatctatatggagactcatttgaaagtcaacgcttcgttaactatactaaaaatatgtcatactgcaatgttcacgtttaaaagagtctcaatctatgcaaataaaatattccataacaaagtatatactttacatttttataattcttaacaatactattttatcaaacatttaccacaataaaaatatctttttcatttttatttaaattaatcatataattgcgaggagaatattatggatttcgttaataatgatacaagacaaattgctaaaaacttattaggtgtcaaagtgatttatcaggataccactcaaacgtatacaggctacatcgtggaaacggaagcttacttaggtttgaatgatcgtgcggctcatggctatggcggtaaaataacacctaaagtcacgtcattatataaacgtggtggtacaatttatgcacatgtcatgcatacgcatttactcattaattttgtaacaaaatctgaaggtatacctgaaggcgtacttatccgcgcaattgaaccagaagaaggtttatccgctatgttccgtaacagaggtaagaaaggctacgaggtaacgaatggcccaggaaaatggactaaggcatttaacattccacgggctatcgatggcgctacgttaaatgactgtagattgtctattgatactaagaatcgtaaatatcctaaagatattattgctagtccacgaatcggtattccaaataaaggtgattggacacataaatctttacgttacacagtgaaaggtaatccatttgtgtctcgcatgcgtaaatcagattgtatgtttcccgaagatacttggaaataaatgccatctttcattgattactatcatgaaaatgaaatctatctccttataagtcaatcaatcgtgccgtcaacatgcggatgggttgattgtttttctttgtatccatcatattttttgattcatctcctcttattgaacttgttcttaattataaaatataacaatagaattatttataattattaaatttagatgcattaatattattgatattattttcaaaaactagaaatattgatttgttgcatgtataatgttaaaagcgcccttttataacgcttacatataaaagcttatttagggagagggatattcaacaagggggatttgaaaatgatagaacttaatgcaattacaacattatgtttagcttgtatcctttatttacttggtaaggctatcgttaatcacgttaattttttaaaacgtatttgtataccagcaccagtgattggcggcttaatctttgctattttagttgcggctttggattcatttggcatggttaagattaaattagatgcttcattcattcaagatttcttcatgttagcattctttacgacaatcggtcttggtgcatcattgaaattatttaaattaggtggcaaagtcttgctattatactttatgttttgtgctatcatttcagtcattcaaaacatagttggtgtatcactagcaaaagtattaaatattaaacctttgttaggattaacagcaggttccatgtctatggaaggcggtcatggtaatgctgctgcttatggtaagacaattcaagatttaggtattgattcggcactgacagcggctcttgcagctgcaactttaggtcttgtatttggagggcttatcggtggtccagttgtaaaatttttaatcaaacgttataacttaaagcctcaacatagtgacgatacatttaaagattatagccaagtagcatataacgaacatttacatagtaaatttaatgccactgaagtattcttcattcaatttacaatcgttgtattctgtatggcagttggaagttatttcagtcatttgtttacagctcaaacagggattaatgttccaatttacgttggctcattatttgtagctgttattgtccgaaatatctctgaaagttttaattttaatattgtagatttaaaaattactaatcaaattggcgatgtcgcattaggtattttcttatctcttgcgctaatgagcattcaattaatcgaaatttataaacttgctatacctcttattattatcgttttagttcaagttgtcgttatgattttatttgctgttttaattttatttagaggtttaggaaaagattatgatgctgcagtaatggtaggtggttttatcggtcatgggcttggtgcacgccaaatgccatggcaaatttagatgttattactaaaaaatatggaaactcacctaaagcatatttagttgtacctattgttggtgcattcttaatcgatttaattggtgttatagtcattatgggattcatacaatggtttagttaaacaccaaactcataaataaaagaggaggccttcgcctcctcttttatttatcctcgatgtatattcaagttacgttgttctatccatgacaatatttccggactaaatacgatttgtttttgtgttaagtcgtcaatatttttagcatctaacatcgtcattattgatttcatgtgttcaataaatgattctacataagctactgtatgtgcaatgccattattttcaacttgatttaaaaacggacgtgacataccagttgcctttgcaccaagtgctaaacttttaattgcatcgagtggtgtacgtaaaccaccactcgcgaaaactgaaatttcgctttgataagccgttgtttcaagtaatgactcaactgtagactgtccccatgatgataagtaatccatatctttatttgcacgacgttcattttcaatatctacaaagttagtaccacctttgccactaacatcgacatacttgacgcctatttgttgtaagtcatgcattaattctttgctcataccaaatccaacttcttttataatgactggaacagacactcgtgatacaatcgacgctatattatctaaccaagtcacaaattcacgattcccttcaggcataactaattcttgaggagaattaacatggatttgtaacgcttgtgcctcaagtaattcaactgcttccaaagccttttctactggtacgtccgcaccaacattgctaaaaatcatgccttcaggattcatttttcgcgcaatcgtaaacgtctcagccatgcgtggatttctcaatgccgcatgtgttgatccaactgccatcgctaagccagtttctcttgcaactacagctagcttttcattgatgtttttcgtccactcgctaccacccgtcattgcattaatataaaccggatatgccatcgttaagtcaggcgtctgtgatgtcaaatcgatatcatttacattaattgatgggatagaatgatgcacaaaacgcatcttatcaaaatctgaatgcattgcgtcagattgggccattgctatttcaacatgttcattttttctctgttctctttgaaaatcactcatgattaaacctaccttttcgtcatttctaatttaaaaccattttttacgtctgaaaaagatgattaatacgacagctataacaaacattacagctaagcaaatataatatccataatgtaaatgtaatgccggcatatttacaaagttcataccataaatcccagctatgaatgttaacggtgaaaatataactgatactaatgtcagtacttgcataatactattcattctaaatgacgtgtatgactcaaaattttctcgtatttcgtttgtcatttcttgagcagtacgaatgatattacgttgcttaatcaagtggtcatcgatatgttgaatgtatagcgaatgtttattatctataatcaaatcaccattttgtttcattgtatcaattagctcttgcataggaaacagtacacgttttactttaatcaaatccgaacgtaacttaaagacactatccatgaccattttattaaagcgatcatctacatggcggtcttcaaaatgataaacactatcttcaagtgcatatacaaagttgaaatatttatcaaccatcatatctaaaattaatatgacgacatctgcacaatctaattctgcatctaatgtattcatatacttatagactactttatttaatgattccaacgtttgatgatgatatgttactaatacattgtcttgtataaaaatatttagtgctattggtgaatagtttgaccccataatactatggaatactaagtattgataatctttataagatttatatttagctcgtggcataccgttaattgcatcatccacttctaaatcattaaaattaaaatgtgctttaaaccattcattttcttgttcattcggttcatcaaaatcataccaaacaatagtcgcatcttttggtatctctttgatatcatcaactactttaaacggttcatatgtagtttgataccgtatctttaaagccatcgatactccccctaaataacgaattctctattattttatcatgaattaaataacgtgtatgtcttaatttattttagtatgatagtcactaaggagatggttattatcaaacaactttttacacatactcaaaccgtaacatctgaattcattgaccataacaatcatatgcatgatgcaaattataatatcatttttagtgacgtcgtgaatcgttttaattacagccacggtctttctttaaaagaacgcgaaaatttagcatatacgctatttacactagaagaacatacgacatacctctcagaattgtctcttggcgatgtatttactgttactttatatatttatgattacgattataagcggttgcatttatttttaacattaactaaagaagatggtacactagcatcaacaaatgaagtaatgatgatgggaattaatcagcacacacgtcgttctgatgcttttcctgaatcattttcaacacaaatagcacactattataaaaatcaatcaactatcacttggcctgaacaattaggacataaaatagcaattccacacaaaggagcattaaaatgacagatgcattacaacaaaagattcatatcgaattactagatttattagatgatgttaagtttgaattaacagaattaaatgcacaaaaagggttatacattaacggaccagcaaatcagctacttaagcgtggcgtgcatatggcttatgttcaaggacaaaagcaagccatcgataatattatgactattgtggaacaacagcttgaaagatcaacatttcctagaacattatgataaatttcaaaatgaggttgctcatcgcaattatgataaaacagctaactttgcagaacttagtgatattccacgtcaattcgataattttttagatcaattttatcaaattaaagggcaatactttatcatcacacatatcaatacacttattggtgattttcactcagaagctcattaacaattagtctatataacccttgctatattttcaaaaacaaaacccaattacgttttcatgtcaaatatcatcttgcatgaaatcgtaactgggtcatttatatgttattagttattttgtgttacatcctcatctatcgatttggcaatttgtttaatagctttatgtgattgtctaattggataaattggaaaatcatgtaccatcttaggataatcataaaactcaatgtattgatgatgttgcaacatcatttgttcaaatagcttcatatcaggatgtgtcatttcacgtccaccaccaaacatataaactggtggcaatccttctattgtgccattaattggcgatatgcgcttatctgttaatggtaggccattcgcccattttttcataatctcattgacaccaaactgacttagaaccgcatcttgttcgattaaggcgtccgaaatatctttattagatagtgttgcatctaaaattggtgagattaaatacaatttattcggtaatggctgttgattakctaaaagagattgtacaaaggataatgccagtgcaccacctgaaccatcacccatgactacgacattttgatgtcctacttcagatactaattgatcataaacacgttgtatcgcttggnaaagtatcgtcaatatgnaaactctggtgtctttggatagataggcagtacaacctcatataatgtacttaaagtgattttatcccaacaatctccaatggaacggtgatggttgtagtgcattgaatccaccgtgaatatataaaattttcttatcaatttgatgtctgaaattaaagcgaaagacttgcatatcatctaatgacaatttttctaaatttgctttaacatttaatgttgaaggctgcttatgtttttttctattttcaatttctcttttataaaaaaatctttcaacatcttgatcatttttaaacataatcgagcgattgtgaagcaaatatttattgacaacgctattcataacacggtttctaatcaatgtcttaacctacctttatatattttatgtatccaatgatkgtctatcccctacattctttgccaaaaaaagtatataatgtagaagatattttctttttcactttcaaatttaagactacaattgaacagtgatttttcatcattataacagacaactagacatattgataagtaaagaaaagaactttatacggaggtaccttgcatgacaaatccaaatcaacgattagaaccatttgatgagacatttcaacaaccgaatattcatcgtggtaagcgatatggtaagaaaaaacgttcattggtaagcatgattattcaaatcattgttgtwatattaaccaccatcgctggaatacagcatggtgg

SEQ ID NO: 37 - DNA, 9834 bp; double-stranded, linear
gtcattaccgamtttcttagaatcatttaaagatgataaatatacaaacgttggtaatttaaaagaagtgaattttgataaaattgctgcgacgaaacccgaagtaatctttatctctggacgtacagctaatcaaaagaatttagatgaattcaaaaaagctgcacctaaagcgaaaattgtttatgttggtgcagatgaaaagaacttaattggttcaatgaaacaaaacactgaaaatatcggaaaaatttacgataaagaagataaagctaaagaattaaataaagatttagataacaaaattgcttcaatgaaagataaaacgaaaaacttcaataaaactgttatgtatttactagttaacgaaggtgaattatcaacatttggacctaaaggtcgttttggtggattagtttacgatacattaggattcaatgcagttgataaaaaagtaagtaatagcaatcatggacaaaatgtttctaacgaatatgttaataaagaaaatccagatgttattttagcgatggatagaggtcaagcgataagtggtaaatcaactgcgaaacaagcattaaataatcctgtattaaaaaatgttaaagcaattaaagaagacaaagtatataatttagatcctaaattatggtactttgcagctggatcaactacaactacaattaaacaaattgaggaacttgataaagttgtaaaataattttaaaagaggggaacaatggttaaaggtcttaatcattgctcccctcttttctttaaaaaaggaaatctgggacgtcaatcaatgtcctagactctaaaatgttctgttgtcagtcgttggttgaatgaacatgtacttgtaacaagttcatttcaatactagtgggctccaaacatagagaaatttgattttcaatttctactgacaatgcaagttggcggggcccaaacatagagaatttcaaaaaggaattctacagaagtggtgctttatcatgtctgacccactccctataatgttttgactatgttgtttaaatttcaaaataaatatgatagtgatatttacagcgattgttaaaccgagattggcaatttggacaacgctctaccatcatatattcattgattgttaattcgtgtttgcatacaccgcataagattgctttttcgttaaatgaaggctcagaccaacgcttaatggcgtgcttttcaaactcattatggcacttatagcatggatagtatttattacaacatttaaatttaatagcaataatatcttcttcggtaaaataatggcgacascgtgtttcagtatcgattaatgaaccataaactttaggcatagacaaagctccttaacttacgattcctttggatgttcaccaataatgcgaacttcacgatttaattcaatgccaaatttttctttgacggtcttttgtacataatgaataaggttttcataatctgtagcagttccattgtctacatttaccataaaaccagcgtgtttggttgaaacttcaacgccgccaatacggtgaccttgcaaattagaatcttgtatcaatttacctgcaaaatgaccaggcggtctttggaatacactaccacatgaaggatactctaaaggttgtttagattctctacgttctgttaaatcatccattttagcttgtatttcagtcattttaccaggagctaaagtaaatgcagcttctaatacaactaagtgttctttttgaataatgctattacgataatctaactctaattcttttgttgtaagtttaattaacgagccttgttcgtttacgcaaagcgcatagtctatacaatctttaacttcgccaccataagcgccagcattcatatacactgcaccaccaattgaacctggaataccacatgcaaattcaaggccagtaagtgcgtaatcacgagcaacacgtgagacatcaataattgcagcgccgctaccggctattatcgcatcatcagatacttcgatatgatctagtgataataaactaattacaataccgcgaataccaccttcacggataataatatttgagccatttcctaaatatgtaacaggaatctcattttgataggcatatttaacaactgcttgtacttcttcatttttagtaggggtaatgtaaaagtcggcattaccacctgttttagtataagtgtatcgttttaaaggttcatcaactttaattttttcatttgggataagttgttgtaaagcttgatagatgtctttatttatcacttctcagtacatcctttctcatgtctttaatatcatatagtattataccaattttaaaattcatttgcgaaaattgaaaagaaagtattagaattagtataattataaaatacggcattattgtcgttataagtattttttacatagtttttcaaagtattgttgcttttgcatctcatattgtctaattgttaagctatgttgcaatatttggtgtttttttgtattgaattgcaaagcaatatcatcattagttgataagaggtaatcaagtgcaagataagattcaaatgtttgggtattcatttgaatgatatgtagacgcacctgttgttttagttcatgaaaattgttaaacttcgccatcataactttcttagtatatttatgatgcaaacgataaaaccctacataatttaagcgtttttcatctaaggatgtaatatcatgcaaattttctacacctactaaaatatctaaaattggctctgttgaatatttaaaatgatgctaccgccaatatgttttgtatattttactgggctgtctaagaggttgaataataatgattcaatttcagtgtattgtgattgaaaacaattagttaaatcactattaatgaatggttgaacatttgaatacatgataaactcctttgatattgaaaattaatttaatcacgataaagtctggaatactataacataattcattttcataataaacatgtttttgtataatgaatctgttaaggagtgcaatcatgaaaaaaattgttattatcgctgttttagcgattttatttgtagtaataagtgcttgtggtaataaagaaaaagaggcacaacatcaatttactaagcaatttaaagatgttgagcaaaaacaaaaagaattacaacatgtcatggataatatacatttgaaagaaattgatcatctaagtaaaactgatacaactgataaaaatagtaaagaatttaaggcactacaagaagatgttaaaaaccatctcatacctaaatttgaagcatattataagtcagcaaaaaatttgcctgatgatacaatgaaagttaagaaattaaaaaaagaatatatgacgcttgcaaatgagaagaaggatgcgatatatcaattaaaaaaattcataggtttatgtaatcaatctatcaagtataacgaagacattttagattatacgaaacaatttgaaaaaaatagatacaaagttgaatcagaaattaaattagctgataataaaagtgaagcaactaatcttacgacaaaattagaacataataataaagcgttaagagatactgcgaagaagaacctagatgatagtaaagaaaatgaagtaaaaggcgcgattaaaaatcacattatgccaatgattgaaaagcaaattaccgatattaaccaaactaatattagtgataagcatgttaataatgcaaggaaaaacgcaatagaaatgtattacagtctgcagaactattataatacacgtattgaaacaataaaggttagtgagaagttatcamaagtcgatgtagataagttgccgaaaaagggtatagatataactcacggcgataaagcctttgaaaaaaagcttgaaaaattagaagaaaaataactataatcatttttcaaagttaaaaattttgaatttatggttaacatgtcaacttactatgtgtataatggtaaacattgatattaactatatgtataaaaatgtcacgcagatgctatttaaatgtgataaatatttttagaggtgaatagagtggctataaagctaagttcaattgaccaatttgaacaggttattgaggaaaataaatatgtttttgtattaaaacatagtgaaacttgtccaatatcggcaaatgcgtacgatcaatttaataaatttttatatgaacgcgatatggacggttattatttgattgtccaacaagaacgcgatttgtcagattatattgctaaaaaaacgaacgttaaacatgaatcacctcaagcattttattttgtaaatggtgaaatggtttggaatcgagaccacggtgatatcaatgtgtcgtcattagcacaagcagaagaataatgaaactatagggttggaacattttgccttacactactagacgtgaatagcacaacttaaattcgtgtgaatcagagtagtttggctataatgatgttctgaccttttattttatgtcacctttagaagcagttaagttagtacttttttacaaacatatgtataatatattcgagtatttttattgaaaatattttggaaaacgacgaatccaataagaaaatttaaacatgatttgtaagttagtttaataggaaatatatgctaaaccaaaagaagcatattgttatttactggaataattaataatcatgtcatgttaaatgttagcatataatcacgagataaaatctaaaatttaagattaatcttttatgaataaaaaacgtatcacaacaaataataaagtaaggtggtcaaggttatgaaagtattagtagccatggatgagtttcatggaattatttcaagttatcaagctaatagatatgttgaagaggcagttgcaagccaaattgaaactgcagatgtagttcaagtaccattgtttaatggaagacatgaattattagattctgtatttttatggcmatctgggcaaaagtatcgtataccagtacatgatgcagatatgaatgaagttgaaggtgtttacggacaaactgatacagggatgaccgttatcgaggggaatttatttttaaaaggtaaaaaaccaattgttgaacgaacaagttatggtttaggagaaatgattaaacatgcattagataacgacgcaaaacatgttgtaatttcactaggtgggattgatagttttgatgctggtgcaggtatgttacaagcattaggtgctcaattctatgatgacgaagggcgtgtcgtagatatgagacaaggtgctggtgtaattaaatatattcgtcgtatggatatgtcgaacttacaccctaaaatggaaacagcaagaattcaagtaatgtcggatttttcaagtcgattatatggtaagcaaagtgaaatcatgcaaacttatgatgcgcatcagttgaatcataatcaagcagcagaaatcgataatttaatttggtattttagtgagttatttaaaagtgaattgaaaattgcaattggtccagttgaacgtggtggtgctggtggtggaattgcagcagtcttgaatggactgtatcaagctgaaatattaaccagtcatgcattagtagaccaactaacacatttagaaaatttagttgaacaagcggatttaattatttttggagaaggattaaatgaaaatgatcagttgctagaaacgacaacattgcgtattgcagaactttgtcataaacatcaaaaggttgccattgcaatttgtgcaactgctgaaaagtttgatttatttgaatcacaaggggttacagcaatgtttaatacatttatcgatatgccagaaacttatactgactttaaaatgggttacaaattaggcattatacggttcagtctttaaaactgttgaaaacacattttaatgttgaggtttagtaaagaaggactaaattggtgatgctgtcatgatggttaataacatttatgatggttagcaaaacgaattagaagatcgaaagtatacgtaaaaaatatgaaaaatcacgctatcattgcactgaatgttagcgtgatttttatatattaattaagcctgagttgaactagtatataatcgttggtttttagtgattttcagcgatatcttctacaattccaatgattacttgtactgctttttccataacatcaatggatgcatattcatatgggccgtggaagttaccgcaacctgtaaagatgtttggagttggtaaccccataaatgacaattgtgaaccatctgtaccaccgcgaataggttcagtgtttgctggaatatctaatttggcaaagacacgtttaggtatatcaataatatgaggcaatggtaatattttttctgccatattgaaatattgatccgatatatcaactttaactggataattttcaaaatgggcattgatatcgtcacgtatttctaaaatacgtttcttacgcaattcgaattgttttttatcatgatcacgaataatgtattgcaaagttgctttttcaacagttccttcaaagttcattaagtgataaaagccttcgtatccttctgttcgctccggaacttcactatcaggtagcaaactatcgaattgttcacctaaacgtattgcgtttaccattgcatttttagctgaaccaggatgaacatttacaccgtggcatgtaataaccgcttcagcagcgttaaagctttcatattgtaattctccatattgactaccatccatagtataagcaaaatcagcattgaagcggtcaacatcaaatttatgtggaccacgaccgatttcttcgtctggtgtaaatccaatgcgaatggtaccatgtttaatttctggatgttcttgtaaataacaaatagcttccataatttccacaatacccgctttatcgtctgcacctagtaacgatgtaccatcagttaccattaatgtatgaccaactaaactgttaagttctggaaatactttaggatctaagacacgtttagtattgcctagtttgtatggcttaccatcatagttttcaataatttgcggtttaacatttgaagcattgaaatcaggtgatgtatcaacatgcgccaaaaatccaactgttgggacgtcgacatcgatgttactttctaatgtagcaaataagtagccattttcatctaaatcagttggcaatcctaattgttgtaattctttttctaataaatgtaacaaatcccattgcttttcagttgaaggtgttgttgtagattttggatcagattgcgtatcaattgtcgtatatcttgttaatctatctatcaattggttcttcattatattcgaccccttaaactctattattcatgttgtaagattttttatatgtcttacctttgattttaccatacagttgtttgatacgtgtgtataggtaatatagaatttcagaaactaatataccgaaagcaatcgcacctgaaatcagtgtacttctaaaaatgtatttacagcacttgtataatcatttgatactaaaaaacgagtcgcttgataagctgcaccaccaggtactaatggtataatgcctggcactatgaatataattaccggtcgtttatatctgcgactcatagtatgactcattaagcctaaaattaagcttcccaaaaatgaagcgccaacttttccaaactctaaatctaccgttaattggtaaatcgtccatgcaatggcacccacaaatccacatgctactaagaggcgtttgggtgcattgaaaatgatagagaaaagtactgttgatataaagctgattgtaaaatgaaataaataaaatagcatgctttaacagtccttccttaaatgattaataaaacgattgcgacaccagcaccgattgcgaatgctgttaatgcagcttcaacaccgcgagacatacctgcaagtaattcacccgctaataaatctcgaatggcattggtaattaatataccagggacaagtggcatgacactggctatagtaatgatatcttgattggttgcaatgcctaatttagtaaatgtggctgcaatggatatgaccacagcggctgcaacaaactctgagaaaaatttaatttgtatatagcgttgcacaaagctgaatgttaaaaatgcggatccgccagcaatgactgcaatccaacaatctgatgcgacaccaccaaacataaataggaagaagccacatgcaatggcagctgcaaagaaattcgttaaaaaagaatattgtaatgatgcatgctgtaaatgaataaattcagatttagcttcatcaattgtgagttctttatttgatattttacgtgaaagactattcgttaaagcgattttctctaaatctgttgtacgctcttgtacacgaattaatcttgtacttgttcgatcgtttaatgaaaaaataattgcagttgaactgacaaaactatatgtattatgaagaccataactatgtgcgatacggttcattgtatcttcaactcgatatgtttcagcacctgattcaagtaaaattctacctgcaattaatacaacatcaatcactttgttttcatctataattgtgattgaatctggcatatcaattcacctccaatgatatgtgttatttatttgaacaattgaagtttacaacttgttgttacaactttcaatagtgagactttgtgttagtatgatgaacttgtatggttcaaatttaaataagaaaaactgttaatctttgctattatactatgatttaataatagcaaaggattaacagttttgtcgttgttataaattgataatagggttaaacattactttgtttcgcccttgatttttggctacatgcaccatatcgtctgcatctttaaacactttacgctgtgattttggatcgtcatctgttaaataaccaacaccgatagacactgacaatttaataacttctttgtttggtaaatggaatgatgatttttcaacacccgaacgaatattttcagctaatttaacactttgatcaagtgaataattgtgaatgacaactgagaactcttcgccaccatttctaaaaattttaaattgattcggcacatagtttttaagtaattgagacatttgttttaatacagcatcacctgatttgtgtgagtaggtatcattgacatctttaaatccatcgatatcgattaataataatgcgatactttgatgttctttttcagcttttcgtgaaatttcatttaaatgtctatcaaattcttttacattacctaagcctgttaagtaatcatatttatcttcgttttcataacgatttacgagtgagaagaaatgccaaatatcgacaaatgttatcgctgaagctaaagtgataattaatgaaattggtattaaaatgataacttccgatagtgtgtaaataggactcactaacgcgacaccaaataaaatgattattgtaacaacattaagtattaataatgatagcacatcattttgttttaaaaatggtccaatagcacttgttactgcagcaataacaatcaacgtaacaccgtacataatcgagttgttaaatactacaatttcaacaattgctacaattactgtggcagataatgtatagaccatatttgtaaatctacctaaaaacaataaaggaacgaatgttaagtgaattaaataatcttcacgataagggatagggtagacagataataataatgatacgattgtcattaaaacagtgacataagccttagaaaaaac

SEQ ID NO: 38 - DNA, 23439 bp; double-stranded, linear
tctcaatcagatgaaaaattgcatatcgtaggttttacagaaagtgcaaaatataatgcgtcatcagtcattttcacgaatgacgctaccattgccaagatcaatcctagattgactggagataaaattaatgcagttgttgtacgtgatacaaattggaaagacaaaaaattaaaccaagagcttgaagcggtaagtattaatgactttattgaaaatttaccaggttataaaccacagaacttaacattaaactttatgatttcattcttatttgtcatttcagctacagttataggcattttcctatatgtcatgacattacaaaagacgagtttatttggcatattaaaagctcaaggatttacgaatggctatttggcgaatgtggtaatttcgcagacggtcatattagcactatttggtacggcatttggcttactgttaacaggcgttacaggtgcatttttacctgatgcagtacctgtcaaattcgatgtactaacattgctcgtatttgcaattgtgttaatgattgtctctgtattaggaagtttattctccattttaacaattagaaaaatagatccgttaaaggcgattgggtaggaggtgtagcaaatgttgaaatttgaaaatgtaacaaagtcatttaaagatgggaatcgtaacattgaagcggttaaagatacaaattttgagataaataaaggtgatattatagcattggttggaccttctggctctggtaaaagtacatttctaactatggcaggtgctttacaaacaccgacatctgggcacattttaatcaataaccaagatattacgacaatgaagcaaaaagcattggcaaaagttagaatgtctgaaataggttttattttacaagctacaaaccttgtaccatttttaacggtaaagcaacaatttacattattgaaaaagaaaaataagaatgttatgtctaatgaagactatcagcaacttatgtcacaattaggtctaacttcattgcttaataagttaccttcagaaatttcaggtggtcagaaacaacgtgtggcgatagcaaagcgttatatacgaatccgtcgattattttagcggatgaacctaccgcggcgttagatactgaaaatgcgattgaagtcattaaaattctacgtgatcaagccaaacaaagaaagaaagcatgtattattgttacacatgatgaacgacttaaagcatattgtgatcgttcatatcatatgaaagatggcgtccttaatcttgaaaatgaaacagtagaatagttttattaagccggtacatcatgtgccggtatttttatgtttatgtattatttgaataaactttcacattcaattaataataattattatcgaaaatcagaaatattccgtgaaatataatattttttgtagtaaaatggcctctaagtattcaatatttaaatatggggattgaatataaaattatcgtaatgggggtcaatggttatggatttattgataggtactttatttttatttttggtcttagtgatttttacattatttacatataaagcgcctaatggtatgcgtgccatgggagcattagctaatgcagcaatcgcaacatttttagtggaagcatttaataaatatgttggtggcgaagtattcggtattaaatttttagaagagctaggagacgctgcgggaggtctaggtggtgtcgctgccgctggattaacagcattagctatcggtgtgtcaccagtatatgcattagttatagcagccgcgtgcggtggtatggatttattaccaggtttctttgcgggttatatgattggatatgtgatgaaatatacagagaaatatgtgccggatggtgtcgacttaattggatcgattgtcatcttagcgccattagctcgtcttattgcagtattattaacgccagtagtgaatagtacattgattcgaattggtgatattatccaaagtagtacgaatacgaatccaattatcatgggtatcattttaggtggtattattacggttgtcggcacagcgccattgagttcaatggcattgacagcattattaggtttaacgggtgtacctatggctattggtgccatggcagcatttagttcggcatttatgaatgggacgctattccatcgcttaaaattaggtgatcgtaagtctacgattgcagtaagtattgaacctttatcacaagcagatattgtatcagccaatccaattccaatctatattacaaatttctttggtggtgcgattgctggtttaattattgctatgtcaggtttaattaacgatgcgacaggtacagctacaccgattgcaggatttttagttatgtttggatttaatcatccgacgacaattgtgatttatggtgtagtaatggcgattgtaggtgcgcttgcaggttatcttggttcaattgtatttaaaaaatatccaattgttactaagcaagacatgattaatcgaggtgcagtagacgcatagcatcatcatattgaatagtaaaaacaaataaaacatagtaacgtgattcagtcgatgtaacagtcgataatgagtcacgtttttttatagaaaaatacaagacataaaaatgtcataatttattgtcgacaaatatcatactgtataaacatttatcattttctcaagtaccttttacacgatggaatgaacttactttttacgaaattatgcgtattttataaacaaatatcattgatataacggtaaatgtaagcgtttacaacagaaataacagcatgctacgatatttttgtaaattcactgattcaagtattttaagtcaatatgaggagggatgttatgagcgattctgagaaagaaattttaaaaagaattaaagataatccgtttatttcacaacgtgaacttgctgaggcaattggattatctagacccagcgtagcaaacattatttcaggattaatacaaaaggaatatgttatgggaaaggcatatgttttaaatgaagattatcctattgtttgtattggcgcagcgaatgtagatcgtaagttttatgtgcataaaaatttagttgcagaaacatcaaatcctgtaacgtcaacacgctctattggtggcgtagcaagaaatattgctgagaacttaggtaggcttggcgaaacggtcgcttttttatctgctagtggacaagatagtgaatgggaaatgattaaacgattgtccacaccatttatgaatttggatcatgttcaacaatttgaaaatgcgagtacaggttcatatacagctttaattagtaaagaaggcgacatgacatatggcttagcagatatggaagtgtttgactacattacgcctgaatttttaattaagcgttcacacttattgaaaaaggctaagtgcattattgtagatttgaatttaggcaaagaggcattaaacttcttatgtgcctataccacgaaacatcaaatcaaattagttatcaccacggtttcttccccaaaaatgaaaaatatgcctgattcattacatgctattgattggattatcacgaataaagatgaaacagaaacatacttaaatttaaaaatagaatctactgatgatttaaaaatagctgctaaacgctggaatgatttaggtgttaaaaatgttattgtgacaaatggcgtgaaagaactcatttatcgaagtggtgaggaagaaatcattaagtcagttatgccatcaaatagtgtgaaagatgttacaggtgcaggcgattcattctgtgctgcagtagtgtatagctggttaaatgggatgtctactgaagatatattaattgctggtatggttaacgcaaagaaaacgatagaaacgaaatatacagttaggcaaaacctagatcaacagcaactttatcacgatatggaggattataaaaatggcaaatttacaaaagtatattgagtattctcgagaagttcagcaagcacgggagaacaatcaaccgattgtagcattagaatcaacaattatttcgcatggtatgccgtacccacaaaatgttgaaatggcaacaacagtagagcaaattatcaggaataatggtgccattccagcaaccatagccattatagatggcaaaattaaaattggtttagaaagcgaagatttagaaatactggcaactagtaaagacgttgctaaagtatctagaagggatttagcagaagttattgcgatgaagtgtgttggtgctactactgtagcgacgacgatgatatgtgctgcaatggctggtattcaattttttgttacaggaggtattgggggcgtccataaaggtgcagaacatacgatggacatttcagcagacttagaagaactgtctaaaacaaatgtcactgttatctgtgcaggtgccaaatcaattttagacttacctaagacgatggagtatttagaaacaaaaggcgttccagttattggatatcaaacgaatgaattgccagcattcttcactcgcgaaagcggtgttaagttaacaagttcggttgaaacgccagaacgacttgctgacattcatttaacaaaacagcagttaaatcttgaaggtggcattgttgttgctaatccaattccatatgagcatgccttatcaaaagcatatattgaggcaatcataaatgaagctgttgttgaagcggaaaatcaaggtattaaaggtaaggacgccacaccgttcttgttagggaaaattgtagaaaaaacgaatggtaaaagtttagcagcaaatataaaacttgttgaaaacaatgcggcgttgggtgctaaaattgctgtcgctgttaataaattattgtaggtgatgatacatgaatattttattcgctatcacagggatagcatttgcactatttgttgcgtttttattcagttttgatcgtaaaaaaatagacttcaaaaagacgttaataatgatatttattcaagtgttgatcgtgttatttatgatgaacacaacgattggtttgacaattttaactgcactaggttcattttttgaagggctaataaatattagtaaagcaggcataaattttgtttttggagatatacaaaataaaaatggctttacgttctttttaaacgtattactgccattagtttttatttctgtattaataggcatctttaattatattaaggtattaccatttattatcaaatatgtaggtatcgctattaataaaataactagaatggggcgcttagaaagttattttgctatttcaacagcaatgtttgggcaaccagaagtatatttaacaataaaagatattattccaagattatctagagcgaaattatatacaattgcgacgtctggtatgagtgctgttagtatggcaatgctaggttcatatatgcagatgattgaacccaagttcgtagttacagcagtaatgttaaatatttttagtgcgcttatcatcgccagtgtaatcaatccctataaatctgatgatactgatgttgaaattgataacttaacgaaatccacagaaactaaaacattgaatggaaaaacaggaaaacctaagaaagttgcctttttccaaatgattggtgatagtgcgatggatgggtttaaaatcgctgttgtagtagccgtaatgttgttagcatttatttcattaatggaagcaattaatatcatgtttggtagtgttggtttgaactttaaacagcttattggctatgtgtttgcaccaatcgcattcttaatggggattccatggagcgaactgttccagctggctctttaatggcgactaaattaattacaaatgagtttgtagcaatgcttgattttaaaaatgtcctgggtgatgtatcagctcgaacacaaggtatcatttcagtttacttagtaagcttcgctaattttggtacggttggtatcatcgtaggttcaattaaaggcattagtgataaacaaggagaaaaagttgcatcctttgcaatgaggttgctacttggttcaactctagcttcaatcatttcaggatcaatcattggcttagtattgtaaatgaatcgaagtacctaaattaaattcatggcaaagctaaaccccgtcaccaagttggcgcaacagcgcatgcataacttagtgacggggttttatcataacaatctactttttcgtagccgtttttgaaatgtatgttgatggtttatctttttcaaaaattgttaatcccgttatatcttttttatgttttgaagggacaatgaagctaagtatataagcaaagacaaaagcaactgtaaatgaaatggtagatacatagaaaggtgagttacctttgccaacaccattatagacataagcaaagatgatacccaatattaatccacaaataacaccgaatgtattcgtacgtttagtgaaaataccaactgcaaatacaccagccaatggaacgccgaataatccagtcacaaacaagaataaatcccataagtcatttgaattagaagcaattaagtatagtgacattccaaaaccgaaaatacctgcaatgataataatgaaacgtgcaaagttaacttcgtgtcgctcgctaccttttccgaagaagcgttgcttaatgtcgattgaaatacaagcagatatagaatttaaactagatgaaatggtagactgtgcagcggcgaaaatggctgcaataagtaatcctgctacaaatggtggcatctcagtcaaaatgaaatatggcactacagatgatgtattgaagccttttggtaaaacagcttcatgtgtataaaatgaatacagcattgtacccataccataaaataagggtgctgaaattaaagctaggataccatttgtccataacgatttatttgtttcttttaaactatcagaagcttgataacgctgcacgacgtcttgactcgctgtgtattgatacaagttgttgaaaatatttcctaggaaaataattggaatggcagctgccgcagtatttagtttccaattgtctgcactaattaattttttgtgctcaatcgcatctgcaaagacagtgccgaaaccgcctttaatgttcacaacacctagaataataataactaaagcgccgcctaataaaatgacgccttgaatgaaatcactccaaaccacaccttcgaaaccacctaaaaatgtatataaaatacatagtaaaccaacgagtgatgcaacgatataagggttcatgtctgatacagatgtgattgctaatgttggtaagtagataacaattgcaacacgccctaaatggtaaacgacaaataataatgagccaatgacacgtatgctagggccaaatctagcttctaaatattcatatgcagatgttacctttaactttttaaagaaagggacatagaaataaataagtaatggaataattgcgacgatagcaatgttaccagcgatatatgaccaatctgttaaaaatgctttctctggtgtcgacataaatgtaatcgcacttaacgtagtagcataaattgaaaagccaactacccaagatggcaagcgaccacttgcggtaaagaaactattggtactttggctcgcgcgcttggtaaaataaacgccaatgaacaacatagctagtagataaatgataacggcaacccagtttagtgtgccaaatccaacttctttcatgggcaacatcccctttacaatgtattgattctttgatgtctataaatcgtattttgcaatgagttgatctaatgtttgtcgatgtgcttcgttaaaaggtttgaaaggtcttttcggtaatcctgcatcaatgccacgatgacgtaatatttctttcaatgttggataaatccccattgataacactgtttcgataatgtcgtttgaatcatgttgcagttggtaagcttcttgaatttgaccttgtcgtgctaagtcgaagatttttcttgcacggcgaccattaacgttatatgtagaaccaattgcaccatctacgccagaaatcgtagcttgaactaacatttcatcaaagccagataagattaatttgtctgggaatgcttttctaatacgttcgagtaggaagaagtttggcgctgtatatttaacaccaacaattttttcatgattaaatagctcgctgaattgttcaatagaaatattcacacctgttaaatctggtattgcataaataatcatattgttctgagttgcttcgataatatcgaaatagtaatctctaatttcttcaaaagtaaatggatagtagaatggtgttacggcagaaagtgcatcataaccgagttctgtggcatattttccaagttcaatggcttcatttaaatctaacgaacctacttgagcaatcaatttcactttatccccaactgcctctttggcaaccttgaaaacttgcttcttctgctctgtatttaataaaaagttttcgcctgagctaccatttacataaagaccgtctaattcttcagtttcaatggcattttgagcaatttgtttaagtccttgttcatttacttgaccattttcatcaaaaggaacgagtaacgctgcatataaaccttttaaatctttgttcattatgaagtccctccaaaaatcatttgataatatagtttacagctataattgtaaacgctatcataaaatgtaacaatatctttttgaaaattgtagtcatatttatgtataattaatgaaaatgtttttcaaaatcaatagaaatggagtgagtaaggtgtattacatcgcaatcgatattggaggcactcaaattaaatcggcagttattgataagcaattgaatatgtttgactatcaacaaatatcaacgccggacaacaaaagtgagcttattactgacaaagtatatgagattgtaacaggatatatgaagcaatatcagttgatccaacctgtcataggtatttcatcagcaggcgttgttgatgaacaaaaaggcgaaattgtatacgcagggccaaccattccgaattataaaggtactaattttaagcgattattaaaatcactgtctccttatgtcaaagtaaaaaatgatgtaaacgctgcattactaggcgaattgaaattacatcaatatcaagcagaacggatcttttgtatgacgcttggtacaggcattgggggtgcgtacaagaataatcaaggtcatattgataatggtgagcttcataaggcaaatgaagttgggtatttattgtatcgtccaactgaaaatacaacgtttgagcaacgtgctgcaacgagtgcattgaaaaagcgcatgattgccggaggatttacgagaagcacacatgtgccagtattgtttgaagcagctgaagaaggtgatgatattgcaaaacaaatattgaatgagtgggcagaagatgtagcagaagggattgcccaaatacaggtcatgtatgatccagggcttatattaattgggggcggtatatctgaacaaggagataatctcattaaatatatcgagccgaaagttgcacactatttaccaaaagactatgtttatgcaccaatacaaacgactaagagtaaaaatgatgcagcattatatggctgtttgcaatgatagttgaaagaaggagtcattctaaaatagaatttgaaaccgttacgagagatgagagctgttgttagttccacacatcacactctatctaggaccaatctaaactatatcaaccaacagtgtgccacgggcaaattaaattgaagaagctgagatattaaaattttagaaaatgtaaaaaaatatttggtattgaaattaaaaaagcacctagcaactcgttgggacaatcacgatgattgtctacagttgcaggtggatttgaatatactactagttatttgttgtctaggataatagatttagtatgttgataagtttgactcagattcgtattttctaataaatgataactcacgatatcgattaaaaagagtgtcgcaatttgtgtgttgataaattgatggtcggtattacgcgattgatccgttgttaaaagtactaaatctgcacaatctgtaagtttactaccttcaaaatttgtgatggcaacgacatatgcaccatgagatttggcgacttccgctgcagaaattaattccgaagtattaccactatttgacatagcaataaacatatccgaatgagatagtagggatgccgatattttcattaaatgtgaatcggtagtaacattaccttttagccccatacgaatcatacgataataaaattcagtcgctgataaaccagagctacctagtccagcaaagagtatatgtcgacttgattgaagtttgtcgataaaggtttggataatgtcgttatcaataaattcaccagtttgttgaatgatttgttgatgatatttatgaattctttgaataattgggctattttcaataactgtctctgtcatttcttgttgaatattaaattttaaatcttggaaattctcataatccagcttatgactaaagcgtgtcatcgttgctggtgatgtaccaatcgcatgggctaaggagttaatcgttgaaaaggcatcgctataaccattttgtcttatataattgacgatgcgtttatcagtttttgtaaataaatgttgataacgttgaacacgattctcaaatttcattgtgtcaccccttcatcttaatgattactattatatatgaaaaatattttcaagatagtaaaaagcattgataaaaattatcttaatgatatattgtaaatgactttacgtgaaaaaacgacttatggagtgaggaataatgttaccacatggattaatagtatcttgtcaggcactaccagatgaaccattgcattcatcttttattatgtcgaaaatggcattagctgcgtatgaaggtggtgctgttggtattcgcgcaaatactaaggaagacattttagcaattaaagaaacggtagatttaccagttattggcattgtgaaacgtgactatgatcactcagatgttttcattactgcaacgtcaaaagaagttgatgaactgatagaaagccaatgtgaagtcattgcattggatgcaacgttacagcaacgtccgaaagaaacgttagacgaattagtatcatatattagaacacatgcaccgaacgttgaaatcatggctgatatcgcgaccgttgaagaagctaaaaatgccgcacgacttggctttgattatattggcacgacgttacatggctatactagttatacgcaaggacaattactttatcaaaatgacttccaatttttaaaagatgtactacaaagtgttgatgcaaaagttattgcggaaggtaatgtcattacaccggatatgtataaacgtgtgatggacttaggcgttcattgttcagtcgttggtggtgcgataacacgaccaaaagaaattacgaaacgttttgttcaaattatggaagattaaatgataacgataaaaaaacgagatgaccatcattaattaaaggcacctaattatcttaggtggctgaatgaatgtaatgggttcatctcgttttgtttgtttatgatagtgattttattttcaactttatccaaaaataagtaaagcgacggggatggtgattaatagcgacaacgccacgcgtaaaaaccaaatgatgatgagtttccagacaggtattttaatttcagttgctagtatacatggcactaatgctgagaaaaagataatggctgatacgcttactacaccgacgacaaatttagtactcattgcagctttagttactaacaaagatggtagaaacatctctacaatagaaackctgacgcttttgctagtaaagcctgatcagcaattgggaaaatataaataaatggatagaagatatagccaagccaatcaatgaatggtgtatagttcgctacaatcagtcctaaaaaaccaatcgataatatagaaggtaaaataccaacagtcatttctaaaccgtctttcaaattgtcccaaacgttcttcacgagagatggtgttaatgcattttgtttcatcgcctctgcatatgcagttttcagtctgcttccttcaatagcaacttcttgttctccttcttgtccgttataatattctgttgattcattgctgattggcggtagccatgcagtaattgcagtcacgacaaatgtgatgactaaagttatccaaaagtataaattccaatgcggcattaatcctaaagttttagcaacgataatcataaaagttgctgaaactgttgaaaagccagtcgcaataatcgtggcttctcgtttgttgtacatcccttgcttatagacacgattagtaatcaataatcctaaggaataactgccgacaaacgaagccactgcatcgacagcggattttcctggtgttttaaaaataggtctcataataggctccatataaacaccgacaaattctaataagccatagcccactaataaagaaagcgcaattgcacctactggaattaagatacttaatggcatcattaatttttcaaacaaaaacggaccatagttagctttaaatagtattgatggaccgattttaaatacatacattataccgatcattgcacctgcaactttaaataatgtaatgaccaagtttgtgattgaagtcataaaagtacgtctcactattggtaacgctgtaccaattaaaatcataatcagtgcaacatagggcataagtggacctatgattgagcgaatggctagatgaacatgatcgacgaaaatagtgttgttaccattaatcgtaaaaggaataaagaaacatagtatgcccactaaactatagacaaaaaaacgccatgcacttggttgttgtgcattagaatgatattgattcattaaagcaacccctttgtttaaatgaatacacaaaactgtatgatgcatcttccccttaatgagatgaatcattattttaatttagaaaaatctgaaaacttactataattgtatagtttgaattattttcataccaatacaaattaactaattatatatagattgaaactatattacttaataaaatatttatcttaaatgttgttgtgttgattcaacaccacaactaaaagtgtttataaattatttggaaatacacatatttgtaaatgattagtatcgatttaatatcgtattattaaatttttattaattttgtagtcttaatcmaaaaataatatatgtcatgttatattgaaggtgcagttgtttttcattctcaagagggggtcaaaaaaatacttttgaggtgattatatgttaagaggacaagaagaaagaaagtatagtattagaaagtattcaataggcgtggtgtcagtgttagcggctacaatgtttgttgtgtcatcacatgaagcacaagcctcggaaaaaacatcaactaatgcagcggcacaaaaagaaacactaaatcaaccgggagaacaagggaatgcgataacgtcacatcaaatgcagtcaggaaagcaattagacgatatgcataaagagaatggtaaaagtggaacagtgacagaaggtaaagatacgcttcaatcatcgaagcatcaatcaacacaaaatagtaaaacaatcagaacgcaaaatgataatcaagtaaagcaagattctgaacgacaaggttctaaacagtcacaccaaaataatgcgactaataatactgaacgtcaaaatgatcaggttcaaaatacccatcatgctgaacgtaatggatcacaatcgacaacgtcacaatcgaatgatgttgataaatcacaaccatccattccggcacaaaaggtaatacccaatcatgataaagcagcaccaacttcaactacacccccgtctaatgataaaactgcacctaaatcaacaaaagcacaagatgcaaccacggacaaacatccaaatcaacaagatacacatcaacctgcgcatcaaatcatagatgcaaagcaagatgatactgttcgccaaagtgaacagaaaccacaagttggcgatttaagtaaacatatcgatggtcaaaattccccagagaaaccgacagataaaaatactgataataaacaactaatcaaagatgcgcttcaagcgcctaaaacacgttcgactacaaatgcagcagcagatgctaaaaaggttcgaccacttaaagcgaatcaagtacaaccacttaacaaatatccagttgtttttgtacatggatttttaggattagtaggcgataatgcacctgctttatatccaaattattggggtggaaataaatttaaagttatcgaagaattgagaaagcaaggctataatgtacatcaagcaagtgtaagtgcatttggtagtaactatgatcgcgctgtagaactttattattacattaaaggtggtcgcgtagattatggcgcagcacatgcagctaaatacggacatgagcgctatggtaagacttataaaggaatcatgcctaattgggaacctggtaaaaaggtacatcttgtagggcatagtatgggtggtcaaacaattcgtttaatggaagagtttttaagaaatggtaacaaagaagaaattgcctatcataaagcgcatggtggagaaatatcaccattattcactggtggtcataacaatatggttgcatcaatcacaacattagcaacaccacataatggttcacaagcagctgataagtttggaaatacagaagctgttagaaaaatcatgttcgctttaaatcgatttatgggtaacaagtattcgaatatcgatttaggattaacgcaatggggctttaaacaattaccaaatgagagttacattgactatataaaacgcgttagtaaaagcaaaatttggacatcagacgacaatgctgcctatgatttaacgttagatggctctgcaaaattgaacaacatgacaagtatgaatcctaatattacgtatacgacttatacaggtgtatcatctcatactggtccattaggttatgaaaatcctgatttaggtacatttttcttaatggctacaacgagtagaattattggtcatgatgcaagagaagaatggcgtaaaaatgatggtgtcgtaccagtgatttcgtcattacatccgtccaatcaaccatttgttaatgttacgaatgatgaacctgccacacgcagaggtatctggcaagttaaaccaatcatacaaggatgggatcatgtcgattttatcggtgtggacttcctggatttcaaacgtaaaggtgcagaacttgccaacttctatacaggtattataaatgacttgttgcgtgttgaagcgactgaaagtaaaggaacacaattgaaagcaagttaaattcatcttctgaatttaatatgctatgtaaatcgtgctgttatcatggcacatcagatataagtagcatcacagtgttgaatttaaaaatagtaaagtgaaataaagcgcctgtctcattagcgaaaactaaagggacaggcgtatctgtttatgagcttaataaattgtatgaataatatggttgatcgaataactgtttatcatgatgataaattgagttttttaaaataatgatatattacatcattgttatagcgtttaagaaatcaacaactttacgataaatagtgattgcttcgtcattaggtctacgatcaaaatcatgctcgtttttattcacgcgttcaaatgttgaatgtggaacatgattcatgatatgttcgctttcctcaacgggaacatcataatcgccattacaatgcgcaatgaaaacaggtggaagtgttttaagttcatctggtgcaatattatattttgaattagtataatcagcaatgttaatcatatttatccatttacctgtgccacgtgcataaacgtagattaaaaaacgttgtgcgatttgatcttgaacaaccggtgttggtgaagtgagttgtgcaatcattgtttcgtttacgctttgagctatttttgcgtaataactattagttgttttaaaaggttcagtgttgatgcgactataaccataaaaatcaataacaccatcaatatctctgtctcgtgcaattaatagacttaaatatgcacctgatgatctgccaaaggtaaaaatagggcaattagaatattgtgattgaatcgcatcgaatgatgcgnagnacatcctcaataatgcaatcgagacttacttctggtaataaacgataacttagttgaattaaatcgtaatgttccgtaagatatcgatatactgtggggataaatcgttagctttaccgaacattaatccaccaccgtggatgtagacaatagcgccttttgttggttgattttttgctttaataattgtgtaaggtaatgcaaatgcatctttagtaattactttatctttaatttcagtcacgatttaataggctccttatttttgatattgatgtcattataacactgtcttaaatttccatgaaaaatagtcttaagacgatgagtcatgataattctgttccaattgacgtaaagcgtcacgggtatgcttctttagaccttccccataatccatcattttaacaatatctttaaaagcagcatgtggaatggctaaatcttctaaatctgccatagaaaattcaagattgatatcatgtggtcgctgttcagcaagtttatgcacaaagtcaggttctgtgacaaaaggcgaagacatgccgaccatatctgcatgttgtaaagcatctaaagcagactctggagaattaatcccgccacttgcaattaaagggatacgacctgctaaatgttcatagacaatttggttaactggtcgaccgaaatgatcacctggtgtacgagacgtattttgataaatatgtcgaccccagctagcgattgctaagtattggatgtttgaaacgtccatgacccaattgattaattggttgaactcgtcaatggtatatcctaaatcactgcctctggtttcttctggcgttgctcgaaatcctaaaataaaattgtcaggtgcttctttatcaatcacttcttgtaccgcacgcataacttctaaacataatcttgcacgattttttaatgagtcggcaccgtaatggtctgtacgtttattcgaaaaagttgagaaaaatgtttgaatcagcaaacgttgtgcaatcgaaatttccacaccatcaaaacctgctttaatcgcgcgtaatgtagcatcgcgatactgctgaatgatgctattgattttctcatgagacatggcgataacatcgtgttcaatcggtgaatgcaatgtcatagggcttggtccatacacctttccaaaatttaaaatggcttgatttgaaaaacgaccagcatgcgctagctggataatagcgaggctaccatgttgtttcatcgtagatgccatgttagttaatccagggatacaagcatcatgatcaatattaaagccatattcaaacaattgaccataaggttcaatgtaagcagcgccggtgacttgcattccagctgaattagagcgacgtgcagcataagccaagtcttcttttgtaatatagccttcttttgttgatgtgtttacggtcattggtgataatacaaagcgattcgaaattttgatgccattaggtaagtggattgattgtaaaagtggtttgtatcggtacatactatgattccttttctattcaatattgttttcaaagtaccatggaaagaatgaataatcaatgatgaacagtcttgatagaatagaattggtacatggaaagtatttttaaaattaaactaatgaatggcatttgtaggtctgaaaatatgaatatgaaaaagaaaaataaaggcgaaaagatataaaagttaattgaaaaacgttatcatatacgtgggtatatgaagagggaatggtattaagaacgctaaaatgttatgtcggtttgacatgacaggataagtttggagatgacggattggttaaattaagcgtattagactatgccttaatagatgaaggtaaggatgcacaaaaggcattgcaagattcagtgacacttgcaaaattagcagatcgacttggctttaagcgaatttggtttacggaacatcataatgtaccagcgtttgcgtgtagtagtccagaacttttgatgatgcatacattggcgcagacaaatcacatacgagttggctctggtggtgtgatgctgccgcactatcgaccttataaaattgctgagcattttagaatgatggcagcgttatatccaaatcgtattgatttaggtattggtaataatccaggtactactatggtaaagcaagctttagatggaataaatcctacatatgatagttacgatgaatcgatttcgttattacgtgattatcttacaataaaggataaaccaagtgcgcatacgttaggtgtccaaccacacattgatcattttccagaaatgtggttattaagtagtagcgcaacatctgccaaaatagctgccgaactaggtatagggctttctgttggaacatttttgctaccagatataaatgcgatacatacagcgaaggataacattgatatttacaaaaaacatttccaagcatcaacgattaaaatggacgcaaaggtgatggcatctgtatttgtcattgtagctgataacgaagcggaagtagcagcattacaacatgccttagatgtttggttattaggtaaattacaatttgcagaatttgaagattttccttcagtagacacagcacaaaagtataagcttaatgatcgagacaaagagatgattcaagcacatcaagcacgcatcattgcaggtacacaagaaaaggttaaagcacaattagatgatttcattgctacgtttgaagttgatgaggtgttagtagcaccgcttattccaggtattgaacagcgttgtaaaacattaaaattactcgcggaaatttatttgtagcattttaaatagaagagaaaggatgaagataagatgaaaaagttagccaattatttatgggtagaaaaagtaggagatttgtatgtgtttagtatgacacctgaattgcaagatgatattgggacagtaggttatgttgaattcgtaagtccagatgaagttaaagtggatgatgaaattgtgagtatcgaagcatcgaaaacggtcattgatgtgcaaacgccattgtcaggaacgattattgagcgaaatacaaaagcggaagaagaaccgacaattttaaactctgaaaaaccagaagaaaattggttgttcaaattggatgatgtcgataaagaagcattcctagcattaccggaggcttaaatggaaacgttaaaatcaaataaagcgagacttgaatatttaatcaatgatatgcatcgagagagaaatgacaatgacgtattggtaatgccatcttcatttgaagatttgtgggaattatatcgaggcttagcaaatgtcagaccggcattacctgtaagtgatgaatatttagctgtacaagatgctatgttaagtgatttgaatcgtcaacatgttacggatttgaaggatttgaagccgataaaaggtgacaatatctttgtttggcaaggtgatatcacgacgttaaaaatcgatgctattgttaatgctgcaaatagtcgttttctaggatgtatgcaagctaatcatgactgcattgataatattattcatacaaaagcgggtgttcaagttcgacttgattgtgcagagatcattcgacaacaagggcgcaatgaaggtgtaggtaaagccaaaataacacgtggatataatttgccagcaaagtatataattcatacggttggtccgcaaatacgtcgattgcctgtttcaaagatgaatcaggacttgttagctaaatgttatcttagctgtcttaaattggctgatcaacatagtttaaatcatgtcgctttttgctgtatatctacaggtgtatttgcttttcctcaagatgaagcagcagaaattgctgttcgaacagtagaaagctatctcaaagaaacaaattcaacattgaaagtcgtgttcaatgtatttacagataaggatttacaactgtataaggaggcatttaaccgtgatgcagagtagtaagtggaatgcaatgtctctgttaatggatgacaagacaaagcaggctgaagtattgcgtactgcgattgatgaagcagatgcgatagtgattggaattggtgcaggcatgtctgcatctgacggatttacatatgtaggagagcgttttacggaaaatttcccagattttattgaaaaatatcgcttctttgatatgttgcaagcgagtttacatccttatggcagttggcaagagtattgggcatttgagagtcgttttattacattaaactatttagatcaacctgtaggtcagtcttacctcgctttaaaatccttggtggaaggtaaacagtaccacattataactacgaatgcagataatgctttcgatgtagctgattatgatatgactcatgtatttcatatacaaggggagtatatactgcaacagtgtagctcagcattgtcatgctcaaacgtatcgcaatgatgatttaattcgtaaaatggttgttgcgcaacaagatatgcttataccttgggagatgattccaagatgtccaaaatgtgatgccccaatggaagtgaataaacgtaaagcggaagttgggatggttgaagatgctgaatttcatgcgcaactacatcgttataatgcttttctagagcaacatcaagatgataaagtgttgtatttggaaattggaattggttatactacaccacaatttgtgaagcatccttttcagcgtatgacacgtaaaaatgaaaatgccctttatatgacgatgaataaaaaggcatatcgcattccgaattcaattcaagaacgtaccatacatttaactgaggatatctcaacattgattacagcagcactccggaacgacagcacaacgaaaaataacaacattggagagacagaagatgtacttaatagaaccgattagaaatggagaatatattactgatggtgcgattgcactcgctatgcaagtttatgttaaccagcatatctttttagatgaagatattttattcccttattattgtgatccaaaagtggaaattggacgttttcaaaatactgctatagaagtgaatcaagattatatagataaacacagtattcaagtagttcgccgagatactggtggtggcgctgtgtatgttgataaaggtgccgttaatatgtgttgtattttagaacaagacacttcaatttatggtgattttcaacgattttatcaaccagctataaaggcgttgcatacattaggtgcaacagatgtggtacaaagcggtagaaatgatttaacattgaatggtaaaaaagtgtcaggcgccgcaatgacattaatgaataatcgtatttatggcggttattcgctattacttgatgttaattatgaagcaatggataaagtgttaaagcctaatcgcaaaaagattgcatcgaaagggattaaatctgtgcgcgcacgtgttggtcatcttagagaagcactggatgaaaagtatcgtgatataaccattgaagaatttaaaaatttaatggtgacgcagattttgggaatcgatgacattaaagaggcgaaacgatatgaattaacggatgcagattgggaagcgattgatgaattagctgataaaaagtataaaaattgggattggaattatggcaagtcacccaaatatgaatacaatcgaagtgaaagattatcttcaggtacggtagacataacaatttctgttgaacaaaatcgtatcgcagattgtcgtatttatggggatttctttggacaaggtgatataaaagatgtggaagaagcattacaaggaacaaaaatgacaagagaagatttaacgcatcagttaaagcaattagacatcgtttattattttggcaatgttacggtagaagcattagtggatatgattttaagttaatattgttattttatgtatgctgaatcattggaagtgtttgcttgctcttgaaaaggtgacaatagtgtttggtgaaggttgaacatatgagtggaaattattgcctttaactattcaaagtatgatatatatatggtttttgtttctaaatgattgggtatttgaaaatagatgagtttaatattttaaggaatataatgatgtttacttttataattcatatagaatattaagcaatataagtctgttgatatatacaaaatataatgactgctataatgagtaatcaatagacacaaagaggagattatgtgatgaataataaagtattagtaaccggtggtacagggtttgttggcatgcgaattatttcacgattattagaacaaggttatgacgtacaaacgacgatacgtgatttaagtaaagctgataaagtaattaaaacaatgcaagacaatggcatttccacagagcgattaatgtttgtcgaagcggatttatcacaagatgaacattgggatgaagcaatgaaagattgcaagtatgtcttgagtgtagcatctccggtgtttttcggtaaaacagacgatgcagaagtgatggcgaactgcaattgaaggtatacaacgtattttaagagctgcagaacatgcgggtgttaaacgtgtggtaatgactgcaaactttggtgcagttggttttagtaataaagataaaaattcaatcacaaatgaaagtcattggacaaatgaagatgaaccaggcttatcagtatatgaaaaatcaaaattgttagctgaaaaggcagcgtgggattttgttgagaatgaaaatacaacagtagaatttgccacaatcaatccagttgcaatttttgggccatcattagatgcacacgtttcaggaagctttcatttattagaaaatttattgaatggttcaatgaaacgtgtaccgcaaattccgttaaatgttgttgatgtgagagacgtagctgaactgcacattttggcaatgacaaatgaacaagctaatggcaagcgatttattgcgacggctgatggacmaattwatttgttgggaattgccaaattaattaaagaaaagggcctggaaatagctccaaaagttcctactaaaaaattacccagctttattttgagcnangngcc

SEQ ID NO: 39 - DNA, 4522 bp; double-stranded, linear
ccctttgagagtatatcatctagtcaaattatgcctgtcattagagcgactagctttgataaaaaaactaaacaaggtgttccttttatctatgatgagcatactgcagaaacagcagtttattatgcagtcgatttagggaaatcatatcgtctaattgacgaaagcatgttagaggatttgaagttaactgaacaacaaataagagaaatgtctctgtttaatgttagaaaattgtcaaattcatatacgactgatgaagtaaaaggtaatattttttattttattaactcaaatgacgggtatgatgcaagtaggatactaaatactgcatttttaaatgaaattgaggcacaatgtcaaggcgaaatgctcgtagcagtgccacaccaagatgtgttaattattgcagatatacgcaataaaacaggatatgatgtgatggcacatttaacaatggaatttttcactaaaggtctagttccaattacatcattatcctttggatataaacagggtcatcttgaaccgatatttattttaggtaaaaataataaacaaaaaagagatccaaacgtgattcagcgtttagaagcaaatcgtcgtaaatttaataaagataaatagaaataattggataaggagttttgtcataatgaatttattttacaatcctaaatatgtaggagatgtcgcatttttacaaattgaaccagttgaaggtgaattaaactacaataaaaaaggtaatgttgttgaaattactaatgaaggtaatgttgtaggttataatatttttgaaatttcaaaagatataacaattgaagaaaaaggtcatattaaattaactgatgaacttgtaaatgtattccaaaagcgtatttcagaagctggttttgattataaattaaatgctgatctatcaccgaaatttgtagttggctacgttgaaactaaagacaaacatcctgatgcagataaattaagtgtactaaatgtaaacgttggaaatgacacattacaaattgtatgtggcgcgcctaacgttgaagctggacagaaagttgttgttgctaaagtaggtgcagtgatgcctagcggtatggtaattaaagatgctgaattacgtggtgttgcctcaagcggtatgatttgttcaatgaaagaattgaatttacctaatgcacctgaagaaaaaggtattatggtattaaatgacagctatgaaattggacaagcattttttgaataattaaggaaggtagtgaaaatatgagctggtttgataaattattcggcgaagataatgattcaaatgatgacttgattcatagaaagaaaaaaagacgtcaagaatcacaaaatatagatracgatcatgactcattactgcctcaaaataatgatatttatagtcgtccgaggggaaaattccgttttcctatgagcgtagcttatgaaaatgaaaatgttgaacaatctgcagatactatttcagatgaaaaagaacaataccatcgagactatcgcaaacaaagccacgattctcgttcacaaaaacgacatcgccgtagaagaaatcaaacaactgaagaacaaaattatagtgaacaacgtgggaattctaaaatatcacagcaaagtataaaatataaagatcattcacattaccatacgaataagccaggtacatatgtttctgcaattaatggtattgagaaggaaacgcacaagccaaaaacacataatatgtattctaataatacaaatcatcgtgctaaagattcaactccagattatcacaaagaaagtttcaagacttcagaggtaccgtcagctatttttggcacaatgaaacctaaaaagttagaaaatggtcgtatccctgtaagtaaaccttcagaaaaagttgagtcagataaacaaaaatatgataaatatgtagctaagacgcaaacgtctcaaaataaacaattagaacaagaaaaacaaaatgatagtgttgtcaaacaaggaactgcatctaaatcatctgatgaaaatgtatcatcaacaacaaaatcaatgcctaattattcaaaagttgataatactatcaaaattgaaaatatttatgcttcacaaattgttgaagaaattagacgtgaacgagaacgtaaagtgcttcaaaagcgtcgatttaaaaaagcgttgcaacaaaagcgtgaagaacataaaaacgaagagcaagatgcaatacaacgtgcaattgatgaaatgtatgctaaacaagcggaacgctatgttggtgatagttcattaaatgatgatagtgacttaacagataatagtacagatgctagtcagcttcatacaaatggcatagagaatgaaactgtatcaaatgatgaaaataaacaagcgtcaatacaaaatgaagacactaatgacactcatgtagatgaaagtccatacaattatgaggaagttagtttgaatcaagtatcgacaacaaaacaattgtcagatgatgaagttacggtttcgaatgtaacgtctcaacatcaatcagcactacaacataacgttgaagtaaatgataaagatgaactaaaaaatcaatccagattaattgctgattcagaagaagatggagcaacgaataaagaagaatattcagkaagtcaaatcgatgatgcagaattttatgaattaaatgatacagaagtagatgaggatactacttcaaatatcgaagataataccaatagaaacgcgtctgaaatgcatgtagacgctcctaaaacgcaagagtacgcagtaactgaatctcaagtaaataatatcgataaaacggttgataatgaaattgaattagcaccgcgtcataaaaaagatgaccaaacaaacttaagtgtcaactcattgaaaacgaatgatgtgaatgataatcatgttgtggaagattcaagcatgaatgaaatagaaaagaataacgcagaaattacagaaaatgtgcaaaacgaagcagctgaaagtgaacaaaatgtcgaagagaaaactattgaaaacgtaaatccaaagaaacagactgaaaaggtttcaactttaagtaaaagaccatttaatgttgtcatgacgccatctgataaaaagcgtatgatggatcgtaaaaagcattcaaaagtcaatgtgcctgaattaaagcctgtacaaagtaagcaagctgtgagtgaaagaatgcctgcgagtcaagccacaccatcatcaagatctgattcacaagagtcaaatacaaatgcatataaaacaaataatatgacatcaaacaatgttgagaacaatcaacttattggtcatgcagaaacagaaaatgattatcaaaatgcacaacaatattcagagcagaaaccttctgttgattcaactcaaacggaaatatttgaagaaagtcaagatgataatcaattggaaaatgagcaagttgatcaatcaacttcgtcttcagtttcagaagtaagcgacataactgaagaaagcgaagaaacaacacatccaaacaatactagtggacaacaagataatgatgatcaacaaaaagatttacagtcatcattttcaaataaaaatgaagatacagctaatgaaaatagacctcggacgaaccaacaagatgttgcaacaaatcaagctgtacaaacatctaagccgatgattcgtaaaggcccaaatattaaattgccaagtgtttcattactagaagaaccacaagttattgagtcggacgaggactggattacagataaaaagaaagaactgaatgacgcattattttactttaatgtacctgcagaagtacaagatgtaactgaaggtccaagtgttacaagatttgaattatcagttgaaaaaggtgttaaagtttcaagaattacggcattacaagatgacattaaaatggcattggcagcgaaagatattcgtatagaagcgcctattccaggaactagtcgtgttggtattgaagttccgaaccaaaatccaacgacagtcaacttacgttctattattgaatctccaagttttaaaaatgctgaatctaaattaacagttgcgatggggtatagaattaataatgaaccattacttatggatattgctaaaacgccacacgcactaattgcaggtgcaactggatcagggaaatcagtttgtatcaatagtattttgatgtctttactatataaaaatcatcctgaggaattaagattattacttatcgatccaaaaatggttgaattagctccttataatggtttgccacatttagttgcaccggtaattacagatgtcaaagcagctacacagagtttaaaatgggccgtagaagaaatggaacgacgttataagttatttgcacattacccatgtacgtantataacagcatttaacnaaaaagccccatatgatgaaagaatgncaaaaattgtcattgtaattgatgagttggctgatttaatgatgatggtccgcaagaagttg

SEQ ID NO: 40 - DNA, 751 bp; double-stranded, linear
tcaactttacggatacgtatatattttgcatgacatttagtgcaataatattcataatttgcccgttgttgatagctttcaatgctgttacaaaatctaggcgctccaacctgttggctcaatcgtttaaaatcttgatctttatgttgataacctttaccagcaatatgcaagtgataatgacacaattcgtgcagtataatttttacaacagcatcttctccataatgctcatattgttttggattaatttcaatatcatgggactttaaaagataacgtccgcctgttgtacgtaaccttttattaaaatatgcacaatgtcgaaacgtacgtccaaatttttcttccgaaagattctcaaccattcgctgaagtttgtcattattcatgtggatcaatcatcgttaatgatactttgtctttatttttgtcaatactgtaaatccaaacgtcaacgatatcaccaacactgacaatatccattggattttttacgaacttcttagaaagtttcgaaacatggacaagtccatcttgtttaacacctatatctacaaatgctccaaaatctactacatttctaactgtaccactcaatttcattccttcttgtaaatcttcaattgatagcacatcggatttaaggattggtgtttcaaactcgtcccttggatctcgattaggtgcgttcaaggatttaataatatcctctaatgtaggtacaccgacttgtaattcaatcgccagt

SEQ ID NO: 41 - DNA, 1076 bp; double-stranded, linear
tctccagctttaacttgatctggcactttaacaattgtctgatccatacatacgcgaccaataacttcgcattgatgaccatttacatttacaaagctaccttgcattatgcgtaaatggccatctgcatatccaataggtaacaatgctattgtagttgggtcagtagctgtataagttgcaccataacttacagactcacccgcttgtagcgtctttgtttgaactacattagcaattaattgcacacttggtttaaggtgtactttaactttttgctgtacatactctgatggataatatccataaagggaaattcctggtcttattgcattacagaattggcaatccattaatagagagcctgctgagttctgacaatgtatatattcaggtttaattgcttcattgaccatatctttaaaacgttgatattgttcagttgtcatatctcctggttcgtcagcacaggcaaagtgtgtaaacacgccttcaaatacaagttgctcatattgttgaatgatttcaatcacttcttgatacgttttagtatctttaatacctaaacgtcccattcctgtatctaatttaatgtgcaaccataactttttctcttgctcaccagaaatgtttttaattgcttctttcaaccactgtttagacggaaccgttaaggcaactcggtgttgtatcgctttatcaatatctttagctggtaacacacctaagactaaaattttagcagtaatcccatgcattctaagttctatcgcttcatctaacgttgctacagcaaaaaatgtggcgccattttccattaaatgacgtgctactttaacactacctagtccataggcattggctttaacgacagccatcactgttttatttggatgcaatgtactgaatactttgaaatttgatgcaacagcgtttaaatctacattcatatacgcagatctataatatttatccgacatattacttcctcctgtaattcccacacgttttaaaactagatcttaattatcattgtataacaaatttaaaatgctgacttttctaaaacaacttgg

SEQ ID NO: 42 - DNA, 2930 bp; double-stranded, linear
tgaccacaatgcccaatacaaccatcccatggtaaagccaagagatgagtcaataaagcgtgttgaataagagctgaatgaacctgatactggataaaatgttgccaactctccaattgatgacattaagaaatatagcatgacaccaataacaagataagcgagtatagcgcctccaggaccagcttgagaaatgatattaccagtagctacaaatagaccagtcccaattgcaccacctatagcaatcatggaaatgtgtcttgagttaagactacggttcattttattatcttccatatttagtctcccatctatttaaatatacccattattgtaagctttttaagtgtactattcaataactatttagtactgtaaagcgaaaaaattaaaattttctgattttttaatcatcttgagcatgtttaattgtaattttgatggggttaaattataatatgtattaaattataattatnataaattgtggagggatgactatgtcacaacaagacaaaaagttaactggtgtttttgggcatccagtatcagaccgagaaaatagtatgacagcagggcctaggggacctcttttaatgcaagatatttactttttagagcaaatgtctcaatttgatagagaagtaataccagaacgtcgaatgcatgccaaaggttctggtgcatttgggacatttactgtaactaaagatataacaaaatatacgaatgctaaaatattctctgaaataggtaagcaaaccgaaatgtttgcccgtttctctactgtagcaggagaacgtggtgctgctgatgcggacgtgacattcgaggatttgcgttaaagttctacactgaagaagggaactgggatttagtagggaataacacaccagtattcttctttagagatccaaagttatttgttagtttaaatcgtgcggtgaaacgagatcctagaacaaatatgagagatgcacaaaataactgggatttctggacgggtttccagaagcattgcaccaagtaacgatcttaatgtcagatagagggattcctaaagatttacgtcatatgcatgggttcggttctcacacatactctatgtataatgattctggtgaacgtgtttgggttaaattccattttagaacgcaacaaggtattgaaaacttaactgatgaagaagctgctgaaattatagctacagatcgtgattcatctcaacgcgatttattcgaagccattgaaaaaggtgattatccaaaatggacaatgtatattcaagtaatgactgaggaacaagctaaaaaccataaagataatccatttgatttaacaaaagtatggtatcacgatgagtatcctctaattgaagttggagagtttgaattaaatagaaatccagataattactttatggatgttgaacaagctgcgtttgcaccaactaatattattccaggattagatttttctccagacaaaatgctgcaagggcgtttattctcatatggcgatgcgcaaagatatcgattaggagttaatcattggcagattcctgtaaaccaacctaaaggtgttggtattgaaaatatttgtccttttagtagagatggtcaaatgcgcgtagttgacaataaccaaggtggaggaacacattattatccaaataaccatggtaaatttgattctcaacctgaatataaaaagccaccattcccaactgatggatacggctatgaatataatcaacgtcaagatgatgataattattttgaacaaccaggtaaattgtttagattacaatcagaggacgctaaagaaagaatttttacaaatacagcaaatgcaatggaaggcgtaacggatgatgttaaacgacgtcatattcgtcattgttacaaagctgacccagaatatggtaaaggtgttgcaaaagcattaggtattgatataaattctattgatcttgaaactgaaaatgatgaaacatacgaaaactttgaaaaataaatttgatatgtagtttctatattgcgtagttgagcagtttatgatatcataataaatcgtaaagattcctaacaagagagggtgtttaacgtgcgcgtaaacgtaacattagcatgcacagaatgtggcgatcgtaactatatcactactaaaaataaacgtaataatcctgagcgtattgaaatgaaaaaatattgcccaagattaaacaaatatacgttacatcgtgaaactaagtaattcttatcattcaaatacgacgatttgaaaataaagcgggcttacctattatattggggagctcgcttttttatgaaatttttgtgaagagtgattaatggattgagtttcatcggtagaacaatatatgattatattagttgttactttattaaaatttgagaatatttatagaaggaaatagattactgattttataaagtcactttgttagcgaatgcttgaaagagtatttaatatagtagaatttaaaatttcaaagcggaatttaataagtacgaagtagttctgggtatgttttataaatgttcgataatacactttaatcttaaatatgatggtttagaaaatgatttaacaaagaaatgaaactttactgttgaattatgtgaggattgtgttattatataaatcgtaataattacgatttgataaaaagtgaggtaactatatatggctaagaaatctaaaatagcaaaagagagaaaaagagaagagttagtaaataaatattacgaattacgtaaagagttaaaagcaaaaggtgattacgaagcgttaagaaaattaccaagagattcatcacctacacgtttaactagaagatgtaaagtaactggaagacctagaggtgtattacgtaaatttgaaatgtctcgtattgcgtttag

SEQ ID NO: 43 - DNA, 3606 bp; double-stranded, linear
cttcttgccatggctctctttatttaaaaatgcttccaacttgtccatttgattgtttctcactcatagtcatcacttccattttgtttttcaatacacattgtattatatatcctaattttataaaaaactaattttacaaatgcttttgcgttcttacaaaaaatgcatttgactattattataataagcgtataattgtcgcatattattttttgtatttttggcaataacgaaggagtatttatgaataaagacaagcaattgcacaacgacaaaatcaatctatcccaattagtcttattagggttaggctctttaataggatctggttggctatttggtgcgtgggaagcatcatcaatagctggaccagcagcaatcatatcatgggttcttggattcctagtcattggaaccattgcctataactacattgaaatcggcacaatgtttcctcaatcaggtggcatgagtaactatgcccagtatacacatggctcattattaggctttattgctgcttgggcgaattgggtgtctttggtgacaataatacctatcgaagctgtgtcagctgttcaatatatgagttcttggccgtggcattgggcgaaaccaatgagatatttaatggaaaatggctctattagcacatacggattgctagctgtatatctcatcattgttattttttcattattaaactattggtccgtaaaacttttaacatcatttacgagtttaatttctgtatttaaattaggcgtacccatgttaaccatcatcatgttgatgctatcaggattcgacacttcaaattacggccattcggcaagcacatttatgccttacggaagtgcaccgatttttgctgcaacaacagcatcagggattattttttcattcaattcattccagacaattattaatatgggttcagaaattaaaaatcctgaaaaaaatatcgcaagaggcatcgctatctcactgtcaatcagtgcagtgttgtacatcattttacaaagtacgtttatcacttctatgcctcaatcaatgttacaacatagtggatggaatggcatcaacttcaattcaccatttgctgatttagctatcttattaggaattaattggctcgcaattttactatacattgaagcttttgtatcaccattcggtactggcgtgtcatttgtcgccgttacaggtcgagttttacgagcaatggagaaaaatggacatatccctaaatttcttgggaagatgaatgaaaaatatcatatcccacgtgtagcaatcatctttaatgccatcattagtatgattatggttacattatttagagattggggtacgctagcagcagttatttctactgcaactttagtagcctatttaactggcccaacgacagtgattgcattaagaaaaatgggaccaacaatgactcgtccatttagagcaaaaattttaaaagtaatggcaccattatcatttgtattagcttcattagctatatattgggcaatgtggccaacaacggctgaagttattttaatcattatacttggattaccaatctacttcttctatgaatatcgtatgaattggcgtaatacaaagaaacaaattggtggtagcttatggattattgtatatttaatcgtgctatcaatactgtcatttataggaagcaaagaatttaaaggcttaaatatgattcactatccatttgactttatcgttattattattgtggcacttatcttctattacatcggtacaacgagttcatttgaaagcgtctatttccgtcgcgcaacacgaatcaatacgaagatgcgtgagtcactaaataatgaatcaaagtcatctcattaaatattttaaaatacagtgccatatatgatttcaacacacacacattaaccaaccattgatttcaacatcttggttggttttttattttgaaaatcggttataaataactaacataacaagatgatgatcaggctgggacataaatcaatgttctatgctctacgaagttatattggcagtagttgactgaacgaaaatgcgcttgtaacaagcttttttcgattctagtcaggggccccaacacagagaatttcgaaaagaaattctacaggcaatgcaagttggggtgggacgacgataaagaaatactttttctatagaaattagtatytcttatgcatgagttttactcatgtattcatatttttaagtacacattagctgtggctaatgtataagaaccactacataataaatcatttgtggctctttatcatttctgtcccactcccgtagaagtacatcatataatgctgaaaatggtttgagttaaaacagatatcaagctcgtctgattcagtcacaaaattgtcttgttatacttgtcacctatcatctatagaccgtggtatgattaaattggggatgataaaggaggttaataaatatgaagattaatactacaggtggtcaaattcatggtattacacaagatggtttagatatcttcttaggcattccttatgcagaaccaccagttcatgacaatcgctttaaacattctacgttaaaaacacaatggtcagagccaattgatgcaactgaaatacaacccatcccaccgcaaccagacaacaaattagaagattttttctcctcacaatctacaacttttactgaacatgaagactgtttatatctaaatatttggaaacaacataatgatcagacgaagaaacctgtcatcatttatttttatggtggtagttttgaaaatggtcatggtacagccgaactctatcaaccggcacatttagtacaaaataacgacattatcgttattacatgcaattatcgtttaggcgcattaggatatttagactggtcatattttaataaagattttcattccaataatggcctttcagatcaaatcaatgtcataaaatgggtgcatcaatttattgaatccttcggtggcgacgctaataacattactttaatgggtcagtctgcaggcagtatgagcattttgactttacttaaaatacctgacattgagccatacttccataaagtcgttctactaagtggcgcactacgattagacacccttgagagtgcacgcaataaagcacaacatttccaaaaaatgatgctcgattatttagatacagatgatgttacatcattatcgacaaatgatattcttatgctgatggcgaagctaaaacaatctcgaggaccttctaaagggcttgatttaatatatgcgcctattaaaacagattatatacaaaataattatccaacaacgaaaccaatttttgcatgttatacaaaagatgaaggcgatatttatattactagtgaacagaaaaaattatcgccgcaacgctttatcgacattatggaattaaatgatattcctttaaaatacgaagatgttcagacggcgaagcaacaatctttagcgattacacattgttatttcaaacagccgatgaagcaatttttacmacmactcaatatacmagattccaaccgcaccaactatggctt

SEQ ID NO: 44 - DNA, 15109 bp; double-stranded, linear
gaaattaaaaaagcaattggnacaagatgcaacagtgtcattgtttgatgaatttgataaaaaattatacacttacggcgataactggggtcgtggtggagaagtattatatcaagcatttggtttgaaaatgcaacsagaacaacaaaagttaactgcaaaagcaggttgggctgaagtgaaacaagaagaaattgaaaaatatgctggtgattacattgtgagtacaagtgaaggtaaacctacaccaggatacgaatcaacaaacatgtggaagaatttgaaagctactaaagaaggacatattgttaaagttgatgctggtacatactggtacaacgatccttatacattagatttcatgcgtaaagatttaaaagamaaattaattaaagctgcaaaataattcagctatataagttagtgaaatgagagtctgaaacatatcaatcttttgatattgtattaggctcttatttttatagctagaaagttagatatttgtatttttttaaataataagtgccgttgttatcgttcaatttaattaatgatagattagtattattatagctaaagtagtatacctgagaaaatagctcaatgtatctctttattaataagttatatcataattattttagtgcatactttatggaagggatatcagggaatggctttcaattaaagaagaggtttaaaaggattacaacagaatgttatgattttgtagaaagatatataacaacgttttataaaaacataatattgttaatggaaaatgaaatgtaagggggatttcgagtgactaagaaagtttattttaaccacgatggtggtgtagatgatttagtatctctatttttattattacaaatggaaaacgttcaattgataggggtcagtacaattggtgctgattgttatttagagccatctttgagcgcatcagtaaaaattattaatcgtttttcaaatgaagatattcaagttgcgccatcatatgaacgaggaaaaaatccatttcctaaagaatggcgtatgcatgccttttttatggacgcattgccaattttaaatgagccagtcaaacatgttgcttcaaatgtgagcgacaaagaagcctttgaagacattattcaaactttaaagagacaatcagaaaaagtaacattattatttacaggcccgcttacagatttagcaaaagcactacaaaaagattcatctatcgttcagtatatagaaaaattagtttggatgggtggcacctttttaccaaaaggaaatgttgaagaacctgagcatgatggttctgcagaatggaatgcatattgggatccagaagcggttaaaattgtttttgatagcgatatagagattgatatggttgctttagaaagtacgaatcaagtaccgctaacgttagatgttagacaaagatgggcgaatgaacgccaatatacgggcattgattttttaggagtaagttatgcagcggtaccaccattaacacactttataacaaattctacttactttttatgggatgttttaacgactgcttatattggtaacaaggacttggttcattcaattgagaaaaaagtcgatgtaataagttatggaccaagtcaaggtaagacatttgagtgtaaagatgggcgcaaaattaatgtcataaatcatgtagataacaacgcattttttgattatataactgcacttgctaaaaaagtaaattaacagctgtgtagaataattaaggttttaatttatatagaacaacttattgtaaacttttcatttcttaaagtttacaatggtgctataataatggtcatgaaatacgaaaggaagtaaaaaatgacaacaaaacagttagtatatacagctttaatgacagcgattatcgctattttaggattggtaccggtaattccactaccattttcttcagtaccaattgtacttcaaaacattggtattttcttagcaggtgcgattttaggacgtaaatatggcacattaagtgttatcgtctttttattattagtagttgctggcttgccattgttatcaggtggtcgcggtggcatcggtgtattcgcaggtccttcagcagggtttttactattatatccagttgtagcattcatgattggggcgattcgagatagattcatcaatgaaattaatttctggattttattcgttggtattttagtttttggtgttatagcattagatgttattggtacattgattatgggcatgattattaacataccatttacgaaagctatttcaatttcattagcttatttgcctggtgatatattaaaagcaattgtagcaagtttgattggtacagctttacttaatcactcgcagtttcgtcaaattatgggaataaaataatcatatttaagatagtaaagtaattgaataagttgctttgaaatttataaaagtgaaaggagtaggtgtcaatggctagtataagtatgtcagatatatattgtaacggcactatatttgaaaatgacgacgagcagttgatttatttaacgccttcttttccacaacgatacacaagtaacacatggatatataaaaagacgcctacccaagagcgatggctgaaagacttagaacgtcaacatcaattacatacaaatcaaggttcaaatcattatgcgtttagtttcccggaaaatgaacaacttgataatcattggatggctatgtttaaagatatgaattttgaactaggtattatggaattgtatgccatagaaagtgatgcgcttgccaatttgccgcgtaactctgacgttgaaattgccatcgttgacgagtcgcatatagatgcctatttaaaagttgcatatcagtttagtttgccatttggaaaagactatgcagatgcacatgaagaaatggtaagggaacattatcaaaaagatgtgattaaacgcttagtagcttatttaaataatgaacctattggcgttgtagatgtcattgaaagtgaaaattacattgaattagatggatttggtgtattagaacaatttcggcaccaaggaattggatctacaattcaatcgttgataggtgaatacgccatatcaaaaaatcacaaaccaatcatattagttgcagatggtgaagatacagcaaaagatatgtatgcaaagcaaggttatgtctatcaatcgttttgttatcaaatattaaaagaagatattggaaattaacgattgatgataggtttgtattagaataaaaaagcagtaagctggtttcgagtagaaatcaacttactgctttttaaattgttttgagctacttatacttataaaaatagtgcgtttaaattgttgattcatgtagaatatcgttcattatgacacactataatgaatatgttattgttcagaatcaatgatacgttctggatgactgtatatattaaagccaccatttcgaataaatccaactgccgtaatatttaggtcattagctaaggttacagcaagcgttgtcggagctgatttagataaaatgacgccaacaccaatttttgcggctttaattaaaatttctgatgaaatacgtccactaaaaattaatactttatctcggacagtaatatgtcgctgaatacaaaatccatataatttatctagagcgttatgtctaccaatgtcttgtcgatgtacaaaaaatgtcaaaccatcgcttatagcagcattatgtaagccacctgtttcttggtaaatatgacttgcactttgtaatcgagtcatcatgttaataatttgcattggagttaaagtgattttagacatagatgttttagcgatagcagcatcattttgaaaataaaactcacgactctttccgcaacaagatgcaatcattcgttttgtggaatattgaaagcgatcgcctaaatctttattaagttcaacatgggcaaaacctttactatcatcaatcagtacagattttaattcatctcgctttaaaatggcaccttccgaagccagaaatccaatgactaactcctcaaggtttgttggactgcatataacagtcgcaaattcttcaccattcaccataattgtaagtggaaattctgtcacatattgatctgttgtattgaataattttccatcttcatatctaacaattggttgacctaaagatacatctttgttcattatctaacccctttaattagcttaaactttattttaaagcaatttgcttaaaattttaacatatttgcttaagtttgaaatttgattgataaaaattaatagcgagcaatctgtttgatttaaattgaattcgagaatatacatactagggcatcaattaataaatatcaatcttatgcaaatttgacaattgtttgaatcaatatataaacaggcaacggttcttttcaaatataatagtaagtgtataatgaaaatgtaaatattattaaaaatgggggttcactcaatgaaattgaaacgtttatttgctgttgtgattgcaatgcttttagtattagctggttgctctaattctaacgataataatgaaagtaaaaaagatgacgcagacaatggtaagaaacaagagattcaagttgcagcggcagcaagtttaacagatgtaaccaagaaattagcttcagaatttaaaaaagagcataaaaatgctgatattaaatttaactatggtggatcaggggcattaagaaaacaaattgaatcaggcgcacctgttgacgtatttatgtctgcaaatactaaagatgtagatgcattaaaagacaagaataaagcgcatgatacatataaatatgcgaaaaatagtctagtattaattggtgataaagattcaaattacacttcagtaaaagacttaaaagacaatgataaattagcattaggtgaagtgaaaactgtaccagcaggaaaatatgcgaaacagtatttagataacaataacttatttaaagaagtcgaaagtaaaatcgtttatgctaaagatgtaaaacaagtattaaattatgttgaaaagggtaatgcgaaacaaggttttgtgtataaaactgacttatataaacaaaataaaaaaattgatactgtaaaagtaattaaagaagtagaacttaagaagccaatcacatacgaagctggtgctacatcagatagtaaattagcaaaagagtggatggaattcttaaaatcagataaagctaaagaaatactaaaagaataccactttgcagcataaggagttgtaatccatgcctgacttaacacctttttggatatcaatacgagttgctgtaatcagtacgattattgtaacggttttaggtatttttatatctaaatggttgtatcgtcgtaagggttcgtgggttaaagtattggaaagtttattgatattacctattgttttgccgccaacggtattaggttttattctattaatcatcttctcgccaagaggaccaatcggtcaattctttgcgaatgtactacatttacctgtagtgttcactttgacaggtgctgtgatagcatctgtcattgttagttttccactaatgtatcaacatactgtgcaaggcttcagaggtatagacacgaaaatgattaatacagctagaacgatgggagcaagtgaaacgaaaattttcctcaaattaattttaccattagctaaacgctctattttagcaggtataatgatgagttttgctcgtgcattaggtgagtttggtgctacattaatggttgcaggatatattccaaataaaacgaatacactacctttagaaatatacttcttagtggaacaaggtagagaaaatgaagcgtggttatgggtattagtgctagtcgcattctctattgtggttatatctacaattaatttattgaataaagataaatataaggaggtcgactagatgcttaaaatcaatgtgaaatatcaattaaagaacactttaattcgcatcaatatagatgatactgaaccaaaaatttatgcagttcgtggtccatctggcattggtaaaactactgttttaaatatgattgccggattacgtaaagcagatgaagctattatcgaagtgaatgggcaattacttactgatacggcaaaaaacgtgaatgttaaaattcaacaacgacgtattggatatctgtttcaagactaccaattgtttcctaatatgacggtctataaaaatattacttttatggctgaaccatctgaacacatcgatcaattaattcaaactttaaacattgatcatttgatgaaacaatatcctatgacattgtcaggtggagaggcacaacgtgtagcacttgcacgtgcacttagcacraaaccagatttaattttattagatgaacctttttctagtttggatgatactacaaaagatgagagtattacattagttaaacgtattttcaacgaatggcaaataccaatcatatttgtgacacattcaaactatgaagcagaacaaatggctcatgaaattattacaattgggtaatcatttatttgccattaaagagtttagaacgtatttaaaattgtagaagtgaatgcttctatcagcattttaatgatgttttaaactcttttttaggggcagtttttttgagagacattgacgcgcgtcatataatgaaagtaatgataaaaagaaaggataacttaatgtgagtcaagaacgttattcaaggcaaattttatttaaacaaataggtgaaataggtcaaagcaaaataaatcaaaaatgtgcgttgattattggtatgggcgcattaggtacacatgtggccgaaggacttgttagagcaggcattgccaaactaatcattgttgatagagattatattgaatttagtaatttacaaagacaaacattgtttactgaagaagatgctttgaaaatgatgcctaaggtggttgcagctaaaaagcatttgctagcgttacgtagtgatgttgatattgatgattatattgcccatgtggattattattttttggaaacacatggacaggacgttgacgttattattgatgcaaccgataactttgaaacacgacaactgattaatgattttgcatataaatatcgtataccttggatttatggtggtgttgtacagagtacatatacagaagctgcatttatacctggtaaaacaccttgctttaactgtttggtaccacaattgccagcattaaatttaacatgtgatacagtaggggtcattcaacctgccgtgacgatggcaacaagtttacaattaagagatgcgatgaaagtattaacggaacaaccaattgacacaaaaataacttatggcgatatttgggaaggtagtcattattcatttggtttcagtaaaatgcaacgttcagactgtacaacttgtggagatgtaccaagttatccgtatttaaacaagaatgaacaacgttatgcaacattgtgtggtagagacactgtacagtatgaaaatgcatcaattacacacgacattcttgttcaatttttaaaacaacatcagttaaattatcgcagtaattcgtatatggttatgtttgaatttaaaggacaccgcattgttgcttttaaaggtggaaggtttttaatacatggcatgacacgcacatcagatgccacacatctaatgaatttattgtttggataaaaaaagataagacaaaaggagtgtaatattatgggcgaacatcaaaacgttaaattgaatcgtacagttaaagcagccgtactaacggtatcagatactagagactttgatacagataaaggtggtcaatgcgtgcgccaactattacaagcagatgacgttgaagtgagtgacgcacattatacaattgtgaaagatgaaaaagtagccatcacgacgcaggtgaagaagtggttagaagaagatattgatgtcatcattacgactggtggaacaggtattgcacaacgtgatgtgacgattgaagcagtaaaaccacttttaactaaagagatagaaggctttggggaattgtttagatatttgagttatgttgaagatgttggcacgcgtgcattattgtctcgtgctgtagcaggtacagttaataataaattgatattttcgattccaggatcaacaggcgcagttaaattagcattagaaaagctcattaaaccagaattaaatcatctgattcatgagcttacaaaataatttattgatttgattggcgttgaaaatctccagatttaccgccagacttgctttcaaggtaggtttcgccaataatcatacctttatcaactgctttcgtcatgtcgtaaatggttaaagccgttgctgatgcagcggttaaagcttccatttcaacaccggttttgccagttgtagagacagttgtttgaatgtttaaagtataaaggggtgcatttgtttcatcccagctgaagtgaacatctatgccagtcaatggtaatggatggcacatcggaataagtgttgatgtatttttggcagccataataccagcgatttgagcagtgttcaatacattgcctttggtattggtgttattagaaatctgcttaaaaatagtttcatttacagtaatgcttgaatgagcgacagcagttctttttgtaatttgtttgtctgatacatcgaccattttggcgtggccttgttgattaatatgagtaaactcagtcattttacccctcctagtgcatctagtatatcatgaaaaaataaaagttttggagatgatttttaatggtagtagaaaaaagaaacccaatcccagttaaagaagcaattcaacgtatcgttaatcagcagagttcaatgccggcaattacggtagcacttgaaaaaagtctaaatcatatcttagcagaagatattgtagctacttatgatataccaaggtttgataaatcaccttatgatggttttgcaattcgcagtgttgattcacaaggggcaagtggtcagaatcgcattgagtttaaagtgattgatcatattggtgcaggttcagtttctgataaattagttggggatcacgaagcggtgcgtattatgactggagcacaaatacctaatggcgcagatgctgttgttatgtttgaacaaacgattgaactagaagatacatttacaattcgtaaaccattttcaaaaaatgaaaatatatctttaaaaggtgaagaaacaaagacaggcgatgttgttctaaaaaaaggacaagtaattaatccaggggctatcgcggtccttgcaacatatggctatgcagaggttaaagttattaagcaaccgagtgtcgctgttattgcaacaggaagcgaattattagatgttaatgatgtattagaagatgggaaaattcgtaactctaatggcccaatgattcgtgccttagcagaaaaattaggtcttgaagttggtatttacaaaacacaaaaagatgatttagatagtggcatccaagtcgttaaagaagctatggaaaaacatgatatcgttattacaacgggcggagtttctgttggagattttgactatttacctgagatttataaggctgtaaaggcggaagtgttatttaataaagtagcaatgcgtcctggtagcgtaacaacggttgcatttgtagatggaaagtatttgtttggattatctggaaatccatcagcttgttttacaggatttgaactatttgtgaanccagctgttaaacatatgtgtggcgcactagaagtcttcccgcaaataattaaagcaacattaatggaagattttaccaaggcaaacccattcacacgatttatacgtgctaaagcaacgttaacaagtgctggagctactgtagtaccttcaggattcaataaatcaggtgcggttgtagcgattgcacatgctaactgtatggtcatgttaccaggagggtcacgtggttttaaagcggggcatacagtagatattatattgactgaatctgacgctgctgaagaggaacttcttttatgattttacaaattgtaggttacaaaaagtctggtaagacaacattgatgaggcatattgtctctttcttaaagtcacatggttatacagttgctactattaaacatcatgggcatggtaaggaagatattcaattacaggattcagacgtcgatcacatgaagcattttgaagcgggggcagatcaaagtattgtacaaggttttcaatatcagcaaactgtaacacgtgtagataatcaaaatcttactcaaattattgaaaaatctgttacaattgacaccaatatcgtattagttgaaggctttaaaaatgctgattttgaaaaagtcgtagtctatcgaaatgaagaagagttgcaagtattacaacaattgtcgaatgtttgttatagcattaatgtaagggagcatgaagattttacagcatttgagcaatggttattaaataaaattaaaaatgattgtgatacacaattaacatagaggattgaaatgaatgaaacaatttgaaatcgtgacagaaccgatacaaacagaacaatatcgtgaattcactataaatgaatatcaaggtgcagtagttgtttttaccggtcatgttcgcgaatggactaaaggcgtcaaaacggaatatttagaatatgaagcgtatattccaatggctgaaaagaaattggcacaaattggagatgaaataaatgaaaaatggcctggaacgataacgagtattgttcatagaatagggccattacaaatttcagatatcgctgtattaattgcggtttcttcaccgcatcgtaaagatgcctatcgagcaaatgaatatgcaattgagcgtataaaagaaattgttccgatttggaaaaaagaaatttgggaagatggttcaaaatggcaagggcatcaaaaagggaattatgaagaagcaaagagggaggaataagagagatgaaggtactttacttcgcagaaattaaagatatattacaaaaagcacaggaagatattgtgcttgaacaagcattgactgtacaacaatttgaagatttattgtttgaacgttatccgcaaatcaataataaaaagtttcaagttgctgtaaatgaggaatttgtacaaaaatcggatttcattcaacctaatgatactgttgcattaattccaccggttagtggaggttaagggagcatgaaagcaataattcttgcaggtggtcattcagtgcgatttggtaagcccaaagcttttgcggaagtgaacggtgagaccttttatagtagagtaattaagacattagaatcaacaaatatgttcaatgaaattattattagtacaaatgcgcaattggcaacgcaatttaaatatccaaatgttgttatagatgatgagaatcataatgataaaggtccattagcaggaatttatacaatcatgaagcaacatcctgaagaagaattgttttttgtcgtttctgttgatacaccaatgattactggtaaagctgtaagcacgttgtatcagtttttagtttctcatcttattgaaaatcatttagatgtcgcagcttttaaagaagatggacgttttattccaacaattgcattttatagtccgaatgcattaggcgctataactaaagcactacattctgataattacagttttaaaaatgtatatcatgaattatcaacggattatttggatgtaagggatgtagatgcgccctcatattggtacaaaaatataaattatcagcatgatttggacgctttaattcaaaaattgtaagctgttaggaggtccacaaatggtagaacaaataaaagataaactaggacgtcccatccgtgacttacggttatctgtgacagatcggtgtaactttaggtgtgattattgcatgcctaaagaggtatttggagatgatttcgtatttttacctaaaaatgaacttttaacgtttgatgaaatggctagaatcgctaaggtatatgcagaattaggtgtaaaaaaaatacgcattacaggtggagaaccattgatgcgacgggatttagatgtacttatagctaaattaaatcaaatcgatggtattgaagatattggtttgactacaaatggtttgttattaaaaaagcatggacaaaagttatatgatgctgggctgcgcagaattaatgtcagtttggatgctattgatgatacgctatttcaatcaatcaataatcgtaatattaaagcgactacgattttagaacaaattgattacgcgacgtctattggtttgaatgtaaaagtaaatgttgttatacaaaaaggtattaacgatgatcaaatcataccaatgcttgaatattttaaagataaacatatagagattcgatttatagaatttatggatgttggtaatgataatggatgggatttcagtaaagttgtaactaaagatgaaatgcttacaatgatagagcagcactttgaaatcgatcctgtagaaccaaaatattttggggaagtagcaaaatattatcgccataaggataatggtgttcaatttggtttgattacaagtgtttcacaatcattttgttctacatgtacacgcgcaaggctgtcatcagatgggaagttttacggatgtttatttgcaactgtcgatggatttaacgttaaagcgtttattcgttctggcgtgaccgacgaagaattaaaagaacaatttaaagctttatggcaaataagagatgatcgatattcagatgagagaactgctcaaacagttgccaatcgtcaacgtaaaaagataaacatgaattatattggtggttaatgtgtagggaccactacatattaaatcattagagatgttttaatatttctgtcttactccctaaaatacaatattatttattaaagtaaaaacggtcatatctatgccagatttaatagaaatgatcgtttttaaagtttttacaagttggcggggccccaacacagaagctgacagaaagtcagcttacaataatgtgcaagttggcggggccccaacatagagaatttcaaaaagaaattctacagacaatgcaagttggggaacggggccccaacacagaaggtgacgaaaagtcagcatacaataatgtgcaagttggcggggccccaacatagagaatttcaaaagaaattctacagacaatgcaagttggggatcaacgaaataaattttatgagaatatcatttctatcccactcttaagaatcactacataataaatctttagtggttctttaacattgatgtcacactccatgccattgagttgtaatatatcttttttaggtataaatgttgtcgaataaacaacaagttgtccaaaagatataaatctaaacaagatatagccagcaatttaatatttgtaatagataaaatgctaagtttgatatataataaatttaagtaattgtataataatatgaattacaaacatctaagaagaaacataggaggcatcatattatgagtaataaagttcaacgttttatagaagcagaaagggagttaagtcagttaaagcactggttaaaaacaacacataagatttcaattgaagaatttgtagtcctttttaaagtgtatgaagctgaaaagattagcggtaaagaattgagggatmcattacattttgaaatgctatgggatacaagtaaaatcgatgtgattatccgtaaaatctataaaaaagagcttatttctaaattgcgttctgaaacggatgaaagacaagtattctatttctatagtacttctcaaaagaaattgttagataaaattactaaagaaatagaagtgttaagcgttacaaactaaaaacttaaaaagcatgccaatctctattcatcataattgcgtcttggggacagacaaatgatgaatagagattggcatgctttttatttttgaatataaatatttagttcatggcatttctagttacatgacgtccatgaattaagaagtaaacaagcatagtaatgattgctaaagcggccataaagccgaagatttcactatatgaaaacatatgagtaaataacccaaggaatgatggaccgaagccgacacctgcatctagaccaacgtaaaaagtagatgtcgcgataccatatttaatcgggggtgagacttttatcgcaatagattgcattgcagatgataaatttccataccctaaacctaggcaagcaccagcaagtaatattaaccagctttgatagcttgaaattaagcatacaaatgaaaggaaaagcatgataaatgctgggtagacaataatattttcatttttatcatccatcaatctaccagcaataggtctagtaattaacgatgctatagcatagcaaataaagaaatagcttgctgcagtgactaggtgtcgctctaaagcaaatgcttgtaaataagttaggatggacgcataggtaacgccaattaaaagcataattacagcaacaggaatggcctcttttgcaataaattgatgaatactaaatcttggtttatcaatgacattagtttcagttttgttatttgttacttcgaaatcaacttttataaataatgagataatgagtccgagtatgcctaatatgacacaaataataaacagtaagtcaattgcgtattttgtaataagtaacatgcctagaaatgggccaatcgctgtacctaatactaaacttaaggaaaataaactgatgccttcactttttctattaacaggggtaacgtatgccgcaatagtacctgttgcagttgtcacaactgcagttgcgataccgtttatgagacgtacaaagattaaaaaagctaaagatccatcaataaaataaagtaattgcgtgataattaaagcaattaaaccaataaataataatcgtttaggtccratttsatttacaaatttacctgtagcaaatcga

SEQ ID NO: 45 - DNA, 9072 bp; double-stranded, linear
gagagtcaatggcaagaagaatataaatatttgagagcgttaatctttaatgaaacagaattagaggaagcgtataaatggatgcatccttgttacacgttgaataataaaaatgtagtacttatccatggcttcaaaaattatgttgcactattatttcataaaggtgccattttggaggataaatatcatacactcattcaacagactgaaaaggtgcaagcagctcgtcagttacgatttgaaaatttaacagagattcaagcacgtaccgaagaaattaaatattatctagccgaagcaattaaagctgaaaaagctggtaaaaaagttgaaatgaagaaaacagaggaatatgttattcctaaagagttagaagctaagttcgaagaaatgccacagttagagtcttcattttataaattaacgccaggcagacaacatcaatatatatatcatattggacaagctaaacgcagtggaacaagacaaaagcgtgttgaaaagtatattaaccaaatactagaaggtaaagggatgcatgataagtaattaatgagtaaagcataccggttatacaacaacatacaagatgacacgaaacaaccaatggctcatgctgttggttgtttttttaggtgtgtctgtcatgggcaacactttgacgttggaattccgttacaggcttgggagtagaaaatgttagcaaaaggcaagggtgtctacaatgaatgatgaagatattaaaatataaggatgactttgtgagtggcggatgggcggttgtccgtctgtaacaatggatgcgtgtgcattattacaaaaattcgacttttgtaataatatttcacattttcgacacttttttgctataaaacaaccaattgagcgataataaattcgcttttaaaaaatatgagttatctatttagttgccaaagataaaataataatgtttaataacatcatatagagtatgttagttttaaatgtcgaatatacgaatgtgcaaacaaagtaatcggtagaaattcaacatacatagcgccgtttactgttaagtattcacattacagatgaaaaatataaaattctacataatcaagaccatgatgtgtacttgtttaacttatgactctatttgtttaacaattgcgataatggtctttttattttatgcgtatcattcgtcatattttttatgaggaaggagaaatgattatgttaagtattaagcatttaacgaaaatttattctggtaataaaaaggcagtagatgacatctctttagatattcaatctggggaatttatcgcatttattggaaccagtggaagtggcaaaacgactgctttaagaatgataaaccgtatgattgaagcgacagaaggacaaattgaaattgatggtaaagatgttcggagtatgaatcctgtcgaattgcgtagaaatattggctatgttattcaacaaattggcttaatgcctcatatgacgattaaagagaatattgtgttggtacccaaattgttgaaatggactaaagaggaaaaggataaacgtgcaaaggaattaattaaacttgtggatttaccggagtcatttttagagcgttatccagcagaactatcaggtgggcaacaacaacgtatcggtgttgtaagagcacttgcggccgaacaagatattattttaatggatgaaccttttggtgcattggatcctattacgagagatacgttacaagatttagttaaaacgttacaacgaaaattaggcaagacgtttatctttgtaacacatgatatggatgaagcgattaaattagcagacaaaatttgtattatgtcagaaggtaaggtggtgcaatttgatacgccagacaatattttaagacatcccgcaaatgattttgtacgtgattttataggacaaaatagactgattcaagaccgtcccaatgacaagactgtagaaggtgtaatgattaaaccaatcacgatacaagcagaagcaacactgaatgacgccgttcatattatgagacaaaaacgtgttgatactatttttgtagtagatagtaataaccatttactaggtttcttagacattgaagatataaatcagggtatacgtggacacaaaagtttacgagacaccatgcaacaacatatttataccgttcaaattgattctaaattacaagattctgtacgtacgattttaaaaagaaacgttaggaatgtacctgtcgtagatgatcaacagcgtttagtaggactgattacgcgtgccaatgttgttgatattgtatatgacacgatttggggcgatagtgaggatacagtgcaaacagaacatgtgggggaagacactgcgtcctcaaaagtgcatgagcaacacactactaatgtcaaagtacgtgacataggagatgataaatcatgattgagttcctacatgaacatggtggacagttgatgtcgaaaacactggaacatttctatatttctatagtggcattattacttgccatcattgttgcagtacctataggcattttattatcaaaaacaaagcgaactgccaatattgtattaactgtggcaggtgtcttacaaactattccaacactagctgtacttgctattatgataccgatttttggtgttggtaaaacgcctgcaattgtagcgctatttatttatgtattattacctattttaaataacacggtactcggtgttcaaaatattgatagcaacattaaagaagctggaaaaagtatgggaatgacacaatttcaattgatgaaggatgttgaattgccgttagcattgccgcttatcattggtggcattcgtttgtcatctgtgtatgtaattagttgggctacacttgcaagttatgtaggtgcgggtggattaggtgatttcattttcaatggtttaaatttatatgatccactgatgattgtaactgcaacggtactcgttactgcactagcattaggtgttgatgccttattagctttagttgaaaaatgggtagttcccaaaggcttaaaagtatctggataattaggaggctaagataatgaagaaaattaaatatatacttgtcgtgtttgtcttatcgcttaccgtattatctggatgtagtttgcccggactaggtagtaagagcacgaaaaatgatgtcaaaattacagcattatcaacaagcgaatcgcaaattatttcacatatgttacggttgttaatagagcatgatacacacggtaagataaagccaacattagtaaataatttagggtcaagtacgattcaacataatgccttaattaatggggatgctaatatatcaggtgttagatataatggcacagatttaacgggagctttgaaggaagcaccaattaaaaatcctaagaaagcaatgatagcaacacaacaaggatttaaaaagaaatttgatcaaacgttttttgattcgtatggttttgcgaatacgtatgcattcatggtaacgaaggaaaccgctaaaaaatatcatttagagacagtttcagatttagcaaagcatagtaaagatttacgtttaggtatggatagttcatggatgaatcgtaaaggcgatggctatgaaggatttaaaaaagagtatggttttgactttggtacagtgagaccaatgcaaataggtctagtctacgacgcattaaactcagagaagttagacgttgcattaggttattctacagatggtcgaattgcggcgtatgatttgaaagtacttaaagatgataaacaatttttcccaccttatgctgcgagtgctgttgcaacaaatgaattattacggcaacacccagaacttaaaacgacgattaataagttgacaggaaagatttcgacttcagagatgcaacgcttgaattatgaagcggatggtaaaggtaaagaacctgctgtcgtcgcagaagaatttttgaaaaaacaccactattttgataaacagaaaggtggtcataagtaatggaaggtaatttattacagcaattattcaattattatgttacgaactttggttatctatgggatttatttttcaaacacttattaatgtctgtctatggtgtgctgtttgcagctttaattggtattccattgggaatcttgcttgcaagatacacaaaactttctggatttgtaattacaattgcaaatataattcaaacagttccagtcattgcaatgttagctattttaatgttagtcatgggcttaggttcagaaacagtagttttaacagtgtttttatatgcgttacttccaattataaaaaacacttatactggtatagctagtgttgatgcgaatattaaggatgctggcaaaggtatgggaatgacacgcaatcaagtgctacgaatgattgaattaccgttatctgtttcggttattatcggtggcattcgtattgccttggttgttgcgataggtgttgttgccgttggatcatttataggagcacctacgcttggtgacattgtgattcgtggtacaaatgcgacggatggcacaacgtttattttagcaggtgcgattccgattgctatcattgcaatcgtcattgatgtactattaagatttttagaaaaacgattagacccaacaacacgacatcgtaaaaatcaatctaatcatcggccgcaaagtattaatatgtaatagtagaagatgtttataatttagcgatttcgtttcatgatttataaaaaatgaggctactcaaggagctcaaataatctttgagtagcctttttataggttgtgtttgtatgcgtttacactaaaatagcaattattatcatgaaagtttttggataaaaagcgttaattattgtaaaaatactaaaaaatgagatgttttatttataattttctgcaaatttatgatattgtttcttaatatatcatattaaaaatttgtttttcttaaacataggaggcttatctaattcatggacacatcaaaacaatttagaggtgacaaccgattgcttttgggtatcgttttaggggttattaccttttggctattcgcgcagtcacttgttaatcttgttgtcccattacaatcaacatatagtagtgacgttggaacgataaatatcgctgttagcttatctgccttatttgctggtttgtttatcgtaggtgctggtgatgttgctgataaatttggtcgcgtcaaaattacttatgtaggattgatattaaatgttgtaggttcattactcatcatcattacacctttgccagcatttttaattataggtagaataattcaaggtttgtctgcagcatgtattatgccatcaacacttgctattattaacgaatattatattggtacaagaagacaacgtgccttaagctattggtctattggttcttggggtggtagtggtatttgtacgttgtttggtggcttaatggctacatatataggttggcgttcaatatttgttgtttcaattctattaacattattagcaatgtacttaatcaaacatgcacctgagactaaagcagaaccaatcaaaggtatgaaagcagaagctaaaaagtttgacgttattggtttagtcattttagtagtgacgatgttaagtttaaatgtaatcatcacacagacgtctcattttggtttagtttcaccgttaattctaggtttaattgttgtgtttatctgttcattagttggttttgtatattacgaaaataaaataaagcatccacttgttgatttttcaatttttaaaaatagaggatacagtggtgcaactatttcaaacttcttattaaatggtgtagcaggtggtgcacttatcgttattaacacgtattatcaacaacaattaggatttaattcttcgcaaacgggttatatttcattaacgtatttaataacagtgttgtcaatgattcgtgtaggtgaaaagattttatctcaacatggtccgaagcgcccactattactaggaagtggctttacagtgattgggttaatcttattgtcgttaacatttttaccagaagtgtggtatatcatatctagtatagttggatatttattgtttggtactggtttaggattatatgctacaccatcaactgatacagcagttgctagtgcgccagatgataagtcgggtgttgcttcaggtgtgtataaaatggcgtcatcattaggaaatgcatttggagtagcagtatctggtacggtttatactgtgttagcagctaatttaaatttgaacttaggtggtttcacaggtatgatgtttaatgccttgctagcaattgttgcatttttagtcattttactattagttcctaaaaatcaaacgaatttgtaaaactgaaatgaaagcaagttattatgtagggattttaaaggaaattttgtgaaagtaagtttatcatacacacttaatgttgcgtattgacgtttaatgttaggtgtgttcttttatagacgataaaagctgtgtgcatattaagcgaatgattttcaaattgacgctaatatgcgaaagtagtatttttaaaatgaacaacaacgatgaagaggggtttataggatgaaaattgcaattgctggatcgggtgcattaggtagtggctttggtgccaaactatttcaagcaggatatgatgtcacacttattgacggatatacatctcatgttgaagcggttaagcaacatggattaaatataacgattaatggagaggcattcgagttaaacattccgatgtatcattttaatgatcaaccggacgaaagcatttacgatgttgtctttctatttccaaagtctatgcaattaaaagaagtgatggaagatatgaagccacatattgataatgaaacgatcgtcgtatgtacgatgaatggtctgaagcatgaagaagtcattgcgcagtatgttgctcaatcacaaattgtcagaggtgttacgacttggacggcaggtcttgaaagccctggacacagtcatttacttggtagtggaccagttgaaataggtgaactagtggatgaaggtaaagaaaatgttataaaagttgctgatttacttaacgaagcggaattgaatggtgtcattagtaaagatttataccaatcgatttggaaaaagatttgtgttaatggtacggcaaatgcattaagcacagtgttggagtgtaatatggcatcgctgaatgaaagtagttatgcgaagtgtttgatttataaattaacgcaagaaatagtgcatgtagcgacgattgataatgttcatttaaatgttgatgaagtatttgaatatttagttgatttaaatgaaaaagttggtgcgcattatccatccatgtatcaagatttaattgttaataatagaaaaactgaaattgattatattaatggcgcagttgcaacattaggtaaacaacgtcatattgaagcgccagtcaatcgctttattactgatttaattcatactaaagaaagtcagcgacacgcacaggattaattggtgttttaggtatgattacaaggaaatgacaatcacgtgatattacggtcattattaagattgaaatgtaataaataaagaacagcagtaaggtactttcaaattgaaatgatcttggtgctgtttttcttgattgatcttcgtcataattcagatttgtcataggctacgacatactattagtatttactagacagtttttacgacgacactttgaaaaattttgaggcaaatcatttggaagtctcacgtgaattttgtaaactcatcaagcaagtaattatattaaaaagacaaatagagaaaaggtgtttataatgagtaaaatttttgtaactggtgcaacgggccttattggcattaaattagttcaaagactaaaagaagaggggcatgaggttgctggttttactacatctgagaatggtcaacaaaagctagctgctgttaatgtaaaagcatatattggtgatatattaaaagctgatactattgatcaagcgttagcagattttaaaccagaaatcattatcaatcaaattacggatttaaaaaatgttgatatggcagcaaatacgaaagtacgtattgaaggttctaaaaacctaattgatgcggcgaaaaagcatgacgttaagaaagtaattgcccaaagtattgcctttatgtatgaacctggcgaaggattagcaaatgaggaaacttcacttgattttaactcaactggcgatagaaaagtaacggttgatggtgtggttggtttagaagaagaaacggctcgtatggatgaatacgttgttttacgttttggctggttatatggcccaggtacttggtacggaaaagatggcatgatttataatcaatttatggatggtcaagtgacactttcagatggcgtaacatcatttgtgcatcttgatgatgcagttgaaacatctattcaagctattcattttgaaaatggtatctataatgtagcagatgatgcacctgttaaaggttctgaatttgcagaatggtataaagaacaacttggtgttgaaccaaatattgatattcaacctgcgcaaccatttgaacgtggcgtaagcaatgagaagtttaaagcgcaaggtggtactctgatttatcaaacttggaaagatggcatgaatccaattaaataataatttatccgtttaatatacaaagaataaagacttggtcgaatcgtggatgatatattatcaaacgcacggctcgaacaagtcttttttattatgtcttcgttatctttgtatgaaggaataacagaattacaattaatgtactgaataatgcaattaatgttgtgattagtgctaatttaatttctattggtagccaagtcagtacaaaagaccaattattgctaccgagaatgagatatggtaatgcatataatatgagcgctaaagcgatacatatacataatgataaccaactcaatacagcaatcc

SEQ ID NO: 46 - DNA, 16826 bp; double-stranded, linear
gtggaacagctgtaactatatcatttctttcaacatttattgggaaaatgttagctacatttctatatccgattaataatgtagtactttcatatatntctgtaaatgaaagtgacaatataaagaagcaatatttgaaaactaatctaattgctatagctgccctatgtttagtcatgattatatgttatccaattacaataattattgtctctttactgtataacattgattcaagtttatattcgaagtttattattttaggtaatataggtgttttattcaatgcagtgagtattatgatccaaactttaaatacaaaacacgcatcaataacattacaagcgaattatatgacgcttcacacgattacatttatattcataactattttaatgacaattgcgtttggtctaaatggattcttttggacaacgctgttcagcaacattattaagtatgtgattttaaatattataggtttaaagtctaaattcattaataaaaaggacgtcgattagatgagtgaaaaaaagattttgattttatgtcagtatttttatccggaatatgtatcttctgcgacgttaccaactcaattggcggaagatttaattgcgaatcacattaatgtcgatgtcatgtgtggatggccatatgaatatagtaatcataaacaggtttctaaaaccgagatgcatcgtggtattcgcattcgacgtctcaagtattcgaggtttaataacaaaagtaaggttggaaggatcatcaatttctttagtttattttcaaaattcgtgattaatatacctaaaatgttgaaatatgatcagattcttgtttactctaatccaccaatcttgccattaataccagacgttttacacagactgcttaagaaaaaatattcttttgtggtgtatgatatagcacctgataatgcgattaagacaggtgcaactcgtccaggtagcatgattgataagctgatgcgttacattaatagacatgtctacaagaatgctgaaaatgtcattgtccttggtacggaaatgaaaaactacttactaaatcatcaaatttctaaaaatgctgacaatatccatgtgattcctaactggtatgacatgcgtcaattacaagacaatcgtatctataatgacacatttaaagcttaccgtgagcaatacgacaaaattttattgtatagcggtaatatggggcagttacaggatatggagacacttatctcatttttaaaattaaataaggatcagtctcaaacgttaacaatactttgtggtcatggtaagaaatttgcagatgtcaaaacggcaatagaagaccatcgtattgaaaatgttaaaatgtttgagtttttaacaggtacagactatgctgacgtattaaaaattgcggatgtatgtattgcatcgctgattaaagaaggcgtcggtttaggcgtgccgagcaagaattatggctatcttgcagctaagaaagcgttggtactcatcatggataagcaatctgatatcgttcaacatgttgaacaatatgatgcgggtatccaaattgataatggcgatgcacatgccatttataacttcatcaacactcactcgagtaaggaattgcacgagatgggtgagcgcgcacatcaactgtttaaagataaatatacgagagaaattaatactatgaagtattacaatctgttgaagtgaggagataattatgaagcgattattcgatgtagtgagttcaatatatggtttagtagttttaagtccgattctgttaattacagcattactaattaaaatggaatcacctggaccagccattttcaaacaaaaaagaccgacgattaataatgaattgtttaatatttataagtttagatcaatgaaaatagacacacctaatgttgcaactgatttaatggattcaacatcgtatataacaaagacagggaaggtcattcgtaagacctctattgatgaattgccacaattattgaatgttttaaaaggagaaatgtcaattgtaggtcctagaccagcgctttataatcaatacgaattaatcgaaaaacgtacaaaagcgaacgtgcatacgattagaccaggtgtgacaggactagctcaagtgatggggagagatgatatcactgatgatcaaaaagtagcgtatgatcattattacttaacacatcaatctatgatgcttgatatgtatatcatatataaaacaattaaaaatatcgttacttcagaaggtgtgcatcactaatgagaaaaaatattttaattacaggcgtacatggatatatcggtaatgctttaaaagataagcttattgaacaaggacatcaagtagatcaaattaatgttaggaatcaattatggaagtcgacctcgttcaaagattatgatgttttaattcatacagcagctttggttcacaacaattcacctcaagcaaggctatctgattatatgcaagtgaatatgttgctgacgaaacaattggcacaaaaggctaaagctgaagacgttaaacaatttatttttatgagtactatggcagtttatggaaaagaaggtcatgttggtaaatcagatcaagttgatacacaaacaccaatgaaccctacgaccaactatggtatttccaaaaagttcgctgaacaagcattacaagaattgattagtgattcgtttaaagtagcaattgtgagaccaccaatgatttatggtgcacattgcccaggaaatttccaacggttaatgcaattgtcaaagcgattgccaatcattcccaatattaacaatcagcgcagtgcattatatattaaacatctgacagcatttattgatcaattaatatcattagaagtgacaggtgtgtaccatcctcaagatagtttttactttgatacatcgtcagtaatgtatgaaatacgtcgccaatcacatcgtaaaacggtattgatcaacatgccttcaatgctaaataagtattttaataagttgtcggtctttagaaaattattcggcaatttaatatacagcaatacgttatatgaaaataataatgcacttgaaattattcctggaaaaatgtcacttgttattgcggacatcatggatgaaacgacaaccaaagataaggcataagtcatctattaaataaaatcaacatacaaatcgttttatttggaggttatagtatgaagttaacagtagttggcttaggttatattggtttaccaacatcaattatgtttgcaaaacatggcgtcgatgtgcttggtgttgatattaatcagcaaacgattgataagttacaaagtggtcaaattagtattgaagaacctggattacaagaggtttatgaagaggtactgtcatcgggaaaattgaaggtatctacaacgccagatgcatctgatgtttttatcattgccgttccgacgccgaataatgatgatcagtaccggtcatgtgacatttcgctagttatgcgtgcattagatagtattttatcatttttagaaaaaggaaataccattattgtagagtcgacaattgcgcctaaaacgatggatgattttgtaaaaccagtcattgaaaatttagggtttacaataggtgaagatatttatttagtgcattgtccagaacgtgtactgccaggaaaaattttagaagaattagttcataacaatcgtatcattggcggtgtgactgaagcttgtattgaagcgggtaaacgtgtctatcgcacattcgttcagggagaaatgattgaaacagatgcacgtactgctgaaatgagtaagctaatggaaaacacatatagagacgtgaacattgctttagctaatgaattaacaaaaatttgcaataacttaaatattaatgtattagatgtgattgaaatggcaaacaaacatccgcgtgttaacatccatcagcctggtccaggtgtaggcggtcattgtttagctgttgatccgtactttattattgctaaagaccctgaaaatgcaaagttaattcaaactggacgtgaaattaataattcaatgccggcctatgttgttgatacaacgaagcaaatcatcaaagtgttgagcgggaataaagtcacagtatttggtttaacttataaaggtgatgttgatgatataagagaatcaccagcatttgatatttatgagctattaaatcaagaaccagacatagaagtatgtgcttatgatccacatgttgaattagattttgtggaacatgatatgtcacatgctgtcaaagacgcatcgctagtattgattttaagtgaccactcagaatttaaaaatttatcggacagtcattttgataaaatgaagcataaagtgatttttgatacaaaaaatgttgtgaaatcatcatttgaagatgtatcgtattataattatggcaatatatttaattttatcgacaaataaaatgtgtcaaactagggcatacatgattaaggaaagataagctgtcatgtgtttgaacttcagagaggataatgttatgaaaaaaattatggttattttcggtacgagacccgaagcaataaaaatggcaccattagtaaaagaaattgatcataatgggaactttgaagcgaacattgtgattacagcacaacatagagatatgttagatagtgtgttaagtatatttgatattcaagctgatcatgatttaaatattatgcaagatcaacaaacattagcaggccttacggcgaatgcacttgctaaacttgatagcatcattaatgaggaacaaccggatatgattttagtacatggtgatactacaacgacttttgtaggaagtttggcagcattttatcatcaaattccggtcggacatgtagaagctggacttcgaacacatcagaaatactcaccatttcctgaagagttaaatcgagtcatggtaagtaatattgctgaattgaattttgcgccaacagtaattgcagctaaaaatttactttttgaaaacaaagacaaagagcgtatctttattactggaaatacagttattgacgcattgtcaacaacagttcaaaatgattttgtttcaacgattattaataaacataaaggcaagaaagttgttttactaacagcgcatcgtcgtgaaaatattggggaaccgatgcatcagatttttaaagcagtaagagatttggcagatgaatataaagatgttgtcttcatttatccaatgcatcgtaatctaaaggtaagagcgattgccgaaaaatatttatctgggagaaatcggattgaattaattgagccattagatgcgattgagttccataattttacaaatcaatcgtacctcgtgctgacagattctggtggtattcaagaggaggctcctacatttggaaaacctgtgttggtattaaggaatcatacagagcgtcccgaaggcgttgaggcgggaacatcgagagtaattggcacagattatgacaatattgttcgaaatgtgaaacaattgattgaggatgatgaagcgtatcaacgtatgagtcaagcgaataatccatatggtgatggacaagcatcacgacgtatttgtgaagcaatagaatattattttggattgcgcacagacaagccggatgaattcgtacctttacgtcacaaataataaaaaacccctaatcatgaagttggtttagacaaccagcggtgactaggggtttttaatatatttatttttgatagtggtagccaatatcatatttgaatactttatttgataatattggactttgctgtccatcgtcatcactttttaaacgtacatttttatgagcttctttaaatacatcggaattcaaccaattattaaagctatcttcagattcccaaatagttaagattttaacttcgtctgtatcctcggtatttaatgttttagtgacaaacatttgttggaagccttcaatagtttcaataccttgtctattgtaaaaacgttcaatcgtttcttccgcactgcctttttgtaattgtaatctattttctgccataaacatgggcaatcactcctctattttatgatttgatttgggtaatgtttttacaaatgtaaagagtacagcggtttgtatgataaccattatgattaatcctacacggactgcaagaacatccaccatataaattgaaaaacctattacaatgtataagctaattaaaattttaattttctgttgtagcgtgtagcctcgatgtaaataaaagttttctacatattctttataaattttttgattaataagccaattgtaaaagcgatctgaacttcgagcaaagcaaaaaactgctacgagtaaaaaaggggtcgttggcagtaaaggtaatacggcacctgcaataccaagcgctgtaaatattaagccaatgacgattaaaataagtcgcattgaaaaaactccattctagtactaatgcgcatgtaatattgttttagtaatataactcatgctaaatataatgtgtatgataagtgcaatgactcagtaaaatgaaacgatgttgaattatccttgtcacattaacgcattttaagcgcgactttcataacaaccaaactatttaatgagaattattctcaagtattatagttatattatgtgttttatttttgaaaagtgcaatatgttttcgaaaataagattatttttatgtgcaaaaacgacgcaaaagttttaaaaatgagacttctgtgagctgattattttataaaatgtaaacgcttactatataatgtgaatcatatcgtttaaaagcattattaaatatgatgctaagagatttatattatagccaataaacaaaggagagataatatggcagtaaacgttcgagattatattgcagagaattatggtttatttatcaatggggaatttgttaaaggtagcagtgacgaaacaatcgaagtgactaatccagcaactggagaaacactatcacatattacaagagcaaaagataaagatgtcgatcatgcagtcaaagtggcgcaagaggcatttgaatcatggtcattaacttctaaatcagaacgtgcacaaatgttgcgtgatattggtgataaattaatggcacaaaaagataaaattgcaatgattgaaacattaaataatggtaaaccgattcgtgagacaacagcaattgatattccatttgctgcaagacatttccattatttcgcaagtgttattgaaacagaagaaggtacagtgaatgatatcgataaagacacaatgagtatcgtacgacatgagccgattggcgtcgtaggtgctgttgttgcttggaacttcccaatgctattagctgcatggaagattgcgccagccattgctgcaggtaatacaattgtgattcaaccttcgtcttcaacaccattaagtttattggaagttgctaaaattttccaagaggtattacctaaaggtgttgtcaatatactaacgggtaaaggttcagaatcaggtaatgcaattttcaatcatgatggtgtagataaattatcatttacgggctcaactgatgtaggttatcaagttgccgaagctgcagcaaaacatctagtacccgctacattagagcttggtggtaaaagcgccaatatcatattagatgatgctaatttagaccttgcagttgaaggtattcagttaggtattttattcaaccaaggtgaagtatgtagtgcaggttctcgattattagttcatgaaaaaatttatgatcaattggtgccacgtttacaagaggcattttcaaatattaaagttggaaatccacaagatgaagctacacaaatgggtagtcaaactggtaaggatcaattagataaaattcaatcatatattgatgcagcaaaagaatcagatgcacaaattttagcaggcggtcatcgcttaactgaaaatggattagataaagggttcttctttgagccgacattaattgctgtgccagacaatcatcacaaattagcacaagaagaaatatttggaccagtgttaacagtgattaaagtgaaggacgatcaagaagcaattgatatagctaatgattctgagtatggtttagcaggcggtgtattttctcaaaatatcacacgtgcattaaatattgctaaagctgtacgtacaggacgtatttggattaacacttacaaccaagtaccagaaggcgcaccatttggtggttataaaaaatcaggtatcggtcgagaaacttataaaggtgcgttaagtaactatcaacaagttaaaaatatttatattgatacaagcaatgctttaaaaggtttgtactagaataaatatcgtttctgaagcgtgtttgtaggtcagtctagcggtaagtcttaacatttaacggcgttgtttagattttaagcaaaacaaaatatataggaacacgtatcatgatattaggatataatgactaaaataatagcagtaggatggtttttaattgcaaatcatcttactgctgtttttaattatgctaatttgcgatgcggctattataaggacagagttgtttattaattatggtgatttagaaatatgaagttcaatatgcaaagtcatcgtttgttttaatatgcggaacaatcattaaagttattgcgattttttgaacttaatgaaactaaacaataaatttgagatacttttttgtcatttttatgtaactaacacaataatctcgtacattattaaaattttctatatgataggaataaagcaaagcgcgagtgtgctgtaaaagttttccaaggtgatattacataaagctataaagggtaaagattaatgagttgtcatgtaaatgacgatgatgtataaatcatggttaattacggaagcattaatattaacctgagaagctataaagaattatttttaaaagcgacaatattaaatacgacgcatttatttaggagtggcaaacgtatgaatgggaaaaaggcgaatacgataaacagatacaaatattttcatcatgtcaatcatcaaaaaattcaacaaagttctaaaaagacgctgtgggcatcactaatcatcacattgttatttacagtgattgaatttgtcggaggtttagtatctaattcattggcattactgtcagattcatttcatatgcttagtgatgtattagcacttggtttatctatgttggccatttattttgcaagtaaaaagccgactgcacgatacacatttggatatttaagatttgagatattagctgcatttttaaatggtttagcattaattgtaatttcaatctggattttatatgaagctattgtacgtattatttatccgcaaccaattgaaagtggcattatgtttatgattgctagtattggtttactcgtcaatattattttgactgttatccttgtaaggtctttaaaacaagaagacaatatcaatattcaaagtgcattatggcatttcatgggagacttattgaactctattggtgtcatcgttgcagttgtattgatttactttacaggatggcgcatcatcgacccaatcattagtattgtaatttcactcatcattttacgtggtggttataaaattacgcgtaatgcgtggttaattttaatggaaagtgtgcctcaacatttggatactgatcaaattatggcagatattaaaaacatagatggcatattagatgtacatgaatttcatttgtggagtattacaacagagcattattcattaagtgcccatgttgtgttagataaaaaatatgagggtgatgattatcaagcgattgatcaagtatcatcattgttgaaagaaaaatatggcattgcacattcaacgttgcaaattgaaaacttgcaattgaatccattagatgagccatacttcgacaaattaacataaataaaacattgtagcgcctaaaacattaatctatgtcataggcgcacgtttcgttttatacttatgttgcatcatttaaatgattttcgtcaatttctttgatgctatctacatctaacacgacatctttaggtttcaaaatatgaatatgtttttcatcatttgtatgtaaaatgcgttctatgatgtacctttgaccggccattgtttctacagcaatctttttgtttctagctaaacttgctacgacagattctttatccataatgatagccccctatatatatgtttatttacttataccctaacatgatttttatactctttgaaaatatattttacagaattttatctaaatatttaaaaaaatatcttaatatccttgtaatccgataagaattatagtaatattttttcaaccattgttataggaggtcttattaatgacattatttttattagaagctaacaatcttgattttgcatcaacgaaagaagaactagaagcaaaggcagcatcactatctacgaagacaattccaacattaattgaagtacaagctactgaaaatttaactcatggttattttattgtggaagcaaatgacgaagcagaagctaaacaatttttaacagaagcagatattagtattcaattagtcaaagaagtacgcttagttggtaaagatttagatgaagttaaaaatggtgatgcacatgttgattaccttgtaacttggaacattccggaaggcattacgatggatcaatatttagcacgtaaaaagaaaaattctgttcattatgaagaagtgccagaagttgaatttaaacgcacatatgtatgtgaagatatgtctaaatgtatttgtttatacaacgcacctgatgaagaagcggtacgtcgcgcgcgcaaagcagttgatacaccgattgatggcatcgaaaaactttaataagacaacaagttgatgagatatatgtatataggtttggcatggatttcgattgcagttaattagaatagctcaatgctataaatgtaagtagttgatatgaagaaactaatgaactaaatgcaagtattgtctaaaacaatcattttattgaaatttagtagagctgaaattaatataacgtcgttaattgaataacgcttatgttataagagcactcataccaaaccataatcatctatagatataacaattcacgatataagggctgtgtttggcatagccctttagatatacacttaattcctattaaaatagtagggattaaaagggggcttgtcatgattaaaattcaacaattacaacatcactttggatcacataaagtaattcataactttaatttggacattagcaagggagaaatagtcactttcatagggaaaagtggttgcggaaagtctactttactcaatattatcggtggatttattcatccatcgtctggtcgtgtcattattgataacgaaattaaacaacagccatctccagattgtttaatgctatttcaacatcataatttgctgccatggaaaacgattaatgacaacattaggattggattacaacagaaaattagtgatgaagagattaacgcacagcttaaattagttgatttagaagacaggggaaagcattttcccgagcaactgtccgggggtatgaaacaacgtgtggcactatgtcgagcgcatgtgcataagcctaacgttatattgatggatgagccattaggtgcattagatgcatttacacgttataaacttcaggatcaactagtgcaactaaaacataaaacgcaatcaactattattttagtgacgcatgacattgatgaagctatttatctttccgaccgcattgttctgttaggtgaagggtgcaatattatttctcaatatgaaattacagcatcacatccacgcagtcgtaatgatagccacctacttaagattcgtaatgaaattatggaaacatttgcattgaatcatcatcaagttgaacctgaatattatttataaggagtgagtgacgatgaaaaggttaagcataatcgtcatcattggaatctttataattacaggatgtgattggcaaaggacgtctaaagaacggtctaaaaatgcccaaaatcagcaagtgattaaaattggatatttgccgattacacattcagctaatttgatgatgactaaaaaattattatcacaatacaatcatccgaaatataaactagaattagttaaattcaataattggccagatttaatggacgcattaaacagtggtcgtattgatggtgcatcaactttaatagagctagcgatgaaatcaaaacagaagggctcaaatataaaggctgtggcattgggccatcatgaaggcaatgtcattatgggacaaaaaggtatgcacttaaatgaatttaataataatggcgatgattaccattttggtataccacatcgttattcaacacattatcttttacttgaggaattacgtaaacaattaaagattaaaccggggcattttagctatcatgaaatgtcgccagcagaaatgccagccgcattgagtgaacacagaattacagggtattctgtagccgaaccattcggtgcactgggtgaaaagttaggcaaaggtaagactttgaaacatggtgatgacgttatacctgatgcgtattgctgtgtgctagtactgagaggggaattgcttgatcaacacaaggatgtagcgcaagcatttgtacaagattataaaaagtctggctttaaaatgaatgatcgcaagcaaagtgtagacattatgacgcatcattttaaacaaagtcgtgacgttttaacacagtcagcggcatggacatcctatggtgatttaacaattaagccatccggctatcaagaaattacgacattggtaaaacaacatcatttgtttaatccacctgcatatgatgactttgttgaaccgtcattgtataaggaggcatcgcgttcatgacacgtcccacaaataacaaatttatattacctattatcacatttattattttcttaggcatttgggaaatggtcattattattgggcattaccaacctgtattgttaccgggtcctgctcttgtaggaaaaagtatatggtctttcattgttactggagaaattttccaacatttagcaattagtttatggagatttgtagcgggctttgttgtcgcattgttggttgctattccattgggcttcttgcttggaaggaatcgttggctatacaacgctatcgaaccgctatttcaattgattaggccgatatctccgatagcatgggcaccatttgttgttctatggtttggtattggtagtttgccagcgattgcgattatttttatcgctgcttttttcccaattgtgttcaatactattaaaggcgttagagacattgaacctcaatatttaaaaatagcagcaaatttaaatttaactgggtggtcattgtatcgcaatatattatttcccggggcatttaaacaaatcatggctgggatacatatggcggtaggaacaagttggatatttttagtttctggtgaaatgattggtgcacaatcgggattaggttttttaatcgttgatgcacgaaatatgttgaacttagaagatgttttagcagcaatattctttatcggattatttggttttattattgatcgattcattagttatattgagcagtttatacttagaagatttggtgaataaggagagatgatgatgactttagaaacgcttatcaaagaacaattagatcctcatttagtagaagttgatgaagggacgtattatccgagaacatttattcagcaattatttgtagatggttatttcggtgaggcggcattgagaaaaaatgctgaagtaatcgaagctgtatcgcagtcttgtttgacaacaggattttgtttatggtgccaattagctttttcaacgtatttagaaaatgccacgcagccacatttaaataatgacttacaacagcaattgttatctggagaaatattaggtgctaccggattgtctaatccgatgaagtcatttaatgatttagaaaagttgaaccttgaacacacttatgttgatggacaattggttgtcagtggacgtatgccagctgtaagtaatattcaagaagaccattattttggtgcgatttcgaaacatgaatcatcagatgaatttgtcatgttcattctacgtgccaatcaagatggtatcactcttgttgaaaaaaccaattttttaggagtcaacgggtcagcaacgtatcaaatcacattgaatcaagtcgtagtgccacaatcacaaattatcacgcatgatgcgaagcagtttgcggcaactattcgcccgcaatttattgcttaccaaattccaataggattaggctcaattaaaagttctttagagttaattgatgcattttcaaatgtgcaaaacggaataaatcaatatttagagtatgatgttgaagcttttaaaaaacgttatcgtcaacttagagaggaatattatgcaatattagatgacggtaacttaacttcacatttaaatgaattaatatcattgaagaaggacatcggctatttattgttagatgtaaatcaagcttctgttgtcaatggtggttctagagcgtacacaccatattcgccacaagttcgcaagttaaaagaaggattcttcttcgcagcattgacaccgacattaagacatttaggtaaacttgaagcagagttgaaggggtaagtgtgataagctgattttttgtttagatgcgtttgttgaaacattttttaaaataatataaatcttagtttataaacattttctgttaatttgttatatccttttaactaggaaaatatacatttcgtaataataataatcgttatcattgaaaaagtgttaataaggtgtataatgaaaatgtgaacaattaatgaacttcttattttaaagaaggtgaatactatagatacgcatactaaagaacaacaattctcgaatctagtaagatcttatcgtaaagaatacgtgggtaaaggacccaatagtattcgagtgtcgtttaaagataattgggcgattgcacatatgacaggtgttttgagtaaagttgagagtttttacctaaacgacaaacgcaatgaatcgatgctccattatacacgcacagagaagattaaacagatgtataaagaaatagatgtaaatgagatggaaagtcttgtaggcgctaagtttgtaaaattatttacagatattgatttgaatgatgatgaagtcatttcaatatttgttttcgataagtcaatagaataagtgttgctggtgtaaggtacacggtgctgtttgctaacttcgctttgaatttaacaataattcaagggggtggtatgtcaaacggtgccgtttttttgtcatatttttaaaacaagcaacatgcaacacgtactttaaggaagtcaaaatttatcatttaggagagatggatatgaaaatcgtagcattatttccagaagcagtagaaggtcaagaaaatcaattacttaatactaaaaaagcattaggattaaaaacatttttagaggaaagaggacatgagttcattatattagcagataatggtgaagacttagataaacatttaccagatatggatgtgattattagtgcgccattttatcctgcatatatgactcgtgaacgtattgaaaaagcaccgaacttgaaattagcaattacagcaggtgtaggatctgaccatgtagatttagcggcagcaagtgaacacaatattggtgtcgttgaagttacaggaagtaatacagttagtgtggcagaacatgcggttatggatttattaatacttcttagaaactatgaagaaggtcatcgtcaatcagtagaaggtgaatggaacttgtctcaagtaggtaatcatgcgcatgaattacaacacaaaacaattggtatttttggatttggtcgaattggacaacttgttgctgaaagattagcgccatttaatgtaacattacaacactatgatccaatcaatcaacaagaccataaattgtctaaatttgtaagctttgatgaacttgtttcaacaagtgatgcgattacaattcatgcaccattaacaccagaaactgataacttatttgataaagatgttttaagtcgtatgaaaaaacacagttatttagtgaatactgcacgtggtaaaattgtaaatcgcgatgcgttagttgaagcgttagcatccgagcatttacaaggatatgctggtgatgtttggtatccacaacctgcacctgctgatcatccatggagaacaatgcctagaaatgctatgacggttcactattcaggtatgactttagaagcacaaaaacgtattgaagatggagttaaagatattttagagcgtttcttcaatcatgaacctttccaagataaagatattattgttgcaagtggtcgtattgctagtaaaagttatacagctaaatagaataaggatgctgggctagcgattaacgctttcaattttatataaatgaatcatataagcactactgctgttgtaaagatggcagtagtttttttatgattacatctaagtatagtcacggctatgttaggacaatgatttaacatttacgcacatatgtgttcacttacgcaattattganaaatntcattcatgtggnaatc

SEQ ID NO: 47 - DNA, 4012 bp; double-stranded, linear
ttcaatgagagtagtgggctgatgtttagcgatatcgcgtaagattaaccattggccataatatatattgtgtttttctaaaatcggctcggctaattttaaataggggcgatatattgttataaaactattgaaaaattcttgtgatagcatagtgacatctcctaagacaaaatagttagcttagctamcctttttacaacaatagtaattataaaacgggagcaattagaaatcaatatataattattaagagcaaaaataattatactttgttaaaataagcgtaattacatgtaaatagggggatactaatgatattgaaatttgatcacatcattcattatatagatcagttagatcggtttagttttccaggagatgttataaaattacattcaggtgggtatcatcataaatatggaacattcaataaattaggttatatcaatgaaaattatattgagctactagatgtagaaaataatgaaaagttgaaaaagatggcaaaaacgatagamggcggagtcgcttttgctactcaaattgttcaagagaagtatgagcaaggctttaaaaatatttgtttgcgtacaaatgatatagaggcagttaaaaataaactacaaagtgagcaggttgaagtagtagggccgattcaaatggaaagagatacacataaagatggtaaggtaaagtggcaattgctttatataatgaatcaggatgatgatgaaattaagccaccattttttattcaatgggaagaaagtgattccatgcgtactaaaaaattgcaaaaatattttcaaaaacaattttcaattgaaactgttattgtgaaaagtaaaaaccgatcacaaacagtatcgaattggttgaaatggtttgatatggacattgtagaagagaatgaccattacacagatttgattttaaaaaatgatgatatttattttagaattgaagatggtaaagtttcaaaatatcattcggttatcataaaagacgcacaagcaacttcaccatattcaatttttatcagaggtgctatttatcgctttgaaccattagtataaatatacgtaagtgctatgagcgagaatgcccatatgaataatgacaagcacaatggaaagaatcgttaatatattatttaatcgtgatgacttaattaaaatgaaaaagattgataatataaatgtgaaaaagataagtataacccgtaaactaaagtaattcacggtgagaggttgactcaatgtcataatgattgcaacgatgttcataattataaatagacttaaaataattgttctcatatcaaacacctcattgttagattattgacattataacaggggtaattgtatatgaacattaatgtggttgcttgaggaaaaatttattcattgaagtcaagttggttcattttagaaatgaatatcgtgttagatgatgaaagtatattgaagtataggtaactagttgaaaagtattaattgtacgataacattaaatttaacacgaaacatagatataaaatgattcacaattaaaatgggtaaatttgaacttgctaaactattaattggagcatggacatttcaaaaataagagttcaaatcttacacaagctctgaatcgacactataagatacaaactgtataattaaaggtattgttaaatagaaggagatatcataaatcatggaaaagatgcatatcactaatcaggaacatgacgcatttgttaaatcccacccaaatggagatttattacaattaacgaaatgggcagaaacaaagaaattaactggatggtacgcgcgaagaatcgctgtaggtcgtgacggtgaagttcagggtgttgcgcagttactttttaaaaaagtacctaaattaccttatacgctatgttatatttcgcgtggttttgttgttgattatagtaataaagaagcgttaaatgcattgttagacagtgcaaaagaaattgctaaagctgagaaagcgtatgcaattaaaatcgatcctgatgttgaagttgataaaggtacagatgctttgcaaaatttgaaagcgcttggttttaaacataaaggatttaaagaaggtttatcaaaagactacatccaaccacgtatgactatgattacaccaattgataaaaatgatgatgagttattaaatagttttgaacgccgaaatcgttcaaaagtgcgcttggctttaaagcgaggtacgacagtagaacgatctgatagagaaggtttaaaaacatttgctgagttaatgaaaatcactggggaacgcgatggcttcttaacgcgtgatattagttactttgaaaatatttatgatgcgttgcatgaagatggagatgctgaactatttttagtaaagttggatccaaaagaaaatatagcgaaagtaaatcaagaattgaatgaacttcatgccgaaattgctaaatggcagcagaagatgaaaacatctgaaaagcaagctaaaaaagcgcaaaatatgattaatgatgcgcaaaataaaattgctaaaaatgaagatttaaaacgagacctagaagctttagaaaaggaacatcctgaaggtatttatctttctggtgcactattaatgtttgctggctcaaaatcatattacttatatggtgcgtcttctaatgaatttagagattttttaccaaatcatcatatgcagtatacgatgatgaagtatgcacgtgaacatggtgcaacaacttacgatttcggtggtacagataatgatccagataaagactcagaacattatggattatgggcatttaaaaaagtgtggggaacatacttaagtgaaaagattggtgaatttgattatgtattgaatcagccattgtaccaattaattgagcaagttaaaccgcgtttaacaaaagctaaaattaaaatatctcgtaaattaaaacgaaaatagattaacgactgaaatctgaacgctcataagactgtcatttgcgttcagatttttttacacaatatagaatggttgagtaaaatatttttgaatatagtgaaagagggggaagtactgtgataaaaaagctattacaattttctttagggaataagtttgctatctttttaatggttgttttagttgtcttgggcggtgtatatgcgagtgctaaattgaaattagaattactaccaaatgtacaaaatccagttatttcagttacaacaacaatgccgggtgcaacgccacaaagtacccaagatgaaataagtagtaaaattgacaatcaagtaagatcattggcatatgtgaaaaatgttaaaacgcaatccatacaaaatgcttcaattgtaacagttgaatatgaaaataatacagatatggataaagcagaagaacagcttaaaaaagaaatcgataaaattaaatttaaagatgaagttggtcaaccagaattaagacgtaattcgatggatgcttttccggttttagcatattcattttcaaataaagagaatgacttgaaaaaagtaacgaaagtactgaatgaacaattaataccaaaattgcaaacggtagatggtgtgcaaaatgcgcaattaaatgggcagacgaaccgtgaaatcacccttaaatttaagcaaaatgaacttgaaaaatatgggttgactgctgatgatgtagaaaactatctaaaaacggcaacaagaacaacgccacttggattgttccaatttggtgataaagataatcaattgttgttgatggtcaatatcaatctgttgatgcttttaaaaacataaatattccattaacgtggcaggaggaccaagggcatctcatcccaaagtgaccataaaccaaattcagccatgtcagacgttatcaggcatcaccacagcaaattcaaagcgtcagcnccaatatatagtggatgccgcangaactaggggtttagcgntatcagtggtgtggcgactctattctaaacgat

SEQ ID NO: 48 - DNA, 7778 bp; double-stranded, linear
caatataggtcgccgagtttcaactacatcaactggttcagttacattagataatgcgctaggtgtaggtggctatcctaaaggacgaattattgaaatttatggtcctgaaagttctggtaagacaacagtagcgcttcacgctattgctgaagtacaaagtaatggcggggtggcagcatttatcgatgctgaacatgctttagatccagaatatgctcaagcattaggcgtagatatcgataatttatatttatcgcaaccggatcatggtgaacaaggtcttgaaatcgccgaagcatttgttagaagtggtgcagttgatattgtagttgtagactcagttgctgctttaacacctaaagctgaaattgaaggagaaatgggagacactcacgttggtttacaagctcgtttaatgtcacaagcgttacgtaaactttcaggtgctatttctaaatcaaatacaactgctattttcatcaaccaaattcgtgaaaaagttggtgttatgttcggtaatccagagactacaccaggtggacgtgcattaaaattctatagttcagtaagactagaagtacgtcgtgcagaacagcttaaacaaggacaagaaattgtaggtaatagaactaaaattaaagtcgttaaaaataaagtggcaccaccatttagagtagctgaagttgatattatgtatggacaaggtatttctaaagagggtgaacttattgatttaggtgttgaaaacgacatcgttgataaatcaggagcatggtattcttacaatggcgaacgaatgggtcaaggtaaggaaaatgttaaaatgtacttgaaagaaaatccacaaattaaagaagaaattgatcgtaaattgagagaaaaattaggtatatctgatggtgatgttgaagaaacagaagatgcaccaaagtcattatttgacgaagaatagtacacaaatttatatctatagttaaacttagcaaatatccttataggattgattgaaagtgatattcatctcataaagctagaataatatctaactttatgggatacactacaaatcgagactataaggttttttattttatttattattacattatcaatagttttataatcgagcttcaaaactttagaaaatagtagaaatagcattcaatatagtgcaaaagtgcaaattgataacttgacacttatctcctataaaccgtacaattaatttgtatgatttatatataatttcataaagtcatattgaatttcatataaagagcaaaccctagaaaaggaggtgtttgtgtgaatttattaagcctcctactcattttgctggggatcattctaggagttgttggagggtatgttgttgcccgaaatttgttgcttcaaaagcaatcacaagctagacaaactgccgaagatattgtaaatcaagcacataaagaagctgacaatatcaaaaaagagaaattacttgaggcaaaagaagaaaaccaaatcctaagagaacaaactgaagcagaactacgagaaagacgtagcgaacttcaaagacaagaaacccgacttcttcaaaaagaagaaaacttagagcgcaaatctgatctattagataaaaaagatgagattttagagcaaaaagaatcaaaaattgaagaaaaacaacaacaagtagatgcaaaagagagtagtgttcaaacgttaataatgaagcatgaacaagaattagaacgcatctccggtctcactcaagaagaagctattaatgagcaacttcaaagagtagaggaagaactgtcacaagatattgcagtacttgttaaagaaaaagaaaaagaagctaaagaaaaagttgataaaacagcaaaagaattattagctacagcagtacaaagattagcagcagatcacacaagtgaatcaacggtatcagtagttaacttacctaatgatgagatgaaaggtcgaatcattggacgagaaggacgaaacatccgcacacttgaaactttaactggcattgatttaattattgatgacacaccagaagcggttatattatctggttttgatccaataagaagagaaattgctagaacagcacttgttaacttagtatctgatggacgtattcatccaggtagaattgaagatatggtcgaaaaagctagaaaagaagtagacgatattattagagaagcaggtgaacaagctacatttgaagtgaacgcacataatatgcatcctgacttagtaaaaattgtagggcgtttaaactatcgtacgagttacggtcaaaatgtacttaaacattcaattgaagttgcgcatcttgctagtatgttagctgctgagctaggcgaagatgagacattagcgaaacgagctggacttttacatgatgttggtaaagcaattgatcatgaagtagaaggtagtcatgttgaaatcggtgtagaattagcgaaaaaatatggtgaaaatgaaacagttattaatgcaatccattctcatcatggtgatgttgaacctacatctattatatctatccttgttgctgctgcagatgcattgtctgcggctcgtccaggtgcaagaaaagaaacattagagaattatattcgtcgattagaacgtttagaaacgttatcagaaagttatgatggtgtagaaaaagcatttgcgattcaggcaggtagagaaatccgagtgattgtatctcctgaagaaattgatgatttaaaatcttatcgattggctagagatattaaaaatcagattgaagatgaattacaatatcctggtcatatcaaggtgacagttgttcgagagactagagcagtagaatatgcgaaataatttttgtctccctcacaaattagtgagggagcttttttaagttgtagtcttaatctagttagacagcactttatcggtaataactatattaaacagtagttatttgaaagtaagacggaccttatattaaataagaagttattgcttttaataaaaatgttttaggcttcgtaattactatatttatattatgtaaacctataaagatgattggttttctatccaataaaaaagaagagaagatgtaacacatcttctcttcygcaatattaattaggatttatttctaagttgagttattttaattgtaaatctgttttctttaattcttttataacttctgcagtatcataacaatttgttgcaattgttgaatatctctctgctaaacgatatgcattaatgtaaagctttaaactttctttagctatatcctctgcatcttcgaattttgatgggttagacataaccactaattctgcaaatttttctggatcaatattaatagacatgtatttatttacaactcctatttattttgatgtcttaatactaacatattgaagttttcagacaaagtaatgtctctctataattgaagaaaaataattcaaagaatttaatatttactttaaatattagaacgtatgaattaaactagtatttatgagaggatgaacaaaacatgagaataatgtttataggggatatcgtaggtaaaattggacgagacgcaattgaaacgtacatacctcaactgaagcaaaagtataaaccaacagttacaattgtaaatgctgaaaatgcagcacatggtaaaggtttgactgaaaaaatatataaacaattactaagaaatggtgtagatttcatgactatgggtaatcacacatatggtcaacgtgaaatttatgattttatagatgaagcaaaacgactagtaagaccagcgaattttccggatgaagcgccgggaattggtatgagatttatacaaattaatgatattaaacttgcagttattaatctgcaaggaagagcgtttatgccagatattgatgatccttttaaaaaggcagatcaattagtcaaggaagcacaagaacaaactccgtttatatttgttgattttcatgcagaaacaacttctgaaaagtatgcaatgggatggcatttagatggtagastagcgctgttgttggaacgcatacacacattcaaacagcagatgaacgtattttaccaaaggggacagggtatataacggatgttggtatgacaggtttttatgatggcattttaggaataaataaaacagaggtaattgagcgttttatcactagtttgccacaaagacatgttgttccaaatgaaggtagaagtgtattatctggtgttgttattgatttagacaaagaaggtaaaacaaagcacatcgaacgtatattgataaatgatgaccatccattttcaacattttaaaattacgtaagtaaacattcgaattggaccctatcgtccattagtatgaatttaatatagtaccactgtttacatagtaaatcggtggttctttttgttatcatttaatatgaaatatatccataggaggcatataactatgaaaccacaattatcgtggaaagttggcggtcaacaaggcgaaggtattgaatcaactggggaaatcttcgctacggctatgaatagaaaaggatattatttatatggatatagacatttttcaagtcgtatcaaaggtggacatacgaataataaaattagagtttctacgacgcctgttcatgcaattagtgatgatttagatattttgattgcatttgaccaagaaacaattgatgttaaccatcatgaaatgagagaagacagtattattttarctgatgccaaggctaaacctgtgaaaccagaaggatgtcatgcacagcttattgaattaccttttacagcaaccgctaaagaattaggtacagcattaatgaaaaacatggttgcaataggtgctactagcgcattgatgaatttgaatacaaatacatttgaagaacttattactaatatgttttctaaaaaaggtgacaaggtagttgaagtcaatatccaagcattaaacgaaggttatcaattaatgcaatctcgcttacctgaaatctacggggactttgaattagagtcaacagatgcactaccacatctatatatgattggtaacgatgccattggattaggtgcaattgctgcaggttcacaatttatggcggcatatcctattacacctgcgtctgaagttatggaatatatgattgccaatatatctaaagtaaacggagcggttattcaaacagaagatgaaattgctgctgtaactatggctattggtgcaaattatggtggagtcagagcgtttacggctagtgctggtccaggtttatctttaatgatggaagcaattggattatctggtatgactgaaacgccattagtcattattaatacccaacgaggtggaccttctactggattacctacgaaacaagaacagtcagatttaatgcaaatgatttatggtacacatggtgatattccaaaaattgttgtagcaccaacagatgcagaagatgcattttatttaactatggaagcatttaatttagcagaacaatatcaatgccctgttatagttctaagtgatttgcaattatctttaggtaaacaaactgttgaaaaattagattataatcgtattgaaattaaacgtggtgaaatcattcaatctgatattgaacgtgaagaagatgataaaggttatttcaagcgttatgcgttaacatccgatggtgtttctcctagacctatccccggtgttaaaggaggtattcatcatataactggtgtggaacacaatgaagaaggtaaacctagtgaatctgcgtcaaatagacaacaacaaatggaaaaacgaatgcgtaaaattgagcagttactaattgaatcgccagtagaagctaacttacaacatgaggatgcagatattctttatatcggttttatttctacaaaaggtgcaattcaagaaggtagtaaccgtttgaatcaacaaggcataaaagttaacactatacaaattagacaattgcatccattcccaacaagcgttattcaagatgcagttaataaagcgaagaaagtcgttgtagtggagcacaattatcaaggacaattggctagtattataaaaatgaatgtcaatattcatgataagattgaaaattatacaaagtatgatgggacacctttcctaccacatgaaatcgaagaaaaaggcaaaataattgctactgaaataaaggagatggtatagatggcgacatttaaagattttagaaataatgttaagcctaactggtgccccggatgtggcgatttctcagtacaagctgcaattcaaaaagcagccgcaaatatagggttagaacctgaagaagtagctatcatcaccggtataggatgttctggccgtctttcaggatatattaattcttatggcgttcattctattcacggacgtgcattacctttagctcaaggtgtaaaaatggcgaataaagatttaactgttattgcatcgggaggagatggtgatggttatgctataggtatggggcatacaatccatgctttaagaagaaatatgaacatgacgtatatagtcatggataatcaaatttatggtttgacaaagggacaaacatcgccgtcatcagcagtaggatttgttactaaaacaacgccaaaaggtaatatagaaaaaaatgttgcgcctttagaattagtattatcatctggtgccacatttgtagcccaaggtttttcaagcgatattaaaggattaacaaaactaattgaagatgcaattaatcatgatggattttcattcgttaatgtcttttcaccatgtgtgacttataataaaattaacacatacgattggtttaaagaacatttaacaagtgttgatgacattgaaaattatgattctacagataaacaattagcgactaaaactgttattgaacatgaatctttagtaactggtattgtttatcaagataaagaaacaccatcatatgaatctcaaattaaagagttagatgatmcaccacttgctaaaagagatatcaaaattactgaagacaccttcaatgcattaactgaacaatttatttaataattaaaactgagtcgtataaatgtatttataacagatccatttatgctactcagttttttactattacaaaaaataaaggagtttttaaaaatgaaagacacattaatgagtatacaaataattcctaaaacaccaaacaatgacaatgttataccttacgtagacgaggcgattaaaataattgacgaatctggtttgcattttagagtaggtccgttagaaacgacagtacaaggaaatatgaatgaatgtttaattttaatacaatcattaaatgaacgaatggtggaacttgaatgtccaagtattattagccaagttaagttttatcatgtgccagatggcatcactattgaaactttaactgaaaaatatgatgaataacattaaaagtgaagtaaactggatttgaattggcttgttagagatgacgtataactttaactgtttttgcactttatagttaaatttaatataattattaaatgatacgggcaaatagaaaggattttgtaaagtgaacgaagaacaaagaaaagcaagttctgtagatgttttagctgagagagataagaaagcagaaaaagattatagtaaatattttgaacatgtttatcagccgcctaatttaaaagcaagcgcaaaaaaagaggtnaaa

SEQ ID NO: 49 - DNA, 1128 bp; double-stranded, linear
agatgaagttgttacgaaaattgcgtacgctgtttcagaacatgtcaaaatagaaacaggtaatccattctttcaaacatcacatagtggttgtgcgacgggcggatcctgtaattgttcattataaaaaacatcgagtcagaaaaaggtggttattgaaccactaactagcatctgactcgatgtttttatttattcgggattgtttgtttgaattgttgtgctaaatctggtcgatctgtcacaatcgtgtgtgcacctttttggtataaatcattcatcagatttatactatttacgccataatagcctggaatgatattcatatcatttaaccatttgataaaacgagatgaagtcaaatcaatgcctttaaaatgagtaggcatttggaacgtttgtgctaatggttggtagtacctaccacctaataaatgatattttaaaaatgcttctgtaacttcctgttggctagcaccaattgcgacggatccttgtgcaattttattaaaacgaacgatttgttctttataaaaacttgtcacaagaacgcggtcaaatgcttgattttctgcaattgtatcaaacataatttgtggtgcgattgagccttcataggattcaggagcatcttttaagtctacgtttatatacatatcaggatattgcttcagcaactcatcgaaggttagtatagctgtgtgtgcatgaccacgatatggtgttagtccattgatatctttgaagtgataagctgcgtctaatttctttaattctgctaatgtatgggcactaacttttccagagccgttcgtcgttctatcaacagttgcgtcatgaaaaacgataagctgttgatcttttgtgagtctcacatctgtttcaaagccatcaacgcctaattgtttagcatagtcaaatgcaagttgcgtttgctctggtcttaaagccataccaccgcgatgcgcaaatatatatggtgcattgcctttgaaaaaagcagggatggtttgctttttagtaatcactttatttttattgatcattaatagactacttaaaaatccagcaccgactagtaccgcatttaaaatgtttctgtttacntttttcataaaaaattcctcc

SEQ ID NO: 50 - DNA, 6252 bp; double-stranded, linear
caagcaaacaatcgtcgataaaattgctaaaataataaaagtaattcgaactttcatcatgatcatcctttgtttatagagtcaatataagtatggaatatgttaggtatatagtcaaatgcgtcaactaatgggaattttggcatagatagagaatttaaggcaattaaaaaggcatcaaacagtaatatgctgcttgatgcccaaatgatgactttagctaaattgattagtcacttttaaagataaagaattgtcatgaattaaaactcatgtaatgatgtgttacatttcgcaatgatggctttcagttatttatcgataacatcactcttgatacctttagattttaagaaatctttaattttatcttgttgctttttattaacatcaccggcatattttgttggcacgtcgacaacattgattttattttgcggttgatagctaagcttttcaatatcttcatcaacattggcgattgtactatttaaagctttgaagtaattcatcattaattcaacgggtttcttatattctttaggaatattgttttcagtgacaaatttcttgaaatgcaaatcgtttttaacagctaagttagataagtggctaagtgtttctgcttgtttttcagtcacttttgtttgactgtcaatttgtttatctagtttatgttgcataatatatttgttatcaagtatatcgctatttacagacaaatacttttctatagcttgcttcatctctgcatcactaatatcactatttttcttatctgagttaaagatatcttttgtttctaattttttagcgcttttaggtgcatggatgccagtacttgtatgatgatcttcgttatcagattgatcggacgcgcaacctgtaagaattaatgtcgatgctaaaaatgtacttagtagtaatctctttttcataatgtaatataactccttagtttatctttaattgaaaaaatatgtattcatgtttaatagagtaacattgaattagtttggaatgtcacgatgaccttgcaatgaccatagacgtaaatgattacgtgcatgagttgctttttctatcaataatgcatcattttggacgttgttaaggatagctttatctataaataactgcataattggttgtactaatttagacgtaggtatcgtacgtaaaagcataataatttcgttcacatacttttctttctcaatatcatttttcatattgatttgtttgcgagaggtacatactttaagcattatcgcacatctcgttgtatatattaagtttatcataacatgattttatgtcgggataaaaaaataacagcatcttaacaaatgtaagatactgtcagtgaaatgaatgaaactttagtttctgataatatagtcaaaggcatttaatgctgcatttgcaccagcgcccattgaaatgataatttgtttgttcttctgatctgtgacatcgccagcagcaaatattccaggaacattcgtattattgttacgatcaatcacaatttcaccacgttcgtttaattcaacagcatcgtttaaccatgatgtgtttggaagtaaaccaatttgaacaaagataccatctaagttaagtagatgttcttcgccggtgttcatgtcttcgtaacgtatacctgtaacatggtcttctccgacaacttcagtagttttggcatttgttttgatatcaacatttgataaagaacgtaaacgatcttgtaacacgttgtctgcttttaattcgctagcgaattcgaataatgtaacatgattaacgataccagcaaggtcaattgctgcttcaaccccagagttaccgccaccgataactgctacgtctttattttcaaatagaggtccgtcacagtgagggcagaatgcaacacctttattaatcaattgctcttcacctggaatgtttagcttacgccaacctgcaccagtagcaataatgactgttttactttctaagacagcaccgttttctaacgtaactttaattgcttcgtcagtcttttcgatatctgtagcacgtatacctgtcattgcatcaatgtcatattgatcaatgtgcgctgctaagttagaagaaaattcagaaccagttgtttctttaacagtaatgaagttctcaataccagcagtatcattaacttggccaccgatacgatcagcaactataccagtacgtaaacctttacgtgctgtgtaaatcgctgcactaccactagcaggaccaccaccaacgattaagacatcataaggttctttattttcaaactcagatgcatctgccgtactgcctagtttcgaaagaatatcttggattgtcatacgaccattgccaaattcttcgccatttaaaaagacagcagggactgccatgatgttttcagattcttcacggaacactgcaccatcaatcatagaatgcgtgatgttagggttgatcacactcattaagttaagtgcttgaacgacatcaggacatttttgacacgttaaactaatgaatgtttcaaaatggaatgaaccttctaattttttaatttggtcaatgattgactgtttttctttaggtgcacgaccactaacctgtaaaattgctaaaacaagtgagttaaactcgtgacctaatggaatacctgcaaatgttacacctgtttcttcgccaggacgattgactgagaaacttggtgtacgttttaaagatttttcagaaagagatagtctaggtgacatatcagtaatttctgtcaacaaatctttaagttctttggatttatcatctgaaccaaggctggcaacgaattcaacgttgccctccattagttctaatagttgtttaagttgttgttttaaatcagcattaagcatggttgtaatgcctccttagattttacctactaaatctaaaccaggttgcaatgttttagcgccttcttcccatttagctgggcatacttcgccagggtttttacgaacatattgagctgctttgattttgtgagctaatgtactagcgtcacggccaattccgtcagcgttaatttcagatgcttgtacaacaccgtctgggtcgataatgaatgtaccacgttgagctaaaccagtagcttcatctaatacatcaaaattacgagtgattgtttgtgatgggtcaccaatcatagtgtaagtgattttgctaattgcatctgaatggtcatgccatgctttgtgtacgaagtgagtatcagttgatactgagaatacatttacgcctaatttttgtaattcttcatattggttttgtaagtcttctaattcagttggacaaacgaatgagaagtcagcaggatagaagcatactacgctccaagaaccttttaaatcttcttgtgtaacttctttaaattgatctttttttggatcgaaarcttgcgctgtaaatggtaagatttctttgttaattaatgacataaatatcttcctcctaagaatttaagtatgaattagaactatcaattgattgcgcttaattataataattctaatctcttagttagcattattacattttgatccagaatagtcaactggataactttgtaaagtgaatgattacttttaaaataaagaaagataatataaagtgctttgataatggattttgtagttgatgatttaaaaggttgtgtctatatttaatatcttgattttaatgtaaaaaatgtaaaaaaagaagatttgtattctcaactaagtcaaccttattgataatggtatgagaatatttgttcgagatggatgaaggtaatgagtgagaaactggatttttaaagtatgagacaatattttaaaaagttcaattattaacttataagcaaataattgctataaaaaagtttggacgtgtacaattgcaatatgaagattttaaattaattgtaaagtatcgaggagtgggtaacgtgtcagaacatgtatataatcttgtgaaaaagcatcattctgttagaaaatttaagaataaacctttaagtgaagacgttgttaagaaattggtagaagctggacaaagcgcttcgacgtcaagtttcctgcaagcatactcaattattggtatcgacgatgagaagattaaagaaaatttacgagaagtttctggacaaccttatgttgtagaaaatggctatttattcgtctttgttattgattattatcgtcatcatttagttgatcaacatgctgaaactgatatggaaaatgcatatggttcaacggaaggtttgctagtaggtgcaatcgatgcagcattagttgccgaaaatattgcggtaactgctgaagatatggggtatggcattgtctttttaggatcattaagaaatgatgttgaacgcgttcgagaaattttagacttacctgactatgtcttcccggtatttggtatggcagtaggggaacccgcagatgacgaaaatggtgcagccaagccacgcttaccatttgaccatgtcttccatcataataagtatcatgctgataaggaaacacagtatgcacaaatggcagattacgaccagacaatcagcgagtactatgatcaacgtacaaacgggaatcgcaaagaaacatggtcgcagcaaattgagatgttcctaggaaacaaagcaagattagatatgttagaacaattgcaaaaatcaggcttaatacagcgatagcaagataccaaaataacccgcccccctctagcttaaaatgataagtatagctagagggggcgggtatttcttgcaatgaattagtgtgaagttaatgcagcattatcatttgaatcgaaagtatctttatcccaatgtttagttaacttggcggtacctgtaccagctagcattgaatcgttcacgtttaatgctgttctacccatgtcaatcaatggttcaacggagatgagcacgccggctaaagcgactggcaagtttaacgttgacaacaccaatatggatgcaaatgtagccccgccaccgacgccagcaacgccgaatgaactaataatcacgacagcgattaacgttacaataaattgtaaatcaatttctacattagcgacgggtgcgaccataattgcaagcatggcagggtaaatgcctgcacaaccattttgtccaatcgacaatccaaatgtcgcagcgaaattggcaataccttctggcacgcctagacgtcttgtttgtgtttgtacattcaatggtaaggcacccgcgcttgagcgtgatgtgaatgcaaagattaatacttccaaagtctttttaacatagcgaattgggctaatacctaacaggcttaaaataattaagtgaatgatatacatcgtaattaatgcagcgtacgatgcgattaagaattttcctaaagtccaaatggcgccaaagtcacttgtcgataatgtgttggccataattgctaatacaccgtatggcgttaaacgtaagacgaacgtcacaatcgccattactagtgaatagatagcgtcaatcgcacgcttaagcaattcaccatgatcaggttgtttgcgtntacgcgtaaataagcaaatcctataaacgaagcaaatatcacgacagcaatcgtggaagttgcacgttgtccagtgaaatctaagaatggatttttaggcaataattccaaaatttgttgtggtaacgtatgtgctgttaaatctttcgcttgtttagcaatttcgcttccacgtgcttgttcagcgttaccaaggttaattgttgatgcatctaaaccaaacaccaaggcatacacaacaccaacaatcgcagcaatggtgacagtgccaattaaaaagataaaaatgagactaccaattttagcaaacttttctccgatttgaattttagtgaatgcagctacaatagaaatgaaaattaaaggcataacaatcatttgcaacaatgcaacgtaaccttgtccgacaatgttgaaccagtcacttgttgatgtaataacattcgaatgtgtgccataaataagatgcaataacacaccgaatactataccaatccctaaagctgtaaacacacgtttcgcaaaagatatatgtttgcgagccatcatgtgcaatattacgatgaaaatcaccaatacaataatattaatcagtgtaagaaaagcattcatgaacgtcactccttaaatttttgaatataattccgactagtatgct

SEQ ID NO: 51 - DNA, 6730 bp; double-stranded, linear
atcaaatcncaaaatatttattaatnanaaggggattatccatgtgagaaacaaagtaatgctctttttttacctcttgtgggttgaaaaatggatcatcagagatagacttcttctttttcgaagatgacatttgatactttaatcttctaaaaccataacttgtcgcatcaaaaatgccttcttgtacaagtaaaatcaaaaatatgctaataaaaataattaatgaaacataaaacaatatatttaaatatgtaatgatagtatggctattaaaaagccatataataaacgttaatattggcgttattagtgccattccaagccattttttcaacatttgatcactcccacttatagaaaactcttacgcatagtttacattaaaatcagacattgaggaatgattttttaatttcttcagctttattgaaattctaaaatcaatcattcttcattagtttaaagcaaaaaaatattgatatatagtaaatattgtatatataatattagttaagatttcagaaaattttgaagggaatggaaatttagaaatcggaatttgttagaggaggggattagatggggaaatatattttcaaacgatttatttatatgcttatttctttatttattattattacaattacatttttcttaatgaaattaatgccaggttcgccatttaacgatgctaaattaaatgctgaacaaaaagaaattttaaatgaaaaatatggattaaatgatcctgtagctacgcagtatttacattatttaaaaaatgttgttacaggcgattttggtaattcattccagtatcataatcaacctgtgtgggatttgattaaaccgagactactaccttcttttgaaatgggtcttacagcaatgttcatcggtgtgatactgggacttattttaggtgttgcagcagctactaaacaaaattcttgggttgactatacaactacagttatttcagttattgcagtatctgtaccatcttttgtacttgctgtacttttacaatatgtatttgcagttaaattaagatggttcccagtagctggatgggaaggtttttcgaccgcggtattaccgtcacttgcattatctgcagctgttttagcaactgtcgccagatacataagagcagagatgatagaggtattaagttcagactatattttattagcgagagctaaaggtaattcgacaatgcgtgtactttttggacatgcacttagaaatgctttaattccaattattacaattatcgttcccatgttagcaagtattttaacaggcactttaacaattgaaaatatttttggagttcctggattaggggatcaattcgtacgttcaattacaacaaatgatttctcagtaatcatggcaatcacactattatttagcacactgtttatcgtttctatttttattgtagatattttgtacggtgtgatagatccacgaattcgtgttccaaggaggtaaaaaataatggctgaaaataaaaacaatttgtcgattaacgacgatcattctaatgcagctatgacgcatacctctgacgtatcgcatcatctgattttattattagagaattagatttgaatcaggaacctgaaatgcaacgagaaagcaaaaacttttggcaagatgcttgggctcagttaaaacgaaataagttagctgttgtcggtatgataggtttaattatcattgtaatatttgcttttatcggtccagttataaataaacatgattatgctgaacaaaatgtagaacatagaaatcttccggcaaaaatacctgtattagacaaagttccatttttaccttttgatggtaaagatgcagatggcaaggatgcttataaagcagcaaatgctaaagaaaattattggtttggtactgatcagttgggtcgagatttatggacaagaacatggaaaggtgctcaaatttcattgtttatcggtgttgttgcagcgatgttagatatttttattggtgttgtatatggtgcgatttctggattcttcggtggacgtgtcgatacgattatgcaacgtatacttgaagtcatagcatctattccgaatttaattgtcgtaattttatttgtattaatttttgaaccatccatttggacaattatattggctatgtctatcacaggctggttaggcatgagcagagttgtacgtggagaatttttaaaattaaaaaatcaagagtttgtcatggcttcgaaaacattgggggcttcaaaattcaaattgatatttaagcatattttacctaatacattaggtgctatcgtggttacatcaatgtttacagtacctagtgctattttcttcgaagcatttttaagtttcattggtataggtgtacccgcacctcaaacatcgttagggtcattagtaaatgatgggcgcgcaatgttattaatttatccacatgaattatttataccagcaatgattttaagtttattaattctattcttttacttatttagtgatggattacgtgatgcatttgatccgaaaatgcgtaaataaaaagggggcatagcatatgactgaaagaatattagaagtaaatgatttgcatgtttcctttgatattacagcaggggaagtgcaggcagtgagaggcgtagatttttatttgaacaaaggggaaacattggcaattgttggtgaatcaggttcaggtaaatctgtaacaacaaaagcaattacaaaattattccaaggggacacaggaagaattaaaaagggagaaattttatttttaggggaagatttagcaaaaaaacctgaaaatgagttgattaaattacgtggcaaagatatttcaatgatctttcaagatccaatgacatctttaaacccaacgatgcaaattggtaaacaagtcatggaaccattaattaagcacaaaaattatagtaaagcacaagctaaaaagcgcgcattggaaatactaaatcttgtaggtttaccaaatgcagaaaaaagatttaaagcatatcctcatcaattttcaggtggacaaaggcaaagaattgttattgcaaccgcattagcttgtgaacctaaagtgctcattgctgatgaaccaacgactgcattagacgtaacgatgcaggcacaaattttagatttaatgaaagaactacaacaaaaaatcgatacagcaattatttttataacgcatgatttaggggttgttgcgaatattgctgatagagtggcagttatgtatggtggtcaaatggttgaaacaggagatgttaacgaaatattttatgatccaaagcatccatatacatggggattattatcgtcaatgcctgatttatcaacaacaaatgacacaccattactagcgattcctggagcgccacctgatttattacacccacctaaaggtgatgcatttgcgagacgtagcaatatgcattagatattgattttaaagtagaaccaccgtggtttaaagtttcaccgacacattttgtgaaatcttggttattagacgcacgtgcaccaaaagttgaactacccgagctggtaaaacaacgtatgaaaccgatgcctaataattatgaaaaaccactcaaggtagaaagggtgtcgttcaatgaaaaatgatgaagtgctattatctattaaaaatttaaagcaatattttaacgcaggaaagaaaaacgaagtggagcgattgaaaatatttcgtttgatatatacaaaggggaaacattaggtttagtaggagaatcggggtgtggtaaatctacaactggtaaatcaattattaaacttaatgatattacaagtggagaaattttgtatgagggtattgatatacaaaagattcgtaaacgtaaagatttgcttaaatttaataaaaagatacagatgatttttcaagacccatatgcgtctttaaatcctaggttaaaagtaatggatatagtagctgaaggtattgatatccatcatttagcaactgataagcgtgaccgaaaaaaacgtgtctatgatttacttgaaactgttggattaagtaaagaacatgccaatcgctatcctcatgaattttcaggtggacaacgccaacgtattggaattgcccgtgcattagccgttgaaccagaattcattatcgcggacgaaccaatatcggcattggatgtttcaatccaagctcaagtagttaatttattattaaaattacaacgtgaaagagggattacgttcctatttatagctcatgatctatcaatggtgaagtatatttcagatcgtattgcagtcatgcattttgggaaaatagttgaaattggaccggcagaagaaatttatcaaaatccattacacgattatactaagtctttattatcagccattccacaacctgatcctgaatcagaacgcagtcgcaaacgatttagttatattgatgatgaagcaaataatcatttaagacaattacatgaaattagaccgaatcactttgtctttagtactgaagaagaagcggcacaactacgagaaaataaattggtgacacaaaattaaggggaagggggaaatgcaatgacgagaaaatttagaacacttattttaattttgattgctacaattgcattaagtggttgtgctaatgacgatggtatttattcagataaaggtcaagtattcagaaaaattttgtcatcagacttaacatcccttgatacatcattaataacggatgaaatatcttctgaagtgactgcgcaaacattcgaaggtttatacacattaggaaaaggtgacaaaccggtgttaggtgttgcgaaagcttttcctgaaaagagtaaagatggtaaaactttaaaggttaaattaagaagcgatgctaaatggagcaatggtgacaaagtgactgcacaagactttgtttatgcttggagaaaaacagttgaccctaaaacaggttctgaatttgcatacattatgggggacattaaaaatgcgagtgatattagtactggtaagaaacctgtagagcaattaggtatcaaagcattaaatgatgaaacattacaaattgaattagaaaagccggttccatatattaatcaattattagcacttaatacctttgcacctcaaaatgaaaaagttgccaaaaaatatggtaaaaattacggtacggcagctgatagagcggtatacaatggtccatttaaagttgatgattggaaacaagaagataaaaccttactatctaaaaatcagtattattgggataaaaagaatgtaaaattagataaagtgaattataaagttattaaagacttacaagccggtgcatcattgtatgatactgaatcagtagatgacgcatttattactgcagatcaagtaaataaatataaagacaacaaaggattaaactttgtgttaacgactgggacattttttgtaaaaatgaatgaaaaacaatatcctgattttaaaaacaaaaatttaagattgstatcgcacaagcaatagataaaaaaggatacgttgattcagtgaaaaacaatggctcaattccttccgatacactaacagccaaaggaattgcgaaagcgcctaatggcaaagattatgcgagtaccatgaattcgcctttaaaatataatcctaaagaagcaagagcacactgggacaaagctaaaaaagagttaggtaaaaatgaagtgacattttcaatgaacacagaagatacaccagatgcaaaaatatctgctgaatatatcaaatcgcaagttgagaaaaatttaccaggagttactttgaaaattaagcaattaccgtttaaacaaagagtatcactagaactgagtaacaattttgaagcatcacttagtggttggtctgcagattaccctgatcctatggcttatttagaaacaatgaccacaggtagcgcacaaaataatacagactggggtaataaagaatatgatcaattacttaaagtagcaagaaccaaattggcacttcaaccgaacgaacgatatgaaaacttgaaaaaagcagaagaaatgttcctaggagatgcaccggtagcaccaatttatcaaaaaggtgttgcacatttaacaaatcctcaagtaaaaggattaatttaccataaatttggtccaaataactcacttaaacatgtatatattgataaatcgatagataaagaaacaggtaagaagaaaaaataatatgctttgtaaattaggctggagacatatctccagtctttttgtgttggataaaaactttgggaataaaaatttaaaataagtcgttttttaaattactgaaattgattaaatgcataaataactgaatattctaaaaataaacttgtaataattttttctatgagtaaactaaaaagaaaaaattagattgaaagtaggaggcatatgtatggggaagctaattaaatatatttcaatacttcttattgtcgttttagtgttgagtgcttgcggaaaaagcagtaataaagatgaaggagtaaaagatgctactaaaacggaaacctcaaaacataaaggtggtaccttaaatgtagcattaacagcaccgccaagtggtgtttattcttcgttattaaatagtacacatgcagattctgtagttgagggatattttaacgaaagctt

SEQ ID NO: 52 - DNA, 6482 bp; double-stranded, linear
aatttttgtcattattaaaaacctcgcttttaaaagattgaaaagtaaatgagtgaaattaaagattatgcacattaaaatcacgccacaatttaattgtgaaaaatatcacaaatatattataacactaaatttcccaaaattcaaaagtgtgttttattgcagaaaacttataacaygtgcacaagttatagtgaattgcaaacggattactttagtctttttaaaacatgaagtataatttgtatagcaataaatataaaaatgggaggctatgttcaatgagcaatatgaatcaaacaattatggatgcatttcatttcagacatgcgactaagcaattcgatccacaaaagaaagtttcgaaagaagattttgaaacaatattagagtcaggtagattgtctccaagttctcttgggttagaaccttggaagtttgtcgtgattcaagatcaagcgttacgtgatgaattaaaagcgcacagttggggcgcagcaaaacaattagatacagcgagccattttgtgctaatttttgcgcgtaaaaatgtaacgtcaagatcaccgtatgtacaacatatgttaagagatattaaaaaatatgaggcacaaacgattccagctgttgaacaaaaattcgatgcattccaagcagatttccatatttctgataatgatcaagccttgtatgactggtcaagtaaacaaacgtatattgcattaggcaatatgatgacgacagccgcattgttaggtattgattcatgtccgatggaaggttttagtctggatacagtgacagacattttagcaaataaagggatcttagatactgagcaatttggtttatcagtgatggtcgcatttggctacagacaacaagagccaccgaaaaataaaacacgccaagcttatgaagatgttattgaatgggttggaccaaaagaataaatagaataccgtatgtctaaatatataaaattaaaaagttagcaataaaaaagcctgcgattacataaatgaatcgcaggcttttgcgtgaaaaaattgtattaataaagtatggatgattatttttctggaacaaggtcagtatttgaatgaactgtgatgtcaaacccttctggtgccgtaaatgtatgtgttgaggcgtcgggttgataaatatcaacatgtgttaatccataactttgtgaattgttttgtcttgcttgattggattgccaagtattagcagcaatatgatggtgataatgattcgttgacataaatagcgcacgtggaaaatcagacacatgttggaatcctaattgttcaatgtaacattgatatgctgcgtctaaatcatgtgtttttaaatgtaagtgtccaatcatgccttttgctggcattccttgccaaccttcatcagtacgatgtgttaataaggtttggctatcaacttctaaagtatccattttaactttgccattttgccattcccatgaagatgaaggtctatcgcgatagacttcaataccattaccttcggggtcgttgaaatataaagcttcacttactaaatgatcaccagcgccgatgcccatatttttttgtgccacgaaatataagaagttagctagatcctcagtagttggtaataaaaatgctatatgaaaaagccctgcttcacgtggggaagtctgacggccgtcttctaataaatgtaacgttagagtatggccaccagtcccaacagataatacggttgtattatcgtcagaacttttaacggatagtcctaaaatgtttttgtaaaatgttgtcattaagtctaagtctcttacgttcagtacaatgtttgtcacttgtgttgctgttttatcgtgaaatgccattatgcatcgcctctttttctatttttctataagttagtataaaaagtataccagaaaagaaaatgaattgatagcataaagtttgaaatgcaaaataactagtcgttttgcaattttatattgatgcgaacaaaaaagcgatggtacagttgcaccatcgcaaaatttatttaaccaagatatacatcttgatatgaatcttctttttctaacatatgtttggcaaatgaacatgaggcaataattttcaaattattttctcgagcgtgttcaacaactgctttaagtagttttttgccaacaccttgaccaccaagttcatcagatacgcctgtatgatcaatgttaatttcattattatccacaaaacggtatgtgatttcagctaaagcattattttcatcatcaccaatatagaatttgttctcgccttgtttgatttcaaggttactcatacatatcaactcctatcatgattgattatagtatttccctattctattttaacttaaacgaagtcaaaggtgcatgacagtcatgtgacgacattgccacatctatgtagtcgtttttattaagcacagtttgaaatgaagatgaaaacacgtatcttgacattaaatctattcagctatataatttatctcgaaatcgaaataaaataaaaaagttggtgatcatatggatcgaacgaaacaatctctcaatgtttttgtcggaatgaatagggcgttagacacattagagcaaattacaaaagaagacgtaaagcgatatggcttaaatattactgaatttgcagtgctcgagttgctttataataaaggtccgcaaccaattcaacgtattagagaccgcgtattaattgcaagtagcagcatttcatatgttgtaagtcaattagaggacaaaggttggattacacgtgaaaaggataaagatgataaacgtgtatatatggcttgtttaactgaaaaaggtcaaagtcaaatggcagatattttccctaagcatgctgagacattaacaaaagcgtttgatgtgttaacaaaggatgaattaacaatcttacaacaagcgtttaagaaactaagtgcacaatctacagaagtgtaaggcgtgcactaaaaatttacattaaagtatctcgatttcgagataaatgcactaaaaatataaagagggtatataaaatgataaataatcatgaattactaggtattcaccatgttactgcaatgacagatgatgcagaacgtaattataaattttttacagaagtactaggcatgcgtttagttaaaaagacagtcaatcaagatgatatttatacgtatcatactttttttgcagatgatgtaggttcggcaggtacagacatgacgttctttgattttccaaatattacaaaagggcaggcaggaacaaattccattacaagaccgtcttttagagtgcctaacgatgacgcattaacatattatgaacagcgctttgatgagtttggtgttaaacacgaaggtattcaagaattatttggtaaaaaagtgttgccatttgaagaagtcgatggccaagtgtatcaattaatttcagatgagttaaatgaaggggtagcacctggtgtaccttggaagaatggaccggttccagtagataaagcgatttatggattaggccccattgaaattaaagtaagttattttgacgactttaaaaatattttagagactgtttacggtatgacaactattgcgcatgaagataatgtcgcattacttgaagttggcgaaggaggcaatggtggccaggtaatcttaataaaagatgataaagggccagcagcacgtcaaggttatggtgaggtacatcatgtgtcatttcgtgtgaaagatcatgatgcaatagaagcgtgggcaacgaaatataaagaggtaggtattaataactcaggcatcgttaatcgtttctattttgaagcattatatgcacgtgtggggcatattttaatagaaatttcaacagatggaccaggatttatggaagatgaaccttatgaaacattaggcgaagggttatccttaccaccatttttagaaaataaaagagaatatattgaatcggaagttagaccttttaatacgaagcgtcaacatggttaattggaatgaggaggatttgtgatggaacatatttttagagaaggacaaaatggtgcgccaacactaatattattgcatggtacaggtggtgatgagttcgatttattaccgttaggcgaagcattgaatgaaaattatcacttgttaagtattagaggacaagtttcagaaaatgggatgaaccgttatttcaaacgtcttggtgaaggtgtttatgatgaagaagatttggcatttcgtggacaagaattgttgacgttcattaaagaagctgctgaacgttatgattttgatattgaaaaagcagtacttgttggattttcaaatggatcaaatatagcgattaacttaatgttgcgttcagaagcaccatttaaaaaagcattgttatatgcaccgttatacccagttgaagtaacgtcaacaaaggatttatcagatgtcagtgtgttgctttctatggggaaacatgatccaattgtgccattagctgcaagtgaacaagtcattaacttgtttaatacacgtggggcacaagtcgaagaagtttgggtgaagggccatgaaattacagaaactggattaacggctggtcaacaaatacttgggaaataacagttctattaagaagcggacagatggaaaagatttttacttttcatctgcccgcttttttgattttgaagtgctgtactaaattttacaatagtatagatattttaatcgatatgagatttgccggtaatacgcttaattaaacctttatagagtacaggtatgagtaagatgaaaccgaacaatcccataatagggaatacttttccaattaatgaaatgaaaccgataaatgtactaatataagtgatgacagccattgtaataataatgatgaagtaacgtctgctgaatggaacgctgaaacgtgacgcaaatgcatacattaatccaacaacagtattgtagatgacaagtatcataatgacagacataataataccaattgacggagacatttgtgtcgctaattttaatgtaggtagatctacgtgtttaattttatcgaattgagaaattaaacctagattaatcatcatgagtaaaaatgtaatgattaaaccgccaatcaagcccccgtataacgttgagtcacgatatttaactttactacccatcactgataagaagctgaaggcagcagcaatttgcaagcttgcatagttaatcgcatcaaaccaccatccaggtgataatgatttctgcttatgaatctgagcatcattattagcggcagtaaaatcaagatgacttgttgtgaaatagtagaccgcaatcataatgacaatcgcaattaaaaatggggtaacaccgccaagcacagcaattaaacgatcgaattttagaaacagtgttgctaaaataaaggcgactaatatgagtgcgctcagccaatacggtaagttgaaactttgatgaatggttgacgcaccacctgcagtcataataatagctaaagacaacataaacattgttaaaataatatcaaaacctcttgcaatagaggggtataagaaatagttaattgaatcagaatgatttctggactttagatgatgacctgtatgcatgacaaccattccacctaaagtaatcaatagtcctgttacaataatgcctgaaatgctatatgcgccatgacttgtgaaaaactggaaaatttcttgaccagtagcaaagccggcaccaacgacaacaccaacaaaggcaaatgccacaataatggactcttttaagatacgcatgatttaaaaatgtcccttcgtaattttaagtaatatagaaaatgtaacatacatgttaatgaaaaatatagtactaatatagtattttgttaaattggagtagaagcgagggtgtcggtcatttcattaatttattagttgattttgcatttttttgctgtaaagttgttataatacagttaacaggaattagcatagatacaccaatcccctcactactcgcaatagtgaggggatttttttcggtgtagctaggtcgcctatttatcatcgtgtttgcgtagcaatgcgtaaacacagtaccactaaataagtgcacgatacatgcatcaaatgtcgtctttagtctaagtaacgatcatgcattaacattttcaaaatatctatttgagcttgaagatctttaccaatattggtatcacgaatcttcttacgttgtaattctttatctacgacgcgctttatagaaagttcatcgataccttcggaaagtatttttnctttagcgttaaattgttggtgtgcaacgagttgcataccgaatgaattatacaatagtgtatagcctgcaatgccagtngttgactgataagcttttgaaaagccaccatcaatgacaagcatctttccatcagccttgat

SEQ ID NO: 53 - DNA, 16592 bp; double-stranded, linear
atttaaggcgattgcttgtgtatttctctcttttgtaggcaaacctgcactcgttccaaaaaatgtaacttccatatatgcccctccttttcttcaattcattttatcataaaatttgtatcaatttagttttaatttatacttgaatcaaaatctgttaaaaattcgtctttgctagttaatttttctaactttaacgtagacataactatataaattttgataattacgttatacttatcattaataagtatcacattaaacatgatacatgaatcgatatttcatttaagacactgcatacagtcgagcatattgtatgacctactgaatggattatcttataataataaatcatatatctaattaagaattgaggttttaatcttgagtactaaaaacaaacacatcccatgtttaatcacaatctttggtgcactgcgtgacttaagccatcgtaagtngtttccatcaatattccatctctaccaacaagacaatttagatgaacatattgccatcatcggtattggacgtcgtgacatkwntaatgatgatttccgtaatcaagtaaaatcatcaattcaaaagcacgtaaaagatacaaacaaaattgacgcgtttatggaacatgtcttctatcatagacatgatgttagtaatgaagaaagctatcaagaattactagattttagtaatgaattagatagccaatttgaattaaaaggtaatcgactattctatttagcaatggcaccacaattctttggcgttatttctgattatctaaaatcttctggtcttactgatacaaaaggatttaaacgccttgttatcgaaaaaccattcggtagtgatttaaaatcagccgaagcattaaacaatcaaattcgtaaatcatttaaagaagaagaaatttatcgtattgaccactatttaggaaaagacatggttcaaaatatcgaggtattacgttttgcgaatgcgatgtttgaaccattatggaataacaaatatatttcaaacatccaagttacatcttctgaaatactaggtgttgaagatcgtggtggttattatgaatcaagtggcgcgctaaaagatatggtgcaaaaccacatgttacaaatggttgcattattagctatggaagcacctattagtttaaatagtgaagatatccgtgctgagaaagtaaaagtacttaaatcactgcgtcatttccaatctgaagatgttaaaaagaactttgttcgtggtcaatatggcgaaggctatatcgatggtaaacaagttaaagcataccgtgatgaagatcgcgttgcagatgactctaacacacctacctttgtttcaggtaaattaacaattgataactttagatgggctggtgtaccattctatattcgtactggtaaacgtatgaaatctaaaacaattcaagttgtcgttgaatttaaagaagtaccaatgaacttatactatggaaactgataaactgttagattcaaacctattagtaatcaatatccaacctaatgaaggtggtatcttttacatctaaatgctaagaaaaatacacaaggtatcgaaacagracctgtccmattgtcttactcmatgagcgctcaagataaaatgaatactgtagatgcatatgaaaatctattatttgattgtcttaaaggtgatgccactaacttcacgcactgggaagaattaaaatcaacatggaaatttgttgatgcaattcaagatgaatggaatatggttgatccagaattccctaactatgaatcaggtactaatggtccattagaaagtgatttactacttgctcgtgatggtaaccattggtggggacgatattcaataattgaattaaaacgcacatgttaaacaaaaataaatgagcgaatgacaaggattgattacgaatcaagtaaatcaattgttctatcattcgctttttttctagactatattatgaaattatattttacaatgcccaaaactattttaataatcattgaacaaatgggtgtataatttatagaaataatgtagaataaaaataaatgattgaattaattggagtgaaagttttggacgttatcaagcaaatacaacaggcaattgtttatattgaagatcgtttattagagcctttcaatttgcaagaattaagtgattacgttggtctttcgccataccatcttgatcaatcatttaaaatgattgtcggcttatctccagaagcttatgcacgcgcgcgtaaaatgacactcgctgcaaatgatgtgattaatggtgctacacgacttgtagatatcgctaaaaaatatcactatgcaaattcaaatgattttgcaaatgattttagtgattttcacggcgtatcacctattcaagcctctactaaaaaagatgaattacaaattcaagagcgattatatatcaaattatcaactactgagagagcaccttatccatacagattagaagagacagatgatatttcattggttggatatgcacgatttatagacactaagtatttgtcacatccttttaatgttccggattttttagaagacttgctcattgatggtaaaattaaagagttacgacgatataatgacgttagtccatttgaactatttgttattagttgtcctcttgaaaatggtttagaaatatttgtaggtgtaccaagtgaacgttatcctgcacacttagaaagtcgatttttacctggcaaacattgtgcgaaattcaatttacaaggtgaaattgattatgcaactaatgaagcttggtactatattgaatcaagtttgcagttaacattgccatatgaacgaaatgatttatatgttgaagtgtaccctctcgatatttcatttaatgacccattcactaaaattcagctttggattcctgttaaacagagtccttatgacgaagattaaataataaaaaacaaagaagccccctaatatatctataggtctacaaatggccttagattctattagggggcatattaatatgttaatttagttcgataacacatgcttcatatggacgtaactgttttaaattaactttggcatcataattaaatagctttacttctccatggcttaaatcaaatggtacagttaattctgcttcgtggttagtaagattacctacaataagaacttgcttttcatttaatgttctcgtgtacgcaaaaacttgtgaattttcagcatctactaaatcaaattgaccatatacgtatacatcattagactttcttaattgaattaaatctttataaaattgtaatactgaatgctcatcttctaattgttgtgcaacattgatagttttataattcggattcactgggaaccacggttcaccatttgtaaatcctccatttaacgtatcatcccattgcattggtgtgcgagaattatctcggttctcatctttatatttcgcaagtaaagcgtctacatctccaccttgagctttcactatttgatagtcatttttaacagcaacatcgttaaacgtttcaatactttcaaatggataattcgtcataccaatttcttgaccttgataaatgaatggcgtaccttgttgcaagaaataaacagctgcatgacttgttgctgattcataccaatacttgtcatcgtcaccccacgtcgatacacgtcgtggttggtcgtgattttcaataaacaacgcattccaacctttattttcaagttgtttttgccatctatttaatacagatttatacgaatttacatcaaagtgagaatcaccactattccacagtcccaaatgttcaaattggaatatcatattaaatttaccattttcttccccgacccagtcatcagcatcatcagggcttacaccattcgcttcaccaacagtcataatgtcatacttacttaatgagcgatctttcatctcttgtaaccaagtttgtatacctggctgattcatatctacatcaaatgctggggcatatgttttaccctcaggtacaggtaagtcacccgcttcaaacgtcttcttaatatgcgtaattgcatctactctaaatccatcaatgcctttatcaaaccaccagttcatcatttcaaatacagcatctctaacttccggattaccccaattcaaatcaggttgttttttactgaataaatggaaataatattgctcagtattagcatcatattcccatgtagatccattaaatatactttcccagttgttaggttcagagccatctggctttggatcttgccaaatgtaccaatcacgtttgggattgtctttactagatttggattctataaaccaaggatgttcatcagatgtatgatttacaactaaatctaaaataagcttcatgcctctatcatgaacaccttttaataaacgatcaaagtcttccatcgttccaaattcatccataatctcttggtagtcactaatatcataaccattgtcatcattaggtgatttaaacattggactgagccaaatgacatcgataccgaaatcttttaagtagtccaatttatcaatcattccaggtaaatccccaataccatcgtgattactatcattaaaacttcttggatatacttgatatgctactgcttctttccaccattgcttattcattttaaaactcctttgctatcgctgtgttgattttcttatttttaattctgtatctataatgacgagttcaataacatcctgtgctttgtttttcaatatatttaaaattgctgcaccagcctgttgacctaacattcgaggcttgatgtcaatacaggtttgtggtggtgacgcaatttcggttaaataagaatcattgaacgttgctgtcattacatctttcggaatttcaatattaagttcatataggacacttaaaatcgctaaatgtaacatagcatctaacgaaatgattgcctgtttaatatttgggtccttcaaacgcgtatgtagattttgcatgtaattaaaaataacttctctttcattactagtctcaataatttgataattaattttattttgagaagctatcgtttcaaatccttgaattctatcttttgaaacttcaaaatttcctttttctgtaataaatattaattcatctacaccttgttcaataacatgtcgtgtcaaattttcagaagctaatatattatcattatctatatgtgtaaattgatgatctatatccgatgtaggcttaccaatcacaataaatggcatgctttcatcaattaacatttgtttaatcggatcattttcttttgaatagagcagtataaacgcatcaaccattcgttgtttaatcattttataaacttcatccattaaatcattcatattatttgagactgtcgtttgtgtaccatagccatgctggttacacgtttcagaaattcctagcaatacattgatgtagaatggattcagtcgaataggctcctcagacccttttaacactaaaccaattttatatgtttggtttgtaattaaagttctagcagcggtattaggaaaataattcaattcttccataactttcttcacttttgaaattgtcgcttcgctaatacgttgatttccttttataactcttgaaactgtcgaaggagaaacaccggcttttagtgcaacatctttaatcgtaaccatttaatcacctcctgttaatttctgcatcggaaaacgcttccaaccactgtataataccagtttagtcacactttctaaaaaagtcaaaagatttgtgcaaacgattgcataaaacgataaaaataaaaccttcatactgaaattcaatccgaaaatcaatataaaggtttgtataaatattaaaatcgattgtttagtcactaactgcaaaatagttaccttggccatcttgaaaattaaatacacgttgaccattcatttctactatatcatgcccagttaaacctaaatcatttaattttgagtataatgcatcaaagtttttctctttaaacattaaagatggtgttcctaggttcacttccgggctatgcttttcaataaattcttttgccataatcgtcaatgacgtttcagcatctttggtaggtgatacttcaactgcaacatagtcctcagctaacggtgtttcacttacaacaacaaattctaaagtttctgtccaaaatgctttcgctttttcgacatcatcaacatataacataacttgatttaacttttccataaaatagtacctctatttctctatagtacatgctatcataacacagtaaatattttattacttcacaaaatgcttaaaaatatggcgggatgcttttaaggtcaaggataatacttgtgtaattttttataggttgtagctactctatcacactctcttttatatttatcaaaagatataaaaaaggatagtatctttcaactatcctttaatcaatattattcttcaatccattgtgtatggaatacgccttctttatcttttctttcgtacgtatgagcaccgaagtagtcacgttgtgcttgaattaagtttgcaggtaaatcagcagcacggtaactatcatagtaattaatacttgatgagaaaccaggtgttggtacaccattttgaacaccagttgcgacaacatcacgtaacgcatcttgatattcagtaacgatgtttttaaagtaaggatctagcaataagttttgtaatcctggattattatcgtaagcatctttgatcttttgtaagaattgtgcacggataatgcaaccttctctccaaatcatagctaaatcaccaagttttaaattccattcattatcttcacttgctttacgcatttgcgcgaaaccttgtgcataagaacaaattttactcatatataatgctttacgaattttttctaaaaagtctttcttgtcaccatcaaatgatgcttttggaccatttaattctttagaagcatttacgcgctcttctttgattgaagagataaaacgtgcaaatacagattcagtaatgattgttaatggaatacctaattctaatgcgttaattgaagtccattttcctgtacctttttgacctgcagtatcaagaattttttcaactaatgcttctttattttcatctaatttcatgaaaatatcaccagtgatttcaattaaataactttctaattcaccagcattccagtctttgaacgtttgagcaatgtcttcatgagacatgcctaataattctttcatcatagcataactttctgcaattaattgcatgtcagcatattcgataccattgtgtaccattttcacatagtgtccagcaccattaggtccaatataagtaacacatgaagcaccgtcttttgcctttgcagcaattgcatcaagaatatctgcaactttgttataagcttcttcttgtccacccggcattaatgacggaccagttaacgctccaatttcaccaccagaaacgcccataccaataaagttgattgcactttgtgywaatgctttattacgtctgatagtatcttgatagtttgtattaccaccatcaattaaaatatctccatcatctaataaaggtaacaaactatcaatcgttgcgtccgtagctttacctgcttgaaccattaataaaattttacgtggtttttctaaagaattaacaaattcttccaatgaatacgttggatgaatatttttcccttttgattcttcaaccattaaatcagttttttcacttgagcggttaaatacagatacactatatccgcgtgattcaatattccaagctaggtttttacccataacggctaaaccaataactccaatttgttgtgtcatattacttacctcacttgttgatttttcattagtattgtatcacaaaatagacatacactacactaaatcatttcgaatgtcgcgcaactattttgattatttctaacacttgacttgcaagcaagttcaatgatttaatcggcattctctcatttgttgtatggattttttcataacccactcctaaaatgactgaaggaataccaaatgtattaataatactgccgtctgaaccgccaccagaaataattgtatttgcagataatcctaaattacgagcactttcttgtgcaattttaacaaccgcttcattatcattaattttaaatcctggataactttgctccactgtaactactgctttcccacctaattctgatgcagtagtttcaaacacatcagtcatatgtttgacttgtgtttttattctttctggatcgtgagaacgtgcctctgcttctaaaatgacttcatctgcaacaatattcgtagctgaaccgccatgaaacttaccaatattggcagtagttatttcatcaacttgtcctaatttcattcgactaattgctttcgccgcaatattaatagcactaacaccctcttttggcgtacttgcatgagccgttttgccaaaaattttagctgaaattaacatttgcgtcggtgcacctacaaccgtagtaccgacatcagcacttgcatcaatagcataaccaaagtccgcgtccaacaactctgaatttaattctttagcaccaattaaacctgattcttctccaacagtaatcacaaattgaatttgtccatgtgggatttgttgttcctttatcacttgcaaaacttcaagcatcgctgataatcctgctttatcatctgcacctagaatagtcgtaccatcagagtatatgtagccgtcatcttttacaattggctttacattaattgcgggtacaacagtatccatatggctcgtcaaatataatttaggtacttcgccttcttcgatagtactattcattgtacacactagattattggcacctaatttaggatgtttagccgcttcatcttctttaacatctaaccctaatgctatgaatttttcttttaaaataggttggattgttgattcattccctgtctcagaatcgatttgtacaagttcaaaaaacgtattaagtaatctttgctcattaatcataatggaaccccttttatcaaaattttcatgtacgccaaacggtaaaaattgatgaaataaaatgttacagtaattgacgttacacagatttatcaggtttgtaaattgtgtcatattattttcaatttattatatataattattgtaactcaaactaagctttgtcaaaaatatattgattgatttttcaaagatatcgtataatgaggaaaatgacataagcaaacttactcatgttttttattatattcctttatgatgattgctagttatatcgtctcaagttaaaagttttatatcttatgtcgtaattattaatacaaaggttattcatttggaggcacacaaaatgcaaaataaagttttaagaattatcattatcgttatgcttgtatcagttgtattagcattgttattaacgagtatcattccaattttataaactatatctcaactacctatacaaaatcatacaattaaaaatccatccattataaacgcatgtattaataagttatcgtattgcaacgattactttcaaacatgggtcatacggatggattattttttaagctacttcactatgcattttcaatgaaccaaattgcgatttgatttgtaaatattcttctaattcatttaatatttgaataatacttgctctcgagttaagcgctttgtgtgttgttggcaatggcagttcatccaatttcaaacgcgtctcatacaaattgtgtaaacgcattgctgtatagtcattactattcacatttagaccaatttctttcagcagtgacgcaacatcatttaaaagcggatctttatgacagatactttcgatgagcggtttcattctcattaacaattccacttgctcttctcgcatatcaaaataatgatagtatgaattttcgtttctaacaaaatgatttttaacatctcggaacgcgatagacttcgcctttttaatatttaaaagtaacacttcaaattcaatcgcaatggtatcttcatatttttcacaaatataactatatttactaaaaatatcagcaatttgttgctcaattttacatttgtattcgtctagttgtttgtctaaacttggcatcattaaattcattgtaaatgcaatgcttagtccaattaacagtaataatgtttcattaacaattaaatgtgcatcaattgattttgcattaaaaacatgaagtaatataacgcaactcgtaatgacaccttcttgtacttttaatacgacagttaatggtataaataacaatacgataataccgagtacaattggactctgacctaataaactaaatattgctgaacctaaaaacaatactaaaaaacatgatactaatcttgaaataatcgcttgtagcgaatgtacttttgtatgtttaatacataatacgactaatatggcgcttgaagcataattatctaaacctaacagcttactaataattacacctaaagtcatacccactgctgtttttattgttctaaatccaatcttgtaaggatttaactttaacatgggttagcgcctcttatctttcttcacaatatttattgaataatgtttgtaattgattaattacgttcatcacatcatgaccttcgatttgatgtctttcaatcatttctgtaatctttccatcttttactaatgcaaatgacggacttgaaggcgcataaccttcgaagtattcacgcgctctttgtgtcgcttctttatcttgtccagcaaatactgtcactagacgatcaggtaatacgtcataatgtaaagcatgtgatgctgctggtcttgcgataccacctgcacaaccacatacagaattgatcataactagtgttgtaccatcttgtttaagaactttgtcaacatcttctgcagtagttaattgctcatatcccgcagattcaatttcattccttgcttgttctacaacaccgttcatgtataaatcgaaattcatgnccataagttcaatcacctatccctttatatttaaactatcctcattctactaattaataacatattgttcaataaactaatctgaatcacacctatatttagacacaattttaacaatataccaaacattattgtgcttaaaatcatggtaactaatttgttcacatgttttcattaatatgtttcaagtatgatgtcttattttgactttactgcaaaaatgcattcaaccatgttgattattgttctttatcttttttgaatatattgcacatattttagtgccaaaaaataatacatccatcgacaagaacaagataaaacaagttgtcgatagatgcatctatgttatcactaatatatatttgtattttctaaagtatactgttcgatacgctgtttaatatgattcataratttacctgtttgtaaaccatctaaaatacgatgatcaattgaaatacataaattaaccatgttacgaattgcaatcatatcattaattactactggctttttaacgattgattctacttgtaaaatcgctgcttgtggatgatttataatacccattgatgatactgaaccaaatgtaccagtattatttaccgtaaatgtaccgccctgcatatcttcagctgtcaattgcttattacgcgctttcgttgctaaagtattaatttctctagctatacctttgattgacttttcgtctgcatgcttaatcacaggtacgtataatttattttcatcagcaacagcaattgaaatattaatgtctttatgtaagacaatttcatttccttgccagctactatttaataaaggatatgcttttaaagcatctgctacagcttttacaaagaaagcaaagaacgttagattatatccttctttatttttaaagctgtttttataatgatttctcgtattcacaagatttgtagcatctacttcaatcatcatccatgcatgtggaatctctgttacactattaaccatattttgcgcaattgctttacgcacaccatttactggtattgtgctgttttcactattgtcttcagatgattggttacttgatgtatctactgatgttgattttgtttgaacttgtttgtcagattgagctgtggtaccaccattttcaataactgacattatatccttcttagttacacgaccttcaaatccactacctacaacttgtgataaatcaatgtcatgctctgaagcgagtttaaatacaacaggtgaaaagcgaccattattacgtggttgattttgtttagcagtagatgtctgttccactgttgcactagcttttttagtagatttctgagtatgctcatccacttttgcttgtatctcttcagttgtttcatttgtcttttcatcagcagtttcaattttacagataattgtatcaatagctactgtctgccccgcttcaactaaaatttctgtaattgttcctgatatcgtggaagggacttcagctgtcactttatctgtaataacttcacataatggttcatattcatcaatatgatcaccaacagaaactaaccattgttcaatggtgccttcatgaacactctcacctaacttaggcattgttatttccatgactttccctccctagaattctgctaattcacgcattttatttaagattttttctggattcatcataatttcattttctaatacaggagaaaatggcatagatggtacatctggagcagctaaacgcatgattggtgcatctaaatcgaacaagcaatgctctgcaataatcgctgacacttctgacataatactaccttctaaattatcttcagttacaagtaaaactttacctgtatgtttagcacgatcaataattgtttctttatctaatggataaacagttcgtaaatcaacgacttcaacattgataccgtctgcagctaaaatatccgctgcttgtaaacaataattgaccattaatccataacaaaatactgttaaatcttcaccttcacgtttcacatctgcttttcctaaaggtacagtgtaatattcttctggcacttcttcctttaagaaacgataagcttttttatgctcaaagtacaatactggatcatttgattcgatagatgataataaaagccctttagcatcatacggtgtggaaggaataacaattgttaaacctggcgatgaagcaaatatactttcaatactttgtgaatgatatagtcctccgtgaacaccgccaccaaatggtgcacgaatcgttaatgggcattgccaatcattatttgaacgataacgcattttcgcagcttcactaataatttgatttgtcgcaggtaaaataaaatctgcaaattgaatttctgcaattggtcttttacctaccatagctgcaccaatggcagttccaacaatatttgactcagctaatggcgtatcgataactctgtcttcaccatatttttgttgcagtccttgagtagtaccaaatacgccaccttttctaccaacatcttcaccaagaataaacacatctttattttgttgtaatgctaagtcttgtgcctgcgtatcgcctctaaataagataatttagccattagttaagactcccttcttcgtacacaaatgcataggcttcttcgacacttggatatggcgcgtcttcagcagcctttgtcgctttattgatgatgtctttnatgtccgcttctatttctgccaaccaagcatcatcgataatgccagctgaaagcaactcttttttgaacttttcattgcagtctgcttttttaagcgtttcacgctcttctttcgtacgatattggtcgtcatcatctgatgaatgagctgtcatacgacttgttactgcttcaatcaaagttgaaccttgaccagaaatagctcgatctcttgcttctttcatcgctttatacattgctaatggatcattaccatctacttgttcaccatgtataccgtaaccaagtgctctatccgataatttttcagctgcgtattgtaatgaatcaggtactgaaattgcatatttattatttataatgacacatacaaaaggaagtttgtgtacacccgcgaagtttaaaccttcatggaagtcaccttggtttgagctaccttcaccaacagttgctgttgcaattttcttcttaccatccatttttaaagctaaagcagcaccaacagcatggggtatttgagttgctaccggtgaactttgagacaaaatattcttagctctactactaaagtgtgatggcatttgttttccaccagagttaacatcgtctttctttccaaacgctgataaaaacgtatcatacgctgagatacccatataagtaacgaaagctagatctctataataaggcgctgtaatatcaccttcttctaatgcgtatgccatcccaatctgagttgcttcttgtccttgaccacttacaacaaatggaattttacctgcacggttcaataaccacagtctttcatctatttttctacctaaatccatccatttatatattacttttaggtcttcttcgctaaggcctaatgatttataatcaatcatgttaaatcctcctatttatacgtgaatagctctactttctgctttcaatcctaattccatcaacacttcagagatggaaggatgtgcgtgtgttgttagtcctaattctaatgccgagccattcatgaactgtaacagtgatgcctcattaatcaattctgttacatgtggaccaatcatattaatacccacaatttcttcagttgattgatcaatcaccatttcgctatacccttcgtttgtgtcatggctatcaatcactgctttaccaattgctttaaatggtactttaaaacttttaactttcattccctctgcctttgcttgttcaatgtttaaaccgatagaagcaatttcaggttgtgaataaatacacttaggcatcatgttatagtttactgggattgggttcccctcaaacatatgatcaacagccacaacaccttcttttgatccaacatgtgccaattgtaattttcctatacaatcaccagctgcataaatatgtttatcttcagtttgttgaaattcgttcgttaaaatatgtcctgatgttgaaagttttattttagtgttgtttaaaccaatatctgatgtgttaggttttctaccaatcgatagcaacactttatctactttaattatgtctgaggaaatttcaaacgtaacaccatcttcgttaacatttatatcattttcagaaagttttattccctcatagaatttaacaccacgtgctgacaatgatttttttaatagttgtgaagcttgtttactttcagttggtaaaattctttcacctgcttctataactgttacgtcaacacctaaatctatcatcaatgatgcaaattccattccgataacaccaccaccaataataccaatacttgatggtaacgtctttaatgataatatatcatcgctagataaaattttatcatgatcaaatgataagaatggcaactctgcaggcgaagaaccagttgcaattaatacaaattggttgggtaataagtctgattcaccatcttcatattcgacagaaattgtgccactttgaggtgaaaatatagatgtacctagaatacgtcccgtgccattataaatgtcaatgtgattgtgttgcattaaatgctttacaccttgatacatttgattaataatgtcttcttttcgtgccaacatattttcaaaattaacattagcatctttgacatcaacgccaaacattgctgcctgttttactgtttgaaatacttcagcagatttaagcagcgatttagtaggaatacaacctttatggagacaagtacctcctaatagttgtcgttctactattgccacttttttacctaattgagacgcacgtatcgcagcaacatatcctgcagtacctccaccgagaacgactaaatcatattgtttctctgacatgttcttactcctaactaatgatatatatccattgaaaatttattaatacatagttttcatgtccattaattacctattttacatgattgtctatttagtttgaatgcacataaataaatccataaatgagtattcaacacactttggaaattatctacgtctttgattgtgttgtatcatttctcttgcattttctcgagttaaatcagtaacacttgcacctgaaatcattcgtgcaatttcatctactttatcatcgctaattaactcttgaacttgtgttgttgtacgatcatcttttgatgatttcgaaattaataaatgatggtcgctcatcgatgcaacttgtggtaagtgagagatacaaataacttgtatatattctgctatatctcgcattttctctgccattt

SEQ ID NO: 54 - DNA, 13794 bp; double-stranded, linear
ccaatacaacgtaaaaagattgcttgtgttattaatgagttagataaaataattaaaggatttaataaggaaagagactacataaaatatcaatgggctccaaaatatagcaaaganttttttatactttttatgaacattatgtactcaaaagattttttaaaatatcgatttaatttaacatttcttgatttatctatcttatatgtaatatcatctcgaaaaaatgagatactaaatttaaaagatttgtttgaaagtattagatttatgtatcctcaaattgttaggtcagttaatagattaaataataaaggtatgctaatcaaagaacgatcccttgcagatgaaaggattgtgttaatcaaaataaataaaatacaatataacactattaaaagcatattcacagatacttccaagattctcaaaccaagaaaatttttcttttaaatttaaacagatttacctcttgataaaataaataagcaatcatactacttctcaatttagtataaataaaaatacataattaactttcttttgtttttatattatttcaataccctactatatatcacaacacataaattaagcatgacactcattcaatttagttcaccatttcgtgttccaattttactgagtatcatgcttttaatgttataaacctaatgctttaataaatcgtgttaattcttctcgcatactgtcatctttcaatgcatattctatggtagttttaacgaagcctaatttttctccaacgtcataacgttcgccttcgaagtcatatgcatacacttggttatcattattcatacgttcaatcgcatctgttaactgaatttcgttacctgcgccttctttttgcgtttttaaataatcgaaaatttcaggcgttaatacataacgtcccataatagctaggtttgatggtgccgtaccttgtgctggcttttcaacaaactttttcacttcatactgacgtccgtttttagttaatgggtcaataattccataacgatgagtatctgcttccggaacttcttggacacctataactgagtgccctgtttcttcataaacgtcaatcaactgtttcactgctggcacttcagattcaacaatatcgtcacctaataataccgcaaatggttcattgccgataaattgacgcgcagaactaatcgcatgccctaaacctttttgttctttctgccttacataaaaaatattcgcaagttccgttgaatactgaactttctctagtaattcagatttacctttttcttttaacaccatttctaattctttttgactatcaaaatgatcttcaatcgcgcgtttgtggcgacctgtcactataataatatcttcaattccagctcttgcagcttcttcaacgatatattgtattgtgggtttatctaagataggaagcatttcctttggcatcgctttagttgctggtaaaaatctagtccctaaaccagcagcgggaatgattgccttttttatttttttcaaagttaatgtgctccttttcctaagtattaaatctatgtatcaacgtcattttaacactaattagaacgccttcatagtgtcattgagtatgtaattatttcttgggaaatttgttttaattttaaaaaacaggcttacttcatataatttatgaaataaacctgtcaattttggattgattatgctttgtgattctttttatttctgcgtaataacgctaaacctaaaatgctaaataatccgccgaacaacatgccgttgtttgttgattcttctccacctgtttcaggtagttcagatttcttagattgtgcttttttagttggtaccactgctttaaccttttcattgatttcaataacaggtgttactactttaccttgttccactggtttagaaggttttttaggttcttctttagcaggtggtattggtttaccaggttcagttggtacctctggcgttggcggtgttggtgtttccggctcgcttggtacttctggtgtcggtggtgttggtgtttccggctcgcttggtacttctggtgtcggtggcgttggtggcacgattggaggtgttgtatcttcttcaatcgtttgttgaccttcattatgaccacttacttgtggaagtgtatcttcttcaaagtcaacactattgtgtccaccgaattgataatttggtttatctttatttgtatcttcttcaataatttcagtgtgcttattgaatccgtgaatatgtggcacactgtcgaagtcgatatcaatgatattaccaccttgttcatacttaggtttgtctttctctgtatcttcttcgaatgattggttaccattattttgaccatgaatttgaggtacactatcgaaatcgatatctacgatattgccaccttgttcatatttcggtttatcttcttctgtgtcttcctcaaatgactgattaccgctattttggccaccttcgtaacctaattcactcttaatatccacgtggctattttcttcgatttcttcaatcacgccataattaccgtgaccattttcagttcctaaaccagaatgagaaatatgatgattgttttcagtaatttcctcgattggtccttgcgcttgaccatgttcttcaggtagttcatctactagttcaatcagattactttcagtcgtatattctttcgtatcttcaattgttgtatgatcgctaacagcaccagttacaataccttttgtagaatcttcgtcaaattcaactaggttagactcagtagtaacctgaccaccacctgggtttgtatcttcttcatattcaacaacatcagcatgatgttttgaattttcatgtgtcgattcttcaaagtctacatgaatagaatcttcttcagtttcaatggtaccttctgcatgaccttctgcaccttcaacagctgtatgatattcaaaatcaattggcttagaatcattactttcttcgattgtaccagtcaattcatgcttctccactggcggctctgatttaaattcaagttcgataggagtactatgttctataataggttcctttagtttatctttgccgtcgccttgagcgttattagagtaaaatgcaacgccatttttccaagttaaattacttgtataataatagttataatatccaaaaaggtgtgtttgaaattctaagttgctagcatttgaatcataatacccttcatattttattacataatttttactttggtctaaattattaaagtttaaagaataaccaccattagtatcaaaatctaaactcatattatcagtcacatcttcaaatttgctgacatcatcaagctttgcatantnagctttcagctaaatcgtctgaaccaatgtgtttatataccttaactgttggattattaacccctggtttatttcctttagttacttgaccagttactgtcacagagcttaacgactggttgttaggtttcatgtacgcaaaatgactaaatttcccatctactttatttaaagtatcaattcgaccattagctgttactccccaattatctctaactccacctaaatattgaatattaaatattttgctaaccgtagtctcacccaatttaacttcaacattttggttacctttttgcgtcactgttgtaggatcaataaatagatttaaagataattcagcagttaaatctttcttttcttgtacatattctttaaacgtatatctaacttttctttctccaattatttctcctgtcgccataacttgaccatctgtactttttatctccggaactttacgcagtgttgagataccatgagtttcaacattatcgcttaatgtgaaatcaaaataatctcccgccttaattccttctccaaatttccatttatatttcaaggttactctttctgcgttatgaggatttacaacattcgtatcttgtttatgtcctacaatttcactaccttcttctacttccactttatttgttacatctgtacctgtcgctttagtttcttccactacttctttctctgcaactgctgtaacgtcattgatcttttcattcttggtttaatttctgagacgttacttggttgagctatgtcaacttgagttcctgtagtttccttatcagcaactttttccgatggcaaatcaactcgcgaagtttctacttttggtgcttgcacagttttcggtgcttcttctgttgttacttgtgttgattgtgatggttgctcagttgatgtcgcgctgtatgattgtgtttcatctattgtattaacgttatttgtagttgtttgtgtttcgcttgctttactttcagtagctgaactcccactttcctctactgtagtattgttttgttccgatgctgcagcttctttttcttgtcccattccaacaacgatcattgttcctaagaatactgaggccgctcccaatttgtgttttcttatgccgtatctaagattgcttttcactataatattctcccttaaatgcaaaattcatttatttttaaaactcaataaatgcaattctatattgttcggtttttaaaagcaatgaaaaaaagcgagttaataaaaagttaagattgttgttaactttatgtataatgagttttttattatttgaaactcacatatatattgcatacaaagctcttgaacaccttgatataacaggcttgtattttttatacttactttttaaattaaattcaaattcatctaatttaaaacaatatactaaaccatacataataatcgcctgtacaatgcatcattaacaagtcactgaaacgcctttcattgtattaataacgtcactataatttttatatcgttcggtttttgtttgattttaatgattatttatacaaaaacagccgtatttcaagccgacattttaaatttaactaaatttgcatctagttaataattgcatttatcaaatttgtcttattgatccaatctaatttgtactcacaaactagtttaaaattctaactttatctctcagttcgttatcaatcatcagacataaaccaatgaagcaatcagaaaacactctaattttctattagaaatttgatttaatataaaaaaacaggcttacttcatataatttatgaaataaacccgtcaatttttgtttaattatgctttgtgattctttttatttctgcgtaataatgctaaacctagaatgctgaataatccgccgaacaacatacctttgtttgttgattcttctccacctgtttcaggtagttcagatttcttagattgtggttttttagttggtgccactgctttaaccttttcattgatttcaataacaggtgttactactttaccttgttccactggtttagaaggctttttaggttcttctttggcaggtggtactggtttaccaggttcagctggtacctctggtgttggcggtgttggagtttctggctcactcggcacttctggtgtcggtggtgttggtgtttccggctcacttggtacttctggtgttggtggcgttggtgtttccggctcacttggtacttctggtgtcggtggcgttggtggcacgattggaggtgttgtatcttcttcaatcgtttgttgaccttcattttggccgcttacttttggaagtgtatcttcttcaaagtcaacactattgtgtccaccgaattgataacttggtttatctttatttgtatcttcttcaataatttcagtgtgcttattgaatccgtgaatatgtggcacactgtcgaagtcgatatcaatgatgttaccgccatgttcatacttaggtttgtctttttctgtatcttcctcgaatgactgattacctttattttgaccatgaatttgaggtacactatcaaaatcgatatctacgatattgccaccttgttcatatttaggtttgtcttcttctgtgtcttcctcgaatgactggttaccgctattttggccaccttcataacctaattcactcttaatatcaacgtggctattttcttcgatttcttcaatcacgtcataattcccgtgaccattttcagttcctaaaccagaatgagaaatatgatgattgtttttagtaatttcctcgactggtccttgtgcttgaccatgctcttcaggtaattcatccactaattcaatcagattactttcagttgtatattctttcgtatcttcaactgttgtatgatcgctcactgcgccagttacaataccttttgtagactcttcgtcaaattcaactaagttagactcagtagtaacctgaccaccacctgggtttgtatcttcttcatattcaacaacatcagcgtgatgttttgaattttcatgtgtagattcttcaaagtcaattggatttgattcctcagaggactcagtgtatcctccaacgtgacctgcttcgctatccacagcagtatggtaatcgatatcaatagctgatgaatccgtttcttctattgtttcaatgtatccatcaacatatccacctccaccatctatagctgtgtggtaatcaatgtcaagagttgatgaatcatattcctcttcaacagtagttactaaattcttatcatattgacctgtaagagtttctttaattgtatcttctttatattcaaatttattattttgaataatcggaccatttttctcatttccgttcgctttattactgtataaaactaaaccattatcccaagttaaggtatatcctctatcataataatacttataaagttgctctggatgtcctaccatttgtgttctaaaatcaacttcatcagtaccatttaaatactctccatcatagtgaacaacataagttttatctagattttctatattcaatgaatagcttccattattttgtaaattcaaattcccactcatattacttgtgacttctttaaatttagaagtatctgtcgtatttgcatatacactcttcgctatgtcttcattattacccaagtattcaaatatcctaacttttggttgatttccattctgattactacctttcattaaagttccagtaacagtcacacttgtcgttttaccattattaggtttaataaatgcaacatgcgaaaatctattattcgctttattaaatgtctcaatcgatccatttaaattggcataataattcccaataccatctttatatttaacatctaattcctttgaagtttgttcttcatttagtgttgaagttatagtttgatttccattagtttgtacagttttaggatcaataaataaattaatttctagttcagccgttacatcaaccttatcttcaatatcatttgtaaatgtatatctaatctttccaccttctaaaacttcacctgtcgccattacgactgaaccatttttaatttctggtacttttctagcagttgatacgccatgcgtatttacattatttgataaagtaaagtcaaagtagtcaccttgatgtaaaccattctcaaatttcaacttatattttagtaccgctcgttgtcctgcatgaggttctactttatttgtattgttatgcccctcaatagaaccaatttctactgtaactttacttgttacatctgtacccgtttccactttcgcgttactagcttccttagcttccgctacatctgctgatcttgtcacacgtggcttactttctgatgccgttcttggctgtgccacttcaacttgtgtttctgcgacttgattttgtgtagcctttttaggtgttaaatctacttgtctttgatctccgctattgtcttgagattgtgttgtttccttaacttgaggtttcgcttcttccttaactacctcttctttaactgtttctatatttgctggttgtgcagtttgtggtgcttgtactgcttttggtgcttcttcagttgttacttgtgttgcgtttgacggttgttctgttactgttgcgttatatgattgagtttcttctatatgattaacgttagttgcagttgtttgtgtttcacttgttttattatcagtagctgaattcccattttcttctactgtagttgtcttttgttctgatgctgcagcttctttgtcttgtcccatcccaacaacgatcattgttcctaagaatactgatgctgctcccaatttatgttttctaatgccgtacctaagattgtttttcactataatatctccctttaaatgcaaaattcattaattttttaaacttaataaatgcaagtctatattgttcggtttttaaaagcaatacaaaaaagcgagttaatgaaaagttaagattgtcattaattttatgttaattgataattttattatttgaaatatacctataaattgtattcaagtcatcagaaacccttgtcacacaaggcttgtattttttatacttattttttaaattaaattcatcattatctaatttaaaacaatatactaaacgtttcataattatcgcctgtacaatacgcacaaaaacatgtcttgaaacgcctttcattactctaaaatacccaatatactttttatatcgttcggattctgagtatttcagacgattttctgcataaaaataaacgtgtttcaaggcaatatattgcaattacctaaaaacacgtttacttaatatttagttaaacaaataagctaatgaataaaatgaagatgatacctgaaacggaaataatcgtttctaataatgaccatgttaagaatgtttcttttacagttaaaccaaaatattctttaaacatccaaaatcctgcgtcatttacatgagacaaaatcacactacctgcacctatcgcaagtacaactaatgcaacatttacatctgatgattgtaataatggtaagacaatacctgtagttgaaatcgcagctactgtagccgaacctaatgcgatacgtagcacagctgcaacaatccatgctagtaaaatcggagacatctctgtaccttcaaacattttagcaattgtatttccgacaccgccgtcaattaatacttgtttaaatgtaccgccaccgccaataatcaataacatcattccgattggataaatcgcattcgtcactgattccataatatgattcatcttacgctttctcattaatcccatcgtaacgattgcaaataatactgctattagcatggctgtccctgctgttcctatcatataaatgatagattcaaatagatttgtaggtttgtcatgcccagttacaagttgcgttatcgtagacactaacattaatatgactggtaatgttgctgttaataaactcataccaaatcctggcatctcttgatccgtaaattctttttgtgcacctaacgctgaaatatcgccttctcgtgtatacgcagacggaatcattttttgtgcactttgttaaatataggccctgcaatgagtgtaactggaatggcaataatcataccatacagtaatacatctccaacatttgcctttaattcttttgcgatgactaccggtcctggatgtggtggtaaaaagccatgtgtcactgataaagctgttaccataggtagtcctagttttaacactgaaacatttgcgcgttttgctactgtaaatactaatggaatcagtaagactaaacctacttcaaagaacaatgcaataccgacgataaatgctgcaacaagcattgcccattgtacatgtttttgaccaaatttttgaatcaacgtgtctgcgattcgagttgcaccaccaccatcagcaagcaatttcccaagtatggcacctaaaccgaatatcagtgcaatgtggccgagcgtactgcccattcctttctcaatcgtctccataattttagtcaatggtatacctagcattaacgctgtaatcatcgatgtgataattaatgaaataaatgtatttaatttaaacccaataattaatactaataaaataacgatacctaaaacaacactgattaacggccatatttcgttaaacatgacattcccctctttctcttttcaatagaatgtaacaccgtcgtcgcgcacgtattccacataatatatagtagtcatggcacaacaactttatctaagatgcttgagtgacgtatttattgtgttttattttcagcgatatgttggcgttgaaaatctgcaatttgttcataattctctgttaaagaacgacttaaattgataaaaatggatacgatctcttggtaaacagtgacattttcttcaatcggcgtatgattgtttgtggcaccgaccatcgatgaaacgattgaaaaatcttcaatgtcacctacagctttaagtccgagcacgcaggcacctaagcatgaactttcataactttcaggaaccactaactctgtgtcaaatatatctgacatcatttgacgccatacttcacttttcgcaaaaccacctgttgcttttatcatcttaggtgtttcattcattacttcaataagcgcaagatagacggtatacaaattgtaaagaacaccttctaatgcagcgcgaatcatatgttcttttttatgagataaagttaaaccgaagaatgaacctcttgcatttgcgttccaaagcggcgcacgttctcctgctaaatagggatggaatattaaaccatctgcacctggtttaacacgctttgcaatttgagttaagacatcataaggatcaacaccgagacgtttcgcagtttcgacttcactcgctagcaactcgtcgcgcaaccatctcaatacgacaccaccattatttacaggacctccgatgacgtagtggtcctctgttaagacataacaaaatattctacctttgtaatcagtacgcggtttatctatcacagtacgaatcgccccagatgtaccgattgtgacagcaacttctcctttaccaacactattgacacctaaattagaaaggaccccatcactcgcaccaataacaaacggtgtatctttattaagccccattaatgttgcataacgttctttcatacctttcatcacatacgttgttggaactaattccggcaacatttccttggaaatacccagcagttctaatgcctcaacatcccaatctaatgtttctaaattaaacatccctgttgcggaagccattgaataatcaatgatatatgtatcaaataaatgatagaaaatgtatgttttaatatctgcaaacttagcagtacgttgaaatacatcttgccattcatgtttcatccaaaaaatcttcgctaatggcgacataggatgaatcggtgtgcctgttcgctggtaaatcgcattgccatcatgcacttcatttattactgttgcatattttgcagcgcggttatctgcccaagtaatattatttgttaatctttgatgttgctgatccatcgcaatcaagctatgcatttgcgcactaaatgacacaaacttaatgtcgtctttattaactttggattctctcataacatatttaatagtcattagtactgcatcaaataattcatctgggttttcttctgagacatcaacgtttggtgtgtgtaaatcatagcctatttgatgtttcatgataaaagttccattttcatcatataagactgacttggtactcgtcgttccaatgtcgacaccaatcatatatttcatgataaatccttctttctttcattttaattcaaccaaaatccttcaatatctttaccaacatcgtcgaaatttaaatgaaacgcttctttcaaaatttgactgtcgtattgttccactgcatcaataaacacttgatgattatgatgtatgcgttcaaaatcttgcgggttctgttgcatacgttgtcgcatggatgttaaaacgagtgccatcattactggttttaaatgactccaaaatgagtttaaatattgatgattagatgctttgattaatgtttcatgaaattcaaagtcatgcttcgtaaatgattctgcatcctcaaattttactgccactttcatcatttcaagttgtttcttcatttcttttacgataggtagtcgctcttgatttttaactcttgaaaatgcaaatgactctaacatcagtcgcaaatcatacatttctttcttttcttgttccccaaacggcaacacatgtgcacccattctttctaattggatgagttgattttgttgcaataatttaaatgcatctcgaattggcgaacgactcacattaaattgctttgccatttgattttcagtgagtaacgtaccttcagctatgtgaccattcacaatgcctaagcgtaattctgccgcgataccttctccagttgtcataccttccaaccatttctctggatatccatacatcatcaaagtcactccttcattacacgacatacttgtatacaagtatgttaatatagttattatgagtttgcaagcgctttctttacgagcactaaaatagtgaccaccccttttcgatttaaatttaaaggaaatggtcactatcacacgaatgatttaattgttatgttgtatgtgggatatttctaattgttctgtactcatatgcgctttaggtacttcaatgcaataatgcgtttcatgacagtttggacattcgaatcgacgtgttgtcgctgtatgtttcgctttgataactgcccacaaagatggtgagaatatatgctggcagttaggacataaataggcaaccttttgttggtaataaaaagtaacaccaatgccataaccaatcataaatggtaaagcaattaaaaacggccatttatttttcatcaaaattgcacttataatgctagaatattgaattattcctataataccagcactaatccaaatgttacgacgaatacttttcatttcagctgatttactcatgacatgctctatgtcttttaagtgtgtgattggagacgtcgacgcttcatttacgtaatattgaacatttttaattttgtttaataccgcttgttgctgtttaacttgttggttaatttcttgttgtttcatagttagtaaagtattgagcgtcttcaaagtaccttcaccttttagcaacatatctatatcgcttaacgcacaacctaaatctttaagcaataagattaactctaatgtttgtcgctgttgttctgtatacacacgacgctttccttctgtaaatccttgtggtttcaaaatacctttgcgatcataatattgaatcgttcgtgttgtcacattgcataattttgcgagttctccagtcgaatagttagacatagattccacctcctataattaccatagttgatgacccgacgtcacgagcaagtacaatttccacattttaaagaaatttattatactaggcgtcttatttttatgatttcgtaccatgttgatttacaaactcactcaaactaagtaacacacctactaaacatctactctgttatttcagaatgaatttgttgtaatttatcttcaacttcagtaatctctgtcgcacattctttcagtaaatctcgatacttttccgtctctgcattgtttttataacgtattttatgttctaaacttgcccacatatccatacctatcgttctaatttgaatttcaacaggcaatacctcaacgcgttctgctaaaaagactggaatagatacaacgatatgtaaactgcggta

SEQ ID NO: 55 - DNA, 1059 bp; double-stranded, linear
ggataagttcaggtaaattcatttctttttcaattttgattttcattgtttccgcccttttaaaataaagttagttgcttctgttcctcatattccaaatcactttgctttatatatgtttcaagctcttccgctgtatcaaatgtctttttcacaccttgccaacctggcacgatatgaccgtgaaagtaataagtgccatttactacatggatatgtgccactcgttcgttatcctgatacagatatctcttagatccaaagaattgatttaggtattctttacgcgcgctatctgtcatggtcatcactccttttaacaattaggcagaccaaacgacatgcattcgtcgtatagctcttcattacttatgcttgccttatagttttcaatcacattgctaacttctttatgactcattgctttaacttgttcgtctgtatatttttcgcagtcttctaattccagttgctcctgtaatgacatcacatattcaacttgtctttgggttgccatcgttaaccctcccacaagtcaaaagctctttggacgtaaaacttcgcctttgctaaatcctcatgaccattctttaacggtgctctagacatgtatttgattgcattacctattgcgaatgctagttgaggtggatactgtgccgtaacctgttcgataaaatctataatttcaatgtcgccgtatgtgtagtgcgctggttgcttaacattgtcttgcgcttcgttcatatctacttttctgttactgattacgctcattatgcttcactccatttcttgaacatttggttataagtgacatcgaaccagtacggatcacgtgaatgtttttgtggcgttccatcataaagccatggtcttaatcttctctttctttcctgttcatattccgctctcacatttcgttggtatcggttcaaaatcgctttttttctgattttttctctccctttttcttcatctttnatttgactctncatatattcaacttcttctgtagatnttgagtcctttcttccacacaataattcancgccgcgc

SEQ ID NO: 56 - DNA, 30246 bp; double-stranded, linear
gaagtaaaagaagaattaaatttaacattaacaatggatgaaattgaatatgtcgggacaattgtaggtcctgcatatccacaacaggatatgttaactgagttaaatggatttcgcgcattaaccaaaatcgattgggaaaacgtaactatcaataatgaaattacggatatacgctggattgataaagataatgatgcgttgattgcgcctgctgtcaaagtttggattgaaacttatggtggtaaacatgacaaataatgacaccatcatgttacgacattatgtcccacaagattattcgatgttagaagcttttcaattaagtgaaagtgatttgaagtttgttaaaacgccagaggaaaatattacagctgcaatgtctgataatgaaaggtatcccatcgttgtaatggatggcaggcaatgtgtggccttttttacattacatcgtggaaaaggggtcgcaccatttagcgataaccaagatgcagtatttttcaggtcatttagtgttgatcaacgttatcgtaatagaggaataggtaaagtggtaatggaaaaattggcgtcatttatcacttcaacatttcaggatattaatgagattgtgttaacggttaatactgacaatccacatgccatggcactttatcgccaacaaggatatcaatatatgggagatagtatgttcgtcggaagacctgttcatattatggcgttaactataaaataaattaaatttaaaagcatctttactcatcgtcgaccacaacaattaatgatgaataaaggtgctttttgttatagatcatcggacaatttactatagtaaaaagcgacctagtgaacaattgacatatatccacaggtcgcttaacttaagttatattgctagttgcgattaattgatagactcatcatttttgcgctgtcgagatggtctttttattaaaaatgccgtaatccaagccgtaatcggaatactgattgcaacggcaataccgcctaaaataatagaaataaattcttgggcaaatattttcgagtttataatatgaccaaatgaatatttaagtttgaaaaaccaaataaataaagcaagttggccaccaaaaaaggcaaggtaaatcgtgttcgcagatgtcgctaaaatttctctaccaacacgcatgccagattggaataattcgtattgcgtaacgttggattcacttgatgcaattcataaatgggtgaactaatggtaattgttaaatctatcacagctgcaataacagcaagaataatagtgaacaccataaattgaaccatatcaatgccaatattcattgaatacacatatgtttcatcttgttgttcggttgaaaagccttgtagatgaccgaagtagaccgataaataaatgagtgtaatcaacaatattgttgtaacgatagtgctggataaatgcagcttgtgttttaacattgtaactattgagtacgaataaattacaagcgccaataataatgcagaaaaagaatgtgacgacataaatcggtacgccaaaaataatcaatacaatactaataattaaaatagcgaaatttaaaaatagggttaaataagagatgaatccctttttacctccgaaaattatcatcagaaagaggagcaataacgccaatataaatacagcattcattgtttcgccctccttaatgtttcaaatatttccataaacaatattgtgataggaattgtaagtacgatacctataccacctgttagtgcgcgcgcaatttctaacgaccaattcatcgaaatagtataagtcactgtattggcattttttaaaaagattaaaaacataggtagtgcaccggataaatatgagaataataagatgttagtcattgttcccataatatcttggccgatgtttcgcccagcaagcgcccatctcctcattgaaatgtgtggcgtacgctgtaaaatttcatgcataccactagcaattgtaattgcaacatccataatagcgccaagtgaacctattaacactgaggctaggaagatatctttcggtggtaatgataaaaagttcatcgtttcatatttaatgcctttaccatctgtcatatatatgattaattctgttaaacctatactcaaaaaagttccgataattgtactggctatggtaatgagtgtacgcatatgccagcctgtaacgagcaataaagtgagtattgttgaacagatcatggcaatggtcatgagtaagaataaattaatattgctatgttgaatatgaatgtaaattgcgattaatatggcaatagaattcaagattaacgataaaatcgattgcagtccgactttgcgaccaaccaataatacagttaataagaacaaaccagtgatgataaccgttaaggtatcacgcttcttttctataatataagcatcactcggcttgttagaaatatgtaataatactttttcgtgtgtgcgaaatgcctcagaatctgcttgcgatttgacgtactgatgattaatcgtcgtcgtttctccagcaaattgaccatttaatattttgacttttaattgatttttatatttaatatcacgattattttgtgcatcttttgtaggtgtcgaagaaacatgtttgacatctataatttgaccaattggtttgttgtaaaagttctcattattgaatgtaaataaaatagcaccaatgaatgcgatgcagaacaaacctaaaattatattaaatggctttgtaaataaatttctatatttcaaaaacaaaaccccaattctatgaatgaattaatatggtgattatacgcccttaattttttattttcaaagatattactgctaagtgtaaaacgaaaatcatcattgatagcatcgaattacttaatggaatgtagacgttttagtcattaattgctgaataagtgttaataatatgccaatatcactctttgtataaggctcctttgtaatagcacatatcgttctttttaattcagtatgatctaattttatatctatccatgatttagattctggtaaatgtatattttgtgatgaaatgatgtaaccttctttttgacgaaggagatactgcgcaagtggttggctactgattgtgtatacatctgatttagtaatcttgcgcaattgtttttttacagtttcggcaaatggtgccaagcaataaatatgactatgctcaaactgaattaatggtgggtgtgtcgccatcgtaattggatcgtctgaaggcgcatataaatgatagtgctcttcgaataaaggtagcatatgtaattgtttgtgtttacgtatttctggtgtaagttccgtgaaaccaatgtctatattcccatttaatacgctatttataattgtgtcatgttctaataagctcggtatgacatgtgtatcattttgtaaatgaaacgtttggataagtggtagtaacatgtgggatacgtcactctcatcatagccaatgtagatacttttatttttagttaatccatggctttgaaattgttcaatcgtgctatctaaatgttcaataatacgcagagcttcattaaataataatttcccttcagatgtgagcgtaatattgcgtccttgctttttaaataaagacacattaagttcttgttctaataatgtaatttgacggcttatcgctgattgagcaatgtttagttcaagtgctgtttcggagatatgttctcttttagcgacctcgataaaatatcttaattgtttaatttccatagcgatataggcacctccaaaaatgagtgttttgtaactattatagcaatattattgataaatgttctattttttagatgaatatcttctattttatatattgaacagataaattttttagattatagtaattatcattaataactaatatcagaatattctaaaaaaggggtgtgcatcatgcacaatgagaaattaattaaaggcttatatgactatcgtgaggaacatgatgcgtgtggtattggtttttatgcgaatatggataataaaaggtctcacgacatcattgataaatcgcttgaaatgttgcgacgcttagatcacaggggcggggtcggcgcagatggcatcactggtgatggcgcaggtattatgactgaaataccttttgcatttttcaaacaacatgtaacggactttgatatcccaggtgaaggtgaatatgccgtggggttatttttttccaaagaacgcattttaggttctgaacatgaagtagtttttaaaaaatattttgaaggcgaagggttatcaattcttggttatcgtaatgtaccagttaataaagatgccattgctaaacatgtagcagatacgatgccagtcattcaacaagtgtttattgatattagggacattgaagatgttgaaaagcgtttgtttttagcgagaaaacaattagagttctattcgactcagtgcgatttagaattgtattttacgagcttatcacgcaaaacaattgtatataaaggttggttacgatcagaccaaattaaaaaactatatacagatttatcggatgatttatatcaatcaaagctagggttagtgcattcgagatttagtacgaatacattcccgagttggaaaagggcacatcctaaccgtatgttaatgcataatggtgagattaacacgattaaaggtaatgtaaactggatgcgagcacgccaacataaattaatcgaaacattatttggcgaggatcaacataaagtgtttcaaattgtcgatgaggatggtagtgactctgccattgtagataatgcgctagagttcttatcgttagccatggagccagaaaaggcagcgatgttactcatacctgaaccttggttatataatgaagcgaatgatgcaaatgtacgtgcgttttatgaattttatagttatttaatggaaccgtgggatggtcctacaatgatttcgttctgtaacggtgacaaacttggcgcgcttacagatagaaatggattacgtccaggtcgttatacgattactaaagataactttattgtcttttcatctgaagtgggtgttgtggacgtacctgaaagtaatgttgcttttaaaggtcaattgaatcctggaaagttattgcttgttgattttaaacagaataaagtcattgaaaataatgatttaaaaggtgcgattgctggagaattaccatataaagcgtggattgataaccataaagttgactttgattttgaaaatatacaatatcaagattcgcaatggaaagatgagacgttatttaaattacaacgtcagtttgcatacacgaaagaagagattcataagtatattcaggaacttgtagaaggtaagaaggatcctatcggtgcaatgggatatgatgcgccaattgcagtgttgaacgagcgaccagaatcactatttaattactttaaacagctgtttgcacaagttacgaatccaccaattgatgcgtatcgtgaaaaaatcgtaacgagtgaactttcttatttaggtggcgaaggtaacttactagcacctgacgaaacggttttagatcgtattcaattgaaaaggccggtattgaatgaatcacacttagcagcgattgatcaggaacattttaaattaacttatttatcaacggtatatgaaggggatttggaagatgcgttagaagcattaggccgagaagcagtgaatgctgtaaagcaaggcgctcaaattctagtgttagatgatagtggattagttgatagcaatggctttgcaatgccgatgttactcgcaataagtcatgtgcatcaattacttattaaagcagatttacgtatgtctacaagtttagtcgctaaatctggtgagacacgagaagtgcatcatgttgcttgtttactcgcatatggcgcgaatgcaattgtgccatacctagcgcaacgtacagttgaacaactgacattgacagaagggttacaaggcaccgttgtcgataatgttaagacatatacggatgtattgtcagaaggtgtcattaaagtaatggctaagatgggaatttcgacagtgcaaagttatcaaggggcacaaatatttgaagcgattggcttgtctcatgatgtgattgatcgttattttactgggacacagtctaagttatctggtatttcgattgatcaaattgatgctgaaaataaagcacgtcaacaaagtgatgataattatcttgcatcaggtagtacattccaatggagacaacaaggtcaacatcatgcttttaatccggaatctattttcttattgcagcacgcatgtaaagaaaatgactatgcgcaatttaaagcatactctgaagcggtgaacaaaaatagaacagatcacattagacatttacttgaatttaaagcatgtacaccgattgacatcgaccaagttgaaccggtaagtgacattgtcaaacgctttaatacaggggcgatgagttatggatcgatttcagcggaagcacatgaaacgttagcacaagccatgaaccaattaggtggaaagagtaatagtggtgaaggtggcgaagatgcaaaacgttatgaagtacaagttgatggaagcaacaaagtaagtgcgattaaacaagttgcttctgggcgttttggtgtaactagtgattatttacaacatgccaaagaaattcaaattaaagttgcgcaaggtgcaaagcctggtgaaggtggtcaattacctggtactaaggtatatccgtggattgcgaagacaagagggtcaacgccaggtatcggtctgatttcaccaccgccacatcatgatatttattcaatagaagatttagcgcaactgatacatgatttgaaaaatgcgaataaagatgcagatatcgcggtaaaattagtttcgaaaacaggtgttggtaccattgcatctggggtggcaaaagcatttgcagataaaattgtcatcagtggttacgatggtggtacaggggcttcacccaaaacgagtattcagcatgccggtgttccttgggagattggtttagcagaaacacatcaaacattaaaactaaatgacttaagaagtcgtgttaagttagaaacagacggtaagttattaactggtaaagatgtagcgtacgcatgtgcgcttggagcggaagaatttggatttgcaactgcaccattagtggtgttgggctgtattatgatgcgtgtatgccataaagatacatgtccagtaggagttgcaactcaaaacaaagatttacgtgctttatatagaggtaaagcacatcatgttgttaattttatgcattttattgcacaagaattaagagaaattttagcatctttaggtttgaaacgtgtagaagacttagttggaagaactgatttattacaacgatcatcaacattaaaagcgaatagcaaagcggctagtattgatgttgaaaaactgttatgtcctttcgatgggccaaacacaaaagaaattcaacaaaatcataatcttgagcatggatttgatttaacaaatttatatgaagtaacgaagccatatattgctgaagggcgtcgctatacaggtagctttacagtaaataatgaacaacgtgatgtaggggttattacaggtagtgagatttcgaaacaatatggagaagcaggacttcctgaaaatacaattaatgtttatacgaatggtcatgctggtcaaagtcttgcagcatatgcaccgaaaggcttaatgattcatcatactggagatgcgaatgactatgttggtaaaggattatctggtggtacggtcattgtcaaagcaccttttgaagaacgacaaaatgaaattattgctggtaacgtctcattctatggtgcgacaagtggtaaggcatttattaacggtagtgcaggagaaagattctgtattagaaatagtggtgtagatgttgtcgttgaaggtatcggcgaccatggattagagtatatgactggtggacatgtcattaatttaggtgatgtaggtaagaacttcggtcaaggtatgagtggtggtattgcttacgttatcccgtctgatgtagaagcttttgttgaaaataatcaactagatacgctttcgtttacaaagattaaacaccaagaagaaaaagcattcattaagcaaatgctggaagaacatgtgtcacacacgaatagtacgagagcgattcatgtgttaaaacattttgatcgcattgaagatgtcgtcgttaaagttattcctaaagattatcaattaatgatgcaaaaaattcatttgcacaaatcattacatgacaatgaagatgaagcgatgttagctgcattttacgatgacagtaaaacaatcgatgctaaacataaaccagccgttgtgtattaaggaaagggggagatacgatgggtgaatttaaaggatttatgaagtatgacaaacagtacttaggtgaattatcactggtagaccgtttgaagcatcataaagcatatcaacaacgatttactaaagaagatgcctctatccaaggtgcacgatgtatggattgtggaacgccgttttgtcaaaccggacaacagtatggtagggaaacaataggttgtccaattggaaactacattcctgaatggaacgacttagtgtatcatcaagattttaaaactgcttatgaacgcttaagcgaaacaaataactttcctgactttacagggcgtgtatgtcctgcaccatgcgaaagtgcttgtgtgatgaagattaatagagaatcgattgcgattaaaggtattgaacgcacaattattgatgaagcttttgaaaatggttgggtagcgccgaaagttccgagtcgccgtagagatgaaaaagtggcaatcgttggaagcggtccagcaggattagctgctgctgaagaacttaatctactaggatatcaagtaactatttatgaacgtgctagagaatcaggcggtttattaatgtatggtattccgaatatgaaacttgataaagatgtggttcgacgtcgtattaagttaatggaagaagcgggcattactttcattaatggtgttgaagtcggtgttgatattgataaagcaacgttagaatctgagtatgatgccattatattatgtactggtgcacaaaaaggtagagatttacctttagaaggacgcatgggtgatggtatacatttcgctatggattatttaactgaacaaacgcagttgttaaatggagaaattgatgatataacaataactgcaaaagataagaatgtcattatcattggtgctggtgatacaggggcagactgtgtagcgacagcattaagagaaaattgtaaatcgattgttcaatttaataaatatacgaaattgccagaagcaattacatttacagaaaatgcatcatggcctttagcaatgccggtgtttaaaatggactatgcgcaccaagagtacgaagctaagtttggtaaggaaccacgtgcatatggtgttcaaacaatgcgttacgatgttgacgataaaggacacatacgtggtttgtatactcaaattttagagcaaggcgaaaatggtatggtcatgaaagaaggacctgaaagattttggcctgctgaccttgtattattatcaatcggcttcgaaggtacagaaccaacagtaccgaatgcttttaacattaaaacggatagaaatcgaatcgtggcggatgatacaaactatcaaactaataatgaaaaggtatttgctgctggagatgctagacgtggtcaaagtttagttgtatgggcaattaaagaaggtagaggcgtagcgaaagcagtagatcagtatttagctagtaaagtttgtgtataatctttgtatggaaatggtggttacgttgacgttgtgacatgctgaatcgagtttgaaaaaatctagtatctatcaacgtcacatgccatctttgtaacctaaaaacaaaggtttgtaagacaacaaatagattaattataagtagtgattttttacattcgtttataggtcaactgtagtggaagacaatgatttgtggtaatcatgtaatgcttaaaaacaatattgacttttacagaacgttcatatatgataaatattgtgtttaggaggaatacccaagtccggctgaagggatcggtcttgaaaaccgacaggggcttaacggctcgcgggggttcgaatccctcttcctccgccatcaatatttatattaaattctatatataatgaaggtaagtgctcaaattttgagtatttaccttttttatttgtctttgaatggctcgtaatttttgataatagaaatgataaggcattgagattggaagggcatttggcttgtgcaatatacatagctaaatgtcttttttgttttgtgaaatatgatggatggcttgtgtggacaagtttgctatttatagatatgcatttttcaatttaggagttggccatgcatctacactttataatggtgagagcgtggtgaggtattgttaataacgcaattgtagcgaggagttattgctacatatgtcgttatggctcattgattttctgaaatggctaccccagataattgtgacaaaataaaaatattttgttgaaagcctttacataacttgtctagacaagttatactcgttttaagacattaagggagtgaaatatatggctgtaaaaagagaagatgtaaaagccatcgtaaccgctattgggggaaaagaaaatcttgaagctgcaacgcattgtgtaacacgattacgtttagtgctgaaggatgaaagtaaagttgataaagacgcattaagtaataacgcgttggtcaaggggcagtttaaagcagaccatcaatatcaaattgtcattggtccaggaacagtcgatgaagtgtataagcagtttattgatgaaacaggtgctcaagaagcttcgaaagatgaagcgaaacaagcagctgcacaaaaagggaatccagtacaacgtttgatcaaattgttgggggatatttttataccaatattacctgcgattgtgacagctggtttgttaatgggaatcaataatttacttacaatgaaaggtttatttggtccaaaagcacttattgagatgtatccacaaattgctgatatttcaaacatcattaatgtgattgcgagtacggcatttattttcttaccagcattaattggttggagtagtatgcgtgtatttggtggtagtccgattctaggcatagtcttaggtttgattttaatgcatccgcaattagtatctcagtatgatttggcaaaagggaatattccgacgtggaacttatttggcttagagattaagcagttgaattaccaaggtcaagtgttgccagttttaattgcagcttacgttctagctaaaattgaaaaaggattaaataaagtcgttcacgattcgataaaaatgttggtcgttggacccgtagcgcttttagttactggatttttagcatttattatcattggaccagttgcgttattgattggtacaggtattacatctggtgttacatttatattccaacatgcaggatggcttggcggagcaatatatggattgttatatgcaccacttgtaattacaggactacaccatatgtttttagcagtagatttccaattgatgggtagcagcttaggcggtacgtatttatggccaattgttgcgatttccaatatttgtcagggctctgcagcatttggagcatggtttgtctataaacgtcgtaaaatggttaaagaagaaggcttggcattaacatcttgtatttctggtatgttaggtgttactgaaccagccatgttcggtgtgaacttacctctgaaatatccatttatcgctgcgatatcaacgtcttgtgtattgggggcaatcgttggtatgaataacgtacttggaaaagttggtgttggtggcgtgccagcattcatttcaattcaaaaagaattttggccagtatatcttattgtgacagctattgctattgttgtaccatgtatactaacaattgtgatgtctcattttagtaaacaaaaagcgaaagaaattgttgaagattaataaaataaaaaaggggcgttcgttatttggacgtcctttattacgttataaggtggtaattgtgtgtcgaaagaaatagattggagaaaatccgttgtatatcaaatttatcctaagtcgtttaatgatacgacggggaatggtataggagatatcaatggaattatagaaaaattggattatatcaagttattgggtgttgattatatttggttaacaccagtgtatgaatcaccgatgaatgataatggctatgatatcagcaattatttagaaatcaatgaagactttggaacgatggatgattttgaaaagttaatcaaagttgcgcatcaaaaagacttgaaagtgatgttagatattgtcattaatcatacgtcgacggagcatgaatggtttaaagaagcccgtaaatctaaagataacccytatagagattattactttttcagatcatctgaagacgggccgccaacaaattggcattctaaattcggtggtaatgcatggaagtatgattctgagacagatgaatattatttacatttatttgatgtcagtcaagctgatttaaattgggataatccggaagtacgtcaatcgttatatcgcatagtcaatcattggatagacttcggcgttgatggttttcgatttgatgtcattaacttaatttctaaaggtgaatttaaggactctgacaaaataggtaaagaattttatacggatggtcctagagtgcatgagtttctgcatgaattaaatcgtcaaacgtttggtaacactgacatgatgactataggagaaatgtcttcgacgacgattgaaaattgtattaagtatacacaaccagaacgccaagaattgaatagtgtttttaattttcatcatctaaaggttgattatgttgatggtgaaaagtggacaaatgcgagcttgnattttcataagttaaaggaaattctgatgcaatggcaacgaggtatttatgacggtggcggatggaacgcgattttctggtgtaatcatgatcagccacgggtagtgtctagatttggtgatgatacgtcggaagagatgaggatacaaagtgctaaaatgttagctatcgcactgcatatgttgcaagggacgccatatatttaccaaggtgaagaaattggtatgacggacccacattttacatcaatagcacaatatcgtgatgttgaatcgattaatgcctaccatcagttgttaagtgaagggcatgctgaagcggatgtgttagcgattttaggacagaagtcacgagacaattcgagaacgcctatgcaatggagtgatgatgttaatgctggatttacagctggtaanccttggattgatatttcggaaaattatcatcaggtcaacgttagacaagcacttcagaataaagagtctattttctatacgtatcaaaaattaatacaattaagacatacgcatgatattattacgtatggagacattgtgccacgttttatggatcatgatcatttatttgtttatgaacgtcattataagaatcaacaatggctagtaattgcgaatttctcagcatcggctgttgatttgccagaaggattggctagagaaggttgtgttgtgattcaaacaggcacagtggaaaataatacgataagcgggtttggtgcaattgtaatcgaaacaaacgcgtaaaataaattgagtggatgcgtttatatggcgaaacaaaaaaagtttatgaagatttatgaggcgttgaaagaagatatattaaacgggcagattcaatatggtgaacaaattccgtctgaacatgatttggtgcaattgtaccagtcatctcgagagaccgtgcgtaaggcattagatttgttggcattagacggcatgattcaaaagattcatggtaaagggtcacttgtcatttatcaggaggttacagagtttccattttctgaacttgttagttttaaagaaatgcaagaagaaatgggcgtcgcatatttaactgaagttgttgtgaatgaggttgttgaagcgcatgaagttccagaagttcaacatgctttaaacatcaattctagtgaatcactcattcatattgttagaactcgtcggcttaaccaacatgtgaagattgttgatgaagattattttctaaagtcgattgtttcagatataggtaatgatgttgcgagtgattctatttatgattatttggaaaaggtattaaatcttaatattagttattcaagtaagtctattacttttgaaccgtttgatgaacaagcatatcaattgtttggtgatgtatcggtggcttattcagcaacagttcgaagtattgtgtatttagaaaatacaatgccgtttcaatataatatttcaaaacatcttgcaaatgaatttaaatttaatgacttctcaagacgtcgtataaagtaaacaatgatataaatgatttatacttgcaattaactattaaaatatagtaatatatatcttgccgtgctaggtggggaggtagcggttccctgtactcgaaatccgctttatgcgaggcttaattcctttgttgaggccgtatttttgcgaagtctgcccaaagcacgtagtgtttgaagatttcggtcctatgcaatatgaacccatgaaccatgtcaggtcctgacggaagcagcattaagtggatcatcatatgtgccgtagggtagccgagatttagctaacgactttggttacgttcgtgaattacgttcgatgcttaggtgcacggttttttattttttaaatattaaaccgattattaagagttgaaaatatataattatagaagctactttcttgaagacaattcagcgtattatacgtggaacatgtttgtgggaagtagcttttttatatgtgaagtttgattcaagtgaactcgatgtgcagtttgaatgatttttgtgtcaatgaaaagtaagaagttataatttgatgataaagaaatgatggtgaaatgagggggagtatcttacaatagaattattaatgagatacgttatgattattgacaatcaaatgcctacggaggacatatgcaaatatatttaagtactttaacagagttagattatgataaatctttaaatagtattgaagaaagttttgatgataatcctgaaacgagttggcaagcacgtgcgaaagtaaaacatttaagaaaatctccttgctataattttgaattagaagtaatagcgaaaaatgaaaataacgatgtcgttggacacgttttattaattgaagtagaaattaatagtgatgataagacgtattatggtttggcgattgcctctttatcagttcatcctgaattacgtggacaaaaattaggtcgtggcttggttcaagcagtagaagagcgtgccaaagcacaagagtatagtacggttgttgtagaccattgttttgactactttgaaaagttgggttatcaaaatgctgctgagcatgacattaaattagaatctggtgatgcaccgttacttgtaaaatatttatgggataatttgacggatgcaccacacggaatcgtaaaatttccagaacatttttattaattgttcaattaagaagtaaaggtattatcatgctataatgagaggtaattgtttatggaggtgctaacttgaattatcaagccttatatcgtatgtacagaccccaaagtttcgaggatgtcgtcggacaagaacatgtcacgaagacattgcgcaatgcgatttcgaaagaaaaacagtcgcatgcttatatttttagtggtccgagaggtacggggaaaacgagtattgccaaagtgtttgctaaagcaatcaactgtctaaatagcactgatggagaaccttgtaatgaatgtcatatttgtaaaggcattacgcaggggactaattcagatgtgatagaaattgatgctgctagtaataatggcgttgatgaaataagaaatattagagacaaagttaaatatgcaccaagtgaatcgaaatataaagtttatattatagatgaggtgcacatgctaacaacaggtgcttttaatgcccttttaaagacgttagaagaacctccagcacacgctatttttatattggcaacgacagaaccacataaaatccctccaacaatcatttctagggcacaacgttttgattttaaagcaattagcctagatcaaattgttgaacgtttaaaatttgtagcagatgcacaacaaattgaatgtgaagatgaagccttggcatttatcgctaaagcgtctgaagggggtatgcgtgatgcattaagtattatggatcaggctattgcatttggtgatggtacgttaacattgcaagatgcgttgaatgtcacaggtagcgtacatgatgaagcgttggatcacttgtttgatgatattgtacaaggtgacgtacaagcatcttttaaaaaataccatcagtttataacagaaggtaaagaagtgaatcgcctaataaatgatatgatttattttgtcagagatacgattatgaataaaacatctgagaaagatactgagtatcgagcactgatgaacttagaattagatatgttatatcaaatgattgatcttattaatgatacattagtgtcgattcgttttagtgtgaatcaaaacgttcattttgaagtgttgttagtaaaattagctgagcagattaagggtcaaccacaagtgattgcgaatgtagctgaaccagcacaaattgcttcatcgccaaacacagatgtattgttgcaacgtatggaacagttagagcaagaactaaaaacactaaaagcacaaggagtgagtgtcgctcctgttcaaaaatcttcgaaaaagcctgcgagaggcatacaaaaatctaaaaatgcattttcaatgcaacaaattgcaaaagtgctagataaagcgaataaggcagatatcaaattgttgaaagatcattggcaagaagtgattgatcatgccaaaaataatgataaaaaatcactcgttagtttattgcaaaattcggaacctgtggcggcaagtgaagatcacgtacttgtgaaatttgaggaagagatccattgtgaaatcgtcaataaagacgacgagaaacgtagtagtatagaaagtgttgtatgtaatatcgttaataaaaacgttaaagttgttggtgtaccatcagatcaatggcaaagagttcgaacggaatatttacaaaatcgtaaaaacgaaggcgatgatatgccaaagcaacaagcacaacaaacagatattgctcaaaaagcaaaagatcttttcggtgaagaaactgtacatgtgatagatgaagagtgatacatgacaagcgatataatcgtatgtataatgaaagaaacatcattttattgataaatatttattgattttcaaggaggaaatggaatatgcgcggtggcggaaacatgcaacaaatgatgaaacaaatgcaaaaaatgcaaaagaaaatggctcaagaacaagaaaaacttaaagaagagcgtattgtaggaacagctggcggtggcatggttgcagttactgtaactggtcataaagaagttgtcgacgttgaaatcaaagaagaagctgtagacccagacgatattgaaatgctacaagacttagtgttagcagctactaatgaagcgatgaataaagctgatgagcttactcaagaacgtttaggtaaacatactcaaggcttaaacatccctggaatgtgatcatagatgcattatccagaacctatatcaaaacttattgatagctttatgaaattgccaggcattggtccaaagacagcccaacgtctggcttttcataccttagatatgaaagaagacgatgttgttcagtttgccaaagcattagtagatgttaagagagaattaacatattgtagcgtatgtggtcacattactgaaaatgatccatgttatatttgtgaagataagcaaagagatcgttcagttatttgtgttgtggaagatgacaaagatgtcatagctatggaaaaaatgagagaatacaaaggtttatatcacgttttacatgggtctatttcgcctatggatggcattggaccagaagatattaatattccttcattgattgaacgcttgaaaaacgatgaagttagcgaattaatcttagctatgaacccgaacttagagggggaatctacagccatgtatatttctagattagttaagcctataggtatcaaagtgacgagattagcacaagggttatcggtaggtggcgatttagagtatgctgacgaagtaacattatctaaagcaatcgcaggtagaacagaaatgtaatktcttctattaaacatttttgattttaatactatagtaagaaaagtcacagtgtaatcattgtggctttttttatggtgtggtgtgatgtactactttatttgcggtgtggcggtggtatggtttacctagttttactgagggatgggtaatctttaggaagcaagccgttggttgtgatttgttacttctaatagtaatgatgtgaattggattatcgaattagatctatggttatggtgtgttggtgctattaatttgataaatgcggttaatgactatgcaaatgaaattcttttgtaattgaaatgatagatgctggcttagtaagttgtacttctttggtctaaagcttattaaatcagcctgtatagcggtgttttgagagattatttaaaacttgtaaatttatttttaatttctggtaaaaaaataacgttctgttttgcgttttttttgattgatatggttagagaaaaatctgtttcttgttctaaaaaacgtactatttataagtggggattttttaagttcgatttttaggataagggcgttcagtacagatgacaaaggtgtaatttttactgttgttaagcagtttgaaagcctgtatagtatttatttgttgaggcaaacaaaacaactcaacttaagaaataacttgaattactaacgaaaattaattttaaaaagttattgacttaaatgttaataaaatgtataattaattcttgtcggtaagaaaaatgaacattgaaaactgaatgacaatatgtcaacgttaattccaaaaaacgtaactataagttacaaacattatttagtatttatgagctaatcaaacatcataatttttatggagagtttgatcctggctcaggatgaacgctggcggcgtgcctaatacatgcaagtcgagcgaacggacgagaagcttgcttctctgatgttagcggcggacgggtgagtaacacgtggataacctacctataagactgggataacttcgggaaaccgkagctaataccggataatattttgaaccgcatggttcaaaagtgaaagacggtcttgctgtcacttatagatggatccgcgctgcattagctagttggtaaggtaacggcttaccaaggcaacgatgcatagccgacctgagagggtgatcggccacactggaactgagacacggtccagactcctacgggaggcagcagtagggaatcttccgcaatgggcgaaagctgacggagcaacgccgcgtgagtgatgaaggtcttcggatcgtaaaactctgttattagggaagaacatatgtgtaagtaactgtgcacatcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaagttgaaactcaaaggaattgacggggacccgcacaagcggtggagcatgtggtttaattcgaagcaacgcgaagaaccttaccaaatcttgacatcctttgacaactctagagatagagccttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggagctagccgtcgaaggtgggacaaatgattggggtgaagtcgtaacaaggtagccgtatcggaaggtgcggctggatcacctcctttctaaggatatattcggaacatcttcttcagaagatgcggaataacgtgacatattgtattcagttttgaatgtttatttaacattcaaatattttttggttaaagtgatattgcttatgaaaataaagcagtatgcgagcgcttgactaaaaagaaattgtacattgaaaactagataagtaagtaaaatatagattttaccaagcaaaaccgagtgaataaagagttttaaataagcttgaattcataagaaataatcgctagtgttcgaaagaacactcacaagattaataacgcgtttaaatctttttataaaagaacgtaacttcatgttaacgtttgacttataaaaatggtggaaacatagattaagttattaagggcgcacggtggatgccttggcactagaagccgatgaaggacgttactaacgacgatatgctttggggagctgtaagtaagctttgatccagagatttccgaatggggaaacccagcatgagttatgtcatgttatcgatatgtgaatacatagcatatcagaaggcacacccggagaactgaaacatcttagtacccggaggaagagaaagaaaattcgattcccttagtagcggcgagcgaaacgggaagagcccaaaccaacaagcttgcttgttggggttgtaggacactctatacggagttacaaaggacgacattagacgaatcatctggaaagatgaatcaaagaaggtaataatcctgtagtcgaaaatgttgtctctcttgagtggatcctgagtacgacggagcacgtgaaattccgtcggaatctgggaggaccatctcctaaggctaaatactctctagtgaccgatagtgaaccagtaccgtgagggaaaggtgaaaagcaccccggaaggggagtgaaatagaacctgaaaccgtgtgcttacaagtagtcagagcccgttaatgggtgatggcgtgccttttgtagaatgaaccggcgagttacgatttgatgcaaggttaagcagtaaatgtggagccgtagcgaaagcgagtctgaatagggcgtttagtatttggtcgtagacccgaaaccaggtgatctacccttggtcaggttgaagttcaggtaacactgaatggaggaccgaaccgacttacgttgaaaagtgagcggatgaactgagggtagcggagaaattccaatcgaacctggagatagctggttctctccgaaatagctttagggctagcctcaagtgatgattattggaggtagagcactgtttggacgaggggcccctctcgggttaccgaattcagacaaactccgaatgccaattaatttaacttgggagtcagaacatgggtgataaggtccgtgttcgaaagggaaacagcccagaccaccagctaaggtcccaaaatatatgttaagtggaaaaggatgtggcgttgcccagacaactaggatgttggcttagaagcagccatcatttaaagagtgcgtaatagctcactagtcgagtgacactgcgccgaaaatgtaccggggctaaacatattaccgaagctgtggattgtcctttggacaatggtaggagagcgttctaagggcgttgaagcatgatcgtaaggacatgtggagcgcttagaagtgagaatgccggtgtgagtagcgaaagacgggtgagaatcccgtccaccgattgactaaggtttccagaggaaggctcgtccgctctgggttagtcgggtcctaagctgaggccgacagcgtaggcgatggataacaggttgatattcctgtaccacctataatcgttttaatcgatggggggacgcataggataggcgaagcgtgcgattggattgcacgtctaagcagtaaggctgagtattaggcaaatccggtactcgttaaggctgagctgtgatggggagaagacattgtgtcttcgagtcgttgatttcacactgccgagaaaagcctctagatagaaaataggtgcccgtaccgcaaaccgacacaggtagtcaagatgagaattctaaggtgagcgagcgaactctcgttaaggaactcggcaaaatgaccccgtaacttcgggagaaggggtgctctttagggttaacgcccagaagagccgcagtgaataggcccaagcgactgtttatcaaaaacacaggtctctgctaaaccgtaaggtgatgtatagggctgacgcctgcccggtgctggaaggttaagaggagtggttagcttctgcgaagctacgaatcgaagccccagtaaacggcggccgtaactataacggtcctaaggtagcgaaattccttgtcgggtaagttccgacccgcacgaaaggcgtaacgatttgggcactgtctcaacgagagactcggtgaaatcatagtacctgtgaagatgcaggttacccgcgacaggacggaaagaccccgtggagctttactgtagcctgatattgaaattcggcacagcttgtacaggataggtaggagcctttgaaacgtgagcgctagcttacgtggaggcgctggtgggatactaccctagctgtgttggctttctaacccgcaccacttatcgtggtgggagacagtgtcaggcgggcagtttgactggggcggtcgcctcctaaaaggtaacggaggcgctcaaaggttccctcagaatggttggaaatcattcatagagtgtaaaggcataagggagcttgactgcgagacctacaagtcgagcagggtcgaaagacggacttagtgatccggtggttccgcatggaagggccatcgctcaacggataaaagctaccccggggataacaggcttatctcccccaagagttcacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgtgggcgtaggaaatttgagaggagctgtccttagtacgagaggaccgggatggacatacctctggtgtaccagttgtcgtgccaacggcatagctgggtagctatgtgtggacgggataagtgctgaaagcatctaagcatgaagcccccctcaagatgagatttcccaacttcggttataagatccctcaaagatgatgaggttaataggttcgaggtggaagcatggtgacatgtggagctgacgaatactaatcgatcgaagacttaatcaaaataaatgttttgcgaagcaaaatcacttttacttactatctagttttgaatgtataaattacattcatatgtctggtgactatagcaaggaggtcacacctgttcccatgccgaacacagaagttaagctccttagcgtcgatggtagtcgaacttacgttccgctagagtagaacgttgccaggcaaaaaatggatgcgatgagccgcattgagaccgcaaggtctcttttttttatgtctaaaacgtcaaaataaaaagcaaacacaaagaaaaatggcttggcgaagtgaaaacgtttgaatctgacgaaacgagaaaagarcgcaacgagtttagtagagctaaatgagtaagygagagccgaagragaggaaagaagcaagcgattgtcacaagtcaagaaaggttcttagcgasgatggtagccaacttacgttccgctagagtagaactggaaatgataatttaataatgtacactttcgattgtctaagtatgtacaactttaattttgtgtttatataaatttaaaatgatatcatcgaaaacaaaatattgtataaatagagaagagcagtaagacggtatctaattgaaaatgatcttactgctcttttatatactttattgaaatacaaaaaggaaattaattattatacaatagacaagctattgcataagtaacactaacttttatcaaagaagtgttactttataattaatgattttattagagcgtctacatgcggttttaaagcatcatcgtctataccgccaaagcctaatataaatttaggggttttcttatagtcttgatcatcatcaaaattataaacttgtaattttaactttactttgtttgctctatcaagacactcttgtaatgttaatccattttttactgtaattgtaaaatgcatacccgtttcagcaccttgaatatcaagctgctctttgtaaggtttcaatctttttaaaatataggttagttttctacgataaattcgtctcattttatttaaatgcctttcaaaaccaccggaagatataaacgttgcaataaggttttgcatatgaacaggtacagtgttgccttcaatgtgattttgagaatgatattttttcattatagaatagggtaacaccatatatgcaactcgacagctaggaaaaatagactttgaaaatgtactgatataaatcactttttctcctcttgaatatagaccttgaattgctggaatgggtttgccgaaatatctaaactcggaatcataatcatcttctataataaatcgttcttctttttcttgagcccattgtattaattgagttcgtttttttaagtccatcacatatccagttggaaattgatgggaaggcgttatatatactatatttttttgtgatttaataacttcatctacgtttattccattatcttcaacttcaatttgttcatattcaacttgttttttatctaaaatatttttgattggtggataactaggtttttcgataataaatgttgaagtataaagtaaatcgactaattgatttactaattgttcggtagatgagccaattataatttgattaggatcacaaattacgccacgattagtaaataaataaaatgccagttgaaaccgcaaatgtaattctccttgaaaatgtcctctacgtaattgatttaaatgatttgtatcataaagatctttggaatactttctgaaaagttctatagggaaatgtttcgtatctatttcatccaaattaaaagcataatcataagcttcatcactcgcttttggtttatatgaatcatcatcaaaaagagaggggataggttgattgtttaaaattgttaaagattcaatttcggacacaaaatatccagagcgaggtcttgaataaatgtaaccttcgtctaatagaagttgatatgcatgctctacggttgtttggctaatagataaatgtttgcttaattgtcttttagaataaaatttatcgccttctttaaattgaccttcaattatttgtttttttaatttttcataaagttgatggtataaagtgtttttcaattttataactgacctcctaaatttatcttattttgtacctttttaaatatcagtttatacattacaatgtatttaatcaacttgaaaaggggttttatgtataatgagtaaaattattggatcagacagagtcaaaagaggtatggctgaaatgcaaaaaggcggcgttattatggatgtcgttaatgctgagcaagcaagaattgcagaagaagctggcgcggtagcagttatggcattagaacgagtaccttctgatattagagctgctggtggtgttgcacgtatggcaaaccctaaaattgtagaagaagtaatgaatgctgtttctattccagtcatggctaaagcacgtattggtcatatcactgaagcaagagtattagaggcgatgggtgttgactatattgatgaatcagaagtgttaacaccagcagatgaggaatatcacttaagaaaagatcaatttacagtaccatttgtatgtggatgtcgtaatttaggtgaagmtgcgcgtagaattggtgaaggtgctgctatgttacgtactaaaggtgaaccaggtacaggtaatattgttgaagctgtaagacatatgagacaagttaattcagaagttagtcgattgactgtaatgaatgatgatgagattatgacttttgcgaaagatatcggtgcgccttatgaaattttaaaacaaattaaagacaatggtcgtttaccggtagttaactttgcagctggtggcgttgcgactcctcaagatgctgctttaatgatggaattaggtgctgacggtgtattcgttggatcaggtatttttaaatcagaagatccagaaaaatttgctaaagcaattgttcaagcaacaacacattaccaagactatgaactaattggaagattagcaagtgaacttggcactgctatgaaaggtttagatatcaatcaattatcattagaagaacgtatgcaagagcgtggttggtaagatatgaaaataggtgtattagcattacaaggtgcagtacgtgaacatattagacatattgaattaagtggtcatgaaggtattgcagttaaaaaagttgaacaattagaagaaatcgagggcttaatattacctggtggcgagtctacaacgttacgtcgattaatgaatttatatggatttaaagaggctttacaaaattcaactttacctatgtttggtacatgcgcaggattaatagttctagcgcaagatatagttggtgaagaaggataccttaacaagttgaatattactgtacaacgaaactcattcggtagacaagttgacagctttgaaacagaattagatattaaaggtatcgctacagatattgaaggtgtctttataagagccccacatattgaaaaagtaggtcaaggcgtagatatcctatgtaaggttaatgagaaaattgtagctgttcagcaaggtaaatatttaggcgtatcattccatcctgaattaacagatgactatagagtaactgattactttattaatcatattgtaaaaaaagcatagcttaatgtatgctaaatcaacgaattattgatatttatagatttgttgagaagaaaatatctccttcaaacttagctttggaggagttattttttatgtcaaaattaaaaatgataaaaaataaagctatacataagaaaaaaacccttcaaagagactgagaatagtcaaaattttgaaggggttaattcgatgttgatgtatttgttaaataaagaatccagcgattgcagctgaaatgaaagatactagtgttgcaccgaataataatttcaaaccaaagcgggcaactgtatctccttttttgtcattaagtgatttaatcgcacctgaaataataccgatagagctaaagttagcaaatgatactaagaatacagatgtaacaccttttgcgtgttcagataaatcactaagtttaccaagtgcttgcattgctacaaattcgttagataatagttttgtcgccataactgaaccggcttgaactgcatcttgccatggcacaccgactaagaatgcaaatggtgcaaagacaaaaccaattaatgtttggaaatcccaagaaatagcgccacctgaaactgtactaaagatattgcttacaattccatttaatagagcgataatggcaatgtatccgattaacattgcgcctacaatgacagctactttaaatccatctaaaatatattctcctagcatttcgaagaatgattgttgtctttcttcagtttcttcaactaataatttgtcatcttcttcattaactttataagggttaataattgaagcgatgatgaaaccaccaaataagtttaagacaacagccgttacaacatatttaggttcaattaaggtaaagtatgcaccgataattgaagcagaaacagtcgacattgctgaagctgttaatgtgtataaacgttgcttaggtatgtatggtaattgttttttaattgaaataaatacttcagattgtcccaaaattgctgcagcaactgcattgtatgattctaaacgtcccataccattaattttagaaattaagaatcctaaaacattaatgattaaaggtaaaatctttgtgtattgaaggataccgataatcgctgaaataaatacgataggtaataatacactgaagaagaatggtggttgcttaggatcgatatattgaataccaccgaatacaaagttaacaccatctgctgcttttaataataagtagttaaaaccgtttgaaataccaccaataaccttgattcccattgtagttttaagcaagataaatgcaaagataagctgaattgcaagtaaaattcctacatatttccagcgaatatttttcctgtctgagctaaatagaaacgcaagtgctaaaaagaagataattccgataatcccaattagaatatgcatatatttctcattcctttagttttttctacaatctatcatacaataaaatggaagggctaacatcataaatttttgaaaatataaaaacaaattaattgaaaaaggtcaaaataggtcatataatatagtcaaagaaggtcaaaaaggggtgatatacatgcacaatatgtctgacatcatagaacaataatcaaacgtttatttgaagagtcgaatgaagatgtcgttgaaattcagagagcgaatatcgcacagcgttttgattgcgtaccatcacaattaaattatgtaatcaaaacacgattcactaatgaacatggttatgaaatcgaaagtaaacgtggtggtggtggttacatccgaatcactaaaattgaaaataaagatgcaacaggttatattaatcatttgcttcagctgattggaccttctatttctcaacaacaagcttattatattattgatgggcttttagataaaatgttaataaatgaacgtgaagctaaaatgattcaagcagttattgatagagaaacgctatcaatggatatggtttctagagatattattagagcaaatattttaaaacgtttgttaccagttataaattattactaaatgaaatgaggtgttgaagtgctttgtgaaaattgtcaacttaatgaagcggaattaaaagttaaagttacaagtaaaaataaaacagaagaaaaaatggtgtgtcaaacttgtgctgaggggcaccatccgtggaatcaagctaatgaacaacctgaatatcaagaacatcaagataatttcgaagaagcatttgttgttaagcaaattttacaacatttagctacgaaacatggaattaattttcaaga

SEQ ID NO: 57 - DNA, 14333 bp; double-stranded, linear
tattcccccatcggtttattaaatcgtccatttcaatactgtttttccccaagatgtcgataaatccatttcaaacgcttggacgatatcttgcatcgtacatacattaatttcatgtccttttaataatgctaacttttcaactatgtctgggtacttacgatataaatcaacaacttgctcaaaatctttagagccgcttcgactactaccaatcaacgttaatcctttttcaagtactaatcgtgtattcacttccacgggtaattcacttacgcctaacaaagcaatactgccttctggtgaaatatgttcaactatttgttgaagtgcaacttgacttcctttacctccaacacattcaaatgcatgatcaattttaagatcatctggtatttgatttactgtaaagatgtcatctacaaatgaaaaatgacttaatttatagtctgtcttaccaaatacataagttttagcttctgggtacaacttacgtagcaaaatagcagtaatataacctaagttaccatcaccccaaataccaaagctggttttcaaaggtatagatttacgttcaaatcgttgtatagcatgataacttactgacactaactctgtgtatgaaatcgtactcaaatcaatgtcattaggcagcggaacgatacgatcatgtgccatcacaacgtagtcttgcataaaaccatcataaccactagatctaaaataactagaggctaagtaattctccgcaataatatgatgttgctctgtaggtgtattcggtaccattactactttcgtacctttttcaaatacccctttactatcaaatacaacttcaccaacagcttcatgaactaatgacattggtaattttttgcgtagtacattttcatctcttcgacctgtgtaatacctttgatcagctgcacaaatagacaagtataaaggtcttacgatgacatgattaccataaatatcaacattattatatgtgacgtcgaactgtctcggtgcaacgagttgatatacttgattaatcatcggcaatatcaccttgaataatggcatttgctacttttaaatcatacggtgttgtcactttaatgttgtatagttctccacgtaccaatttaactgcatgtccagattcgacaatgattttacatgcatctgataagatttctttttgttcactacttaaggcgcgataactatcttgtaataatttaatattaaatgattgtggtgtttggccttgatacatttcattccttacagggatactgtgtatgttctgtttatctttagacattacaatcgtatcaattgcttcaatgactgtatctactgcaccatattttgctgctacttcaatgttctctttaataatacgttgagttaaaaatggtcttacggcatcatgagttacaatcacatcatcattattaattccatttacattgcgaatatggtcgataatgttcataattgtttcatttcgatccgtaccacctgcaactactttgacacgttgatctgtaatgttatatttttttaaaatatcctgtgtatgggaaatccactgtgctggcgttgcgataataatctcattaaattcactcactaaaatgaacttctcaattgtatggattaaaatcggtttattatcaatatctaaaaattgttttggtaatggcacgttccccattctcgaaccaatacctcctgctaaaatacctgcataaatcatgttgtcctccattctgtcattacatcatttccatttatacattactgacctatgcccgcacataagcctaacctattgctcacttgcctcttttattaatccaaagatagttgtcacaatagtgtgataattttttataaaaatgtatttttgtaactgaccattctaagttgttttgccatgcagttaatcattaactctgacgatattaaattgttaaaggtattaatgtttactctttttcaaattcattattactgccatcattttaccatatattataataaatttatcttattaagtggctgtacttgattttcactttaaaaattatcaaatattgccatctcattttaagtatacaaaatgcaaaacaaccgattcacaagcatatttcacacaagtaaaccggctatttatcaacgtatattcgaagatgaattatttcgatagtatctatagaccagacggcattcgcactttcatagctataactataccagcgttttcgtcctcaaaggtgcatactaataaatcgtaaacatgactttatcaaatcgttctttcttgttaactaatttatcaaatgtctccgggcctttttctaacggtaaaaaatgagaaataataggctttacattaatatctttcgtcttcatataatgtaaggttgccgtccactctttgcccggaaaattactggacaaacagttccaagagccacatactgtcaactcgttacgcagaattttttcaaaatgaacgcgatcaatctcaatatcatcatatggtattccgagtaataccacctcgccaccttttttaggtagcgtcaatatttgaccaatcgtaactttagcacctgatgattctatagctaaatcgatttgattggcgtaatgattttcgatgaatttctcaagattttcttcttttgaattgattgtttgatgtgcgcccaatgatgttgcaatatctagtttatgcgcatctatatctatagcgatgatatgtgcagcaccaaatattcgtgcccattgaatagctaacaaacctatactgccacaccccattactgcaacagtcataccaggttgtatattcgatttataaaacccatgcgcaacaacggctgatggctcaaccattgctgcttcaatgtaatcaacattgtctggaacctttaaaacattttgcgctggcaatttgacatattccgcgaacgatccaggttcatatgagccaatgacgaataacttttcacatcgtgcatattcaccttttaaacaatactcgcattgataacaaggtattgctgggcaacctgtcactttgtcgcccacattaacatgcgtaacatcacttccaatggcatctactacacctgaaaattcatgaccaaatggcatacctttaatgtatggccccatttttttgtatcgtgacgtgtctgaaccacatatgccagtcgctcgtactttaataataacgtcattcgcactttcaatgactggcttttcattatcctcataccgtaaatcttccacgccatataatttcaatgctttcacttgtaaatcacctcaaatttgatttaattcacaacttttttctttttaaaaatacctgtcgcaaaataacctgcaatgacaatggaattacttacgagtaaatgttccatataaaaatcagtgatttgtcttaatggcccaagcataaaagttagcattgattctaccatattaattctctccttcattttcatctaaatcgagcggcttaagtaatgctttaataccttcgccggattttaaatgttgatacgcctcgtcccatttcgaaatatcatatatttttgtcaccaaagcttcagcatttactaaaccatccgccataagttgcaatgaaggttcccaatctgctggcttttgacttctactaccaacaactgttatttctttttgaatcactttttccatatcaaatggaatttcagcatccttaaaaatacctatttgactgtagaaaccttttttgcgtaaaatatccaaaccttgtcgtgctgctggaactgcacctgaacattcaacaacaacatctgcaccgtaaccgtctgtaattccattgatatacgtttttaagtctgtttgttgtaaattgactacataatccatgtgcaatgcttctgctttatctaatctgactttgtcattgtccaatccagttaccacaacagttgcgcctttactttttaacacttgtgctacaagtaatccgattggcccaggtcccattacaactgctacatcgcctgaattgacttgaatcttagaaacgccatgatgtgcacatgctaatggttctgtcatagctgcagactgatacgatattcgtctggaatatgatgcaaactttcttcacgtgcaatgacataattagtaaatgcgccatcaacttgtgttccaataccttttcgatggttgcataaattatagtcttttgatttacagtattcacactcattacaaacatagaatgtcgtttcagatgtgacacggtcaccaactttaaaatctttaacgtctgctccaacttcaacgatttcaccagaaaattcatgacctaatgtcactggaaaattaactttataatgaccttcataagtatgaatatctgtgccacaaattcctgcataatgtactttaatctttactttatcatctagcggtgttgcaacttctttatcaagaagttctaagttgccatgtccttctcttgtttttactaaagctttcaccacaaacacctcgatttttaattgaatagactaaatagtttaaagataagatagttaacgatattaccaccttgatcaatacttgaaatttcagatgaaccttttggcatttgtacattcgtacctttcgccatatctgtgaaaatgggtgctacgtctgttgcaatatatagtgaaattgcaatcataatcgtacccacaatgacagaatgaataatgtttcctcttgctgcaccaacaataaacgcgacaacaaatggtatcgttgctaagtcaccaaaaggtagtacttggtttcctggtaaaataacggctaataaaacagtgataggtactaaaattaatgctgtcgaaataactgctggatgacctaatgctacagccgcatccaatccaatataaatttcacgttcgccaaaacgtttatttagccatgttcttgcagactctgaaactggcattaaaccttccattaagatttttaccattctaggcattaataccattactgcagccattgacattcctaaattaatgatgtctccaggtttgtaacctgctaacacaccaatacctaaacctaaaattaagccgacaaatatagactctccaaatgcgccaaaacgtttttgaattgtttcaggatcagcatctaacttattcagaccgggtactttttgtaacaatttaactaagtaaatacctggtgcataagaaattgtacttcctgtagcaatcgatacacctggtaaatcaaagaactcactcatcatcggtgctgtccaatctgctactttcaaacagataatttggaaaataactgctgctaataacgcttgccaaatactgcctgatacggcataaaccattgctgctgtaaacgtataatgccaaaaattccaaatatctacattcatcgtctttgtcactttagttactagcaatacaacgttaactatgattccgagtggaataataaatgctgcgacagatgatgcccaagcgatagatgatgttgctggccaacctacatcaatcacattcagactgacgcctaaatttttaaccatcgcttgtgctgctggccctaaatttttaactaataaatcgatgactaagaaaatccctacaaaagccacacctattgttaaaccagacctaaatgccgctccaattttctgcctaaagaataggccaagcaagaatatgacaaccggtaaaataacagttgcacctaaatctaaaaatccccttacaaaatcagtgaagtaactcatatttaaaccctccctgttatatatgcattgtcacgatactttccgattgtgattacatttgacgttacagtcatttcaacgacaacccttgctaaattcgactgcagtccttttgaattacagtcactgcgtttctatgtcatcaacaatcatttgtcgtgatagtcatttatatgcaatttgcatatattaatatgttatcgacccacgttacatatcaattccgttatttttgtaactctgttaagatttgttgttttgtttcttcaataccaataccagttaagaaattacgtgcgttgataactgggaatttatattctttttttgtcattgcagttgtaactaataaatctgcagtgtcttcataaggtccaacttctgtaattttgatttgtttaatatctactttaatattgtgttcctttgccatttcttcaattgcattatttactactgttgacgttgcaatacctgcaccacacgctactaatacttgtttcattttcaattcctccaattaatttttagttatattccaaataatcattgattagtgttgctaaaattgtttcatctttcgttcgtagaatctgctccaatttttcttcactttgaaaaatttgcatcaactgttgtaacagcttaagttgatcatctactttatccattgctaacataaaaacgattttcacttctgtctgttgatcaagtgttcccatttcaataaacggcacttctttttctagaacagccacacctatcgttctatggttaatatgttcgacatctgtatgcggtatagcgaccgaacatagatgcgttggtaaaccagtagcaaattctttttctctgtcgatgactgcatctttaaacgttgacttcacgaacccattttgaaataacacatctgacatttgtgacaatacggattctttatcagttgccgacaaattgagcattatattttctttatgcactaattgctgtcccatccattttccctcgcttctttatttgaataattttttaaaatctcatttacatcagaatttttgcgactttgtatgatgcgcttaattgcgtcattgtcttgcgccacatctctcaattgtagtaacgctcttaagtgtgtcactttatcaacagcagcaataggtacaataatatggattgctgtgccatctgacatgtatattggttcttgtaatatcaacatactcatcgctgttttatgtacatgcttttcagagtatgcatgtggaatagcaatattttgcatgataaccatatacgaatcatcaaatacctgttgcatctcatgaatatatttaatatcaataaaatgattagcaactaacacatcacttgctttagcaatagcttcatcaatattttcaacatgatgcattcttttcacgtgccttgccggtatcaagtcagctaaatctaatgyctwattttgtgtgacaatcgatccattaatggttgaaattgaattataattggcaataaaatcttctaaaccatcacgtagtctgtaatgtcattaactgtcgttgtgcgttcaattaatgccattaacttgtttatttccttatcaatgtcagccgattccttattaatgtacttcatcacttctttacgtaactttcgttgctcattttcagataaagctacttttgtgataaataattttttatgtgttaggacaaacattggtgaaaagacgatgtcataatctaatgtgtaattttcaaatgttctaagtgaaatcgcatctaagaaaataatttctggaaataagtttcgcaactcgtataacatcatttgtgatactgacgtgccttgtgtacacacgataatagcttttatcttgccatcgaagttttcatcttgacgtctcaaactacctccgaacaacatggttaaatatgctatttcattatcaggcaacgattttccgaaatattcagttaacgattgacatgattgtttcaccatatgaaataaggattgataatttccttgtaaaggatttattaattcatcacgatccgttaagttatatttaatcctataaaaagcaggcgttaaatgtaacaagagttgctgtgataatttctccttatcttcaatgttaataaaagtgatttgttcaaaatggtgaatcatttgagcgatggccatcgttaaattcgatatgctatctgattcttgcaaatcagtccattgcacacttgttgaaagtaagtgtaatgtcaaatataacttttccgcttctggcaaatccggctcatgttgcgtcataatctccgttgcttgatattctttcgtatccctcaaatactgataattaatatttaatggattcatcacatgaccactttgaattcgtctacgaatcacacaaaggacataaggcaatgaactaagtgatttgtctataaagcgactcttcaaaaattgttctacctgtttgatcttgtctttttgatatgcgatatcttcgaatgttaagttgagcgcctttaaaacttcacttttagtaatatcatgattcaacctttgatcaatcaacttaatgaagaaacggcgaacttcaaattcatcaccaacaatttcataaccatgttttcgagaatacttaagtgacaaaccatgattttccaattgctctttcacatgatttatatcgtgaatgacagtatttttactgacttgtaaatcaattgaaaaatggtttagagacattgcgttttccttactaaaaagcatgagcattaaataataacgacgtgtttctatgctaaaaatgacattgttgccgtttaacatttgctgctccgatacatctcgcttgaataacgtcatgatttcagaacttacaataaaatttccttggcttgttctttcaagttttggataaccctcttgttcaagccacaaattgattttttgaatgcgatatcctagttgtctacgagacaaaccaaatatcgattcaagttctttaccatgaatagtaggattcaatacaatttctctgagtatttgctgattatccccgttcatgttcgattctcctttgagcatctgagctcaatttatcatcaatcgtcacaccgatgtacacactttgaacacatattttcaaaatgagcatgtacatcattgtgatgttttaacaacatttcaattatatctatattttttgtgattttaatcttttaaaataaagcaattgaaatttttgcatatatttttgtgttttgtgtttttttgaagcatttttaacatacatatctcaatcattatcaaattgtcatgaccattgtaacccaatacaaaaaccctaaggacgcttatatcaggcgccttagggttaactgtatctatttaattaagtattattattcgtatgtacgtaacttatggtctatcaagttccacacttcttcaacatcaactgctgtagcaaaataagcattggcaggcttacctgtaacatgatttaaatcgacagccatagtgccataagttagtggactttgatgttcaatgtcgatattaacgggtaccattgtaaacaattctggttgtaacaaatacaaaattgtacaagcatcatgtattggaccaccatccatattaaagtgagtcttgtatgtcttcttaaagaattgcaataattctacgacgaactgtgcaacaggattattgatactttcaaagcgttcaatcacgtgatcgtcggctaaaacttgatgtgttacatctaaaccaaacacatttatagtaatcccactttcaaaaacacgcttcgctgcttcagcatctacccaaatattgaattctgctgtaggcgtccaatttccaaatgtaccaccacccatcaaagtaatagattcaatatgctcagcgattcttggctcacgaatcaatgccgttgctacattcgtaagaggacctgtcgctacaattgttacaggtgtatcactcgtcatcactttgtttataatcacatctgatgctggcattgcaactgcttgacgtgatggtgtcgacggtagtttcggaccatctaatccagattccccatgtatttcagaagcaaaggcagctggtttaattaacggcctatccgcacctttcgctactgctatatcttggcgtcccataatatccaatacgttcaaggcgtttgtcgtattcttgtcaactgattgattacctgcgactgttgttacagctaatatctctagtggactgtcaattgcccccgctaaaattaatgctattgcatcatcgtgtcctggatcacaatccataataatctttcttttcatttatatatccacctttcttaagttgttatcgatagcttatgtatatttatttatgtggtgaatcatgtttattttgaaaaatagttttaactttctcatatttttggatacaaacactatttatctattttatggcttataaatttatccgatatgccttatcaacctacctcgctaaaaataggatgtctacatatctataccgacttttgtcaactcattttcacaacaatataaacagcaatttatatgattgttacatgattcaaacaatttttatgaaaaatattttcatacacagaatatatattgatattaaatttctcaaaagctatattgagaataattaggagggatgttgatgaaatctttatttgaaaaagcacagcagttcggcaagtcctttatgttacctatcgcaatcttaccagctgcaggtctattgttgggtatcggtggtgcattaagtaatccaaacaccgttaaagcataccctattttagatattaccttattacaaaatatttttacattaatgtcagctgcaggtagtattgttttccaaaatttaccggtcatctttgcaattggtgtcgcaatcggattatctagaagcgataaaggtactgcaggtttagctgcgctgctcggtttcttaattatgaacgcaactatgaatggcttattaactatcacgggcacattggcaaaagatcagcttgcacaaaatggacaaggcatggtgctcggtatacaaacggttgaaaccggtgtttttggcgggattatcacaggtattatgaccgcaatacttcacaacaaatatcacaaagtggtattaccaccgtatttaggtttctttggtggctctagatttgtccctattgtcacagcatttgccgcaatctttttaggtgtattgatgtttttcatttggccaagcatacaagccggcatttatcatgttggtggatttgtaacgaaaacaggtgccatcggtacttttgtttatggcttcatcttaagattgttaggtccactcggtttacaccatattttttacttaccgttttggcagacggcacttggtggtactttagaagtcaaagggcacttagttcaaggtacgcagaacatcttctttgctcaacttggtgatccagatgtgacgaagtattattcaggtgtgtcacgctttatgtcaggccgttttattacgatgatgttcggcttatgtggtgccgcacttgcaatttatcacacagctaaacctgaacataaaaaagttgtcggcggtttaatgttatccgctgcactcacttcatttttaacaggtattaccgaacctttagagtttagtttcttgtttgtcgcacctattctttatgtaatccatgccttctttgatggattagcatttatgatggcagacattttcaacattacaattggtcaaaccttcagtggaggctttatcgatttcttactctttggtgtgctacaaggtaatagtaaaacaaactacctatacgtcatacctattggaattgtgtggttctgtttgtattacatcgttttcagattcttaattacgaaatttaatttcaaaacacctggtcgagaagataaagctgcagcacaacaagttgaggctactgaaagagcacaaactattgttgctggtttgggaggcaaagataacattgaaatcgttgactgttgtgcaacgagactacgcgtcacacttcatcaaaatgacaaagtcgataaagtattactcgaaagtactggtgccaaaggtgtaatccagcaaggcactggtgtgcaagtaatttatgggcctcacgttacagttatcaaaaatgaaattgaagaattgctcggggattaagactaaccgaaatatcaacagaactaatggcaacgatgtacgaagtaagaagtgacatcgttgcttttatttttaatgttacatttgaagcattaagttcatcatgcactgtagtgagcccgcaaatcgcctctgctagacaatcatcttaatgctatgattaaagcttaagtgccagatttgaatttaatttcaacaacgactttcactacattaaaaatagggccactcgacacatatagttgtatcaaatagccctttatacaattttttgggtaaggttttacaatttttgggatggtatagattttataaaaagttatttaagttcttctgcttcagccataatatcttttaatgttttagctgaatgtgcgaacttgctttgttcttcgtcgtttaatgggatttctacgacgttgcgaataccgtttctattgatgactgctggaacaccaatataaacatcttcttcctcatattcgccttctaataatgctgatacagtcaatacggcatcttcatttctgaaaatcgcttcagtaattctagctaatcccattgcaacaccataataagtggcacctttagcttgaataatgtcatatgctgcatcacgtgtttgaacaaaaatttgttcaatttgcgctttgccctcaggacgttgttcaagtaatgtcttcaaaggttgacccgcaatattagcgtgtgaccatactggtaattcagtgtcaccatgttcaccaataatttgagcatcgacgctacgtggcgcaacatcgnacgytcgcttaacaataatctaaagcgtgcagagtctaaaattgtaccagaacctataacacgttctttaggtaaaccagagaatttccatgttgcatacgctaaaatatcaacaggatttgtagctaccaagaaaataccatcaaattttgatgccattacttcaccaacaattgatttgaatattttcaagtttttagatactaaatctaaacgtgtttctccaggtttttgtgcagcaccagcacagatgacaactagatccgcatcatgacaatcactgtattcgccagctttcacacgaactgttgttggagaatatggtgtggcatgttttaaatccataacatctcctcgaactttttcagtgtctaaatcaatgatgactaattcatcaacaatgctttggttcactaatgaaaatgcgtagcttgaacctactgcaccattacctattaatacaactttgttccctttaaatttgttcattacaaaaactcccttatgattaattcactaacatacatgtagcttcaaatatgttagtttaatgctgcttattgacgatacaaaagcaaataaacatctcttttattttcaacgcataacttaaaaggtcatgtgtcatccgcttttaagtttgtgatttatttcacatataaaatgtaacatgcattaagtactgggtcaatattaaattgtgatttatttcacattttattttaatttttacacctttttaatttgtatmcgattacatcttagatgtctttagtcttcgtacttcgccagtgattatttacactttcacatttttattatcatgtttacttttttctaggaaaacaacaatgttttttgaattagtcaaataaatgcgctcaatcgtcggtgtgcaaacagacaattgtacacaatgcttattgataagtatttaaaaaattaaaaatgtcatacaattatcaaatttgccattttatttatattttctcaaaccaattaattgaatatcgaaatttttagtagaataatcaaaatatacagattaaaggaggagtatcatgcttacagaacaagagaaagacattatcaaacaaacggtgcctttacttaaagagaaagggacagaaattacgtcaatcttttatccaaaaatgtttaaagcgcatcctgaacttttaaacatgtttaatcaaacgaaccaaaaacgaggcatgcaatcttcagcattagcacaagctgtaatggccgcagcggttaatatcgataacttaagtgttattaaaccagtcattatgccagtcgcatataaacactgcgcactacaagtttatgctgaacattatccaattgtggggaaaaatttattaaaagccattcaagacgtgacaggattagaagaaaatgaccctgtcattcaagcttgggcaaaagcatatggcgttattgcggatgtgttcatccaaattgaaaaagaaattta

SEQ ID NO: 58 - DNA, 8779 bp; double-stranded, linear
ggtattttnggangggtacctaaagcaattccggcaaagggtnaatccaggtaccgaaatggacttcccgttatcgataataccgacatatattgtgacaagtagattttatggacatttaggcttacttttacttgtgataattgcatgtatgtttactggtatttatccatcaatacatatcattcaattattgatatatgtaccgttttgttttttcttaactgcctcggtgacgttattaacatcaacactcggtgtgttagttagagatacacaaatgttaatgcaagcaatattaagaatattattttacttttcaccaattttgtggctaccaaagaaccatggtatcagtggtttaattcatgaaatgatgaaatataatccagtttactttattgctgaatcataccgtgcagcaattttatatcacgaatggtatttcatggatcattggaaattaatgttatacaatttcggtattgttgccattttctttgcaattggtgcgtacttacacatgaaatatagagatcaatttgcagacttcttgtaatatatttatatgacgaaaccccgctaaccattaataaatggaagtggggttcatttttgtttataatttaagtaaataacatattaagttggtgtattatgaacgttttaataaagaaattttatcatttggtagttcgaatactttctaaaatgattacgcctcaagtgattgataaaccgcatatcgtatttatgatgacttttccagaagatattaagcctatcatcaaagcattaaataattcgtcgtatcagaaaactgttttaacaacaccaaaacaagcgccttatttatctgaacttagcgacgatgttgatgtgatagaaatgactaatcgaacattggtaaaacaaattaaggctttgaaaagcgcgcagatgattattatcgataattattacctattgctaggtggatataataagacttctaatcaacacattgttcaaacgtggcatgcaagtggtgcattaaaaaactttggcttaacagatcatcaagtcgatgtgtctgacaaggcaatggttcagcagtaccgtaaagtttatcaagcgacggatttttacttagtgggttgtgaacaaatgtcacaatgttttaaacagtctttaggtgcaacagaagagcaaatgctgtattttgggcttccgagaattaataaatattacacagctgatagagcaacggttaaggcagagttaaaggataaatatggaattacaaataagttggtattatatgtaccaacatatagagaagataaagcagataatagggctattgataaagcttattttgaaaaatgtttaccaggatatacactgattaataaattacatccatcaattgaagattcagacattgatgacgtatcttcaatcgacacgtctacattaatgctaatgtcagatataattattagcgactatagttcgctgccaatagaagctagcttgttagatattccaactatattttatgtgtatgatgaaggaacatatgatcaggtgagaggcctgaatcaattttacaaagcaataccggatagctacaaagtgtatactgaagaagatttaataatgacgatacaagaaaaagaacatctattaagtccgttatttaaagattggcataagtataatactgataaaagtttacatcagctcacagaatatatagataagatggtgacaaaatgaggtttacgataatcatacctacatgtaataatgaggcaacaattcgacaattgttaatatctattgagagtaaagaacactatagaatcctttgtattgatggtggttctactgatcaaacaattcctatgattgaacggttacaaagagaactcaagcatatttcattaatacaattacaaaatgcttcgatagctacgtgtattaataaaggtttgatggatatcaaaatgacagatccacatgatagtgacgcatttatggtcataaaaccaacatcaatcgtattgccaggtaaattagataggttaactgctgctttcaaaaataatgataatattgatatggtaatagggcagcgagcttacaattaccatggtgaatggaaattgaaaagtgctgatgagtttattaaagacaatcgaatcgttacattaacggaacaaccagatttgttatcaatgatgtcttttgacggaaagttattcagtgctaaatttgctgaattacagtgtgacgaaactttagctaacacatacaatcacgcaatacttgtcaaggcgatgcaaaaagctacggatatacatttagtttcacagatgattgtcggagataacgatatagatacacatgctacaagtaacgatgaagattttaatagatatatcacagaaattatgaaaataagacaacgagtcatggaaatgttactattacctgaacaaaggctattatatagtgatatggttgatcgtattttattcaataattcattaaaatattatatgaacgaacacccagcagtaacgcacacgacaattcaactcgtaaaagactatattatgtctatgcagcattctgattatgtatcgcaaaacatgtttgacattataaatacagttgaatttattggtgagaattgggatagagaaatatacgaattgtggcgacaaacattaattcaagtgggcattaataggccgacttataaaaaattcttgatacaacttaaagggagaaagtttgcacatcgaacaaaatcaatgttaaaacgataacgtgtacattgatgaccataaactgcaatcctatgatgtgacaatatgaggaggataacttaatgaaacgtgtaataacatatggcacatatgacttacttcactatggtcatatcgaattgcttcgtcgtgcaagagagatgggcgattatttaatagtagcattatcaacagatgaatttaatcaaattaaacataaaaaatcttattatgattatgaacaacgaaaaatgatgcttgaatcaatacgctatgtcgatttagtcattccagaaaagggctggggacaaaaagaagacgatgtcgaaaaatttgatgtagatgtttttgttatgggacatgactgggaaggtgaattcgacttcttaaaggataaatgtgaagtcatttatttaaaacgtacagaaggcatttcgacgactaaaatcaaacaagaattatatggtaaagatgctaaataaattatatagaactatcgatactaaacgataaattaacttaggttattataaaataaatataaaacggacaagtttcgcagctttataatgtgcaacttgtccgtttttagtatgttttattttctttttctaaataaacgattgattatcatatgaacaataagtgctaatccagcgacaaggcatgtaccaccaatgatagtgaataatggatgttcttcccacatacttttagcaacagtatttgccttttgaataattggctgatgaacttctacagttggaggtccataatctttattaataaattctcttggatagtccgcgtgtactttaccatcttcgactacaagtttataatcttttttactaaaatcacttggtaaaacatcgtaaagatcattttcaacataatatttcttaccatttatcctttgctcacctttagacaatatttttacatatttatactgatcaaatgagcgttccattaatgcattccccatcatattacgttgcttctcgccaccaaggtttttatagtctcctgcacccatgataacttgattaattctaaatttacctcgtttggtagtaatcgtatggttgtaatttgctgtatcacttgatccagtttttaaaccatctgtacccggcaaactcatttttgcaccttccaatgaaaagttgaatgtgtaatacgtaactgcatgcgttgttggtgctaactgctttgtaaagtctaatattttaggtgtctctttaatcacgtgtaaatctaaaatggcatagtctctagcagtcgttacagtacgttcttggtctttatactttgttggtgcaaatgtacgtaatcttgaattttcagcacccgttggattgacgaaatgtgtatttttcattccgatagctttagctttgttattcattaaatcaacgaaatcgctggtgttttttgaaaccttcttagctaaaattaatgccgcggcattactagaattagatactgtaatttgtaataggtctgcgattgtccatacttgtccaggatatagtttcgtattactcaactcaggtagtgtagacataatatattctttgttcgtcattgtgactgtgtcatcaagtgaaagctgccccttatttacagcttccaatgttaagtacattgtcattaatttagtcatagacgctggattccacttagtatcgatattgtattgatacagtaattgtccagtttgacttacattaacagcactcgtcggttcgtatgcagccgacaaacctgcataaccatattgatttgctgcttgtacaggggttacgtcactgttagtagcttgtgcatatggtgtcataatacttaatgttaaacataaaatgatgataatagatattaaatttttcataaagcgttaatcttcccttttccaattcttaaatattccctaaaagcaatggttattcctacttacggaaatcattgctaattcacttcaccttaattaaattgttgaaaataaagttttctgcagttaatttgaaaaataatgcaaatatattacgtgtgtagctaaaggtgttataatgtttgtacgaagagcaaacttactcaaaagcgattaattttcatgttttaatataaagactttgagaagttattacaaaaaatgcaatagaaatattctatcatataaatgttatgagcggtattttggggcaacactttatttgatttttaaagttttgttgggagaaagtatatgatagaaatgcatgtatctatctaaatgaattaactataaatttcaaacagaagaggtaaaactatgaaacgagaaaatccattgtttttcttatttaaaaaactatcatggccagtgggtcttatcgttgcagctatcactatttcatcactagggagcttaagtggactattagtgccactgtttactggacgaattgtagataaattttccgtgagccatatcaattggaatctaatcgcattatttggtggtatctttgtcatcaatgctttattaagcggattaggtttatatttattaagtaaaattggtgaaaagattatttatgcgatacgctcagttttatgggagcatatcatacaattaaaaatgccattctttgacaaaaatgaaagtggtcaattaatgagtcgattaactgacgatacgaaagtgataaatgaatttatttcacaaaagctacctmacttattaccatcaatcgttacattagttgggtcactaatcatgttatttattttagattggaaaatgacattattaacatttataacgataccgatattcgttttaattatgattcctctaggtcgtattatgcaaaagatatcgacaagtacacaatctgaaattgcaaacttcagtggtttgttagggcgtgtcctaactgaaatgcgtcttgttaaaatatcaaatacagagcgtcttgaattagataatgcacataaaaatttgaatgaaatatataaattaggtttaaaacaggctaaaattgcggcagttgtacaaccaatttcaggtatagttatgttgctaacaattgcaattattttaggttttggtgcattagaaattgcgactggtgcaatcactgcaggtacattaattgcaatgatattttatgttattcagttatctatgcctttaatcaatctttccacgttagttacagattataaaaaggcagtcggtgcaagtagtagaatatacgaaatcatgcaagaacctattgaaccgacagaagctcttgaagattctgaaaatgtattaattgatgacggtgtattgtcatttgaacatgtagactttaaatatgatgtgaagaaaatattagatgatgtgtcgttccaaatcccacaaggtcaagtgagtgcttttgtaggcccttctgggtctggtaaaagtacgatatttaatctgatagaacgtatgtatgaaattgagtcaggtgatattaaatatggccttgaaagtgtctatgatatcccgttatctaagtggcgacgcaaaattggatatgttatgcaatcaaattcgatgatgagtggtacaattagagacaatattttatacggaattaatcgtcatgtttcagatgaagaacttattaattatgctaaattagcgaactgtcatgattttatcatgcaatttgatgaaggatatgacacgcttgtaggtgaacgaggattgaaactgtctggcggacaacgtcaacgtattgatattgctagaagttttgttaaaaatcctgatattttgttacttgatgaagcaacagctaatctcgatagtgaaagtgaattgaaaattcaagaagctttagaaacattgatggaaggtagaacaacgattgtcattgcgcatcgtttgtctacaattaaaaaagccggtcaaattatattcttagacaaaggacaggtaacaggtaaaggtacgcattcagaactgatggcatcacatgcgaagtataaaaactttgtagtgtctcaaaaattaacagattaattttatatatataagtaagcttggagcaaatacacatataccatcgaggaaattaaagtgtggcacattgatggatatagatgttaataaattgcttcaagcttttgtctattttaaatcatttgagaagttacgacataataattcttaaattaatgaaatcgatattttaagaaaaaaatgctcatggtataatacaagttataagcaaacatacatatattaaatactgtagccacgagtcataattcttcatattttacatagcaatttaactgattttagagtccacggtacagaagtttgatatttcaatgtttctaaatttttaaaaaattaaatcataggtgggtgccaaatgtttttattaatcaacattattggtctaattgtatttcttggtattgcggtattattttcaagagatcgcaaaaatatccaatggcaatcaattgggatcttagttgttttaaacctgtttttagcatggttctttatttattttgattggggtcaaaaagcagtaagaggagcagccaatggtatcgcttgggtagttcagtcagcgcatgctggtacaggttttgcatttgcaagtttgacaaatgttaaaatgatggatatggctgttgcagccttattcccaatattattaatagtgccattatttgatatcttaatgtactttaatattttaccgaaaattattggaggtattggttggttactagctaaagtaacaagacaacctaaattcgagtcattctttgggatagaaatgatgttcttaggaaatactgaagcattagccgtatcaagtgagcaactaaaacgtatgaatgaaatgcgtgtattaacaatcgcaatgatgtcaatgagctctgtatcgggagctattgtaggtgcgtatgtacaaatggtaccaggagaactggtactaacggcaattccactaaatatcgttaacgcgattattgtgtcatgcttgttgaatccagtaagtgttgaagagaaagaagatattatttacagtcttaaaaacaatgaagttgaacgtcaaccattcttctcattccttggagattctgtattagcagcaggtaaattagtattaatcatcatcgcatttgttattagttttgtagcgttagctgatctatttgatcgttttatcaatttgattacaggattgatagcaggatggataggcataaaaggtagtttcggtttaaaccaaattttaggtgtgtttatgtatccatttgcgctattactcggtttaccttatgatgaagcgtggttggtagcacaacaaatggctaagaaaattgttacaaatgaatttgttgttatgggtgaaatttctaaagatattgcatcttatacaccacaccatcgtgcggttattacaacattcttaatttcatttgcaaacttctcaacgattggtatgattatcggtacattgaaaggcattgttgataaaaagacatcagactttgtatctaaatatgtacctatgatgctattatcaggtatcctagtttcattattaacagcagctttcgttggtttatttgcatggtaatatgtcgaagagtgactatgataatacattttaactaataaatatgtccaggcatgtcgtctattgatataggtgagatgcttggacttttttattattgatataaaggtatntaaatatttttaaagttaccgaaattgaagcattataaaaaccaagtgcacatggtaatacacttggcttttatgggaaatgaatattattgtacatatgacagtaaggactaggtacagtcatagtacttcgagcaaaatttgttttgttattataaacaacacaaaggagataacttctctantgaagaagttaaaaacattatagcagacaatgaaatgaaagtaaattaaaaat

SEQ ID NO: 59 - DNA, 31096 bp; double-stranded, linear
gttgcagtagtcaaagaattaaacaaggtgaaggcgtgtagcttgcacacccgaaaatgtgcgtaagttaacggatgcaggacataaagtaattgttgaaaaaaatgctggcattggttcaggattttctaacgatatgtatgaaaaagaaggcgctaagatcgtaactcacgaacaagcatgggaagctgatcttgttatcaaagtaaaagaacctcatgaaagcgaatatcaatatttcaaaaagaatcaaattatctggggatttttacatctagcatcttcaaaagaaatagtagaaaaaatgcaagaagttggtgtaactgcgattagtggtgaaaccattataaaaaatggaaaagcagaattattagcgccaatgagtgctatagcaggtcaacgctcagcaattatgggagcttactactctgaagcacaacatggtggtcaaggtactttagtgactggtgtacatgaaaatgtggatatacctggtagtacatatgtgattttcggtggtggagtagcagcaacaaatgcagcaaatgttgccttgggactaaatgctaaagtaatcattatcgagttaaacgatgaccgcattaaatatcttgaagatatgtatgcagaaaaagatgtcacagtagtcaaatcaacaccagaaaatttagcagaacaaattaagaaagcagatgtatttatttctacaattttaatttcaggtgcgaaaccgccaaaattggttactcgtgagatggttaaatcaatgaaaaaaggttcagtattaatcgatatagctattgaccaaggtggaactattgaaacaattagaccaactacaatttctgatccagtgtatgaagaagaaggtgtgattcattatggtgtaccaaatcaaccaggagcagtcccaagaacttcaacaatggcattagcacaaggaaatattgattatatattagaaatttgtgacaaaggcttagaacaagcaattaaagataatgaagccttaagtactggtgtaaacatttaccaaggacaagtgacaaatcaaggattagcttcatcacatgacctagattataaagaaatattaaatgttatcgaatagatagtaatttaaatgaaattgagtgaaatgaatattttaaatatagcattatagtttggactaaaaatttacaaaacggaaggatgtaattattatgacaaccaacacagttacattacaaacagcacatattgtaagtttaggagatatcgaagaagctaaagcaagcattaaaccatttattcgtcgaacacctctaattaaatcaatgtatttaagccaaagtataactaaagggaatgtatttctaaaattagaaaatatgcaattcacaggatcttttaaatttagaggcgctagcaatnaaaattaatcacttaacagatgaacaaaaagaaaaaggcattatcgcagcatctgctggggaaccatgcacaaggtgttgctttaacagctaaattattaggcattgatgcaacgattgtaatgcctgaaacagcaccacaagcgaaacaacaagcaacaaaaggctatggggcaaaggttattttaaaaggtaaaaactttaacgaaactagactttatatggaagaattagcgaaagaaaatggcatgacaatcgttcatccatatgacgataagtttgtaatggcaggccaaggaacaattggtttagaaattttagatgatatttggaatgtgaatacagtcatcgtaccagttggcggtggaggattaattgcaggtattgccaccgcattaaaatcatttaacccttcaattcatattatcggtgttcaatctgagaatgttcatggtatggctgagtctttctataagagagatttaactgaacatcgagtggatagcacaatagcagatggttgtgatgtaaaagttcctggtgaacaaacatatgaagtagttaaacatttagtagatgaatttattcttgttactgaagaagaaattgaacatgctatgaaagatttaatgcagcgtgccaaaattattactgaaggtgcaggcgcattaccaacagctgcaattttaagtggaaaaataaacaataaatggcttgaagataaaaatgttgttgcattagtttcaggcgggaatgttgacttaactagagtttcaggtgtcattgaacatggactgaatattgcagatacaagcaagggtgtggtaggttaaaacatttaatcttaaaaatgaggtgtaattatgtcaaatggtaaagaattacaaaaaaatataggtttcttctcagcgtttgctattgttatggggacagttattggttcaggagtattctttaaaatatcaaacgtaacagaagtaacaggaacagcaggaatggccttgtttgtatggttcctaggcggcatcattaccatttgtgcggggttaacagcagcagaacttgctgctgcaatccctgaaacaggtggcttaacgaagtatatagaatatacatacggtgatttctggggcttcctatcaggttgggcgcaatcatttatttattttccagctaacgtagcagcattgtctatcgtatttgcgacacagctaattaatttattccatttatctataggttcgttaataccaatagcaatcgcatctgcgttatctattgtgttgataaatttcctaggttcaaaagcaggcggaattttacaatcagttactttagtaattaaactgattccaatcatcgttattgtaatttttggtatttttcaatctggagatatcactttttcattaattccaactacaggtaattcaggaaatggcttctttacagcaattggtagtggtttattagcaactatgtttgcatatgatggttggattcatgtaggaaatgttgcgggggaacttaaaaatcctaaacgcgatttacctttagcgatttcagttggtatcggttgtattatggctgtgtatttattaattaacgctacattcttattaacgttgccaatagaactacttgctggtaatttaaatgcagcttcagatacatcaaaaatattatttggtgaaaatggcggtaagattattacaatcggtatattaatttctgtttatggtacgatcaatggctatactatgactggtatgcgcgtaccatatgcaatggctgaaagaaaattattgccatttagccatttattcgcaaaattaacaaaatctggcgcaccatggtttggcgcaattatacaacttataatcgctatcatcatgatgtcaatgggagcatttgatacaattacaaatatgttaatctttgttatttggttgttctattgtatgtcatttgttgcggtaataattttaagaaaacgtgaaccaaatatggaacgaccatataaagtaccgttatatccgatcatacctttaattgctattttggcaggatcatttgtattaattaatacactgtttacacaatttatattagcaatcattggaattctaataacagcacttggtataccagtttattactataaaaagaaacaaaaagcagcataaggtaagataactagcattgagaataaatggatggactactaataaatttaaagttttacacattaaaatcaaaaaccattcaattattctatggaacagacaaatttctgttatggaatttgtctgtttttcaaaagtatagggaggcaaatagagatggaaaagccgtcaagagaggcatttgaaggcaataataagttgttaataggaattgttctaagtgtaataacgttttggctatttgcacaatcattggttaatgttgtaccaatacttgaagatagtttcaatacagatattggaacggttaatatcgccgttagtataactgctttattttcaggaatgtttgtagtaggagcaggtggtcttgctgataaatatggcagaattaaactcacgaacattggtattatcttaaatatattaggttcattattaatcattatttcaaatattcctttattacttattataggaagattaattcaaggactttcagcagcatgtattatgcctgcaactttgtctattattaagtcatattacattgggaaagatagacaacgcgctttaagttattggtcaattggctcatggggcggctctggtgtttgttcattttttggaggtgcagttgcaacgcttttaggttggcgttggattttcatcctatcaattataatttcattaattgcactgtttcttattaaaggcacacctgaaactaaatctaaatcgatttctctaaataaatttgacattaaaggtctggttcttttagtcattatgctcctcagtttaaatattttaattactaaaggatcagaattaggtgtaacctcacttctttttattactttattagctattgcaattggatcttttagtttatttatagttcttgaaaagcgtgctacaaatcctttaatcgattttaaattatttaaaaataaagcttacacaggtgcaacagcttcaaactttttgttaaatggtgttgcaggaacattaatagtagccaacacatttgttcaaagaggtttaggatattcttcattgcaagcaggaagtttatcaatcacttatttagtaatggtactaattatgattcgtgttggtgaaaagttacttcaaacactcggatgcaagaaaccaatgttaattggaacaggagttcttattgtcggagaatgtctcatttcattaactttcttgccagaaatattctatgtcatttgttgtattataggttatttattctttggtttaggactagggatatatgctacaccatcaacagatacagcaattgcaaatgcaccgttagaaaaagtaggcgttgctgcaggtatctataaaatggcttctgcattaggtggagcatttggcgtcgcattgagtggtgcagtatatgcaatcgtatcaaatatgacaaacatttatacaggtgcaatgattgncattatggttaaatgcaggtatgggaatattatcattcgttatcattttgttacttgtgcctaaacmaaacgacactcaattatgataattgagaattaaattgaaatcatacaagtcgctacaatattaaacaaaaatataaaccgattcttatgtgtcattattttaaatgaacatagggattggttttttattactcttttacgctactttatttataattattataaattgtcacaaattcaatttaccttacaatatattttgtgttattatattctggagcataaataaattgttcaacacatagttgtaatgtgtttcaatactttttggatagattgcgaaattgtattgaatcgtcatcgttttaaatttttaaatgagaatggaatgagcattacaatacacaagcaatcaaaagtaaatacattcacaacacaacagagacataacaacaagataaggagtgaacaatagctgtgaattatcgtgataaaattcaaaagtttagtattcgtaaatatacagttggtacattttcaactgtcattgcgacattggtatttttaggattcaatacatcacaagcacatgctgctgaaacaaatcaaccagcaagcgtggttaaacagaaacaacaaagtaataatgaacagactgagaatcgagaatctcaagtacaaaattctcaaaattcacaaaatggtcaatcattatctgctactcatgaaaatgagcaaccaaatattagtcaagctaatttagtagatcaaaaagtagcgcaatcatctactactaatgatgaacaaccagcatctcaaaatgtaaatacaaagaaagattcggcaacggctgcgacaacacaaccagataaagaacaaagtaagcataaacaaaacgaaagtcaatctgctaataaaaatggaaacgacaatagagcggctcatgtagaaaatcatgaagcaaatgtagtaacagcttcagattcatctgataatggtaacgtacaacatgaccgaaatgaattacaagcgttttttgatgcaaattatcatgattatcgctttattgaccgtgaaaatgcagattctggcacatttaactatgtaaaaggcatttttgataagattaatacgttattaggcagtaatgatccaataaacaataaagacttgcaacttgcatacaaagaattggaacaagctgttgctttaattcgtacaatgcctcaacgtcaacagactagccgacgttcaaatagaattcaaacgcgttcggttgagtcaagagctgcagagcctagatcagtatcagactatcaaaatgcaaattcatcatattatgttgaaaatgctaatgatggttcgggctatcctgttggtacatatatcaatgcttctagtaaaggggcgccatataatttaccaactacaccatggaatacattgaaggcctctgactcaaaggaaattgctcttatgacagcgaaacaaactggagacgggtaccaatgggttattaagtttaataaaggacatgctccacatcaaaatatgatcttttggtttgcattaccagcagaccaagtgccagtaggaagaactgactttgtaacagttaattcagatggaacaaatgtacaatggagtcatggagcaggagcaggtgcaaataaaccacttcaacaaatgtgggaatatggagtaaatgatcctcatcgttcacatgactttaaaataagaaatagaagtggccaagtaatatatgactggccaactgtccatatttattctttagaagatttatctagagcgagtgattattttagtgaagctggagcgacacctgctactaaagcttttggtagacaaaattttgaatatattaatggtcaaaaacctgctgaatcaccgggtgttcctaaagtttatactttcatcggtcaaggtgatgcaagttatacaatttcatttaaaacacaaggtccaactgttaataaattgtactatgcagcaggtgggcgtgctttagagtacaatcaattatttatgtacagtcaactatacgtcgaatcaacgcaagaccatcaacaacgtcttaatggtttaagacaagtggttaatcgtacatatcgcataggtacaactaaacgtgtagaagtgagtcaaggaaatgtacaaacgaaaaaggtattagaaagtacaaacctaaatatagatgattttgttgatgatcctttaagttatgttaagacgccgagtaataaagtgttaggattttattcgaataatgcaaatactaatgcttttagaccgggtggagcccaacaattaaatgaatatcaattaagtcaattatttactgatcaaaaattacaagaagcagcaagaactagaaacccaataagattaatgattggtttcgactatcctgatgcttatggtaatagtgaactttagttcctgttaacttaacggtattacctgaaatccaacataatattaaattctttaaaaatgacgatactcaaaatattgctgaaaaaccattttcaaaacaagctgggcatccagttttctatgtatatgcaggtaaccaagggaatgcttccgtgaatttaggtggtagcgtaacatctattcaaccattacgtattaatttaacaagtaatgagaattttacagataaagattggcaaattacaggtattccgcgtacattacacattgaaaactcgacaaatagacctaataatgccagagaacgcaatattgaacttgttggtaacttattaccaggggattactttggaacgatacgttttggacgtaaagaacaattattcgaaattcgtgttaaaccacatacaccaacaattacaacgacagctgagcaattaagaggtacagcattacaaaaagtgcctgttaatatttcgggaataccgttggatccatcggcattggtttatttagttgcaccaacaaatcaaactacgaatggtggtagtgaggcagatcaaataccatctggttatacgatacttgcgactggtacacctgatggggtgcataatacaattactatacgaccgcaagattatgttgtattcataccacctgtaggtaaacaaattagagcagtagtttattataataaagtagttgcatctaatatgagtaatgctgttactattttgccagatgacattccaccaacaatcaataatcctgttggaataaatgccaaatactatcgaggcgacgaakcaactttacaatgggtgtctctgatagacattctggtataaaaaatacaactattacgacattgccgaatggttggacatcaaatttaacaaaagcggataagaataatggctcattatctattacaggtagagtgagtatgaatcaggcatttaacagtgatattacatttaaagtgtcagcgacagacaatgtcaataatacgacaaatgatagtcaatctaaacatgtttcaattcatgtaggtaaaattagtgaagatgctcatccgattgtattaggaaatactgagaaagttgtagtagtcaatccgactgctgtatctaatgatgaaaagcaaagcataattactgcctttatgaataaaaaccaaaatataagaggatatttagcatcaactgatccagtaactgtcgataataatggtaatgtcacattacattaccgtgatggctcatcgacaacgcttgatgctacaaatgtgatgacatacgaaccagttgtgaaacctgaataccaaactgtcaatgctgctaaaacagcaacggtaacgattgctaaaggacaatcatttagtattggtgatattaaacaatattttactttaagtaatggacaacctattccaagtggcacatttacaaatattacatctgatagaactattccaactgcacaagaagttagtcaaatgaacgcaggcacgcagttataccatataactgctacaaatgcgtatcataaagatagtgaagacttctatattagtttgaaaatcatcgatgtgaaacaaccagaaggcgatcaacgtgtatatcgtacatcaacatatgatttaactactgatgaaatctcaaaagtaaaacaagcatttattaatgcaaatagagatgtaattacgcttgccgaaggtgatatttcagttacaaatacacctaatggtgctaatgtaagtactattacagtaaatattaataaaggtcgattaacgaaatcattcgcgtcaaacctagctaatatgaatttcttgcgttgggttaatttcccacaagattatacagtgacatggacgaatgcaaaaattgcaaacagaccaacagatggtggtttatcatggtctgatgaccataaatctttaatttatcgttatgatgctacattaggtactcaaattacgacgaatgatattttaacaatgttaaaagcaacaactacagtgcctggattgcgaaataacattactggtaatgaaaaatcacaagcagaagctggcggaagacctaactttagaacgactggttattcacaatcaaatgcgacaactgatggtcaacgtcaatttacgttgaatggtcaagtgattcaagtgttagacatcatcaacccttcaaacggttatggtgggcaacctgttacaaattcaaatactcgtgcaaaccatagtaactcaactgttgttaacgtaaacgaaccggcagctaatggtgctggcgcatttacaattgaccacgttgtaaaaagtaattctacacataatgcaagtgatgcagtttataaagcacagttatacttaacgccatatggtccaaaacaatatgttgaacatttaaatcaaaatacaggaaatactactgacgctattaacatttattttgtaccaagtgacttagtgaatccaacaatttcagtaggtaattacactaatcatcaagtgttctcaggtgaaacatttacaaatactattacagcgaatgataactttggtgtgcaatctgtaactgtaccaaatacatcacaaattacaggtactgttgataataaccatcaacatgtttctgcaacggcaccaaatgtgacatcagcaactaataagacaatcaatttattagcaactgatacaagcggcaatacagctacaacttcgttcaatgtaacagtgaaacctttgcgtgataaatatcgagttggtacttcatcaacggctgctaatcctgtgagaattgccaatatttcgaataatgcgacagtatcacaagctgatcaaacgacaattattaattcgttaacgtttactgaaacagtaccaaatagaagttatgcaagagcaagtgcgaatgaaatcactagtaaaacagttagtaatgtcagtcgtactggaaataatgccaatgtgcacagtaactgttacttatcaagatggaacaacatcaacagtgactgtacctgtaaagcatgtcattccagaaatcgttgcacattcgcattacactgtacaaggccaagacttcccagcaggtaatggttctagtgcatcagattactttaagttatctaatggtagtgacattgcagatgcaactattacatgggtaagtggacaagcgccaaataaagataatacacgtattggtgaagatataactgtaactgcacatatcttaattgatggcgaaacaacgccgattacgaaaacagcaacatataaagtagtaagaactgtaccgaaacatgtctttgaaacagccagaggtgttttatacccaggtgtttcagatatgtatgatgcgaaacaatatgttaagccagtaaataattcttggtcgacaaatgcgcaacatatgaatttccaatttgttggaacatatggtcctaacaaagatgttgtaggcatatctactcgtcttattagagtgacatatgataatagacaaacagaagatttaactattttatctaaagttaaacctgacccacctagaattgacgcaaactctgtgacatataaagcaggtcttacaaaccaagaaattaaagttaataacgtattaaataactcgtcagtaaaattatttaaagcagataatacaccattaaatgtcacaaatattactcatggtagcggttttagttcggttgtgacagtaagtgacgcgttaccaaatggcggaattaaagcaaaatcttcaatttcaatgaacaatgtgacgtatacgacgcaagacgaacatggtcaagttgttacagtaacaagaaatgaatctgttgattcaaatgacagtgcaacagtaacagtgacaccacaattacaagcaactactgaaggcgctgtatttattaaaggtggcgacggttttgatttcggacacgtagaaagatttattcaaaacccgccacatggggcaacggttgcatggcatgatagtccagatacatggaagaatacagtcggtaacactcataaaactgcggttgtaacattacctaatggtcaaggtacgcgtaatgttgaagttccagtcaaagtttatccagttgctaatgcaaaggcgccatcacgtgatgtgaaaggtcaaaatttgactaatggaacggatgcgatgaactacattacatttgatccaaatacaaacacaaatggtatcactgcagcatgggcaaatagacaacaaccaaataaccaacaagcaggcgtgcaacatttaaatgtcgatgtcacatatccaggtatttcagctgctaaacgagttcctgttactgttaatgtatatcaatttgaattccctcaaactacttatacgacaacggttggaggcactttagcaagtggtacgcaagcatcaggatatgcacatatgcaaaatgctactggtttaccaacagatggatttacgtataaatggaatcgtgatactacaggtacaaatgacgcaaactggtcagctatgaataaaccgaatgtggctaaagtcgttaacgcaaaatatgacgtcatctataacggacatacttttgcaacatctttaccagcgaaatttgtagtaaaagatgtgcaaccagcgaaaccaactgtgactgaaacagcggcaggagcgattacaattgcacctggagcaaaccaaacagtgaatacacatgccggtaacgtaacgacatacgctgataaattagttattaaacgtaatggtaacgttgtgacgacatttacacgtcgcaataatacgagtccatgggtgaaagaagcatctgcagcaactgtagcaggtattgctggaactaataatggtattactgttgcagcaggtactttcaaccctgctgatacaattcaagttgttgcaacgcaaggaagcggagagacagtgagtgatgagcaacgtagtgatgatttcacagttgtcgcaccacaaccgaaccaagcgactactaagatttggcaaaatggtcatattgatatcacgcctaataatccatcaggacatttaattaatccaactcaagcaatggatattgcttacactgaaaaagtgggtaatggtgcagaacatagtaagacaattaatgttgttcgtggtcaaaataatcaatggacaattgcgaataagcctgactatgtaacgttagatgcacaaactggtaaagtgacgttcaatgccaatactataaaaccaaattcatcaatcacaattactccgaaagcaggtacaggtcactcagtaagtagtaatccaagtacattaactgcaccggcagctcatactgtcaacacaactgaaattgtgaaagattatggttcaaatgtaacagcagctgaaattaacaatgcagttcaagttgctaataaacgtactgcaacgattaaaaatggcacagcaatgcctactaatttagctggtggtagcacaacgacgattcctgtgacagtaacttacaatgatggtagtactgaagaagtacaagagtccattttcacaaaagcggataaacgtgagttaatcacagctaaaaatcatttagatgatccagtaagcactgaaggtaaaaagccaggtacaattacgcagtacaataatgcaatgcataatgcgcaacaacaaatcaatactgcgaaaacagaagcacaacaagtgattaataatgagcgtgcaacaccacaacaagtttctgacgcactaactaaagttcgtgcagcacaaactaagattgatcaagctaaagcattacttcaaaataaagaagataatagccaattagtaacgtctaaaaataacttacaaagttctgtgaaccaagtaccatcaactgctggtatgacgcaacaaagtattgataactataatgcgaagaagcgtgaagcagaaactgaaataactgcagctcaacgtgttattgacaatggcgatgcaactgcacaacaaatttcagatgaaaaacatcgtgtcgataacgcattaacagcattaaaccaagcgaaacatgatttaactgcagatacacatgccttagagcaagcagtgcaacaattgaatcgcacaggtacaacgactggtaagaagccggcaagtattactgcttacaataattcgattcgtgcacttcaaagtgacttaacaagtgctaaaaatagcgctaatgctattattcaaaagccaataagaacagtacaagaagtgcaatctgcgttaacaaatgtaaatcgtgtcaatgagcgattaacgcaagcaattaatcaattagtacctttagctgataatagtgctttaaaaactgctaagacgaaacttgatgaagaaatcaataaatcagtaactactgatggtatgacacaatcatcaatccaagcatatgaaaatgctaaacgtgcgggtcaaacagaatcaacaaatgcacaaaatgttattaacaatggtgatgcgactgaccaacaaattgccgcagaaaaaacaaaagtagaagaaaaatataatagcttaaaacaagcaattgctggattaactccagacttggcaccattacaaactgcaaaaactcagttgcaaaatgatattgatcagccaacgagtacgactggtatgacaagcgcatctattgcagcatttaatgaaaaactttcagcagctagaactaaaattcaagaaattgatcgtgtattagcctcacatccagatgttgcgacaatacgtcaaaacgtgacagcagcgaatgccgctaaatcagcacttgatcaagcacgtaatggcttaacagtcgataaagcgcctttagaaaatgcgaaaaatcaactacaacatagtattgacacgcaaacaagtacaactggtatgacacaagactctataaatgcatacaatgcgaagttaacagctgcacgtaataagattcaacaaatcaatcaagtattagcaggttcaccgactgtagaacaaattaatacaaatacgtctacagcaaatcaagctaaatctgatttagatcatgcacgtcaagctttaacaccagataaagcgccgcttcaaactgcgaaaacgcaattagaacaaagcattaatcaaccaacggatacaacaggtatgacgaccgcttcgttaaatgcgtacaaccaaaaattacaagcagcgcgtcaaaagttaactgaaattaatcaagtgttgaatggcaacccaactgtccaaaatatcaatgataaagtgacagaggcaaaccaagctaaggatcaattaaatacagcacgtcaaggtttaacattagatagacagccagcgttaacaacattacatggtgcatctaacttaaaccaagcacaacaaaataatttcacgcaacaaattaatgctgctcaaaatcatgctgcgcttgaaacaattaagtctaacattacggctttaaatactgcgatgacgaaattaaaagacagtgttgcggataataatacaattaaatcagatcaaaattacactgacgcaacaccagctaataaacaagcgtatgataatgcagttaatgcggctaaaggtgtcattggagaaacgactaatccaacgatggatgttaacacagtgaaccaaaaagcagcatctgttaaatcgacgaaagatgctttagatggtcaacaaaacttacaacgtgcgaaaacagaagcaacaaatgcgattacgcatgcaagtgatttaaaccaagcacaaaagaatgcattaacacaacaagtgaatagtgcacaaaacgtgcaagcagtaaatgatattaaacaaacgactcaaagcttaaatactgctatgacaggtttaaaacgtggcgttgctaatcataaccaagtcgtacaaagtgataattatgtcaacgcagatactaataagaaaaatgattacaacaatgcatacaaccatgcgaatgacattattaatggtaatgcacaacatccagttataacaccaagtgatgttaacaatgctttatcaaatgtcacaagtaaagaacatgcattgaatggtgaagctaagttaaatgctgcgaaacaagaagcgaatactgcattaggtcatttaaacaatttaaataatgcacaacgtcaaaacttacaatcgcaaattaatggtgcgcatcaaattgatgcagttaatacaattaagcaaaatgcaacaaacttgaatagtgcaatgggtaacttaagacaagctgttgcagataaagatcaagtgaaacgtacagaagattatgcggatgcagatacagctaaacaaaatgcatataacagtgcagtttcaagtgccgaaacaatcattaatcaaacaacaaatccaacgatgtctgttgatgatgttaatcgtgcaacttcagctgttacttctaataaaaatgcattaaatggttatgaaaaattagcacaatctaaaacagatgctgcaagagcaattgatgcattaccacatttaaataatgcacaaaaagcagatgttaaatctaaaattaatgctgcatcaaatattgctggcgtaaatactgttaaacaacaaggtacagatttaaatacakcgatgggtaacttgcaaggtgcaatcaatgatgaacaaacgacgcttaatagtcaaaactatcaagatgcgacacctagtaagaaaacagcatacacaaatgcggtacaagctgcgaaagatattttaaataaatcaaatggtcaaaataaaacgaaagatcaagttactgaagcgatgaatcaagtgaattctgctaaaaataacttagatggtacgcgtttattagatcaagcgancaaacagcaaaacagcagttaaataatatgacgcatttaacaactgcacaaaaaacgaatttaacaaaccaaattaatagtggtactactgtcgctggtgttcaaacggttcaatcaaatgccaatacattagatcaagccatgaatacgttaagacaaagtattgccaacaaagatgcgactaaagcaagtgaagattacgtagatgctaataatgataagcaaacagcatataacaacgcagtagctgctgctgaaacgattattaatgctaatagtaatccagaaatgaatccaagtacgattacacaaaaagcagagcaagtgaatagttctaaaacggcacttaacggtgatgaaaacttagctgctgcaaaacaaaatgcgaaaacgtacttaaacacattgacaagtattacagatgctcaaaagaacaatttgattagtcaaattactagtgcgacaagagtgagtggtgttgatactgtaaaacaaaatgcgcaacatctagaccaagctatggctagcttacagaatggtattaacaacgaatctcaagtgaaatcatctgagaaatatcgtgatgctgatacaaataaacaacaagagtatgataatgctattactgcagcgaaagcgattttaaataaatcgacaggtccaaacactgcgcaaaatgcagttgaagcagcattacaacgtgttaataatgcgaaagatgcattgaatggtgatgcaaaattaattgcagctcaaaacgcagcgaaacaacatttaggtactttaacgcatatcactacagctcaacgtaatgatttaacaaatcaaatttcacaagctacaaacttagctggtgttgaatctgttaaacaaaatgcgaatagtttagatggtgctatgggtaacttacaaacggctatcaacgataagtcaggaacattagcgagccaaaacttcttggatgctgatgagcaaaaacgtaatgcatacaatcaagctgtatcagcagccgaaaccattttaaataaacaaactggaccgaatacagcgaaaacagcagtcgaacaagcacttaataatgttaataatgcgaaacatgcattaaatggtacgcaaaacttaaacaatgcgaaacaagcagcgattacagcaatcaatggcgcatctgatttaaatcaaaaacaaaaagatgcattaaaagcacaagctaatggtgctcaacgcgtatctaatgcacaagatgtacagcacaatgcgactgaactgaacacggcaatgggcacattaaaacatgccatcgcagataagacgaatacgttagcaagcagtaaatatgttaatgccgatagcactaaacaaaatgcttacacaactaaagttaccaatgctgaacatattattagcggtacgccaacggttgttacgacaccttcagaagtaacagctgcagctaatcaagtaaacagcgcgaaacaagaattaaatggtgacgaaagattacgtgaagcaaaacaaaacgccaatactgctattgatgcattaacacaattaaatacacctcaaaaagctaaattaaaagaacaagtgggacaagccaatagattagaagacgtacaaactgttcaaacaaatggacaagcattgaacaatgcaatgaaaggcttaagagatagtattgctaacgaaacaacagtcaaaacaagtcaaaactatacagacgcaagtccgaataaccaatcaacatataatagcgctgtgtcaaatgcgaaaggtatcattaatcaaactaacaatccgactatggatactagtgcgattacccaagctacaacacaagtgaataatgctaaaaatggtttaaacggtgctgaaaacttaagaaatgcacaaaacactgctaagcaaaacttaaatacattatcacacttaacaaataaccaaaaatctgccatctcatcacaaattgatcgtgcaggtcatgtgagtgaggtaactgctactaaaaatgcagcaactgagttgaatacgcaaatgggtaacttggaacaagctatccatgatcaaaacacagttaaacaaagtgttaaatttactgatgcagataaagctaaacgtgatgcgtatacaaatgcggtaagcagagctgaagcaattctgaataaaacgcaaggtgcaaatacgtctaaacaagatgttgaagcggctattcaaaatgtttcaagtgctaaaaatgcattgaatggtgatcaaaacgttacaaatgcgaagaatgcagctaaaaatgcattaaataacttaacgtcaattaataatgcacaaaaacgtgacttaacaactaaaattgatcaagcaacaactgtagctggtgttgaagctgtatctaatacgagtacacaattgaatacagcgatggctaacttgcaaaatggtattaatgataaaacaaatacactagcaagtgaaaactatcatgatgctgattcagataagaaaactgcttatactcaagccgttacgaacgcagaaaatattttaaataaaaatagtggatcaaatttagacaaaactgccgttgaaaacgcgttgtcacaagttgctaatgcgaaaggtgccctaaatggtaaccataatttagagcaagctaaatcaaatgcaaacactactataaacggacttcaacatttaacaactgctcaaaaagataaattgaaacaacaagtgcaacaagcacaaaatgttgcaggtgtagatactgttaaatcaagtgccaacacattaaatggtgctatgggtacgttaagaaatagcatacaagataacacagctacgaaaaatggccaaaactatcttgatgctacagaacgtaacaaaacaaactataacaatgctgttgatagtgctaatggtgtcattaatgcaacaagcaatccaaatatggatgctaatgcaattaaccaaatcgctacacaagtgacatcaacgaaaaatgcattagatggtacacataatttaacgcaagcgaaacaaacagcaacaaatgccatcgatggtgctactaacttaaataaagcgcaaaaagatgcgttaaaagcacaagttacaagtgcgcaacgtgttgcaaatgtaacaagtatccaacaaactgcaaatgaacttaatacagctatgggtcaattacaacatggtattgatgatgaaaatgcaacaaaacaaactcaaaaatatcgtgacgctgaacaaagtaagaaaactgcttatgatcaagctgtagctgctgcgaaagcaattttaaataaacaaacaggttcaaattcagataaagcagcagttgaccgtgcattacaacaagtaacaagtacgaaagatgcattgaatggtgatgcaaaactggcagaagcgaaagcggcagctaaacaaaacttaggcactttaaaccatattacgaatgcacaacgtactgacttagaaggccaaatcaatcaagcgacgactgttgatggcgttaatactgtaaaaacaaatgccaatacattagacggcgcaatgaatagcttacaaggttcaatcaatgataaagatgcgacattaagaaatcaaaattatcttgatgcggatgaatcaaaacgaaatgcatatacgcaagctgtcacagcggctgaaggcattttaaataaacaaactggtggtaacacatctaaagcagacgttgataatgcattaaatgcagttacaagagcgaaagcggctttaaatggtgctgacaacttaagaaatgcgaaaacttcagcaacaaatacgattgatggtttacctaacttaacacaattacaaaaagacaacttgaagcatcaagttgaacaagcgcaaaatgtagcaggtgtaaatggtgttaaagataaaggtaatacgttaaatactgccatgggtgcattacgtacaagtatccaaaatgataatacgacgaaaacaagtcaaaattatcttgatgcatctgacagcaacaaaaataattacaatactgctgtaaataatgcaaatggtgttattaatgcaacgaacaatccaaatatggatgctaatgcgattaatggcatggcaaatcaagtcaatacaacaaaagcagcgttaaatggtgcacaaaacttagctcaagctaaaacaaatgcgacgaacacaattaacaacgcacatgacttaaaccaaaaacaaaaagatgcattaaaaacacaagttaacaatgcacaacgtgtatctgatgcaaataacgttcaacacactgcaactgaattgaacagtgcgatgacagcacttaaagcagctattgctgataaagaaagaacaaaagcaagcggtaattatgtcaatgctgatcaagaaaaacgtcaagcgtatgattcaaaagtgactaacgctgaaaatatcattagtggtacaccgaatgcgacattaacagtcaatgacgtaaatagtgcggcatcacaagtcaatgcggctaaaacagcattaaatggtgataacaacttacgtgtagcgaaagagcatgccaacaatacaattgacggcttagcacaattgaataatgcacaaaaagcaaaattaaaagaacaagttcaaagtgcaactacattagatggtgttcaaactgttaaaaatagttctcaaacgttgaatacagcgatgaaaggcttaagagatagtattgcgaatgaagcaacaattaaagcaggtcaaaactacactgacgcaagtccaaataatcgtaacgagtacgacagtgcagttactgcagcaaaagcaatcattaatcaaacatcgaacccaacgatggaaccaaatactattacgcaagtaacatcacaagtgacaactaaagaacaggcattaaatggtgcgcgaaacttagctcaagctaagacaactgcgaaaaacaacttgaataacttaacatcaattaacaatgcacaaaaagatgcgttaacgcgtagcattgatggtgcaacaacagtagctggtgtaaatcaagaaactgcaaaagcaacagaattaaataacgcaatgcatagtttacaaaatggtatcaatgatgagacacaaacaaaacaaactcagaaatacctagatgcagagccaagtaagaaatcagcttatgatcaagcagtaaatgcagcgaaagcaattttaacaaaagctagtggtcaaaatgtagacaaagcagcagttgaacaagcattgcaaaatgtgaacagtacgaagacggcgttgaacggtgatgcgaaattaaatgaagctaaagcagctgcgaaacaaacgttaggtacattaacacacattaataatgcacaacgtacagcgttagacaatgaaattacacaagcaacaaatgttgaaggtgttaatacagttaaagccaaagcgcaacaattagatggtgctatgggtcaattagaaacatcaattcgtgataaagacacgacgttacaaagtcaaaattatcaagatgctgatgatgctaaacgaactgcttattctcaagcagtaaatgcagcagcaactattttaaataaaacagctggcggtaatacacctaaagcagatgttgaaagagcaatgcaagctgttacacaagcaaatactgcattaaacggtattcamaacttagatcgtgcgaaacargctgctaacacagcgattacaaatgcttcggacttaaatacaaaacmaaaagaagcattaaaagcacaagtaacaagtgcaggacgtgtatctgcagcaaatggtgttgaacatactgcgactgaattaaatactgcgatgacagctttaaagcgtgccattgctgataaagctgagacaaaagctagtggtaactatgtcaatgctgatgcgaataaacgtcaagcatatgatgaaaaagttacagctgccgaaaatatcgttagtggtacaccaacaccaacgttaacaccagcagatgttacaaatgcagcaacgcaagtaacgaatgctaagacgcagttaaacggtaatcataatttagaagtagcgaaacaaaatgctaacactgcaattgatggtttaacttctttaaatggtccgcaaaaagcaaaacttaaagaacaagtgggtcaagcgacgacgttgccaaatgttcaaactgttcgtgataatgcacaaacattaaacactgcaatgaaaggtctacgagatagcattgcgaatgaagcaacgattaaagcaggtcaaaactacacagatgcaagtcaaaacaaacaaactgactacaacagtgcagtcactgcagcaaaagcaatcattggtcaaacaactagtccatcaatgaatgcgcaagaaattaatcaagcgaaagaccaagtgacagctaaacaacaagcgttaaacggtcaagaaaacttaagaactgcgcaaacaaatgcgaagcaacatttgaacggcttaagtgacttaactgacgctcaaaaagatgcagtgaaacgtcaaatcgaaggtgcaacgcatgttaatgaagtaacacaagcacaaaataatgcggatgcattaaatacagctatgacgaacttgaaaaatggtattcaagatcagaatacgattaagcaaggtgttaacttcactgatgccgacgaagcgaaacgtaatgcatatacaaatgcagtgacgcaagctgaacaaattttaaataaagcacaaggtccaaatacttcaaaagacggtgtcgaaactgcgttagaaaatgtacaacgtgctaaaaacgaattgaacggtaatcaaaatgttgcgaacgctaagacaactgcgaaaaatgcattgaataacctaacatcaattaataatgcacaaaaagaagcattgaaatcacaaattgaaggtgcgacaacagttgcaggtgtaaatcaagtgtctacaacggcatctgaattaaatacagcaatgagcaacttacaaaatggtattaatgatgaagcagctacaaaagcagcgcttaatggtactcaaaaccttgaaaaagctaaacaacacgcaaatacagcaattgacggtttaagccatttaacaaatgcacaaaaagaggcattaaaacaattggtacaacaatcgactactgttgcagaagcacaaggtaatgagcaaaaagcaaacaatgttgatgcagcaatggacaaattacgtcaaagtattgcagataatgcgacaacaaaacaaaaccaaaattatactgatgcaagtcagaataaaaaggatgcgtacaataatgctgtcacaactgcacaaggtattattgatcaaactacaagtccaactttagatccgactgttatcaatcaagctgctggacaagtaagcacaactaaaaatgcattaaatggtaatgaaaacctagaggcagcgaaacaacaagcgtcacaatcattaggttcattagataacttaaataatgcgcaaaaacaaacagttactgatcaaattaatggcgcgcatactgttgatgaagcaaatcaaattaagcaaaatgcgcaaaacttaaatacagcgatgggtaacttgaaacaagcgatagctgacaaagatgctacgaaagcgacagttaacttcactgatgcagatcaagcaaaacaacaagcatataacactgctgttacaaatgctgaaaatatcatttcaaaagctaatggcggcaatgcaacacaagctgaagttgaacaagcaatcaaacaagttaatgctgcaaaacaagcattaaatggtaatgccaacgttcaacatgcaaaagacgaagcaacagcattaattaatagctctaatgaccttaaccaagcacaaaaagacgcattaaaacaacaagttcaaaatgcaactactgtagctggtgtaaacaatgttaaacaaacagcacaagagttaaacaatgctatgacacaattaaaacaaggcattgcagataaagaacaaacaaaagctgatggtaactttgtcaatgcagatcctgataagcaaaatgcatataatcaagcagtagcgaaagctgaagcattaattagtgctacgcctgatgttgtcgttacacctagcgaaattactgcagcgttaaataaagttacgcaagctaaaaatgatttaaatggtaatacaaacttagcaacggcgaaacaaaatgttcaacatgctattgatcaattgccaaacttaaaccaagcgcaacgtgatgaatacagcaaacaaatcacgcaagcaacacttgtaccaaacgtcaatgctattcaacaagcggcgacaacgcttaatgacgcgatgacacaattgaaacaaggtattgcgaataaagcacaaattaaaggtagcgagaactatcacgatgctgatactgacaagcaaacagcatatgataatgcagtaacaaaagcagaagaattgttaaaacaaacaacaaatccaacaatggatccaaatacaattcaacaagcattaactaaagtgaatgacacaaatcaagcacttaacggtaatcaaaaattagctgatgccaaacaagatgctaagacaacacttggtacactagatcatttaaatgatgctcaaaaacaagcgctaacaactcaagttgaacaagcaccagatattgcaacagttaataatgttaagcaaaatgctcaaaatctgaataatgctatgactaacttaaacaatgcattacaagataaaactgagacattaaatagcattaactttactgatgcagatcaagctaagaaagatgcttatactaatgcggtttcacatgcagaaggtattttatctaaagcaaatggcagcaatgcaagtcaaactgaagtggaacaagcgatgcaacgtgtgaacgaagcgaaacaagcattgaatggtaatgacaatgtacaacgtgcaaaagatgcagcgaaacaagtgattacaaatgcaaatgatttaaatcaagcaatgacacaattgaaacaaggtattgcagataaagaccaaactaaagcaaatggtaactttgtcaatgctgatactgataagcaaaatgcttacaacaatgcggtagcacatgctgaacaaataattagtggtacaccaaatgcaaacgtggatccacaacaagtggctcaagcgttacaacaagtgaatcaagctaagggtgatttaaacggtaaccataacttacaagttgctaaagacaatgcaaatacagccattgatcagttaccaaacttaaatcaaccacaaaaaacagcattaaaagaccaagtgtcgcatgcagaacttgttacaggtgttaatgctattaagcaaaatgctgatgcgttaaataatgcaatgggtacattgaaacaacaaattcaagcgaacagtcaagtaccacagtcagttgactttacacaagcggatcaagacaaacaacaagcatataacaatgcggctaaccaagcgcaacaaatcgcaaatggcataccaacacctgtattgacgcctgatacagtaacacaagcagtgacaactatgaatcaagcgaaagatgcattaaacggtgatgaaaaattagcacaagcgaaacaagaagctttagcaaatcttgatacgttacgcgatttaaatcaaccacaacgtgatgcattacgtaaccaaatcaatcaagcacaagcgttagctacagttgaacaaactaaacaaaatgcacaaaatgtgaatacagcaatgagtaacttgaaacaaggtattgcaaacaaagatactgtcaaagcaagtgagaactatcatgatgctgatgccgataagcaaacagcatatacaaatgcagtgtctcaagcggaaggtattatcaatcaaacgacaaatccaacgcttaacccagatgaaataacacgtgcattaactcaagtgactgatgctaaaaatggcttaaacggtgaagctaaattggcaactgaaaagcaaaatgctaaagatgccgtaagtgggatgacgcatttaaacgatgctcaaaaacaagcattaaaaggtcaaatcgatcaatcgcctgaaattgctacagtgaaccaagttaaacaaacagcaacgagcctagatcaagcaatggatcaattatcacaagctattaatgataaagctcaaacattagcggacggtaattacttaaatgcagatcctgacaaacaaaatgcgtataaacaggcagtagcaaaagctgaagcattattgaataaacaaagtggtactaatgaagtacaagcacaagttgaaagcatcactaatgaagtgaacgcagcgaaacaagcattaaatggtaatgacaatttggcaaatgcaaaacaacaagcaaaacaacaattggcgaacttaacacacttaaatgatgcacaaaaacaatcatttgaaagtcaaattacacaagcgccacttgttacagatgtcactacgattaatcaaaaagcacaaacgttagatcatgcgatggaattattaagaaatagtgttgcggataatcaaacgacattagcgtctgaagattatcatgatgcaactgcgcaaagacaaaatgactataaccaagctgtaacagctgctaataatataattaatcaaactacatcgcctacgatgaatccagatgatgttaatggtgcaacgacacaagtgaataatacgaaagttgcattagatggtgatgaaaaccttgcagcagctaaacaacaagcaaacaacagacttgatcaattagatcatttgaataatgcgcaaaagcaacagttacaatcacaaattacgcaatcatctgatattgctgcagttaatggtcacaaacaaacagcagaatctttaaatactgcgatgggtaacttaattaatgcgattgcagatcatcaagccgttgaacaacgtggtaacttcatcaatgctgatactgataaacaaactgcttataatacagcggtaaatgaagcagcagcaatgattaacaaacaaactggtcaaaatgcgaaccaaacagaagtagaacaagctattactaaagttcaaacaacacttcaagcgttaaatggagaccataatttacaagttgctaaaacaaatgcgacgcaagcaattgatgctttaacaagcttaaatgatcctcaaaaaacagcattaaaagaccaagttacagctgcaactttagtaactgcagttcatcaaattgaacaaaatgcgaatacgcttaaccaagcaatgcatggtttaagacagagcattcaagataacgcagcaactaaagcaaatagcaaatatatcaacgaagatcaaccagagcaacaaaactatgatcaagctgttcaagccgcaaataatattatcaatgaacaaactgcaacattagataataatgcgattaatcaagcagcgacaactgtgaatacaacgaaagcagcattacatggtgatgtgaagttacaaaatgataaagatcatgctaagcaaacggttagtcaattagcacatctaaacaatgcacaaaaacatatggaagatacgttaattgatagtgaaacaactagaacagcagttaagcaagatttgactgaagcacaagcattagatcaacttatggatgcattacaacaaagtattgctgacaaagatgcaacacgtgcgagcagtgcatatgtcaatgcagaaccgaataaaaaacaatcctatgatgaagcagttcaaaatgctgagtctatcattgcaggattaaataatccaactatcaataaaggtaatgtatcaagtgcgactcaagcagtaatatcatctaaaaatgcattagatggtgttgaacgattagctcaagataagcaaactgctggaaattctctaaatcatttagatcaattaacaccagctcaacaacaagcgctagaaaatcaaattaataatgcaacaactcgtgataaagtggctgaaatcattgcacaagcgcaagcattaaatgaagcgatgaaagcattaaaagaaagtattaaggatcaaccacaaactgaagcaagtagtaaatttattaacgaggatcaagcgcaaaaagatgcttatacgcaagcagtacaacacgcgaaagatttgattaacaaaacaactgatcctacattagctaaatcaatcattgatcaagcgacacaggcagtgacagatgctaaaaacaatttacatggtgatcaaaaactagctcaagataagcaacgtgcaacagaaacgttaaataacttgtctaacttgaatacaccacaacgtcaagcacttgaaaatcaaattaataatgcagcaactcgtggcgaagtagcacaaaaattaactgaagcacaagcacttaaccaagcaatggaagctttacgtaatagcattcaagatcaacagcaaacggaagcgggtagcaagtttatcaatgaagataaaccacmaaaagrtgcttaccaagcagcagttcaaaatgcaaaagatttaattaatcaaactaacaatccaacgcttgataaagcacaagttgaacaattgacacaagctgttaaccaagctaaagataacctacacggtgatcaaaaacttgcagacgataaacaacatgcggttactgatttaaatcaattaaatggtttgaataatccgcaacgtcaagcacttgaaagccaaataaacaacgcagcaactcgtggcgaagtagcacaaaaattagctgaagcaaaagcgcttgatcaagcaatgcaagcattacgtaatagtattcaagatcaacaacaaacagaatctggtagcaagtttatcaatgaagataaaccgcaaaaagatgcttaccaagcagcagttcaaaatgcaaaagatttaattaaccaaacaggtaatccaacactcgacaaatcacaagtagaacaattgacacaagcagtaacaactgcaaaagataatctacatggtgatcaaaaacttgctcgtgatcaacaacaagcagtaacaactgtaaatgcattgccaaacttaaatcatgcacaacaacaagcattaactgatgctataaatgcagcgcctacaagaacagaggttgcacaacatgttcaaactgctactgaacttgatcacgcgatggaaacattgaaaaataaagttgatcaagtgaatacagataaggctcaaccaaattacactgaagcgtcaactgataaaaaagaagcagtagatcaagcgttacaagctgcagaaagcattacagatccaactaatggttcaaatgcgaataaagacgctgtagaccaagtattaactaagcttcaagaaaaagaaaatgagttaaatggtaatgagagagtcgctgaagctaaaacacaagcgaaacaaactattgaccaattaacacatttaaatgctgatcaaattgcaactgctaaacaaaacattgatcaagcgacgaaacttcaaccaattgctgaattagtagatcaagcaacgcaattgaatcaatctatggatcaattacaacaagcagttaatgaacatgctaacgttgagcaaactgtagattacacacaagcagattcagataaacaaaatgcttataaacaagctattgctgatgctgaaaatgtattgaaacaaaatgcgaataagcaacaagtggatcaagcacttcaaaatattttaaatgcaaaacaagcattaaatggtgatgaacgtgtagcacttgctaaaacaaatggtaaacatgacatcgaccaattgaatgcattaaacaatgctcaacaagatggatttaaaggtcgcatcgatcaatcaaacgatttaaatcaaatccaacaaattgtagatgaggctaaggcacttaatcgtgcaatggatcaattgtcacaagaaatcactgacaatgaaggacgcacgaaaggtagcacgaactatgtcaatgcagatacacaagtcaaacaagtatatgatgaaacggttgataaagcgaaacaagcacttgataaatcgactggtcaaaacttaactgcaaaacaagttatcaaattaaatgatgcagtcactgcagctaagaaagcattaaatggtgaagaaagacttaataatcgtaaagctgaagcattacaaagattggatcaattaacacatctaaacaatgctcaaagacaattagcaatccaacaaattaataatgctgaaacgctaaataaagcatctcgagcaattaatagagcaactaaattagataatgcaatgggttcagtacaacaatatattgacgaacagcaccttggtgttatcagcagcacaaattacatcaatgcagatgacaatttgaaagcaaattatgataatgcaattgcgaatgcagcacatgagttagataaagtgcaaggtaatgcaattgcaaaagctgaagcagagcaattgaaacaaaatattatcgatgctcaaaatgcattaaatggagaccaaaaccttgcaaatgccaaagataaagcaaatgcgtttgttaattcgttaaatggattaaatcaacagcaacaagatcttgcacataaagcaattaacaatgccgatactgtatcagatgtaacagatattgttaataatcaaattgacttaaatgatgcaatggaaacattgaaacatttagttgacaatgaaattccaaatgcagagcaaactgtcaattaccaaaacgctgacgataatgctaaa

SEQ ID NO: 60 - DNA, 2243 bp; double-stranded, linear
atgacagaatgggagcgaggacttagaatgtttcctaaatcaggtttattaaattttgagttagcgatagmaaatcgttcattaaatgatgatgaaaaagcattaaaatatgtgcgtaaagcattaaatgcagaccctaaaaatacagattatattaacttagaaaaagagttgactaaatcaaatgagtcgaaaaataaataacttttatgatgtacaacagttattgaaaagttacggatttctaatatattttaaaaatccagaagatatgtacgaaatgattcaacaggagatttcatcattgtatcaatatgaactgttatctaaggaagaatatttgaaatgtacgttgataattaatcagagaaggaatgaacagaaatgacaaaaattattttagcagctgatgtaggcgggacgacttgtaaattaggtattttcacacctgaattagaacaattacataaatggtctattcacactgatacatctgatagtacaggatatacacttttgaaaggaatttatgattcgtttgttgaaaaagtaaatgaaaataattataatttttcaaatgtacttggcgtaggtattggtgtaccaggtcctgttgactttgaaaaaggtacagtaaatggagcagtaaacttatattggccagaaaaagttaatgtacgtgagatttttgaacaattcgttgattgtccagtgtatgtagataatgatgctaacatagctgctttaggggagaaacacaaaggtgctggtgaaggtgccgatgatgttgttgccatcacacttggtacaggtctaggtggaggaattatttccaaatggtgaaatcgtacatggtcataatggctctggcgcagaaataggtcattttagagcagacttcgatcaacgatttaaatgtaattgtggtcgttctggatgtattgaaacagttgcttcagcgacaggcgttgttaacttagttaacttctactatccgaagttgacgtttagatcttctatattagaattgattaaagaaaataaggttacagcaaaagctgtttttgatgcggcaaaagctggtgaccaattctgtattttcattactgaaaaggttgcaaactatattggatatttatgtagtattattagtgttacaagtaatccgaaatatatcgttctaggtggaggaatgtctactgcaggacctattttaattgaaaatattaaaacagaatatcataatttaacatttgcacctgctcaatttgaaactgaaattgtacaagcgaaattaggtaatgatgcaggtattacaggagcagcaggattaatcaagacctatgtattagataaagagggggtaaaataatggctattgttgatgtggttgttattccagttggaacggaaggtccgagtgttagtaaatatattgcagatattcagaaaaaacttcaagaatataaagcaatgggtaaaattgattttcaattaacaccaatgaatactctaattgaaggtgaattaagcgatgtattagaagttgtgcaagtgatacatgaattaccttttgataaaggtttaagtagagtttgtacaaatatccgtattgatgaccgacgagacaaatctagaaaaatgaatgataaactaacatcagtacaaaaacatttagaaaatagtggtgaaaacctatgaggatttcaagcttaactttaggcttagttgatactaatacgtatttcatcgaaaatgacaaagctgttattctgattgacccttcaggtgaaagtgaaaaaattattaaaaaattaaaccaaataaataaaccgttaaaagctattttattaacacatgcacactttgatcatatcggagcagtcgatgatatagttgatcgattcgatgtcccggtttatatgcatgaagcagagtttgattttctaaaagatcccgttaaaaatggggcagataaatttaagcaatatggattaccaattattacaagtaaggtaactcctgaaaagttaamcgaaggtagcacagaaatagaaggatttaagttntnayrtgtacacacacctggacattcaccaggaagtttaacatatgtgttcgatgaattcgcagttgttggagatacattatttaataatggaatcggacgtacagatttatataaaggtgattatgaaacgctagttgattctattcaagataaaatatttgaattagaaggc

SEQ ID NO: 61 - DNA, 8009 bp; double-stranded, linear
ttggnatcattyacggtaaaaagaataaagcaagatttatttcattagtactaatttgtgcaatgtttgcaatttgttgggttgcatatattcaatgggagtctacaatcgcttcatttacacaatctattaatatttcaatggcacaatatagtgttttatggacaattaacggaataatgattttagtagcacaaccattaattaaaccgattctctatctgttaaaaggaaacttaaagaagcaaatgtttgtcggcatcatcatttttatgttgtcgttctttgtcacgagttttgccgaaaactttacaatatttgttgtcggtatgattattttaacttttggagaaatgtttgtatggccagcagttccaactatagccaatcagttagcgccagatggtaagcaaggacagtaccaaggttttgtgaattcagctgctacagtaggaaaagcatttggtccatttcttggtggtgtattagttgatgcgtttaatatgcgcatgatgtttatcggtatgatgctactacttgtatttgcattaatattattaatggttttcaaggagaataatacgcaacctaaaaaaatagatgcataatgagtaaatagaattaacgttatagacttgaaataaatgtcgttataacataatattaatttgtataatttaatttcgtttggagcttttctacagaaagctagtgatgctgagagctagtgttaaggactaaatgtaaatcgtattaattttaaattgaatgaatgacatctcttactattaaaatgagtgcacaatttttgtgaaatagggtggtaacgcggcaaatgtcgtccctatgtaaatagaatagttagaggtgtcttttttattgaataggaggaaatgtgttgaattacaaccacaatcaaattgaaaagaaatggcaagactattgggacgaaaataaaacatttaaaacaaatgataacttaggtcaaaagaaattttatgctttagacatgtttccatatccatcaggtgctggtttacatgttggacatcctgagggctatacagcaacagatatcatttcaagatataaaagaatgcaaggatataatgtattacatccgatggggtgggatgcattcggattaccagcagagcaatatgctttagacactggcaacgacccacgtgaatttacaaagaaaaatatccaaacttttaaacgacaaattaaagaattagggttcagttatgattgggatcgtgaagttaatacaacagatccagaatactataaatggacacagtggattttcatacagttatataacaaaggtttagcatacgttgatgaagttgcagttaactggtgtccagcattaggcactgttttatctaacgaagaagtgattgatggtgtctctgaacgtggtggacatccagtttatcgtaagccgatgaaacaatgggtacttaaaatcacagaatatgcagatcaattattagcagatttagatgatttagattggcctgagtctttaaaagatatgcagcgcaattggattggacgttctgaaggggccaaagtttcatttgatgtagataatacggaaggaaaagtagaagtatttacgactagaccagatacaatctatggtgcatcattcttagtcttaagtcctgaacatgcattagttaattcaattacaacagatgaatataaagaaaaagtaaaagcttatcaaacagaagcttctaaaaagtcagatttagaacgtacagatttagcaaaagataaatcaggtgtatttactggtgcatatgcaactaatcctttatctggtgaaaaagtacaaatttggattgctgattatgtattatcaacatatggtactggagcaattatggcagtaccagcgcatgatgacagagattatgaatttgctaaaaagtttgatttgccaatcattgaagtcatcgaaggtggaaatgttgaagaagcagcatacactggtgaaggtaaacatattaattctggtgaacttgatggtttagaaaatgaagcggcaattactaaagctattcaattattagagcaaaaaggtgctggcgaaaagaaagttaattacaaattaagagattggttattcagtcgtcagcgttattggggcgaaccaattcctgtcattcattgggaagatggaacaatgacaactgttcctgaagaagagctaccattgttgttacctgaaacagatgaaatcaagccatcagggactggtgagtctccactagctaatattgattcatttgtaaatgttgtagatgaaaaaacaggtatgaaaggacgtcgtgaaacaaatacaatgccacaatgggcaggtagttgttggtattatttacgttacatcgatcctaaaaatgaaaatatgttagcagatcctgaaaaattaaaacattggttacctgttgatttatatatcggtggagtagaacatgcggttcttcacttattatatgcaagattttggcataaagtcctttatgatttggctatcgtacctactaaagaacctttccaaaaattatttaaccaaggtatgattttaggagaaggtaatgagaagatgagtaaatctaaaggaaatgtaatcaatcctgatgatatagtacagtctcatggtgcagatactttgcgtctttacgaaatgtttatgggacctttagatgctgcaattgcatggagtgaaaaaggattagatgggtctcgtcgattcttagatcgcgtatggcgtttaatggtaaatgaagatgggacattgagttcaaaaattgtaactacaaataataaatctttagataaagtttataaccaaactgttaaaaaggtaacagaagactttgaaacattaggatttaatactgctattagtcaattaatggtatttattaatgagtgttataaagttgatgaagtttataaaccttacattgaaggcttcgttaaaatgttagcacctattgcaccacatatcggtgaagaattatggtcaaaattaggacatgaagagtctattacgtaccaaccttggccaacttatgacgaagcactacttgtagatgatgaagtagaaatcgttgttcaagtgaatggtaaattgagagctaaaattaaaattgctaaagatacatcaaaagaagaaatgcaagaaattgccttatctaatgacaatgttaaagcgagtattgaaggtaaagacatcatgaaagtcatcgctgttcctcaaaaattagtcaatattgtagctaaataatgttttaaggaggactttgaaatgaagtcaattactacagatgaattaaaaaataaacttttagaatctaaaccagttcaaattgttgatgttcgtactgatgaagaaacagcaatgggatatattcctaatgcaaagttaattccaatggataccattccggataatttaaattcatttaataaaaatgaaatatattatattgtatgtgctggtggagttcgaagcgctaaagttgtagaatatttagaggcaaatggcattgatgccgtaaatgtcgaaggcggcatgcacgcatggggcgatgaaggtttggaaataaaaagtatttaaagtagtgacataatttaaaataatattacatttgtaatgacaccaagtaacgtttcggttgcttggtgttttttggtatgaattactttctgttacaaaacaatctaaagcgttcttgttatgttttattaagattttaattacaaaacggaaactaaattgtaataaaataaaactttattttataaaatgatgatgataaaattgagtgaacttaaaatattgtacaaaataatatagctataaatataatatagctataaatataatatgagggagcgtatatttttagcataattcttaacaacacagcagagaacagacaaccaggaggaaaatgaaatgaatttgttaaagaaaaataaatatagtattaggaagtataaagtaggcatattctctactttaatcggaacagttttattactttcaaacccaaatggtgcacaagccttaactacggataataatgtacaaagcgatactaatcaagcaacacctgtaaattcacaagataaagatgttgctaataatagaggtttagcaaatagtgcgcagaatacacctaatcaatctgcaacaaccaatcaagcaacgaatcaagcattggttaatcataataatggtagtatagtaaatcaagctacgccaacatcagtgcaatcaagtacgccttcagcacaaaacaataatcatacagatggcaatacaacagcaactgagacagtgtcaaacgctaataataatgatgtagtgtcgaataataccgcattaaatgtaccaactaaaacaaatgaaaatggttcaggaggacatctaactttaaaggaaattcaagaagatgttcgtcattcttcaaataaaccagagctagttgcaattgctgaaccagcatctaatagaccgaaaaagagaagtagacgtgcggcaccggcagatcctaatgcaactccagcagatccagcggctgcagcggtaggaaacggtggtgcaccagttgcaattacagcgccatatacgccaacaactgatcctaatgccaataatgcaggacaaaatgcacctaacgaagtgctgtcatttgatgacaatggtattagaccaagtaccaaccgttctgtgccaacagtaaacgttgttaataacttgccgggcttcacactaatcaatggtggcaaagtaggggtgtttagtcatgcaatggtaagaacgagcatgtttgattcaggagataataagaactatcaagcacaaggaaatgtaattgcattaggtcgtatacatggaactgatacgaatgaccatggcgattttaatggtatcgagaaagcattaacagtaaatccgaattctgaattaatctttgaatttaatacaatgactactaaaaacggtcaaggcgcaacaaatgttattatcaaaaatgctgatactaatgatacgattgctgaaaagactgttgaaggcggtccaactttgcgtttatttaaagtacctgataatgtgagaaatctcaaaattcaatttgtacctaaaaatgacgcaataacagatgcgcgtggcatttatcaactaaaagatggttacaaatactatagctttgttgactctatcggacttcattctgggtcacatgtttttgttgaaagacgaacaatggatccaacagcaacaaataataaagagtttactgtaacaacatcattaaagaataatggtaattctggtgcttctctagatacaaatgactttgtatatcaagttcaattacctgaaggtgttgaatatgtgaacaattcattgactaaagattttccaagtaacaattcaggcgttgatgttaatgatatgaatgttacatatgatgcagcaaatcgtgtgataacaattaaaagtactggaggaggtacagcaaactctccggcacgacttatgcctgataaaatactcgatttaagatataaattacgtgtaaataatgtgccgacaccaagaacagtaacatttaacgagacattaacgtataaaacatatacacaagatttcattaattcagctgcagaaagtcatactgtaagtacaaatccatatactatcgatatcatcatgaataaagatgcattacaagccgaagttgacagacgtattcaacaagctgattatacatttgcgtcattagatatctttaatggtctgaaacgacgcgcacaaacgattttagatgaaaatcgtaacaatgtaccattaaataaaagagtttctcaagcatatattgattcattaactaatcaaatgcaacatacgttaattcgaagtgttgatgctgaaaatgcagttaataaaaaagttgaccaaatggaagatttagttaatcaaaatgatgaattgacagatgaagaaaaacaagcagcaatacaagttatcgaggaacataaaaatgaaataattggtaatattggtgaccaaacgactgatgatggcgttactagaatcaaagatcaaggtatacagaccttaagtggggatactgcaacaccggttgttaaaccaaatgctaaaaaagcaatacgtgataaagcaacgaaacaaagggaaattatcaatgcaacaccagatgctactgaagacgagattcaagatgcactaaatcaattagctacggatgaaacagatgctattgataatgttacgaatgctactacaaatgctgacgttgaaacagctaaaaataatggcatcaatactattggagcagttgttcctcaagtaactcataaaaaagctgcaagagatgcaattaaccaagcaacagcaacgaaaagacaacaaataaatagtaatagagaagcaactcaggaagagaaaaatgcagcattgaacgaattaactcaagcaaccaaccatgctttagaacaaatcaatcaagcaacaacaaatgctaatgttgataacgccaaaggagatggtctaaatgccattaatccaattgctcctgtaactgttgttaagcaagctgcaagggatgccgtatcacatgatgcacaacaacatatcgcagagatcaatgctaatcctgatgcgactcaagaagaaagacaagcagcaattgacaaagtgaatgctgctgtaactgcagcaaacacaaacattttaaacgctaataccaatgctgatgttgaacaagtaaagacaaatgcgattcaaggaatacaagcaattacaccagctacaaaagtaaaaacagatgcaaaaaatgccatcgataaaagtgcggaaacgcaacataatacgatatttaataataatgatgcgacgctcgaagaacaacaagcagcacaacaattacttgatcaagctgtagccacagcgaagcaaaatattaatgcagcagatacgaatcaagaagttgcacaagcaaaagatcagggcacacaaaatatagtagtgattcaaccggcaacacaagttaaaacggatactcgcaatgttgtaaatgataaagcgcgagaggcgataacaaatatcaatgctacaactggcgcgactcgagaagagaaacaagaagcgataaatcgtgtcaatacacttaaaaatagagcattaactgatattggtgtgacgtctactactgcgatggtcaatagtattagagacgatgcagtcaatcaaatcggcgcagttcaaccgcatgtaacgaagaaacaaactgctacaggtgtattaaatgatttagcaactgctaaaaagcaagaaattaatcaaaacacaaatgcaacaactgaagaaaagcaagtggctttaaatcaagtggatcaagagttagcaacggcaattaatmatataaatcaagctgatacaaatgcggaagtagatcaagcgcaacaattaggtacaaaagcaattaatgcgattcagccaaatattgttaaaaaacctgcagcattagcacaaatcaatcagcattataatgctaaattagctgaaatcaatgctacaccagatgcaacgaatgatgagaaaaatgctgcgatcaatactttaaatcaagacagacaacaagctattgaaagtattaaacaagctaacacaaatgcagaagtagaccaagctgcgacagtagcagagaataatatcgatgctgttcaagttgatgtagtaaaaaaacaagcagcgcgagataaaatcactgctgaagtggcgaacgtattgaagcggttaaacaaacacctaatgcaactgacgaagaaaagcaggctgctgttaatcaaatccaatcaactttaaagattcaagcaatttaatccaaatttaatccaaaacccaaacaaatggattcagggtaggacaccacttacaaatccaa

SEQ ID NO: 62 - DNA, 10953 bp; double-stranded, linear
acccaccccntggggatantttacctggtggggccttcgattgcctttaggtgaaaccagcatgttcattaggatctgctaatttaattgatacaaccaaatttattccattaggtttagagatgaatgctaaccatattcattctgctaaagatggtcgtgttactgcgacagctgaaattattcatcgaggtaagtcgacacatgtatgggatataaaaattaagaatgacaaagaacaattaattacagttatgcgtggtacagttgctattaaacctttaaaataaaagaactgctagctgaaatgttatgagatattcataactacggctagcagtttttttatgcgctatattgttgtagttttagaaatgcttgttcaatgcgttcggcagctttacggccacccataacatttctaccaaatggtcctaattctaagtctgcaaagcatcctgcgacaaatagatttggtatccattctaatttttcggaaataacagggtaattacattcgttgataggtgcatcataattttgtattaattgcttaataagtggttgtgacataaaatcttgttcaaaaccagttgcaaccataatctgttgatatggaacagaatcattttcagtgttaattacaccaccactaatttgagtgataggtgttttatgcacatttatacgaccatttttaatatgttttttaaggcgtaagtacagttcgtgaggcattgatcctttatgacgttcgcgttgtacaatggcatttctttcaggcatgcttttagtacttaaaaatgaagacatatttttcggacctaaccaaccaggatcagcatcaaagtcatgtatttcaatatctttatttagccataaatgaatctttttatcgttatcatgatttaacaatttaagtgcaagatgtgcagcagtaatgccgctaccaacgatatgatcggtcttatcatatactacttgatcaagttctttctcgaagatatgatttacattctgtttgtcttttaaaatgtcaggcataaacggaatatttgtactgcctattgcaataacgacgcaatctgtagtgataatttgtccatcttctaacttgatatgccatttgtcttcttgtttatctaaagtttgaactaaaccttgaaccaagcaatcctctaattgatattgtttagaagcatgtgcaatatgatccataaacattgtcaattcaggtcgttgataaggaccataaaaagcatttgtatattggtgctgtttagcgaattgttttagatggaacggttgtggatgtacgtgatgtacaatcggtgatcttaaataaggcatttctattcgatttgtatatgagttaaacctttggcaaaaagtttcgtgtgggtcaatgattgttaatcggtctgttgttaatccgcttgataatagtttttgtgcgattgcagttccctgtatgccaccgccgataattgtccaatgcataataaaacctctctctttttaaaacgtaatagttacgatttataattattattatcataatacataacgacatgaaaggcaattaaattaaagagatatatgtagatagggcgaatctgtagtcaaagaaaaaatcattgaaaaagaggtaacaatgtcaaaagawaacagcagtaaaatcattcctaatttggaatcatcttactgctgtttgttgttgatttatattcatgattttgttatataatctacaattttgtgtcttttaagtcttccgaaatttcatcgactttagtctttttagtataaggcgttttaatattatatgctgctttcataatcatatgacttgaaagaggacctgtaattaatacaaagataatcgcaacgattaattgcatatttacaaaaccttgagtagcaataaaatataaaaacgtaccaaatagtaatgacattgcacctaatgttgatgcttttccggcagcatgtgcacgtgaatatacatcttcaagtctcaataatcctatagctgctagggcgctaattaaagcaccgatgataacaaagataagtgcaagactaatcagtatgattttgatcatgttcaatcaccttacctttgtccataaatttagagaatactgcagtacctaaaaaagctaatataccaatcatcataataacgacaatcatgtatttaatatttaataaaatactgaataatgctataactgccattaattgaagaccaatcgcatctaatgcgacaacacgatcggcaagtgatgggcctagcacaacgcgaatgagcatagctaacatagaaatgacaactatgattaatgcaataacgataataacattatgattcattatatttcgcccacctctcttacaattttctctaatgatgttttaatactttctacttcttgctctttagttgaaaaatctatggcatgaatataaatttttgtacgatcgtcacttacaccaagcactacagtaccaggtgttaatgtaattaaattagacagcaagacaatttgccaatctttttttaaatctgtgtgataaacaaagaatcctggttcatttttaatcgaaggtttaataataattttcaaaacatcaaaattagctttaatcagttcgattaagaaaataataactaatttaataatacgatatagcgtgatgacataaaatctacctggtaacactctgtgtaagaggtaaacaagaactaggccaaagatgaaacctaacacaaagttatttgttgtgtaactatttgtcacaaacaaccaaaacactgcgataataaagtttaatactaattgtacagccatgttatttacctcctaatacagctttaacgtaggttgatggattgtagaatgtttctgcaccagcttttaccattggatataagtaatctgctgacaatccatataaaacagttatcacaactgcaacgattgcaatcgtagttaaatatttgacgtcgactttgttattaagatcatatccttttggttgaccgaaaaagccttgtaggaatatgcgaatgacagaatataatacgactaaacttgataataagacgatgacaccacttaaataaaatcctctttcaaatgttgattggacaataaaaaattttccataaaagccactgagtgggggaatgccagctaaacttaatgctgcgataaagaatgaccaaccaagtacaggatatcgtttaattaagccaccaaattgtcttaaatcagcagtgcctgtaattttaatcataattccgataagcaagaataatgcaagttttactaacatgtcgtgcaatgtatagtaaatagccccaatcatacctgactctgtcatcattgcaacgccgactaagatcacacctacagcaatcatgacattgtataggatgatttttttaatgttggcatatgcaacagcaccgacacaaccaaagatgatcgttaatagtgctaagaataaaatgacataatgtgaaaagcttacattatcactaaagaataggctcaatgttctagcgattgcataaacaccaacttttgttaacaaagcaccaaagaatgcaatgattggaattggtgggcatagtatgcactaggtaaccaaacaaacattgggaatacgccagcttttgtagcaaaaacaaagataaatagtatgaaaacgatattgactaagccactgtcatgcgctgaaaggttagctaatttattgcttatatctgctagattcaatgttcctactactgaatataaaatcgctacacccattacgaagaaggatgacgatacaacgttaacaagaacatattttattgtttcttgtagttgaatttttgtagaaccaattactaataagaaataagatgacattaaaaatacttcgaaaaatacgaataggttgaaaatgtcaccagttgtgaatgcaccaatgatacctattaacataaatagtactgaaaaataataataatatctttcacgttcaataccaattgtttggtatgaatataaaatcacaatagctgtaataataatactagtaattattagtagggcactgaatatgtctaatacaaagacaatactgtatggtgctttccatgaacctagctctacgcgtattggtccatgtttaacaacatttgctaaattgataattgccgcgaccaaggttaataatgtaccgcctagtgcgacataacgctttataataggacgctttccaataaagacaagtaatatggctgtaattactggaataactagcgttaacacaagcatattactttcaatcatcttctggaactcctttcatactctcaacgttatctgtgcctaattctttatatgttctaaatgctaatactaagaaaaaggctgttgtcgcaaggcgataacgattgctgttaaaataagtgcttgcgggataggatcaacatagctttttacgttcgcttcataaattggaacagtaccatgtttaagtccgcccatagttattaaaaataaatttgctgcatgtgttaatagtgtagttcccataacaattcgtatcagacttttagacaaaacgagatagacactaattgctgtgagaataccactaacaaaaatcataataatttccactattcgttctctccaatcgaaataataattgtcatgacagtaccaactactgcacataaaacaccgaaatcaaagaatactgctgttgtcatatgaacaggttctaatataaataacggtatatcaaatgtgacatgcgtaaagaaatttttgcctaaaaaccaacttgcgataggcgtcgcaatacaaaaaactaatccgatacctatcaagattttaaaatctaatgggaaaattttacgcattgtttctatatcaaatgcaatcgtaatgataacaagtgaacttgcgaataataatccgccgacgaaaccgccaccaggtgtataatgtcctgctaagaaaagtgaaaaaccaaagaccattaccatgaaaaagataataactgcagcaaattgcaaaattagatcattttgttgtctattcatgatttttcacctcgttaccttgcgtttgacgctttttacgtaatttaatcattgtatatacagctaatcctgcgataccaagcacagatgactcgaataaagtatccataccacggaaatcaacaagtatgacgtttaccatgtttttaccgtgagctaaatcataaacgtgctcttgataaaacttagatatcgattcaaaatgtctatttccgtatgcaattaaaccgataataatgacggacaaaccaacaccaccagcaattaaagcattagtaagctggaatgagcgcttttcattataacgatttaaatttggtaagtggtagaagcataataagaacaatgctgttgaaatagattcaacgacaaactgtgtcaatgctaagtcgggtgctttaaagaatataaacaatacagacacagcatatccaactgcacttaacataatgatgctaaataatcttgatttagcgaaaagaattaaaaaggcagcacttaataataaaattacgatacaaacttcgaaaattctaatcggactaacgtctttaaaattaatgttgaaaggtactgagaatatagtgacaaatgttaataaaattaatgcaccaaaaatgataactaaattattacgtgaataatcggtaacatagctattcgtcatcttttcagagtagtttggaataacatttgcacttctgttgtaccaataattgaatgttagtttaccaggttgtcgttgcaacaatttcacccaataactaaatgtcacaattagtaagatacctaaaatataaatcactaatgttgataaaaaggcaggcgttaatccatggaacatatggaattcaacatcatcaattaccgtatgattaatcgaagagtnagctggttcaataatcgaattagttaaaatgccagggaataaaccaaatacaattactaatgtagctaaaatagctggtgataaaagcattaatattgatacttcgtgtgcttttttaggtaattgttcaggtttatattgtccgaaaaatatatgcattataaatttaattgaatatacaaatgtgaagacactgcccactataccaatgattgggaataggtagcctaatgtatcaacactgaataaatttgcttggcttgctgtaaatgttgtttctaaaaatgattcttttgataagaaaccattgaacggtggtacaccagcgcatacttaatgctgtaataacagtgattgtaaatgaaataggcataattgttagtaagccacctaatttcttaacatcacgtgtaccagtagaatgatccactgcacctgtaatcataaatagggcacctttaaatgttgcatggttgattaaatggaatattgcagccgtaaatgcagcagcatatattttgctatcatcgccttgatagtgataactaatggcaccgattccaagcatcgccataatcatacctaattgggatactgttgaaaatgccagtatacctttcaagtcttgttgttttgttgcgtttagcgaagcccagaataatgtaattaaaccaacgagtgtgacagtccatacccaaccttgcgatgctgcgaagattggtgtcattcgagcgattaaatataaccctgctttaaccattgttgctgaatgaagataagcactgactggtgtaggtgcttccattgcatctggtagccaaatataaaatggaaactgagcagattttgtaaaagcaccaatcatgattaaaatcatcgcaaaaatgaagaatgggctattttgaatttcagaagcatgttgaatcatgtactgaatgctaaatgattgtgttggtatagcgagtaagatgataccacctaataatgatagaccaccaaatactgtgattatgagcgatttttgagcaccatatatagatgcttgtcgttcgcgccagaatgaaataagtaaaaaactagaaaatgacgttagctcccagaataaatatagaataataacattatctgaaagtacgacacctaacattgcacccataaatagtaataaataacaataaaaattccctagttgttctgacttacttaagtagccgattgaatataatactactaaactgccgattcctgaaataagcaaactaaagagtaaacctaagccatcaagatataaatcaaagttcataccaaaatgaggcatccaatttaaggttttcattacagtattacctgacatcgtcgttttaattaatgtaagcatataaataaatatgacgatagggacaggtaatacgaaccatcctaaatgtatacgtttaaaaaatctatacaggataggaataatgagtgcgaatattaacggtaatatcaccgcaatatgtaacaaactcactatgttgtcctcctttaaaaaatatttatgttattcattatacatgaatgatatagttctgaaaaacgtacacactccttgttgtgctttattttcagaagtatttaaataagaagaaacacgtcattttttatttaaaattttctttgtattgaagtgaataatcttcttttaagcgtgctaaactagctaaagacatttcagcatgttttgtttgctgagctttaagtttagtttctaaatctgtaattgcttgttgaagtgaatcttcatagcgcaatacatcaacattgaagtcgcgtaattgtgaacgtttcgtatagcgtttttcaaaatggcttaatgctttgcggtcatggaaaaatacaccttcagtttcagtagggttatgtaaatcaccttgtttcgggtgtttgataacttgttcaactttaacaaggacatcgtctccattttcttcaacaatcgtgacaccatagctacctgttttgtgtgaaaatcgatatagcttcatgctattttcctcccttaaaagtatgttaatatatatgtatcataacatgaatggagaatataaatggctaactatccacagttaaacaaagaagtacaacaaggtgaaatcaaagtggttatgcacacaaataaaggtgacatgacattcaaattatttccaaatattgcaccaaaaacagttgaaaattttgtgacacatgcaaaaaatggttattatgatggaatcacattccaccgtgtcattaatgacttcatgattcaaggtggcgatccaacagctactggtatgggtggcgaaagtatttatggcggtgcttttgaagatgaattttcattaaatgcatttaacttatatggcgcattatcaatggctaactcaggacctaatactaatggttcacaatttttcattgttcaaatgaaagaagtacctcaaaatatgttaagtcaacttgcagatggtggctggcctcaaccaatcgttgatgcatatggcgaaaagggtggtacaccatggttagatcaaaaacatacagtattcggtcaaatcattgatggtgaaactacattagaagatattgcaaatacaaaagtgggaccacaagataaaccacttcatgatgttgtaattgaatctattgatgttgaagaataatatctaaacataattaactaccaacattttaaactcggataaagctaatttatgaatggattagtatatattccaacgaaaataaataaactaatatgatgagcaatctcaatatatttatcaagaaagcacagtttttaaatagatgtgtattttaaagataatagttgaggttgctttttatgtttttacagagaattgctattcaaatagtaaataaattgaaaacaaagtagctggatatcatattgatttagataggaatttgttgctaattttatttgtaaatccaagtttgtagaattcttattcatttataaaataatattcgtatgatttgattttttaattagtccaccatttcgatttgtgctatgataatagtgttaagtaaacgaaataaggggttattaagttgaataactacaaaattggccaacatatcaaggtgcgtgtactggtattcaaccatacggtgcgtttgttgagacccctaatcatactgaaggactgattcatatatcagaaattatggatgactacgttcataatttgaagaaatttctatcagaaggccaaattgttaaagctaaaattttgtctatagatgatgaaggaaagcttaatctatcattaaaggataatgattacttcaaaaattatgagcgtaagaaggaaaaacaatcagtattagatgaaatcagagaaacagaaaaatatgggtttcaaacacttaaagaacgcttaccaatctggataaaacagtcaaagcgagcaattcgaaacgactaaaggaacagataaatcgtaccgaaaatcatacaaagggtctgaaatgaaagtttcttagactataaaagagattagtatctattaaattttattagatactaatctctttttgtctacgataacgtaatatgattgattctatttacacgtacaaatggtttaaggtgacatatccattatctttgttagatagaatcgttgatttgcaatattgtatgtggatttgttttttttatttattttagaaatgagaactacaacttaaagtattaaacgaattgcaactatataaacagataattggagaatgaaaaaattacatgttatagtcaactcaataattttaaggaggaattaagtaatgaaaagtaaatacgaaccattgtttgataaagtagaattaccaaatggagtagagttgagaaatcgatttgtgttagcccctttaacacatatttcttcaaatgatgatggtactatttcagatgtagaacttccttatattgaaaagcgttcacaagatgttggtattacaattaatgctgcgagtaatgtgagtgatgtcggaaaagcatttccaggacagccatcaatcgcgcatgacagtaatattgaaggactaaaacgattagctacagcaatgaagaaaaacggtgccaaagcactcgtacaaatacatcatggcggtgcacaagcattgcctgaattaacacctgatggagacgtcgtagcaccaagtccaatttctttaaaaagttttggtcagaaacaagaacatagtgctagagaaatgacgaatgaagagattgaacaagcaatcaaggattttggtgaagcaacgcgacgtgcaattgaagcagggtttgatggtgttgaaatacatggcgcgaatcattacttaattcatcaatttgtatcaccatactataatagaagaaatgatgtatgggcaaatcaatataaattcccggtcgctgtgattgaagaagtacttaaagcgaaagaagcgtatggcaataaagactttatagttggatacagattatctccagaggaagcggagtctccaggaatcacaatggaaattacagaggaactcgttaataaaattagccatatgccaatcgactatattcatgtttcaatgatggatacgcatgcaacgacacgtgaaggtaaatacgctggacaagaaagactgcctttaattcacaaatggataaatggtcgtatgccacttatcggtattggttcaattttcacagctgacgaagctttagatgcagttgaaaatgttggtgttgacttagtagccattggtagagagctactactggattatcaatttgttgaaaaaattaaagatggacgggaagatgaaattattaattactttgatccagagagagaagataatcatcacttaactcctaatttatggcatcaatttaatgaagggttttatccattaccacgta

SEQ ID NO: 63 - DNA, 8155 bp; double-stranded, linear
tttgatanaaaactgaatnaattaaatgtatcgattcaacctaatgaagtgaatttacaagttaaagtagagccttttagcanaaaggttaaagtaaatgttaaacagaaaggtagtttagcagatgataaagagttaagttcgattgatttagaagataaagaaattgaaatcttcggtagtcgagatgacttacaaaatataagcgaagttgatgcagaagtagatttagatggtatttcagaatcaactgaaaagactgtaaaaatcaatttwccagaacatgtcactaaagcacaaccaagtgaaacgmaggcttatataaatgtaaaataaatagctaaattaaaggagagtaaacaatgggaaaatattttggtacagacggagtaagaggtgtcgcaaaccaagaactaacacctgaattggcatttaaattaggaagatacggtggctatgttctagcacataataaaggtgaaaaacacccacgtgtacttgtaggtcgcgatactagagtttcaggtgaaatgttagaatcagcattaatagctggtttgatttcaattggtgcagaagtgatgcgattaggtattatttcaacaccaggtgttgcatatttaacacgcgatatgggtgcagagttaggtgtaatgatttcagcctctcataatccagttgcagataatggtattaaattctttggatcagatggttttaaactatcagatgaacaagaaaatgaaattgaagcattattggatcaagaaaacccagaattaccaagaccagttggcaatgatattgtacattattcagattactttgaaggggcacaaaaatatttgagctatttaaaatcaacagtagatgttaactttgaaggtttgaaaattgctttagatggtgcaaatggttcaacatcatcactagcgccattcttatttggtgacttagaagcagatactgaaacaattggatgtagtcctgatggatataatatcaatgagaaatgtggctctacacatcctgaaaaattagctgaaaaagtagttgaaactgaaagtgattttgggttagcatttgacggcgatggagacagaatcatagcagtagatgagaatggtcaaatcgttgacggtgaccaaattatgtttattattggtcaagaaatgcataaaaatcaagaattgaataatgacatgattgtttctactgttatgagtaatttaggtttttacaaagcgcttgaacaagaaggaattaaatctaataaaactaaagttggcgacagatatgtagtagaagaaatgcgtcgcggtaattataacttaggtggagaacaatctggacatatcgttatgatggattacaatacaactggtgatggtttattaactggtattcaattagcttctgtaataaaaatgactggtaaatcactaagtgaattagctggacaaatgaaaaaatatccacaatcattaattaacgtacgcgtaacagataaatatcgtgttgaagaaaatgttgacgttaaagaagttatgactaaagtagaagtagaaatgaatggagaaggtcgaattttagtaagaccttctggaacaaaccattagttcgtgtcatggttgaagcagcaactgatgaagatgctgaaagatttgcacaacaaatagctgatgtggttcaagataaaatgggattagataaataaatactgtattacaaatgagccgatgcgtatgcantcgttttttgtgtttgtagaaataatttatagtacaaacgtaaaatgatataaacaaaataaaaacaaagtaatcaatatgtaatataaaatacactggtactcaatatataatgatgataaaattaattttaattagatagagttgctttgtgtttttaacgcagatgctactacttatcttaacagttgattaagtgaaatcatttaacagcgagaataatcaaccaggaggatgacttaatgaatttattcagacaacaaaaatttagtatcagaaaatttaatgtcggtattttttcagctttaattgccactgttacttttatatctactaacccgacaacagcgtctgcagcagagcaaaatcagcctgcacaaaatcaaccagcacaaccagctgatgccaatacacagcctaacgcaaatgctggtgctcaagctaatcctacagcacagccagctgcacctgccaaccaaggacaaccagcagtacaaccagcaaaccaaggtggacaggctaatccagcaggaggagcagcacaaccaaatacacaaccagctggacaaggtgatcaagctgatccgaataacgctgcacaagcacaacctggaaatcaagcaacaccggcaaaccaagcaggtcaaggaaataaccaagcaacacctaataataatgcaacaccggcaaatcaaacacagccagcgaatgctccagcagcagcgcaaccagcagcacctgtagcagcaaacgcacaaactcaagatccaaatgctagcaatactggtgaaggcagtattaatacgacattaacatttgatgatcctgccatatcaacagatgagaatagacaggatccaactgtaactgttacagataaagtaaatggttattcattaattaacaacggtaagattggtttcgttaactcagaattaagacgaagcgatatgtttgataagaataaccctcaaaactatcaagctaaaggaaacgtggctgcattaggtcgtgtgaatgcaaatgattctacagatcatggtaactttaacggtatttcaaaaactgtaaatgtaaaaccagattcagaattaattattaactttactactatgcaaacgaatagtaagcaaggtgcaacaaatttagttattaaagatgctaagaaaaatactgaattagcaactgtaaatgttgctaagactggtactgcacatttatttaaagtaccaactgatgctgatcgtttagatttacaatttattcctgacaatacagcagttgctgatgcttcaagaattacaacaaataaagatggttataaatactattcattcattgataatgtaggtctattctcaggatcacatttatatgtcaaaaatagagatttagcaccgaaagcaactaacaataaagaatatactattaatactgaaatcggtaacaatggtaattttggtgcttcattaaaagcagatcaatttaaatatgaagtaacattaccacaaggtgtaacttacgttaataattcattaactacaacattccctaatggtaatgaagacagtacagtattgaaaaatatgactgttaattatgatcaaaatgcaaataaagttacatttacaagccaaggtgtgacaacggcacgtggtacacacactaaagaagttttattcccagataaatctttaaaattatcatataaagttaatgttgcgaatatcgatacacctaaaaatattgattttaatgaaaaattaacatatcgtactgcttcagatgttgtaattaataatgcgcaaccagaagtacactaactgcagatccattttcagtagcggttgaaatgaacaaagatgcgttgcaacaacaagtaaactcacaagttgataatagtcattacacaacagcatcaattgcagaatacaataaacttaaacaacaagcagatactattttaaatgaagatgcgaatcatgttaaaactgcaaatcgtgcatctcaagcggatattgatggtttagtaactaaattacaagctgcattaattgataatcaagcagcaattgctgaattagatactaaagctcaagaaaaggttacagcagcacaacaaagtaaaaaagttacgcaagatgaagttgcagcacttgtaactaaaattaacaatgataaaaataatgcaatcgcagaaattaataaacaaactacagcacaaggtgtcacaactgaaaaagataatggtatcgcagtgttagaacaagatgtgattacaccaacagttaaacctcaagcgaaacaagatattatccaagcagttacaactcgtaaacaacaaattaaaaagtcaaatgcatcattacaagatgaaaaagatgtagcaaatgataaaattggtaaaattgaaacaaaggcaattaaagatattgatgcagcaacaacaaatgcacaagtagaagccattaaaacaaaagcaatcaatgatattaatcaaactacacctgctacaacagctaaagcagcagctcttgaagaatttgacgaagttgttcaagcacaaattgatcaagcacctttaaatcctgatacaacaaatgaagaagtagcggaagctattgaacgtattaatgcagctaaagtttctggtgttaaagcaattgaagcgacaacgactgcacaagatttagaaagagttaaaaacgaagaaatctcaaaaattgaaaatattactgactctacgcaaacaaaaatggatgcctataatgaagttaaacaagctgcaacagctagaaaagctcaaaatgctacagtttcaaatgcaacaaatgaagaagtagcagaagctgatgcagcagtagatgcagctcaaaagcaaggtttacatgacatccaagttgttaaatcaaaacaggaagttgctgatacaaaatcaaaagtattagataaaatcaatgcaattcaaacacaagcaaaagttaaacctgcagctgatacggaagtagaaaacgcatataatacacgtaaacaagaaattcaaaatagcaatgcttcaactacagaagaaaaacaagctgcatatacagaattagatactaaaaagcaagaagcaagaacaaatcttgatgctgcaaatacaaacagtgatgtaacaacagctaaagacaatagtattgctgcaattaatcaagttcaagctgccacaactaagaaatcggatgcaaaagcggaaatcgctcaaaaagcaagtgaacgtaaaacagcaattgaagcaatgaatgattcgactactgaagaacaacaagcagcgaaagacaaagtggatcaagcagtagttactgcaaacgctgatatagataatgctgcagcaaacaatgatgtggataatgcaaaaactacaaatgaagctacaatcgcagccattacacctgatgcaaatgttaaaccagcagcaaaacaagcaattgcagataaagtacaagctcaagaaacagcaattgatggaaataacggctcaacaactgaagaaaaagcagctgctaaacaacaagttcaaactgaaaaaacaacagctgatgccgcaatagatgcagcacatacaaatgcggaagttgaagcggctaaaaaagcagcaattgctaaaattgaagcgattcagccagcaacaacaactaaagataatgcgaaagaagcaattgctacgaaagcgaatgaacgtaaaacagcaatcgctcaaacgcaagacattactgctgaagaaattgcagcggctaatgcggacgtagataatgctgtgacacaagcaaatagcaacattgaagctgctaatagtcaaaatgatgtagaccaagcgaaaacgacaggtgaaaatagtattgatcaagtaacaccaacagttaataaaaaagcaactgcacgtaatgaaatcacagcaattttaaataacaaattgcaagagattcaagctacgccagatgcaacagatgaagaaaaacaagcagctgatgctgaagcaaatactgaaaatggtaaagcaaatcaagccatttcagcagcaactactaacgcacaagttgatgaagctaaagcaaatgcagaagcagcgattaatgcggtaacaccaaaagttgtgaagaaacaagcggctaaagatgaaattgatcaattacaagcaacgcaaacaaatgttatcaataatgatcagaacgctacaacagaagaaaaagaagcagctattcaacaattagcaacagcagttacagacgcgaaaaataatattacagctgcaactgatgataatggtgtagatcaggcgaaagacgctggaaagaattcaattcaaagcacgcaaccagcaacagcggttaaatcaaatgctaaaaatgatgttgatcaagctgtgacaactcaaaatcaagcaattgataatacaactggtgctacaactgaagagaaaaatgcagcaaaagatttagttttaaaagctaaagaaaaagcgtatcaagatatcttaaatgcacaaacaactaatgatgttacgcaaattaaagatcaagcagttgctgatattcaaggtattactgcagatacaacaattaaagatgttgcgaaagatgaattagcaacaaaagcaaacgaacaaaaagcgcttattgcacaaactgcagatgcgactactgaagaaaaagaacaagcaaatcaacaagtagacgcacaattaacacaaggtaatcaaaatattgaaaatgcacagtcaatcgatgatgtaaacactgcaaaagataatgcaattcaagcaattgacccaattcaagcatcaacagatgttaaaacgaatgcaagagcggaattgctaactgaaatgcaaaataaaataactgaaatacttaataataatgagactactaatgaagaaaaaggtaacgatattggaccagttagagcagcatatgaagaaggtttaaataatattaatgcagcaactactacaggtgatgtaactactgctaaagatacagcagtacaaaaagttcaacaacttcatgcaaatcctgttaagaaaccagcaggtaaaaaagaattagatcaagctgcagctgataagaaaacacaaatagaacaaacaccaaatgcatcacaacaagaaattaatgatgcaaaacaagaagttgatactgaattaaatcaagcgaaaacaaatgtcgatcaatcatcaacaaatgaatatgttgataatgcagttaaagaaggaaaagctaaaattaatgcagttaaaacatttagtgagtacaaaaaagatgctttagctaaaattgaagatgcatataatgctaaagtaaacgaagcggataactctaacgcatcgacttcaagtgaaattgctgaagcgaaacaaaaacttgctgaattaaaacaaactgcggatcaaaatgttaatcaagctacttctaaagatgacattgaagttcaaattcataatgacttagataatattaacgattacacaattccaacaggtaaaaaagaatcagctacaacagatttatatgcttatgcagatcagaagaaaaataatatttcagctgacactaatgcaacacaagatgaaaagcaacaagcaattaagcaagttgaccaaaatgttcaaactgcattagaaagcattaataatggtgtggataatggtgacgttgatgatgcattaacacaaggtaaagcagcaattgatgctattcaagtagatgctactgttaaacctaaagcgaaccaagctattgaagttaaagcagaagatacgaaagaatctattgatcaaagtgaccagttaactgctgaagaaaaaactgaagcattagcaatgattaaacaaattacagatcaagctaaacaaggtattactgatgcaacaacaactgctgaagttgaaaaagcgaaagctcaaggacttgaagcatttgataacattcaaatcgactcaacagaaaaacaaaaagctatcgaagaattagaaactgcactagaccagattgaagcaggtgtaaatgtcaacgctgatgctacaactgaagaaaaagaagcgtttacgaatgctttagaagacattttatcaaaagcaactgaagatatttctgatcaaactacaaatgcagaaatcgctactgtcaaaaatagtgcgcttgaacaacttaaagcacaacgtattaatcctgaagttaagaaaaatgctttggaagcaatcagagaagtggttaacaagcaaataggaataattaaaaatgcagatgcagatgcatcggcggaaaganattgcacgtacgggatttaggtagatattttggaccgatttgctggataaatttagggtnaaaccccaaccaatgccgaagttgcctgaattacca

SEQ ID NO: 64 - DNA, 1630 bp; double-stranded, linear
tttgggcccattgggaccggtatgttttagagatatctgaaattgtaaaacgtgttggatctgttttatttgcagcacccatactggaaatcactttaatccctcggtcaagacactctttcattaagtgtactttgtacattattgtatcacttgcatctacaaaataatctatatcgtagttatcgaaaatttcttcatatgtctcttctgtataaaacatatgtaagggcgtgactttacaatctggattaattaatttaatacgttcttccatcaaagaaactttactttgtcctaccgttgtagttaaagcgtgtaattgtctgtttacatttgtaatatcaacatcatctttatctattaatataatatgaccaatattcgttcttgctaatgcttcagcagcaaatgaaccaacacctccaacgccaagtatgacaacagtttgttgcttcaataaatctaaaccttgttgtccaatcgctagttcatttcttgaaaattgatgtttcattattttacctctttcactgatttatacataagtacatagtaacttaaaattttatatttagcattatcactttgattattttcccaaaattcaacgaggaaacatttattaaacgctataaaacccaactaattctttattaaaaacttaaagaaacgcataaaaatacgcaagacaaagtcttgcgtatcgatagagtccgtattgccgtagttataatagcttgatcattcggcctgttatatacaggtgggtgccctgtttcttgttttgtacgtccttcatataaggcgtgtacgctgcaagaaaacccattgggctcccttgatcaaagagtgttaggcccaaattaaaaagcaaacttacgaacaactcagatgactatcttatgatgttatattaccacataattaaaattaatgaaattataacaaaccaaagtttattgattttttaaaatttagtgacgaattcgcaaagaaagttcttctaattgtttatcagaaacttcactaggcgcattcgttaataaacatgtagcagatgctgttttagggaatgcgattgtatctctcaagtttgttctattagtcaataacatgactaatcggtctaatcctaatgcaataccgccatgtggtggtgcaccatatttaaatgcatctagtaagaagccgaactgttcctgtgcttgttctttagtaaatccaagaacttcgaacattttttcttgtaactcaccatcatgaattctgattgaaccgccacctaattcataaccatttaatactatgtcataagcatttgcctcagcttcttctggcgcagtgccaagcttagcaatatcagcttcttttggagatgtaaatggatgatgtgctgcaacgtaacgtttcgcatcttcatcatattctaataatggccaatctgtcacccataagaagtttaattttgtttcatcgattaaacctaattctttagctaatttgacacgtaatgcacctaaactttgtgcaacgacatttggtttgtctgcaacaaacattactaagtcaccagcttcagcaccagttaatgtaagtaatgtttcaacattttctgttcaaagaaacg

SEQ ID NO: 65 - DNA, 732 bp; double-stranded, linear
caattggacatcttgtatgaaaaggacaaccttgcggcggattacttggcgaaggtaattctccttttaatataattctattgttattatgtttatcaatttgtggtattgatgaaatcaacgcttttgtatatggatgtttgggattttcataaatttctttatcagatgcgatttcaactatatgacctaaatacataactccaatgacatcacttatatgttttactacacttaaatcatgtgcgataaataaatagcttaagttaaattgttcttgtaaatcttttaataaattcagtacttgagattgaacagatacatctaatgcacttacaggctcatcagcaacaattaaactcggacgcaaagccaatgctcttgcaattcccactctttgtctctgtccacctgaaaattcatgtgcatatttataatatgcatcttcacttaggccaacacattttaataaatatagtacttctttttttatttcttcttttggcaattttttataatttaaaataggttctgaaatgatatctccaaccatttgcatcggattcaatgatgcatacggatcttgaaatatcatctgatattgttgtcgtgattttctgagttttttaccttgtaatcttgttatatcttcaccattaacaattattgagcctgaagttgcatcttcaagcctgataatcactttacctaacgttgacttaccacaacccg

SEQ ID NO: 66 - DNA, 5838 bp; double-stranded, linear
aatatattcatatgtttcatcaacaatattagctgctttttgaattaaagcaatttcgtcagcatctttgacgtctctaattttatctacagtattagaaatgcttattaatgatatacggcttttatttaattcaaggtatgtatcataacttacatgatgcccctcaaaacctacattttcaaaattttcttggtgtagcaattctttaatctcaccaataatagtagatttacgattaataatttcataatttggcgcctgcttagttgcttgatcaatatatctaaagtctgttatcaaatattgtttatctttagatatgataagtgctccactggtaccagtaaaacctgataaatatcttctattgtaatccgaaagaatgataatcgcatctaaatgtttttgttctaaaatacgatgcacttgtgttattctgctcatcttattacctcctagtgaacggtttgtgcatttcaactttatacattaaaataatatcataataaggataaaaaataatagatattgattttagggagatagtaatgaaaaaattggtttcaattgttggcgcaacattattgttagctggatgtggatcacaaaatttagcaccattagaaganaaaacaacagatttaagagaagataatcatcaactcaaactagatattcaagaacttaatcaacaaattagtgattctaaatctaaaattaaagggcttgaaaaggataaagaaaacagtaaaaaaactgcatctaataatacgaaaattaaattgatgaatgttacatcaacatactacgacaaagttgctaaagctttgaaatcctataacgatattgagaaagatgtaagtaaaaacaaaggcgataagaatgttcaatcgaaattaaatcaaatttctaatgatattcaaagtgctcacacttcatacaaagatgctatcgatggtttatcacttagtgatgatgataaaaaaacgtctaaaaatatcgataaattaaactctgatttgaatcatgcatttgatgatattaaaaatggctatcaaaataaagataaaaaacaacttacaaaaggacaacaagcgttgtcaaaattaaacttaaatgcaaaatcatgataggagtcttttaatgcgtaatataatattttatcttgtacttattattgctgcgattggattagtaatgaatctagatgcctttattttttcaatcgtcagaatgttaatcagctttgcgtaatagctggtattatttatctgatttattatttcttcatcttaactgaagaccaacgcaaatatcgcaaagcaatgcgtraagtataaaagaaatcaaagaagaaaatagataaaaaaacggaagcacttgtaggtaaaatagtctacgtgcttccattttttattctaaaaactactttctaaacatccattcatctgaacgatatttttcagttaattcttccacttctgccaattgagcttctgttaattcaagtggctttaattctatatttaaacctttcttaaaacctttctcgaaagcttcttccatttgactaatagtaatgtgttcatctgaaatatcattgatggcaactgctttttcaacgaatgcctctttcatttttaattttaatctttcatttttataaatraacatatcaaacagttcatcaatatcaatatcttgtaaaatcgaaccgtgttggaggattacgcccttttgtctcgtttgagcactcccagcaatcttacggccttcaacaactagctcataccaacttggtgcatcaaaacacactgaacttcgaggttgttttaatttttgacgctcttcaggcgttttaggtaccgcaaaataagtatcaaatcctaagtttttaaatccttctaataatccttgtgaaatcactctgtacgcttctgtaactgtagaaggcatattcggatgcgattcaggcacaatcacactgtaagttaactctttatcatgtagcaccccacggccaccagtttgacgccttacgagaccaaaacctttctctttaaccttatcaatatcaatttctttttgtagcctttggaaataccctattgataatgttgcaggattccatgtgtaaaaacgtataactggatcaatttcacctctagagacaaaatttaataacgcttcatccattgccatattataatatgggtctttacttcctgtattaataaaattccaagtttcagtcatattcaagaactcctatcagcaaaatgtataatatttgattcgctaattaatcaatttaactaaatgaataataattgcaattctttagtgaaatattttgataatttgacctaacagtcttataattatattatcgtttaattagggaggatgcaagatgagtgctagtttgtacatcgcaataattttagttatagcaattattgcttatatgattgttcaacaaattcttaacaagcgagctgttaaagaattagatcaaaatgaattccataatgggattagaaaagctcaagtcatcgatgttagagagaaagttgactatgactacggtcacattaatgggtctcgcaatattcctatgacaatgttcaggcaacgattccaaggattaagaaaagatcaaccggtatacttatgtgatgccaatgggattgctagctatagagccgctcgtattttgaaaaagaatggatatacagatatctatatgttaaaaggcggctataaaaaatggactggaaaaataaagtctaaaaaatagtttttgtaaatttaatatacgatttaataaaatctgagtgttaattgatcatcaataacaatactcagattttaattttttaacaaagtctgttactatatttctctagcttcactgatcattaaacttagtttcagcataataaagaaagttcagctcattttcaatacgattcaattaccgcaatctaaaaaatgaaaagacaatttctatgaaagaataataccaaaccctaagagttattacttcggtttagttttcttgtttaaatagaaattgtctttttcaattgattttgaaaccattatccttaaatcttcatacaaagttagaataataattctcggaatatgtgtttaatactttatttttcctgtttaagattttcaaactttaatattggtttacgagcagctgtagcttcgtctaatcgatcaatcacagttgtatgtggtgcttctagcactttatcaggatcatttttagcttcttcagcaatactaattaatgtatcgataaaataatcaagtgtttctttagactctgtctcagtcggttcaatcatcataccttcttcaacatttaatgggaagtatattgttggtggatgtacaccgaaatctaataatcgcttagccatgtctaaagtacgtacaccaaattctttttgacgcacaccacttaacacaaactcgtgtttacaatattgtttataaggtatttcaaagtgtttagataaacgtgctttaatataattcgcattaagaaccgctgcttcagaaacctctttaagtccagttgctcccatagttcgaatatacgtataagctcttaagtaaataccaaagttaccataaaatggttttacacgtccgatagaatttttaatgtcattatcatatttaaatttgtcgccatctttaataaccattggctttggtaagtaacttgctagttcttttactacaccgactggacctgaaccaggaccgccaccaccatgtggaccagtaaatgttttatgcaagtttaaatgaacagcatcaaatcccatatctcctgggcgaactttgtccataatagcgtttaaattcgcaccatcataatataatagaccaccagcattatggacgatttcacggatttccataatatttttttcgaaaatacctaaagtgtttggattagttaacataatagctgctgtattttcatttacaacacgtttcaagtcatcaatatcaacttcgccacgttcgtttgattttacagtaactgatttaaatcctgcaaatgaagctgaggctggattcgtaccatgcgcagaatctggcacaatgacttcatcacgatgaccttcaccattattctcatggtaagctttaaatatcatcaatgcagtccattcaccatgtgcgccagcagctggttgtaatgtcacctcatccataccagtaatttcttttaattcttcttgcaaactataaataatttctaatgaaccttgaacttgatcttcatcttgtaatggatgtgattcactaaatcctggtattctagcaaccttttcattaattttagggttatacttcatcgtacatgaacccaatggataaaatccgttgtctacaccgaaatttttatttgaaagttcagtataatgacgtactaagtctagttcagcaacttcaggaaactccgctttgtttttacgaataaatttatcatctaacaatgactcaacagaatttgttttaatatcactttttggtaatgaatatgcatatctgccttcacgagatctttcaaaaattaatggacttgatttactagtcatttaactcaccagccttttctacaaatgtatcgatttcatcttttgttcttaattcagttacagctattaacatgtgatttttaaagtcgtctgaaacaacacctaaatcaaaaccaccgataatattgtacttcactaattcctcgttaacttgttgaattggtttgtcaaatttgactacaaactcattgmnaagntgtaccatctaatacttcaaaaccttttttaataaattgttgtttagcatagttagcatgttctatattttgaactgcaatatcatagataccttgtttaccaagtgctgacattgcaattgatgacgctaaagcatttaatgcttggttagaacaaatattagatgtcgctttatcgcgtcgaatatgttgttcacgtgcttgtaatgttaatacaaagccacgattaccttcatcatcttgtgtttgaccgactaatctacctggcactttacgcattaactttttcgtcgttgcaaaatatccacaatgtggcccaccgaattgagcaggaattccgaatggctgagtatcacctacaacaatatctgcaccaaatgaacctggaggtgtaagtaatcccaatgctaatggatttgcatatacgataaataatgcttttttatcttcaataaagctatgaatcttttcaagatcttcaattgaaccgtaaaagtttggatattgtactgcaacagctgctgtttcatcatccactgctgcttctaattttttcaaatctgtaacagtgccatctaaatcgatttccactacttcgaattccttacgcgtcttagcataagtatgaagtacttgtaatgcttgataatgtaaaccttttgagactacaattttatttttctttgtttgactaaatgctaagatacatgcttcagcaaagctagtcatcccatcatacatagaagaatttgctacatccatatctgttaattcacaaattaaagtttggaactcaaaaatggcttgtaattcaccttgagaaatttccggttgatatggcgtatatgctgtgtaaaattctgatcttgaaatcatagcatccacaactgatggcgcgtaatgatcataaacaccagcacccaraaatgatgtatgcgtttctttagtgatattcttgctkgcaatggggatttaaacntctaagtaacggtgtntccgcg

SEQ ID NO: 67 - DNA, 18355 bp; double-stranded, linear
atnataattggctttgctaataattacttccctgaattacaagtattagcaaacgaaataaaatctgatatggctagttcattaaaacaatgatatttttatttaaatttttaaagctttgtacgaaattgtacaaagcttttttggtgcgtattgtatgggcaacaacttgacgatgaaaatccgttacaggattggtaataggaaatgttagcgaaagacaagggtatccattgtagattaacaaaaggacgtttccacaagtgtgggttattctcactaaagcaatacgcagagacaacttacgtaaaattttgaactgactagaacggaacttctactcaattattgataaaaattttcaaaaagacttgaatgtgctgagaatacgaagtttatggaaggattatcaaaatataaatgtgcattcatttacaacctttattgacaatgattctcaactaatatagtatataatcaaatcgtaatagttacgatttgttttctgcaacttttttgaagttttagttgaggtgaaaacaataaaagcatctaagtgaatgtagttaacggacaactgcattcgcttgtagagccacaagaagcaactttaaataaggtttacggttgcattttgatacaacaaccgattactaagtcatgctttccactttgcgggttagcatgacttacctaatagatagagctattaggttcagcttctaaaaaattacagttttagaggaatacagttgcttgcttcgcaacaactgcataagagccatggttttcgcttttgcgaattagcatgacttacctactagatagagctattaggttcatcttctaaaaaattacaggtttagaggaatacagttgtttgcttcgcaacaactgcataagagcctctagtaattaaaattacagaggctctaaaaatacatctaaaggagtgtcgtatgaatcggcaggttatagaattttctaagtataatccttcggggaatatgacgatacttgttcattcaaaacatgatgctagtgaatatgcatctatcgccaatcagttgatggccgcaacacatgtatgctgtgaacaggtaggctttatagratcaacacaaaatgatgatggtaatgattttcacttagttatgagcggtaatgaattttgcggtaatgcgacgatgtcatatatacatcatttgcaggaaagtcatttgcttaaagaccaacagtttaaggtgaaggtgtctggctgttcggatttagtgcaatgcgcaattcatgattgccaatactatgaagttcaaatgccacaagcccatcgtgttgtgccaacaacaattaatatgggtaatcattcatggaaagcaatagaaattatttatgaaacatatgtacattatgtgattccagttaaacaagtaacaacagaaattcaacatttggttgaagcgtttgtgcgtgagcaacaatggagtcacaaatataaaacagtaggtatgatgctttttgatgaacaacgtcaatttttacagccattaatctatataccagaaattcaaagtttaatttgggaaaatagctgtggttctggtacagcatcaattggggtttttaataattatcaacgtaatgacgcatgcaaagattttacagtacatcagccagggggcagtattttagtgacatcaaagcgatgtcatcaattgggatatcaaacttcaattaaaggacaggttacaactgtagctacaggaaaagcatatatagaataaggagcctacaatgaataactttaataatgaaatcaaattgatattacaacaatatttagaaaagtttgaagcgcattacgagcgtgtattacaagacgatcaatatatcgaagcattagaaacattgatggatgactatagtgaatttattttaaatcctatttatgaacaacaatttaatgcttggcgtgacgttgaagaaaaagcacaattaataaaatcactgcaatatattacagcgcagtgtgttaaacaagtggaagtcattagagcgagacgtctattagacggacaggcgtctaccacaggttactttgacaatatagaacattgtattgatgaagagtttggacaatgtagtatagctagcaatgacaaattattgttagttggttcaggtgcatatccaatgacgttaattcaagtagcaaaagaaacaggtgcttcagttatcggtattgatattgatccacaagccgttgacctagggcgcagaatcgttaacgtcttagcaccaaatgaagatataacaattacggatcaaaaggtatctgaacttaaagatatcaaagatgtgacgcatatcatattcagctcgacaattcctttaaagtacagcattttagaagaattatatgatttaacaaatgaaaatgtcgtagttgcaatgcgctttggtgatggcatcaaagcaatatttaattatccgtcacaagaaacagcggaagataagtggcaatgtgtgaataaacatatgagaccacagcaaatttttgatatagcactttataaaaaagcagctataaaggtaggtattacggatgtctaaattattaatgataggcactggtccggtcgcaatccaattagcgaatatttgctatttaaaatcagattatgagattgatatggttggacgtgcctcaacatcagaaaaatcaaaacgcttatatcaagcgtataaaaaagagaaacaatttgaagtcaaaatacaaaacgaggcgcatcaacatctggaaggtaagtttgaaattaatcgtttgtataaagatgttaaaaacgttaagggtgaatacgaaacggttgtcatggcatgcacagcagatgcttattatgacacactacagcaattgtcgttagaaactttgcaaagtgtcaaacatgtcattttaatatcaccgacatttggttcgcaaatgattgtcgaacaatttatgtctaaatttaataaagatatcgaagtgatttcattctcaacttatcttggcgatacacgtattgttgataaagaagcgcctaatcatgtgttgacaacaggtgtaaaaaagaaattgtacatgggatcgacacattcaaactcaacaatgtgtcaacgaatctctgctttagctgagcaattgaagattcaattagaagtcgttgaatcgccactgcatgctgaaacgcgaaacagttcgctttatgtgcacccaccactatttatgaatgacttttcattgaaagccattttcgaaggaacagatgtaccggtttatgtgtataagttatttcctgaaggaccgataacgatgacactaatccgtgaaatgcgtttaatgtggaaggaaatgatggttattttacaagcatttagagtgccgtcagtcaacctgcttcaatttatggtgaaggaaaattatccagtacgtcctgaaactttggatgaaggtgatattgagcatttcgaaatcttgccagatatcttacaagaatatctgctttatgtaagatataccgcaatcctcattgatccattttcacagccagacgaaaacggacattactttgatttttcagctgtaccatttaagcaagtctataaaaatgaacaggatgttgttcaaattccaagaatgccaagtgaagattattacagaacggcgatgattcagcatattgggaaaatgctaggtatcaaaacgccaatgattgatcagttcctaactcgctatgaagcaagttgccaggcgtacaaggatatgcatcaagatcaacacttatcttctcaatttaatacaaatctatttgaaggagataaagcactcgtcacaaaatttttggaaatcaatagaacgctttcataataagggtttgaagttttataatagaaaaaaattattgaattatgtttgacatttacataaaaataagcaaataattgagaaaaataatcattacgatttgattaagtaatgcaacttatcaatttagaaagaggaaaagcaaatgagaaaactaactaaaatgagtgcaatgttacttgcatcagggctaattttaactggttgtggcggtaataaaggtttagaggagaaaaaagaaaacaagcaattaacgtatacgacggttaaagatatcggtgatatgaatccgcatgtttacggtggatcaatgtctgctgaaagtatgatatacgagccgcttgtacgtaacacgaaagatggtattaagcctttactagctaaaaagtgggatgtgtctgaagatgggaagacatacacgttccatttgagagatgacgttaaattccatgatggtacgccatttgcatgctgacgcagttaagaaaaatattgacgcagttcaagaaaacaaaaaattgcattcttggttaaagatttcgacattaattgacaatgttaaagttaaagataagtacacggttgaattgaatttgaaagaagcatatcaacctgcattggctgaattagcgatgcctcgtccatatgtatttgtgtctccaaaagactttaaaaacggtacaacaaaagatggcgttaaaaagttcgatggtactggtccatttaaattaggtgaacacaaaaaagatgagtctgcagactttaacaaaaatgatcaatactggggcgaaaagtctaaacttaacaaagtacaagcaaaagtaatgcctgctggtgaaacagcattcctatcaatgaaaaaaggtgaaacgaactttgccttcacagatgatagaggtacagatagcttagacaaagactctttaaaacaattgaaagatacaggtgactatcaagttaagcgtagtcaacctatgaatacgaaaatgttagttgtcaattctggtaaaaaagataacgctgtgagtgacaaaacagtcagacaagcgattggtcatatggtaaacagagataaaattgccaaagaaattttagatggtcaagaaaaaccagcaactcaattatttgcgaaaaatgtaacagacattaatttcgatatgccaacacgtaagtatgaccttaaaaaagcagaatcattattagatgaagctggttggaagaaaggtaaagacagcgatgttcgtcaaaaagatggtaaaaaccttgaaatggcaatgtactatgacaaaggttcttcaagtcaaaaagaacaagcagaatacttacaagcagaatttaagaaaatgggtattaagttaaacatcaatggcgaaacatcagataaaattgctgaacgtcgtacttctggtgattatgacttaatgttcaaccaaacttggggattattgtacgatccacaaagtactattgcagcatttaaagagaaaaatggttatgaaagtgcaacatcaggcattgagaacaaagataaaatatacaacagcattgatgacgcatttaaaatccaaaacggtaaagagcgttcagacgcttataaaaacattttgaaacaaattgatgatgaaggtatctttatccctatttcacacggtagtatgacagttgttgcaccaaaagatttagaaaaagtatcattcacacaatcacagtatgaattaccattcaatgaaatgcagtataaataaaggagcaattagatgttcaaatttatcttaaaacgtattgcgctcatgtttccattgatgattgtagtaagttttatgacatttctattgacgtatattacaaatgaaaatccagctgtgacaattttacatgcacaagggacgccaaatgtaacaccagagttgattgcagaaacgaatgagaagtacggtttcaatgatccattattaattcaatataaaaattggttacttgaagcgatgcaatttaattttggtacaagctacattacaggtgacccagttgctgaacgtattggtccagcatttatgaatacattgaaattaacaataatttcaagtgttatggtgatgattacatcaattattttaggtgtagttagtgcattaaaaagaggaaagttcactgatcgtgcgatacgttcagtggctttctttctaactgcattaccatcatattggatagcttcaatacttattatttacgtttcagtgaagttaaacatattgccgacttctggattaacaggtccagaaagttacatattgccagtgatcgttattacgattgcctatgctggtatttactttagaaatgttagacgctcgatggtggaacaattaaatgaagattatgtactttatttaagagcaagcggtgtgaaatctatcacattaatgttgcatgtgttgcgtaatgctttacaagttgcggtatcaatcttttgtatgtctataccaatgataatgggtggactagttgttatcgagtatatctttgcatggcctggactaggtcaattaagtttaaaagcaatacttgaacacgattttccagtcattcaagcatatgtattaattgtagcggtattatttattgtatttaatacattagcagatatcattaatgcgctattaaatccaagattaagggagggcgcacgatgataattttaaamcgattattmcargwtaaaggtgcagtaattgctttaggcattattgtattatatgtctttttaggattagcagcaccacttgtgacattttatgatcctaaccatatcgatacagcaaacaaatttgctggcatgagttttcaacatctactaggtactgaccatttaggtagagatattttaactaggttaatttatgcgattagaccaagtttgttatatgtctttgttgcgctatttgtttctgtacttattggatctattttaggattcttatcaggatatttccaagggtttgttgacgccttaatcatgcgtgcgtgtgatgttatgttggcattcccaagttatgttgtaacgttagcattaattgcattgtttggaatgggtgccgaaaatattatcatggcatttattttgacgcgttgggcatggttctgtcgtgttatacgtacaagtgttatgcagtacactgcttctgaccatgtaagatttgctaaaacaatcggtatgaatgatatgaaaattattcacaaacatattatgccattaacattagcagatattgctatcatctctagtagctcgatgtgttcaatgatcttgcaaatatctggcttttcatttttaggattaggtgtcaaagcgcctactgcagagtggggcatgatgcttaacgaagctagaaaagtgatgtttacacatcctgaaatgatgtttgcgccaggtattgccatagtgattatagtgatggcatttaacttcttatccgatgctttacaaattgctattgatccccgcatctcttctaaagataaacttcgttctgtgaaaaaaggagtggtgcaatcatgacattgttaacagttaaacatttgacgattacagatacctggacagatcaaccactcgtgagtgatgtgaattttacattaactaagggtgaaactttaggcgttattggagaaagtggtagtggtaaatcaatcacttgtaaatcgattattggtttgaatcccgaacgactcggggtgacaggtgaaattatctttgatggtacatcaatgttgtcattatctgaatcgcaattgaaaaagtaccgtggtaaagacattgcgatggtcatgcaacaaggtagtcgtgcctttgacccatcaactactgtcggtaaacaaatgtttgagactatgaaagtacatacgtcaatgtctacacaagaaattgaaaagacattgattgaatatatggattatttaagtttgaaagatcctaaacgtatattaaaatcatacccttacatgttatcaggaggaatgttacagcgattgatgattgctttagcgttagctttgaaaccaaagttaatcattgctgatgagccgacaacggctttagatacaattacacaatatgatgtactggaagcatttatagatattaaaaaacactttgactgtgcgatgattttcatttcacatgatttaacggttattaacaagattgcagaccgtgttgttgtgatgaaaaatggtcagcttattgaacaagggacacgtgaatcagtcttgcatcatccagaacatgtttatacgartattktattatcaacgaagaagaagattaatgatcattttaaacatgtgatgaggggtgatgtacatgattaaaattaaagatgttgaaaagtcatatcaaagcgcacatgtttttaagcgtcgtcgaacacctatcgtgaaaggtgtgtcatttgagtgtccaatcggtgcgacgattgcgattatcggagaaagtggtagcggtaaatcgacgttgagtcktatgatattaggtattgagaaaccggataaaggttgtgtaaccttaaatgatcaaccgatgcataagaagaaagtgagacgtcatcaaattggtgctgtatttcaagattatacgtcatcattacatccatttcagactgttagagaaatcttatttgaagtgatgtgtcaatgtgatggacaacctaaagaagttatggaagtccaagcaattacattgttggaagaagtcggtctatctaaggcatacatggataaatatcctaatatgttatcaggtggagaggcgcaacgtgttgcgattgcgcgtgcaatatgtattaaccctaaatatattttgtttgatgaagccattagttcactcgacatgtcaattcaaacacaaatattagatttattgattcatttacgtgaaacgcgtcagttgagttatatttttatcacacatgatattcaagctgccacgtatttatgtgatcaattaattatttttaaaaacggaaaaatagaagaacaaattccgacaagcgcattgcataaaagtgacaatgcttatacaagagaattaatagaaaaacaactatcattctaaggagtgagataatgaaaggtgcaatggcttggccctttttgagattatatatattaacattgatgttctttagtgccaatgcaatcttaaacgtgtttatacctttacgagggcatgatttaggcgcaacgaatacggttatcggtatcgttatgggggcatacatgttaacagcaatggtatttcgaccatgggcaggacaaattattgctcgtgtcggtcccattaaagtattaagaattattttgattatcaatgccatagctttaattatttatggttttactggcttagaaggttatttcgtagcacgtgttatgcaaggtgtgtgtacggcattcttttctatgtctttacagctaggtattattgatgcattaccagaggaacatcgttctgaaggtgtatcattgtactcgctattttcaacgattccaaacttaatcggaccattagttgccgtaggtatttggaatgcaaataatatttcactatttgcaattgtcattatctttatcgcattaacaacaacattctttgstatcgcgtgacctttgctgaacaggaacccgatacgtcagataagattgaaaaaatgccgtttaacgctgtaactgtttttgcgcaatttttcaaaaataaagagttgttgaacagtggtattatcatgattgttgcatcgattgtatttggtgcagttagtacatttgtaccgttatacacagtgagtttaggattcgcgaatgcgggaatctttttgacaatacaggccatcgcagttgttgcggcaagattttacttaaggaaatacattccgtcagatggtatgtggcatcctaaatatatggtatctgtactatcattattagtaatcgcgtcatttgtagtggcatttggtccgcaagtaggtgcaattattttctatggtagtgcgatattaataggaatgacgcaagcaatggtgtacccaacattaacatcatacttaagcttcgtcttaccaaaagtaggtcgtaatatgttgttaggtttatttattgcctgtgcagacttaggtatatcgttaggtggcgcattgatgggacctatttccgatttagtaggatttaaatggatgtatctaatttgtggtatgttagtcattgtaataatgattatgagtttcttgaaaaagccaacaccacgtccagcgagtagtctttaatgaagtgaattaaagcatattaagttaatgaatatttaaattttaaaaggtatattgagcatggcgattcatgtgcttcatgctaggacatgaaacattctatatggctcgtttttagaacgacatatatctaaataaagcacgcttaraagtgagttttgatactgacttttaagtgtgctttttgatgtgtatggataatggataatactctgaaaaattttacatgaaaatatgcaaaacgagtataactgctaattgatagaaatagctcaccataaaattacggtatgattttaaatataagtaagtcgcactacctgctagtatcaatgctggaatgaattcccaccatgtattaatgtatggatagtagaacagagtttcaaggataatggacaatactattgtaatctttaaaggtattaatctgcttaattcttgaattaaaatatgacggaaaataagttgacaaatcaaagtatttaatataatggttaacgaaaatatagctattaaactgatggaaccataccctttaatgagcgggtaaatgtcaaagacagtaaaggaatctacatttagtgcgaaaatattgaaatgatttaaaagtaaaaagagtacgacacttagtgtaaatgatataagaatatgccatttatatttagcactagcaacgatttgcgaacgtatcattggaataaacgcatcttcatgcatcagacgaaaaatagctagtgaaataataactgcgagtaaatagctaatgttcattgaaataggaaaagagaaaccccacggagcttgttgagtgaatacagctactaacccaaaagttaaaaagacgataatgatcggcaagatgttaaccaaaaatatgtaaaggaaaataaatccaatatcacgtttgaaaaaacgcgattgttcggtagcgtattcttcttctatgtaatgtttatttgtatttgacatagtatacctcttaaatagttgtattatatagatactttagcacatattactttgtattgtatgttttatacattaaaatttaaaatgaaaaacatatcataaaattgttttataaaatgaagcgcttccattgtgttttgttttgtaaggtgtatcataaatattgaattgaaattttggggggaggtattgtaatgacgtttcttacagtcatgcaatttatagttaacattatcgttgtaggattcatgcttacggttattgttatcgggcttatttggttaattaaagataaaagacaatcacaacatagtgtattaaggaattatcctttactagcacgtattagatatatttcagaaaaaatgggaccggaattacgtcagtatttattttctggggataatgaagggaaacctttttcacgtaatgattataaaaatatcgttttggctggaaaatataactctcgtatgaccagcttcggtactactaaagattatcaagacggcttttacatacagaacacaatgtttccgatgcaacgtaatgagatttcagtagataatacaacattgttatcaacattcatttataaaatcgcgaatgagcgtttatttagtcgtgaagaatatcgtgtgccgacaaagattgatccgtattacttaagtgatgaccatgcaataaaattaggtgaacatttaaaacatccatttattttaaaacgtatcgtaggacaatctggtatgagttatggcgctttaggaaaaaatgccattacagctttatctaaaggtctagctaaagcgggcacttggatgaatacaggtgaaggtggcttatcagaatatcatttaaaaggtaatggggatatcattttccaaattggtcccggtttatttggtgttcgtgataaagaaggtaattttagtgaaggtttatttaaagaggttgcacagttatctaacgtacgcgcatttgagctgaagttggcacaaggtgctaagactcgtggtggtcatatggaagctgaaaaggtaaacgaagaaattgctaaaatccgaaatgttgaaccttataaaacaatcaattcacctaaccgttacgaatttattcataatgctgaagatttgattcgtttcgtcgatcagttgcagcaattaggtcaaaaaccagtaggattcaaaattgtagtaagcaaagtttcagaaattgaaacacttgtacgtacgatggtggaactagataagtatccaagctttattacgattgatggtggtgaaggtggtactggtgcaacattccaagaattacaagatggtgttggcttaccgctatttacagctctacctattgtgtctggcatgttagaaaaatatggtattcgagataaagtgaaattggcggcatctggtaagttagtgacaccagataaaattgcgattgcactaggtttaggtgcagattttgtaaatatcgcacgtgggatgatgattagtgtcggttgtataatgagtcaacaatgtcacatgaatacgtgtcctgtaggtgttgcaacgacagatgcgaagaaagaaaaagcattgattgttggagaaaagcaatatcgtgtcacaaactatgtaacaagtttgcatgaaggcttattcaatattgcagcagctgttggcgtatccagtcctacagaaattactgctgatcatattgtatatcgaaaagtcgatggtgagttacaaacgatacatgattataaattaaaactcattagttaacttaattatttcgggaaattgaaagcagcggattttagcgttactgcaaataattttatattagtagtggatgctggtcacacaagaacttcaaatattaaagccctcagaatatgaattaaggtttgtaaccttagtcttatctgagggcatttttaagttataaactatttgtcgtccattttatctttttcttttaaacctctgtgctttaattgcttttcaagtttttcaaaactaatatctttattttctttagtcgaaacaccaagacgtttatttaattttttcatgtcaacttctgtgtaatctatgtctaagtgytcaattgcttttttatctttatagtctactttgtattttacgcctttaaggtctttgaaaatactttcagatttggcgaataactttttggcttcgtctttatccatacctagatcgtcatatttaattgtgttgattgtagactgttttaaaactttatcatctttatatgtgatagaagttagtacatgtttaccactaacatcaccwtcatatgttttggtttgttctttaccacaagctgataatgcaatgatacaaactaatgctactacaattaatgaacataattttttcaaagtcagtcgccttctttcgatatttgtattataaagaaattataacatttactaaaaaatgatgttattcaaaaatttaaattttgtcattttttttgaagatatgagtttttttaagcggattcctcacaaaattttaaaaatatttaagcctkaaaatgataaagcgktagggaacgtttttctgaaagttagtgatacaatagttttaagttgaaatacaggaggatgaataacatgaatcagtcagtcaaattacttaaacatttaacagatgtaaacggcattgctggttatgaaatgcaagttaaagaagcaatgcgtaactatatagagcctgtcagtgatcaaattattgaagataacttgggtggcatttttggaaagaaaaatgctgagaatggtcaatactcaattatgatttctggtcatatggatgaagttggttttatggtaacaaagattgataaacatggttttatttcatttacgccaktggtggatggtggaatcaagtcatgctatctcaaaaagtaacgattacaacagattcgggcaaagaaattagaggtatcatcggttctaaaccgccacatgtcttaacgcctgaagaacgtaaaaagccaatggaaatcaaaaatatgtttatagatattggtgttagtagcaaggaagaagctgaagaagctggcgttgaagtaggcaatatggttacgccatatagtgaatttgaagtgcttgcaaatgataaatatttaactgcgaarcatttgataatcgctatggctgtgcattagctattgaggtattaaaacgtttaaaagatgaaaatattggcattaacttatacagtggtgccacagtgcaagaagaagttggtttgcgtggtgcgaaagtggcagcgaatacgattaaaccagacttggcgatagctgtcgatgtaggtattgcttatgataccccaggtatgtcaggtcaaacgagcgatagtaaactaggcggtggtccagttgtcattatgatggatgctacaagtattgctcaccaaggtttgcgaaagcatattaaagatgtagctaaggaacataacatcgaagtacaatgggatacgacaccaggtggaggtacagatgcgggaagtattcatgtcgcaaatgaaggtattccaacgatgacaatcggtgttacgctgcgatacatgcattctaatgtttcagtgctcaatgtagatgattatgaaaattctatccgtcttgttactgaaattgtccgttcattgaatgatgaaagttataaaaatatcatgtggtaatcaaatccataaataataaagaatccttttaatatggtaggttgttaaacaattgtctaattttaattcttagtcattagacagtatccatgttaataggattttttgtttttaatttaaatgctgaaaatcaattatgcctaaattttgatattacaagaaaatgattttttcttaaatgtaattgcactaaaaaccaaaaaaacgggaataatatacctgatatattacatgaggagcggtgcaaatgttgttagaaattaaagatttagtgtataaagcgagcgatagaatcatactagatcatatcagtctaaaagtagataaaggcgagagtattgccattataggtccatcaggtagtggtaaaagtacatttcaaaagcaaatatgtaatttgtttagtccaactagtggagaactttattttaaaggtaaaccctataatgattatgacccggaagaattgcgtcaacgaatcagttatttgatgcagcaaagtgacttgtttggtgaaacgattgaagataacatgatattcccatcacttgcacgtaatgataaatttgatagaaaacgtgcaaagcaattaattaaagatgtcggtttgggacattatcaattaagttcggaagtggaaaatatgtcgggtggtgagcggcaaagaattgctatagcgcgccaactgatgtatacaccggatattcttttattagatgaatcgaccagtgcattagacgttaataataaagaaaagatagaaaatatcatttttaaattagcagatcaaggcgtggcaattatgtggattacccacagcgatgaccaaagtatgcgacactttcaaaagcgtataacaattgttgatggtcaaatttctaatacagaggagttgaatcaacatgagtaatacggcacttggattgacggcattgcttttagtcattccgattatcatttcatataaagaaggtttacatattattaaagatttaattgttgcgacattacgagcagttgtgcaattaatcattttgggatttttgctgcattatatttttaaaataaacgataaatggctgcttattttatgtgtattggtcattattattaatgcatcatggaatacaattagtcgagcatcaccagtgatgcatcatgtgttttggatatcatttctagctatcttcattggaacggcattaccgcttgcaggtactattgcgacaggggccattcaatttaccgcaaatgaagttatacctatcggcggcatgcttgcaaataatggcttgattgcaattaatttagcttaccagaatttagatcgtgcattcgtacaagatggtactaatattgaatctaaattatcacttgcagctacacctaaattggcttctaaaggtgcaatacgtgaaagtattcgtttagctatagtgccaactattgattcggttaaaacatatgggcttgtgtcgattcctggtatgatgacaggcttaattattggtggcgtaccacctttacaagcgattaaatttcaattgttagtcgtgtttattcatacaactgcgaccattatgtctgctttgattgcgacatatttaagctatggtcaatttttcaatgcaagacatcaattagtagcacgaaatactgatgttaagagtgaatcatgatagattttactgcatcagatttaggcattagttttaattggaaatgaagtgacgcgcacatatagtatcgctattcattagcgcagcgaaaatattcataaaggcacgcatactttgtagtcagttatctgttctgacatataaagcgtgcgtgcttttttggagttattgttgaaactgaagtaattatacataattattaaatgacatacttgtgttaatttttcaaatactgaaaaacaatttcaataattttccaattaagcacagaaaattaaagcaaaatattatataatagaacggttatatataaanattngtgcacacattttttaataaatcgttattctaagggaaatgaatatcggaaattttgtttgaaaggagttttaaattgtcaatcatgcgactatttacattcattttaagtatttttatcgtaggaatggttgaaatgatggttgcaggaattatgaacttgatgagtcaggacttacatgtatcagaagctgtcgttggtcaattagtgacaatgtacgctttaacatttgcgatatgtggacctattctggttaaattaacgaaccgtttttcatcaaggcctgtattattatggacattacttatatttatcattggtaatggcattattgctgtagcgccaaatttttcaatattagtagttggtagaattatctcatctgcagcagcagcactaattatcgtaaaagtattagctattacagcgatgttatcagcacctaaaaatcgtggtaaaatgattggacttgtctatacagggtttagtggtgctaatgtttttggtgtaccaattggaacggttatcggcgatttagtaggttggcgctatacatttctattcttaattattgtgagtattattgttggcttcttgatgatgatctatttaccgaaggatcaggaaatacaacgaggccctgtgaatcatgagacaccatctcatgaaaatcatgttacttcgaaaatattaagacctgctgaagtagcaaaatatttaattattacgtttttagtattgattgcaaactcagtgacattcgtctttataaatccacttattttatctaatggtcatgatatgtcattcgtttcattagcacttctagtaaatggaatcgctggcgttattggaacatcattaggtggtatattctccgataaaattacaagtaagcgttggttaatgatttctgtttctatttttatcgtcatgatgttacttatgaatttaatcttacctggttcaggtctattgttagcaggactatttatttggaatatcatgcaatggagtactaatccagcagtgcaaagcggtgtgattcaacatgttgaaggcgacacaagccaagtaatgagttggaacatgtctagtttaaacgctggtattggtgttggaggcattattggaggcttggtcatgacacatgtttctgttcaagctatcacatatacgagtgccatcattggcgcattaggattaatcgttgttttcacattgaaaaataatcattatgctaaaacatttaaatcatcataattctcatatgamaagcacgcctgctatcaaattcaggtgtgcttttttagatgcgataacgttattgatatgtgcgataatagcgacgttcattatgatacatcggccaaggcattttaccgcttttagcaaaattagctaaatcattttgcatttgtcgacttaaaaatttaaggtgagcagttgttggatatgat

SEQ ID NO: 68 - DNA, 1192 bp; double-stranded, linear
cgcaaagaagtacaaaaaatgtttttacaagaaggtattaaaacacctcaaccaattatgactgcttataatcatagtgaaaacggtgtttagtagtttataatacatggaggtcatatttaatggcgtcaaaatatggaataaatgatatagtagaaatgaaaaaacaacatgcgtgtggaacaaaccgttttaagattattagaatgggtgcagacataagaattaaatgtgaaaattgtcaaagaagtattatgattccacgtcaaacgtttgataaaaaacttaaaaaaatcatcgaatctcatgatgatacacaaagataggagaatgattaatggctttaacagcaggtatcgttggattgccaaacgttggtaaatcaacattatttaatgcaataacaaaagcaggtgctttagcagcgaactatccattcgctacgattgatcctaatgtagggatagtagaagtgccagatgctagattacttaaattagaagaaatggttcaacctaaaaagacattgccgactacatttgaatttacagatatcgctggtattgtgaaaggtgcttcaaagggagaagggttaggtaataaattcttatcacatattagagaagtagatgcgatttgtcaggtcgttcgtgcatttgatgatgataacgtaactcatgttgctggtcgagtagaccctattgatgatattgaagttattaatatggaattagtactagcggacttagaatctgttgagaaacgtttgcctagaattgaaaaattagcacgtcaaaaagataagactgctgaaatggaagtacgtattttaacaactattaaagaagctttagaaaatggtaaacccgctcgtagtattgactttaatgaagaagatcaaaaatgggtgaatcaagcgcaattactgacttctaaaaaaatgctttatatcgctaatgttggtgaagatgaaattggtgatgatgataatgataaagtaaaagcgattcgtgaatatgcagcgcaagaagactctgaagtgattgttattagtgcaaaaattgaagaagaaattgctacattagatgatgaagataaagaaatgttcttagaagatttaggtatcgaagaaccaggattagatcgrttaattaggamcacttatgaattattaggnttatccaccataatt

SEQ ID NO: 69 - DNA, 7494 bp; double-stranded, linear
aatatagctgcaatagcatctcgtttcatttgtataatcaattccggtttaaatatcagtgtgaacgtaagcacgacacagattaaaaataacactgccggaatgagtcgtttcaatcgtcgcttccaaaactctagcaaatcgattttttgcgtccgataatactcacttatcaacaaacttgttattaaataacctgaaataacgaagaatgtatctactcctaaaaagcccccacttaaccattgtgcattcaagtgataaataatgattcctataactgcgaatgccctcaatccatctaatccaggtaagtatcgcggggaatacattttttctaaacgtttaaagtcttttgtatccatgttaataaacgccccatttatttttctctattttgtagtatatcacaatatttttgaaaataaaatattgcactgattttcattaattgatttaacccttaattaagatagttttaaattttttattaagtagaaaacaattattacagttgatttcattactgcaaaccacatataaatttgtcgattttactacataacatagattatcatagattcttgaatttttagcaaaataactgttattttcattatatttttacaaaaaaaggttcgttttatattttatgcatcttactgtaacagaatcattaagatatgctattcgaatatactttttcaaaatttatataatgaataaattaacatgtattgaaaaaaaagcgaaatgcagcctatcctctaatgtaaaccaaacgatatatctcgtcagactttatatttaaacgctatgtgtcacttttaaaatgaatattactaagattgtcatatcaattattattgcatcgaattaatcttttaaatttctgtaataaaacctattatctacatctaatttaggaaaactacttggtaaatctcctcgcttaatttcacggaagtcattattagaataaaaatactgtgcactaataaatttatcaattgttcctaaataaataccatcgatattttgttctttacatgtcattataactttatctaaaagttttttacctatttttaaattcctataacctttatcaacaaacatttttttaagtgcagacatattattatctagtctaatcaaacctatagtaccaacaatattttgatgattgtttattgcaagccaaaatgccctccattattcaaatagttatgttcgatgttctccaaatcaggttgatcatctctatcaatttttatataaattcatttttttgaatcgataaaataaactcgattagctcttccttataagacctattatattcaattatgtttatagccatttttatctcctttttcatttaatttaattataaaatgtgcgtttagtttgtatctagtgtactcagtacagcctcaaatgaagtttcattccacttggcacttaataaagacaagtattttagcagtaatacaataaagtccaataaatttccctaacttcaatatccactttttaaaaaatgtatttttaattaataaaaaaactctccccaatttctatgggaagagctatatatttaatgtctaaacattacttttatttattatgaaggaattagaatccccaagcacctaaaccttgtgctttgtatgctttaacagctgcgttgatttgttggtcaacagtgtttgttggaccccaacctggcatagtttggaataaacctgaagcacctgatgggttgtaagcatttacttgaccatttgattcacgagcgatgattgcagcccatgtagaagctgaaacaccagtacgttgagccatgatttgagctgctgatgaaccagtagcacctgcagtattaccattgcttaatctcactgaacttgaagtagttgaagtgctgtagttatggtaagttggagctgaaacagcttcaacgtttgagttacttgattgtgcattgtagcttactgattgtacatttgaaccttggttgtatgaagtagtgtagtctgcacctgcaacgtttgagaaaccagcagtttgaccattagctgcttcatagctccatgaccatgtagtaccatttgaagtgaagttatattggaaaccatcttttacaaagtggatgtcatatgcaccatctttgattggagctgcatttaattgatcttggtgattatgcgctaagtcaactaagtgtgcttgatcaacgtttacttcagcagcgtgtgcttgatgtcctgtacctgctgcgtaacctgttacacctaatgccactgctaatgatgatgccataattgtctttttcatagtaaaaaatcctccagtaataattgtnagtttatgtttttagtaattatattttgaatttgaatgtcgtagtgcaagtttaaattgtcttttatttctttcaacggtactcactatatcacaaaaaaccagccagtaaattacactttctttacaaaacattacaatatcaagtgttatttgtaatgttgaaatatggctgttttatactgtaatgtgaaatatgtgccctttagaatccaatcaacccttgaaatagtctttaacacataagatttttactatatttagctcaactattacagctttcgtaatattacagattgtatttttgttacatagctgtaatatatctgacatgtaacttctcttattttcgtacattaaacgcaattawaaagcaatcaacaaatatgtttctacacatgtattgattgctattattgttgtatattcaaagttttaaaacacacatcttttgtgaattgtcttatcttttattagcgcaaataaactgcagctcaattatattgttcaacttcattctcgcaattcacaataacattaaataatttttggtctcatattttcaaaaaacatactgttattatcccatgaatttaaaaatatcattagtatataaacgaaacactttacgataaatgatatctgcaagccaagctgttacaaatggtacaacaaagaacgctactacaattagtaagacactcaaccaagcagaatcaacctccataaatttaaatgcattaatcggtcctaccattcctataaaaccaaatccagctgactctttcgttccatgaatacctactaatgctgataccaaacctgatacaatggctgtcgttaatattggtaacataagaattggatatttcaccatattaggtatcatcattttaacgcctccaaagaagacggataacggcacccctaaacgattcactttacttgtaccaattatcaatactgcttcagtcgcggagataccaattgacgctgatccagctgctaaacctgtaatacctatcgcaaaggcaatggccacagttgatagtggcgaaataataataagactaaataccattgaaatcaaaatactcatgacaatcggttgtaattctgtaaaaccattaaccatattaccgatggctgttgtaatcattttcgtatacggcaatattaaaacaccaattgcacctgaaataccgccaacaactgttgggaatacaatcaatgccatactacctacgcgatgttgaataagtaaaatgaataacactgcaatcgctgctgtaatcattgtattaattaaatcaccaatacccgtaatcatccaagcaccatttttaaactgcgctgcaccgcttcctacatatgctgcacttgccacaacagcaattgctaatggcgataggtcaaatttcatggcaaccaatgcaccaatcaaagcaggtactgtaaattgaattgcaacgacaacgcctaataacgttttaaaaatcggatgataatccataaagtatttaaaaatttctccaagtatcgcattaggaactaaacccgcaacaatacctatggcgacacctgataaaactctaaatataaaatctttgggtgtaattgttttaattgatgtcataatatcatccttccatttatgtatatacatctgtatgcaaataataaagagccttaagttataagctgccactagcttaaattctaagatgtgcatgccgatgttgttatatttaggctagcagtatcatctataactcaagactatgaaaaatagtatatcacaaaattctgaatttttagataaataaattggcaatttttcaaacatattgttacaatacacttttattttatcttcatttttaaaatccattaatacaatagaagaaagacattcaaatgcttaccaaaaaggtacattatttgttaggagcgtatcagcacttacatatcatcaacacaattgacaatataatagaagatactgataataagtgttaaaacaacagatgttaggtagtgaacaaatgatggaaagtaaatccatagatccaagaatcgttagaaccaaacaattgcttgtcgatgcttttcttaaaatttctagagaaaagaaattatctcaaattacagttaaagatatcactgatattgctacgctaaatcgtgcaacattttacgctcatttcgctgataaagaagacctcctagactacacattatctgtaaccattttaaaagacttgaatgataatttgagcatttctaatgtcattaatgaaaaggttctgcgtaatattttcatttcaattgcgagttatatcaaagatgctgcaaagtcttgcgaattaaatagtgaagcattttgcaacaaagcacatcaacgtattaataatgaattagaagatatttttgcgattatgttagaaaacagctatccggagcatcaacgagatatcattgtaaatagtgcgagttttttagcagctggtatctcaggcttagcattacattggtttaacacgagtcaagagacagccgatgtgtttatcgatcgcaaccttccatttttaattcatcatatagcacatttttaataaaacttggtatttagtcatgcatcttgaaatcactatgtgacttaggttcatacttgtacacacaataaaatttaacgtattacgattgattagccgtgtctaggacataaatcaacgtcctatactctacaatgtcatattagcagtcgttaactgaatgaaaataagcttgtcattaaaacatatagattttagtgacaagcatttttgtttttgcgtacttaaacaacacttcaggcaatatgttgtttaggcaacaaatgatatgtgcgtgtttattggcaaacgtacgacatagtagtatagtatgtctaaacaacatatgttgcatagttgatatgcgttgtttaaatactaagataggagggattgacgtgagcgagacagatgaacctcaggggtttgaacgcacgcataatatattaaatattaatcagagtagtctgggtgtagtgacatacattacaaataaattaaagtcgacgttgaagcaacacataataattgctcgtggtaaaaagcgaatcgactatcgactgtcgtataacttttacatacgtattatgataatgtagaaatcaagaaaatcgactgtgaatatacctatgctatgcccattgcaattttaataagacacacgatgtcattcgacaatgctcatttctttgctcagttacgtcatcctgtcttataaaacaacattgcagacatgtatatcaaacgacacttcaataacatcactttgcccatcgtactactagtaaaatcgtgtctcaaatcccttattttaattccaaaaatctgctggtcaaaagaccgagaaactaaaaacattacttaatgtgttgataaattaccatataaaaataatctcaaaatatatcaacacttgattctaaggaggatatgacaatatgaaaattttagatagaattaatgaacttgcaaataaagaaaaagtacaaccacttactgtagctgaaaaacaagaacaacatgcattgcgtcaagactacttaagcatgatccgaggacaagtattaacaacattttccacaataaaagtggttgatccaatcggtcaggatgtcacaccagataaagtttatgatcttcgccaacaatacggttatattcaaaattaatatttgctcacgaggtattgcacttaaggtgccaactgacctcataaacaaagcccatactgattgaagacactaatgtgtcsaccatggtgcacattacgcttcatctctgtatgggctttttatttattcttttgagaatttcattttagcagaccaaaaaattaaaatggtgtccatcaagatctttgaacattgctccataaaacccttggcttactgttggttcttgaacgactgtgccacccgcttctttcactttattcaccaactggtcaacttcttcatttgtgttcacacctagagaaatcatcacttcatttggttcagtattaaggctttgctgacttacattttgaaaatgcttgtnttctattaaaattacggktgtttgacctatttgaatgccgaccattttatctaacatttgtgggtttctatttattttaaatcctaacgctttataaaactgtgcgctcttttctaaatcttgcacatgcaaattaaaccacattgattgaatcatgattgcaccccattcattacttattatagttttggactttaagccaatcacttaatgataatcttgttggatttatttcagccattaattcaaagtctacttcataacctttttcttccaaccattgcttttctgcaacaccactaacaaattctccttctataacagtagatttacctgtcacttcactaaaaattgttgctgcttcacttaatgtaacttcatcggaaccaatctctattgattgatgcgtaaagctttgtggatgtgcaaaaatatacgatgcaattttagctatatcaatagaagaaatcattgtgaattttatattcggattaataaattctggtaatgtaatacgttcatcttcgactttagcaatgcgtaaaaaattatccataaagaatgatggtttgataactgttgcatttatattagattccattaatctattttctatttttgctagtacttcaaagtgtgggccagttcgatttcgattaacccctcccgcagtactatacacaatatgttgaatattttcttgctcagctatttcaattatcttcataccttgtcttaattcttcgctaacatcatctttaacgattggctgaatactgtataagccatacttacctttcatcgctgattgcaaactaacattatcactcagatcaccttcarcgattgataaatgcggatgtcctatgtctgaaagtttacgattatncttatttctagttaatgcacttacataccatccatcctctaacaactgttttacaactgcattaccttgcttccctgttgcgcctattacnaaaatatctttcat

SEQ ID NO: 70 - DNA, 11802 bp; double-stranded, linear
aatttatttcgccgtcccaccccaacttgcattgtctgtagaaattgggaatccaatttctctttgttggggccccgccccaactcgcattgcctgtagaatttcttttcgaaattctctgtgttggggcccctgactagaattgaaaaaagcttattacaagcgcattttcgttcagtcaattactgccaatataacttcgtagatcatagaacattgatttatttcccagcctattcttttcataaaaaaaagacggattaattatccgtctttttcttatatctttttataatatttagcaaaggtaataatgatattaataatgtacaaaaaatataaatcaaatcgacatccttataaaacatcagaaccactaaaaacaaaaaagcacaaaataaaattaaatttaaaataaacgaccacttttcaaaaaaatctcttttcatatttccacccctaattttaataagcattattttatattctcttttaagtttattattcaaaaggaaaacagaaatatctttcaatattattataaacatttcaactacttttaaaaaccaacaaaaaaatacttattttaagtagatgagcataagtgaacatagttctttagttataataattaattcaaccaaaagtcgatttgtttttgcaattggttttcatttcctcttaaagatattttcattaaatctgtcaaatcaatagacgctatatttttcaacttatctctatatttatttttagtacgtctttctaaatttccccattcctcttcttcgtgagttaataaatgaagcattgctcgttcttgtatattttcaatcatttttaaattcggttttaaaatatgcaaatcatcaaaacaatctttccaacaatcaaccatatctcgttttaattcaatttccacacgccatagaaatgttgaatcaatttcaacatctgcattatctttacgttcttgtttttattataaatccgaataaacctatcactattacgcacaccaaaatattttgtttctggttttacattacgtccataaaatatagttttctttaccgacttatctgacaatgcataatagtcatttaaatcaaattcaaaatcaaaagccaaatctaatctcgtaaaactaacatcgtccaaataactgatgatattttgttttaaccaaagcacttcatcatgcgaaagcttattaggattaaattcaacgcgcatatacgtctattccaaagagttgcttttattttgtcatattcaatataaactttttctttaagagctttagctttaaagtttgtttgtaaaatatcccaaagccgaatttcaggattagtactcataaaatgtgaaagtctctctgcgttagacatgctaagattcccaacaatcgttatagcgtcaaaagacaattttggaatagctagtgacatcctatgtcgatttaaccggctattaccggatattagagtatccagttttacaaatggatgaaacgaaattcaaaacactaaaaaatatgttccactaacagcaaaaaaataccattatgttcctactaaaaaacyaaaaatactggagaacaaatgtcaggatataacttaggatactatgtaataaaaatttacaataaaaaaacaggaaaacaaatttcaagtaaaagmatacccatacaaagaggataaaataaaaaacctcgaactgaaatgatgatcttttcagctcgaggtttaaatattggtgccttatttatatagattcgttatattatattctctattttcattaacmtaatccttaaagagttttaaattaatacctgctagatgattcaaaaatgtttcatcaacttttaaataattcaataatttttgtggtgtcagtaaatntctatcaaaatacaactttaataaactattcattttgacaggacgtgacatttcaatcacgtcgtctaaagataatactttctcgctttanacaaanacaaaaacttacccgattaaaatcaagtaagttttacatatatccgtcacttttcaactttaaaatcaacaacttgcgggatgcgcatcaaattattatttgataaaaaatcaataagtaattgtgcgccttcaacttgaatatcttttacaactggcgcgtcgatatacatatcatactgaccaccgcctactgcacgataattatttacacaaattgtatatgtctgctttaaatcaactgcgtgaccttgaatcatcatattgctcacacgttgtccctttggtcttccaacatgaatggtataacttacgccaccatatatatcataattaaagtgttgtggtttgggttcaaggaagtctgcgctcacactaacttcatcatttttcacgtcaaaatattctgctgatcgttcaatggcttctttaagtttggcaccacttacagctaaaactttaaatgtatttggaaatgggtaattgttaataacatctcgcatcgtcacgacttgcttgaaaccactagcagaatcaaacaaagctgtacaggcaacatctgcgtcacttttttctaataaagcgtaattcataaaatttgtaaaaggatgcggtgccacacgtgcctcaaatgcatgattaatcgtcatatcatatggcaatgtagtaatttcgtaatctaaccagtcctctaactgctttcgtaaatgttggtcatcttcatcaatagtaaatgtggaatcatctataacaggaagtaattcacatgattcaacggatagattttcatattcatcagtactcaagactactctgcctacagttgtacctctcgtaccaggttgaatcacagccgtttgcttaaacctttcagcaatttgtcgatgttggtgacccgtaataaagatatctatatctttagaaaacgcttctaacatggcatatccttcattttcacccgttaatacttcggtcggcgtaccactttctaaatccttttcaaatccaccatggtaacaaaccacaatgatatctgcatgtcgcttcatttcaggtaagtattgttgaagtatttcaaaagcactatgaaacgtartgncntgaatatgctctggttgttcccaatggggaataaattgtgtcgttaaacctatcacaccaacagtttgatctccaacctgaaaatacttcacaccgttatcagtcaatgtactatcattttcatatatattagcgcacaaaactggataattgagtctgcgtaaagtgtcttttaagtatggtaatccataattaaattcatgattaccaagcgtaccaaagtcgaatgccattcgattataaaaatcaactaaaggctggctactgccgctatgcgcgattaagtaattacaaaatggtgacccttgcaaaaaatcaccattatctattttaaaactttggtcatactgccttctgtsttgttctataacatgattcgctagtaacaatcccataggttgatattgatttctactcgtaaaatctgttgggaaaatataaccatgtacgtcactcacgacataaaatgctatgtttgacatcctcactcactccttcaatcacaaacatctttcttatttctattatatatttatttgaagtctgttgtaatcaaggttttgtcaccgagttttaaacgaatctttgaaccttccatactttcaagtactttagcattgaccttaattgtgacatttccgttttcatctgctttaactgttggcaaagtactgtaacctggtgggttataatcgttatctttacttgaaaattgtccgatttgacgtccgccttctttgtaaataccaactctaagattttcaagtgtttgatttgcttcaaatccttttaaatgtattgtcatttcaaatggctcatttacagaaacattttgcgggatatcaaatgttactttttcgttctgatttggtggtgtatgatcatctggtgtgtttggctgaggatctgcgcctttttcgctgccataactacctgctttaaatgttgttggatcataccatttataaccactcggcggttgtgaccatggctctttttcaggctcagttgaacgctctggtcgttcaaaatcaagcaacttagtctttgtatctaatgttaggctactcgccttaagtgatttcccatcattatctttagacatccaagccgttatattatttaatagcttaccgttgtcttgttctttaaaaccatcatatgttttcttcttttctccattatcttctcttacatatttgggcgaactatcttccacaagtgatgaatcaccgataaatgctgctttaccttttccaactttagaaattgctacataggggccttctgctttaccgcccccattataaataccttgatctacagcatgtgaccatttacttttcgctggcaattgttctggtgtatacacaataccttttgctttctctggattagtaattgctaatgtcgatccggcatgcatagagacagatttcacaccttcagtaataccgaaactttcttttgaagaaacaatattgctcgtatttaaatcacctagtgcattatatcgaaaacgtacgccaaagtttgtagataaccaatctgaacttttcacaccttgcattgcagtagaacttttttcttctgcattcatacctttcgacatatcttcatatgctccacgtcgataaccattcattgcctccgatgaatcaatacgatttaaatttcggtcagcattgtaatgatctgaaataaagacaacattgccaccttgtttcacatatttaacaattgctgcctgttctgattctttgaaaggaatgttagcctcaggaattacaaatattttggaacttttcaaacttgcttctgttatgttcgaatgaccatcaatagctttaacgtcataaccttgtttttgtattgaatccgcataatctgaaaatgcaccatcactaacccaatctgcagcaccagctgtttgaccatgagaacgatcgaataataccgttcgctgttgctttgtaggttgcgattcatgcgttatagctaaagattgcggtaaagcacttaatgataccgttgcaacaattgcagagacagttaatgacttatatatttttttcattttgtgaggctccttttaaaataaatttgttcttgaattataggataaaaattcgttgcatatgagcaatttaacgaaaaatttacaaaatcttatcaaactcttaaagaaagttattaaaattcatttttataaaatactttttaacatttaaatgtggtacgctataagtgtaatttcattgcatacatattacacgattaagaatgtgaaggggacagttatcaaatgaaaaattttaagtgtttatttgtattaatgttagcagtcattgtttttgcagcagcatgtggaaactcaagttctttagataatcaaaagaacgctagtaatgattcggattctaaatcaggaggatacaaacctaaagaattaaccgttcaatttgtaccttcgcaaaatgctggaacattagaagctaaagcaaaaccattagaaaaattactatctaaagaattagggattccagttaaagtgtctgtatcaactaactacaatacaattgttgaagctatgaagtctaaaaaagttgatgttggtttcttaccaccaacggcatacacattagcacatgatcaaaaagcagctgatttattattacaagcacaacgtttcggtgtaaaagaagatggttcagcaagtaaagaacttgtagatagttataaatcagaaattcttgttaaaaaagactcaaaaattaaaagcttgaaagatttaaaaggtaagaaaattgccttacaagatgtaacatcaactgctggatatacattcccacttgcgatgttaaaaaacgaagcaggtattaatgcaactaaagatatgaaaattgtgaatgttaaaggtcatgaccaagcagttatctcattattaaatggagatgtagatgctgcggctgtatttaacgatgcacgtaatactgtgaaaaaagaccaaccaaatgtatttaaagacacacgaattttaaaattaacacaagctattccgaatgacacaatttctgtaagaccagatatggataaagattttcaagaaaaattgaaaaaagcttttatagacattgctaaatcaaaagaaggtcacaaaattattagcgaagtttattcacatgaaggatacacagaaacgaaagattcaaatttcgacattgtaagagagtacgaaaaattagttaaagatatgaaataatcattatttaacaaatgaatcattagcgaatttggtattaaaagctttcgttcaatagatatattctagattaatattgaaaagctaggcgctaaactgaaacagatatagaaaggtgtcgctgtacatttgaaaccatttgtacacagaaacccaatgtctatgatatttcagtttaccttggcttttctttattaaagaaaggtgtcaaacatgagtcaaatcgaatttaaaaacgtcagtaaagtctatcctaacggtcatgtaggcttgaaaaatattaacttaaatattgaaaaaggtgaatttgcagttattgtcggactatctggtgctgggaaatccacgttattaagatctgtaaatcgtttgcatgatatcacgtcaggtgaaattttcatccaaggtaaatcaatcactaaagcccatggtaaagcattattagaaatgcgccgaaatataggtatgattttccaacattttaatttagttaaacggtcaagtgtattacgaaatgtactaagtggacgtgtaggttatcaccctacttggaaaatggtattaggtttattcccaaaagaagacaaaattaaggcaatggatgcactagaacgcgtcaatatcttagataaatataatcaacgctctgatgaattatcaggtggccaacaacaacgtatatctattgcacgtgcgctatgccaagaatctgaaattattcttgcagatgaaccagttgcttcattagacccattaactacgaaacaggttatggatgatttaagaaaaatcaaccaagaattaggcatcacaattttaattaatttacattttgttgacttggcaaaagaatatggcacacgcatcattggtttacgtgatggtgaagttgtctatgatggtcctgcatctgaagcaacagatgacgtatttagtgaaatatatggacgtacaattaaagaagatgaaaagctaggagtgaactaacatgcctttagaaatacctacaaagtatgactcccttttaaagaaaaaggtttctttaaaaacgagttttaccttcatgttaatcattgtgcttatcatttggagcttcatttatacgggatttaattttggagatttaatgataggaatacctcaaataggtgatctattcaaacaaatgattccacctgatttcgagtatttacaacaaattacaacgccaatgttagataccattcgaatggctatcgtaagtacagtattaggtagcatcgtttcaataccaattgcgttattatgtgctagcaatatcgttcatcaaaagtggatttcaataccctcgcgctttattttaaatatagttcgtactattccagatttgttattagcagcaatctttgtggctgtatttggaatcggtcaaattccagggatattagcactgtttattttaactatctgtattattggaaaattattatatgaatcattggaaacgatagatccaggtccaatggaagcaatgacggctgttggcgctaataaaataaaatggattgttttcggtgttgtaccacaagccatatcgtcatttatgtcatacgtattatatgcatttgaagtaaatatacgtgcttcagctgtgcttggattagtcggcgctggcggtattggattgttttatgatcaaacacttggtttatttcaatatccaaaaacagcaacgattattttatttactttagttatcgtcgtcgtcattgattacatcagtacgaaagtgagggcacatctcgcatgacacaggaaatagcaaaatataatgttcacacaaaagcacacaaacgaaaattgattaaaagatggcttattgcaattgtcgtcttagctattatcatctgggcatttgcaggtgtaccaagtttagaacttaaaagtaaatcattagaaatcttaaaatccatattcagcggattattccatcctgatatcagctatatctatataccagatggcgaagacttattacgtggtttacttgaaacctttgcgatagccgttgtaggtactttcatcgccgcaattatctgtattccattagcatttctaggtgcaaataatatggtaaagctacgcccagtttcaggtgttagcaaatttattttaagtgttatacgtgtcttcccagaaattgtaatggcacttatatttatcaaagctgttggcccaggttcattttcaggtgtattagctttaggtatccattccgtagtatgcttgggaaacttttagctgaagatattgaaggtctagatttcagtgctgtagaatcattaaaggccagtggtgcgaataagattaaaacactcgtatttgcagtcataccacaaattatgcctgcctttctatcactcatactttatcgctttgaactaaacttacgttcagcttctatactggggctaattggggctggtggtatcgggacaccactcatatttgccattcaaacacgttcttgggaccgtgtaggtattatattaatcggtttagtactaatggtcgcaattgtcgatttaatttccggttcaatccgaaaacgtattgtttaacattaaatcaggatactcctaaataagaagtcctaccgtcttacgtttctctattataataaaaacagcagtgaagaaaactattgttatagttaacttcactgctgtttttataatatctaaatttattctatttcaattcctttaaataacttttaccgaactctggtaatgttacgttgaaattatctgctatagttgcaccgatagaactgaatgtagtatcactttctagtgcatgaccacctttaaatttcggactgtacataattactgggatatattctctcgtatggtccgtacctggcgctgtcgggtcattaccatggtctgctgtaataattactaaatcgtcttcttttaagttgctaaacagttctggcaagcgatcatcgaaatctttaattgcttgtgcataacctggtttatcacgacgatgaccgtataatgcatcaaagtctactaagtttaagaagctaatacctgtgaaatctttcttaacaattttcatcaattgatccataccgtccatgttactcttcgtacgaaccgcttctgttacaccttcaccatcataaatgtcattaattttaccgatggcaataacatcataaccaccgtctttcaaatgatctaagacagttttaccaaaaggttttaacgcatagtcatgtcgattagatgtacgtgtaaagtttcctggttcaccaacatatggacgtgcgataatacgaccaattaaatatttagggtcttttgtcaactcacgaaccttttcacaaatatcatataactcttctaatgggataatgtcttcatgtgcagcaatttgcaatactgggtctgcacttgtataaacaattaagtcaccagttttcatttggtgctcgccccactcatcgataatttgcgtacccgatgccggtttgttagcaacaactttacgacctgtcatttcttcaatttgttgaattaactcttcagggaatccattagggtatactttaaaaggttgcataatatttaatcccataatttcccagtgaccagtcattgtatctttaccaactgaagcttcactcaatttagtatagtatgcttctggttgttcaactgcatttactactggtaatttatcgatgttccctagacctaacttttcaaggtttggtaaagtttgatcgaaaccttctaaggtatgtcttaaagtatgtgaaccttcatctttaaaatcagctgcgtctggcgcttcaccaatacctactgaatccattacgattaaatgtacacgattaaatggtcttgtcatagctatcactcccaaaatttatatatattagtaatctgaatctgcttctaaaccttgcataatttgaacacctgcgctcgcaccaatacgtgtcgcacctgcttcaaccattttattgaaatcttctaaattacgtacgccacctgatgcttttacttctacatcagcacctactgtatctttcattaatttaacgtcttctgcagtcgcaccgccacctgcaaaacctgttgaagttttaacgaagtccgcaccagccgcttttgttaattcactcgcttttacaatttcgtcatggtccaacaataccgtctcaataatcacttttactgtgtgacctttcgcagctttaaccactgcttcaatgtcttgttgtacatcatcaaaacgtccatcttttaatgcgccgatgttgatgaccatgtcaatttcatctgcaccattttgaattgcatcttctgtttcaaatgctttcgttgcagttgtcgacgcacctaatgggaatcctattaccgtacaaacgagcacctctgaatcagctagtcgctctgctgcatatttaacatgtgttggattcacacatacagatttaaaattgtatgctttcgcttcatcgatgatttgatcgatttgcgtacgtgttgactcaggcttcaataaagtgtgatctatatatttctcaaatttcatacttactactcctcgtgttatataatctctttatttaattttactataaatacgaatatatctcgcgaatttatatctatttatttttcagattgtgtccaacgatttaagctgacgaataaaactaatccgacaatactcattaaacctaaaataattaaaataataccgaaatgtgaacttaatgcatcattgcctgggaaatttaatgctttaaaatcgattagagccgcagcaatcgcaatacctacagataccgccacattaataattaaattataaaaaccaatagccacacctgtcatattaagatctattgttttaatggcttcgttaagtaaaggtgcatacattaaagcaaagctacctgcaaagaatatcatagaaatgacgaagattgaaatgtgattacctactgcaaatgcaggtaaaatcaagctcagtgctattaaaataattgctgtgataatcgcttgttttgaattcagatattcgccgattttaccacttagtgcaccaacaatgactgctactatataacccggtactaataacagtgatgttgtgtctagttgcagatgataaatttgctccattatgaatgggaacgtaaaaatataacccaattggatagcatacattacaaatactataaataaaaatgaagcataacgtttattttggaaaaatgatttatttactaatggacgttgcgcatttttaatatatagcgcaaaaacgataatcgcaattaaggcaccaatcatatataaccaattaaagttcgtaataaacagcatgactgttgtagcaggggatcctctagagtcgancctg

SEQ ID NO: 71 - DNA, 1196 bp; double-stranded, linear
ctaaagaagatgcgaaacaagatgttgataaacaagttcaagctttaattgacgaaatcgatcaaaatccaaatctaacagataaggaaaaacaagcacttaaagatcgtattaatcaaatacttcaacaaggtcataacgacattaacaatgcgatgacaaaagaagcaattgaacaagcaaaagaacgtttagcgcaagcattgcaagacatcaaagatttagtgaaagctaaagaagatgcgaaaaatgatattgataaacgtgtacaagctttaattgacgaaatcgatcaaaatccaaatctaacagataaggaaaaacaagcacttaaagatcgaattaatcaaatacttcaacaaggtcataacgacattaacaatgcgctgactaaagaagaaattgagcaggcaaaagcacaacttgcacaagcattgcaagacatcaaagatttagtgaaagctaaagaagatgcgaaaaatgcaataaaagccttagctaatgcgaagcgtgatcaaatcaattcaaatccagatttaacacctgagcaaaaagcaaaagcgctcaaagaaattgacgaagctgaaaaacgagcactacaaaacgttgagaatgctcaaactatagatcaattaaatcgaggattaaacttaggtttagatgacattagaaatacacatgtatgggaggttgatgaacaacctgctgtaaatgaaatttttgaagcaacacctgagcaaatcctagttaatggtgaactcattgtacatcgtgatgacatcattacagaacaagatattcttgcacacataaacttaattgatcagctttcagcagaagtcatcgatacaccatcaactgcaacgatttctgatagcttaacagcaaaagttgaagttacattgcttgatggatcaaaagtgattgttaatgttcctgtaaaagttgtagaaaaagaattgtcagtagtcaaacaacaggcaattgaatcaatcgaaaatgcggcacaacaaaagattaatgaaatcaataatagtgtgacattaacactggaacaaaaagaagctgcaattgcgnaagttaataagcttaaacaacaagcaattggatcatgttnaacaatggcacctggatgttccattcagttgaaggaaatttcaacaacaaggaacaagcgccngattggaacaatttga

SEQ ID NO: 72 - DNA, 1519 bp; double-stranded, linear
caatcgtttcaacgctattatctttagacaacaattgtaagcgtgtatgtgcagtttctaaacagtctataattcgagttcttaattcagctggatcatctttaaaaataaaatccatcgctgcaactttgtagacaaatgttaaataggtaagttcactgtgactcgtaacgaaaataatgttaccaactgggtcatgcttacgaatttcactgcctaatttgataccattaatatcagttgaaagttgaatatctaaaaagtaacagcctatgtcattcatatttttagcttgctcaagcacctcataaggattatcagttgcgagggcaatttccataggcttttcttctatcattatataatttttaataatggtaaccatgttttctctttgttttggatcgtcttcgcaaatgaaaattttcatacattcacatccttatggctagttgttaataatttcaactttttgaataaagaaaccattttcgataattgtatctaataagacattgtctgcattatcagcaatttcttttaaagttgatagacctaaaccacgaccttcacctttagtagaaaaactttcttggaacaattcatgaatgcgtggtatatcatcagcgcatttattcataacaataaacgttactgaattttcactttcaataaatgcaacgcgaatgatagggtcatcaatttcagttgatgcctcaattgcattatcaagaataataccaatactgcgacttaaatcgatcatattcaagttaatgctacttacttcatcgggtatttcgatactaatcggaatattcatttcttgtgcacgtaaaattttcgcagtaattaagcctttaatttcacgtactttaagattctcgataccatttaattttatagcattcatttgtaaattgtctttcataggtacaatatttttattgaaataatcacgtaggccaggcatgtcatcttctcgaatgtattctgaaagtgtcgttaagatattgacataatcatgacggaacttgcgcatttcgttgttgatagcttcaatcttcaatgtatattcataataggtttcaatttcttcttgattacgtttatatttcatctctttaaggagaaattgagaaataacaaatgttaatatacttaaaaatatagtgataccaataaaaataaaagaatactgccttattactttagcttcatccgagtttatttgtgaataaaagaaaaataatgaaaaagtaagcagtaagatagtcgaaataactattaaaaatcctttgtttagtattagatatggtgtgctaatttttttgagaactctatttattatatatgagaatagtatactaatagtcacataaactacaaaaaagctagggaatattacaaatatactatcagaaattttggtggatatatgcatatataactatatacctgtagttagcacngtnataggaataatcnggcgaggtccataatccaccaaaatagaata

SEQ ID NO: 73 - DNA, 5445 bp; double-stranded, linear
gtaggaatctctttgtctttttgggaggacatttaatatgaatgtatatttagcagaattcctaggaactgcaatcttaatcctttttggtggtggcgtttgtgccaatgtcaatttaaagagaagtgctgcgaatggtgctgattggattgtcatcacagctggatggggattagcggttacaatgggtgtgtttgctgtcggtcaattctcaggtgcacatttaaacccagcggtgtctttagctcttgcattagacggaagttttgattggtcattagttcctggttatattgttgctcaaatgttaggtgcaattgtcggagcaacaattgtatggttaatgtacttgccacattggaaagcgacagaagaagctggcgcgaaattaggtgttttctctacagcaccggctattaagaattactttgccaactttttaagtgagattatcggaacaatggcattaactttaggtattttatttatcggtgtaaacaaaattgccgatggtttaaatcctttaattgtcggagcattaattgttgcaatcggattaagtttaggcggtgctactggttatgcaatcaacccagcacgtgatttaggtccgagaattgcacatgcgattttaccaatagctggtaaaggtggttcaaattggtcatatgcaatcgttcctatcttaggaccaattgccggtggtttattaggtgcagtggtatacgctgtattttataaacatacatttaatattggttgtgcaattgcrattgttgtagttattattactttgattttaggttacattttaaataaatcatcaaaaaaaggtgatatcgaatcaatttactaaaataaaaagaaacgtaaatagcataatttaacatgtttgattcatggattatgctattttttcgccaaaatttaacagattttgtacaatgggttagcgattattttttaataaaggagatactactaatggaaaaatatattttatctatagaccaaggaacaacaagctcaagagcgattttattcaatcaaaaaggggaaattgcaggggtagcacaacgtgagtttaagcaatattttccacaatcaggttgggttgaacatgatgcaaatgaaatttggacatctgtgttagctgtaatgacggaagtaattaatgaaaatgatgttagagctgatcaaattgcaggtatcggtattacaaaccaacgtgaaacaacggttgtttgggacaaacatactggccgcccaatttatcacgcaattgtttggcaatcacgtcaaacacaatcaatttgttcagaattaaaacaacaaggatatgaacaaacatttagagataagacaggattacttttagatccgtattttgcaggtacaaaagttaaatggattctagacaatgttgaaggtgcacgagaaaaagcagaaaatggcgatctattatttggaacgattgatacttggttagtatggaaattatcaggaaaagctgcgcatattactgattattcaaatgcgagtcgtacattaatgtttaatatccatgatttagaatgggacgatgagttattagaactattacagtacctaaaaatatgttgccagaagttaaagcttcgagtgaagtatatggtaagacaattgattaccacttctatggtcaagaagtaccaatcgctggagtagctggtgatcaacaagcagcattatttggacaagcttgcttcgaacgtggtgacgtgaaaaacacatatggaactggtggcttcatgttaatgaatacaggtgacaaagcggttaaatctgaaagtggtttattaacaacaattgcttatggtattgatggaaaagtaaattatgcgcttgaaggttccatctttgtttcgggttcagcaatccaatggttacgtgatggattaagaatgattaattcagcaccacaatcagaaagttatgcgacacgagttgactctactgagggtgtttatgttgttccagcttttgtaggtttaggaacaccatattgggattctgaagcacgtggtgcgattttcggtttaacacgtggaactgaaaaagagcactttatccgtgcaactttagaatcactatgttaccaaactcgtgacgttatggaagcaatgtcaaaagactctggtattgatgtccaaagtttacgtgtcgatggtggtgcagttaaaaataactttattatgcagttccaagcagacattgttaatacttctgttgaaagacctgaaattcaagaaactacagctttaggtgctgcatttttggcaggtttagcagttggattctgggagagtaaagatgatatcgctaaaaactggaaattagaagaaaaattcgatccgaaaatggatgaaggcgaaagagaaaaattatatagaggttggaaaaaagctgttgaagcaacacaagtttttaaaacagaataaacttgtagattagacttttgtataaacattgtgatacaatcaatttaagttaatatttgaatcgagaagcgagagatttgttcgaacatgtacaattgaaggattgtttatgtgggacaagtctctcgtttttacattttttaggaggcgttttggaatggcattgtctacttttaagagagaacatattaaaaagaatttaagaaatgatgaatatgatttagtaattattggtggcggtattacaggtgcaggtattgcactagacgcgagtgaaagaggaatgaaagttgcattagttgaaatgcaagactttgcacaaggaacaagctcaagatctacaaaattagtccatggtggtttgcgttacttaaaacaattccaaattggagtagttgccgaaactggtaaagaacgtgcgattgtttatgaaaatgggcctcatgttacgactccagagtggatgcttttaccaatgcataaaggtggaacatttggtaaattctcaacatcaattggtttaggaatgtatgatcgtttagcaggtgttaagaagtctgaacgtaaaaaaatgttatctaaaaaagaaactttagctaaagaaccattagttaaaaaagaaggtctaaaaggcggcggttactatgttgaatatcgtactgacgatgcgcgtttaactattgaagttatgaagcgtgctgctgaaaaaggcgcagaaattatcaactatactaaatctgaacacttcacttatgataaaaatcaacaagtaaatggtgttaaagttatagataaattaactaatgaaaattatacaattaaggctaaaaaagtggttaatgcagcaggtccatgggttgatgatgttagaagtggtgattatgcacgcaataataaaaaattacgtttaactaaaggtgtacatgttgttattgatcaatcaaaattcccattaggtcaagcagtatactttgatactgaaaaagatggaagaatgatttttgcaattccacgtgaaggaaaagcgtatgtaggtactacagatacattctatgacaatatcaaatcttcaccattaactacacaagaagacagagactatttaatcgatgcgattaattacatgttccctagtgttaatgttacagatgaagatattgaatcaacatgggcaggaattagaccattaatttacgaagaaggcaaagacccttctgaaatctctcgtaaggatgaaatttgggaaggtaaatcaggtttattaactattgcaggtggtaaattaacaggctatcgtcacatggctcaagacattgttgatttagtatctaaacgcttgaaaaaagactacggtttaacatttagtccatgtaatacaaaaggtctggcaatttcaggtggcgatgtaggtggtagcaagaactttgatgcgtttgtagagcaaaaagtagatgtagctaaaggattcggcattgatgaagatgttgcaagacgtttagcatctaaatatggttcaaatgttgatgaattgttcaacattgcgcaaacatctcaataccatgatagcaagttaccattagaaatttatgtagaacttgtttatagtattcaacaagaaatggtatacaaacctaacgatttcttagttcgtcgttctggtaaaatgtatttcaatattaaagatgtattagattataaagatgctgtcatcgatattatggcagatatgcttgattactctccagctcaaattgaagcatatactgaagaagttgagcaagcaattaaagaagcgcaacatggaaataatcaaccagcagttaaagaataattaatttgtacaatcataaactggtgtcctgttttaagggcatcagtttttttatacgagatacattagtcaattgaaactatgcatcactaaatgtatgataataataaaagcgaatataaaagcgttgttattaaaggtgtgagatgatgactgaaaaacaatttaaattaactgtacaagataatacgaatattgaagttaaagtgaattttacagatgtagattcaaaaggaattattcatatatttcatggtatggctgaacatatggaacgttacgataaattagcacatgcactttcaaagcatggcttcgatgtgatacgtcataatcatcgaggacatggtattaatattgatgaatcaacaagagggcattacgatgatatgaaacgagttatcggtgatgcctttgaagtagcgcaaacagtgagaggcaatgttgataaaccatacattataatcggacattcaatgggatccgttatagctagattgtttgtagaaacatatccgcaatatgttgatggtctaattttaagtggtactggtatgtattcattatggaaaggtttaccaaccgttaaagtgttacaactgattacaaaaatttatggtgctgagaaacgagttgaatgggttaaccagttagtatcaaatagttttaataaaannatacgtccattacgtacacaaagtgattggatttctagtaatccaattgaagtagataactttattaaagatccatatagtggatttaatgtgtcaaatcaattattatatcaaacagcctattatatgctacatacatcacaattaaaaaatatgaaaatgttaaatcatgccatgcctatattattagtttcaggatatgacgatcctttaggtgattatggtaaagggattttaaaattggcgaatatatatagaaacgctggcatnaaaaatgttaaagtgaatctttatcatcataaacgtcatgaagtgttatttgaaaangatcatgacnaaatttgggaagacttgtttaaatggttgaatcaattttataaaaaataaagaaagtggaattaaatatgaataaaaataagccttttattgtagtaattgtggggccaactgcttgcag

SEQ ID NO: 74 - DNA, 2569 bp; double-stranded, linear
tggcttgaactacgccaataagtccccctagtacaagaatgaataccatgatatcgaccgcttctatcgtaccttcaaccatgctacttgttatttgttctggtccagctggatgttgctttaatctttcataagtattcggaattgataccggcttattaattgcacctgatttaaattgttcaatcttaattttaacccccattttgtctagttcctgttgcgtacccggaacctttttcacttggttatgagggttaactatctttagttcttgggatgaaggttcgtaagaaagtttagaatatgcaccagcaggaataacccatgttgctataactgcaacaaccgttaaaatgaataaaatcataaatgcacctggcatttttaatttaaatcgttttttcttttcacttksrttaattgtattttccacggtttcatctccttcgacatttaacctagcatttctaccttaaagattttataaatataaattaagaaagtgcaccccgcatcaaaatagaggcattattttcagggggtgcacataaataataaaaatcatgcatttgacatatagtaattgaaaagcgtttcaattcaattactttttaatcacagtacctactttaccctctaaggcagcatctaattcatttaatgatgttataagcacacttccttttggattgttttcaataaatgatatggctgcttcaatttttggtaacatacttccttttgcaaattgattttcgtctatatatcgttttaattcatcaacatttgttgttttcaaaggctgttggttttcagtgttaaaattaatatatacataatcaattgctgttaaaataatcaattgatcgcattgaatattagcacccaacaacgcacttgttttatctttgtctataactgcatcaatacctttaaaaccatcatgttgctctctaattactggtatacctccaccaccagcagcaataacgagtgtatcatttttaataagtgttttaatactctctaattcaataatagagatgggttgtggtgaaggaacaacgcgtctatatcctcttccagcatcttcaacaaatataaatcctttttctttttgaatttgttcagcttcttctttgttgtaaaataacccaattggttttgaaggattgttaaatgccggatcattttcatcaacttcaacttgtgtcactagtgttaccacttgtttatccattccaatagaatgcaattcattttgtaagctttcttgtaattgatagccgatgtaagcttgactcattgcgccacattcagcaaatggaaatgccggaccttggttatgttctgcagcatagttaagtcccaaattaatgcttccaacctgtggtccattaccatgactaataacaatctcatgtccttttgtnattaaycctactaatgatttcgcagtatttttaacaagctcgagttggtycttgaggtgatttncctaaagcattaccacctaatgctactactattttcgccatcatattcacttccttatatcatttaaaattcacccaatgtagcaaccatgactgctttgattgtatgcattctgttctcagcttcttggaatacaactgaagctttactttcgaatacttcatctgtaacttccatttctcgaataccatatttttcaaaaatttgttgacctattttcgtatcagcattatggaaagatggtaagcaatgctcaaaaataacatttggattaccagttttatccattatttctttatttacttgatatggtttcaataattcaagtcgttctttccatacttcatcaggttcacccattgatacccaaacatcagtgtaaattacatccgaaccttttacaccttggtcaatatcatctgtgattaatatgttgccaccattttcagcggcaatatttttacagcgatttaataattcatctgttggatttaattcttttggacaaactaaatggaagttcatacccataatggcagcaccttgcattaatgcatttgcaacgttattacgaccatctccaacatatgtaaagttaatatctgcataatctttttttaagacttcttttgctgttaagaaatcagcaagaacttgagtaggatgatcttcatcagttaaaccattccacactggtacgcctgaatactcagctaaagtttctactgttctttgtgaaaaaccacggtattcaatgccatcatacattccaccaagcacacgtgcagtatctttagttgtttcttttttacccatttgtgatccagttgggcctaaataagttacatttgcaccttgatcatgcgctgcaacttcaaatgcacatcgcgttcttgtagaatctttttcaaataacagtgcaatatttttattttttaacataggcttttcagtgccaatatatttagcacgttttaaatcctcggagagtgttaataaggttctacctcttgtcgtgaaaagtctaataaagttaaaaaacttctgtttcgtanatttttcattaana

SEQ ID NO: 75 - DNA, 1273 bp; double-stranded, linear
cctggaaccatccaatcgtgcaaatcttgaaagagaatacgcaacaacaattaaatgtattggaacactatattccaaatgaccatccagcactcgttgaattaaaaatatgggaacgttggttacataaacaaggttacaaagacatccatttagatattactgcgcaccacctagatcctattacacaggtttatttattcaatgtcattttgctgaaaatgaatctcgagttttaacaggtggttattacaaaggaagcatcgaagggtttggattaggattaacactttaagtaagggagtatgcacaatgttaagaatcgccatagccaaaggacgtctaatggatagtttaattaactatttagatgtaattgaatatacgacattatcagaaacattaaaaaatagagaacgccaattattattaagtgtagataatattgaatgcattttagtaaaaggaagtgacgtgccaatctatgtggaacaaggaatggcagacataggcattgttggtagcgacatattagatgagcgccaatataatgttaataatttgttgaatatgccttttggagcatgtcattttgcggttgcagcgaaacctgaaacgaccaattatcgtaaaatcgcaacgagttatgttcatactgctgaaacatattttaaatcaaaaggtattgatgtcgaattgattaaattgaatggctctgttgaattggcctgtgttgtagatatggtagacggaattgtcgacatcgttcaaacaggtactacgctaaaagcgaacggactggttgaaaagcaacatattagtgatatcaatgcaagattaataactaataaagcagcttattttaaaaaatcacaattaatagagcaatttattcgctctttggaggtgtctattgccaatgcttaatgcacaacaatttttaaatcaattttcattagaagcaccattagatgagtcattgtatccaattattcgcgatatttgtcaggaagttaaagttcatggagataaggctttgaaaatgtataatctaacattcgatcatacgaaaacagatcatttagaaattagtcatgamcaaattaaagcagcatttgacacattagatgaaaaaacaaaacaagcattacaacaaagttatgaaagaattanagcatatcaagaaagtattaaacagacgaatcaacagttagaagaatcagtggagtgttrtgaaatataccatccmctagaaagtgtcggtatttatgtg

SEQ ID NO: 76 - DNA, 1308 bp; double-stranded, linear
gttgataaattaaaaatgtttttatcagatattcaaagttaccaacaatatagtaaagatcatccggtgtatcagttaattgataaattttataatgatcattatgttattcaatactttagtggacttattggtggacgtggacgacgtgcaaatctttatggtttatttaataaagctatcgagtttgagaattcaagttttagaggtttatatcaatttattcgttttatcgatgaattgattgaaagaggcaaagattttggtgaggaaaatgtagttggtccaaacgataatgtcgttagaatgatgacaattcatagtagtaaaggtctagagtttccatttgtcatttattctggattgtcaaaagattttaataaacgtgatttgaaacaaccagttattttaaatcagcaatttggtctcggaatggattattttgatgtggataaagaaatggcatttccatctttagcttcggttgcatatagagctgttgccgaraaagaacttgtgtcagaagaaatgcgattagtctatgtagcattaacaagagcgaaagaacaactttatttaattggtagagtgaaaaatgataaatcattactagaactagagcaattgtctatttctggtgagcacattgctgtcaatgaacgattaacttcaccaaatccgttccatcttatttatagtattttatctaaacatcaatctgcgtcaattccagatgatttaaaatttgaaaaagatatagcacaaattgaagatagtagtcgtccgaatgtaaatatttcaattgtgtactttgaagatgtgtctacagaaaccattttagataatgatgaatatcgttcggttaatcaattagaaactatgcaaaatggtaatgaagatgttaaagcacaaattaaacaccaacttgattatcgatatccatatgtaaatgatactaaaaagccctcaaaacaatctgtttctgaattgaaaagacaatatgaaacagaagaaagtggcacaagttacgaacgagtaaggcaatatcgtatcggtttttcaacgtatgaacgacctaaatttctaagtgaacaaggtaaacgaaaagcgaatgaaattggtacgttaatgcatacagtgatgcaacatttaccattcaaaaaagaacgcatatctgaagttgagttacatcagtatatcgatggattaatcgataaacatattatcgaagcagatgcgaaaaaagatatccgtatggatgaaataatgacatttatcaatagtgattatattcgatattgctgaagc

SEQ ID NO: 77 - DNA, 1431 bp; double-stranded, linear
gatgccattnatnngtatgcaagaagttgttccgggttcaggtggattaccagttggtactggtggtaagacgttactaatgctttcaggcggtatagactcaccagttgctgggatggaagtgatgagacgtggcgtaacaattgaagcgattcatttccatagtccaccatttacaagtgatcaagcaaaagaaaaagttattgaattgacacgtattttagctgaacgtgttggaccaattaaattgcatattgtaccatttacagaattgcaaaaacaggtaaataaagttgtacatccaagatatacaatgacttcaacgagacgtatgatgatgcgtgttgctgataaattagtacatcaaataggggctttagctattgtaaatggtgaaaacctagggcaggtagccagtcaaacacttcatagcatgtatgcaattaataatgtaacttctactcctgtattacgtcctttattaacttacgataaagaagaaattattattaaatcgaaagaaattggtacatttgaaacatctattcaaccatttgaagattgttgtacaattttcacccctaaaaatccagtaaccgaaccaaactttgataaggtagtccaatatgaaagtgtctttgattttgaagagatgattaatcgtgctgttgaaaatattgaaacacttgaaataactagtgattataaaactattaaagaacagcaaacaaaccaattaataaacgactttttataaataaaatcctagagtaaatttaaacataaggggatgttaaactatggatttgaacttaacgatgattataatcataattttatttggttttatcgcggcgtttatagattcggttgtagggggtggcggtttaatttctacgccagcattattagcaatcggtctaccaccatctgtggctttaggtacaaataaattggcaagttcgtttggttctttaactagtacgataaagtttataaggtccggtaaagtggacttatatgttgttgccaaattatttggttttgtatttttggcatctgcatgtggcgcatatattgcaacgatggttccgtcacaaatattgaaacctttaatcatcattgcactttcgtcggtgtttatattcacattacttaaaaaagattggggcaatacacgcacgtttactcaatttacatttaagaaagccataatatttgcagcactttttatattaatcggcttttatgatggatttgtaggtgggggaacaggttcatttatgctttttgtattgttagtctttggttttgattttttaagtgcagcaggaaatgctaaagttttgaactttgcttctaatataggtgcgcttgtattatttatggtattaggacaagtagattatgtaataggtttaattatggcta

SEQ ID NO: 78 - DNA, 4403 bp; double-stranded, linear
aatattattttaaattcaatatttattggtgcatttattttaaacttattattcgcctttaccattattttcatggaaagacgttctgccaattctatctgggcttggttactagtcttagttttcttgcctttattcggcttcattttatacttactattaggacgacaaattcaacgtgaccaaattttcaaaattgataaggaagataaaaaaggattagagttaatcgttgatgagcaattagctgctttaaaaaatgaaaacttttcaaattccaattatcaaattgtaaaatttaaagaaatgattcaaatgttgttatataataacgcagcatttttaacaacagacaacgatttarrrrtatacacagacggccaagaaaaatttgatgacctaatacaagacatccgtaatgctactgattatattcattttcagtactatattattcaaaatgatgaattaggtcgtaccattttaaatgaacttggtaaaaaagcggaacaaggtgtagaagttaaaattctttatgatgacatgggttctcgtggactgcgtaaaaaaggcttacgcccgtttcgcaataaaggtggacatgctgaagcatttttcccatcaaaattacctttaattaacttgcgtatgaacaatcgaaaccatcgaaaaattgttgtaatagatgggcaaattggatatgttggtggttttaatgttggtgatgagtacttaggtaaatcaaaaaaattcggctattggcgagatacgcatttacgaattgtcggggatgcagtgaatgcattgcaattacgatttattctagattggaattcacaagccacacgtgaccacatctcctatgatgatcgttatttcccagatgtaaattctggtggaacaattggcgttcaaatagcttctagtggtcctgacgaagaatgggaacagattaaatacggctatttgaaaatgatttcatctgctaaaaaatcgatttatattcaatctccctatttcatacctgatcaagcctttttagattctattaaaattgcggcattaggtggtgttgatgtcaatatcatgattcctaataaacctgaccatccgtttgttttttgggctactttaaaaaatgcagcatccttattagatgccggtgttaaagtatttcactacgacaatggctttttacactcaaaaacacttgttatagatgatgaaattgcaagtgtgggaacagctaatatggaccatcgcagtttcacattgaatttcgaagtcaacgcttttatttatgaccaacaaattgccaaaaaattaaaacaagcttttatagatgatttagcagtatcttctgaattaacaaaagcacgttatgctaagcgaagtctttggattaaatttaaagaaggtatttcacaattattgtcacctatcttataaaatagaaatatgaggagtgtaactttaatgcaacaatcagacgtcattagtgctgccaaaaaatatatggaatctattcatcaaaatgattatacaggccatgatattgcgcatgtatatcgtgtcactgctttagctaaatcaatcgctgaaaatgaaggtgttaatgatactttagtcattgaactcgcatgtttgcttcatgataccgttgacgaaaaagttgtagatgctaacaaacaatatgttgaattgaagtcatttttatcttctttatcactatcaaccgaagatcaagagcacattttatttattattaataatatgagctatcgcaatggcaaaaatgatcatgtcactttatctttagaaggtcaaattgtcagggatgcagatcgtcttgatgctataggcgctataggtgttgcacgaacatttcaatttgcaggacactttggtgaacctatgtggacagaacatatgtcactagataagattaatgatgatttagttgaacagttgccaccatctgcaattaaacatttctttgaaaaattacttaagttagaatctttaatgcatacagatacggcgaagatgattgctaaagaacgtcacgactttatgatgatgtacttgaaacagttttttacggaatggaattgtcacgactagacattgaagttgtagtatgatgatgcgatgtaatggcgtgttgttgtggaagcttggtgtcatgccatgttactttgatgtgttgttgtgggagcttggtgacatgtcatgctactttgatgtgctggtaccacgatgcgtcttgatgtagtgctatgatgtggcattgcggtgttatggtgttatagacaggtttggcgttgatgccatgttactttgatgtgctggtaccacgatgcgacttgatgtagtgctatgatgtggcattgcggtgttatggtgttatagaccggtttgatgttgatgccatgttactttgatgtgctggtgctacgatgcgacttgatgtagtgctatgatgtggcgttgcgctgttatggtgttatagccaggtttggtgttgatgtcatgccgttacgattctatgatatgttgttgggacgttgcaatgtgtattatgccgttgtgacgttattatttcacactgttacatgtataagtgaattgctgtggaaatttgcgacatatactgctacactgatgaatcattgtgtcaagatgacattgcgatgaagaatgacaactctgttattaaccactttttacatactgaaaactcgttaatattatttcaaataaaaacagcagtaggatgactttcacatttgaaatcatcttactgctgtttctatttatcacatattgtataatgtgacactaagtttcgctattgaagcgaaaaataatgtgcgccctataaagttaaaattatcttcaacttttagggtgcacattatttggacttgctaaggttatttctttttctttttagacacaacttgtgtgtttttgccttttttattgctgccgccgttgtgctctctttcatacgcttcaatgaaaggttgtacttcttttttagcgactttttcataataaatgttcgcaaagtgtgtttgaactacaaggaacgccgcactgactgaccagtacaaaccaagtgctgatgctgagcttaatgaaatccagataatcataattggtgaaatgaccatcatcatgtaacccatttgacgttgttcgtctggcatcgttttacttgatacatatgcttggataaagtataaaacaccggcaataattgtaatccaaatatcaggacgtcctaaatcgaaccataagaagtgtggatatttaaacaaaccatctacaagttggtctttaagtacaaagtataatcccatgatgattggtaattggattagcattggtaaacaacccaacatactcttaatcgggttcatgtcatactttttatatacttgcattaattcttggtttgcagccattttttcttcttgtgtacgcgncacgttcactttttcttgaattttttcaacttctggctttgcaactttcattttttgacgcatcatatgactatttttatagtttgacaacatgaatggtaataaaataatacgaattaccaatacaaggataataatagctaaaccataattgtcgtttaataagttatttcccaaccaatccaatacatttttcattggatctacgaatgtattgtagaaaaaycwctacgtttttcaggtttagaatagtcacaaccagccaaaaagaccataatacctaaaaataatggtagtaacgcttttttcttcatttttccacctctatcattatattcacataggatttattctatcacattaatgagtacgtatgaaacaataagtggaaaaatttaactaattattaaaaaaatctttgaatcgattaacagtcttttcaatattttcacttttagaaatggctgaaatgactgaaattccattggcacctgcttctacaatcggcgccacattattagtattgataccgccaatagctacaatcggtagttgcggattcatttctttaaacgttgcaatcatttctggacctactggtatatgcgcgtcatgcttcgacggcgtaggatagattggtccaacacctatataatcmacatgagttaaatcagattttgcatactcatctaaatcactaatactaagtccaataattttatcagtgaaatattgtgctatctctttgactttcgcatcatcttgaccgacatgtataccatccgcgttaatttcttttgccaaggatacatcatcattaacgataaaaggcacatcatattgatgacagagatgctgtaattctttagctaatacaagtttatcgtttccttttaaagctgattcacc

SEQ ID NO: 79 - DNA, 1808 bp; double-stranded, linear
tgganccaatattagaaatgattaaaacattaacaggtattaatagtccttcaggagncacagangaagcaattcaatttgtcgaaaaatatgcaaaagacttgggttatcaaacaacactaacaaataaaggtgcgttattaataacagtgccaggcaaaaatgatgaagtacaacgctgtattactgctcatgttgatactttaggtgcaatggttaaagaaattaaagaagatggtcgcttagcaatagaattaattggaggattcacgtataacgcgattgagggtgaatattgccaaattaaaactgatgctggtcaaatatatacaggaacaatttgtctgcatgaaacaagtgttcatgtatatagaaataatcatgaaatacctagagatcaaaagcatatggaaataagaattgatgaagtaactacatcagaagaagatacaaagagtttaggtatttcagtaggtgattttgttagctttgatccacgtacagttatcacgtcatcaggttttattaaatctcgtcatttagatgataaagctagcgtacggttgatactacaattactaaagaaattaaaagaagagcaaataatattaccacatacaacgcaattttatatttctaataacgaagaaataggttacggtgcaaatgcatcaattgattcgaaaatcaaagaatatattgcattagatatgggcgcgttgggagacggtcaagcatcggatgaatatacagtttctatttgtgccaaagatgcttcaggtccatatcataagcaattgaaatcgcacctagttaatctttgcaaaataaataacattccatataaagtagacatatatccatattatggttcagatgcttcagcagctttacatgctggtgcggatatcagacatggtttatttggcgctggcattgaatcatctcatgcaatggaacgaacacatattgattctattaaagcgacagagaaattactatatgcatattgcttatcaccaattgagtaaacaattagtgttgacaaatgtgaacgacctatgtaatataatgaactataaaaataattagaattttctaaagaaatagtagcagatatgaaacgtagcaaatagaaagctaatgggtgatgggaattagcacgccatatcttgtgaattggactttggaaaacaattgaatgagttttgaaagtgaacatgaattatgttaactaaggtggcaccacggtaacgcgtccttacaggtatatgcgttatgtggtgtctttttatttagacaaaatgtagtagttaattaaaggtagcaacagaaagttagtggatgatgtgaactaacaccgagattaatgaaattgggttttgtctgcaacagaaaaattatatatagtaaagagtgaactatgaatatttcgaatattcggttaatttaggtggtaccacgcgtcacntcctttatattgataaggatgctggcgcttttttgaaaggagcgtatagaatggatatattttataaaaaaataaaagcaaatgtaacgcccgaagttttagcacaacttcattccaagaagatcattttggaaagtacaaatcaacaacaaactaaaggtcgctattcagttgttatttttgatatttatggcactttaactttagataatgatgtattatcagtaagtactttaaaagaatcgtatcaaatcactgaaagaccgtaccattatttaacgactaanataaatgaagactaccataatattccaagatgaggcaacttaagtcatta

SEQ ID NO: 80 - DNA, 1320 bp; double-stranded, linear
tggtcgtcaatttcttgattatatctataatcctcattttcaatattagagtctgtagaatcatcgatattattatcattcgcatgactagaagcagaatcattatttttatcattgctttcttcttttttgaagtctttatttatcaagtaaatttcttcatcaaaatcagcttgttgagatgtatcatctttattttgattagaaaaatgtgtagcctttgatctttttctttgccgtcttttcttagatgtattcctcgtaaataattctaattcatctttatcttcatttgattcttgttgatcgttcttcgttttatcatccatcaatactcacaccctttaataagatggtaaatgggcacggaatctttcaataaatttctctccacgctcttcaaaagtactatattgatcccaactcgcacaagcaggtgacaataatacaacatcatttggttctataatatcttgtactttatcaacagcgtcttcgacattgttcgcttcaatgaccgatttcccttgactattacctagtttagcaaacttagctttcgtttgtccgaatacaaccatcgcgcgaacattttccatataaggaatgagttcgtcaaattcattccctcgatccaaaccaccacataaccaaatgattggttgattaaatgaatttaaggcaaactgtgttgctagcgtgtttgttgctttggaatcattataatatttattagttctattagtaccaacatattgcaatctatgctctattcctgaaaatgtagttaaactatcaataattgctttaataggtacaccagcanaatacaagcaagcacagctgctaatatatttctaaattatgttcaccaggcaatactagatcttcagtgttaataatacgaacacctttataaacgataaaaccatctttaatataaataccatcarcttcttgttgagttgagaaatacaatgtcttagcttttaattcttccgactctatcacttgtctttgatgataattacaaatcaaataatcctcttccgtttgatttttatatatttgctttttagcattttgatagttttctaaattttcatggtaatctagatgcgccgaataaatgttagtaattatagcaatgtgtggtttatacttttcgattccaagtaactggaatgacgacaactctgtaactaaataatctgtaggctttacttcttgtgctactttagatgcaacataaccaatattgccggataatcttccagttaagcgactttttttaaacatatctccaattagagaagtaac

SEQ ID NO: 81 - DNA, 4280 bp; double-stranded, linear
tttacaccaatcaaaaaatcgaactgatataaataagtacaaagcttatctatcaatccgatttagttataaaacaaaaaaagccacagtaatgtggctttttgttatattcagtatcaaaatggtatcaatagccattttcggaagtcaagaatggcttaacaacgcggtttaaagctatccaatactaccttccatttcgaacttgattaaacggttcatttcgaccgcgtattccattggaagttcttttgtaaatggttcgatgaatcccataacaatcatttctgtcgcttcttcttcagaaataccacgactcattagatagaataattgttcttcagaaacttttgaaaccttggcttcatgttctaatgatatttgatcgttgaatacttcgttatatggaattgtatctgatgttgattcgttatctaagattaatgtatcacattcaatatttgaacgagcaccttttgctttacgtccaaaatgaacaataccgcgataaataactttaccaccatttttagaaatagatttagaaacaattgtagaagatgtattaggtgctttatgaatcattttagcaccggcatcttgaacttgtcctttaccagcaaatgcaatagataatgtactaccttttgcaccttcacctaaaagaacacagtttggatatttcatcgttaacttagaacctaagttaccatctacccattccatatttccgttttcataaacaaaagtacgttttgtaactaaattgtatacattgttcgcccagttttgaatcgtagtataacgaacgtgcgcatctttatgcacaatgatttccacaacagcagagtgtaaagaactagttgtataaactggtgcagtacaaccttctacgtaatgtacagaagcaccttcatcagcaatgattaatgtacgttcaaattgacccatgttctcagagttaatacggaaataagcttgtagtggcgtatctagtttgatatttttaggtacataaatgaacgaaccacctgaccatactgctgagtttaacgccgcaaatttgttatctgctgcaggtactacagaagcaaagtattttttgaataattcttcattttcttgtaaagcactatctgtatctttaaagataatacctttttcttcaagttctttttccatattatggtaaacaacttcagattcatattgagcagaaacaccagctaaatatttttgttcagcttcaggaattcctaatttatcgaaagttcttttaatttcttctggcacttcatcccatgaacgttcagcttgttctgaaggctttacatagtaagtaatgtcatcgaaattcaattctgataagtcgccaccccattgaggcattggcattttataaaacaattttaatgatttaagacggaaatctaacatccattccggctcatttttcatgttagaaatttctctaacgatattctcagttaaaccacgttctgatctgaaaatggacacatcatcgtcgtggaatccatatttataatccccaacatcaggtgcttttttagccatttcaatcactccttaaaaatatatttacaacggcgtgcgtaagtttttaattcatgatgtaaaccatattataacaatgacatgacatcttataaaaatttttatacttttatatgtctaatatcaaaattatctatgattaacagcattctattcttcttcagtcgtaccttctgctttaccttctttagcaacagtacctttttccaatgctttccaagctaatgtggcacatttaatacgagctgggaattgagatacaccttgcaatgcttcaatatctcccatttcttctgtaatcacatagtcttcaccaagcatcattttcgtaaattcttggctcatttgcattgcttctccaagtgaatgacctttaacagcttgtgtcatcatcgatgcacttgccattgaaatcgaacaaccttcaccttcaaacttagcatcttttataatgccgtcttctatatcaaatgttagtcgtatacggtcaccgcatgtcgggttattcatatctactgtcatagacccgttatctaatacacctttatttctaggatttttataatgatccataatgacagatctatataattgatctagattattaaaattcataagagaaaaactccttcgtttgtttcaaggcatttattaactgatcaacgtcttctttcgtgttgtatatataaaaactcgctctagctgttgaagacacatttaaccatttcattaacggttgcgcacaatgatgcccagctctaaccgctacaccttctgtatctacggctgtagcaacatcgtgtggatgtacatcttgtaaattaaacgttattacacctgcacgacgatcctttggcgggccataaatttcaattccttcaattgcagacatttgctcataagcatatatcgttaattcttgttcatatttatgaattgcatcaaaacctatgcgttctaaatagcgaatagcttctgcaagcccaattgcttgagcaattaatggagtacccgcctcaaatttagtaggtaaatcagcccatgttgcatcatacttacttacaaaatcaatcatgtcgccaccgaactcaatcggttccattttttgtagtaactcacgtttaccaaataatacgccaatacctgttggtccaagcattttatgaccactaaaactataaaaatcagcattcatttcttgcatatcaagtttcatatgtggtgctgcttgcgccccatcaacactgataattgcaccatgttgatgagctatttctgcaatggttttaacatcattaattgtaccgagcacattagatatatgtgcaatagcaacgatctttgttttatcattaatcgtttgcttaatatcctcgatgtttaattcaccgtcagctgtcattggtataaatttcaatgtcgcatttttacgctttgctaactgttgccaaggaacaatattggcatgatgttccatttcagtgacaacaatttcatcgccctcttcaacatttgcatcaccatagctatgtgctacaaggttaatcgacgcagttgttccgcgtgtaaaaatgatttcttcaaaatacttcgcattaataaaacgacgaacggtttcacgggcattttcataaccatcagttgccaatgatcctaatgtatgaacaccacgatgaacgtttgaattataacgcttgtagtaatcttctaaaacatttaacacttgcacaggcgtttgacttgtcgctgttgaatcaagatatgctaaacgtttgccattgactttttgatctaatatcggaaaatccttgattacttcattaacgtcaaatgagtgttcggccacttcattcacgacctttcttaaataaaaatcctaatcatttaaatactgacgttgtattagtcttataccaatatcgacagtctatatctattacaaacttttattttcaaaatattatttagaaactttgcgttcaattacttctctcaattgacgtttaacgtcttcgataggtaattcacgtactactggatctaagaaaccatgtataacaagacgttccgcttctctttgagaaataccacgactcattaaatagtaaagttgatctggatcaacacgacctactgatgcagcatgaccagcttgtacatcatcttcatcaattaataaaataggattcgcgtcaccacgagcatgttcagataacattaatacacgtgattcctgattagcaattgatttagttccaccatgcttaatgtagccgataccattaaatacagacgatgcatgttctttcataacaccatgtttaaggatataaccatctgtttctttaccatattgtacgattttagatgttagattaattttttgttcgcctgtacctacaactactgatttaagtgaacttgttgaacgatcaccaaataaatttgttgtattatcaataatttggctaccctcattcattaaacctagtgcccaattaattgaggcatccgcttcagtaataccacgtcgaatgatatgacctgtaaagcctttatccatatagtccactgagccatatgtgatatttgaatttgcaccagcaatcacttcagaaataatatttaattgatttccttcaccagatgcatttgmtaagtaattttcaacatatgtgacttcggcgctttcttcagtaacgatg

SEQ ID NO: 82 - DNA, 15598 bp; double-stranded, linear
tcngactcgaacggtgmaactattccgttgtaattccggaggaascaaggtatgcccatctgcaaagaaagaatgsaatgaactttttggaaatgtagaagtggtaaataaagataaaggatattacattctgagaagtataaaagcttgaaatgaaatggatattctgttatagttatataatgtaaaaatttatgttcaataagtgtgtacttttacgttaaatagataagttaattaagaataaatatagaatcgaaaatggtgtcatcattagtgttgccgttttctttttgtctttttattaatatgcttatggtatttagctaaaagcggatcacataatttttgaggggtgaatctgtttggcaggtcaagttgtccaatatggaagacatcgtaaacgtagaaactacgcgagaatttcagaagtattagaattaccaaacttaatagaaattcaaactaaatcttacgagtggttcctaagagaaggtttaatcgaaatgtttagagacatttctccaattgaagattttactggtaatttgtcattagagtttgtggattaccgtttaggagaaccaaaatatgatttagaagaatctaaaaaccgtgacgctacttatgctgcacctcttcgtgtaaaagtgcgtctaatcattaaagaaacaggagaagttaaagaacaagaagtctttatgggtgatttcccattaatgactgatacaggtacgttcgttatcaatggtgcagaacgtgtaatcgtatctcaattagttcgttcaccatccgtttatttcaatgaaaaaatcgacaaaaatggtcgtgaaaactatgatgcaacaattattccaaaccgtggtgcatggttagaatatgaaacagatgctaaagatgttgtatacgtacgtattgatagaacacgtaaactaccattaacagtattgttacgtgcattaggtttctcaagcgaccaagaaattgttgaccttttaggtgacaatgaatatttacgtaatactttagagaaagacggcactgaaaacactgaacaagcgttattagaaatctatgaacgtttacgtccaggtgaaccaccaactgttgaaaatgctaaaagtctattgtattcacgtttctttgatccaaaacgctatgacttagcaagcgtgggtcgttataaaacaaacaaaaaattacatttaaaacatcgtttatttaatcaaaaattagctgagccaattgtaaatactgaaactggtgaaattgtagttgaagaaggtacagtgcttgatcgtcgtaaaatcgacgaaatcatggatgtacttgaatcaaatgcaaacagcgaagtgtttgaattgcatggtagcgttatagacgagccagtagaaattcaatcaattaaagtatatgttcctaacgatgatgaaggtcgtacgacaactgtaattggtaatgctttccctgactcagaagttaaatgcattacaccagcagatatcattgcttcaatgagttacttctttaacttattaagcggtattggatatacagatgatattgaccatttaggtaaccgtcgtttacgttctgtaggtgaattactacaaaaccaattccgtatcggtttatcaagaatggaaagagttgtacgtgaaagaatgtcaattcaagatactgagtctatcacacctcaacaattaattaatattcgacctgttattgcatctattaaagaattctttggtagctctcaattatcacaattcatggaccaagcaaacccattagctgagttaacgcataaacgtcgtctatcagcattaggacctggtggtttaacacgtgaacgtgctcaaatggaagtacgtgacgttcactactctcactatggccgtatgtgtccaattgaaacacctgagggaccaaacattggattgattaactcattatcaagttatgcacgtgtaaatgaattcggctttattgaaacaccatatcgtaaagttgatttagatacacatgctatcactgatcaaattgactatttaacagctgacgaagaagatagctatgttgtagcacaagcaaactctaaattagatgaaaatggtcgtttcatggatgatgaagttgtatgtcgtttccgtggtaacaatacagttatggctaaagaaaaaatggattatatggatgtatcgccgaagcaagttgtttcagcagcgacagcatgtattccattcttagaaaatgatgactcaaaccgtgcattgatgggtgcgaacatgcaacgtcaagcagtgcctttgatgaatccagaagcaccatttgttggtacaggtatggaacacgttgcagcacgtgattctggtgcggctattacagctaagcacagaggtcgtgttgaacatgttgaatctaatgaaattcttgttcgtcgtctagttgaagagaacggcgttgagcatgaaggtgaattagatcgctatccattagctaaatttaaacgttcaaactcaggtacatgttacaaccaacgtccaatcgttgcagttggagatgttgttgagtataacgagattttagcagatggaccatctatggaattaggagaaatggcattaggtagaaacgtagtagttggtttcatgacttgggacggttacaactatgaggatgccgttatcatgagtgaaagacttgtgaaagatgacgtgtatacttctattcatattgaagagtatgaatcagaagcacgtgatactaagttaggacctgaagaaatcacaagagatattcctaatgtttctgaaagtgcacttaagaacttagacgatcgtggtatcgtttatattggtgcagaagtaaaagatggagatattttagttggtaaagtaacgcctaaaggtgtaactgagttaactgccgaagaaagattgttacatgcaatctttggtgaaaaagcacgtgaagttagagatacttcattacgtgtacctcacggcgctggcggtatcgttcttgatgtaaaagtattcaatcgtgaagaaggcgacgatacattatcacctggtgtaaaccaattagtacgtgtatatatcgttcaaaaacgtaaaattcatgttggtgataagatgtgtggtcgacatggtaacaaaggtgtcatttctaagattgttcctgaagaagatatgccttacttaccagatggacgtccgatcgatatcatgttaaatcctcttggtgtaccatctcgtatgaacatcggacaagtattagagctacacttaggtatggctgctaaaaatcttggtattcacgttgcatcaccagtatttgacggtgcaaacgatgacgatgtatggtcaacaattgaagaagctggtatggctcgtgatggtaaaactgtactttatgatggacgtacaggtgaaccattcgataaccgtatttcagtaggtgtaatgtacatgttgaaacttgcgcacatggttgatgataaattacatgcgcgttcaacaggaccatattcacttgttacacaacaaccacttggcggtaaagcgcaattcggtggacaacgttttggtgagatggaggtatgggcacttgaagcatatggtgctgcatacacattacaagaaatcttaacttacaaatccgatgatacagtaggacgtgtgaaaacatacgaggctattgttaaaggtgaaaacatctctagaccaagtgttccagaatcattccgagtattgatgaaagaattacaaagtttaggtttagatgtaaaagttatggatgagcaagataatgaaatcgaaatgacagacgttgatgacgatgatgttgtagaacgcaaagtagatttacaacaaaatgatgctcctgaaacacaaaaagaagttactgattaatacgcaatttacaaaacaggcaaaaagatactaagctgaattttattgatgattcagtttagtactttaagccattttaaataaatgcaaatcaatcaaatagcacagctaatctaaattgaaggaggtaggctccttgattgatgtaaataatttccattatatgaaaataggattggcttcacctgaaaaaatccgttcttggtcttttggtgaagttaaaaaacctgaaacaatcaactaccgtacattaaaacctgaaaaagatggtctattctgtgaaagaattttcggacctacaaaagactgggaatgtagttgtggtaaatacaaacgtgttcgctacaaaggcatggtctgtgacagatgtggagttgaagtaactaaatctaaagtacgtcgtgaaagaatgggtcacattgaacttgctgctccagtttctcacatttggtatttcaaaggtataccaagtcgtatgggattattacttgacatgtcaccaagagcattagaagaagttatttactttgcttcttatgttgttgtagatccaggtccaactggtttagaaaagaaaactttattatctgaagctgaattcagagattattatgataaatacccaggtcaattcgttgcaaaaatgggtgcagaaggtattaaagatttacttgaagagattgatcttgacgaagaacttaaattgttacgcgatgagttggaatcagctactggtcaaagacttactcgtgcaattaaacgtttagaagttgttgaatcattccgtaattcaggtaacaaaccttcatggatgattttagatgtacttccaatcatcccaccagaaattcgtccaatggttcaattagatggtggacgatttgcaacaagtgacttaaacgacttataccgtcgtgtaattaatcgaaataatcgtttgaaacgtttattagatttaggtgcacctggtatcatcgttcaaaacgaaaaacgtatgttacaagaagccgttgacgctttaattgataatggtcgtcgtggtcgtccagttactggcccaggtaaccgtccattaaaatctttatctcatatgttaaaaggtaaacaaggtcgtttccgtcaaaacttacttggtaaacgtgttgactattcaggacgttcagttattgcagtaggtccaagcttgaaaatgtaccaatgtggtttaccaaaagaaatggcacttgaactatttaaaccattcgtaatgaaagaattagttcaacgtgaaattgcaactaacattaaaaatgcgaagagtaaaatcgaacgtatggatgatgaagtttgggacgtattggaagaagtaattagagaacatcctgtattacttaaccgtgcaccaacacttcatagacttggtattcaagcatttgaaccaactttagttgaaggtcgtgcgattcgtctacatccacttgtaacaacagcttataacgctgactttgacggtgaccaaatggcggttcacgttcctttatcaaaagaggcacaagctgaagcaagaatgttgatgttagcagcacaaaacatcttgaaccctaaagatggtaaacctgtagttacaccatcacaagatatggtacttggtaactattaccttactttagaaagaaaagatgcagtaaatacaggcgcaatctttaataatacaaatgaagtattaaaagcatatgcaaatggctttgtacatttacacactagaattggtgtacatgcaagttcgttcaataatccaacatttactgaagaacaaaacaaaaagattcttgctacgtcagtaggtaaaattatattcaatgaaatcattccagattcatttgcttatattaatgaacctacgcaagaaaacttagaaagaaagacaccaaacagatatttcatcgatcctacaactttaggtgaaggtggattaaaagaatactttgaaaatgaagaattaattgaacctttcaacaaaaaattcttaggtaatattattgcagaagtattcaacagatttagcatcactgatacatcaatgatgttagaccgtatgaaagacttaggattcaaattctcatctaaagctggtattacagtaggtgttgctgatatcgtagtattacctgataagcaacaaatacttgatgagcatgaaaaattagtcgacagaattacaaaacaattcaaccgtggtttaatcactgaagaagaaagatataatgcagttgttgaaatttggacagatgcaaaagatcaaattcaaggtgaattgatgcaatcacttgataaaactaacccaatcttcatgatgagtgattcaggtgcccgtggtaacgcatctaactttacacagttagcaggtatgcgtggattgatggccgcaccatctggtaagattatcgaattaccaatcacatcttcattccgtgaaggtttaacagtacttgaatacttcatctcaactcacggtgcacgtaaaggtcttgccgatacagcacttaaaacagctgactcaggatatcttactcgtcgtcttgttgacgtggcacaagatgttattgttcgtgaagaagactgtggtactgatagaggtttattagtttctgatattaaagaaggtacagaaatgattgaaccatttatcgaacgtattgaaggtcgttattctaaagaaacaattcgtcatcctgaaactgatgaaataatcattcgtcctgatgaattaattacacctgaaattgctaagaaaattacagatgctggtattgaacaaatgtatattcgctcagcatttacttgtaacgcacgacatggtgtttgtgaaaaatgttacggtaaaaaccttgctactggtgaaaaagttgaagttggtgaagcagttggtacaattgcagcccaatctatcggtgaaccaggtacacagcttacaatgcgtacattccatacaggtggggtagcaggtagcgatatcacacaaggtcttcctcgtattcaagagattttcgaagcacgtaaccctaaaggtcaagcggtaattacggaaatcgaaggtgtcgtagaagatattaaattagcaaaagatagacaacaagaaattgttgttaaaggtgctaatgaaacaagatcataccttgcttcaggtacttcaagaattattgtagaaatcggtcaaccagttcaacgtggtgaagtattaactgaaggttctattgaacctaagaattacttatctgttgctggattaaacgcgactgaaagctacttattaaaagaagtacaaaaagtttaccgtatgcaaggtgtagaaatcgacgataaacacgttgaggttatggttcgacaaatgttacgtaaagttagaattatcgaagcaggtgatacgaagttattaccaggttcattagttgatattcataactttacagatgcaaatagagaagcatttaaacaccgtaagcgtcctgcaacagctaaaccagtattacttggtattactaaagcatcacttgaaacagaaagtttcttatctgcagcatcattccaagaaacaacaagagttcttacagatgcagcaattaaaggtaagcgtgatgacttattaggtcttaaagaaaacgtaattattggtaagttaattccagctggtactggtatgagacgttatagcgacgtaaaatacgaaaaaacagctaaaccagttgcagaagttgaatctcaaactgaagtaacggaataacaagtatataacagaggctaatgctttagcctcttgttatttttatgtaaattatttgatttaatgttgacgaattctcttgttcaatgttaatatattaaaggttgatgcaagcagaactttggaggataaattattgtctaaggaaaaagttgcacgctttaacaaacaacattttgtagttggtcttaaagaaacgcttaaagcgttaaagaaagatcaagttacatctttgattattgctgaagacgttgaagtatatttaatgactcgcgtgttaagccaaatcaatcagaaaaatatacctgtatcttttttcaaaagcaaacatgctttgggtaaacatgtaggtattaacgtcaatgcgacaatagtagcattgattaaatgagaattagtaagtgttttacttactaaattttatttaacctaaaaatgaaccacctggatgtgtgggattaaaaagtgaagagaggaggacatatcacatgccaactattaaccaattagtacgtaaaccaagacaaagcaaaatcaaaaaatcagattctccagctttaaataaaggtttcaacagtaaaaagaaaaaatttactgacttaaactcaccacaaaaacgtggtgtatgtactcgtgtaggtacaatgacacctaaaaaacctaactcagcgttacgtaaatatgcacgtgtgcgtttatcaaacaacatcgaaattaacgcatacatccctggtatcggacataacttacaagaacacagtgttgtacttgtacgtggtggacgtgtaaaagacttaccaggtgtgcgttaccatattgtacgtggagcacttgatacttcaggtgttgacggacgtagacaaggtcgttcattatacggaactaagaaacctaaaaactaagaatttagtttttaattaaatcttaaacttaaaatatttaatataaggaagggaggatttacattatgcctcgtaaaggatcagtacctaaaagagacgtattaccagatccaattcataactctaagttagtaactaaattaattaacaaaattatgttagatggtaaacgtggaacagcacaaagaattctttattcagcattcgacctagttgaacaacgcaggttcgtgatgcattagaagtattcgaagaagcaatcaacaacattatgccagtattagaagttaaagctcgtcgcgtaggtggttctaactatcaagtaccagtagaagttcgtccagagcgtcgtactactttaggtttacgttggttagttaactatgcacgtcttcgtggtgaaaaaacgatggaagatcgtttagctaacgaaattttagatgcagcaaataatacaggtggtgccgttaagaaacgtgaggacactcacaaaatggctgaagcaaacaaagcatttgctcactaccgttggtaagataaaagcttttaccctgagtgtgttctatattaatgaattttcattaagcgttcatgcttagggcatcgccatatctatcgtatttattcagtaatataaactggaaggagaaaaaatacatggctagagaattttcattagaaaaaactcgtaatatcggtatcatggctcacattgatgctggtaaaacgactacgactgaacgtattctttattacactggccgtatccacaargknggtgaaacacacgaaggtgcttcacaaatggactggatggagcaagaacaagaccgtggtattactatcacatctgctgcaacaacagcagcttgggaaggtcaccgtgtaaacattatcgatacacctggacacgtagacttcactgtagaagttgaacgttcattacgtgtacttgacggagcagttacagtacttgatgcacaatcaggtgttgaacctcaaactgaaacagtttggcgtcaggctacaacttatggtgttccacgtatcgtatttgtaaacaaaatggacaaattaggtgctaacttcgaatactctgtaagtacattacatgatcgtttacaagctaacgctgctccaatccaattaccaattggtgcggaagacgaattcgaagcaatcattgacttagttgaaatgaaatgtttcaaatatacaaatgatttaggtactgaaattgaagaaattgaaattcctgaagaccacttagatagagctgaagaagctcgtgctagcttaatcgaagcagttgcagaaactagcgacgaattaatggaaaaatatcttggtgacgaagaaatttcagtttctgaattaaaagaagctatccgccaagctactactaacgtagaattctacccagtactttgtggtacagctttcaaaaacaaaggtgttcaattaatgcttgacgctgtaattgattacttaccttcaccactagacgttaaaccaattattggtcaccgtgctagcaaccctgaagaagaagtaatcgcgaaagcagacgattcagctgaattcgctgcattagcgttcaaagttatgactgacccttatgttggtaaattaacattcttccgtgtgtattcaggtacaatgacatctggttcatacgttaagaactctactaaaggtaaacgtgaacgtgtaggtcgtttattacaaatgcacgctaactcacgtcaagaaatcgatactgtatactctggagatatcgctgctgcggtaggtcttaaagatacaggtactggtgatactttatgtggtgagaaaaatgacattatcttggaatcaatggaattcccagagccagttattcacttatcagtagagccaaaatctaaagctgaccaagataaaatgactcaagctttagttaaattacaagaagaagacccaacattccatgcacacactgacgaagaaactggacaagttatcatcggtggtatgggtgagcttcacttagacatcttagtagaccgtatgaagaaagaattcaacgttgaatgtaacgtaggtgctccaatggtttcatatcgtgaaacattcaaatcatctgcacaagttcaaggtaaattctctcgtcaatctggtggtcgtggtcaatacggtgatgttcacattgaattcacaccaaacgaaacaggcgcaggtttcgaattcgaaaacgctatcgttggtggtgtagttcctcgtgaatacattccatcagtagaagctggtcttaaagatgctatggaaaatggtgttttagcaggttatcctttaattgatgttaaagctaaattatatgatggttcataccatgatgtcgattcatctgaaatggccttcaaaattgctgcatcattagcacttaaagaagctgctaaaaaatgtgatcctgtaatcttagaaccaatgatgaaagtaactattgaaatgcctgaagagtacatgggtgatatcatgggtgacgtaacatctcgtcgtggacgtgttgatggtatggaacctcgtggtaatgcacaagttgttaatgcttatgtaccactttcagaaatgttcggttatgcaacatcattacgttcaaacactcaaggtcgcggtacttacactatgtacttcgatcactatgctgaagttccaaaatcaatcgctgaagatattatcaagaaaaataaaggtgaataatataacttgttttgactagctagcctaggttaaaatacaaggtgagcttaaatgtaagctatcatctttatagtttgattttttggggtgaatgcattataaaagaattgtaaaattctttttgcatcgctataaataatttctcatgatggtgagaaactatcatgagagataaatttaaatattatttttaattagaataggagagattttataatggcaaaagaaaaattcgatcgttctaaagaacatgccaatatcggtactatcggtcacgttgaccatggtaaaacaacattaacagcagcaatcgctactgtattagcaaaaaatggtgactcagttgcacaatcatatgacatgattgacaacgctccagaagaaaaagaacgtggtatcacaatcaatacttctcacattgagtaccaaactgacaaacgtcactacgctcacgttgactgcccaggacacgctgactacgttaaaaacatgatcactggtgctgctcaaatggacggcggtatcttagtagtatctgctgctgacggtccaatgccacaaactcgtgaacacattcttttatcacgtaacgttggtgtaccagcattagtagtattcttaaacaaagttgacatggttgacgatgaagaattattagaattagtagaaatggaagttcgtgacttattaagcgaatatgacttcccaggtgacgatgtacctgtaatcgctggttcagcattaaaagctttagaaggcgatgctcaatacgaagaaaaaatcttagaattaatggaagctgtagatacttacattccaactccagaacgtgattctgacaaaccattcatgatgccagttgaggacgtattctcaatcactggtcgtggtactgttgctacaggccgtgttgaacgtggtcaaatcaaagttggtgaagaagttgaaatcatcggtttacatgacacatctaaaacaactgttacaggtgttgaaatgttccgtaaattattagactacgctgaagctggtgacaacattggtgcattattacgtggtgttgctcgtgaagacgtacaacgtggtcaagtattagctgctcctggttcaattacaccacatactgaattcaaagcagaagtatacgtattatcaaaagacgaaggtggacgtcacactccattcttctcaaactatcgtccacaattctatttccgtactactgacgtaactggtgttgttcacttaccagaaggtactgaaatggtaatgcctggtgataacgttgaaatgacagtagaattaatcgctccaatcgcgattgaagacggtactcgtttctcaatccgtgaaggtggacgtactgtaggatcaggcgttgttactgaaatcattaaataatttctaatttcttagattttatataaaaagaagatccctcaatcgaggggtctttttttaatgtgtaaattttgtaatggctattcgatttagaagaacaataattgatgaaagactgactaataaaacttataactgataatactgtttaaataaaattgttgagtcttggacattgtaaaatgctcccttcaaagttttcattttttcaatgtctactttgaagggagcatttcattagtttatgtctcagattcatatctttcaattaatttaaatgcttaatttgttttaaatacttgctctaattctatgatttttaaaaatacagctacagcgtattttaatgatttttcatcaatatcaaatttgggattatggtgtggcgctgtaatacctttactttcattaccacaaccagtcagaaagaatgcacctggtcgtactttcaaataatgtgaaaaatcttctccaatcatcattaaatctgattcattaaagcgtacatgtaagtcatttgttgcttctttaataacttgatatgctttctcgttattatggacaggcaaataccctttaatataattcaaatcatagttaatatcatttgctattgctaaaccttgtagaagcttatccattttgtccattacatgattctgtatatctgaatcgaaagttctaactgtacctttacaaaatgcttgatcaggaataacgctatctgtggtgcctgcttgaatcattccaaatgaaagtacagcttgtttaactggatcgatcgtacgtgaaattattttttgtgcacttaaaatgaactctgccatgattactattgggtcaatggtttcatgaggtttggcaccatgaccaccacgacctttaaatgtgacgctaaattcatctggagaggccatgattgcccccgcacgtgaatgaatagttccagtaggataaccactccataaatgtgtaccgtaaattctatctacattttccagacatccagcatctatcatttcttgagaaccacctggcatgatttcttcaccgtactggaatattaatacaacattaccttctaataaatgtttatgttcatctaaaatctctgctacagtaagtaaaattgctgtatgaccatcatgcccacacgcatgcatacatcctggatttttagacttataaggcacatcgtttaattcctcgacaggtaacgcatcaaagtcagctcttaatgcaatggtaggtcctgtgcccaagcctttaaatgtggctttgataccattgcggccgataggagtttcaatatcacaagataactggcttaattggttaacaatataatcatgtgtttgaaattcttcaaaagataactcaggatattggtgtaaataacgtctgagttgaattgttttattttctttattatttgctagttggaaccaatctaacacccttatcactactttctaaaataatgtttatagtataacattttatgaaattatcgtactaaatgattgctttgagatattttatctatgaatgataaggctttcaagttatgtagaattactgtatgataaaggtattaccaaacaatacttaagggggattatatactgtggttcaatcattacatgagtttttagaggaaaatataaattatctaaaagaaaatggtttgtataatgaaatagatacaattgaaggtgcaaacggaccagaaatcaaaatcaatgggaaatcatacattaacttatcttcaaataattatttaggactagcaacaaatgaagatttgaaatcagctgcaaaagcagctattgatacacatggtgtaggtgcaggcgctgttcgtacaatcaatggtacattagatttacacgacgaattagaagaaacactagcaaaatttaaaggaacagaagctgcaatagcttatcaatcaggatttaattgtaatatggctgctatttcagctgtcatgaataaaaatgatgctattttatcagatgagcttaatcatgcatcaattattgatggatgtcgcttatctaaagctaaaattattcgagttaaccattcagacatggatgatttacgtgcgaaagcaaaagaagcagttgaatcaggtcaatacaataaagtgatgtatatcactgatggcgtttttagtatggatggtgatgtggctaaattacctgaaattgtagaaattgcagaagaatttggtttattaacttatgttgacgacgctcatggttcaggtgttatgggtaaaggcgctggtacggttaaacattttggtttacaagataaaatcgatttccaaataggtacgctttctaaagcaattggtgtcgttggcggttatgtagcaggtacaaaagagttaatagattggttaaaagcacaatcacgaccattcttattctctacatcattagcacctggggataccaaagcaataactgaagcagttaaaaagttaatggattcaactgaattacatgataaattatggaacaatgcacaatatttaaaaaatggattgtcaaaattaggatatgatacaggtgagtcagaaactccaattacaccagtaattattggtgatgaaaaaacaactcaagaatttagtaagcgtttaaaagacgaaggtgtctatgtgaaatctatcgttttcccaacagtaccaagaggtacaggacgtgtaagaaatatgcctacagctgcacatacaaaagacatgttagatgaagcaattgcggcttatgaaaaagtaggaaaagaaatgaagttgatttaatatttatttattcccacggcaaatattgtcgtgggctttttttaatgtttagtttattaacagt

SEQ ID NO: 83 - DNA, 661 bp; double-stranded, linear
aagtaaatcaacttactgggataagaataaaggcgattatagtaacaagttgattttattcgaaaaacattttgaaccggttctgggtatcaagatgcaacatagtggaggtcatagctttggccacacgattattacgattgaaagtcaaggagataaagcagttcatatgggtgatatattcccaactactgcacataaaaatcctctatgggtaacggcatatgatgattatcctatgcaatcgattcgtgaaaaagaacgcatgataccatattttattcagcaacaatattggttcttgttttatcatgatgaaaactactttgctgtaaaatacagcgataatggtgaaaacatagatgcatatattttacgtgaaacattagttgataataactaaaataaagatgtattactaaacaaattttcaaaaataaaaaattgagccacatccaatcttactaattagggtgtggctcatttttaagttttacgatccaaatcaaatatggataaaattcgtattaacgctctacaatgttaatgacttcaccagtatatgcatctgcataaaaatcataatgaatattttgaccatttttaatagttgtaattccaccttgataaactaaacggtatttatcagtttcaggatgaa

SEQ ID NO: 84 - DNA, 5738 bp; double-stranded, linear
gcagacggtacagcagttaaagtcgcaccaaaactgtagtgaatctaatcggtgcattctttttaggattagttgtcgcgcttatatatatcttcttcaaagtaattttcgataagcgaattaaagatgaagaagatgtagagaaagaattaggattgcctgtattgggttcaattcaaaaatttaattaaggatggttgctacttatgtcaaaaaaggaaaatacgacaacaacactatttgtatatgaaaaaccaaaatcaacaattagtgaaaagtttcgaggtatacgttcaaacatcatgttttcaaaagcaaatggtgaagtaaagcgcttattggttacttctgaaaagcctggtgcaggtaaaagtacagttgtatcgaatgtagcgattacttatgcacaagcaggctataagacattagttattgatggcgatatgcgtaagccaacacaaaactatatttttaatgagcaaaataataatggactatcaagcttaatcattggtcgaacgactatgtcagaagcaattacgtcgacagaaattgaaaatttagatttgctaacagctggccctgtacctccaaatccatctgagttaattgggtctgaaaggttcaaagaattagttgatctgtttaataaacgttacgacattattattgtcgatacaccgccagttaatactgtgactgatgcacaactatatgcgcgtgctattaaagatagtctgttagtaattgatagtgaaaaaaatgataaraatgaagttaaaaaagcaaaagcacttatggaaaaagcaggcagtaacattctaggtgtcattttgaacaagacaaaggtcgataaatcttctagttattatcactattatggagatgaataagtatgattgatattcataaccatatattgcctaatatcgatgacggtccgacaaatgaaacagagatgatggatcttttaaaacaagcgacaacacaaggtgttacagaaatcattgtaacatcacatcacttacatcctcgatataccacacctatagaaaaagtgaaatcatgtttaaaccatattgaaagcttagaggaagtacaagcactaaatctaaagttttattatggtcaggaaataagaattaccgatcaaatccttaatgatattgatcgaaaagttattaacggtattaatgattcacgctatttactaatagaatttccatcaaatgaagttccacactatactgatcaattatttttcgaattacagagtaaaggctttgtaccgattattgcacatccagagcggaataaagcaataagtcaaaaccttgacatactatacgatttaattaacaaaggtgctttaagtcaagtgacaacggcgtcattagcgggtatttccggtaaaaaaattagaaaattagcaattcaaatgattgaaaacaatctgacacatttcatcggttcagatgcgcataacacagaaatcagaccgttcttaatgaaagacttatttaatgataagaaattacgtgattattatgaagatatgaacggatttattagtaatgcgaagttagttgttgatgataaaaaaattcctaaacgaatgccacaacaagattataaacagaaaagatggtttgggttataaacagcaaatgaggggttttatggcacatttatctgtgaaattgcggcttttaatactagcattaatcgattcactgatagtgacattttcagtattcgtaagttattacattttagaaccgtatttcaaaacatattctgtcaaattattaatattggcagctatatcactattcatatcgcatcatatttcagcatttatttttaatatgtatcatcgagcgtgggaatatgccagtgtgagtgaattgattttaattgttaaagctgtgacgacatctatcgttattacgatggtggtcgtgacaattgttacaggcaatagaccgttttttagattgtatttaattacttggatgatgcacttgattttaataggtggctcaaggttattttggcgtatttatcggaaataccttggaggtaagtcatttaataagaagccaactttagttgttggtgctggtcaagcaggttcaatgctgattagacaaatgttgaaaagtgacgaaatgaaacttgaaccggtattagcagtcgatgatgacgaacataaacgcaatatcacaattactgagggtgtaaaagtccaaggtaaaattgcggatattccagaactagtgaggaaatataagattaaaaaaatcatcattgcaattccaactattggtcaagagcgtttgaaagaaattaataatatttgccatatggatggcgttgagttattgaaaatgccaaatatagaagacgtcatgtctggtgagttagaagtgaaccaacttaaaaaagttgaagtagaagatttactaggcagagatcctgttgaattagatatggatatgatatcaaatgaattgacgaataaaactattttagttacgggtgcaggtggttcaataggatcagaaatttgtagacaagtttgtaatttctatccagaacgtattattctacttggccatggtgaaaacagtatttatttaatcaatcgtgaattgcgaaatcgcttcggwaaaaatgttgatatcgttcctattatagcggatgtgcaaaatagagcgcgtatgtttgaaattatggaaacgtataaaccatacgcagtttatcatgcagcagcacacaagcacgtgccgttaatggaagacaaccctgaagaagcagtacgtaataatattttaggtacgaaaaatactgctgaagctgctaaaaatgcagaggtaaagaaattcgttatgatttctacggataaagccgttaatccgcctaatgtcatgggagcttcaaagcgaattgcagaaatgattattcaaagtttaaatgatgaaacgcatcgaacaaattttgttgcagtgagatttggtaatgtacttggatcgagaggatctgtgattccacttttcaaaagtcaaattgaagaaggtgggccagttactgtgacacatcctgaaatgacacgttactttatgacaattcctgaagcttctagactagttttgcaggcaggggcattagcagaaggtggcgaagtatttgtgctagatatgggagaaccagtgaaaattgtagatttggcacgtaatttaattaagctaagtggtaaaaaagaagacgacatacgcattacttatacagggattagacccggcgaaaaaatgtttgaagagcttatgaataaagatgaggttcatcctgaacaagtatttgaaaaaatttatcgtggcaaagtacaacatatgaaatgtaatgaagttgaagcgattattcaagacatcgtcaatgactttagtaaagaaaaaattattaactatgccaatggcaaaaagggagataattatgttcgatgacaaaattttattaattactgggggcacaggatcattcggtaatgctgttatgaaacagtttttagattctaatattaaagaaattcgtattttttcacgcgatgagaaaaaacaagatgacattcgaaaaaaatataataattcaaaattaaagttctacattggtgatgtgcgtgatagtcaaagtgtagaaacagcaatgcgagatgttgattacgtattccatgcagcagctttaaaacaagtgccgtcatgtgaattctttccagttgaggcagtgaagacaaatattattggtacagaaaatgtcttacaaagtgctattcatcaaaatgttaaaaaagtcatatgtttatctacagataaggcagcgtatcctattaatgctaggggtatttcaaaagcaatgatggaaaaagtattcgtagccaaatcaagaaatattcgtagtgaacaaacgcttatttgtggtacaagatacggtaatgtgatggcttcaagaggatcagtaatacctttgtttatcgacaaaatcaaagctggagaacctttaacgattacagatcctgatatgacaagatttttaatgagcttagaagatgcggtagaactagttgttcatgcatttaagcatgcagagacaggagatattatggttcaaaaagcaccaagctcaacggtaggggatcttgcgaccgcattattagaattgtttgaagctgataatgcaattgaaatcattggtacgcgacatggagagaaaaaagcagaaacattgttgacgagagaagaatacgcacaatgtgaagatatgggtgattattttagagtgccggcagactccagagatttaaattatagtaattatgttgaaaccggtaacgaaaagattacgcaatcttatgaatataactccgataatacacatattttaacggtggaagagataaaagaaaaacttttaacactagaatatgttagaaacgaattgaatgattataaagcttcaatgagataggagagattgacgttgaatattgtaattacaggagcaaaaggttttgtaggaaaaaacttgaaagcagatttaacttcaacgacagatcatcatattttcgaagtacatcgacaaactaaagaggaagaattagagtcagcattgttgaaagcagactttgtcgtgcatttagcgggtgttaatcgacctgaacatgacaaagaattcagcttaggaaacgtgagttatttagatcatgtacttgatatattaactagaaatacgaaaaagccagcgatattattatcgtcttcaatacaagcaacacaagataatccttatggtgagagtaagttgcaaggggaacagctattaagagagtatgccgaagagtatggcaatacggtttatatttatcgctggccaaatttattcggcaagtggtgtaagccgaattataactcagtgatagcaacattttgttacaaaattgcacgtaacgaagagattcaagttaatgatcggaatgttgaactaacgctaaactacgtggatgatatcgtcgctgaaataaagcgtgctattgaaggaactccaacgattgaaaatggtgtacctacagtaccaaacgtatttaaagtgacattgggagaaattgtagatttattatacaagttcaaacagtcacgtctcgatcgaacattgccgaaattagataacttgtttgaaaaagatttgtatagtacgtatttaagctatctacctagtacagactttagttaycccttacttatgaatgtggatgataggggttcttttacagaatttataaaaacaccggatcgtggtcaagtttctgtaaatatttctaaaccaggtattactaaaggtaatcactggcatcatactaaaaacgaaaaatttctagtcgtatcaggtaaaggggtaattcgttttagacatgttaatgatgatgaaatcattgaatattatgtttctggcgacaaattagaagttgtagacataccagtaggatacacacataatattgaaaatttaggcgacacagatatggtaactattatgtgggtgaatgaaatgtttgatccaaatcagccagatacgtatttcttggaggtatagcgcatggaaaaactgaarttaatgacaatagttggtacaaggcctgaaatcattcgtttatcatcaacgattaaagcatgtgatcaatattttaa

SEQ ID NO: 85 - DNA, 9062 bp; double-stranded, linear
atcatcaacaagaatgatatttttcccatctactatatcttttaccgcagataacttcactctcacaccttgctcacgtaattcttgagttggttgaataaatgttcttgcaacatattgatttttaactagtcccatttcatatggcaaacctatttcttcagcataaccactcgcagctgatagcgatgaattgggtacaccgatgaccatatcagcatttacagggctttcttgggctaattttttaccagaagctttacgtactgcatggacatttttaccagctattgttgagtctggtctagcaaaataaatatattccatcgcagaaattgcagttgtcgtatgatgtgtataagatttaactgtaatacctttatcgttaatcacgacatattcacctgcatgaatatcttgaacaaattctgcacctaacacatctattgcacatgtttcacttgcaaggatgtatgtcccatctttcattttacctacaacaagtggtctgatagcatttggatctactgcgccatataacgcatctttagttaaaatcgcaaatgtaaaaccgcctttaacttttcgcaaactttctttcaacgcttcctcaaaagtaggagctttacttcgacgtatcaaatgcataatgacttcagtatcagaagacgaatggaagatagcaccttgtttttctaaattctgacgcaatgatttagcattaatgaggttaccattatgacaaatacctacactcatatcataaaagtgatacagaaacggttgaatattttcaatacctttattacctgaagtagcataacggacgtgaccaattgcatgttgatatccttttaatcgttccatttgatcatctttaatcgcttcagttagtaagcctaatcctcgctcgccttttaattcattttgatcagaaacaactatacctgcaccttcttgaccacgatgttgcaaactatgaagtcccatatatgttagttgcgctgcttcaggatgattccaaataccaaacacgccacattcttcgtttaatcctgagtagttaaacattgagcaattgccccttcccatatttgtttaatatctgaaacattttcactaatctctgtatatggtgttgttaccttgraattatcactatctgttaaaagtccaatttctattgcattatcaatatttaaagttttacctgatttaacagaaacaacatatcggccttgcgtctcactaaacaattgtgcatttgttatatctattgaagattttaatcctaaaccgtaatgcgcacttagtttagctaaggtaatcagtaagccacctttaccaactgtttgaacatgtgataatagtccttcacgaatagcggtcttgattgattcacctttttcaacttctgaactcaaatctaatgactcaaattcatgattaactttgccataaattaacttttcaagttgactaccaccaaagtcgtccttagtatcaccgattaaatataatttatctccaacttgaggttcaaaatcatttaaataatttacattttcaatcaaacctaccattccaacaactggtgttgggaaaatagaagtacctttcgtttcgttatataaagatacattaccagaaactactggtgtcttaagaatgtcgcatgcttctgccatacctttcgttgaatctatcaactgttgatagatttctttcttttcaggagaaccataatttaaacaatctgtcattgctaatggtgttgcacccacggcaattaaatttcgataagcttcagctactaccatctttccaccttcatatggattgttatatacataacgcgcttcaccatcaattgttgaagcaattgccttatttgtgccttccacacgtactaccgatgcttgaagtcctggcttaattatcgtattggcaccaacttgttggtcgtattgatcatataaatagtgtttagatgctatagtcggatgcttaagtaatttaaagaaagtatctttaacatcgatgtgtgtataatcatttttagaagtattataatctttttcttctccttctaaaatatatacaggtgcttcatcagctagtggttcaactggaatgtcagcataaacttcgtcatcatatgttaaaacaaaacgatttgtatctgtaacttcacctataacagcactatccaattcgtgcttatcaaataaatctaagaatttttgttcagtacctttttcaacaactagtaacatacgttcttgagtttctgaaagcatcatttcataaggagaaatacctggctcacgtgttggcacttgttctaatctcaaatgtaacccactaccaccttttgccgccatttcagacgatgaagatgttaaaccagcagcacccatatcttgaataccaactaattcatcaaatgtaattgcttcaagtgttgcttccattaattttttacctacaaatggatcaccgatttgtacagaaggtcgtttactttcgctttcttccgtcaattcttcagatgcaaaagtagcaccatgaataccatctcgaccagttttcaaaccaacataaatgaccgaattacctacaccttttgctgtgcctttttgaatcatgtcgtgattgataacaccaacacacattgcattaacaagtggattgccatcataacgttcatcaaattcgatttcaccagcagttgttggaataccaatgcagttaccataacctccgataccctttacaacacctttaagtaatctttggttttgtttattatctaattctccaaatctaagactgtttaacaaattaataggtctagccccaatagagacaatgtcacgaatgattccaccaacgcctgtagcagccccttgatatggttcaattgctgatggatgattgtgagactctactttaaatactacggcttgattatcacctatatcgactacccctgcaccttcaccaggccccataagcacatggtcacctgacgtaggaaattgctttaaaaacggtttagaatgtttataagagcaatgttcactccacataacagaaaagatacctgtttctgtaaagttaggttgtctgcctaaaatatcgcaaactttttcatattcttgatcacttaatcccatatcttgatatactttttcaagtttaatttcttcaacgcttggttcgataaatttagacatgttgttccctccaactttttaccatcgcttcaaataatttcacaccactatcagtacctaacaacgtttctaaagctctttcaggatgtggcatcatgccacatacattgcctttttcgttaacaattcctgcaatatcatcatatgaaccgttcggattattcacatatttcagaataatttgattgttagcttttaattgttgatatatttcatcagtacaataataatgaccttcaccgtgagctacaggatatataactttttcaccttgttcataaagatttgtaaatgccgtttgattattcactatttctaactcttcatttctactaataaataaatgtgaatcgttatgcaataatgcaccaggtaataagcctatttcagttaaaatttgaaacccattacaaacacctaatactggcttaccttcagctgcaagacgtttaacttccgaaataatcggsgctacactagccattgccccagatcttaagtaatccccgaatgaaaatccaccaggaataagtacgccatcaaatccacttagtgatgtttctctataatctacatattccgcttcaacaccacttttaatagcagcattaaacatgtctctatcacaattcgaacctggaaaaacaagaaccgcaaatttcattttatgcattctccttttcatcatctaacactttatagctatattcttcaatcactgtatttgcaaacaatttttcacttagagttgtaataatgttgtgtaccttttcatcactaacctcatccactgtcatatataatacttttcctacacgaatatcattcacttgtgcataacctaagtcatgtacagctcgagtaagcgtttgtccttgcgtatctaatacttgtggttgtaatgtgatatgtagttcaattgttttcattattttaaatcctccaatttgtttaaaaatatttgatatgtttcaatcagtgatccagtgttatttctatatacatctttatcaaagtttgcattggtagctttatcccaaattcgacatgtatctggagatatttcatccgctaacaaaatttgaccagtctcagtctttccaaattcgattttaaaatctactaattttaaattcatagcatccattaattgtttcaacacattattaatctttaatgctttggattttagtatttcaatatcttcatctgatgctatattgagcaatttaacatggtcatccgttatcaacggatcatttaacgcatcatttttatagaaaaattctacaagtggttctctaaaaacttcaccattttcaaaacctaaacgctttgtaatagatccactagcaatattacgaacaactacttctaatggaattattttcacaggcttaactaattgttctgtttcagataattgtttaataaagtgactttctattccattttcttgtaaatatttaaatataatagaagtaatttgattatttaatcgccccttacctgccattgtgtctttcttagccccgtttccagcagtaacttcatctttatattcaactcttaattcattttcttgatttgttgagaaaatgcgcttcgcttttccttcatataataatgtcatgctttaattactcccctcaaatttagcgtacatatcttgttcagtttggtttacatcattcgttagtacagtcatatgccccatttttctgctatctttacgctcagacttaccataaatatgtaagtgccactctggatgttcattaaattcattttccaataaatctaaatctttacctagtaagttcatcatgactgctggctttaataattcaattgaatttggtaatgattgtccggtaactgctaaaatatgagtatcaaattgtgaataatcacatgcttcaattgaataatgtccggaattgtgaggccttggtgctatctcgttcacatacaattggttgttactatctataaaaaattcaactgtaaatgttccaatgaaatgaatcgattggataattttattaacttgctctttcgcctcagctgttttatctattctcgctggaacaattgttttgaaaagtatttgatttctatgctcattttcttgtaatgggaaaaaagtgatttgattgttgtttcctcttgtaacagtaagagatacttctttcttgatattcaaatatttttcagctacgcattcactagtttcaattaatttaaaaccttcttgtaagtctttttcgttgttaattaaaacttgacctttgccatcgtagccaccaaatctagtttttacaataaaaggatatcctaatgtttcaattgctttgtcaatatctgtagattcttttactgaaatgaacgggacaactttggtaccagcactttttaatgtttctttttcagttaagcgatcttgtaataactgtatagcttggtaaccttgcggaatattgtacttttcacataatagttttaattgttgggctgaaatgttttcaaattcataagtaatcacatcacatttttgtcctaattgattgagtgccttttcatcgtcatacttggcttgtataaattcgtgtgcaacgtatctacatggacaatcttcagaaggatccaatacaaccactttataacccattttttgagctgattgtgccatcatctttccaagctgaccaccaccaataatgccaatagtcgcaccaaactttaatttattgaagttcattttgcatgtcctccactttttgaattaacgaagattcatactgatttagtttttcaactaaagaaggattttgaatacttaacattcttgctgcaagtatacctgcgtttttagcacctgctgcaccaattgcagtcgttgcaaccggaatacctcctggcatttgaacaattgataataaagaatctataccctttaaactttttgtttcaatcggcactccaataactggtagcgtcgttaatgatgcaaccatacctggtaaatgtgccgcaccgccagcgcctgcaatgataatgtttatacctctttctctcgcttcagaagcaaattgaaccatcatttttggcgtacgatgtgcggatactacttgtttttcgtacggaatttcaaaataatccaacatgttacaactctcttgcataattttccaatcggaagaactgcccataatgactgctactttcactttgtacaccctttcaaaagtttgaattgtgaattactttagttgtatattatagatatagcataacaagcaatttctgctttttcaatcaaaaatcgaactttattttgattttttatttgaatttacgtcttttgctatgtaaattagttttataaactaacaaagttaggatattgacaataggaggagaagtttttatggttgctaaaattttagatggtaaacaaattgccaaagactacagacaggggttacaagatcaagttgaagcgctaaaagaaaagggttttacacctaaattatccgttatattagttggtaatgatggcgctagtcaaagttatgttagatcaaaaaagaaagcagctgaaaaaattggtatgatttcagaaatcgtacatttggaagaaacagctactgaagaagaagtattaaacgaactaaatagactaaataatgatgattctgtaagtggtattttggtacaagtaccattaccaaaacaagttagcgaacagaaaatattagaagcaatcaatcctgaaaaagatgtggacggttttcatccaataaatatagggaaattatatatcgatgaacaaacttttgtaccttgcacaccgctcggcatcatggaaatattaaaacatgctgatattgatttagaaggtaaaaatgcagttgtaattggacgaagtcatattgtcggacaaccagtttctaagttactacttcaaaaaaatgcatcagtaacaatcttacattctcgttcaaaagatatggcatcatatttaaaagatgctgatgtcattgtcagtgcagttggtaagcctggtttagtaacaaaagatgtggtcaaagaaggagcagtaattatcgatgttggcaatacgccagatgaaaatggcaaattaaaaggtgacgttgattatgatgcggttaaagaaattgctggagctattacaccagttcctggtggcgttggtccattaacaattactatggtattaaataatactttgcttgcagaaaaaatgcgtcgaggtattgattcgtaaagagcctgagacataaatcaatgttctatgctctacaaagttataatggcagtagttgactgaacgaaaattcgcttgtaacaagcttttttcaattctagtcaaccttgccggggtgggacgacgaaataaattttacgaaaatatcatttctgtcccactccctaataactgagttttaatgaagtcttttaacccacattaaatattattttgcaattgcaatgaataacaagaaaaatctgggacattaatcgatcaaatgctcccttcaaagtagacattgaataaatgaaggctttgaagggagcatttcactttgtacttggctcaacaattttatatagacagtagttaattgaatgaaaataagcttgtaacaagttttcaattctagtcaggggccccaacaaagaagctgacgaaaagtcagcttacaataatgtgcaagttggggatgggccccaacacagaagctgtgactatgataaagtactactacatagttaatcattagtggttctttatcattttcgcctcccttttcttattgttttgatacacaaaaatttaagttcaaactgtcgaataaagttatatttgatttcaaattatccctaaattattaattktacaattgtggcagattttcaaaataataattatttcctcattatttataaatttatatttaaatttcattctttatagggtaagattaggactatagtatgatgtgtarataatataaattaaggtatagtaaagctaactcagaaatgacttatcattcggaggttacattatgaataaactattacagtcattatcagccctcggtgtttctgctacactagtaacaccaaatttaaatgcagatgcaacgacgaatactacaccacaaattaaaggcgctaatgatatcgttattaagaaaggtcaagattataaccttctaaacggcataagtgcatttgataaagaagatggagatttaaccgataaaattaaagtcgatggccaaattgatacatctaaatctggtaaatatcaaattaaatatcatgtcactgattcagatggtgcaattaaaatttccactaggtatattgaggttaaatagccctcatcactatactgcaaataaaatggtagcaaacgaacatgttttgctaccattttatttgttattctaacttcatctgcaactttaacccaaatattgtattttttctgtataccaaaggactacctatcaaattattaaaacttaactgctctttttaaaaaaatgttttgattttgaacaaacaaatttccacttttcattgtttaacgataaattacttttggcaaattccttattaaaatgtttgcgcttcctttcaatcaactagccatcattttcaatttattagacaatttcaaactttttttattttcattcaattaacctttaattgaaagctattctcaactttccttttaaatatgaagcaattttttcaaaaacgctattagtcacaaaatgt

SEQ ID NO: 86 - DNA, 2738 bp; double-stranded, linear
aaatattttttcaaaactatgtgaaaatggaccatgtctaaatcatgtaataatgcagyacataatgccaacggtctmtctttattgtcccatgcatcatgaccaataaatgactcatcaattaatcgtctaactatttcatacacacctaaagaatgtccaaagcgactatgttctgctgtgtgaaaagataggtacagtgttcctagttgtctaattcgacgtaacctttggaattccttagttttaattaaatcccatatcaattgatcttcaacatgaatatatcgatgtatcgggtctttaaaaactttttcttctactaattttaaatctacatatgcgttagtcattattcccctccttttcgtttaatataatatttaatttacttaaaatgctttgtacataagtgctaagtctaacttttcgccatacatttctggctcataagagcgtaagattgtaaaaccttgctctttatagtaagctactgcttcttcatttttattatctacttctaagtaaacaccttcaaatttatcttcaaaacgtgataatccttcatttaacaatgctgtaccataacctgtatgttgcgattctggtttaacataatgagctgataaatataattcttcaccgtaaataaagttagcaaagccaacgatgtcattaccttcttcaacgactaagaataattgttcttgaagtcttttctttaaatgatgttcattatatgaagcttctaacaagtgattaactgttgtcgcagcgtatatatttaagtatgtattaaaccaagctttagttgcgacatctctaatttgaacaacatctttttcagttgcttgtcttaccttgaacatgactttctccccttattaacaagttttaataacggcattataccacaacttgctcaatacttaataaacaatgattgtctattcaatttatatatttatattttccgttaaaattaaaaataaaaaataacgaagcaaaaaatcacttcgtttagtatgaggtatgtcttattgcaatatactattccactcagttgcacgtgctaaggcatagttgtctttcatgatgtcaccaggcttttcagcagttccaataatataaccatttaaagtggcacctaraaagtctaaactatatttcatttgcgtaattgctggttcgcttttatttttggacaatctccaccaactaaaataactctaaaatccttttcggccatttgtgccttaaaattaggatatcgtttatcttgtaatgtttctgaccaatgttcgataaatgctttcaatggtgctgaaatgctataccaatacactggtgatgcaaaaataattgtatcactagccaatattttatctagaatcggcaaatagtcatcgtcatatgaagtaatagtctctgctgtatgtctcacgtcacgtatcggtttaaactgatgttgtgtcacgtcaatccattgatactctaaatcttgcaaagcgaattttgttaattgtgcagtattaccgtttggtctactcccaccaaacaaaacagtaatcattttagcctaacctcacttttgattaataaatatctgtgtttttcgttacctaattatactatcataagctttgcctaccgaatagtaaaacgcttacaacttttatataaatttgacgaaatttcgtcatgccttatataacgtcgtttgtgatacggggctaattcatgatgaaattagatacatatatcaccattaaatacaattcatttagtcttcaatcggaaacagttcatcgatatattgaatctcatcatctgataaaacgatatctgcagctttaatattttcaacgacttgttctgcacgttttgcaccaggaataatcacatcgatagctggtctcgttaaataaaatgctaatacaatgttcgcaattgaagtttgatgtgctgcagctatgctttccaaagcttttacgcgacgcacattttcttcaaatacacctggtttaaaatcacgacgtgtagtacgatggtcactaaaatttagtgttctcatcatattttccagctaaaataccggatgctaatgggaaatatggaataaatgtgatttggtgatcaacacaatattgtaatactgcctcattttcgcgatgcaataaattatattctaactgtacaacatcaacgtaaccatctttatttgcttctttaagttgatctaatgtgaaatttgatacaccaattgctttaatcttcccttgttccttaagctcttgtaatgctgcaactgcttgatctttcggagtgttgttatccggaaaatgaatataatataaatcgatataatcagtttgtagacgtttcaaactattctcaacttgttgttttaaatattccggttgattgttctgatgtacttcttgattttcatcaaattcatgagaccctttcgtagcaattttaatttgctctcgcggatattctttaacaacttctccaaccaattcttctgatcgttctggcccataaatatatgccgtatctaataaattaataccatgattaatggcttgacgaacaacatcttttccttgttcttcatctaagttcggatataaattatgcccaacctatgcgttcgtcccaagtgcgattggaaacacttcaacatcagatttacctaagtttacaaattgctncattagacccagcncctt

SEQ ID NO: 87 - DNA, 9425 bp; double-stranded, linear
gattagatgatatttaacgaaaattaagrtgmaatacttgaatgtargaagtctgatgtcgaaaatagctattaaaatagagtagacgtaatgtaaatgaaagcacctaaaatagaaaaatttcaaaaatagcgtaattattataataaatagactgccaataaaatgcaatttttcacttataacattcttcaaaaaataatagcaaaattatgtaaaaaatatcttgtcatggcaagattggctgtgctataatctatcttgtgcttaagaacggctccttggtcaagcggttaagacaccgccctttcacggcggtaacacgggttcgagtcccgtaggagtcaccattttttaggtctcgtagtgtagcggttaacacgcctgcctgtcacgcaggagatcgcgggttcgattcccgtcgagaccgtacaaatgcctatccaagaggataggcatttttttgcgtttaatattatattaataaaagatatatggacgaatgataatcatattgatttatctgttcgtccattttctttaaaatgtatgaacctcaagtaacttagtggttggatatgaaagataaacgtagacaataaaatctttattagacgtacaaacatatgctactgtcaacatatttcttcgttgtgatatgccaccagtcctccataacatcaattgttaaagtaacgaataacgaataatgatatttattttctgagcaatgacgtgcactagaagttgccattatcctaattttattattggaatagagacctcatcattgtgttaaatatcattgtcacaatccgccgtgagaaactaataaaaaatagtaatatataagtttatattggaaaatagaattaatagcttataaatggtaaattatataataggttactatacgttataagacggaaaatgcgcacaataacaaaaatagtaagcgacatcctgtgattttttacacaaacataaacgataaagaacaaaaaatgataaaataatattaatgatttaagaaaagaggtttatgcaaatggctagaaaagttgttgtagttgatgatgaaaaaccgattgctgatattttagaatttaacttaaaaaaagaaggatacgatgtgtactgtgcatacgatggtaatgatgcagtcgacttaatttatgaagaagaaccagacatcgtattactagatatcatgttacctggtcgtgatggtatggaagtatgtcgtgaagtgcgcaaaaaatacgaaatgccaataataatgcttactgctaaagattcagaaattgataaagtgcttggtttagaactaggtgcagatgactatgtaacgaaaccgtttagtacgcgtgaattaatcgcacgtgtgaaagcgaacttacgtcgtcattactcacaaccagcacaagacactggaaatgtaacgaatgaaatcacaattaaagatattgtgatttatccagacgcatattctattaaaaaacgtggcgaagatattgaattaacacatcgtgaatttgaattgttccattatttatcaaaacatatgggacaagtaatgacacgtgaacatttattacaaacagtatggggctatgattactttggcgatgtacgtacggtcgatgtaacgattcgtcgtttacgtgaaaagattgaagatgatccgtcacatcctgaatatattgtgacgcgtagaggcgttggatatttcctccaacaacatgagtagaggtcgaaacgaatgaagtggctaaaacaactacaatcccttcatactaaatttgtaattgtttatgtattactgattatcattggtatgcaaattatcgggttatattttacaaataaccttgaaaaagagctgcttgataattttaagaagaatattacgcagtacgcgaaacaattagaaattagtattgaaaaagtatatgacgaaaagggctccgtaaatgcacaaaaagatattcaaaatttattaagtgagtatgccaaccgtcaagaaattggagaaattcgttttatagataaagaccaaattattattgcgacgacgaagcagtctaaccgtagtctaatcaatcaaaaagcgaatgatagttctgtccaaaaagcactatcactaggacaatcaaacgatcatttaattttaaaagattatggcggtggtaaggaccgtgtctgggtatataatatcccagttaaagtcgataaaaaggtaattggtaatatttatatcgaatcaaaaattaatgacgtttataaccaattaaataatataaatcaaatattcattgttggtacagctatttcattattaatgcacagtcatcctaggattctttatagcgcgaacgattaccaaaccaatcaccgatatgcgtaaccagacggtcgaaatgtccagaggtaactatacgcaacgtgtgaagatttatggtaatgatgaaattggcgaattagctttagcatttaataacttgtctaaacgtgtacaagaagcgcaggctaatactgaaagtgagaaacgtagactggactcagttatcacccatatgagtgatggtattattgcaacagaccgccgtggacgtattcgtatcgtcaatgatatggcactcaagatgcttggtatggcgaaagaagacatcatcggatattacatgttaagtgtattaagtcttgaagatgaatttaaactggaagaaattcaagagaataatgatagtttcttattagatttaaatgaagaagaaggtctaatcgcacgtgttaactttagtacgattgtgcaggaaacaggatttgtaactggttatatcgctgtgttacatgacgtaactgaacaacaacaagttgaacgtgagcgtcgtgaatttgttgccaatgtatcacatgagttacgtacacctttaacttctatgaatagttacattgaagcacttgaagaaggtgcatggaaagatgaggaacttgcgccacaatttttatctgttacccgtgaagaaacagaacgaatgattcgactggtcaatgacttgctacagttatctaaaatggataatgagtctgatcaaatcaacaaagaaattatcgactttaacatgttcattaataaaattattaatcgacatgaaatgtctgcgaaagatacaacatttattcgagatattccgaaaaagacgattttcacagaatttgatcctgataaaatgacgcaagtatttgataatgtcattacaaatgcgatgaaatattctagaggcgataaacgtgtcgagttccacgtgaaacaaaatccactttataatcgaatgacgattcgtattaaagataatggcattggtattcctatcaataaagtcgataagatattcgaccgattctatcgtgtagataaggcacgtacgcgtaaaatgggtggtactggattaggactagccatttcgaaagagattgtggaagcgcacaatggtcgtatttgggcaaacagtgtagaaggtcaaggtacatctatctttatcacacttccatgtgaagtcattgaagacggtgattgggatgaataataaggagcatattaaatctgtcattttagcactactcgtcttgatgagtgtcgtattgacatatatggtatggaacttttctcctgatattgcaaatgtcgacaatacagatagtaagaagagtgaaacgraacctttaacgacacctatgacagccaaaatggatacaactattacgccatttcagattattcattcgaaaaatgatcatccagaaggaacgattgcgacggtatctaatgtgaataaactgacgaaacctttgaaaaataaagaagtgaagtccgtggaacatgttcgtcgtgatcataacttgatgattcctgatttgaacagtgattttatattattcgattttacgtatgatttaccgttatcaacatatcttggtcaagtactgaacatgaatgcgaaagtaccaaatcatttcaatttcaatcgtttggtcatagatcatgatgctgatgataatatcgtgctttatgctataagcaaagatcgccacgattacgtaaaattaacaactacaacgaaaaatgatcattttttagatgcattagcagcagtgaaaaaagatatgcaaccatacacagatatcatcacaaacaaagatacaattgatcgtacgacgcatgtttttgcaccaagtaaacctgaaaagttaaaaacatatcgcatggtatttaacacgattagtgttgagaaaatgaatgctatactatttgacgattcaaccatcgttcgtagttcaaaragtggtgttacaacctacaacaataatacaggtgtcgcaaactataacgataaaaatgaaaaatatcattataaaaacctgtccgaagatgaagcgagttccagcaaaatggaagaaacgattccaggaacctttgattttattaatggtcatggtggtttcttaaacgaagactttagattgtttagtacgaataatcagtcaggcgagttaacatatcaacgtttccttaatggttatccaacgtttaataaagaaggttctaatcaaattcaagtcacttggggtgaaaaaggcgtctttgactatcgtcgttcgttattacgcaccgacgttgttttaaatagtgaggataataaatcgttgccgaaattagagtctgtacgttcaagcttagcgaacaatagtgatattaattttgaaaaagtaacaaacatcgctatcggttacgaaatgcaggataattcagatcataatcacattgaagtgcagattaacagtgaactcgtaccgcgttggtatgtagaatatgatggcgaatggtatgtttataacgatgggaggcttgaataaatgaactggaaactgacaaagacacttttcattttcgtgtttattcttgtcaacatcgtgttagtatcgatttatgttaataaagtcaatcgctcacacattaatgaagtcgagagtaacaatgaagttaattttcagcaagaagaaattaaagtaccgactagtatattgaataaatcagttaaaggtataaaattagagcaaattacagggcgatcaaaagactttagttctaaagctaaaggcgattcggatttgaccacatcagatggtggaaaattattgaatgcgaacattagtcaatcggtaaaggtcagtgacaataacttaaaagatttgaaagattatgttaacaagcgcgtatttaaaggtgctgaatatcaattaagcgagattagttcagattctgtaaaatatgaacaaacgtatgatgattttccgattttaaataacagtaaagcgatgttaaactttaatatagaagataacaaagcgactagttataaacaatcaatgatggatgacattaagcccacagatggtgcagataagaagcatcaagtgattggtgtgagaaaagcaatcgaggcattatattataatcgttacttgaaaaaaggtgatgaagtcattaatgctagactcggttactactcagtcgtgaatgaaacgaatgttcaattgttacaaccaaactgggaaattaaagtgaagcatgacggtaaggataaaacgaatacttactatgtcgaagcgacaaataataaccctaaaattattaatcattaatatgaatcgtaataagctagcattgcaagctcatcatatgtgagaagcggtgctagcttttttgctggtacggtttattatggctgatgtttttgcgtctccaacgtgcgcatttattcatattttaagtagaaccgcattgtaaaattagtgtaactgttattttaaaaactttagtatttgtctaatcattgttataataattaagaaattcattgcacgtgattatcaaaatttaaatataagaaaccggtcgatgaactaaagttacataataggaaaggtatacaaaacagctaatatactgatagtttctgtagggaaaatcgtatatttgcactgatgtatattgcagtcatatagagagattgactgtttaaagagaaaggatgagccgcttgatacgcatgagtgtattagcaagtggtagtacaggtaacgccacttttgtagaaaatgaaaaaggtagtctattagttgatgttggtttgactggaaagaaaatggaagaattgtttagtcaaattgaccgtaatattcaagatttaaatggtattttagtaacccatgaacatattgatcatattaaaggattaggtgttttggcgcgtaaatatcaattgccaatttatgcgaatgaaaaaacttggcaggcaattgaaaagaaagatagtcgcatccctatggatcagaaattcatttttaatccttatgaaacaaaatctattgcaggtttcgatgttgaatcgtttaacgtgtcacatgatgcaatagatccgcaattttatattttccataataactataagaagtttacgattttaacggatacgggttacgtgtctgatcgtatgaaaggtatgatacgtggcagcgatgcgtttatttttgagagtaatcatgacgtcgatatgttgagaatgtgtcgttatccatggaagacgaaacaacgtattttaggcgatatgggtcatgtatctaatgaggatgcggctcatgcaatgacagacgtgattacaggtaacacgaaacgtatttacctatcgcatttatcacaagacaataacatgaaagatttggcgcgtatgagtgttggccaagtattgaacgaacacgatattgatacggaaaaagaagtattgctatgtgatacggataaagctattccaacgccaatatatacaatataaatgagagtcatccgataaagttccgcattgctgtgagacgactttatcgggtgcttttttatgttgttggtgggaaatggctgttgttgagttgaatcggcttgattgaaatgtgtaaaataattcgatattaaatgtaatttataaataatttacataaaatcaatcattttaatataaggattatgataatatattggtgtatgacagttaatggagggaacgaaatgaaagctttattacttaaaacaagtgtatggctcgttttgctttttagtgtaatgggattatggcaagtctcgaacgcggctgagcagcatacaccaatgaaagcacatgcagtaacaacgatagacaaagcaacaacagataagcaacaagtaccgccaacaaaggaagcggctcatcattctggcaaagaagcggcaaccaacgtatcagcatcagcgcagggaacagctgatgatacaaacagcaaagtaacatccaacgcaccatctaacaaaccatctacagtagtttcaacaaaagtaaacgaaacacgcgacgtagatacacaacaagcctcaacacaaaaaccaactcacacagcaacgttcaaattatcaaatgctaaaacagcatcactttcaccacgaatgtttgctgctaatgcaccacaaacaacaacacataaaatattacatacaaatgatatccatggccgactagccgaagaaaaagggcgtgtcatcggtatggctaaattaaaaacagtaaaagaacaagaaaagcctgatttaatgttagacgcaggagacgccttccaaggtttaccactttcaaaccagtctaaaggtgaagaaatggctaaagcaatgaatgcagtaggttatgatgctatggcagtcggtaaccatgaatttgactttggatacgatcagttgaaaaagttagagggtatgttagacttcccgatgctaagtactaacgtttataaagatggaaaacgcgcgtttaagccttcaacgattgtaacaaaaaatggtattcgttatggaattattggtgtaacgacaccagaaacaaagacgaaaacaagacctgaaggcattaaaggcgttgaatttagagatccattacaaagtgtgacagcggaaatgatgcgtatttataaagacgtagatacatttgttgttatatcacatttaggaattgatccttcaacacaagaaacatggcgtggtgattacttagtgaaacaattaagtcaaaatccacaattgaagaaacgtattacagttattgatggtcattcacatacagtacttcaaaatggtcaaatttataacaatgatgcattggcacaaacaggtacagcacttgcgaatatcggtaagattacatttaattatcgcaatggagaggtatcgaatattaaaccgtcattgattaatgttaaagacgttgaaaatgtaacaccgaacaaagcattagctgaacaaattaatcaagctgatcaaacatttagagcacaaactgcagaggtaattattccaaacaataccattgatttcaaaggagaaagagatgacgttagaacgcgtgaaacaaatttaggaaacgcgattgcagatgctatggaagcgtatggcgttaagaatttctctaaaaagactgactttgccgtgacaaatggtggaggtattcgtgcctctatcgcaaaaggtaaggtgacacgctatgatttaatctcagtattaccatttggaaatacgattgcgcaaattgatgtaaaaggttcagacgtctggacggctttcgaacatagtttaggcgcaccaacaacacaaaaggacggtaagacagtgttaacagcgaatggcggtttactacatatctctgattcaatccgtgtttactatgatataaataaaccgtctggcaaacgaattaatgctattcaaattttaaataaagagacaggtaagtttgaaaatattgatttaaaacgtgtatatcacgtaacgatgaatgacttcacagcatcaggtggcgacggatatagtatgttcggtggtcctagagaagaaggtatttcattagatcaagtactagcaagttatttaaaaacagctaacttagctaagtatgatacgacagaaccacaacgtatgttattaggtaaaccagcagtaagtgaacaaccagctaaaggacaacaaggtagcaaaggtagtaagtctggtaaagatacacaaccaattggtgacgacaaagtgatggatccagcgaaaaaaccagctccaggtaaagttgtattgttgtagcgcatagaggaactgttagtagcggtacagaaggttctggtcgcacaatagaaggagctactgtatcaagcaagagtgggaaacaattggctagaatgtcagtgcctaaaggtagcgcgcatgagaaacagttatttcataatcaacagtcattgacgtagctaagtaatgataaataatcataaataaaattacagatattgacaaaaaatagtaaata

SEQ ID NO: 88 - DNA, 3886 bp; double-stranded, linear
agttgtaatgtcacatttccagagtctgaaattatctttatcacgttacatttactaggctctaaaatgactgaacatacagcatcttcaattacctttgaataccatgatttatcgcaaaatatacatgaattgatcacttgtgttagccaagaattaggcattgatatgtcaaaagacaacaagttacataccagtctgatcacacatatcaaaccagctatacatcgtattaaatacgatatgctacaacctaatcctttgaggcaagaagttatgcgtcgctatcctcaaatcattgaagccgttagcaagcatattagtccaattgaacaagatgctgctattcgcttcaacgaagatgaattaacatacattacaattcacttcgcatcaagtatagagcgtgttgcaacacataaacaatcaatgattaaggttgtcttactatgtggttctggtataggcacgtcacaacttttaaaatcaaaactaaatcacctgtatcctgagttncacatttgggatgcctattccatttatcaattggaagaaagtcgattattgcaagataacattgattatgtcatttcaacagtaccttgtgaaatatcagctgtaccagttattcatgtcgatccatttatcaatcaacaatctcgtcaaaaattgaatcaaattatcaatgactcaagagaacaacgagtcatgaaaatggcaactgatggcaagtcactcgcagatttattgcctgaacatcgcatcattataaataaacaaccattatcaattgaatccgcaattgcagtggctgtgcaacctttaatcaatgatggcattgtctattcaaattatacagctgcaattttaaaacaatttgaacaattcgggtcatatatggtcattagtccacatattgcacttattcacgctggtactgattatgtacagaatggtgtaggtttcgcactaacatatttcactgaagggattatctttggtagtaaagctaacgatcccgttcaccttgtaattacattagcaacggaccaccccaatgcacatttaaaggcattgggacagttaagcgaatgcttaagcaacgacttatatcgacaagatttcttagatgggaatatttttaaaattaaacaacacattgctttaactatgacaaaggaggcttaataacgtgtcattagacattttgtcaacaacacgcatcattgtaaaagaacaagtaaatgattggactgaagctataactatagcttctcagccattactacaagaacaaattattgaacaaggctatgttcaagcaatgattgatagcgttaatgaacttggaccttatatcgttatcgcacctgaaattgcaattgcacatgcaagaccgaacaatgacgtacatcaagttggtttaagtctattaaagttgaatcaacatgtggcattttgtgatgaagatcactacgcatctctcatttttgtattgagtgccatcgacaatcattcacacttatctgtattacaaaatttagcaaccgtactgggcgataaccaaacagtccagcaactattaactgcaacaaatgcacaagacattaaaaacattttaaaggagcatgattaatatgaaaattttagtagtatgtggccacggtttaggaagtagttttatggtagaaatgaacgcacaagaagcacttaggcaacttaatgcaccatctgatatcgaagttgaacatagtgacattatgacagcaagtccagagatggctgacttgtttatttgtggtagagatttagctgaaaatgccgaacgtctaggggatgtcttagttcttgataatattttagataaagctgaattacaacaaaagctctcagaaaaattacaacaacttaacatgatttaaaggaggtacgacctatgcaagcaatccttaattttatagtcgatattttaagtcaaccagccattcttgttgcactgattgcctttataggtttaatcgttcagaaaaaacctgccgcaacgatcacttcaggaaccattaaaacgatattaggcttcttaattttaagtgcaggtgctgatgtcgtcgttcgatctcttgaaccattcggcaaaatattccaacacgcatttggtgtgcaaggtatcgtacctaacaacgaagctatcgtctcactagccttaaaagattttggaacaacagctgcactcatcatggtctgtggcatgattgttaatattttaattgcccgcttcactaatttaaaatatatctttttaacaggtcatcatacattttacatggctgcgtttttagcaatcattttaacagtcagtcatattaaaggctggctaacgattgttatcggcgcactcgtattaggattaatcatggcagtattacctgcattactccaacctacgatgcgaaaaattacagggaatgaccaagtagctttaggtcattttggctcaatcagttactttgccgcagtgctgtaggtcaattattcaaaggtaagtctaaatcaacggaagagattaaatttccaaaaggcttaagtttcttacgagaaagtacaattagtatctcgattacgatggcattactttacttcatcgcatgcttatttgcgggcgttagttatgtacacgaatctattagtgatggtcaaaactttattgtcttttcattaattcaaggtgtgacatttgctgctggtgtatttattattttaacgggcgttcgtttaatcttagctgaaatcgtcccagcatttaaaggaatttctgaaaagcttgtaccaaattctaaacctgcattagactgccctattgtgttcccttatgcacaaaatgcagtattaattggattctttgtcagctttattacaggtgtcatcggtatgtttatcttattcttatttggtggcgtcgtcattttacctggcgtagttgcacacttcttcttaggtgcaacggctgctgtattcggtaatgcaagaggcggtattaaaggtgctattgctggcgccgctctaaatggtatcctaatcacgtttttaccattattattcttgccatttttaggcgaattaggtggtgctgcaacaacattctcagatacagactttttagctgtcggtatcgtgttcggtaacgcagtaaaatatatgggattatttggtgcgattctatttattattatcgtaggtgcgacaacaattttattaaaaggccgtcaaaaagaacagcaatagtgttaacgtagaaatataaaacaccgtcacatattgagtgaatgccccttttatcaagaggaaagccacttacttatggacggtgttttgtattatattaaatgatacttagccatactatcgacagctgctaaaattgcttcttcttgtgtcgcaatcggttcccaaccaagtaatgtttttgcacgttcgttacttacattgcggttcatatctaataaaagtttaccttctttagcttgatgattaaatttagcacctagactcaaaataaagtctggtaattttttagtagaaactttttgagctatttcaggtctcttttctttaattaattttgcaatttccaacaaattaatttgtccatcagccgtcgcaataaatcgcttgccattagcttgttcatttgtcattgccaaaatgtgcagttcagctacgtctctcacatcaacaacatttaacggaatttgcggtacacgtttcattgaaccattcaataaattttctaataaatgaaagcttcctgaaacgtgtgcatctaatgatggcccaaaaattgcaactggattgattgtggcaaattctactgttgtattttcattct

SEQ ID NO: 89 - DNA, 4879 bp; double-stranded, linear
gtcatctatcaaaaatttggtatacagaccgacaattattaattaataatttaatttcccaggcaataccagtgattaaatatccacaaatacaacataaagaacaaccattagaatctatttcacaacttatattgtctaagatgacatctaatcaatagtgtttaaatttctcagtggctgtgaatgaggtttaaaagtactataaaacgtaaactttgatactttaaaatacgcaaaaaacggtaaaccctaattcatattatagagtttaccgttttattttttaacttgcatcatagttatattaacattattgttggtagtttggatcagtaaccattgcttgtccagtataatcaaccgttacaattgaatattttccatttgcatttgggtctttaaaactaaacacatacttatagttgccattatgttcttcaatagaataatcattatacactttattattactaccaaatttatttgcttcattattagccgcatttaaagctgtttggaaatttggcaattgctgtaaagcttgatttttatttccattaaacggataaatttgacgtgcaaccggcgcggcattttgnccataatatggtgcaacgtaacttgatttttgattattattcgcttggttattacttgattggttattatttgtttggttttggtcattgtttgttgcatttgaattagattgttgctggttatcgtttgcactattatctttattatctttgtttacgtctttactatcatctttattatctttcttatctttagatgaatcatttgtttttttatcttgttgttcagttttcgctttatcatctttttctttattaccgtctttttgttggtcactatcttgaccacatgcagctaaaaataatgataatgctagtaaccctgtaactaatcttttcatacatatctcctcctataattcgatattcattgaataatcttgaaatacatatctaccatgtgtatcttttcatggcttgttaccaaagcgtcaacattaatatgatctgaattatcacaatatccataactacaatctaaggttctttttattataccctaatttttgttcattattatttaatttttgtgaattttatgtttkctataaatttaattattttactttaacaattcattacgcatttagcatttcaaggtatacacaatatttattactatgatttcattttatctgctgcaaaaacaatcattataactctttttccataattaaatctgtatccgttacatcacctgtttgaaaatgatgttcaccaaccactttaaatccatgacgtttataaaatgcttgagcacgaggattatgctcccaaactcctagccaaattttatgtttattatgttcttgagcaattttttcggccaattctatcaattgtgaacctcttccgccaccttgaaagtctttcaaaaaatatatgcgctgcacttctaaataggtctcccccatttcttcagtttgagcactattaatattcatctttatataaccaacattcgcaccatcttcttgataaaaataatgaaatgaatctacatggttaatctcttgtgtaaatttctctacagtataattgtctttaaaaaattgatcaaaatctttgtcatcatagtaagaaccaaacgtgtcataaaatgttctagttgctaattcaactaattcactagcattttgttctgaaatttctttgattatcccagccatataaatcctccaataaacagtgatcgaatcaaaatattacttatgttatttttcagccaaaactatttaaaaatacattaacacaaatcaattacaaattgtattgattgtgtgtaacatcaataaatgatacatttattccagtaaaatggccgtattttcaaaagagaaaaagagaggatgtatcgttgtgatagaaacatttaaagcgtttgtaattgataaagatgagagtggtaaagtgacaccaactttcaaacaattatcgcctactgatttacctaaaggagatgtgctgattaaagtacattactctggtataaattataaagatgctttagcgactcaagatcataatgcagtcgtaaaatcgtatcctatgattccaggaatagatttagctggaacaattgttgaatccgaagcaccaggctttgaaaaaggagaacaagtaattgtaacgagttatgacctaggtgtcagccattatggcggttttagtgaatatgcgcgtgtaaaatcagaatggattatcaagcttcctgatactttaacattagaagaatcaatgatatatggcacagctggttatactgccggtttagcaattgaaagacttgaaaaagttggaatgaatattgaagatggtcctgtactcgttcgcggtgcttcaggtggtgtcggtactttagcagtactcatgcttaatgaacttggttataaagttatcgcaagtacaggtaaacaagatgttagcgatcaattacttgaacttggtgccaaagaagttatcgatcgacttcctgttgaagatgatcataaaaagccactcgcatcatcaacttggcaagcttgtgtagaccctgttggtggcgaaggtattaattatgttacaaagcgtttaaatcatagtgggtcaattacagttattggtatgactgccggtaatacttatactaattctgtattccctcacattttaagaggtgtaaacattttaggaattgactcggtatttactgctatgaaattaagacagcgcgtttggcgtcgtctcgcaaaagatttaatgcctgaaaatttacatgagatcaagcaagttattacatttgatgaacttccagaacaacttaacaaagtaattaaacatgaaaataaagggcgcattgttatcgatttcggtgtagataaatagtattcatgaaaaagacatcccgttatgcgagatgtcttttttaatttagtatttgatatacataccgcctgaatctggttcggtaggtataaatccaaattttgtatataatttatccgctgggtagtctgcaatcagactaacgtatgtactctcaacagccacacctttaatatattgcataatatgctccataattagactgccgtaaccttgaccttggtaacttttcaaaactgcaatatcaacaatttgaaaaacagttccgccatcgccaatcactctacccataccaattaaccgatctttatcatacaaggttactgtaaataaggcattaggtaatcctttttcagctgttcgcgcgtctttggactcatacctgcgttaatccttaatgcgcaataatcctcgcaagtcggaatatcatatgtcactttaaccattatttaccccacttttcatcacacaatatatcaacctagtataaatgtttatttacaatagtcttattcgcttctttaaacacttcatgatgacttgaaacataaccctctgcattcgcatctggttggatatatgttttagcaaggttcgctgcatttgcaccatcactaaatgcacttgcaattagatgtgattttgcatcatgataaacaatatctccacacgcatagataccaggtatactagttgtcgtattaccaaatcctttaacacgacaatcatcatgcatatctagctttgaagatgtttcactcaataatgtattacaacgatcaaacccatgactaataatgacatcgtcaaatttaactgtatgcctatcgccactttcaacatgttccaaaacaacttcacttatatgcgtttcatcatcattgccgaccaagtatttaatacgtgtttttgggcatagtttcacatttaaatctgtcaccaacgttttcatcgcttcatgaccacttacatcttcttttcgataaacaactgtcacgcttttagcaatcttggcaatatcatgcgcccaatctaatgctgtatttcctccacctgatattaatacatctttatctttgaaacgtctgtaactttgtacaacataatgtaaattagttaattgatatctctctacacctttaacatctaattgttttggattaataatacccgcaccaattgcaatgataactgctttcgatgtatatatttctcccgcttctgtttcaacttcgaaatgacgttctgcctttttcctaatatctaccacacgttcattcaaatgaacttccggtttaaaatataatccttgcttaattgtatcttttaaaatttcatgacaaggttttggcgcaatgccgccaatatcccaaataattttttcagggtaaattctcatcttaccccctaattcagattgaacatctatcaatcttacagacatatctcgcaatccagcataaaagcttgcatacaaaccagacggaccgccaccaatgattgtaacatctttcattatgtgcctcctatgactctctatattcatttctttcattaacgtgctcaaattgataattattatcatttaaagccattatactattaatatttatattgttaaaataaatcgcatagttagccatgaattatcaataactatcccatcacaatataaaaacacacctttcaaagtaagawacaacaatgttcctttgaaagatgtgtatattttttagttctagttatattattttttaaaagactcatcacgtggttctttaagaattgcttgtcttaaaaggaaaaatagcaacaataaacctgcaagcatacctgtgtgcccaatacctgcaaagcctgcnaatgcttctggagagtatgatttaccagtgacttggaagaatccttttgtc

SEQ ID NO: 90 - DNA, 1560 bp; double-stranded, linear
ataatgtcttagattgattgggagtttttttaatttttttgaaattaaattaatctgtasytaataaaaaatttgaataactgacacayttttttgatcatagctayatactttgtgaattaattcacattataataagagtgaagataagagtattataaatnatctttaaataaatatatgtgaagtaaaaattacacgttagcatatcgattatggtcatttcktttaacatattaactggggaacgttaaaagttaacggktgatatcyaactaaaaacaaggtcacagtagtatgttttaatctggcgtctattacaaataaaaattacatctataattattcgttttcttttttgaaagtaatagccaattaatatcatacatactggagtgactataaggaggacattattatgagagcagcagttgtaacgaaagatcacaaagtaagtattgaggacaaaaagttaagagctttaaaacctggtgaagcgttggtacaaacggaatattgtggcgtttgtcataccgatttacatgttaagaatgctgattttggtgatgttacaggcgttactttaggtcatgaaggtattggtaaagtcatcgaagttgcggaagatgtagaatcattaaaaattggagaccgtgtgtctatcgcttggatgttcgaaagctgtggaagatgtgaatattgtacaacaggtcgtgaaacactttgccgtagtgtgaaaaatgctggttatacagtagatggtgcaatggctgaacaagttattgttactgcagactatgctgtgaaagtacctgaaaaattagatccagcagcagcgtcttctattacatgcgcaggtgtgacaacttataaagctgtaaaagtaagtaatgtaaaacctggacaatggttaggtgtttttggtataggtggtttaggtaacctagctttacaatatgctaaaaacgttatgggggctaaaattgttgccttcgacatcaatgatgataaattagcattcgcgaaagaattaggtgctgatgctattattaattctaaagatgttgatccagttgcagaagttatgaaattaactgataacaaaggattagatgcaacagtggtaacttcagttgctaagacgccatttaaccaagcggttgatgttgtaaaagctggtgcaagagttgttgccgttggtttacctgttgataaaatgaacttagatatcccaagattagtgcttgatggtattgaagtagtaggttcacttgttggtacaagacaagacttacgtgaagcgtttgaatttgctgctgaaaataaagtaacacctaaagttcaattaagaaaattagaagaaatcaatgatatttttgaagaaatggaaaatggtactataactggtagaatggttattaaattttaaaaatatcaactgactatatagataaagaaggtagtgctctgaacactatcattattaatcaaaccccgaggttttcctgaaaagatagtggnaaatccccgtgttttttgggtttgaggnggttgtntgta

SEQ ID NO: 91 - DNA, 11014 bp; double-stranded, linear
gtcctgtngctgcaatgaatacgcctaaaaatccagggatgtaatggatactttgtggtagtactaatgatagaaatgataaaaatgaaatcacaaaggctacgctcgcaaaagcttgacatgtacgcttatcgccataatctaaccctgtacgtatatgtaataaatactgtaatccgatacttaaatacataattgccacgcataagaagaatgggaagaatgtcttttcaaagtccggatataggctgttagataggaagaccatgatgaacatattaaacatcataaacgagacgtctttgaatgtaacttgaccaaatcgatttgtaaaaaatgtttgatgagaccacattaaccataagaacaaactcatgacgatgtatttgaaaaataaatcagctgaaatggaaccgttttgtgttgttaaaatcacatgtgcaattttttgaatggcatagacgaaaattaaatcaaagaacaactcatggaatcctgcacgcttttcagctaaatgttttggtgttaatgcattaaccataaaattttaactcctttaagatgtgtaattaatttactaagtatactatttattttttctagtgaataggggcagatttggcgatgaagtggaaggagaggtgactgcaaggtaattgcggaattaacaatcatcagcgatttaatatttgactggagacgtcatggtaataaaaaattgatgagaaattgatggtgaaaccagctgtgaatascgatgcaatgatrsatagaatttaattagagtcattacgcgaaatgattaatgataatttgtggtaaatcaaagcataattttgtactatagatgaggatgatagagcatatttaagagggtgaaatgttaaagtgaaaccgtttacgtttccgattgcccaaacaaattacatcattgtataatatgatttgttaaatgcataacaagaatgaaaatgtaacatacgtagcaattggtttcataaattggatgttagtggcgtattggttcattagacgtattagtaataaaattgtatatatcataaggagatgaatatgacatgacgagagtcgtattagcagcagcatacaggacacctattggcgtttttggaggtgcgtttaaagacgtgccagcctatgatttaggtgcgactttaatagaacatattattaaagagacgggtttgaatccaagtgagattgatgaagttatcatcggtaacgtactacaagcaggacaaggacaaaatccagcacgaattgctgctatgaaaggtggcttgccagamacagtacctgcatttacggtgaataaagtatgtggttctgggttaaagtcgattcaattagcatatcaatctattgtgactggtgaaaatgacatcgtgctagctggcggtatggagaatatgtctcaatcaccaatgcttgtcaacaacagtcgctttggttttaaaatgggacatcaatcaatggttgatagcatggtatatgatggtttaacagatgtatttaatcaatatcatatgggtattactgctgaaaatttagtagagcaatatggtatttcaagagaagaacaagatacatttgctgtaaactcacaacaaaaagcagtacgtgcacagcaaaatggtgaatttgatagtgaaatagttccagtatcgattcctcaacgtaaaggtgaaccaatcgtagtcactaaggatgaaggtgtacgtgaaaatgtatcagtcgaaaaattaagtcgattaagaccagctttcaaaaaagacggtacagttacagcaggtaatgcatcaggaatcaatgatggtgctgcgatgatgttagtcatgtcagaagacaaagctaaagaattaaatatcgaaccattggcagtgcttgatggctttggaagtcatggtgtagatccttctattatgggtattgcaccagttggcgctgtagaaaaggctttgaaacgtagtaaaaaagaattaagcgatattgatgtatttgaattaaatgaagcatttgcagcacaatcattagctgttgatcgtgaattaaaattacctcctgaaaaggtgaatgttaaaggtggcgctattgcattaggacatcctattggtgcatctggtgctagagtattagtgacattattgcatcaactgaatgatgaagttgaaactggtttaacatcattgtgtattggtggcggtcnaactatcgctgcagttgtatcaaagtataaataataagaaaacaggttatcacaacagtattaattacatgttggcataacctgtttttatttgtttatggatttattgggtaatattagtcatttgatggtttaattgcaaatgctctaacagggaacccaggtgcatcttttggtttagggctgatagcgtaaatgatggcgccacgagttggtaattgatctaaattagttaataactcgacttggtatttatcctgaccaagaatataacgttcgccaactaaatcaccattttttacaacgtccacagatgcatcggtatcgaatgtttcatgaccaacagcttcaacacgacgttcttcaattaagtacttcaaagcatctaatccccaacccggtgcatgttgttgtccgttcgcatctttgttttcaaacttttcaatattaggccaacgttttgaccaatcggtacgaagtgcaacaaaagtgccaggttcaatagtaccatgctctttttcccatgcttctatatgcgcacgtgttacgatgaaatcattgttgttcgctacttctgttgaaaagtctaatacaattaacggcaataccaattcttttaaatcaatgtcttctaaataacgtttattctcgacaaagtgaattggtgcatcaatgtgagtaccatattgcgttacaatattccaacgttgcacatagaaaccatgatctttaaccgtgaataaagttgaaacttcgcctttttcaaactcactaaaacgtggtatttccggatcaaatgtatgcgttaaatcaacccaagttgcttgttttaaagtatttaattgttgccataaaggatattgtgtcataaaatcacccgtttttagtttattatatgataaatgctgcgattattcttggcgtttagctttaacagcattcacaagcacagtcaatgcatctttaacttcttcttcttttcgcgtttttaaaccacagtcagggtttacccagaataatgagcggtcgatttgttgtagtgaacgattgattgctgtagtaatttcttcttttgttggaatacgtggactatgaatatcatatacacctagaccaatacctaaatcataattaatatcttcaaagtctttaattaaatcaccatggctacgagatgtttcaattgaaataacatcagcatctaagtcatgaatagcatgaatgatttgaccgaattgagaataacacatatgtgtatggatttgagtttcatcacgaactgaagacgttgcaagtttaaatgataaaacagcatctttaagatattgttcgtgatattcagagcgtaatggtaagccttcacgtaatgcaggttcgtcaacttggataactttgattcctgcagcttcaagtgctaatacttcttcgttgattgctaaagcaatttgatcttgaacgactttacgtggtaaatcaacacgttcaaatgaccagtttagaattgttacaggtccagttaacatacctttaactggtttatctgttaagctttgtgcataaactgtttcatcaacagttaaaggcgctgtccattttacatcaccataaatgattggtggttttacggcacgtgaaccatatgattgcacccaaccgaatttagttactaagaaaccttgtaatttttctccgaagaattcaaccatgtcattacgttcaaattcaccgtgaactaatacatctaagccaatgtcttcttgaattttaatccatcgagcaatttcattttttaagaatgtttcatatgcttcgtctgtaatgcgtttgttcttccaatctgcacggtattttcgaacttctcggctttgtgggaatgatccaatagttgttgttggtaaatccggtaagttcaaacgtttttgttgttgttcaatacgttgcgcgaatggtgattgtcttgaagtacgcacgctttcgaaatcataatctaagtttttgaatgattgattttggaaacgctcataacgtgcttttaatttatcatatttaacactatcgttttgattaaataggcgacgcaatgcatctaattcgtctaatttttcagttgcaaagcttaagccttcgccaacacttgtatctaatgtttcatcatctaaagatactggaacatgtaataatgaagatgatggttgaatgacaagttcattagtgtgtgctaacaatttatcgattaagacttttttagcttcaatgtcacttgcccatacattacgaccatcaataattccagcgtataatgtttttgatttatcaaaatctccagcttcaatttgtttaaggttatagccattatcatggacaaagtctaaacctataccaccaacaggtaaagaacttaagaatttaagatgtgcacgttcaaagtatgtttgaatgactaattttttagcaacaccagctttttcgaaatagtcataagcttcacgtgtaatattttcatagctttcgctgtcgtctgtaactaagattggctcatcaacttgaatgtactcagcacctgcatcaattaatgattcaaacacttctttataaagtggtaataacgttttaactttttcttcaaaagtttggtgaccgccttttgataatttaacaaaagtaatcggaccaacaatgacagggtgagcgttaacgtttaaagattgggcatatttaaagcgatctaataatacattgcgactcactttaggctcaacattgtcccattcaggtacgatgtaatgatagttagtgttaaaccattttataagtgcacttgcaacatggtctttattaccgcgagcaatatcaaataataaatcatcatcaatagttcttccttggaaacgttcagggatgatgttgaataataatgacgtatctaatatatggtcatataaagagaaatcaccaactgggatgctatctaagtgatagtacttttgtaataataaatttyctttatgtagatcagttaatgtttgatctaattcttctttagaaatcttctttgcccaataactttcgatggcttttttccattctctttttctacctaatcttgggaatcctaagtttgatgttttaattgttgtcataatattgcctccttgtgagcagtaatagattttgagtatgctgcaagttctaatgaatcttcgacattttgaaacggtgtgataatgtataaaccattaaaatattcatgaacagtatcgattaaatcctttgaaagcttaagacttagttctcgtgttttggctttatcatctttaactgcttcaaattgttgtaaaatttcatctgacatcttgattcctggcacttcattatgcaaaaagagtgcgtttttgtaacttgcgataggcataatgcctatgaaaaatggtttgttcaagtgcttagtggcatggtaaatttcaatgattttctctttgctgtacacgggttgtgttataaaataagacattccgctttctatctttttctctaatcttttgacggcaccatataatttacgaacattagggttaaaggcgccagcgatgttgaagtgtgtacgtttcttcagcgcatcaccgtcagtgttaataccttgattaaatcttagagcgagttcagttaatcctttagaattaacatcatagacattggttgcacctggtaagtgaccaacttttgaaggatcaccagttatggctaatatttcgttaacgccaatgagcgataatccaagtaaatgggactgcaagccgattaagtttcggtctcgacatgtaatatgtacgagtggttcaatattgtaatattgcttaattaagctagcagcagcaatattgctaattctgacagttgccaatgaattatctgcgagtgttaccgcatctacattagctttatcaagtttagcgatattttcaaaaaatctatccgtgtctaaatgtttcggtgtatccaattcgataataacggttggacgttcttgaaccttagatgttaatgattgtctaactttattttgagatggattgaaaagtgctttcgttggtatcggaatcacttttttgtcattaacaggtttaagtgtctgaatagattctttaataaatttgatgtgctctggcgttgtaccacagcaaccaccaattaaacgaacaccttcgcgaattagattttgagcaacttgaccgaaatattgtgcattgtcactatacttaaattcactattttcaatatctaataagctggcatttggataacaagataagaatgcgtgctctggtaattcaatatgtgtgaaagactcttgcatatggtgcgggccatgatgacaattgagtcccacgatgtttgcaccacattgaacgagttgttttaatccttcattgattgcctgaccattaactaagtaatttgtgtttgaagcggttaattgagcaatgattggaatgtcgtatttctttctcgttcgtgaaatgacatttgttaactcttctaggtcgtaatacgtttcgaaaagtagcgcgtcaacgccttcttcaattaaggtgtctatttgaatttcagtatgataaagaatagtttgtaagctgatatcctcttgtttgatacctctaaacccaccaactgtgcctaatatatacgtatctttatttgctgctttttttgcgatgcgaacggcggcttgatgtattgctttaactttatcttcaagaccgaatcgttttaacttttcaaaatttgcaccataagtattggtttgaatgacatcagcaccggcttcaatatatgaacgatggatgcgttcaactttatctggatggctaagattatatgcttctggacaggtgtctaatccttcagagtataaaatggttcctatagcgccatcagctactaaaacattatctttcaattgtgtgaggaattgactcattgaatgcctcctttaatgcgtatttgatgtctgcaatgagttcatcaggatcttcgagaccaacacttaatcggaatagaccgaaagtgataccacgttcttgtctcacttcttcaggtagtgcagcgtgagacattgttgctggatgtgaaaggatcgtttcaacaccgcccagactcactgaaacgagtggtaatgtcagtgcatcgacaaattgttgtgctttagactcatcagctaaacgaaagccaataacggcaccgccatttttagcttgttctaaatgagcagtagtgagtcccggataataaacttctgaaatttcatcttgctttattaaaaatgacacgattttttgagcgttttcgacagattgtttaaatctgattggaaaagtttttaaatgtttagcaagtgtccagctatcctgagcagataacatattgcctgtaccattttgtattaaataaagagcgtcactaattgcctcattattagttatgacagcaccagcaattaaatcgctatgtccacttaaaaattttgtagcactatgaatgacaatatcagcgccaagtaataaaggtgattgacctaacggtgtcataaatgtattgtccacagctaccagtagttcatgcttttcggctattttagaaacagctttgatatcagtaattttaaaacagggattcgatggtgtttcgatataaattaattttgtgtttgattgaatggcaccctcgatttgttcgagctttgtagtatctacggttgtaaattcaatattaaatcgattcaaaatttgctcagtgaggcgaaaagtaccgccatatacatcatcgggtaagatgacatgatcaccagatttgaaagtcaaaagtactgctgaaatagcagcaatacctgatgcaaaagcaaaagcgaattttccctgttctaatcgtgctaacttctcttctaaaagttcacggttagggttgcccttcgtgcataatcatatttaacatcgccaccaagacttgtttgatggaatgttgaagaatcatagagtggtgggttagctgaatgatattccacacctctacgccaatcgaatatcacttctgtctcttttgaaagtgtcatacaatctctccaatctgagctttatctaatgcttggatgatatcgcgttcgatgtcttcataattttcaacacctagtgataagcggattaaatactcatcaatgccacgtttatctttttcagcatctggcatatcaacatgtgtttgggtgtaagggaaggtcactaatgtttcagtacctcctaaactttctgcaaaaatgcaaatgtctaaattttctaataatttagcgacgctataggccttgttaagtcttaaactaagcatgccagtttgcccgctatatagtacttcgtcaattgcttgaagtgactgacattttttagcaagttttctagcgtttgattgcgcacgctcaatgcgtaaatgcaaagttttaagtccacgtaacaacaaataactatctattggtgaaagtgttgcgccagtcatgttgtgaaaatcaaacaactgttgcgcgagtgattcatctttgacggttacgacacctgctagtacatcgttatgtccgccaatatatttcgtggctgaatgtaagactatatcagcaccttctgctagtggtgttgaaagataaggtgttaaaaaagtattgtcgataattgacaataagcctttagctttacaaagttgatagtatggctttacatcaatagcaatcatttgtgggttagatattggttcaatgaataatgcaactgttttatcagtgatttctttttcaacttgttcataatctgtaaaatcaacgtacttaaatttgatatcgtattgttgctcgtaaaattcaaataatctaaatgtgccaccatataaatcgaatgaaactaaaatttcatcatgaggtttaaatagattacatattaattgaatggctgacattccacttgatgtagcgaatgatgcaataccatgctcaagtttggcaaaacaggtttcaaatgttgagcgtgtaggatttttagtacgtgtataatcaaaacctgtcgattgtcctagttttggatgcttgtaggcagtagataaatggattggattcgctatagcaccggttgaatcatcggttaatgtgatttgggctaactgtgtatccttcatattaagaccctcctataagaaaaaataaaaaaagcttccgtccttcgtacccgaatgaatcggataaaaaggacgaaagcttatgtttcgcggtaccacctttatttgttattccatcgctgaaataaccttattcagtacgcattaaaagtaaatatgcttactgaacaattatcacaattaaagtcagtaagtaaggatatagtaatgtgctatcccatacttattaacaaaaaatcgtgcgtaaagaatccagtacgccatttaacatcaatgttaatactgtatcgctataacgggcgaacccgtagacacctcatattggcatcaacactccaaggccattttcaaacacgctttcaaaatcttctctcagctactaaagactctctgtataagcagggtgtgttttacttycctctttattgtgtttacgtttcattaaactgttataagatattaattagcttacagagtaaaaaaagatttgtcaacaattattcagaaaattttgatttaaaagttaatttgtttgtgaaattgtaattggtatcttgaagttgaaaaatgaattattttttaaataaagtgtggttaatggttgtctgactcatttagaatacataaaatatatttaactgttgttatcaaataaaaagtgatgtgagtgaattgtcaaaaagtgaagatcaacgtattactaaaacaaaagatgaacaaattaagcaaatagatatatcggatatcaaaccgaatccgtatcagccccgaaaaactttcgatgaaaatcatttaaatgatttggcagattcaattaagcaatatggaattttgcaaccaattgtgcttagaaaaacagttcaaggttattacattgtagttggtgaaagaaggtttagagcttcgaaaattgctggtctaaaatacgtatcagcgattatcaaagatttaacagatgaagatatgatggaactggcggtcatcgaaaatttacaacgagaagacttaaatgcgattgaagaagctgaaagttatcaacgtttgatgacagatttgaaaattacacaacaagaagtagcgaaacgattgagtaagtcgcgcccgtatatagcgaatatgttgaggttattacatttgccgaaaaagattgctgacatggtaaaagatgggcgactgacaagtgcacatggacgaacgttattggcaattaaagatgaacaacaaatgcttaggttagcgaaacgggttgttaaagaaaagtggagtgtcagatatttagaaaaccatgttaatgaattaaaaaatgtttcgtcaaagtcggaaacagacaaagtagatataactaagcctaaatttataaagcagcaagaacgacagttgcgagaacagtatggtaccaaagtagatatatcaataaaaaaatcggttggtaaaatctcatttgagtttgattcacaagaagattttgtgagaataattgaacaattaaatcgtaggtatggtaaatagttacacaattttatataataactctttgtgcaagtgtaaataaattgtaatcagtgacatttgattctagat

SEQ ID NO: 92 - DNA, 6022 bp; double-stranded, linear
tccccttatggaatttcacattctagtttacataatatatattataggaagttatatgtgtgtaacgcaaaaggtaccctacatcataatcattatctaatatcgtcacataacttacttatgctataatcatggtattatattgtttggagtgatttgatgagatttgtctttgatattgatggtacgctttgttttgacggccgattaattgaccagactattattgatacattgttacaattacaacatgatggtcatgaacttatatttgcatcagcacgtccgattcgtgatttgttgccagttttaccatcagtatttcatcagcacacattaattggcgcaaatggtgctatgatttcacagcaatcaaagatttctgttatcaaaccaattcatactgatacatatcatcatatcttcaaaataattcaaaagtatgagttagattatattattgatgatgattggaattatgctgcacaacttgacgctgnagaacgcgatttttgagcgtttagatccacataagctggccagttgtattgatgttgcaaatatcgacacgccaatcaagaktattttattaaatatagacccggcacaaattacaactatattagacgagctagataaataccatcaagaattggaaatgattcaccattcaaatgagtataacattgatataacagcgcaaaatattaacaaatatactgcattacaatatatatttgatgcagatgttaaatatatagcatttggtaatgaccacaatgatattgtcatgttacaacatgctagtagtggctatattataggaccatcagaagcatacacacacgcaatattgaaacttgataaaatcaaacacatcaataataatgcacaagctatttgcaaagtcttaaaatcatataaataaaaacacccctatcaaatgataatcattatcaatcgataggggctattttaataaaattcgtcctcgaacatttcttcctcttcatctaatccaaataattctgccatttctccatgttcaattaacatgtttaaatatgcatcgcggagttcttcttcactcatatcattaatcatttctttaagactatcaatccacatatttctgcgtaattgatagtcttcttcaacttcgtttaacatcattatatgtttatttgctgcttctggactagctgtaaagagtaatgcaatcatatgtttacatatcactcgtcttccatcagcatgaggacaattacatatggattttctaggatgttccatatcaatataacaacgatatactttgttgccactgccctttacttcagcctcatgctgcgtttctgaaaatgattttaagttaatgacgcattcactttgataataattaaagcctctttctatagaacgaatacttgcaatatcaagtaatcccattaatgatactcctttttattattatttttaaataaagaaaataaaatagataagtgtctagattaaaatacttgatttatctatattttataacaagtctagaattatcgcattcttaaataactaatatgaaaatgcttgcactaattcttttgtataagggtgtctatcaacattaaataattcctctattgcaaaatcatcgactatcatgccatccttaagaacgataattctattaactaagcgttgtaacacggataaatcatgagaaataacgataaaatgatttaagttcgtaatcgtttgcgcttttaatatattgattacattttgttcagctataacatctaaatttgaagttatctcatcacatattaaaacgcgaggctgtgctaataacgaacgcatgacattaaatctttgtaattgtccgccactcacttcgcttggtaatttagtcaataattgcgcgtttaactcaaaagtagataaatgttgtaataataattgatcctgagcagtattatcagttagacctctgtaataatataacgcttcttttaatgaggtctcaatcgtccaatcagggttaaagctagttaaagggtgttggaaaatcggtaacacagcattgtcacttaagtaaatctctcctttaacaggtttaaacaagccaagaaccaatgaagcgagcgtacttttaccacagccactttcgcctaaaataccaacattttctccatcaggtatagtaatattgatatcttgtagcaccatctgctttttattataaccaaaagtcacatgttttaactcaatcatagtaatccctctttaattgtgttctatatttaattagacgttcagtatacggatgcaaatgctcatacttgaaatgattaatattacctcgttcaatgatttgaccttcttttaaaacataaatgtactgacaatatttcaatacatgacttaagttatgtgtgataataaataatgtttgaccatgttctaatacaatatgctgtaataaatccatcacttgattaccgttcaaagcatccaatgatgcaactggttcgtctgcaatgattaatttaggctccaacatgagaacgcttgctatgtatacgcgttcaagttggcccccagaaagttggaaactatatttatttaatatatctttgctttgtaaattaacccacgacaaagccttatcaactttggacaaagcctcttctttactacctttataatgcttacgataaatcgcagttaactgtttacctaatttagtatggtcgttaaaactttctgcataattttgagaaatatagccaattgtatgaccataatattgactcaatctactaacattttccccatcaaattggtacgaatcatacgtgcagcttaaatcaaatggtaaatattcaagtaaagctttagcaatcaaactttttccagcgccgctctctccaatcaaggcattaatctgttgactaaaaattttcaaatcaatccctttaataagagatttctcactagtattctttattgttaaattttgtatatcaatgagactcatcatattcaccccgttgtttcagcaatctatctcttagtgcatcaccggttaaattaaaaattaaaatagttatagcaatgactgaagcaggtgcaatcaacataattggatgagacgaaataaaatcacgaccttgttgcaacatagcgccccactctggtgttggcggttgtgcacctaacccaataaatgatagtgaacttatatatagaatgattttaccgaaatcaacgaccatcaaaacgataatagccggtataattttaggtgttaaatgacgtattaatattgttcttgttggtacatgaaataattgtgccatttttatataaggcttattcatttcgctattaactatacttctagtcaaccttgtgtaattcatccattttattaatgtaattgagataactaaattccataaagatggttgaaaaaaacttgctaaagcaatcatgatgataaattctggaatacttagaccaacatcaataaaccttaacactaatcgttcaatccacccttttttgtatccggcaaatagacctagtgtaacacctatgacaacgatagctattaatgttaaaacagtaacaaacaatgttgaacgtgcaccgataataattcgggtaaataaatctctcccataatcatcagttcctaataaatgcaaccaactaataggttcaaaagtttgtgataaattgactttggttgcattttcactactgacaaagaattgcagtacaattaccacaaaaataaatgcaacgaatacaaaaaatatcaggttattctttgaaaatattttatgcatgacggtcactactttctgatatcaatggtgtattggttttgatttttggatttcctaattgtaaacgctgcttcggatcaagtaataacgttaataaatcagcaatcgtattgataataacaacgaagaagccaataaataacacgcatccttgaataacaggataatctcgagatttaatactatccattaatagataaccaataccaggtatatcaaataaattttcaatcactacagtaccacctattagactgccaagtgaaatccctagtaatgggataatcggcaaaattgttggttttagtaaatcatgaattaaaatataacgttcattcataccgcgtaatcttgatgcttgtacgatattactttgcaataacatcaataaattagaacgcactaaacgaatgatgtatgcacacatacctaaagatagcgtgattacaggtaatataaactgacttagtataacgctatctatattcattaaatttgtgacaataaataataaaataataccgataaagaacgctggtaaactaatcgatagtgttgagatcactctaatcactttatccgtccacttatgaaatcgtttggctgctataatgccgagcggtatagatatgcataacgacactactaatgttgaaaatgatatgagtaatgttatgggtgcatagttgaataatatctgtgttaccggttcttttgattcaaaactttttcctaaattaaaatgtaataaatgattcatccaatgccaccactgtaccaataaagaatcatttaatcccaatttatctttggttgcatttatttgttccgtcgacacttgtgctacatcaagatgtaatattttatcaacaggattgcctggtgataatttcattaaaatgaatgtaagtgtagaaataacaaataaaacaactatcatttgcatcagtctatacaacatagactttattatgaacataatagtccccctccttgtgtaagttactaacactttctttttacatgagaatggcgcatgtatatgcaacttacatattaagaactaacgttcattatagtattatccataaagaaattgaagtatatttaattttttaacaaaatcattataaaatataatattttgaatcaagtcaaccatgtaaaatataaaaaagtcaaaacaaaaacaactatagcactgtattccatctctttcgaaataattgttactgcagtgtaacttaaaagtcgatgattttgtgcatatagttgtcgaatattattttttatctttacggcgaagttcagcgccctcatagccgtatttttcaatttgcttttctaatttacgcgcttttctttctttacgccaatttctagtaaaataccataatagaaaactaattaataaactcataatcgctaaaaatgcagcgtatcctaataatggttgatattttatatcttgaaaatttggaataaaaaatgcaagcacacctaatataacaaatgtaattactgcagatacaaaccatttatttaaaactaagcaacagaatattgttaataaaatcattattaatgttgtgatccataaataattaggcatatcgaataatgtcatattcattctccttttatttcattactttccttgtatacattttattataaatttttaaaaacttaaacaatagcagtcagtttcaagcaatattctatctactaatagaaaaatcattgttccttgcgacatggaaatcgtaacattatcgtttaggagacaaaattatgtataatgaatgtattataccaaaggagtgattatatgtctcaaggtttacctttaagagaagatgttcctgtttcagaaacatgggatttagtagacttatttaaagatgatcaacaatattatgaaagtattgacgctctagtacancaagcaaatcaatttcatcntacatatgcaacaacattaaattcaatcgaacaaattaatactgctttagctgaattagaaaatattttaattgccttagatcgcttaagtaattatgcagaactacgtttaagtgtagatactagtaatatcgaggcacaagtattgagcgctaaattatctactacatacggtaaaattgttaagccaattatccttt

SEQ ID NO: 93 - DNA, 476 bp; double-stranded, linear
ccatcaataatgtatacatgattggcatcatattcccctttaattagagagctacgtacagtttgtyttattaaagtagaactaataaataaccatctcttatgtgcacaaacacttcccgcaacaattgattcagttttaccaacccgtggcatacctctaatgccaatcaacttatgaccttcttctttgaacaattcagctaaaaagtctactaacaagcctaaatcttcacgctcaaatcgaaaggttttcttatcttttgcatcttgctcaatatatcttccatgtcttactgcaagacggtctcttaattctggttttttaagctttgttatttcaatttcatttataccacgagctatttgctcaaaacgttcaactttttcaagattgtctgttttaattaaaaggcctcgtttaccttgatcaacaccattaattgtaacaatacttatacctaacatacctaataa

SEQ ID NO: 94 - DNA, 3633 bp; double-stranded, linear
agaaatacaacgaagcatataaatataaccgatcttttttctaattgaatattaagtaagtgtatgtactttctggaagtagcacctagtrggattgttcctcctacaacaggccaaaaatttttatttttaactggcttaacagtgttcagtttttcatactcttctctactaattttggcgcacctttttggaatgaaccaattaataaatggaaaaaagtatacaagccaagttcttattacatcgaccattaaatactcatcatcatacttaataactctgtatttcggatttttattgataatttcggtttcacaaagcaataattatcacttcctattaataacaaattcacacagctatattatcgtttctgtttctcaaaacacttgtgcccttttgtatcaaaattaatatttatatgaccttaaatatataacatgaatctttttgtctattattgaagacatatttataaagaaaaatagcattgtcataataacccaagcaataaatactataatattttggatagataaactaatcarracatctaagaacatgattgataatccaccacagaaaaaataagaaaatagtacaaagcaaagattcttgaatgatggaaaaatcataatttttccattgctactccgatcattatagatagataactttactttctgatttaaatatatataaaacactagaatacttaataataaaaccgaacaaatgataataacgcaatttttttctaaatgagaatcaggtatatatattttatctctaaacatagtgccaaataaaagtatgctacctatagctggccataaagctttatttttaactggtttgacaatatttaaattatcaaaatcttctctgctgatttggacatatttttttggtattaaccaattaataaacggaaagaacaaaactaaccaggtgcttactaaatcaatcatcagatagtcgtttttatatttaataattctatatctgggatttttgtttacaactctaacctcgcaaagcaatatctccacttccgtctcgttggttttatatctaatacactttcagatactttataagtgttttgtattttagtaacatactattttcctgtttattacttaacttacgaactacaatctaagtttagtaatttctattgctttttaagtttggcataaacctttttattactaattgagcccatgcttattagaaagaaaaaaattgtaataataatccacataataaataccagtagattttgaggttttatagtcattagccatattaaaaataatatagaacaacctcctaataatagatatgtgaaaactataaaacttccatctttaaaagtaggcactaatataaccctattttcattatctagattatcatcatatatctttagtttaagctttttatttaagtaaatgtaaaatgctgcaatacctataaatcctataaaacataaagatattaaaatcttattatctaattgaacttcaaacgtatgtacatatttccgtaaaataactacaaataaaaacgaactaccagtaactggccagaaaatattatttttattttgtttatcaacatttaaattttcaagttccttctcactaagttttgcataccttttgggaatgaaccaattaataaaaggaaaaaagtatacaagccaagtgcttactaaatcaattaacaaatactcatcattatattgaacgactttatatctcggatttttattaataaccttaatattaaaaagcaaaactcaccacgcccatttcattggatttatatgattgctaataatatttttagcttcactaacagcattcccaacactatccatggatttttctgtagtttttttaacaacatctatactattatcgattttatgccctacccagtctactttatcttttaatccaaaaatattattttgataaattaaatctgttcctaatgcaaatactgtactcatagccaaacctgctaaaatcacccatcctactggattacttcctaaaacaaaagtcgctaatccagctccaactgctgtccctgcagatccagctgcaagcgtgcataccattatgcgacaacgcctctccaaatgttttatcatcatttgcaaggtcatcatacatacctataccaaatcctacaccagcaacacctttacctaggtattttccgccttttgcaaatttactaccattttctataaacacattacctgatgtacgtttgacttccacaaatgaatttggacctgctgggcctttcactccacctgctgtattgataaatacaccgaatttacttgcatttataccgtcttgctctaaaagtgttgacgtaatatctaatcctatatctcttttaatactgtctttattgtcatttatatatttcaatatacttttcgggatatcgtcttctggatgttctttggcatatgcctttataacagcaaagtctgctttatttaaagtttctttctctgctttatgttcaattttccccatagcaactttcaaatatttttcatgacttgctttggcccaatcaagttctttacctgaaggaatattaaattgatttgttgaaaagttccaaaaattctgcgcttgggtaagtccttgttggacaattttttgaaattcttcaacttctttaaatatttctggtgatttttgattaaactcacgcaatttgcgtagcttctcttctaattcatgtttttgttgacctaatgttcgtattatttgttggttcgatgaaatggcttgctgattatcggaagcatgctttttcaaattgttattcaaattttcatatcgcgtaatttgttgacttaatgatctgatatcttcttcaagctctgattcttttaaagatatgctatcaacctcactcgtataacgtgacacaaaattatcgcaagcttgcttcgttaaatcactcaatgttttcatacttgttgataatggaattaacaccgtactaaaaaattgcttagctgacgtatacgctttccctttaagcgcatcatcattaataaattgagtaattgctttttccaacgcatcataatttgaattcattgtttgactcaaattccccacacttgaagcttggtttcgagatctgtctaaatacatgtcaatactcatcggcatgctcctttttcaaaaatatatgattttcaaactatttaaaatcaaatgctttttacatctacaaagttgtaaaattttaaaactcggcgatgattatttcttatgtaaaggagtctagatgcaggtaaattgagataacatgtcgccttttttcttattttagcatatggatataatggtgtctttgtatattcgcaattaatcaataaaaattatctttcaatattttaattttattgcgacaacatccttaacattaaatatattaatatctcaaaatatattcactattaaaatatgtcatcagttgttaaaagtatttcctcatcatgcgaaatatcaaaacgtatctaaaatacgaataagtttatacaatcacacaacatcatcattcaaaattttattg

SEQ ID NO: 95 - DNA, 2365 bp; double-stranded, linear
tgatacgaatgcattacaattcatatgcaacatacaattccttctacagcaaatgaagtgaaacaaatagttgatgtgacatctgtagcagaaaatgatacgcattagtcataaaattaaatggaaatgtcgatgaagtgtatcagcaattacagcgattaattaagaatgctaatgtcgaagagagtgagaatactgacaatattaatagtcaagatacaagttatacacctcaagtaaaagtaacaacaccaattttagtgaaagcaccaatcgctggtcgtcgtattttacttaaagaagtaagagattcaatttttagagagaaaatggtaggtgaaggcttagcaatcaaagctcatgaagaatccaaagtaatcgcaccgttcaatggtttaatatctatgattgtaccaactaagcatgcagttggtattcaatcagaagacggtgtggacatagtcattcatattggcgtgaatacagttgacttggaaggtaaagggttcaagtgctttgtaaagcaaaatgatcatgttgaagcagggcaaacgttgttgcaattcgaccagcaatatatacaacaacaaggctacaatgctgacgttattgtcgttattagcaactctgccgatttaggaaaagtagaactgacaatgaatgaaatcattacgactgaagatgttatttttaaaatatttaaaaactaggagtgtgttgtaataatgacaaaattaccgcaaaatttcatgtggggtggcgctcttgccgcaaatcaatttgaaggtggatatgataaaggtggtaaagggttaagtgtaattgatgttatgacgagtggtgcacatggcaaagcacgtcagattacagaatctatagatcccaatcactattatccaaatcatgaaggtattgatttttatcatcgttataaggaagatattgccttgtttaaagaaatgggattgaaatgtttacgtacgtcgattgcgtggacacgtatctttccgaatggggatgaagatgtgccaaatgaagaaggactcgccttttatgatcgtatctttgatgaattaattgcacaaggtattgaacctgttgtgacgttatcacattttgagatgccacttcatttagcgaaacattatggtggatttagaaatagagaagttgtcgattattttgtgcattttgcgcgtgttgtatttgaaagatataaagataaagttacatattggatgacgtttaatgaaattaataatcagatggacacatcaaatcctatctttttatggacgaattctggggtagcattgacagaaaatgataatcctgaagaagtcytgtatcaagtagcacatcatgaacttttagccagtgcyttagcagttcgtcttggtaaagagattaatccgaagtttaagattggracmatgatttcamatgtacccmtttatccatawtcgtgtcatccgaaagatatgatggaagcacaaattgcgaatcgcttacgtttctttttcccggatgtccaagtgagaggttattatccaagctatgctaaaaaaatgttggcacgaaaaggatatgatgttggatggcaagaaggggacgacagtattttacagcagggcacggttgattatattggctttagttattacatgtctacggctgtaaaacatgatgttgatactacagttgaaaacaacatcgtcaacggtggtttgaatcattctgtggagaatccgcatatcgcaacgagtgattggggttgggcgattgatccagatggcttaagatatacattgaatgtgttatatgatcgttatcagttaccactttttattgtggaaaatggttttggtgcagttgatgaagtggtagatggacatattcatgatgattatcgcattgaatatttaaaagcacatattacagcagcgatagaagcagttgatcaagatggtgtagatttaatcggttatacaccgtggggaatcattgatattgtttcatttacaaccggtgaaatgaagaaacgctatggtttaatatatgttgatcgagataatgatggtcatggcacgatggaacgcttgaaaaaagattcgttctattggtatcaacaagtgatagcatcaaatggagataaattataaaggtatattataagtattttagggttagagcccgagacataaattaatatagtaggacctacagtgttataatggcgggcccccaacacaaagaatttcgaaaagaaattctacaggtaatgcaagttggcggggcccaacacagagaaattcgaaaagaaattctacaggtaatgcaagttggggaaggacagaaataaatt

SEQ ID NO: 96 - DNA, 11050 bp; double-stranded, linear
ctgcgatacgatttgttgaaagtggggaaaacaaaaaagttatcattaccaatttagagcaggcatacgaagctttgattggtaataaaggtacacacattcacatgtagcactttatcacgcgacaaaacattaaatatgtttctccgttgattcaaatgaaaaagttgtctgctgacactttgcaaggtttgaaggagtttaacttatgacagaaaactttattttgggtagaaataataaattagaacatgaactaaaggcattagcagattacattaatataccatatagtatattacaaccatatcaaagtgaatgttttgtcagacattatacgaaaggccaagttatttatttttcgccacaagaaagtagcaatatttactttttaattgaaggtaacattattagagaacattacaatcaaaatggagatgtatatcgttattttaataaagagcaagtattatttccaatcagtaacttatttcatccgaaagaggttaacgaattgtgtacagcattaaccgattgtacagttcttggattgcctagagaattgatggcctttttgtgcaaagctaatgatgatatatttttgacactttttgcattaataaatgataatgagcagcaacacatgaactataacatggcattaacaagtaaatttgctaaagatcgaattatcaaattgatatgccatctatgtcagacagtaggatacgatcaagatgaattttatgaaatcaaacagtttttaactattcaactcatgagtgatatggctgggatttcccgggaaacagctggtcatattattcatgaacttaaagatgaaaaacttgttgttaaagatcataaaaattggttagtaagcaaacatttattcaatgatgtatgtgtttaatatacaatgtaaaatgaataagttgaacatgaggtctaacgtacatttatacgttaggccttttttgctagcatgatgaataatttaaaatgttagttaaatttgattgttgaaattacagtaaaatttaaggtgatgaaaaatttagaacttctaagtttttgaaaagtaaaaaatttgtaatagtgtaaaaatagtatattgatttttgctagttaacagaaaattttaagttatataaataggaagaaaacaaattttacgtaatttttttcgaaaagcaattgatataattcttatttcattatacaatttagactaatctagaaattgaaatggagtaatatttttgaaaaaaagaattgattatttgtcgaataagcagaataagtattcgattagacgttttacagtaggtaccacatcagtaatagtaggggcaactatactatttgggataggcaatcatcaagcacaagcttcagaacaatcgaacgatacaacgcaatcttcgaaaaataatgcaagtgcagattccgaaaaaaacaatatgatagaaacacctcaattaaatacaacggctaatgatacatctgatattagtgcaaacacaaacagtgcgaatgtagatagcacaacaaaaccaatgtctacacaaacgagcaataccactacaacagagccagcttcaacaaatgaaacacctcaaccgacggcaattaaaaatcaagcaactgctgcaaaaatgcaagatcaaactgttcctcaagaagcaaattctcaagtagataataaaacaacgaatgatgctaatagcatagcaacaaacagtgagcttaaaaattctcaaacattagatttaccacaatcatcaccacaaacgatttccaatgcgcaaggaactagtaaaccaagtgttagaacgagagctgtacgtagtttagctgttgctgaaccggtagtaaatgctgctgatgctaaaggtacaaatgtaaatgataaagttacggcaagtaatttcaagttagaaaagactacatttgaccctaatcaaagtggtaacacatttatggcggcaaattttacagtgacagataaagtgaaatcaggggattattttacagcgaagttaccagatagtttaactggtaatggagacgtggattattctaattcaaataatacgatgccaattgcagacattaaaagtacgaatggcgatgttgtagctaaagcaacatatgatatcttgactaagacgtatacatttgtctttacagattatgtaaataataaagaaaatattaacggacaattttcattacctttatttacagaccgagcaaaggcacctaaatcaggaacatatgatgcgaatattaatattgcggatgaaatgtttaataataaaattacttataactatagttcgccaattgcaggaattgataaaccaaatggcgcgaacatttcttctcaaattattggtgtagatacagcttcaggtcaaaacacatacaagcaaacagtatttgttaaccctaagcaacgagttttaggtaatacgtgggtgtatattaaaggctaccaagataaaatcgaagaaagtagcggtaaagtaagtgctacagatacaaaactgagaatttttgaagtgaatgatacatctaaattatcagatagctactatgcagatccaaatgactctaaccttaaagaagtaacagaccaatttaaaaatagaatctattatgagcatccaaatgtagctagtattaaatttggtgatattactaaaacatatgtagtattagtagaagggcattacgacaatacaggtaagaacttaaaaactcaggttattcaagaaaatgttgatcctgtaacaaatagagactacagtattttcggttggaataatgagaatgttgtacgttatggtggtggaagtgctgatggtgattcagcagtaaatccgaaagacccaactccagggccgccggttgacccagaaccaagtccagacccagaaccagaaccaacgccagatccagaaccaagtccagacccagaaccggaaccaagcccagacccggatccggattcggattcagacagtgactcaggctcagacagcgactcaggttcagatagcgactcagaatcagatagcgattcggattcagacagtgattcagattcagacagcgactcagaatcagatagcgactcagaatcagatagtgagtcagattcagacagtgactcggactcagacagtgattcagactcagatagcgattcagactcagatagcgattcagactcagacagcgattcagattcagacagcgactcagattcagacagcgactcagactcagatagcgactcagactcagacagcgactcagattcagatagcgattcagactcagacagcgactcagactcagacagcgactcagactcagatagcgactcagattcagatagcgattcagactcagacagcgactcagattcagatagcgattcggactcagacagcgattcagattcagacagcgactcagactcggatagcgattcagattcagatagcgattcggattcagacagtgattcagattcagacagcgactcagactcggatagcgactcagactcagacagcgattcagactcagatagcgactcagactcggatagcgactcggattcagatagcgactcagactcagatagtgactccgattcaagagttacaccaccaaataatgaacagaaagcaccatcaaatcctaaaggtgaagtaaaccattctaataaggtatcaaaacaacacaaaactgatgctttaccagaaacaggagataagagcgaaaacacaaatgcaactttatttggtgcaatgatggcattattaggatcattactattgtttagaaaacgcaagcaagatcataaagaaaaagcgtaaatacttttttaggccgaatacatttgtattcggtttttttgttgaaaatgattttaaagtgaattgattaagcgtaaaatgttgataaagtagaattagaaaggggtcatgacgtatggcttatatttcattaaactatcattcaccaacaattggtatgcatcaaaatttgacagtcattttaccggaagatcaaagcttctttaatagcgatacaactgttaaaccattaaaaactttaatgttgttacatggattatcaagtgatgaaacgacatatatgagatatacaagcatagaaaggtatgcgaatgaacacaaattagctgtgattatgcccaatgtggatcatagcgcatatgctaacatggcatatggtcatagctattatgattatattttggaagtgtatgattatgttcatcaaatatttccactttccaaaaagcgtgatgacaattttatagcaggtcactctatgggaggatatggcacaattaaatttgcattaacacaaggggataaatttgccaaagctgtaccattatctgctgtgtttgaagcgcaaaatttaatggatctagagtggaatgatttttcaaaagaggccataattggcaatctttcaagtgttaaaggaactgaacatgatccgtattacttgctagacaaagctgtagctgaagataaacaaattccaaaattgctcattatgtgtggtaaacaagactttttatatcaagacaacttagattttatcgattatttatcacgcataaatgttccttatcaatttgaagatggaccaggagatcatgattatgcatattgggatcaagcgattaagcgtgctataacatggatggtgaatgattaattatttcttggaaaatatgtggctgcattaaatacacagagtgagagatacaaactatttacgcacgactaacatttctaagtgtttaaattatttttgtattaatatgattggcgcaatttgctgatacacaaaaatgtttctcgtgaaacttagatttagcttatagttttatcatcatttgtatgacttacattataaattttattataatgaggttaacgctttgaaaggagtcatcatcatgtcgaccaataaaaacgattatgagcatatgttgttttattttgcatataaaacctttattactaccgctgatgaaattatagagaagtatggtatgagtcgtcagcatcatcgttttttgttttttatcaataaattacctggtattactattaaatcattactagaaatattagaaatttctaamcaaggatcacatgcaacacttcaaaaattaaaagagcaaggtctcattattgaaaaagttttagagactgatcgacgtgtcaaaaaattatattcgacggataaaggcgatcaactcattgctgaattgaacaaggcgcaagatgaattattgcaaaatatatatcaacaagtcggttcggattggtatgatgtgatggaagcattggctaaagggcgacctggctttgattttattaagcatttgaaagatgaaaaagaaagctagcatcagaaatgttaaaaatcttcgcattcttaaatttaaaaaatatgtcaaaaagtgtataataaaaacatataatttaattgaactcagtttcaacacatcttagaaaggagtttgaatgatgaaaaaattagcagttattttaacattagttggcggtttatacttcgcatttaaaaaataccaagaacgtgttaaccaagcacctaacattgagtactaaattaaaccataaaaaattcccgaacaccttgttatagtgctcgggaatttttttatgctttacttgaatatatcaaatattatttttgcgctttctgtattttcgatattaccactaaatgattctgatctaggtccgtaagcgtaggtattaacatcctcgcctgtatgtccatcggaagtccaccctgtataagatttatcatttactggcttctgaatagcgtgttgtagggcttttgtttgcgtttctacttctgcggatttttcgtctttttcttttttaagtagtctttttagctttttattctcttttttaacctttttcatatcatcttgtgaaaattcaaatccataaccttcattaataactttttcagggtcttcacctttagccattttttctgtcatatatgatccagagtgtttcatagatttaatcggttgaggattccattcgtatcctttatctttaccaattgttagaccaccagtagagtgatctgctgttgcaacgacaagtgtatctttatgtttcttagcatattgaatggcgtcatcgaatgctttttcaaaaccttccatttcagacataacgcctgtaatatcgttggaatgcgctgatttatctatagaagcaccttcgaccattaaaaagaatccttttttattgcgctcaagcttactaagtgcactttgttgcatatcagctaatgatggttcgtctttagaagcatctattgcaagtggcatatttttatctgcaaacaaaccaagaactttatctttatcagattttgataactccttactgttcgtggcaaggtcgtaaccatcttttttgaattttttatctaaattgccattacttttaccgaaatatttagcgccgccgcctaataaaacatcaactttatgctttccgttgattttatctttataaaattgtttagcgatttcgtttttatcatctctagaagtcacgtgtgcagcatatgctgctggtgttgcatctgttaattcagctgttgaaacaagaccagtcgacttacctttttcttttgcacgttcaagcaccgtctttactttctgcttgttactgtcaacaccgatggcaccattatatgtcttatgaccagaactaaaggctgttccgccagctgcagaatcagtaatattctgttttgggtcatttgaatatgtacgatttgtgccttttaaatatgaatcaaaagcagtaggggtcatttctttagcatgcggatcatttttataataacgataagctgtgttaaatgatggacccatgccatcgccaactaaaaagataacattttttggatttttagtattaccaaccgcgaaactttcatctttagaacttttatcggattgcgcaattgcaggtgtgacagaactaaaaaccgttgacacgataataaggttagcaactgcaaattttgtggcttttttaactgataacataagacatcctcctgagtatatgactatgtcttcagtgtaaaagaggaattttgagcaattatgtagttttagttanaaatatgtaaacagagtgatttagaataacaaaaaatgaatatatatgacaatttgttatagaaagcgttagaatagaagcgtgtgaaaatatagaattaaatataatttgaggtggaaaaatgatactagtaatgttatctccattattaatcatattctttatagtgttgtctattttagaagagcgtaaacgtacgaagaaaaagcaactcgagaaagaaaaagcaaatacactaaatcaaaatacaaatgacacggaaagttcaaatcaagagccgtcattgcagcaggataaagaacaaaaagataacaaaggataattcaattgaaggaagaagattatagatgaaaatattaattgttgaagatgattttgttatagcagagagtttagcatctgaacttaaaaaatggaattacggtgttattgtcgttgaacaatttgatgatatactgtctatctttaaccaaaatcaacctcagcttgtattgctagatattaatttgccaacgttaaatggttttcattggtgtcaagaaatccgaaaaacatctaatgtgccaattatatttattagttcccgtattgataatatggaccaaattatggcaatacaaatggggggagatgattttatcgaaaagccatttaacttgtcattaacgattgccaaaattcaagcattattgagacgaacttatgacttgtcagtagctaatgattcattgacggttaaaggttgtacattaatattagatgaagcaaaagtcgtgtatcaagaacaaaacatacagctatctttgactgaattacaaatattaaagttattatttcaaaatgaagataaatatgtaagtagractgctttaattgaaaaatgttgggaatcagaaaacttcatagatgataacacattagctgttaacatgacgcgcctgctgaaaaaattaaatactattggcgttaatgattttatcattacaaagaaaaatgtcggatataaagtatagggtgaatgcaatgacctttcttaaaagtattactcaggaaatagcaatagtcatagttatttttgctttgtttggcttaatgttttacctgtatcatttgccattagaagcatatttactagcacttggcgttattttattattattactcatattcataggtattaaatatttaagttttgtaaaaactataagccaacaacaacaaattgaaaacttagaaaatgcgttgtatcagcttaaaaatgaacaaattgaatataaaaatgatgtagagagctactttttaacatgggtacatcaaatgaaaacacccattactgcagcacaactgttacttgaaagagatgagcctaatgttgttaatcgtgttcgtcaagaggttattcaaattgataactatacaagtttagcacttagttatttaaagttattaaatgaaacttctgatatttctgtcactaaaatttcgattaataatatcattcgcccaattattatgaaatattcaatacagtttattgatcaaaaaacaaaaatccattatgaaccttgtcatcacgaagtattaactgacgttagatggacctctttaatgatagaacaattaataaataatgcacttaagtatgcgagaggtaaagatatatggattgaatttgatgagcaatccaatcaattacacgtaaaagataatggtatcggtattagtgaagcgracttgcctaaaatatttgataagggctattcaggttataatggccagcgccaaagtaactcaagtgggattggtttatttatcgtaaaacaaatttcaacacacacaaaccatcctgtttcagtcgtatctaaacaaaatgagggtacaacatttacgattcaatttccagatgaataaaaactttcaatattgtaagtatactagtaacatttttttactaatttaaatgttattagtatttttttgttttaatatagaactaacaaagaaatgaggtgcatgccatgttgctagaagtgnaacatgtaaaaaaggtttatggtaaaggtttgaatgctacgacagcacttaatcaaatgaatttatcagttggagctggtgaatttgttgcaattatgggtgagtctgggtcagggaagtctacactactaaatttaattgcttcttttgatggactaactgaaggtgacattattgtggatggcgcacatttaaataatatgaaaaataaaagtaaagcattgtatcgtcaacaaatggtaggttttgtttttcaagattttaatcttttaccaacaatgacgaataaagaaaatataatgatgccattaattttagctggtgctaaacgaaaagatatagaacaaagggtacatcagttggcagtacaattacatttagagggattcttaaacaagtatccttctgaaatctctgggggtcagaagcaacgcattgccattgcacgtgcattagttactaagccgacgattttactagccgatgaacctacaggtgcacttgattcaaaaacatcaaaggcattgatgatgttatttcaagagattcatcaattggaacagacaattttaatggtaactcattcaaatatcgatgcgtcttatgcagagcgagtcatttttattaaagatgggcgtctatatcatgaaatatatcgtggtgaagaaagtcaattagcttttcaacaacgaataacagatagcttagcacttgtgaatggaggaagtgtcaatatatgaagttaagattgttatgnacatagtgcgacgtcaatttattacgcagcgacttgtaatcattccattcattttagcggtaagtgtactattcatgattgaatatacgcttgtgtcaattgggttaaatagctacataaaacagaagaatgacttcctagtaccatttattatcatagctaatttttttatggcgcttttaacttttatttttattttctatgcaaatcactttatgatgtcacaaagacgaaaagagtttagcatttttatgacattgggcatgaccaagaaaagtatgcgtttaattgtagtgatggaaactatcttacaatttgtgataatttcagtcgttagtattgccggcggatacttacttggtgcgatatttttcttgtttatacagaaaataatgggcagtgaagttgcgacgttaaggtattatccatttgactctgtagcgatgtttattactttgattatcattgctgtattaatgggcatgctacttatattcaacttgtttagtattaattttcaacggccgataacttatcaacatcgttccgattctagtgtcatatcacgatggttgcgttacgttttaattgttataggaagcgcanactatatttaggttactttattgcattacaacaagatacgacgtttggtgccttttttaaaatatggattgtcataggattagttattatcggtacttatgcattttttgtaggtataagtgaaataattattagtatattgcagcaggtatcaaaagtttactatcatccacggtatttttttgtggtagttgggatgcgtgtacgtcttaaaatgaatgcagtcagtcttgcaacaatcactttgctgtgtacatttttgattgtaacgctcacaatgacattaacaacctatcgtgatatgaatcataccattacgaaattgattacgaatgattakgatttgtcatttagcgacaattctaagtcacaaatagaacgtcaacaaacaattgag

SEQ ID NO: 97 - DNA, 983 bp; double-stranded, linear
cgacataacgaggcaagggtacatgatactttagcctcgtttttgatatgtatttttctgaatataagggcaatagatggtattttatawtttttttaaggtagtgattaacatagatatttatcaacactttagacaggaagaatacgaattaattgatcagctaacggataaatgtgatcaagcggaacagcattatgcaccagtattaacgcattttttagatccaagagggcaatatatattggaagtgatttgtggcagttatgaagatttaaacgtatctttttatggtggacctaatgctgaaagaaaaagagcaatcatttcgccgaactattatgaacctaaagaaagcgactttgaattaactttaatggaaatagattatcctgaaaaattcgtcactttaaaacatcaacatattttagggacattaatgtctttaggtatcgaacgcgaacaagttggagatataattgtgaatgaacgaattcaatttgttttgacaagtagattggaatcatttattatgttagaattacaacgtattaaaggcgcatcagttaaactttatactattccagtaacagatatgatacaatctaatgagaattggaaaaatgaaagtgcacagttagttctttaaggttagatgttgttattaaagaaatgatacgtaaatcacgtacgattgcgaaacaactaatcgaaaaaaaacgtgttaaagtgaatcacactattgttgattcagcagattttcaattacaagcaaatgatttaatatccatccaaggttttggtagagcacacattactgacttaggtggtaaaactaaaaaagataaaacgcacattacctatagaacattattcaaatagtaatgatttaaggaggataacaaatgccttttacaccaaatgaaattaagaataaagagttttcacgtgtaaagaatggttttagaacctactgnagttgg

SEQ ID NO: 98 - DNA, 10322 bp; double-stranded, linear
ttttgcaaagcttattttatgtcaaacagatagtcaatgtgaaacaaaggttagtacatataatcatccagactttatgtatatatcaacaactgagaatgcaattaagaaagaacaagttgaacaacttgtgcgtcatatgaatcaacttcctatagaaagcacaaataaagtgtacatcattgaagactttgaaaagttaactgttcaaggggaaaacagtatcttgaaatttcttgaagaaccaccggacaatacgattgctattttattgtctacaaaacctgagcaaattttagacacaatccattcaaggtgtcagcatgtatatttcaagcctattgataaagaaaagtttataaatagattagttgaacaaaacatgtctaagccagtagctgaaatgattagtacttatactacgcaaatagataatgcaatggctttaaatgaagaatttgatttattagcattaaggaaatcagttatacgttggtgtgaattgttgcttactaataagccaatggcacttataggtattattgatttattgaaacaggctaaaaataaaaaactgcaatctttaactattgcagctgtgaatggtttcttcgaagatatcatacatacaaaggtaaatgtagaggataaacaaatatatagtgatttaaaaaatgatattgatcaatatgcgcaaaagttgtcgtttaatcaattaattttgatgtttgatcaactgacggaagcacataagaaattgamtcaaaatgtaaatccaacgcttgtatttgaacaaatcgtaattaagggtgtgagttagatgccaaatgtaataggtgttcagtttcaaaaagcgggaaaattagaatattatacacctaatgatatacaagtagatatagaagactgggtagttgtcgaatctaaaagaggcatagagataggtattgttaaaaatccattaatggatattgctgaagaggatgttgtgttacctcttaaaaatattattcgcattgctgatgacaaagatattgataaatttaattgtaatgaacgagatgctgaaaatgcattaatactatgtaaagacattgtaagagaacaaggtttggacatgcgtttagtcaattgcgaatatacattagataaatcgaaagttatttttaattttacggcggatgatcgtattgattttagaaaattagtaaaaatattagcgcaacatttaaaaacacgtatcgagttgagacaaattggtgtaagggatgaagccaaattgcttggcggtatcggaccttgtggtaggtcgttatgttgttctacatttttaggggattttgaaccagtatcgattaagatggctaaggatcaaaatttatcattaaatccaactaaaatttctggtgcatgtggtcgtttgatgtgttgtttaaaatatgaaaatgactattatgaggaagtacgtgcacaattacctgatattggtgaagcaattgaaacgcctgatggtaacgggaaagtagttgctttaaatatattagacatttctatgcaggtgaagcttgagggacatgaacagccacttgaatataaattagaagaaatagaaactatgcattaaggaggcattattacatttggatcgcaatgaaatatttgaaaaaataatgcgtttagaaatgaatgtcaatcaactttcaaaggaaacttcagaattaaaggcacttgcagttgaattagtagaagaaaatgtagcgcttcaacttgaaaatgataatttgaaaaaggtgttgggcaatgatgaaccaactactattgatactgcgaattcaaaaccagcaaaagctgtgaaaaagccattaccaagtaaagataatttggctatattgtatggagaaggatttcatatttgtaaaggcgaattatttggaaaacatcgacatggtgaagattgtctgttctgtttagaagttttaagtgattaatcaagcacactcaaatagtgttataattataaatgaatatggtttggataagtctgagacaatgcatgtttcaggctttaattgtgtataaagttttggtgattgcataagagatggcggtactaaatgttattattaagtgtgcacgcagtatcattagttataaaatgtagctgttaaaagtcaaaaatacatcgaatgtagttaggcatataatataaaaagagttttcaattactcaatagaaaaaggttgtcttcataggagttaaaaatgttaaaagagaatgaacgatttgatcaactaatcaaagaagattttagtattattcaaaatgatgatgttttttcattttcaacggatgctttgttgttagggcattttacaaaacctagaacaaaagatattgtgttggacttatgttcaggcaatggggtgatacccttgttattgtttgcgaaacatccacgacatatagaaggtgttgagattcaaaaaacacttgtcgatatggcgcgacgcacatttcaattcaatgatgttgatgaatatttaacaatgcatcacatggatttgaaaaacgttactaaagtatttaaaccttcacaatatactttagtaacgtgtaatccgccttattttaaagagaatcagcaacaccaacatcaaaaagaagcacataagatagcgagacatgagattatgtgtacacttgaagattgcatgattgcagcccgtcatttattaaaagaaggtggcaggctaaacatggtacatcgtgcagagagactaatggatgtcttgtttgaaatgagaaaagtgaatattgaacctaagaaagtcgtttttatatatagtaaagtagggaaatcagcacaaacgatagtagtagaaggtcgaaaaggtggaaatcaaggtttagaaatcatgcccccattttatatttataatgaagatggtaattatagcgaagaaatgaaggaagtatattatggatagtcattttgtatatattgtaaaatgtagtgatggaagtttatatacaggatacgctaaagacgttaatgcacgtgttgaaaaacataaccgaggtcaaggagccaaatatacgaaagtaagacgtccggtgcatttagtttatcaagaaatgtatgagacaaagtctgaagcattgaagcgtgaatatgaaattaaaacttataccagacaaaagaaattgcgattaattaaggagcgatagtatggctgtattatatttagtgggcacaccaattggtaatttagcagatattacttatagagcagttgatgtattgaaacgtgttgatatgattgcttgtgaagacactagagtaactagtaaactgtgtaatcattatgatattccaactccattaaagtcatatcacgaacataacaaggataagcagactgcttttatcattgaacagttagaattaggtcttgacgttgcgctcgtatctgatgctggattgcccttaattagtgatcctggatacgaattagtagtggcagccagagaagctaatattaaagtagagactgtgcctggacctaatgctgggctgacggctttgatggctagtggattaccttcatatgtatatacatttttaggatttttgccacgaaaagagaaagaaaaaagtgctgtattagagcaacgtatgcatgaaaatagcacattaattatatacgaatcaccgcatcgtgtgacagatacattaaaaacaattgcaaagatagatgcaacacgacaagtatcactagggcgtgaattaactaagaagttcgaacaaattgtaactgatgatgtaacacaattacaagcattgattcagcaaggcgatgtaccattgaaaggcgaattcgttatcttaattgaaggtgctaaagcgaacaatgagatatcgtggtttgatgatttatctatcaatgagcatgttgatcattatattcaaacttcacagatgaaaccaaaacaagctattaaaaaagttgctgaagaacgacaacttaaaacgaatgaagtatataatatttatcatcaaataagttaatcactttatcgattatatgaaattttaaacgattttataaacgcaagctgtaattttaaatggtaagttatcattttgcattgatactgataaaatgatgttgactatgataaaaaaatgatgacatcgacgttttttaatgtaaaataaatacattgaaagtaataaataccttaacattgaataagatgaaaatgagatgacgagataaatgttcgcgtccgttgaaatgcatagaaatcttagatattatttgaagtgagacattacgaggaggaacagttatggctaaagaaacattttatataacaaccccaatatactatcctagtgggaatttacatataggacatgcatattctacagtggctggagatgttattgcaagatataagagaatgcaaggatatgatgttcgctatttgactggaacggatgaacacggtcaaaaaattcaagaaaaagctcaaaaagctggtaagacagaaattgaatatttggatgagatgattgctggaattaaacaattgtgggctaagcttgaaatttcaaatgatgattttatcagaacaactgaagaacgtcataaacatgtcgttgagcaagtgtttgaacgtttattaaagcaaggtgatatctatttaggtgaatatgaaggttggtattctgttccggatgaaacatactatacagagtcacaattagtagacccacaatacgaaaacggtaaaattattggtggcaaaagtccagattctggacacgaagttgaactagttaaagaagaaagttatttctttaatattagtaaatatacagaccgtttattagagttctatgaccaaaatccagattttatacaaccaccatcaagaaaaaatgaaatgattaacaacttcattaaaccaggacttgctgatttagctgtttctcgtacatcatttaactggggtgtccatgttccgtctaatccaaaacatgttgtttatgtttggattgatgcgttagttaactatatttcagcattaggctatttatcagatgatgagtcactatttaacaaatactggccagcagatattcatttaatggctaaggaaattgtgcgattccactcaattatttggcctattttattgatggcattagacttaccgttacctaaaaaagtctttgcacatggttggattttgatgaaagatggaaaaatgagtaaatctaaaggtaatgtcgtagaccctaatattttaattgatcgctatggtttagatgctacacgttattatctaatgcgtgaattaccatttggttcagatggcgtatttacacctgaagcatttgttgagcgtacaaatttcgatctagcaaatgacttaggtaacttagtaaaccgtacgatttctatggttaataagtactttgatggcgaattaccagcgtatcaaggtccacttcatgaattagatgaagaaatggaagctatggctttagaaacagtgaaaagctacactgaaagcatggaaagtttgcaattttctgtggcattatctacggtatggaagtttattagtagaacgaataagtatattgacgaaacaacgccttgggtattagctaaggacgatagccaaaaagatatgttaggcaatgtaatggctcacttagttgaaaatattcgttatgcagctgtattattacgtccattcttaacacatgcgccgaaagagatttttgaacaattgaacattaacaatcctcaatttatggaatttagtagtttagagcaatatggtgtgcttaatgagtcaattatggttactgggcaacctaaacctattttcccaagattggatagcgacgganaattgcatatatcaaagaatcaatgcaaccgcctgctactaaagaggaaaaagaagagattcctagcaaacctcaaattgatattaaagactttgataaagttgaaattaaggcagcaacgattattgatgctgaacatgttaagaagtcagataagcttttaaaaattcaagtagacttagattctgaacaaagacaaattgtatcaggaattgccaaattctatacaccagatgatattattggtaaaaaagtagcagttgttactaacctgaaaccagctaaattaatgggacaaaaatctgaaggtatgatattatctgctgaaaaagatggtgtattaaccttagtaagtttaccaagtgcaattccaaatggtgcagtgattaaataactgtatttttaaaaattaggagagataattatgttaatcgatacacatgtccatttaaatgatgagcaatacgatgatgatttgagtgaagtgattacacgtgctagagaagcaggtgttgatcgtatgtttgtagttggttttaacaaatcgacaattgaacgcgcgatgaaattaatcgatgagtatgattttttatatggcattatcggttggcatccagttgacgcaattgattttacagaagaacacttggaatggattgaatctttagctcagcatccaaaagtgattggtattggtgaaatgggattagattatcactgggataaatctcctgcagatgttcaaaaggaagtttttagaaagcaaattgctttagctaagcgtttgaagttaccaattatcattcataaccgtgaagcaactcaagactgtatcgatatcttattggaggagcatgctgaagaggtaggcgggattatgcatagctttagtggttctccagaaattgcagatattgtaactaataagctgaatttttatatttcattaggtggacctgtgacatttaaaaatgctaaacagcctaaagaagttgctaagcatgtgtcaatggagcgtttgctagttgaaaccgatgcaccgtatctttcgccacatccgtatagagggaagcgaaatgaaccggcgagagtaactttagtagctgaacaaattgctgaattaaaaggcttatcttatgaagaagtgtgcgaacaaacaactaaaaatgcagagaaattgtttaatttaaattcataaagttaaaagtgagaaagatcaccgccataaatgtaaacgatgctatattcgtttaatatgctatggttctttctcacttttttaaattaaaatatcgtgcatgtggaatacgtgcgatagagatggttagagctttgaaattaagaattgtaggaaggcgttttaaatgaaaatcaatgagtttatagttgtagaaggacgagatgatactgagcgtgttaaacgagctgttgaatgtgatacgattgaaacgaatggtagtgccatcaacgaacaaactttagaagtaattagaaatgctcaacaaagtcgaggcgttattgtattaacagatccagatttcccaggagataaaattagaagtacaattactgaacatgtcaaaggtgttaaacatgcgtatattgatagagaaaaagctaaaaataaaaaagggaaaattggtgttgaacatgccgacttaattgatattaaagaagcgttaatgcatgttagttcaccctttgatgaagcttatgaatcaattgataaatctgtgctaatagagttggggttaattgttgggaaagatgcaaggcgccgtagagaaattttaagtagaaaattgcgaatcggccattccaatggtaagcagttattgaaaaagttaaatgcatttggttataccgaagcggatgtaaggcaagctttagaagatgaatgaggaagtgaaaatgttggataataaagatattgcaacaccatcaagaacgcgagcgttgttagataaatatggctttaattttaaaaaaagtttaggacagaactttttgatagatgtgaatatcattaataatatcattgatgcaagtgatattgatgcacaaactggggtgattgaaattggtccaggcatggggtcattgacagaacaattggccagacatgctaaaagagtattggcatttgaaattgatcaacgtttaatacctgtattaaatgatacactatcaccttatgataatgtgacggtgattaatgaagatattttaaaagcgaatattaaagaagctgttgaaaatcatttacaagattgtgaaaaaataatggttgttgcaaacctgccgtactatattacgacgccaattttattaaatttgatgcaacaagatataccaattgatggctacgtggtgatgatgcaaaaagaagtgggcgaacgcttaaatgctgaagtaggttcaaaagcatatggttcgttatcaattgtcgtacaatactatacagagactagtaaagtattaacggtacctaaatctgtatttatgccaccacctaatgttgattcaatagttgtaaaactgatgcagagaactgaaccgttagtaacagtagataacgaggaagcattctttaagttagcaaaagcagcatttgcacaaagaagaaagacaattaacaataactatcaaaattattttaaagatggtaaacaacacaaagaagtgattttacaatggttggaacaagcaggtattgatccaagacgtcgcggtgaaacgctatctattcaagattttgctaaattgtatgaagaaaagaaaaaattccctcaattagaaaattaaatgattgacaaagcaaagcactattgttaaaatttaaattttgtttgacgaaaacgttgcaaatatggtattatgtaacttgtagcgaggtggagcaatatgccaaaatcaattttggacatcaaaaattctattgattgtcatgtaggaaatcgtattgtactgaaagccaatggaggccgtaagaaaacaataaaacgttctggaattttaaaagaaacatatccgtcagttttcattgttgagttagatcaagacaaacacaactttgagagagtatcttatacatacactgatgtgttaactgaaaatgttcaagtttcatttgaagaggataatcatcacgaatcaattgcacactaaataagacatatagagatgttagacgtttcttagtataagaagtaaatattatgataattatttgagtgttgggcattatgttcaatactctttttatttacaaaatgtttaacactgatgtttcgcttatagatttttcagtaaatggataattgtatttataaacacaaatacaagtaaatactaagtaattagatggagaaaattacttttttattaaaaaaacactaaaaaacaaattaaaatgtcaaatattaattctctttatgttaaaatcatcatattaagataacgaaaagagggcggaaaatgatatatgaaacggcaccagccaaaattaattttacgctcgatacactttttaaaagaaatgatggctatcatgagattgaaatgataatgacaacagttgatttaaatgatcgtttaacttttcataaaagaaaagatcgaaagatagttgttgagattgaacataattatgtgccttctaatcataaaaatctcgcatatcgtgcagcgcaactatttattgagcaatatcaactaaagcaaggtgtaacaatttctatcgataaagaaatacctgtttctgctggcttagctggaggttcggctgatgcagcagcaacgttaagaggattgaatcgactttttgatataggggcgagtttggaagaattggctctactaggcagtaaaatcgggacagatattccgttttgtatttataataaaactgcactatgtactggaagaggagagaaaatcgagtttttaaataaaccaccttcagcttgggtgattcttgctaaaccaaacttaggcatatcatcaccagatatatttaagttgattaatttagataagcgttacgacgtacatacgaaaatgtgttatgaggccttagaaaatcgagattatcaacaattatgtcaaagtttgtctaatcgattagagccaatttctgtttcaaaacacccacaaatcgataaattaaaaaataatatgttgaaaagtggtgcagatggtgcgttaatgagtggaagcggacctactgtgtatgggctagcacgaaaagaaagccaagcaaaaaatatttataatgcagttaacggttgttgtaatgaagtgtacttagttagactattaggatagaagggttgaaaagatgagatataaacgaagcgagagaattgtttttatgacgcaatatttgatg

SEQ ID NO: 99 - DNA, 5614 bp; double-stranded, linear
gattgattaaatgttttaatccacttcaatgccttcgataaactctacaatcgcgctattcatataattattcgatttcatttgttcagcatatgtctcattaaatccagacataacttttttaaawgcgaaaattgaaattggtatcgttactaataaggcactagccatacgccaatcaatgagcattatgtataaaaagatagcagctgacaaaagtaagtttcctataacttcaggaatcatatgtgctaaaggtaattctattgtttcaaccttatcgacaaatatattttttaattcacctattttcttagattccactacgcctaaagggagacgcattaatttttgagctaattttttacgaatttcagataaaatttcatatgccgtaatatgtgatagcatcgttgacgctccaaaacaacacacttgtgaaatataagcgattaaagcaataaagatataaaccataatcgaattaatcgtatatgtattgttaatcatcattaaaataattttaaatactgcccaataaggaactaatccagaaaagacactgatgatagacaacaaaattgataacataattttccatttactatcagaagcaaatccgctgagtatctttatccaatttgtctgattgttcatcgtatatgtaactcctktcaattaataatctaaattaagccgcttatattatttatttcactggatgatatacataatataaatttgttatttgttaaaaattaatacttattacaagtacatcatatattagttgataacgattatcaatgtcgcgtggatttgtgacacatttcttttaaaaattcacaaggttatggggcagaaatgataaagagccactaatgatttattatgtagtggttctgggagtgggacagaaatgatattttcacaaaatttatttcgtcgtcccaccccaacttgcattgtctctagaaattgggaatccaatttctctttgttgggtccctgaatatagccttgtagagtctagtacattgatttgtatcccaatgtccctataattgattattcgctttatctaatgatcctatgactcaactattaaatcatttttcgaaatacttaattctaatataattaaattcatttattgtaatattgcaaaaatacattgcacaccttgttcatcaatgctataattaattacataataaattgaacatctaaatacaccaaatcccctcactactgccatagtgaggggatttatttaggtgttggttatttgtcaccttttttattgttgcgcgttcgtaaccaatgtgcaaaaaacgcaacaagacagccgcttatagctgaagtcatgatgttaattaataaattgaacatccgtcatacacctcctctctgcgttaaagtaacgcccgagatgttaggcgaccatcatattatatcatttatttattatatttcacgcaatattaaggcttaagtaaagttttttttagtggtttacgctactttaattgctatcttttaaaatccatttagataatataaatgtgatgggtatcgtaataattaaaccagcaaatggtgcaatttctgctggcaaatttagccaggatacaaatacatataataaaactgtttgtaagcttacgttgacaatctgcgtaattggaaaactaatgaattttctccaagtaggttttaccctgtaaacaaaataacaattcaaataatatgaaatcacaaaagcgactagaaatccggtaatatgactaatcatatattcaatgtgtaataattttaacagcaataaatagacaacataataatttaacgtattaatgccgccaacaatgataaattttaaaatttcagcatgcgtttgtgttagtttcatatgtgtactcctcaacatcaaaatatatgcataactacgttctcgaacatactcgaatatgcgagccaatccgcttcacttcaaatatgcttatttcaatctttataccctttcacagcaaatttagtctctttcccctcatccttatacgccattataatgtaactgatttatcgcgtgactcattagcactatagagattactttagttcactagtaattttatatacaataagagcgacaacagtaatgagaggatgtctactatgcaattacaaaaaattgtcatcgctcctgactcatttaaggaaagtatgaccgcacagcaagttggcaatattataaaacaggcttttactaatgtttatgggaatacccttcattatgatatcattccgatggctgatggtggtgaaggtaccacagatgctttaatgcatgcaacaggtgccactaagtatacagtcatcgttaatgaccctttaatgcgacctattgaagcatgttatgcacgcgcagacgaacaacaaattgcaattattgaaatggcggcagcgtcaggtttggatttattagaaaaagaggaacgtaatcctttatacacatcatcatatggtaccggtgaactaattaaagatgcattaaatcatggtgctaagaccattattttagggattggtggcagtgcaacaaatgatggtggtacaggtatgctaagtgcactaggcgtaaagtttactgatgtaaacggggacttattacaaatgaatggtgctaatcttgctcacattgcacaaatcgatataaccaatctagattcgcgattaaaagaggtgacctttaaagtggcctgtgatgtttcaaatcctttattgggtgaaaatggtgctacctatatttatggtcctcaaaaaggcgctgatgcaaagatgataccaaagttggatttcgcaatgtcgcattatcatgataagataaaaatgtgcacaggaaagtccgttaatcaaataccaggttctggtgcagctggcggtatgggcgcagcattattagcgttttgtgagacaactttaacaaaaggtattgatgtcgtctttgacattacagattttcatcaaagaattaaagatgcagacctcgttattactggagaaggacgcatggattatcagaccatctttggtaaaacacccgtaggcgttgcgttagctgcaaaacaatatcatattcctgtcatcgcgatttgtggcagtctaggcgaaaattatcaacatgtttacgatttcggtattgatagtgcctattctataatctcttcacctagcactttagaagatgtcctacaaaatagcgaacaaaatttattaaacactgcaactgacattgctcgtattctgaaattacaataatgtcaaagtaaatcatcagctttattatttgcagttaaaacttgaatgaggtgaaacccatgaaaagaactgataaataccgtgattcatatcaatacgacaatcaaaaccaaaatcatcgtcgtcaatctgaagacgcatcgtatagacaacaatatgctaaaggcgatcctgaagaacacccggaacgatactataatggtagagattatcgaagagaacaaattcttgaagaagaaaacgagaaatcccgccgttcaaaaaaatggttatatatcattattgccattctcttaattattgtcgctatttttgtcacacgcgccttacttaacaatgatagcgataaagttagtaatgaccctaaagtctctcaaaattataaaaaacaagttgaaaatcaagacggccaaattaaccagcaagtagataatgctaaagaaaatattaaaaacaaccaaaaaactgatgacattattaaaaatttacaaaatcaaatcgacaacttgaagcagcaagaacaaaacaaagctgattctaagctaactcaattttatcaagaccaaatcaacaaattgacagaggcaaataatgcacttaaaaacaatgcaagccaaggtaaaattgaaagcatgttaaatgatattaatacaaaattcgacagtattaaatctaaattagaaagcttatttaaagatgacaatggtggcgctaattaattattacacctgctttgatgataaacattaattccctatactttatctgtatcactacgttattcgtgatgatgcattaagagtatagggattttttatataaacttgtattctaactacatacaaatacacacaaaacgtatataatttatataattatatcatttaaaggagtctgatcatgcaatcaacgaaaaccaaaacgaagcatttttcatttttattgctaattacgttaggcgtcatgaccgcttttggcccactaactatagatatgtacgtaccatcattacctaaagtgcaaggtgattttggttctactacatcagaaattcaattaacattatcattcacaatgattggtcttgcactaggccaatttatctttggacctttatccgatgcttttggtcgcaaacggattgctgtatccattttgatcattttcattttggtatcaggtttgtctatgtttgttgatcaattgccattattcttaactttacgatttattcaaggtttaactggtggtggcgtcatcgtgattgcaaaagcctctgctggtgataaatttagtggcaacgcactcgctaaatttttagcatctttaatggtagttaatggcatcatcactattcttgcaccattagccggtggattagctttatccgtagcaacatggcgttctattttcacaattttaactattgtggcactcatcattttaattggcgtcgcttctcaattacctaaaacatctaaagatgaattaaagcaggtgaattttagtagcgtcattaaagattttggaagtcttttgaaaaaaccagcatttattattccaatgctattacaaggwttaacttatgtaatgctatttagttattcatctgcatcgccatttattactcaaaaattgtataatatgacaccccaacaatttagtatcatgtttgctgttaacggtgtaggtttaatcattgtcagtcaagtcgttgctttattagtagaaaaattacatcgccacatattattaatcattttaactattatacaagtggtaggtgttgctttaattatcctgacacttacattccatttaccactttgggtcttactcatcgcattcttcttaaatgtgtgtcctgtgacgtcaattggaccgcttggtttcacaatggctatggaagaacgaacaggtggcagtggtaacgcatcaagtttacttggcttattccaatttatcttaggtggcgctgttgcaccattagttggcttaaaaggcgaatttaatacatcaccatatatgattattatcttcattacagccattctattagtcagtctacaaatcatttactttaaaatgattaaaaagcaacatgtcgcataacacttcaacataattagaaccctagcaaagatatctatctttgtcagggttcttctttatgaattatgagatcgaatcttcaactaaaattacgccttcatagcaaggacatttctattcaatcaccctttaacaggcatccaaatttctgtaatatatttttcacttgtagtatcaccat

SEQ ID NO: 100 - DNA, 9179 bp; double-stranded, linear
catggtaaatttgttgaagcaaataataatgaaattgctaaagcaatgactatttcacataaagacaatgatatgaagtatatggatatcacagaaaaagtgccaatgtcggaatctgaagttaaccaattgctaaaaggtaaggggattttagaaaatcgagggaaagtttttctagaagctcaagaaaaatatgaggttaatgtcatttatcttgttagccatgcattagtagaaacaggtaacggcaaatcagaattagcaaaaggcattaaagatgggaaaaaacgctattacaacttttttggtataggagcattcgatagtagtgctgttcgtagtgggaaaagttatgctgaaaaggaacaatggacatcaccagataaggcgattattggtggtgcaaagttcattcgtaatgaatattttgaaaacaatcaactgaatttatatcaaatgcgatggaatccagaaaatcctgcgcaacatcaatatgcgagtgacattcgctgggcagataaaattgccaaattaatggataaatcctataagcagtttggtataaagaaagatgatattagacaaacatattataaataagacatcggtgcttaaaggagctggaacaatttattgtttcgagctcctttagcgcattctgagtgtgttagttaaatggattttaacctaacaaaaaacgctatatagcatcaaatatgctatatcccacatcattgttacaaatgtacatgatgtaaatgaatattgctgtctaaatgtgcatgtaatatacaatggtgcagataatacacttaagtccttaaaaatgaaacgttagttccaagagtcatttttaaacaatagtgcatgtgataaaatagaaaagaatgaaaaatatagaggtgacaatatgaagatagcaattataggtgcaggcatcggtggattaacagctgctgcattattacaagaacaaggtcatactattaaagtctttgaaaaaaatgagtcagttaaagaaattggcgctgggattggtatcggagataatgtgcttaaaaaactaggtaatcatgacttagctaaaggtattaaaaatgctgggcaaatcttatctacaatgacagtgttagatgacaaagatcgcctgttaactactgttaaattaaaaagtaatacattgaatgtgacgttaccacgccaaacattaattgacattattaaatcttatgtaaaagatgacgcaatatttacaaatcatgaagtcacgcatatagataatgagacagataaagttaccatacatttcgcggaacaagaaagtgaagcatttgatttatgtattggtgctgatggaattcattctaaagtgagacaatctgtaaatgctgacagtaaagtattatatcaagggtatacatgctttagaggtttaattgatgatattgatttaaagcatccggattgtgcaaaagaatactggggaagaaaaggaagagtaggtattgttccgttattaaataatcaagcatattggttcattacaattaactcgaaggaaaacaatcataaatatagttcgtttggtaaacctcatttgcaagcatactttaatcactatccaaatgaagttagagagatcttagacaaacaaagtgaaacaggtatcttattgcataatatttatgatttgaaaccactcaaatcttttgtttatggtcgtactattttactaggagatgcagcacatgcgacaacgcctaatatggggcaaggtgctggacaagcaatggaagatgctatcgtattagtaaattgttttaacgcatacgactttgaaaaagcattacagcgttatgataaaatacgtgtcaaacatactgcaaaagtaattaagcgttctagaaaaatcggtaaaattgcccaatatcgtagtcgtttatttgttgcagttagaaatcgtattatgaaaatgatgccaaatgcattagcagctggacaaactaaattcttatataaatcgaaagaaaaataatacaacaatatgaaaacccccgtatgttgaaacgagagctcaacatatgggggttcttgtttttataatgttattataataaattcaattattagttaacgacaaattgtggtttctcaccttgaacggcactaattgcagcattagcaacaattttagacatcatgtcacgtgcttcaaatgtagcattaccaatatgcggtgttaatactacattattaagtgattttaagtcatcggtaatatctggttcaaattcatatacatcaagtgcagcaccttcaatttcattatctttcaatgcttgcactagtgcttgttcgtgcacgattggaccacgagaggcattgattaaatacgccgtagatttcatcattttaaattgttctgtatcaattaaatgatgcattttaggattataagcagcgttgatagtgataaaatctgcattctttaatagtgtatctaaatctacatattttgcaccgatttctcgttctttttcttctttgcgattaggtccagtgtatagcacatccatgtcaaatgctcttgcacgacgagctactgcactaccaatttcacctaaaccgataatgccgattgttttcccagatacttctctacctctgaaaaataaaggtgcccatccatcaaatccagttgtacgtgataattggtccccttcaacaatacgacgcgctactgcaagtactaatccaattgttaaatcagcagtcgcgtttgttgatgctttaggtgtgtttgtaacatctatacttttttctcgggcatactcgatatcaatattattaaaaccagcgccatagttggcaatgatttttaagtctttaccagcatcgataacatctttatcaacgtttgtagataataaactaattaaggcagtcgcgtttttaacacctttaattaaagtgtctttatcgactaatcctttaccttcatacatttcaacttcaaaatgttcttgtaaaagttttaaacctacttctggtattgcaccagcaacataamctttttccataaaagatcactccttttatcttagtatagtagaagattagacagtatacaactatgtcatgatgtcttgtgtatcaatgatgtaagcgcgtacttttgatggaggcgatataacttaggcactgtagaactatgaatattgtaatgtggaaaaactggatcaattaaattagataacgtagttttaaagttaatagtattagaaaaaattaatattttgaatatgggaggaaatataaataagtaggtggcaacgaaaaatagcaaaaaaagagcttctcctataaaggaaagctcaaagttttttgatgacatatgtactagaattaagtttcaagacaatatgtatcatcgtgtttatattaaatatggatgtagttgtagttacctgcttcacttgcagaaatagttctagaacttactgagaaaggtccgccactataattcatttctgaaattgtaactgaaccatcactgtttacactttctacatatgcaacgtgaccaaatggtccttcagaagattgtaggatagcgcctttagaaggtgtatgatttactgtgaatccagcaccttgtgcagcagcagcccaattattagcatttccccaagtagaaccgatttctccgccaactttatcatatacataccaagtacattgtcctgcagtgtataagttaccagaatgtgaaattgatgatgtagttgtcgtagttgtcgtagtcgttgtagtttgagtcgtgttgtagttatagttgttgtaatttgtataattttcagcagcatctgcatgatgtgcttgacctactaatgctgtgccgattcctgctgttaacgtagttgctgttactaattttttcatgaataaagtcctccaaagttctatatctttttttataaataaaacgtagcgactgttttattctcacatctcgaattgatgacaatagttactttaacaaaattaatgcttcttgtggggaatgttattgatttgtaaaagaataaaaaaactttgactaattttgtaataaaaattagtcaaagttacaatgagattaacagataattaataggaaatatttatttgtaatatgtttaaataaatcgaattgttaaaggtattatatattcttggccattataatatttgacacacgcaataattgtgaatacaaaagataatattgagaaagcgaatatggataaaataccgataaacgtaatgatgaaacctataataataatgaaatcaatatctgtagcaattaggaaaacgcctattaaagtgataacgactaaaacgatagaccaaataatataagaaatcgtatagttaagataattttttccagcacgatcaactagtttcgattcatcttttttcaataaccatattatcagtggaccaataatagatgtgaataaacttaataaatagataagcatcgccataatgttctcatcattggatttgcgattcggttgatgatttgttacgtcgttcatttcagttgtcatattagacactcctttgaaaattgtaatattatctttaactataacaaaatataatcaaaaataaacatgtttattaaacaattattaaaaataaaaataattggtggacgtcggcgtttaaataggttaatttaaggttatatatacttaacatttataatgatgcgtaatgaattcgcatcatttttatattgtcttacgtataatttgtttttaattttaaccaaagatagaaagagggttgtttatgaaaatagcaattgtaggatcaggaaatggcgcagttacggcagcagtagatatggtgagcaaaggccacgatgttaaattatattgtcgtaatcaatctataagtaagtttcaaaacgcaatcgaaaagggcggatttgattttaataatgaaggtgatgaacgtttcgtaaaattcactgatattagtgatgatatggaatatgttttaaaagatgctgaaattgttcaagtgattattccatcttcatacatagagtattatgctgatgtaatggcagagcatgtaactgataatcagttgatattcttcaacatggctgcagcaatggggtcaattcgttttatgaatgttttagaagatagacatattgaaacaaaaccacaactagcggaagctaatacgttgacgtatggtacgcgtgtcgattttgaaaatgcagcagttgatttatctctaaatgtacgtcgtatcttcttttcaacatatgatagaagctgtctaaatgattgttatgacaaagtttcaagtatttatgatcatttagtaaaagaggaaagcttaattaaaacaaatcttgaaaatggtaatcctgaagtgcatccaggaccaacattattgaatgtcggtcgcattgattatgctggcgagttcgctttatataaagaaggaattactaaacatacagttagattacttcatgcaatcgaattagaacgtttgaatttaggccgtagattaggttttgaattatcaacagctaaagaatcacgtattgaacgtggttatttagaacgtgataaagaagatgaaccattaaatcgtttgtttaatacaagcccagtattttcacaaattccaggaccaaatcatgtagaaagcagatatttaactgaagatattgcatatggtttagtactatggtcaagcttaggtcgtgttattgatgtaccgacaccaaatatagatgcagtaattgtaattgcatcaaccattttagagagagacttctttgaggaaggcttaacagttgaagaaattggtttagataagcttgatttagaaaaatatttaaaataaatgatggcttgaagatagaaaaggatatagcattatgcaaaagcaataaattgaagaaaagaggtttctcatcaataagcgnaggggacgatagatgatgaaaagaaaacccacctttttagaatcaatttcgacaatgattgtaatggttattgttgttgtaacaggctttgtgttttttgatattccaattcaagtattattaattattgcctcagcatatgccacatggattgcaaaacgtgtaggcttaacatggcaagatttagaaaaaggcattgcagaacgtttaaatactgcaatgcctgcaattttaattatactagcggtaggaattatagtaggcagttggatgttttctggcacagtgccagccttgatttattatggcttagatttattgaatccaagctattttttaatatcagccttttttataagtgctgttacatctgtagcaactggtacagcatggggctctgcatcaactgcagggattgcacttatttctattggtaatcaattggggattcctccagggatggcagcgggtgctattatagcaggggctgtgtttggcgataaaatgtcaccattatcagatacaactaatttagcggcgcttgttactaaagttaatatatttaaacatatacattcgatgatgtggacgacgatacctgcatcaatcataggtttattagtatggtttattgctggatttcaatttaaagggcattcaaatgataaacagattcaaactttgttatcagagcttgcacagatttatcaaattaacatatgggtctgggttcccttaattgtgatcattgtttgtttgctatttaaaatggctacagtgccagctatgctaatatcaagcttttctgccattatagtggggacttttaatcatcatttcaaaatgacagatggtttcaaagcaacatttagtggttttaacgaatcaatgatacatcagtctcatatttcatccagtgtgaaaagcttgttagaacagggtggtatgatgagtatgacccaaatattagtaacgatattttgcggatatgcatttgcaggtattgtagaaaaagcaggatgtttagaagtcttattaactactatttctaaaggcatccattctgtaggaagtttaatatgtattactgttatttgttgtattgcgcttgtattcgctgcaggtgttgcttcgattgtaattattatggtcggtgtgttaatgaaagatttgttcgaaaaataccaagtctctcgttccgttttatcaagaacacttgaagactcaagtacgatggtcttacctttaataccatggggaacatcaggtatttactatacgaatcaacttcatgtctctgttgaagaatttttcatatggacagtaccatgttatttatgcgcaattatagcaattatctatggttttacagggataggtattaaaaagtcatcgaattcacgtttaacttaatgtgagcgtggaatatatataatatgttgaaacactttaatcatttataattgtagcggttataatttgaaaaggttttaacttagaataaatatcctctatgcatatactgaatatgttttgtagcggaacatgttgatatatgtaatgtaagttttatgtcatgatttgtaatgactaaattaattgagaatttgaaggcaagtatatttgtaagtactttaactaaaaatttatcaatgtatagccgatttgacatgcctaaatttgggtgtgtcaatggctgtatgttgtttattctttattacagagtgaatcggattggtgaaaatcgaaattttgagatttttaccaattcgatttttttcatagaaattaaaaaagccaacaaggctcttgaaaccttgttggcgtaaacatagccatcactaattagtgaatgaagttataaccagcagcttggctagctgagattgtacgtgaagttacaacacctgggccataaccatagttcatttctgaaactcttactgaaccattgctgttaacactttcaacgtatgcaacgtgaccgtatgcaccttgagttgtttgcataattgcaccagcttttggtgtattgttcactgtgtaaccagctcttgcagctgcgttagcccagttacttgcattgccccaagttgaaccgattttaccacctacacgatcaaatacgtagtatgtacattgaccagaagtgtataagttacgtcctgaagtataaccacttgagattgaacggccatttgatgatggagccatagttgtagttacttgaacattgttgcttgaagtgctgtagcttgcacctaaaccaccagtacggtagctgtttgtgttgtaactattatagttattgtagttatatgattgattattatttgagtagttgttgtaacggctgtagttattgtagctataaccgttgttgtaattgttatagttattgtaaccattgtagtagtaatagctgtagtagccattatcttggtttaattgacttggatgccagttacctttccatgtgtaatggtagttaccttgtgcatcaatagtgtaagtatagctatatgatgttgggtcgtttggattataaccgtagttatcttgctcagaagcatgagcttgatttcctgatgcaattgcgattgtagcgaatcctgcagttgcgatagtagctgtagcgattttcttcattttaaaaatatcctcctaaaaattttaaatctaaaatattttcgtaatgtccgtgtgacaaaattaatgttataagttatctctcgtaattaaacgacaagaaagactataacagaaattagcgtccttgtgtgctttgttaacgttttgtaattttttgctaatatcttgacacaatagaattttaaaagtatagaaatttgcattttgcaaaacttataactacggcattctttgtgaaaactgaatgtttcgaaaataagtctgttacaaatttgtaatattactgaaaattctaaatgtatattttgtgcataatataggacttttaatcagaaaatgcataaaaattcgacacgaacgatcaagtttctatgattatgaaagctttggtatttggatgaaaatgtatatttaatggataaaatatcctaatttagcataaaaaaatgttttaataaaagtattatttgatataatcgatttatgttttgttactgctaaaaaacatgtggcg

SEQ ID NO: 101 - DNA, 1868 bp; double-stranded, linear
ccttcagccatttgacttcgacatgagttgcctgtacatataaaataaattgtttttttagtcataacaatctcctaattaattaaaatatgataagtgttagatacaaccctatgagggttataaatagtactggaattgtaatgatgataccagttttaaagtatgtgccccaagaaatcttaacatctttttgtgttaagacgtgtaaccacagtaatgtagctaaagagcctatcggtgtaatttttggacctaaatcagaaccgataacattcgcataaattaggccttcttttaacatgccatggacatttgattgaccaatagcaatcgcatctattaaaactgtaggcatattattcattattgatgataaaaacgctgaaatgaagcccattcccaaaatagtgctaaatagaccgtaattggaaatatattctaatattttagccaatattaaagtaatgccagcatttcttaagccgaatacgacgatatacataccaattgaaaataatactatattccaaggtgcgcccttaatgacttgcttaatatttacagcatttgatttacgagccaacattagaaaaataaaagcaatgattccagtgaaaattgataccggaattttagtaaatttactgattagatagccgaaaagtaatataactagaacaatccatgaaattttaaatagctttaaatcattaatggcatctttaggatgctttatattattatcatcaaacgttttaggtatcgcttttctaaaatataaccacaatactataatacttgctaaaagcgagaataaattaggtataatcattctactaaaatatcgaacgaatcctacatgaaaataatcagcagatataatattcactagattgctcacgattaaaggtaaagaagttgtgtcagctataaaaccactcgcaataatnaaagggaatatggcccgcttactaaaacctatatttttaaccatcgctaatacaataggcgttaagattaacgtgcgccatcatttgcgaaaaatgcagcaacaatggcacccaataatatgatataaacgaacatttttaaaccattgccttttgaagcatgaagcatgtgaatagctgaccattcgaataatccaactttatctaatattaatgaaataagaatgactgagacaaaagtcaaagtagcattccaaacaatacctgttacttcgaaaacatcggaaaaacttacaacaccagtaataacagcaataaaggcaccagttagtgcggtaatgccaatatctaggcctttaggttgccataatacaaataataaagttactagaaaaatgagtgtcgctaaagttgtcatcattagcattcaccagtcttaaggttatgacaaatacatcgttggttagaggtatgaaccttagacaagttattaattacggactcaaaaatattatgattgagctggtataaatgtttatttccgatttttcgtgtcgtaactaagttggtttttactaatgctttcatatgrtagctaagtgtaggttgagagaattgaaaatgtgctaacaaatcacaagcgcataactctccacaagaaagtaaatctagtatttctaatctgcttgaatctgataaaacttttaaaaatgttgctagttctttatacgtcataacatacctcctagacgttaaatagattatcatctatatagatgaatgtctatgttcctttggtatattacacgatatgactatgtaatttaaatttggttttagtattaaaagggtattaaagataaattatagatattgattttgcaaaatatactctttgttctgcattgaaaaagg

SEQ ID NO: 102 - DNA, 15249 bp; double-stranded, linear
atttatgaaatccatagcnataaacattattcttgcatcggctatacaaacagttaccgcaagcaaatttgtatatcaacctggaattgtgttcacgtcaatggcaaatgccgatgatgtgttatcaggcgatagttattttatggctgaattaaaatctattaagcgtattgttgaaattccagataatcaaaaaatatactgctttatagatgaaatttttaaaggtaccaacacaactgaacgaattgccgcttcagaatcagtactatcatttttacatgaaaaatctaactttagagttattgcagcaacacatgatattgagttagctgaactcttaaaacaacgttatgaaaattaccatttcaatgaggtaatagaaaataataacatacattttgattacaaaattaagcctggcaaagcaaatacacgtaatgccatcgaattattaaaaatcacttcatttccagcaaaaatatatgaacgagcaaaagataatgtcccgaaaatttagcatttaactttaaacataaaaacgtcagctatcacatgacagaagactatgaacagtttcaataatgttcatagtaatcatgttaataactgacgtttattttattctgcagaatactcttctaaatctatattgctgtgcccatttaatgctaaatcagcaaatcgaccttgctgatacaaatagtggccggcaacgcctatcattgcagcattatctgtgcataatttaggacttgggatagttaattgaatgtcattgactttgcattgatccgctaaagattgacgtaatcctttattactcgccacgccaccagcaacaattaatcgctgaacaccatattctttacaagcttgaatagctttaaacgtgagcacctctacaacactgttttgaaagctcgttgctacgttagcttcaatgattggaatatttttttgtcgttgattgtgaagttgattgattacggcacttttcaacccactaaaactaaaatcataactatctttatccaaccaaacacgagggaatgaataagtatcttcaccttcagcagccaaccgatcaacttgtggaccacctggataatttaaaccaattgttcgtgccactttatcataagcctcacctactgcgtcatctcgtgtttcaccaatgacttcaaatgataaatgatccttcatataaactaattcagtatgtccacctgaaacaataagtgcaattagcgggaatgttaatggctcttctatgtgattagcatatatatgtcctgcaatatgatgaacaggaataagtggctnatcgtaagcaaatgccaatgctttggctgcattaacacctattagtaacgcaccaattagtccagggccttctgtaaccgctatggcatcaatatcttctattgatacatcggcatcccctagagcctcgtttattgttgctgttataccttcaacgtgatgtctacttgccacttcgggaacgacaccgccaaatcgtttatgactttcaatctgacttaaaactgtatttgataaaatatctctgccattttttataacactaacgcttgtttcatcacaacttgtttcaacagctagtattaatatatctttagtcatttaaattcacccacataaccattgcgtcctcaccttcaccataataatttttacgtttaccaccatattgaaatcctaaattttcatatacatgttgtgccactttattattaactcttacttctaaactcatcacatcacaagtgtgacttgcatagtttattccgtattttaaaagcatttgacctaaaccatagcctctataattatcatcgattgcaactgttgtaatttgagcttgatcgataacaatccataaacctaaataaccaataatttgttgttcaaattctaagacaaaatatttcgcaaagttattttgctctatttcatgataaaatgcgtcaattgtccaagaactgtcattgaaactccgacgctcaagatcaaagacttgtggcacatcttctttagtcatctctctaatgtttaattgttcttttgactgttgatccaatttcgttccgcctcagctaatttatggtatttaggagtaaatgtatgtacgtctgaaggtttatctagcaattgatacatgactgatgcatttggtagctgcgcaatcacttcaccttgtaattcatcttgtaattttacagtatctttcccaatataaataaatggttggtttaaatcttctaaaaaagctcgcaatgcctctatcgacatatattgatcttctaaaatagtcactaattgaccattttgccactggaatatgcctgtataaactgcttgtcgtcttgcatcaaacacaggaaccaataatttatcagtatgatcgattgttgctgccaatgcctttaatgatgaaacaccatataatttaacatctaacgcatacgctaatgttttagcaacagtaacaccgatacgtaagccagtatatgaaccaggaccttcagcaacaataatcgcatctaattgctgtttagctattttgctctgctcaaatagctgactaatcgcaggcattaattgcactgaatgattttgtttagaatccgtagttatttcagctaaaacttcatcgttttgcatcaatgctactgataatggttgattcgatgtatcaatgagcagcgaattcatggataattgcctccttaatttgttcataatgttctccttgcgcgaacaactcaatttgtcttgtattttcagatattgttgaaatgttaatagataaatgcgtcgctggaagtaaatcttttataaattgactccattcaataacagtaattgcctgatcttcgaaaaattcatcaaatcctaaatcttcatcagaatcttctaagcgataacaatccatatgatgcaattttaaatttttacccctatatgatttaatgatgttaaatgtcggggaattaatcgtacgtcttacaccaagagcttttcctataaattgcgttaacgttgttttacctgctcctaaatctccgttaagtaaaatcaaatcaccacttttcaattgctcaactaaaaatatagcaaattgattcatttcatctaaattatttatctttatcaatgttgattctcctatattatgcttttcattcataaaaatgattatccattgttcaatcgtatctaactttatatttaacctttatattgtaacaaatttcaacttaaatttcttatctttgaaacagattatctattcaaagttaattgtaagaaaatttaaaatatttgttgacatactaaagcagatatagtaaattaaatttatcaaatttttagacaattctaactattaaagtgatatataccattcacggaaggagtataataaaatgcttaatcaatatactgaacatcaaccgacaacttcaaatattattattttattatactctttaggactcgaacgttagtaaatatttactaaacgctttaagtcctatttctgtttgaatgggacttgtaaacgtcccaataatattgggacgtttttttatgttttatctttcaattacttatttttattactataaaacatgattaatcattaaaatttacgggggaatttactatgcgaacgagcatgatcaaaaaaggagatcaccaagcaccagcaagaagtcttttacatgccacgggcgcgctaaaaagtccaactgatatgaacaaaccatttgtagctatttgtaactcttatattgatattgttcctggacatgttcacttgagagagcttgcagatatagctaaagaagcaattagagaagccggtgccattccatttgaattcaatacaattggtgttgatgatggaatagctatgggacatatcggaatgcgatattctctaccatcacgtgaaattattgcagatgcagctgaaactgtaattaacgctcattggtttgacggcgtattttacattcctaattgtgacaagattacacccggtatgattttagcagccatgaggacaaacgtaccagctatcttttgctctggtggaccaatgaaagctggcttatctgcacatggaaaagcattaacactttcatcaatgtttgaagcagtcggcgcatttaaagaaggatcgatttctaaagaagaatttttagatatggaacaaaatgcctgccctacttgtggttcatgtgctgggatgtttactgcaaattcaatgaactgtttgatggaagttttaggtctagcattaccatacaacggtactgcacttgcagtcagtgatcagcgacgagaaatgattcgccaagcagcttttaaattagttgaaaatattaaaaatgatttaaaaccacgtgatatcgttactcgcgaagcaattgatgatgcatttgcacttgatatggctatgggtggttcaacaaacacggtactgcatacgttagccattgccaatgaagctggtattgattatgacttagagcgcattaatgctattgccaaacgcacgccatatttatcaaaaatagcacctagttcatcgtattcaatgcatgatgtgcatgaagctggtggcgtcccagcaattattaatgaattgatgaagaaagatggcacgttacacccagatagaatcacagttactggcaaaacgttacgtgaaaataacgaaggcaaagaaattaagaactttgatgtcattcaccctcttgatgcaccatatgatgcacaaggcggtttatctatcttatttggtaatatcgcccctaaaggcgcagttattaaagttggcggcgttgatccatctatcaaaacatttactgggaaagcaatttgtttcaattcgcatgatgaagctgttgaagcaatagacaatcgtaccgttcgtgcaggccacgtcgttgtcattagatatgaaggacctaaaggtggaccaggtatgcctgaaatgttagcacctacttcctctattgttggtcgcggcttaggtaaagatgttgcattaattactgatgggcgtttttccggtgccacaagaggtattgcagttggtcatatttcccctgaagctgcatctggtggaccaattgccttaattgaagatggtgatgagattactattgatttaacaaatcgtacattaaacgtaaaccagcctgaagatgttctagcgcgtcgccgagaatctttaacaccatttaaagcgaaagtaaaaacaggttatctagctcgttatactgccctagtaactagcgcaaatacaggtggcgtcatgcaagtccctgagaatttaatttaatttatttttatattggagatggttaaaatgtctaaaactcaacatgaagtaaaccaaaatattgaccctttaaaaatggctgaatcacttgaacctgaacaactaaatgaaaaaactttaaatgatatgcgttcaggatcagaagtgctagtagaagctctacttaaagaaaatgtggattatttattcggttatcctggtggtgccgtactacctttatatgacacgttttatgatggtaaaatcaaacatattttagcaagacacgaacaaggtgctgttcatgctgcagaaggttatgcacgtgtatctggtaaamtggcgtcgttgtagttacaagcggtccaggtgcaactaatgtaatgacaggtattacggatgcacattgcgactctttacctctagttgtattcactggacaagttgctacaccaggcattggtaaagatgcattccaagaagcggatattctatctatgacttcaccaattacaaaacaaaattatcaagtgaaacgtgttgaagatatccctaaaatcgtacacgaagctttccatgtagctaattctggacgcaaaggtcctgtagtgattgattttccaaaagatatgggtgttttagctacaaatgtggatttatgcgacgaaatcaatattccaggttatgaagttgttacagaaccagaaaataaagacattgacactttcatctcacttttaaaagaagcgaaaaagcctgtcgtattagccggcgcaggtattaatcaatcaaaatcaaatcaattattaacacagtttgttaataaacatcaaatcccaacagttactactttactaggtctaggtgctgtaccttatgaggatacactatttttaggtatgggaggaatgcatggttcttatgctagtaacatggcattaactgagtgtgatttactcattaatttaggtagccgcttcgatgatagattagcaagcaaacctgatgcctttgcacctaacgccaaaattgtacatgtagatattgatccttcagaaatcaataaagttattcatgtagatttaggtattattgcagactgtaaaagatttttagaatgtttaaatgataaaaatgttgagactatagaacacagtgactgggttaaacattgtcaaaataataagcagaaacacccatttaaacttggtgaagaagatcaagtattttgtaagccacaacaaacaatcgaatatatcggcaaaattacaaatggtgaagcaattgttactacagacgtgggacaacatcaaatgtgggcagctcaattttatccatttaaaaatcacggacaatgggttacaagcggtggtttaggaacaatgggattcggtattccttcgtcaattggtgccaaattagctaatcctgataaaacagtcgtatgtttcgtcggtgacggtggtttccaaatgacaaaccaagaaatggcacttttacccgaatatggtttagatgtcaaaatcgtactaatcaataatggaacattaggtatggttaaacaatggcaagataagttctttaatcaacgcttctcacactcagtatttaatggtcaacctgattttatgaaaatggcagaagcatatggcgtcaaaggtttcttaatcgataagccagaacaactggaagaacaattagatgcagcgtttgcttatcaaggaccagctttaattgaggttcgtatttcccctactgaagctgtaaccccaatggttccgagtggcaaatcaaatcatgaaatggagggcttataatgacaagaattcttaaattacaagttgcggatcaagtcagcacgctaaatcgaattacaagtgcttttgttcgcctacaatataatatcgatacattacatgttacacattctgaacaacctgggatttctaacatggaaattcaagtcgatattcaagatgatacatcacttcatatattaattaaaaaattaaaacaacaaattaatgttttaacggttgaatgctacgaccttgttgataacgaagcttaattttaagacaaaggcaatgatgcgctaattagttatagatatatcataggctgctagttaacatctgccactattacaaagttatatttcagaattttcgaaacacaaaatatttaattatttggaggaatttattatgacaacagtttattatgatcaagatgtaaaaacggacgctttacaaggcaaaaaaattgcagtagtaggttatggatcacaaggtcacgcgcatgcacaaaacttaaaagacaatggatatgatgtagtcatcggcattcgcccaggtcgttcttttgacaaagctaaagaagatggatttgatgtgttccctgttgcagaagcagttaagcaagctgatgtaattatggtgctattacctgatgaaattcaaggtgatgtatacaaaaacgaaattgaaccaaatttagaaaaacataatgcgcttgcatttgctcatggctttaacattcattttggtgttattcaaccaccagctgatgttgatgtatttttagtagctcctaaaggaccgggtcatttagttagacgtacatttgttgaaggttctgctgtaccatcactatttggtattcaacaaggcgcttcaggtcaagcacgtaatattgctttaagttatgcaaaaggtattggtgcaactcgtgcaggtgttattgaaacaacatttaaagaagaaactgagacagatttatttggtgaacaagcagtactttgcggtggtgtatcgaaattaattcaaagtggctttgaaacattagtagaagcgggttatcaaccagaattagcttattttgaagtattacatgaaatgaaattaatcgttgatttgatgtatgaaggcggtatggaaaatgtacgttactcaatttcaaatactgctgaatttggtgactatgtttcaggaccacgtgttatcacaccagatgttaaagaaaatatgaaagctgtattaactgatatccaaaatggtaacttcagtaatcgctttatcgaagacaataaaaatggattcaaagaattttataaattacgcgaagaacaacatggtcatcaaattgaaaaagttggtcgtgaattacgcgaaatgatgccttttattaaatctaaaagcattgaaaaataagatagacctacaatgaggagttgttaaatatgagtagtcatattcaaatttttgatacgacactaagagacggtgaacaaacaccaggagtgaattttacttttgatgaacgcttgcgtattgcattgcaattagaaaaatggggtgtagatgttattgaagctggatttcctgcttcaagtacaggtagctttaaatctgttcaagcaattgcacaaacattaacaacaacggctgtatgtggtttagctagatgtaaaaaatctgacatcgatgctgtatatgaagcaacaaaagatgcagcgaagccggtcgtgcatgtttttatagcaacatcacctattcatcttgaacataaacttaaaatgtctcaagaagacgttttagcatctattaaagaacatgtcacatacgcgaaacaattatttgacgttgttcaattttcacctgaagatgcaacgcgtactgaattaccattcttagtgaaatgtgtacaaactgccgttgacgctggagctacagttattaatattcctgatacagtcggctacagttaccatgatgaatatgcacatattttcaaaaccttaacagaatctgtaacatcttcaaatgaaattatttatagtgctcattgccatgacgatttaggaatggctgtttcaaatagtttagctgcaattgaaggcggtgcgagacgaattgaaggcactgtaaatggtattggtgaacgagcaggtaatgcagcacttgaagaagtcgcgcttgcactatacgttcgaaatgatcattatggtgctcaaactgctcttaatctcgaagaaactaaaaaaacatcggatttaatttcaagatatgcaggtattcgagtgcctagaaataaagcaattgttggccaaaatgcatttagtcatgaatcaggtattcaccaagatggcgtattaaaacatcgtgaaacatatgaaattatgacacctcaacttgttggtgtaagcacgactgaacttccattaggaaaattatctggtaaacacgccttctcagagaagttaaaagcattaggttatgacattgataaagaagcgcaaatagatttatttaaacaattcaaggccattgcggacaaaaagaaatctgtttcagatagagatattcatgcgattattcaaggttctgagcatgagcatcaagcactttataaattggaaacactgcaactacaatatgtctctagcggccttcaaagtgctgttgttgttgttaaagataaagagggtcatatttaccaggattcaagtattggtactggttcaatcgtagcaatttacaatgcagttgatcgtattttccagaaagaaacagaattaattgattatcgtattaattctgtcactgaaggtactgatgcccaagcagaagtacatgtaaatttattgattgaaggtaagactgtcaatggctttggtattgatcatgatattttacaagcctcttgtaaagcatacgtagaagcacatgctaaatttgcagctgaaaatgttgagaaggtaggtaattaattatgacttataacattgttgccctacctggtgatggaatcggtccagaaattttgaacggatctctatcattgcttgaaattataagtaataaatataactttaattatcaaatagagcaccacgaatttggtggtgcctctattgatacattcggcgagcctttaactgagaaaaccttaaatgcgtgtaaaagagcagatgctattttactgggtgcaatcggtggacctaaatggacagatcctaacaatcgaccagaacaaggattattaaaattgcgtaaatccttaaatttatttgtaaatatacgccccactaccgttgtcaaaggcgctagttctttatcacctttaaaggaagaacgcgttgaaggcacagatttagttatagtccgtgaattgacaagtggtatttattttggagaacctagacattttaataatcacgaggccttagattctcttacttatacaagagaagaaatagaacgcattgttcacgtagcatttaaattggccgcttcaagacgaggaaaactaacatcagttgataaagaaaatgtattagcttctagtaaattgtggcgcaaagtcgtaaatgaagtaagtcaattatatccagaagtaacagtaaatcacttatttgttgatgcttgtagtatgcatttaatcacaaatccaaaacaatttgacgtcatcgtatgtgaaaacttatttggcgatattttaagtgatgaagcttcagtgattcctggttcacttggtttatcaccttctgctagttttagtaacgatggtccaagattgtatgagcctattcatggatcagcaccagatattgcaggtaaaaacgttgccaatccatttggaatgattctatctttagcgatgtgtttacgtgaaagcttaaatcaaccagatgctgcagatgaattagaacaacatatttatagcatgattgaacatgggcaaacgacagcagatttaggcggcaaattgaatactactgatattttcgaaattctatctcaaaaattgaatcactaagggggagatgtaaatgggtcaaacattatttgacaaggtgtggaacagacatgtgttatacgggaaattgggcgaaccgcaactattatacattgatttacaccttatacatgaagttacttctcctcaagcatttgaaggacttaggcttcaaaacagaaaattaagacgcccagatttaacatttgcaacactcgatcacaatgttcctactattgatatattcaatattaaagatgaaattgcaaacaaacaaatcacaacattacaaaaaaacgccatagattttggggtgcatatttttgatatgggttctgatgaacaaggtattgttcacatggtaggacctgagacaggacttacacagcctggcaagacaatcgtttgtggtgactctcacacagcaacacatggagcatttggtgctattgcatttggaattggaacaagtgaagttgaacatgttttcgcaactcaaacgctatggcaaacaaaacccaaaaacttaaaaatcgatattaatggtaccttaccaacaggcgtctatgctaaggacattattctgcatttaattaaaacgtatggtgttgactttggtacaggctatgctttggaatttactggcgaaacaattaaaaacctttcaatggatggtcgaatgactatttgtaacatggctatcgaaggtggtgccaaatacggcataatccaacctgatgatataacatttgaatatgttaaagggagaccatttgccgataacttcgctaaatcagttgataagtggcgtgagctatattctgatgacgacgcgatatttgatcgtgtaattgaacttgatgtttcaacattagaaccacaagtgacatggggaactaatcctgaaatgggtgttaatttcagtgaaccattccctgaaatcaatgatatcaacgatcaacgtgcgtatgattatatggggttagaaccaggtcaaaaagctgaagacatcgacttagggtatgtttttctcggttcatgtacaaatgctagactatcagatttgattgaagctagtcatattgttaaaggaaataaagttcatccaaatattacagctattgtcgtaccaggttctcgtacagtaaaaaaagaagcagaaaaattaggtctagatactatctttaaaaatgcaggatttgaatggcgtgaaccaggatgttcaatgtgtttaggcatgaatcctgaccaagtacctgagggcgtacattgtgcatctacaagtaatcgaaactttgaaggacgacaaggcaaaggtgcaagaacacatttagtatcccctgctatggcagcagcagcagctattcatggtaaatttgtggacgtaagaaaggtggttgtttaaatggcagcaatcaaacctattacaacatataaaggtaaaatagtccctctcttcaacgacaatatcgatacagaccaaatcattcctaaggtacacttaaagcgtatttcaaaaagtggctttggtccatttgcttttgatgaatggcggtacttacctgatggttcagataatcctgatttcaatcctaacaaaccacaatataaaggggcttctattttaattactggagataattttggatgtggttcaagtcgtgaacatgctgcttgggctcttaaggactatggttttcatattattattgcaggaagtttcagtgacatattttatatgaattgcactaaaaatgcgatgttgcctatcgttttagaaaaaagtgcccgtgaacatcttgcacaatatgttgaaattgaggtcgatttaccaaatcaaactgtgtcatcaccagacaagcgtttccattttgaaattgatgaaacttggaagaataaacttgtaaatggcttagatgacattgcaatcaccctacaatatgaatcattaatagaaaaatatgaaaaatcactttaagggagttgaatattatgacagtcaaaacaacagtttctacgaaagatatcgatgaggcatttttaagacttaaagatattgtcaaagaaacacctttacaattagaccattacttatctcaaaagtatgattgtaaagtctatttaaaacgagaagatttacaatgggtacgttcttttaaattaagaggtgcttacaacgctatttctgttttatcagatgaagctaaaagtaaaggtattacatgtgcaagtgcaggtaatcatgctcaaggtgttgcctatacagctaaaaaacttaatttaaacgctgttatctttatgccagtcactacacctttacaaaaggtaaatcaagtaaagttctttggaaatagtaacgttgaagttgtactcactggtgatacatttgatcactgtttagctgaagctttaacttatacaagtgaacatcaaatgaactttatagatccattcaataatgttcatacaatttctggacaaggtacgcttgctaaagaaatgctagaacaagcaaagtctgacaatgttaactttgattatctatttgccgcaattggtggtggcggtttaatttcaggtattagtacttactttaaaacctattcacctaccacgaaaattataggtgttgaaccttcaggtgcaagtagtatgtatgaatctgttgtggtaaataatcaggtagtcacattgcctaatatcgataaatttgtggacggtgcatctgtagctagagttggcgatattacatttgaaattgcaaaagaaaatgtagatgattacgttcaagtagatgaaggtgcagtttgttctacgattttagatatgtattcaaaacaagcaattgtagcagaacctgctggcgcattaagtgtaagtgcgcttgaaaactataaagatcatattaaaggtaaaacagtggtttgtgtcattagtggtggtaataatgatattaatcgaatgaaagaaattgaagaacgttcattactatacgaagaaatgaagcattactttatcttaaatttccctcaacgtccaggtgcattgagagaatttgtaaatgacgtattaggacctcaagacgatattactaaatttgaatacttaaaaaaatcttctcaaaatacaggtactgtcattattggtattcaacttaaagatcatgatgatttaatacaactcaaacaacgtgtaaatcatttcgatccttccaatatttatattaatgaaaataagatgttatattcattgttaatttaacacatagtaagaaaaacagtcataaattgatttctaattgaaatcatcttatgactgctttttattatactttacatttctcgtttcgtcagattcaaacgttttcacttcgccaagccatctttctttgtgtttgcttttattttgacgttttagacataaaaaaagagaccttgcggtctcaatgcggctcatcgcatccactttttgcctggcaacgttctactctagcggaacgtaagttcgactaccatcgacgctaaggagcttaacttctgtgttcggcatgggaacaggtgtgacctccttgctatagtcaccagacatatgaatgtaatttatacattcaaaactagatagtaagtaaaagtgattttgcttcgcaaaacatttattttgattaagtcttcgatcgattagtattcgtcagctccacatgtcaccatgcttccacctcgaacctattaacctcatcatctttgagggatcttataaccgaagttgggaaatctcatcttgaggggggcttcatgcttagatgctttcagcacttatcccgtccacacatagctacccagctatgccgttggcacgacaactggtacaccagaggtatgtccatcccggtcctctcgtactaaggacagctcctctcaaatttcctacgcccacgacggatagggaccgaactgtctcacgacgttctgaacccagctcgcgtaccgctttaatgggcgaacagcccaacccttgggaccgactacagccccaggatgcggatgagccctacatcgagggtgccaaaacctccccgttcggatgtggaactt

SEQ ID NO: 103 - DNA, 14051 bp; double-stranded, linear
gtggcaatatttctagttctcgttttgataagattttaaaaggatctgttgtgtttgcagtgtcctgatttgaattagatacaaattcattcactaaagatgttgtaagtttcatatctacatatgtttcacctttatatacagttcgaatagctaacaataattgttcatcaggtgcatttttcaatatgtaacctttcgcaccattacgcaacacatggaacaaatactcctcatcatcaaacattgttaatattagtattttagtttcaggaaaactgtcagcaattttactcgtagcgataagacctgactcacctggtggcatacttaaatccattagtaacacatcaggtttatattccattactttttggtaagcttcgacgccatctgcagccgttgcaacaacttccatatcattttgataatttaaaatcatagagaaccccgtacggacaacagcgtgatcatcggcaatgactattttcaattttattcccccaatgtatgtttcaaattggaatgttcaatgtaacattggtaccctcaccaattttcgtttcaatattgacgctaccgctgactaactcagctcgctcattcattccatataaaccgagtccagaacctttaggcttagaacttggatcaaaaccatttcccgcatctatcacttctgctaccaaatggcgcccagtttgacggatacctacatttatttcatttacatcagcgtatttcaacgcatttaaaatagcttcttgcactactcgataaacaaccgtttcaatatcactatcaaagcgagtatttttaatatttgatgtatatatgatttttattccataattttcttcaaactgtttaaaatatgatttaaaagctgcttcaaggcctagatcatccaaagaagcgggtcttaattcaaccgacatattacgtatatcatcaattaatttagcgacaatatattcaatattttctgcgtcttccaaaagcttagttgtatcttcttgatattttaataatctcaattgaacatctacattgagcatttcttgaatcacactatcatgtaactctctagaaattcgctttctttcattttcttgggctgagattgttttacgcatcatacgttgttgatgcaatttctcttgctgttcaatttgtgatgaaacattttgaagcgtaaatgcatgaattcccctgtcttgatcaatcaactgatatgttgctgtaaatggcatcactttttgatctttcgtcttcataaatacttggaaattcgtagcttgtacttgcatcgattctaagaaacagtctttacatgattgtacatcataggcatttgtatacccttcacatctgtgacaaatcgcattcgccacagcactgtaattatcttcttcagataatatatctttagcagcatcattcattgcaataattttaccgttatcatcagcaaaaactatcttttcgattgaatgctcataatattttttcaataaagtatctaactgtatactgtcctcattaatcatgacttacaccctaattcatctcattatttatcatcattgaaaataccaaacttacgttgaatatcatcattatcaaatatttttggtaaaggacgaccatctctttgaccaaataatagtacgccatacacttgattcttataccaaagcggcactgctaaaactgctgttaatgattcgctcaataaaattggatagtcaatcttttcttcaggccctaaagctaaaccaacattggctattaccatacgctttcctgttttcataacagttccagctaatccacgaccttttcttaaaataatcaatttaaatcgattatttttattacctgaaacatagtgccattttattggagatgatggtttgttagattcatagaaagcgattgccgcaaaatcataaccctcttctttgcgtattttatctaatgtctcttgaaatctacgatcttcaattattgcttctggtgtcaaatcctttcacctcttatgcttacactttattcttacggtaaataatatatctgcgatttatatatgtcaaaggtacactccaaacatgcaccaaacgtgtaaatggccaacaagccataatagtgaaacctaacaatatatgcattttaaatgcaatcggcacaccactcatcaatgacgcatctggttttaacataaataattgtctaaaccaaattgataatgaagttctgtagttaaagtctggatgttgtatatttgttactaatgttgcgtaacatcccataaatacgataagtaataataagaaatttacaaatatatccgacgctgaacttaatcttcgaatacttttcgtagtaacacgtctcgctgttaataaaaacatccctatcaaagttattataccaaagatgctaccaatataaacagcgcctatatgatataaatgctcagacacacccactgcatccatccatggtttcggtattaacaatccaactacgtgtccaaaaaacactggaataatacctaagtgaaataataaacttccccacatcaacctttttctttctattaattcactagatttagctgtccaagaaaatttatcataacgataacgtgcaatatgacctgcgacaaagacaactaaacataaatacggaaatataacccataaaaactgattaagcatgatgtttcactccttttggtgatgtcaaacataatttcaatgtttttctaagtgcttgaatcacataggcatatggattgttatcttcaccaagtgcattcgccatcacatatgttccatcctcaataatcataatgattaattgaatattctcttcagctcttggatcatttcgccattctgccacttgcaaaaattgaagcatcaacggtagataatcagaaagttcattatctaccatttctagtccaaacatttcatataatacctttaatttagctaacatttgcccacgttctttttgcgtatcaaatttgttatacgtcatatataatggtgcttttttcgtaaaatcaaatgtatctgtataaatcgctttgatttctgataatgaaaatgtcatcattacatttctaaatgctactaaatcttcatatgctggatgatctttcgaaattgtttcttcaaaagtttttggatgaaaagttaatttttctggaaaacataactgttgtgccatatatccaaaactttcttgatattttttaaaattatcgaaattaatcacggaaaatccctccatagaaattctcattataaatttcttgaccagttttccctgaacctactgcaacgccacagccttcacagttatctccaaaatgctcgccgccgtaattgtatcctgtactaccttgtgcgtgatacgtatctaaataggtttctttgtgtgatgttggaataacaaatcgatcttcatatttggctagtcctaataaacgatacatgtctttagtttggcgctcggttatacctaatcgctctaatcgagacgtgtcaaatggctgttgagtaacttgagatctcatataacttctcatcattgccatacgttgtagggctccttttactggctctgtatctcctgcagtgaaaatattagctaagtattcaataggtaaacgcatttcttcaatggctgggaaaatcgcatctggattttgagttgtatttttaccttcaaaatagctcataattgggctaagtggtgggcaataccaaaccatcggcatcgttctaaattcaggatgtaacggaaatgcaagtttatattcaattgctaacttataaattggagagttttgtgcagcttcaatccaatcgtaaccaataccatctttttcagcttgagcaatgacttcttcgtcaaatgggtttaagaatatatctaattgtttttcatataaatctttctcgtctactgctgaagctgcttcatgaactcgatctgcatcatataataaaacacctaagtaacgcatacgtcctgtacaagtttcagagcataccgtaggcatacccgcctcgattctcgggaaacagaaagtacacttttcagctttgttcgttttccaattgaagtaaactttcttatatggacaacctgtcatacagtaacgccatccacgacatgcgtcttggtcaactaatacaatgccatcttcatcacgtttatacatagcacctgaaggacacgatgcaacgcaacttggattcaagcaatgttcacataaacgtggtaaatacatcataaaagtttcgtcaaattggaatttaatatcttcttctattttttggatgttaggatcttttggacctgtaacatgaccacctgctaagtcatcttcccagttaggtccccattcaatttcaatgttatcccccgtaatttctgaatacgctctagcaactggcgaatgcttccctgatttcgcagttgttaaatgttcataattatagttccatggctcataataatctttaattaatggcatatctgggttataaaaaattttacctaaagcaatttttgaaattctacttccagattttaattcaagtttccctttacgatttagtacccaaccacctttgtagtgttcttggtcttcccaacgtttcggataccctacacctggcttcgtttctacgttgttgaaccacatgtactcagcacctggacgatttgtccaagtgtttttacatgtcacactacacgtatggcatcctatgcatttatctaaatttaataccatcgcaacttgcgctttaatcttcaagccaattaacctccttcatctttctaactgctacatataaatccctttggttcccaattggtccataataattaaagtgataactaatttgtgcgtatcctccgactagttgtgttggtttcaaatggattctagtcggcgcgttgtgtgaaccaccacgtgtatctgtaatttctgacccaggcgtttgaatatgtttatcttgtgcatgatacataaacattgtacctttaggcatacgatgcgaaataactgctcttgccgttacaacaccattacggttatacacttctagccaatcattatcttggatatcgtgtttttcagcatcttcatttgatatccaaaccgttggaccacctctaaatagtgtcaacatatgcttattatcttgatacattgagtgtatattccattttccatgaggcgttaaataacgcagtaccaaagcatctgtaccacctttaattttcttatctctattcccaaataccattggcggcaatgtcggtttatatactggtaagctctccccaaattgttggaaaacttcgtgatccacataataactttgacgtcctgttaatgttctaaaaggtactagacgttctatattcgttgtaaatggtgaatatcgtcgaccttgtttatttgaacctgggaatactgctgtcggtattacttctcgtggttgtgaagttatatttaaaaacgaaattttctcagcagcgcgttcgctagaaatatcttttaacggcattccagtttgttcttcgagatcttcatatgatttttgtgataatttaccattcgtagcagatgaaatacttagtattgcatcagctacattacgtgctgtatcaatacgtggacgattcgctctcacagaatcatcatttgtatcactccacgtacctaacatactttttaattcttcatattgttcactgacaccgaaacttacaccatgtgctccaactttccctttttcaagtacaggaccaagcgtgacatatttgtcgtaaattttagtgtagtcgcgttctacaattgcaaagttaggcattgtacgtccaggtaccgcttcaatttcacccttcgaccaatctttcactacgccgtatggtgttgaaatttcttgctttgtatcatgactaagtggagttgtcacaacatctttaaacgttccaggtaaatagtcttttgccatttctgaaaatgcttttgccaacgttttataaatatcccagtctgaacgcgattcccataacggatcaatggcaggattgaaaggatgtacatatggatgcatatccgttgatgataaatcatgtttttcataccaagtcgctgccggcaaaacaatgtcagaatataacggtgttgccgtcattctgaagtctaaagagaccactaaatctaacttacctgttgtttcttcacgccacgtaatttcttctggcttttcatcttcatttggtgtagctaataaccctgattttgtgccaagtaaatgcttcataaagtattcttgaccttttgcagaacttgaaattaagtttgaacgccatataaataatgattttggatgattctttttcaaatcaggatcttctattgcaaattgtgtttgttttgatttcacttcatcaattgcacgttgcaaaatcgcttcatttgaatctataccttcatctttagcttcttctgcaaacaacaaactatttttattaaattgtggatatgatggtaaccaaccaagtctagctgctaaaacattataatcagctggatgttgatgctttaactcctctgttttagctaatggagattttaaacgatctacatttgactcttcatatttccattggtctgttgcaaaatagaaccaacttgttccgttttgcaaacgtggtggtccttgccagtctttcgcaaatgcgacagtactccatccttcaatcggacgacatttttcttgtcccacatagtgagcccaaccgccaccattcacaccttgacagccacataacataactaagtttaagattgaacgataaatcgtatctgagttaaaccaatggttaatacccgcacccatgataatcattgaacgcccttcagtatcgatagcgttttgcgcaaattctttcgctacttgaatgacaacactttgttttacgcctgaaatggcttcttgccaagcaggtgtatattttgattctgcatcgtcgtatccttttgattctaatttatgatcaaaacgacgcacgccatattgacttgccattaagtcaaaaattgtagcaatacggactttgtcaccatttgctaaagtgacttgtcgagttggaattggacgattgaatatcccatctccatcactatcaaagtatgggaattgaattgtttctaattcgtatccaccttctgtcattgataatgtagggttaattttagaaccatcttctgtttctagttttaagttccacttcttaccttcttcccaacgttgacccattgtgccattaggtactactaaactatcgctgattgcatcatgaataactggcttccattcgccttgctctgttgtttgacctaagtcactcgctcttaaaaatcgacccgctttatatccattttcatcttcatccagcatgataagaaacggcatatctgtatattgtttagcgtaatttataaagcgttcattaggttgattaacataatgttcttgtaaaataacatgcgtcattgcttgtgcaattgcagcatctgaaccaggattcggtgctagccagttatctgcaaatttcacattttctgcgtaatctggtgctactgaaatgacttttgtacctttatagcggacttcagtcataaaatgtgcatccggagtacgtgttaaaggtacattagagccccacataataatgtatgatgcgttataccagtcacttgattcaggcacatctgtttgctctccccaaatttgtggagaggcaggtggtaaatctgcataccagtcataaaaactaagcatttcaccaccaagcaaattgatgaatcgagcacctgctgcataactaatcattgacatcgctggaataggtgtaaatcctgcgattcgatctggaccatatttttttattgtatacagtaattgtgctgcgattatctctgtaacgtctttccaatttgaacgcacgtgccctcccatacctcgggcttgcttatattgtttggctttgtcttcattttcaacaatagacgcccatgcagcaacgcgattaccattgttttcttctaatgcttcagtccataaatcccagagttttccacgaatatatggatatttgattcgaagcggactgtattcataccaagagaatgacgcacctcgtggacatcctctcggttcatattcaggcatatccggaccacaacttggatagtcagtttgttgattttcccaggtaatcacaccatttttcacaaatactttccaagaacatgagcctgtacagttaacaccatgtgttgttcttacttctttatcgtggctccaacgttctctgtacattttttcccattctctacttttactttctaggatcgaccaattcccattaaatttttctgttggcttaaagaaattcaatccaaattttcccatatttatatcctcctacgtataaaaatacgatgtgtagatgtcgtgtttttaaatactttaaaatgcccaagactattgctttaattagattgtacattttttcacaaacataaaatattagggaatcacctaattacttaaggaatttccctatcaataacgggatttcattgaaataatacacaatcatgtatggtcatgcttattgccaatctaaatcgttcaaatttggcacaacgacaaataaggcttcaacacgaatatattctctcggttgaaaccttacttattcatttattttttataaattagtgacataacactgtattagcatctgcacgatcggttgaaatatatgttacattttcttgctgcttaataaatgcatcatagtaatcatattgcgacgaatgatatgtgccattcgatgtatcatttgggtttagcaaacagccataaccttcgtcatataaatgttcacagagcataagggcgtcatgtttagaaccacttactacataaaattgcttcataggatcatatgatttaggagtgttttcagtataatcaacaacttcccctataatacatatacctggtttcgcctcaattgaatagtgttgcaattttgaaataatattacttaaacgccccttaacaacaaactcgttaaaacacgatgcttgaaagacaatcgctatcgggtaatcaatatctgtgtattgttgtatctgtgtgataattttccctaaacgttttacccccatataaattgctaacgtgccaccattcactaaggaattgacatccacttcattttcttctgaatctttaaagtgacctgtagaaaatgtcacacttttagcaactgtacgcattgtcaaacctgtctgcatagtagcaactgctgcgctcgctgatgtcacccctggtacaatttcaaacgcaatatgatgttcatttagtatgtcgacttcttcttgcacacgaccaaatatcgctggatcgccacctttaagtctaacaaccttgttatatcgacgcgctgcttccacgatacagtcatttattttttcttgctgaatatgttttgcatacggctttttaccaacatcgataatttcagtagtcaaattcgcatattgtaaaattaacggattcactaatcgatcatatagaatgacatccgcttcacgtattaaacgctcagcctttttcgtcaaataattcggattacctggacccgcacctatcaagtaaaccttgccatattcctctacagacatatatatacgttcccgtctgtaacttctacctcataaacatctacacaaccttcatcaggttcttgaacaatacctgtatttaaatcaattttttgatcgtggagcgggcaaaatacatattccccactcactgtcccttcagacaatggtccttgtttgtgtggacagatattgtgaatcgcatgaattttgccactttctgttaaaaacaaccctacctctttgcctttgacaataaccttttttccaattaggggtgttaattcatctatagttgtcactttaattttttcttttgtttccatgtattacaccttctccacttcaaaaattctacgtgcttgagcattgctagttattgcttcccaaggttcagcttcgactgcttttttagcatccataatgcgttcaaatagttcattttgtctttctgggtcaagtaagacttcttttacattttcaaatccaagtcttcttaaccatggcgctgttctttcagcatatatacctgtttcgcgataatattgcatcaaagcaccacataatttgattacttcatcttctgtttctacagttgttaaaaattcagctttttcaacttctgtaccaccattaccaccgatatagatttggaatccattttcaactgagataataccaaaatctttaacacctgattcaacacaacttcttgggcagcctgatacacccattttgaatttatgaggtgtatcgatgtattcaaatgttttttctaaacgaatgccaagtcgtgtcgtgtattgcgtaccaaatcgacaaaactctttaccaacacagcttttaactgagcgtgttttcttaccataagctgatgctgaacgcatacctaggtcttcccatatatttggtaattcttcttttttaactccatacaaaccaacacgttgtgaacctgtcactttaactagtggcacatgatatttcttagccacttctcctagacgaatcagttggtctgcatctgtaacacccccacgcatttgaggtataacagaaaatgtaccatcattttgaatattcgcatggtaacgttcgttagcaaatcttgattctctttcatcttcatgatcatgtggataaaccatgtttaaataatagttgattgctggtcgacattttggacatccacctttatttttaaagtttaaaacatgtcgaacttctttagatgtttttaaacctttcgctcttatttgcgttactatttgatcgcgtgtcaaatcagtacaaccacatataccagcaggttttgcggcaacaaagtcatctcctaaggtgtgctgcaatatttgagcaatttgcggtttacatttaccacatgaattccccgcttttgttttagccgttacttcttcaactgttgtaaagccattttccgtaatcgcatttactatagtacctttatcaacaccattacaaccacaaattgtttcatcatcagccatatcagcaattgatagcgatgcctcttctccacctttagtaagcaatgatacaagtgtgtaatcttcagtggattcaccttttttcatcatgttataaaagcgtgaaccatcatcgatatcaccatatagtactgcaccaactacattaccgtcttttaaaaagatttttttatagttattatcaacactattaaatatttcaatacctttaatttctgcattttctacaatttgaccagcactatacaagtcacacccagaaacttttaatgacgtaaatgttgttgatcccttgtatccgttcgtttctttatttgttaaatgatcagctaatactttaccttgttcatatagtggtgcaacgagtccataaactttgccgttatgttctgcacattcaccaactgcatatacattgctatcacttgtttgcatcacatcattgacaacaataccacgattaacatctagacctgattctttggctacttctgtgtatggtcgtatacctactgccataacaactaagtctgccggaatctcgcgtccatcagccaatttaacaccctcaacatcatcttctcctaagatttcagttgtgttggcttgcatttcaaacttcataccttgcttttctagatctgctttaagcatatttccagctttacggtctagttgcatttccatcaaccattcagctaaatgtaacaccgttacttccataccttgatctaataaaccacgtgcacactctaaacctagtaatcctccaccaattacaattgctttctttttagtcttagcaatgttcatcatttgttcagtatcatcaatcgttctccaaccaattacactcggtaatgtcgaacctggaactggaatgacgaatgctttagaacctgtcgcaaaaatcaatttatcgtatgatacttcaataccatttgcagtagtaactgattgatttgctctatctacttcaattacaggatcatttgtaattaactcgataccatgttcctcataccactcatatggattcataattgtttcttcaactgtcattttattttgtaaaatatttgaaagcatgatgcggttatagtttggataaggttctttacctattaccgtaatatcatataaatcgttggcgcgctctaatatttcttcgattgttcgaatgcccgccataccgttaccaatcattactagtttttgctttgccataaaatatgcccctttactccataatatttatttcaaaaaaaggtattaatttttcgttagtgcttttatattttcattggaatcattaagctttctaatctatcgttaatgatttgctttaaaattgggtcgaagttaattgaaggtgtgaagtgtatatctgtattaataaccatgtcattcatttgctgcttcactttgttaacaagtcttccgtcatataaaaataatggtacgacaatcaatttttgataccgtttcgagatgctttctaaatcatgtgtaaaactaatctctccatatagcgttctcgcatatgtcggcttgctaatttgcaaattttgagcgcatatttgtaactcttcgtgtgccttagtaaactttccattaatattgccgtgtgcaacaaccataactccaacttgttgttcgtcacctgctaatgcgtcacaaatacgttgttcaattaatcgtctcattaaaggatgtgtgccaagtggctcgcttacttctacctttatgtctggataccgtcgtttcatttcatgaacgatattcggtatatccttgagataatgcattgcactaaagattagcaatggtacaattttaaaatggtcaaccccactttgaatcaacgtcgtcattaccgtctctaaatcctgatgctcactttctaaaaacgcaatatcatagtgatgtatatcatcttttactaattcagaaataaatgcttctaacgcttgattctgtcgtccgtgcctcatgccatgtgcaacaatgatattcccattcacatttaccaaccctttcacacgtattgtataccaaatcattttgtttttgtgaaaagaatcacattataatgtaaaatcagggaattccctgatgcctgtagtcatgcatattccttatacattttccctttttgttaaatcaaaaaaagcgaccgatatatgaatccctactcaacatttatttgagcaagcattaatatatcggtcgcttgtagtgtatattattatcttaaaatggtggttggcctaatattgtttcgtcaaagcgctcgggtatcaatactttgcgcatgatcacacctaaatcgccatcatcattttcatgttcgctgtatatttcataacctcttttttcataaattttaagtaaccacggatgcaatcttgcagatgtacctaaagtaactgccgctgactttaacgtatctcgcaaaaatgcttcttcaacataagtaagtaattggctaccatagcctttcccttcatactcaggatttgtcgcaaaccaccagacaaaaggataacccgaaatacttttcacacttccccaaggatatctaaccgtaatcgtagatataatttcatcatcaattgtcatgacaaatgtagtatttttatctatattttctttaacagcatctaaattagcattaatcgaagsccaatcaatacctagttctcttagaggcgtaaatgcttcatgcatgagttcttgcaatttttctgcatctt

SEQ ID NO: 104 - DNA, 1885 bp; double-stranded, linear
taatcctcaacttngattatatggcttgggcgcatatgaactgcttagtttagtgtatgacattcatacagttcgcatgactatcatacaacctcgaatagataacttttctactgaagagttaccaatctcaagattacttcaatggggaaccgattttgttaaacccttagccagacttgcttataacggtgaaggtgagtttaaagcaggtagtcattgtagattctgtaagataaagcattcatgtagaacacgtgcagaatacatgcaaaatgtgcctcaaaagccaccacatttgttgagtgatgaagagattgcagaacttttatataaactgcctgatatcaaaaaatgggctgatgaagtagagaaatatgcgttagaacaagcgaaagagaatgataaaacgtatccaggttggaagctagtcacgggacgttcaaggagagtgataactgatacaaaagcagtccgagacaggttagttgaagcgggttataaacctgaagatattacagaaaccaagttacttagcattacgaatttagaaaaattaatcggcaaaaaagcattttctaaaattgcagaaggctttatagaaaagccgcaaggtaaattaacacttgctaccgagtctgataaacgaccagctataaagcaatctgctgaagatgattttgacaaactataaaaattaaaaaggacggtatataaacatgaaagcaaaagtattaaataaaactaaagtgattacaggaaaagtaagagcatcatatgcacatatttttgaacctcacagtatgcaagaagggcaagaagcaaagtattcaatcagtttaatcattcctaaatcagatacaagtacgataaaagccattgaacaagctatagaagctgctaaagaagaaggaaaagttagtaagtttggaggcaaagttcctgcaaatctgaaacttccattacgtgatggagatactgaaagagaagatgatgtgaattatcaagacgcttattttattaacgcatcaagcaaacaagcacctggtattattgaccaaaacaaaattagattaacggattctggaactattgtaagtggtgactatattagagcttcaatcaatttatttccattcaacacaaatggtaataagggtatcgcagttggattgaacaacattcaacttgtagaaaaaggcgaacctcttggcggtgcaagtgcagcagaagatgattttgatgaattagacactgatgatgaggatttcttataagtcaataggtggggtttttagccccactttaattttaaagaaattgaggtgtcaagaatttgaaatttatgaatatagatattgaaacatacagcagtaacgatatttcgaaatgtggtgcctataaatacacagaagctgaagatttcgaaattttaattatagcttattcgatagatggtggagcgattagtgcgattgacatgactaaagtagataatgagcctttccacgctgattatgagacgtttaaaattgctctatttgaccctgctgtaaaaaagtatgcattcaatgctaatttcgaaagaacttgtcttgctaaacattttaataaacagatgccacctgaagaatggatttgcacaatggttaattcaatgcgtattggcttacctgcttcgcttgataaagttggagaagttttaagactacaaagccaaaaagataaagcaggtaaaaatttaattcgttatttctctataccttgtaaaccaacaaaagttaatggaggaagaacragaaacctacctgaacatgatcttgaaaaatggcaacaatttatagattactgtattcgagatgtagaagtagaaatggcgattgct

SEQ ID NO: 105 - DNA, 2656 bp; double-stranded, linear
taatccttagttcactgncaaatttcaaaacaccagttccctctatctgcatccatagaaactgnatgtttgtgtcaataaccggattatattgtgatgntgtttgtaactcgattaagttatcatctttcgaaaaattatctactaccattattcaaccacctttccttcgaataaactccatttaccaackccaccagtaccaaagtttctaactaaaaattgatgtgcagacgggaagttattacgtcttaatacttgtgttgtattacctggtgtattcgattttacttctaatatccaacctgcaatacctttaaagtctttaggaaaatcagtaaatcggtttgattcttcagtagtgatatagaaatctaaaccaacgatttttaaatctgataattttgtaatactcttagggatatgttcccaataaccggcgttttgcgggcagaaattccatgctccgttgtttttcttattgaaaatgtcaatgacacgttcgaatttaagcatatttctacctgtgctgtttctggtaagtacttgtcttagagcaccattatagtgtccaggcagtacatccaagaaccaccctgcatctctaaacgctttcggtaacgggaaatctaatgcattttgtgtgtcttgacgtatagatatagtaatgaccaacttccgtaatatcacttagatatgctgggttctgtattggtaacggtttaacacgtccgcctgaatcagtcattgatacttgaggtgcgatgtttttcaagaattggtttacacctctttgaccgatagaataaattgaatgatgtctgttgttaccaggtccaatagttaccccgattagaagtgctttacgtcctgtttctagatcgtaatacatatctagaccctcagcctcttggaaatctcctttaaagttgttattcacaccgcctatatcgatgcgacgtttaaataacaattctttcgttttgatatcgaagccttgtaagtagttagggttggctgtattcgaatcacctgtataccaatataagatacctgcatcataagtgataccttgcataggttgtgtatctgaagtgtattccataggtatatccatttgatacaatactttgtctatacctttatcaatatcgtcagcacttctaacctcaacaaagttcaacgaattcttaagttgtctttcagtgggtttatattcacgtctaaaaatcattaaattttctaccggattataaatcgctgacgtatatctgtcgttaaatatattcggcatgacatcttgcatttcattaccataagttatttctccagttctatattggaaacgtacaaacttgttgtttttgttactgtccaatacagctgaataaatccataattctccatcaatgtatctatacgcattgtgtgtaccgtgaccgccgtttttaacaagcaatctatcaataaattgtccgttgggcttcaatctagataacatgtaatgattacctggacgagcttgcgtcatataaataattttcgttctagggtctacccaaaatgattgcattactgcatttgtatatggcgataaatcagtgataaattccggttcttgctcttttggttcgaatcggtattctgtcgctcgatattctttatagtgttcatctacagctttctcaacctttttagtgaaaacatctagtgttgaataatcatgatacaaacgatcttgcaatgtcttatgaccataacctgtattatcaacgcgcgcgtcttttacttcgttgataccgtcgccgttatgacctagtaccatgttgctaaatcgaccgtttaaatatgttaaaaagtcagagacgttacttgtaacatttaaatgttcatactttatttgttctccatcatgtgcgaatacctctttatttctgtggtattcaagagagaaattaaaatccgtcagcatgtctgaaataagtttaaagttatactcattttcatctacatatctgtagtcaaagactctacttaaatctgtaattagtttattactcatgttttcctcctttactatccataaaactgatmataatttttaataagctcatacataataacttcatgacctctttcattaggatgtaatccatcaggcatgctagattttctaaatgctggattatatggtttgaaataatctgtgtgataagcatcatatactggtacatccaattcactacaagccaatatctgagcattgacataatcctctaaagttaaccctagtttgtttttgtccgtatctttacggcgtatcgttgtaccactcatagggcattgcctagtagctgtcattacaagtatttttgaagctggattatttttcctgataacttcaattgcagaacaaaaggcgccgtaaaacgttttagtgtcggttttatcagtgcctatcggtacgcctgcccaataaccatgtaaccagtcatcatctgtaccttgtaatatgattaggtctcctcttatttgctctgcttgtctataaatgctgttttctaccgcttctttacctattggaactgttgccattgttgcgccacctcttgcaaggttggtcgttttagcttttaacttcttgcctaacatttct

SEQ ID NO: 106 - DNA, 4854 bp; double-stranded, linear
aaaatgagggttctagcggaaattaccaaaagcgtggttcatactatgggcagcgtaatcgtatttcaaaagaaaaaacacctaaatggttagaaaatagagataaacctagtgaagaagattcggctaaagataatagcgtagatgatcaacaattagagcaagatcgacaagcatttctagataaattatctaaaaaatgggaggaggacagtcaataatgaagcaatttaaaagtataattaacacgtcgcaggactttgaaaaaagaatagaaaagataaancagaagtaatcaatgacccagatgttaagcaatttttggaagcgcatcgagctgaattmacgaatgctatgattgatgaagacttaaatgtgttacaagagtataaagatcaacaaaaacattatgacggtcataaatttgctgattgtccaaatttcgtaaaggggcatgtgcctgagttatatgttgataataaccgaattaaaatacgctatttacaatgcccatgtaaaatcaagtacgacgaagaacgctttgaagctgagctaattacatctcatcatatgcaacgagatactttaaatgccaaattgaaagatatttatatgaatcatcgagaccgtcttgatgtagctatggcagcagatgatatttgtacagcaataactaatggggaacaagtgaaaggcctttacctttatggtccatttgggacaggtaaatcttttattctaggtgcaattgcgaatcagctcaaatctaagaaggtacgttcgacaattatttatttaccggaatttattagaacattaaaaggtggctttaaagatggttcttttgaaaagaaattacatcgcgtaagagaagcaaacattttaatgcttgatgatattggggctgaagaagtgactccatgggtgagagatgaggtaattggacctttgctacattatcgaatggttcatgaattaccaacattctttagttctaattttgactatagtgaattggaacatcatttagcgatgactcgtgatggtgaagagaagactaaagcagcacgtattattgaacgtgtcaaatctttgtcaacaccatactttttatcaggagaaaatttcagaaacaattgaattttaaaatgattggtgtataatgaatacaaatctaaatcgtttaaatgattgaagacaagatgatctaatcaatattacacagaaagccattgtttgatgagaatatggttaataaattagatgattactacttcatttatggtatttgtaatgaatacccggatcaagaccgttatcttaagcagagatatttaatacataaattgtattagataactagggtggtaccacgacgatctcgtcccttgtataggggcgggattttttgtttttttcagacataaatgtttgttggtgtcataaattccctgtttattgttaataggtttaatgttaaaacgatgattgttgttcaattttttaacgaggtcagataaaagtatttataaagcaaataggagggtttaacatggaacaaattaatattcaatttccagatggtaataaaaaggcgtttgataaaggtactactactgaagatatagcacaatcaattagtcctggattacgtaaaaaagctgttgccggcaaatttaacgggcaacttgtagatttaactaaaccgcttgaaactgatggatcaattgaaattgtgacaccaggtagtgaagaagcgttagaggtattacgtcattctactgcacatttaatggcacacgcgattaaaaggttatatggtaatgttaaatttggtgtaggtcctgtaatagaaggtggattctactatgacttcgacattgaccaaaacatctcatctgatgactttgaacaaattgaaaaaacaatgaaacaaatcgttaacgaaaatatgaaaatcgaacgaaaagtggtttcacgagatgaagtgaaagagttattcagcaatgatgaatacaaattagaattaatcgacgcgattcctgaagatgaaaatgtaacattatatagtcaaggtgattttactgatttatgtcgtggagttcacgttccatcaacagctaaaattaaagagtttaaactattatctacagcaggtgcatactggcgtggagatagtaacaacaaaatgttacaacgtatatacggtactgctttctttgataaaaaagaattgaaagcacatttacaaatgttagaagagcgtaaagaacgtgatcatcgtaaaattggtaaagagttagaactattcacaaatagccaattagttggtgctggtttgccattatggttacctaacggtgcaacaattagacgtgaaattgaacgttacattgttgataaagaagttagcatgggatatgaccacgtttatacaccagtacttgctaatgttgatttatacaaaacatctggtcactgggatcactatcaagaagatatgttcccaccaatgcagttagatgaaactgaatctatggtattacgtccaatgaactgtccacatcatatgatgatttatgcgaataaaccacattcatatcgtgaattacctatccgtatcgctgagctaggaacgatgcatagatatgaagcaagtggtgctgtatcaggattacaacgtgttcgtggtatgactttaaatgattcacatatctttgttcgacctgatcaaattaaagaagaattcaaacgcgttgtaaacatgattattgatgtgtataaagactttggtttcgaggattatagctttagattaagttatagagaccctgaagataaagaaaagtactttgatgatgatgatatgtggaataaagctgaaaatatgcttaaagaggcagcggatgagcttggcttatcgtacgangaagcgattggtgaagcggcattctatggtccgaaactagatgttcaagttaaaacagcgatgggtaaagaagagacattatcaacagcacaacttgatttcttattaccagaacgttttgatttaacttatattggtcaagatggtgaacatcatcgtccagttgttattcatcgtggtgttgtatcaacaatggaacgatttgtagcatttttaactgaagaaactaaaggtgcattcccaacttggttagcgccaaaacaagttcaaatcattccagttaacgttgatttacattatgattatgcgcgccaattacaagatgaattgaaatctcaaggcgttcgtgtaagtattgatgaccgtaatgaaaaaatgggttataaaatcagagaagctcaaatgcaaaaaataccttatcaaatcgtagttggggataaggaagttgaaaataatcaagtgaatgtgcgtcaatatggatcgcaagaccaagaaacagttgaaaaagatgaatttatctggaatctagttgatgaaattcgtttgaaaaaacatagatagacagttgtcgcaataaaatgctttaaaacttttattgcgtatcaagttttacagggttgattatgcgtgatgaatcctgtatattacaagttagttaaaatattaaattgagttagaggttgcatgtttaattagtaacttgtcagaagtatttatggtacataagttgaacaagtgaaaggtaaagatgccgaaatagatataaaccataaattatatctattgggacagttttcgaataggaactgtactgtcacagaatgtgatgtgctaccttatatagataattgccaaagtggttgcatatcttaaaggtatgtagccacttttttacttttaatatcactatgttctgtaaaaaagggtatgaaagtgaataaaggttatttatttcttggcctctaaaacatggaaagggagcttatatgtcaaaagttcaaaatgaaagtaacaatgttgtcaaaaggggacttaaagatcgtcatatttctatgattgcgattgggggttgtattggtacaggtttatttgtaacttctggtggagcaattcatgatgcaggtgctttgggtgcattaataggatacgcaattatcggaataatggtatttttcttaatgacgtcacttggcgaaatggctacgtatttgccagtatcaggttcatttagtacatatgctacaagatttgttgatccatctttagggtttgcgcttggttggaactattggtttaactgggtagtgactgtagcagcagatattacgattgcagcacaagtcattcaatattggacaccattgcaaggcatacccgcttgggcatggagtgcgttgttcttagttataatttttagtctgaattcgttatcagttcgcgtctatggtgaaagtgaatactggttggcattgataaaagtggttacagttattgttttcattgcaattggtttattaacgattgtcggaatcatgggtggtcatgttgtaggattcgaaatatttaataaaggtgaaggtccaattcttggtggcaacttaggaggaagtttgttatcaattctaggtgtattcttaatcgctggtttctcattccaaggtactgagttaattggtattacggctggtgaatcagaaaatcctgaacgtgctgtgccgaaagcaattaaacaagtattctggagaattttattattttacattttagccatttttgttatcggtatgttaattccttatgatagtagtgcattaatggggggtagtgataatgtagcaacgtctccattcacattagtgtttaaaaatgctggatttgcgtttgcagcatcatttatgaatgcagtcattttaacgtctgtgtta

SEQ ID NO: 107 - DNA, 2488 bp; double-stranded, linear
atcaaaaattgattgttttcnattttttgtttcagcgcgggatcttttacgtcttttgtgaaaacgattttattattaactacttttactggataacttttgtatgtcgagtcagtagcattttttctatcgtttgtagttgtgtcatattcaccagttattttatgtgtgttcttatctacctttaacaacatacggtcttcttttaaaagctcatctgatccaacaactgaataagaggattctatataccatgtgtcttgatcattattttcataatggggattatcgtgaccatcaatttcataaagcgtttctaagtttttaataggatacgtacttagtacttttttaagaccatctttcaaatgaatttgttcccacttcattgccaaaaacatatcgccactgactacaattgaaataataataattgctgctaagtttaaccagaaaattttatgtgctttcatacattcccaccgtttctcaaaatacttcattaacactataataatatattttgaaaaatatttacatcagtattaaagtgaatatcaaattttaaatttatgaaaataatagatatttataaaaagcggaaaagagatacaataaaaaactgcatgacgtttgagacgtcacacagtgtaactaaaaatttaaaaagttgttgctaatttttcagcattattaatactagttgctttaatttcttcagtcttatgaggttcagcattgtgtccttcaataatgattgtttcatatgatggcacacctaagaatgtcataattgttcttaaataacggtcacccatttcaaaatcagcagcaggtccttcagtataatatccaccacgtgattgaatgtgtaatacttttttgtcagttagtaaaccttgtggtccttcagcagaatatttaaaagttttacctgcaattgaaatagcatcaatatatgctttaactacaggtgggaaagaaaggttccacataggcgttacaaatacatatttatctgcacttaaaaattcttctaaaatgtcactcaatcttgaaactttcatttgttcatcatcagttaacgtttcgccattactcatttttccccaaccagttaatacatctttgtcaataactggaatataagtttcarataaatcaatatgtttcacttcatcatcaggatgttgttgttgatatgtttcgataaatgctttaccagccgccatagaatttgataccagttcattaaaagggtgtgctgtaatatataatacttttgccatttgaaaattctcctctgkttctgttattttcttaagtataattattatactcgatataaaatttaatatcaatcaaaatattcaaattaccatcattttcttcatctatatntggcagtactactaaagtatgagtgcatttaattatgaaatagttgatttagaatatatacttaatacccaaaatatatgaaggatggatgccactatgacraagcgaccaaaacgtattttggcaacaattatcatttttctttcactattatttacgattatttatatagatgacattcaaaaatggtttaaccaatataccgataaattgacacaaaatcataaaggacaaggacactcaaaatgggaagacttttttagagggagtcggattactgagacttttggtaaatatcaacattcaccatttgatggtaagcattatggcattgattttgcattgccaaaaggtacaccaattaaagcgccgacgaatggtaaagtaacacgtatctttaataatgaattgggcggcaaggtattacagattgccgaagacaatggagaatatcaccagtggtatctacacttagacaaatataatgtcaaagtaggtgatcgagtcaaagcaggtgatattattgcatattcaggcaatacaggtatacaaacgacaggcgcacatttacattttcaaagaatgaagggtggcgtaggtaatgcatatgcagaagatccaaaaccgtttatcgatcagttacctgatggggaacgtagcctatatgatttgtagttatagaagggtgcccgcagtctaaaaaattaagcaatcattgtgtgagtatgatacttacataatggttgcttttttcaatgaaaatcgtaatgctaagtcatacttgtttgatttagatattacttaaaatgtaagacaaggttgttagcattggcagtgaaatatcgcacataaaaaacattattgtcacactagaaaatagttgtgcactatatcaattttctgtataaaagtttaattctgacagtaatgtaaacgtttacaatttatgattgacattaataatgactgaatatatgatttatgtaagtatttgtgcaacgttttcacaaagtgtattgcacaaycaaactgtaaacaaagtatggggggccataacatggcagaactaagttagagcntattaaaa

SEQ ID NO: 108 - DNA, 4093 bp; double-stranded, linear
ttttctttatttcaamctgtatattaatgatgtcacttcatttgatacgattcttgataacctattcaaaattccgccaaataacataaatattatataaatgccgatacttttaatcattttctactttttcttcgatacggaaacttgttttcgaattgaacacttcaccagcttttaaaattgacggtgctttttcaccatataaattaatatcatttggtaaaaattgtgtttctaatgtaaagccagaatgtggtttataaatattaaatggactatcccactcatcaggctggttaaaagtaaagaacacaacatgaggcatatctgtatcgacctctaacataaattcatgattttcaacatacattttatgttcaccaactgtaaatgggtgatcgagaccaccaaaacgtgtcatttgttggcttaattgcgcatgttgtgatgtaaaaatatcactcaattttatcttgttatcttcaaacacttcatgtaaatctagaatatcacctgtaacaatatttcgctcatctaatacatacatatctaattgattacttgaaatgcgatgattatcaacgacattattatctcgattcaaattgaagtacacatgattcgtaggactaaacaatgtgtcttctgatgcaactgcttcgtattcaatcgaccattggtgatccgcatcataaatatgtgtaatcgtcacatcgatatcacccgggaaatgatcatcagctgatttcaacaccgtcttaaatataactttaatttgagcaatttcatttctaatttcataatcaaataacttattgtccaaaccatgacatccaccatgtaaatgatgttcaccgttgtttttttctaactgatattctttacctttcaacttaaatttagcattatcaattctaccgctatatcttcctatagaagcaccaaatttaaaaggattactatgataaaattcatccgcttcaacaacatttccaagaacaatattattatcatgatatttccaagacactactcttgctccataattcgtaaaaataattttagtttcatcattatcaattttgattaaatctacaccttgtctttggtgctcaacttcaactatcatttttacttctcccttctaaccacaagtgttcaagctctgctgggtagcaacattactaaaacacctacaatacaaatgattgcaccgataacatcatatttatctggcatttgtttatctacgaccatcgcaaaaatcaaactcatgatgataaatacgccaccatatgctgcatatactcttccgaatgatggaaatgattgaaatgtcgcaatgacaccatataacatgagtatcgcaccgcctattagcccaacaagtgaagactgtccttccctaagccacagccaaatcaggtatcccccacctatttcacataagccagctaatataaatataaaaatcggatataacatgaaatcactccatcacacatttgctatcaataatctatcggctacatatcatttgtttacatttcttcttacttcacattcccattttaaaaagttcgttttcacattcatattgtacacttttttagacattattctatagctaaatataaaaaaataagagtaacacgctttcatcatcattttatatgataaatgtgtgtcactctcatcaattttattttttaaatacacgtttcattgaattaaataagccacgttcaaatgtaagtactgaatctttatatgttttaattgcaatccatatcaagacagctaccattacaattgagattaaagaacttaagatgacctcatatatttgaagccctgaagtttgagcgcgtacaactaattgaaatggcgctaaaaacggaatataacttgtgattaaagcaagttgtccatcaggattatttatcgtgaatatcgcgatataaaatgcaatcataccaagtaatgtcagtggcatcaaagattgatttaaatcttctattctagatgttaatgatccgaggatggctgcaagtaatacatacgccgtaattccaacaatactacttataattccgacaataataatttgccaagacaattgattcatttccacgttaaaaccttgtagcaagtcttttaagtcaaaggcaaaaatgcatataactgccatcaatacaattaaaataatctgagtcacggcaactgctataacgcctaaaattttagcaaaaatatgttggattggtgaaatacttgtaataatcatttcaatgacacgcgatgttttctcactagcaatttccatagctatttgagatgcataatttaaaacaatgaagaacattagaaagataatgccatmagctaaagcatagttgaaaatcttttgtccttctgatactttatcgacttcatcattagaaatcaccttattatcaactttactttgtgcttgtaatttttgtaagtcttctttgttgatatttaattccccggctaccatatttgtttgaatagctgtaagcagtgcttgtactttttgtgaatcttcatgacttactcgcttctcactaatgattgtcccttgtaacgtgcgattttgattcaccttgataatataagctttatcaagtttatgtttttttacttctttttcagcatcttctatagaaactttagtaaacttagcatcactatgaaatgtattcgcctgttgcttgaaaaccttatagatttgttcattcggtgctgctacaccaattttatctggaccatcatcaaacatgttaataatcttatcaatgttagataggccaatcattaaggcagcaataataatcataaaaattacaaatgatttagctttaatttttttgatatatgtcaaagtaaatgtcgcccaaaacttatgcatccttgccaccaaccttctcaatgaatatatcttgtaatgatggttctacaacttggaatcgtttaacataaccttgatgtgccacaacttgataaatatctttggctacgtcttcattctcaatcgtcaactgaagaccttgcttcatgttttcactatgaatgatgcctctaatgtttgttaaatctggtagtgttgtttctgattcaatgacaactttcttgttaccattagatgcacgtacatgattgatatcaccagaaacaacaagttgacctttatctaaaatacaaacatcatcacataattcttcaacatgctccatacggtgagaactataaacgattgtactgccccaatcatttaagtctttaactgcttcttttaataactcaacattaactgggtctagaccactgaaaggctcatctaatattagtaattctggtttatgtaacatacttgctaacagctgaattttttgttgattcccttttgatagactatcaattcgttttttgcggttttcagtaatatcaaaacgctcaagccaatacgatatttgctgttgtatttctgtttttgacattccctttaaagttgccaaatatttcaattcttcttcaactgtcaatttcccatgtaaaccgcgttcttccggtaaataaccaatacgattgtacattgttttatctagttttttaccgttatacgtrrtgtgtccttcagttggttcacttaagcctaaaatcatacgaaatgtcgttgttttacmtgcaccatttcttcctagaaaacctaacattttacctgattctaactttaatgaaatatcatttactgccgtcatcttgccaaaacgtttcgtaacatgttcaattacaagtcccatactttgcctcctaaaaanatatgtatttatcttaatataacatttccattctctataaatgcaatatttttaaaatgaatttatttttaaaatttctgaaattgaaaaatttaaatagtgccatttttgcatgttaagtatcattagcactagatatgttttttccatgcctttattgccttatttgtaaaaaaatatcccarcatcattgtgccgagatatttatatcattacaattgattatctgtttcttnccggtgttt

SEQ ID NO: 109 - DNA, 17846 bp; double-stranded, linear
tgccaaactaccttttgacagtcgttgctgtacttcaggatgatcaatcacatatnttactttatcaaatagggcatcttcatcatttttagtaattaaataaccattgaaatctgaagtaatcagttcgttaggtccatatttaatatcataactaataactggaacaccatgtgctaaagattcaagtagcgctaaagagaaaccttccatgttacttgttattaaactcaaataggcatcgctatattcttggtctagattgcttaaaaagccgcgtaagtaaacatgattttccaatccatatttttgtatcaattcatttaattttttactttcagaaccaaaaccatacatatgaagctctatttttgggacatacgatactaagcgtttaattaattcaatttgttgatgtaattgtttttcaggtgaataacgagcaacggaaattaatttaacactgcgctgatctaatgtttggactggtgtatcaattgtttcactatagccgacaggaatattaacaactggaatagtatggttaatacgtttttcaacatctaatttttgctgctcagtagaaacgataattgcacgatatcgagataaattttcaaacatcgctttatatacatttttaaatggcgatgaatctaatgcatcaatatttttaatgtgtgtactgtgaagcacagctactactgggattgactcaggcgttaagttgaaaataggtgctgtgtacacattacgatcactgaaaaataaatccccatgttgatatagttgtttaatgaaaaatgcgcctaattccgtttcattattaaagaaatattgtttgttagcatagtaaacaataattttttgtacttctggtttgccatccttgtaagaaaaatacttttctaattttgtgtcaccttctggattatagaaaaattcacataatgtttgttgtttatcaacaagaatcctactacaacttaaaaagccacgcacatcataaaaatcacgttttacttttcgtctttgactatcaaaatgatttacataatctaatatacgatatttaggatcttgaaaatgggcatacattaagaaacgctcttgatcatatattctaaagtcatgactattttcaacatgttttaaagtataatgacattcatcagtccaatacgacaaccagtcaaatggttcattgcgttctaaatatgttgcttcttggaagaaatcatacatattaatatagtcagaactagtaatataattttgggcatttctatataaatatctattccatgacagaaatacacattgcgctggtcttcccatttctttaaataaatttaaacgattaataattgctttctctatcccagttaaattaacacctaaactattacctacaaaataattcatttacaacaccacttatatctattttttataattatatcacataatatttaattacttcttttaactggaagatgtgtttatttataaaacaacaaattttgatatttataatgatagtagttattcaatcactacgacccaatatatcatkgtagagcttaggatattgatttatgactcaggcacatcaaatgagaggatttataaargagatatacaactctagaaggtataataaaaacgcgcaactaatgttacgcgtttgaattaatcatatgatattatttgcgatactttaatttagcgaaagcatcatgttgatggatagactcttcattacgacattcgatatcgaaaccgtctaaccaatcaaattcaactaagtccgcggcaattaaacgaattaagtcttcgacaaaacgtggattttcatatgcacgctctgtcacacgtttttcatcaggacgttttaaaatagggtatagaattgaacttgcattagcttccattgcatctaaaattttatttttatagtcatcaactatgtcttgatctttattaatatatgttttaacagtgacaacaccacgttggttgtgcgctgaatactcacttatttcttttgaacaagggcatagcgttgtgacagttgcttcaatagtaagttctttacgtgtanctttatcaccgtcaattgctaatccataagtgacatcggcattaccaactgctttaatatttgtggttggactatagcgatcaaagaaccatttcccagaaacatcaacgcctgccgcattttgtttcatattcgtttgtaaagtgcgtaacacctgataaagtgtattaaattcaagttcaataccattatcatagtgcttttcaacactttcgattatacggctcatattaatacctttttcgtcttttgttaaacttgttgaaaaactaaatgtgccagctgtttgatactggtcaacaagtacagggtacactaagtttttaataccaacttcttctatttcaaataaaaaatctttatgtgtactttgtaaatctgtcatttcgttcttagtagtaggtttcgtgccttcaataggatctacggaaccaaagtgtttccaacgaccttctcgtgtcgataaatcaaattcagtcatttttttcctccgttaagatttaaagtgatatgtccaatatggttcgactgttaaaaagctgtgttgtttaccatcgatttcaggacttgctaattgttttaaaaatggacctgtttgagaagcatgtgcttcaaatgccttaattttaagttctttaaaatctgtaatatcattttgaatatcaggttctccaagagcttcggttgcatcattactgaacgcaactaaagttaaacgagggcgttcttctttaggcatgcgttcaaccgttcgaattacagcgtctgctgttgcttcgtgatcaggatgtactgcatatccaggataaaatgaaataatcaatgatggatttgtatcatcgattaaagatttaatcataccatctatatgttcatagggttcaaattcgacagttttgtcacgtaaacccatttttcttaaatcagtaataccgataactttacaagcttcttctagttcacgctcacgaatacttggtaatgattcgcgtgttgcaaatgggggattacctaaatttctgcccatttgtcctagggttaaacatgcatatgttacaggtatgcctttttggatataatttgctaatgtgcctgcagatgagaaggtttcatcatcaggatgtggaaatattactaatacatgtctttcgtcagtcatgttgatgcctcctctataaattaaatggtcgctcactaatttgaagtgctgcagcgagttgaccttcgtaattaaaacctgcaattaaaaattcatcatgctcattgacctcaaaatgcgttagaccttgtacataaacccaaccaccatttgatagtttaagaccaatgcgataaggttctttattaccaccttttagttgtgcatgcgtatatgttatttgtatgtttcttaaaaaagtaccagcattaaaaacacgttgatcgaaatggttcgcataggccccatttgtcgtttcaacatgcagatacacaggtttatgttcaaaagaagcaagtaaatctataacttcttgttctttaattggttccaacacgttcactccttacactatcaatgtgtttatctttctattttactaaaaactattcgataattgtatacgattgctcaattatttataaattaattttcatgaagggtaattactcaggattacgtaatcatacagcattagttttttacttttaaaaatcaaaaatttgttggaatttgaaaagtgttaaacattaaaaatgatgctatattaatggtgtatgaatgaattcataagtttttaaaatgtattaaatttgtggaggcatgtaaacaatgaaagtattaaacttaggatcgaaaaaacaagcatcattctatgttgcatgtgagttatataaagagatggcatttaatcagcactgtaaactaggtttagcaactggtggtacaatgacagatttgtatgaacaacttgttaagttgttaaataaaaatcagttaaacgtagacaatgtatccacgtttaatttagacgaatatgtaggtttaaccgcatcacatccgcaaagttatcactattatatggatgacatgcttttcaaacaatatccttattttaatagaaagaacattcatattccaaatggagatgccgatgatatgaatgcggaagcgtgcaaaatataatgacgttttagaacaacaaggtcaacgtgatattcaaattttaggtattggtgaaaatggtcatattggatttaatgaacctggtacgccgtttgatagcgttactcatatcgttgatttgactgaaagtactattaaggctaatagtcgatattttaaaaacgaagatgatgttccaaagcaagccatttcgatgggacttgctaatattcttcaagccaaacgtatcattttactcgcatttggtgaaaagaaacgtgctgctattacacatttattaaatcaggaaatttctgttgatgttccagccacattacttcacaaacacccgaatgttgagatatatttagacgacgaagcttgcccgaaaaatgttgcgaaaattcatgtcgatgaaatggattgattgcaatgtttaattaagaaatgcctcgggaaaggttccaatagaaagataaaaagcattggaaggatgatttttagtggaattacaattagcaattgatttattaaacaaagaagacgcggctgagttagcaaataaagtaaaagattatgtagatatcgtagaaatcggtacgccaatcatttacaacgaaggtttaccagcagttaaacatatggcagacaacattagtaatgtaaaagtattagcagacatgaaaattatggatgcagctgattatgaagttagccaagcaattaaatttggcgcggatgtaattacaatactaggtgttgcagaagatgcatcaattaaagcagctattgaagaagctcataaaaataataaacaattactagttgatatgattgctgttcaagatttagaaaaacgtgcaaaagaactagatgaaatgggtgctgattatattgcagtacacactggttatgatttacaagcagaagggcaatcaccattagaaagtttaagaaccgttaaatctgttattaaaaattctaaagttgcagtagcaggtggaattaaaccagatacaattaaagatattgtcgctgaaagtcctgatcttgttattgttggtggcggaatcgcaaatgcagatgatccagtagaagctgcgaaacaatgtcgcgctgcaatcgaaggtaagtaatatggctaaatttagtgactatcaattaattctagatgaattaaagatgactttgtcacatgttgaagcggatgagttttcaacttttgcatccaaaatactacatgctgaacatatatttgtagctggcaaaggacgttcaggattcgtggcgaatagttttgcaatgcgcttaaatcagctcggcaaacaggcacatgttgttggagaatcaacgacacctgcgattaagtcgaatgatgtatttgtaattatctctggttcaggttccacggaacatttaagattattagcagacaaagcaaaatcagtaggtgctgacatcgtattaattactacaaataaagattctgcaataggcaatctagctgggacgaacatcgttttgcctgcaggtacaaaatatgatgaacaaggctcggcacaaccattaggaagtttgtttgaacaagcatctcaattatttttagatagtgttgtaatgggattgatgactgaaatgaatgttacggaacaaacgatgcaacaaaatcatgctaatttagaataaaataaagatagtcgataatatgatgcctaggcagaaatattatcgattatttttttatttaaataataaattatagtataatatcaataataaacgaataggggtgttaatattgaagtttgacaattatatttttgattttgatggtacgttggcagacacgaaaaaatgtggtgaagtagcaacacaaagtgcatttaaagcatgtggcttaacggaaccatcatctaaagaaataacgcattatatgggaatacctattgaagaatcatttttaaaattagcagaccgaccattagatgaagcagcattagcaaagttaatcgatacatttagacatacatatcaatctattgaaaaggactatatttatgaatttgcgggtataactgaagccattacaagtttgtataaccaagggaaaaaacttttcgtggtgtctagtaagaagagtgatgtattagaaagaaatttatcggctattggattaaatcacttgattaccgaagctgttggatccgatcaagtaagtgcatataaaccaaatcctgaaggcatacacacaattgtgcaacgctacaatttaaatagccaacaaacggtgtatattggtgattcaacgtttgatgttgagatggcacaacgtgctggtatgcaatctgcagctgtcacttggggtgcacatgatgcaaggtcattacttcattcaaatccggattttattattaatgatccatcagaaattaataccgtattataaaacttgttaaaacagagaataccatggttaaaatgcatattcataaatattagattatacttagaaatatttcgctttagattaggaatttaaaataaatatttattaaacattatgaatttttaaagagtaatgtctgactcgttgataatttatttttgtaaaaataaattaaagtaatgacaaagttattgaagtaaattgagtataaacatttaaatacgatgtcgaaaatggcgatagcatatcacttacatgaagttgtgtgctatcgctatttttagttataattccaaaaagttaatcgttcgatgatttaagaattattattgtttaattcaaatgtatgagggtataaaatcattgaatttaattcgataaagcgaaatttttgaacaaacatacttttgtatttatataaaagtttaaattcttataaatttgacaaaactaattaactccgtataattatgaaacatacaagagggagtgtatgaattcatggattttaataaagagaatattaacatggtggatgcaaagaaagctaaaaaaaccgttgttgcaaccggtatcggtaatgcaatggaatggttcgattttggtgtctatgcatatacaactgcgtacattggagcgaacttcttctctccagtagagaatgcagacattcgacaaatgttgactttcgcagcattagccattgcgtttttattaagaccaattggtggtgtcgtatttggtattattggtgacaaatatggacgtaaagttgtattaacatctacaattattttaatggcattttcaacattaaccattggattattgccaagctatgatcaaattggactttgggcaccaatactattattgcttgcaagagtactacaagggttttcaacaggtggagagtatgcgggggcaatgacatatgttgccgaatcatctccagataagcgtcgtaactcattaggtagtggactagaaattgggacattatcaggttacatagctgcttcaattatgattgctgtattaacattctttttaacagatgaacaaatggcatcatttggttggagaatcccattcttactcggtttattcctaggattattcggcttatatttacgtcgtaagctggaagaatcaccagttttcgaaaatgatgttgcaacacaaccagaaagagataacattaactttttacaaatcatcagattttattacaaagatatatttgtatgttttgtagctgttgtattcttcaatgttacaaactatatggtaactgcatatttaccaacctatttagaacaagttattaaattagatgcaacgacaacaagtgtattaattacttgtgtcatggcaataatgattccattagcattaatgtttggtaagttagcggataaaataggtgaaaagaaagtatttctaattggtactggtgggctaacattattcagtatcatcgcatttatgttattacattcacaatcatttgttgtaatagtaatcggtatatttatattaggatttttcttatcaacttacgaagcgacaatgccagggtcgttaccaacgatgttttacagtcatataagatatcgaactttatcagtaacatttaatatctctgtttcgatatttggtggtacgacgccattagtkgcamcatggttagttacgaaaactggagatccattagcmcctgcgtattatttaacagcaatcagtgttattggctttttagttattacattcttacatttaagtacagcaggaaaatctctaaaaggttcgtatccaaatgtagataacgagcaagatagagcttattatgcagaacatccaaaagaagcattatggtgggttaaagaacgtaagaattagagattttaataaaaagtataaatcaatcgtatataagcactttaaagctagtaggttctgctaactttaaagtgctttttaaattgagaactgtaattagccgtaataaagtttttgtatatacataaacccccactgcaatgattatcgcaatgggggaaagaggggacttaaagcatatgtttagctttgaatacttaaaattctcttgctattgaaatgttaggatgtaaatatgtcttagagtattttgtccaacgcaattaatattgagactctaaccttcaatattattatagagaacacaaacttaaatagattgggtgacttatttgtgtcagttattgcgattgcgataacttcttttctctatatacatatagtaacgtcttatctaataaaaaacatggtactacagtatcaaatttatctagggcttaagtttgatttttataataggcaggtttacctgataaaaatacttattcattatataatgttaacaatatgtattttaaagtttacattgagtgagggatattgatgaacgtaattttagaacagttgaaaacacatactcaaaataaacctaatgacatagcattacatatcgatgatgaaacaattacatatagtcaactaaatgcccgcatcactagcgcagttgaatctttgcagaaatattcacttaaccctgtcgttgctattaatatgaaatcaccggtgcaaagtattatttgttatttagctttgcatcgtttacataaagtgcctatgatgatggaaggtaaatggcaaagtactatacatcgtcaattgattgaaaaatatggtattaaagatgtaattggagatacaggtctcatgcagaatatagactcaccgatgtttattgattcaacgcaattacagcactaccccaatttattacatattggttttacttcagggacaactggactgccaaaagcatattatcgtgatgaagattcatggttggcttcttttgaagttaatgaaatgttgatgttaaaaaatgaaaatgcaatagcagcccctggaccactatcgcactcgttaacattatatgcgttattgtttgctttaagttccggtcgtacttttataggacagaccacttttcatcctgaaaagttacttaatcaatgtcataaaatatcatcatacaaagttgctatgtttcttgttccaacgatgattaaatcattattgttagtttacaacaatgaacatacaatccaatcattttttagcagtggagataagctgcattcttctatttttaaaaagataaaaaatcaagcaaatgacataaatttgattgaattttttggtacatcggaaaccagttttatcagctataacttgaatcagcaagcaccagttgaatcagtaggtgtgctatttccaaatgtggaattgaaaacaacgaatcacgatcacaatggtataggaactatttgtataaaaagtaatatgatgtttagtggctatgtaagtgaacaatgtataaataatgatgaatggtttgttactaatgataatggctatgtaaaagagcagtatttatatttaacgggacgtcaacaggatatgttaattattggtggtcaaaatatatatccagcacatgttgaacgccttttaacgcaatcttcgagcattgatgaagcaattatcatcggtattccaaatgagcgttttggtcaaataggcgtattgctttattctggtgatgtgacacttacacataaaaatgtaaaacaatttttaaaaaagaaagtgaaacgntatgaaattccatcgatgattcatcatgtagaaaagatgtattacactgcaagtggtaaaattgctagagaaaaaatgatgtcgatgtatttgagaggtgaattataatatgaatcaagcagtcatagttgcagctaaacgaactgcatttgggaaatatggtggcactttaaaacatttagagccagaacaattgcttaaacctttattccaacattttaaagagaagtatccagaggtaatatctaaaatagatgatgtagttttaggtaatgttgttgggaatggtggcaatattgcaagaaaagcattgcttgaagcggggcttaaagattcaatacctggcgtcacaatcgatcggcaatgtgggtctggacttgaaagtgttcaatatgcatgtcgcatgatccaagccggagctggcaaggtatatattgcaggtggtgttgaaagtacaagtcgagcaccttggaaaatcaaacgaccgcattctgtgtacgaaacagcattacctgagttttatgagcgtgcatcatttgcacctgaaatgagcgacccatcaatgattcaaggtgctgaaaatgtggccaagatgtatgatgtttcaagagaattacaagatgaatttgcttatcgaagtcatcaattgacagcggaaaatgtaaagaatggaaatatttctcaggaaatattacctataaccgttaaaggagaaatattcaacactgatgaaagtctaaaatcacatattccgaaagataactttggccgatttaagcccgtgatcaaaggtgggaccgttaccgctgcgaatagttgtatgaaaaatgatggtgcagttttattgcttattatggaaaaagatatggcatacgaattaggtttcgagcatggtttattatttaaagatggtgttacggtaggtgttgattctaattttcctggcattggtccagtaccagccatttccaacttactaaaaagaaatcaattaacgatagaaaatattgaagtcattgaaattaacgaagcgttcagtgcacaggtagttgcctgccaacaagctttaaatatttcaaatacgcaattaaatatatggggtggtgcattagcatcaggtcatccatacggtgcaagcggtgcccaattagtgactcgattattttatatgtttgacaaagagactatgattgcatctatggggatagggggaggtctaggaaatgcagcattatttactcgattctaaccagcgattaaatgtgtcattttctaaggatagtgtggctgcatattatcagtgttttaaccaaccttatagaaaagaagtaccaccattaatgtgtgcgtcattatggccaaaatttgatttatttaaaaaatatgcaaatagcgaactgattttaacaaaatcagcaattaatcaaactcaaaagatagaagtagacacaatatatgtagggcatttagaagatattgaatgccgacagactcgcaatatcacacgttatacaatggctttaacattaactaaaaatgatcaacatgtcataacggttacacaaacttttattaaggcgatgaagtagagatggagtttaatgagatatggataaatgaatatttggcgctcgtaaatgatgataatccaatacataatgagattgtgccaggacaattagtgagtcaaatgatgctgatggctatgtcattagagacaaaccagtgtcaaattaactacgttaaacctattttaataaatgaaaatatcgaattcattgaacaacacgaacacgaaattatagcaattaatgacgatggagagattaaaataaaaatttctttgagcacaaaaaaataaccgatattagctgcatgaacgcatattaattaggagatgaaaggacagctaatatcagttatgtattgttattattattgggaacagagatgaatataggttacgtttctttctttgcacggggatgcattaatctaaaataataataacaactatatcaatgtttaataaattctggattattggaacgattagtcaatttaactaactttcatatgatctatatcgtcttgtaataaagagagcaatttgaatatttcagtatcactaaatgaatcgtcacatttaattgaaacatgctgaaacgttttggttataatttcataaactggtgcgccttcatggtgatactgtcgataaataatcataacctatattacctcctttgctactctatggttatattataaataacatttttatgtgtgacatcaaccttaagtatcaactttttatcagacatagaacgtatgatttactaagactatttatgtataaaagttctaaataaatatatatttatagagtcgcctggcagtcatttgggaaatataacatatatgattagagaggcatctatcgcaaaagaatgataatgatagaggtattgagcatatagatgagtttaagttcatcttgaaaataaagggttatttagtcatagatgtagatgtataggaaatatttgtatgtattgttcgatatgtatgaaattttcaataaaagctaataacgcttatatgtaactttcaaatttaaattatatacagagcatgatgattataaaaaaataaccacatcacataaattgagttcatacccaatttaagtggtgtggctaataatgttgatttatagatgaaccgcctaatcgttaaacctctgttacttcaacatcgatatgttcaatacggttgtatgcaccgtgatccacaggaccaacaaaatcattcattttccaaccgtttttaatagcagaagcgacgaaagctttcgcgctaatcacagcttctttcggtgacttaccgttagctaaatatgcagttgttgccgcagcaaatgtacaaccagcaccatggttataactttgttggaacatgtctgttgttagttgataaaatgtttgaccatcatagtataagtcatacgatttatcttgatctaaagctttgccacctttaatgatgacatgctgtgcgcctttatcaaagataattgttgcagcctttttcatatcttcaattgaatttaatttacctaatcctgataattgacccgcttcaaataagtttggtgtcactaccgttgctttaggtagtaaatatttaatcatcgcctcagtatttccaggattaagcacttcatcttcgcctttacaaaccatgacaggatctactacaaaatattgtgcattagatgcctcatatacttctccagcacgtttgattatctcctcagtacctaacatacctgttttaatagcatcaggtccgattgataaagccgtttcaagttgtttttcaaatacatccattggtaatggtgtaacatcgtgtgaccatgtatctttatccatagtaacgatggcagttaaagcgaccatgccatacgtatctaattcttggaacgttttcaaatctgcttgcatacctgcgccagcacttgtgtcagaaccggcaattgttaaaactttctttaaagccattgagcttcactcctacataataatattgtattcatcatatcatttttaacctaattgaaaaatattaagcattcaatatttgatgattgttgaaatgaatcattcatactattgtaacttttgaaaatgtcattcactttagataagtgtgatatgttaaaatatgtcctgaggtgagattgaatggaatggtcgcaaatttttcatgacataacaacgaaacatgactttaaagctatgcatgattttttagaaaaagaatattcgactgcaatcgtataccctgatagggaaaatatatatcaagcgtttgatttaacaccgtttgaaaatatcaaagttgttatattaggacaagacccgtatcatggtccaaaccaagcacatggattagcattttcagtgcaacctaacgcaaaattccctccatctttacgtaatatgtataaagaattagcagatgatattggatgcgttagacaaacaccgcatttacaagattgggcaagagaaggcgtcttgttattgaatacagttttaaccgtaagacagggtgaagcaaattctcatcgtgatattggttgggaaacatttactgatgaaattattaaagcagtgtctgattataaagaacatgttgtctttattttgtgggggaaacctgcacagcaaaaaataaagcttatcgatacatctaaacattgtattataaaatcagtgcatcctagtccactgtctgcatatagaggattctttggatcaaaaccgtattccaaagcgaatgcctatttagagtcagtaggaaaatcaccaattaattggtgtgaaagtgaggcgtagatgttgaatagagaaactttaatagcacgaattgagcaagaattagtacaagcagagcaggcacagcatgaccatgactttgaaaaacatatgtatgccatacatatattaacatctttatatgcttcaacatcaaatacaccacatattggtgaacaacaaatgaatcgtcgtattgctaaccataatcaaatgccacaatcacaaataacgcagccaactcatcaagtgacagttgctgaaattgaagcgatgggtggtaaagtaaatacgcattcagcacatcatcataataagtcatattcacaaccttcaaaccaacaacaaagattagcgacagatgatgacattggcaatggtgaatccatatttgatttttaaaaagcaacaatgaaacataattacttaatagcttgttaagtatgtaggttaataatcaagacgcatatacttttattcgagtgttcggatttaaacatttattaatactgaattatataaggagaggtagcaatgaaattatttattattttaggtgcattaaacgcgatgatggctgtcggtacaggtgcatttggtgcgcatggtttacaaggaaaaataagtgatcactatttatcagtatgggaaaaagcaacgacgtatcaaatgtaccatggcttagcattattaattataggtgtaattagtggtacaacttcaatcaatgttaactgggctggctggttaatatttgctggtattattttctttagtggatcattatatattttagtattaactcaaattaaagttttaggtgcgattacgccaattggtggcgtattgttcatcattggatggataatgttaatcattgcgacattcaaatttgctggttaaattttaaaactttagattacctatgtaactaaacattaaatttttaataaaaataatcaagaaaaagagttacaaactcatcttttgggtatagaataccttcgaggtgagtttttatttatggaaaaaaagaataagcaaatagatagaggcgatttaaaacaaaacctatctgaaaagtttgtatgggcgattgcatatggttcatgtatcggatggggcgcattcatcttaccaggagactggattaagcagtcaggtccgattgcagcatcaattggtatagttattggtgcattattaatgatattaattgcggttagttatggcgcattagtagagagatttccagtatcagggggcgcgtttgcctttagtttcttaagtttcggcagatatgtgagtttcttctcatcatggtttttaacttttggttatgtctgtgtcgttgctttaaatgcgaccgcattcagtttactagttaaattcttattgccagatgtcttaaataatgggaaactatacaccattgcgggctgggacgtttatattacggaaatcattattgcgaccgtattactacttgtattcatgctagtaacgattcgtggcgcaagtgtatctggatcattacaatattatttctgtgtggcgatggtaatcgtcgtattattgatgttctttggttcattctttggtaataattttgcacttgaaaatttacaaccgttagctgaacctagcaaaggatggttagtgtctattgtggttattgtatccgtggcaccatgggcatatgttggatttgataatattccacaaacagcagaagagtttaactttgcaccaaacaagacatttaagcttatcgtgtacagtttattagcagcatcattaacttatgttgtcatgattttatacactggttggttatcaacaagtcatcaaagtttaaatgggcagttgtggttaacaggtgctgttacacaaacagcatttggttatattggattaggtgtattagcaattgcaattatgatgggtatatttactggtttaaatggattcttgatgagttcaagtcgcttgttattttctatgggacgttcaggtattatgccaacaatgtttagtaaattacatagtaaatacaaaacaccatatgtcgcaatcatattcctagtaggagtgtcgttaattgcaccttggctaggaagaactgcattgacttggattgtagatatgtcatctactggtgtatccattgcctactttattacatgtttgtctgcagcgaaattattcagttataacaaacaaagtaatacgtatgcaccggtttacaaaacgtttgctattatcggctcatttgtatcattcattttcttagcgttgttattagtgccaggttctcctgcagcactgactgcaccgtcttatattgcattacttggatggttaatcatcggtttaatattctttgtgattcgatatcctaaattgaaaaatatggataatgatgaattaagtcgcttgattttaaatagaagtgaaaatgaagttgatgatatgattgaagaacctgaaaaagaaaaaactaaataataaaagaatcgcacaataaaccttcttcattcggaggcgtatcgtgcgattttttgtattataaattgacatttaagacgaggcagctgaaccttatatataattgctaagagttagggctgagccatttctaacaaatatttataatcgtttaaaagatttcacgaacccagaaacaattaatttggaaatttggtcggcgaataataaacctaatgcgatggcgcctgcaataagtgtaacctctagcatggtattgattgctgtactgaaatttaataagactaaattttttgtagcatcgtatgctaagccaccaggtactaatggaatgatacccgttaccataaaaatgatggcaggttctttttgtttacgagccatataatgacttaacaagcctaatgctaaactaccaaagaaactagagtatatagtgtgcacattaaagccgttgaagaataaggtgtaaaccatccatccacacgtaccaacgaaaccacatgatagatataattttctaggtgcatcaaaaatgacgcagaa

SEQ ID NO: 110 - DNA, 5544 bp; double-stranded, linear
attgacacttggtgaaagtaatatcgccgcgctattttggcaaaatggacacttagaacctgagttacaagatgaacagccaattaatatattaggatctgktcaaatcaacgaatggaatggtaatcaatcaccgcaaataattattcaagatattgcgatgaatgaacagcaaatattagattatagaagtaagcgaaaaagtttaccttttacagaaaatgatgaaaatattgtcgtgcttattcatcctaaaagtgataaagtaaatgcgaatgaatattattatggtgaagaaattaaacaacaaactgataaagtagtattaagagatttaccaacgtcaatggaagacttgtctaattccttgcaacaactgcaattttctcaactttatatagttttgcaacataatcattcgatttacttcgatggtatacctaatatggatatttttaaaaagtgttataaagcattaataactaaacaagaaacaaatatccagaaagagggtatgttattgtgtcaacatttaagtgtgaaaccagatacacttaaattcatgttgaaagttttcttagacttaaaatttgtaacacaagaagatggtttaattcgaatcaatcaacaacctgataaaagatcgattgattccagcaaagtatatcaattaagacaacaacgtatggatgttgaaaagcaattattatatcaagatttttcagaaataaaaaattggataaagtcacaattgtcgtgagcaatttaggaggaaatattaatggatttaaagcaatacgtatcagaagttcaagattggccgaaaccaggtgttagtttcaaggatattactacaattatggataatggtgaagcatatggctatgcaacagataaaattgtagaatacgcaaaagacagagatgttgatatcgttgtaggacctgaagcgcgtggctttatcattggctgtcctgtagcttattcaatggggattggctttgcacctgttagaaaagaagggaaattacctcgtgmagtcattcgttatgagtatgacctagaatatggtacaaatgttttaacaatgcacaaagatgcaattaaaccaggtcaacgtgtgttaattacagatgatttattagctactggtggtacgattgaagcagcaataaaattagttgaaaaattaggcggtatcgtagtaggtattgcatttataattgaattgaaatatttaaatggtattgaaaaaattaaagattacgatgttatgagtttaatctcatacgacgaataataaataatataattttatcaaatgaaatccttcatcaaatgtataagaaccaatgacttaattaaaaaagttgtttaagttttcttaacatgagatgttaggattttttatttactgaaaatgttagatgattgagcattataccttaataacatcgtttatttatttcataaattgtagtatcatagaactaatatttaaaaaatgaaacagtagatttaggtcgaatttttgtaaaagttttaaaagtaggaatagtatacaaattaaactcgctcaagtaaaattaatattacgattaatgacgacaggataaatatttatcgtcgacggacgtatgattggtgtgggacaaatactattcaacaagagtacctaaatcattgtttaaggcgaagtaataaatatgaatggggtgtatcatataatgaacaacgaatatccatatagtgcagacgaattcttcacaaagcaaaatcatatttgtcagcagatgaatatgagtatgttttaaaaagctatcatattgcttatgaagcacataaaggtcagttccgaaaaaacggattaccatacattatgcatcctatacaagttgcaggtattttaacagaaatgcgattagacggaccgacgattgtcgcaggttttttgcatgatgtaattgaagatacaccgtatacatttgaagatgtaaaagaaatgttcaatgaagaagttgctcgaattgttgatggtgtgacgaagcttaaaaaagtaaaataccgctcaaaagaagaacaacaagctgaaaatcatcgcaagttatttattgcgattgccaaagatgtacgcgtaattttggtgaaattagcagacagattacataatatgcgtaccttgaaagccatgccgcgcgaaaaacaaattagaatttctcgagaaacattagaaatttatgcaccattagcacatcgtcttggtattaatacaatcaaatgggaactagaagatacggctcttcgttatattgataatgtgcaatattttagaatagtcaatttaatgaagaagaaacgtagtgaacgtgaagcgtatatcgaaacggctattgatagaatacgtactgaaatggaccgaatgaatatcgaaggcgatataaatggtagacctaaacatatttacagtatttatcggaaaatgatgaagcagaaaaaacaatttgatcaaatttttgatttgttggcgatacgtgttattgtcaattctattaatgattgttatgcgatacttgggttggtgcatacgttatggaaaccgatgccaggacgttttaaagattatattgcaatgcctaaacaaaatttgtatcagtcattgcatactacagtagtaggcccaaatggagacccgctcgaaatccaaatacgaacgtttgatatgcacgaaattgctgagcatggtgttgcagcacactgggcttacaaagaaggtaaaaaagtaagtgaaaaagatcaaacttatcaaaataagttaaattggttaaaagaattagctgaagcggatcatacatcgtctgacgctcaagaatttatggaaaccttaaaatatgacttacagagtgacaaagtatacgcatttaccccagcgagtgatgttattgagttgccatatggtgctgtgccgattgattttgcttatgcgattcacagtgaagtaggtaataagatgattggtgccaaggtgaatggcaaaattgtaccaattgactatattttacaaacaggcgatattgttgaaatacgtactagtaaacattcatatggaccaagtcgtgattggttgaaaattgttaaatcgtctagtgccaaaggtaaaattaaaagtttcttcaaaaaacaagatcgttcatctaatattgaaaaaggccgaatgatggttgaagctgaaataaaagagcaaggatttagagtcgaagatattttgacagagaaaaatattcaggttgttaatgaaaaatataactttgcaaatgaagatgatttattcgcagctgtaggatttggcggcgtgacatccttacagattgttaataaattaactgaaagacaacgtattttagataaacaacgtgctttaaatgaagcacaagaagttacgaaatcattgcctattaaagacaacatcattactgatagtggtgtctatgtagaaggtttagaaaatgtacttatcaagttgtcaaaatgttgtaatcctataccaggtgatgatattgtaggttatatcaccaaaggtcacggtattaaagtacatcgcactgattgcccaaatattaagaacgaaactgaacgactaattaatgttgaatgggtaaaatcaaaagacgcaactcaaaaatatcaggttgatttagaggtaatgcgtatgaccgaaatggcttgttgaatgaagtactacaagctgttagctcgacagccggcaatttaattaaagtttcaggacgttcagatattgataaaaatgcaataataaatattagtgtcatggtgaaaaacgtgaatgatgtttatcgtgtggtagaaaagatcaaacaacttggtgatgtttatacagtaacaagagtttggaactagaggtgcaaaatatgaaagtagttgtacaaagagttaaagaagcatcggtgacgaatgatacattaaataatcaaatcaaaaaaggatattgtttattagtcggtatcggtcagaactctacagagcaagatgcagatgtaattgcaaagaaaattgctaatgcaagattatttgaagatgacaataataaattaaactttaatatccaacaaatgaatggtgaaatactatcagtttcacaatttactctctatgcagatgtaaaaaaaggtaaccgtccaggtttctcaaattctaaaaatcctgatcaagcggtaaaaatttatgagtattttaatgcatgcgctacgagcgtatggtcttactgtgaaaacaggtgaatttggaacacacatgaatgttagcataaataatgatggtccagtcactattatttatgaaagtcaggacggcaaaattcaatgaaaaaaatagaggcatggttatctaaaaagggtcttaaaaataaacgtactctaatagtagtgattgcctttgtcttatttatcatctttttatttttattgctgaatagcaatagtgaagatagtgggaacatcacgataactgaaaatgctgaattacgtacaggtccaaacgctgcgtatccagtcatatataaagttgaaaaaggtgaccattttaaaaagattggtaaagtaggtaaatggattgaagttgaagatacatccagtaatgaaaaaggttggatagctggatggcacacaaatttagatattgtcgcggataatacgaaggagaaaaatcctttgcaaggtaaaacaatagtgcttgatcctggtcatggaggtagtgaccagggtgcttcaagcaatactaaatataaaagtttagaaaaagattatacgttgaaaacagcaaaagaattgcagcgtactttagaaaaagaaggcgcaactgttaagatgacaagaacagacgatacatatgtttcactagaaaatcgtgatatcaaaggcgatgcctatttgagtatacataatgatgcgttagaatcatctaatgcaaatggaatgacagtttattggtatcatgataatcaaagagctttagcagatacgttagacgctacgattcagaagaaaggtctactttctaatcgcggttcaagacaagaaaattatcaagtgttaagacaaacaaaagttcctgctgttttattagaattaggttatattagtaacccaactgatgaaacgatgattaaagatcaattacatagacaaattttagaacaagcaattgttgatggccttaaaatttatttttctgcgtagggcttgcaaaaatatgtgaaagtagttatcattgatattgaattttataactaaaaccgttagtattcttgaaatggtaaatgaaataggtagcaatctaactaagattgtgtaggaatataatccatagactgaaagattatgctgagtagtttatatacattgaacacaagaagaggtgctttatgaaaagtaaagccgttaaacgtacgttaaacgttttgagtgggtttattaaatgcacgcttataaaaagtaatgatgattacaattaggcatgttttttaaacca

SEQ ID NO: 111 - DNA, 1067 bp; double-stranded, linear
aaaagattgcaaatataaatggcatgtttaatatgttagaacaacaaatcattcatagccaagatatggctcattttagaagtgaatttttttacgtcaatcatgagcatcgagaaaactatgaagcactcctaatttattacaaaaatagtatcgacaatcctattgtagatggtgcatgttatattttagccctacctgaaattttcaatagtgttgatgttttcgaatcagagttaccattttcatgggtatatgatgaaaatggcattaccgaaacaatgaaatcacttagcattccattacaatatttagttgcagcagctttagaagtaactgatgtgaatatatttaagccttcaggatttacaatgggaatgaataattggaatattgctcaaatgcgaatcttttggcaatatacagcaattattagaaaagaagcactataacattaataattaattagctataaagatgattcacaacaatcatctttatagcttttttatgtctaattatttttgaggaaaatmacaatcgttattctatgttattattagtaaattaaatgtaaatgattttgttaggatgtggaggaattttatgttttcaaaagtaaacaatcaaaagatgttagaagattgcttctatataagaaagaaagtgtttgtagaagaacaaggcgtccctgaggaaagtgaaattgatgaatatgaatctgaatctattcacctcattggatatgataatggacagccagttgccactgctcgaatacgccctattaatgaaacaactgtcaaaatagaacgagtagctgtgatgaaatcacatcgtggacaaggaatgggtagaatgcttatgcaagctgtagaatcattagctaaagatgaaggtttttacgtagctactatgaatgcccaatgtcatgctatcccattttatgaaagtttaaactttaaaatgagaggtaatatatttcttgaggaaggcatcgagcatattgaaatgacaaaaaagttaacctcgcttaattaaaaaaagttgtatctattttagaaaca

SEQ ID NO: 112 - DNA, 18613 bp; double-stranded, linear
aagacgtatgataacaacaatacgtgtagtgaaagattttaatctacatattactgacaaagaattcattgtatttgttggaccatcgggatgtggtaaatcaacaacattacgaatggttgctggactagagtctatcacatctggagatttttatattgatggggaacgcatgaacgatgttgaaccaaagaatagagatattgcgatggtatttcaaaactatgcattatatccacatatgactgtttttgaaaatatggcatttgggctaaagctacgtaaagtaaataaaaaagagattgaacaaaaagttaatgaagcagctgaaatattaggattaactgagtatcttggtcgtaaaccaaaagcgttatctggcggacagcgtcaacgtgttgctttgggcagagctattgttagggatgcgaaagtctttttaatggatgaaccattatcgaatcttgatgcgaayttcgagtacaaatgcgcacagaaatattgaaattacataagcgacttaatactacgacaatttatgttacacatgatcaaactgaagcattgacgatggctagtcgaattgttgttttgaaagatggcgacattatgcaagtcggcacacctagagaaatatatgatgcccctaattgcatatttgtggcgcaatttatcggctcaccagcaatgaatatgttgaatgctacagttgaaatggacggattgaaggtaggaacacaccattttaaattacataataaaaaatttgaaaagttaaaagctgctggctacttagacaaggaaattattttaggtattcgagctgaagacattcatgaagaaccaatatttattcaaacttctccagagacacaatttgaatctgaagtagttgtatccgaactgttaggttcagaaattatggtacatagcacattccaaggaatggaattgatttctaaattagattcaagaactcaagtgatggcgaacgacaagattacactagcatttgatatgaataagtgtcacttttttgatgaaaaaacaggaaatcgtatcgtctaagggggagtattcatgtctaaaattttaaaatgtatcacgttagccgtggtaatgttattaatcgtaactgcatgtggccctaatcgttcgaaagaagatattgataaagcattgaataaagataattctaaagacaagcctaaccaacttacgatgtgggtggatggcgacaagcaaatggcgttttataaaaaaattacggatcaatatactaaaaaaactggcatcaaagtaaagcttgtaaatattggtcaaaatgatcaactagaaaatatttcgctagacgctcctgcaggaaaaggtccagatatctttttcttagcacatgataatactggaagtgcctatctacaaggcttagctgctgaaatcaaattatcaaaagatgagttgaaaggtttcaatargcaagcacttaaagcgatgaattatgacaataagcaactagcattgccagctatcgttgaaacaaccgcacttttttataataaaaaattagtgaaaaatgcaccgcaaacgttagaagaagttgaagctaatgctgccaaactaactgatagtaaaaagaaacaatacggtatgttatttgatgctaaaaatttctattttaattatccgtttttattcggcaatgatgattatattttcaagaaaaatggcagtgaatatgatattcatcagctaggactaaattcaaaacatgtcgtcaagaatgctgaacgattacaaaaatggtacgacaaagggtatcttcctaaggcagcaacacatgatgtcatgattggtctttttaaagaaggaaaagtaggacaatttgtcactggaccgtggaacattaatgaatatcaagaaacgtttggtaaagatttaggagtaacaacattacctacagatggtggcaaacctatgaaaccatttctaggtgtacgtggttggtatttatctgaatatagtaaacataagtattgggctaaagatttaatgctgtatatcactagtaaagatacattacaaaaatatacagatgaaatgagcgaaattactggacgtgttgacgtgaaatcatctaatccaaatttaaaagtgtttgaaaagcaagcacgtcatgctgaaccgatgcctaatattcctgaaatgcgacaagtttgggaaccgatgggcaatgcaagcatatttatttcaaatggtaagaatcctaaacaagcgttagatgaggcgacgaatgatataacgcaaaatattaagattcttcatccatcacaaaatgataagaaaggagattagttatgacgaaacgtaaccctaaattagcggcattattatctgttatacctggtttgggacagttttataataaaagacccattaaagggacgatattttttatctttttcatcagttttatttctgttttttatagctttttaaatattggtttttggggattgttcacattagggacagtacctaagttagacgattctcgtgtcttacttgcacaaggtattatttctatcttactcgttgctttcgcaatcatgctatatatcattaatattttagatgcatatcgtaatgctgaacgatttaatcgcaatgaggaaataaaggatccgaagcgcgtatggtggcaacatgggacaagacgttcccatacttactaatctcaccaggtacattcttattgatatttgtagttgtatttccattaatayytatgtttggagtagcatttacaaattacaatttatacaacgcgcctccgagacacacattagaatgggttggtttagataactttaaaacgttattcacaattggcgtttggcgtaaaacatttttcagtgttattacttggacattagtatggacgcttgttgcaacgacacttcaaattgcattagggctgtttttggcaattattgtaaatcaccctgtcgtcaaaggtaagaaatttatccgtactgtgttaatcctaccttgggctgtaccatcatttgtgacaattttaatatttgtagcgttatttaatgatgaatttggtgcgataaataatgatattttgcaacctttattaggtgtagcaccagcatggttaagtgatccgttttgggcaaaagtggcattaatcggcattcaagtatggcttggattcccatttgtctttgcactgttcactggagtactgcaaagtatttcatcagattggtacgaagcagcagatatggatggtgcgtctagttggcaaaagtttagaaacatcacattcccgcatgtcatttacgccacagcgccattgttaattatgcaatatgcaggtaatttcaataattttaatcttatttatctatttaataaaggcggtccaccagtgtcagggcagaatgctggtagtacagatatcttgatatcttgggtgtataatctgacatttgagtttaacaacttcaacatgggtgcagttgtgtcattaattattggatttattgttgctattgtcgcatttattcaattcagacgtacaagtacgtttaaagatgagggaggtttataagatgacaaagaagaaaaacatattaaaagcaatcggtatttacagttttatagcgatgatgtttgtcatcattttatatccactactgtggacatttggcatttcccttaatccaggtacgaacttgtatggtgccaaaatgataccagacaatgcaacatttaaaaattatgcattcttactattcgatgacagtagtcaatacctgacttggtataaaaatacgcttatcgtagcatctgcaaatgcactgtttagtgtgatatttgtcacgttaacagcatatgctttttctagatatcgctttgttggtcgtaaatacgggctgattacatttttgattttacaaatgttccctgtattaatggcaatggtcgcaatctatattttgctaaatacaattggattattagattctttatttggactaacactggtatatattggtggatcaataccgatgaatgcctttttagtgaaaggttacttcgatacgattccaaaagaacttgatgaatctgccaaaattgatggtgcagggcatatgcgtattttcttacaaattatgcttccattagctaagccgattttagcagttgttgctttgttcaattttatggggccatttatggactttatattacctaaaatactattaagaagtcctgaaaaattcacattagcagttggattgttcaactttattaatgataagtatgcaaataatttcacagtgtttgcagcaggggcaattatgattgcagtacctatagcaatcgtattcttgttcttgcaacgctatttagtatcaggtttaacaacaggtgcgacaaaaggttagtttgaaattaggagtggggcagaattgataaagaaccactaatgacgataaagattaaaaggaggacgttatgatgacgattaaagttggaatcattgggtgtggtggtattgcgaatggcaagcacatgccaagtttacaaaaagttgaaaatgttgaaatgatcgcattttgtgacgtagacatttcgaaagcagcgagtgcggcagaagcatacggaactgacaatgcaaaggtttatgatgattacaaagcattgttaaaagatgacacgattgatgttatccatgtttgtacgccaaatgactcgcattgtgaaattactgtagcagggttgcatgctggtaaacatgtgatgtgtgaaaaaccaatggctaaaacgacagcagaagctcaaaaaatgatagatacagctaaatcaacaggtaaaaaattaacaataggttatcaaaatcgtttccgagcagatagtcaatttttacatcaagcagcgcaacgtggcgacttaggagacatttacttcggaaaggcacatgccattcgtcgtcgagcagtaccaacatggggtgtctttctagacgaagaagctcaaggtggaggaccattaatcgatatcggtacacacgctttagatttaacgttatggatgatggataattatgaaccagaatcagtgatgggttcaacattccataaattaaataaacagcatcatgcggcaaacgcttggggttcatggaatccagatgaatttacagttgaagattctgcgtttggatttattaaaatgaagaatggagcgacgatcattttagaatccgcttgggcgattaattctttagaagtggatgaggcaaaatgttcattatcaggaactaaagcaggtgctgatatgaaagatggtctacgtattcatggtgaagacatgggtacactttataccaaacacgttgaattggaaaacaaaggcgtcgacttttatgaaggtaatgaagtggatgaagctgaagaagaagcaaaagcttggattgatgcagttgtaaatgatactgaaccagttgtgaaaccggaacaagcaatggtagttacaaaaattcttgaagcgatttatcagtctgcaaaatcaggcaaagcaatttactttgaataacatcatacggtaaggaggcacatcatgacaaaattaaaagttggtgtgataggtgttggtggtattgcacaagaccgtcatattccagcattgctgaaactcaaagacacagtctcattagttgcagtacaagatattaatacagtgcagatgattgatgttgcgaagcgctttaatatacctcatgcagttgagacacctagcgagctgtttaaacttgttgatgcggtggtcatttgtacacctaataaattccatgctgatctttctatagaagcattgaaccatggtgtccatgtattgtgtgaaaagccaatggcgatgacgacggaagagtgtgatcgcatgattgaagcggctaataaaaatcacaaattattaactgtcgcatatcattatcgtcacacagatgtggcaattactgctaaaaaagcaattgaatcaggtgtggttggtaaacctttagtagcacgtgtacaagcgatgcgtaggcgtaaagtgcctggctggggtgtttttaccaataaagcgttgcaaggtggcggtagtttaatcgattatggttgccacttgttagacttatctttgtggctactaggtaaagatatggtgccgcatgaagtgctaggaaaaacatataatcaattgagcaaacaaccgaatcaaattaatgattggggaacatttgatcatactaaatttgatgtcgatgatcatgttactagttatatgacatttgccaatcgagcaagcatgcagtttgaatgttcgtggtctgcaaatatcaaagaagataaggttcacgttagtttatcaggagaagatggcggtatcaatttatttccatttgaaatatatgagccccgctttggaactatttttgaaagcaaagctaatgttgagcataacgaagacattgctggtgagagacaggcgcgtaactttgtcaatgcgtgtttagggatagaagagattgtggtgaaaccggaagaagcacgcaatgtaaatgcccttatagaagcgatttatcgtagcgatcttgataacaagagcatacaactttaatgattatcatatatgatacaaaattctcaatataaaaagaaggagtgcttttcaatgaaaataggtgtattttcagtattattttacgataaaaattttgaagatatgttagattatgtctcagaatctggattggatatgattgaagttggaacaggtggtaacccaggagataaattttgtaagttagatgagttgttagaaaatgaagacaagcgccaagcatttatgaagtcaatcacagacagaggcttacaaataagtggtttcagttgtcataacaatccaatttctccagatccgatagaagcgaaagaagccgatgaaacgttacgtaaaacaatccgtttagcaaatctattagacgtgccagttgttaatacattttctggcattgcaggatcagatgataccgctaaaaagcctaattggcctgttacaccttggccaacagcctactctgaaatttatgattatcagtggaatgaaaagttgataccatattggcaagatttagctgagtttgcaaaagagcaagatgtaaaaattgccatagagttgcatgcaggatttttagtgcatacaccatatacaatgttgaagttacgtgaggctacaaatgaatatatcggtgctaacttagatcctagtcatctatggtggcaaggtattgacccaattgctgcgattcgcatattaggccaagcaaatgcaattcatcacttccatgctaaagatacgtatattaatcaagaaaatgtaaatatgtatggtctaactgatatgcaaccatatggtaacgttgcgacaagagcatggacattccgtacagttggttatggacatagtccatatgtatgggcagatatcataagtcaacttattattaatggatatgattatgtattaagtattgaacatgaagatcctattatgtcagtagaagaaggtttccaaaaagcttgtcaaactttgaaatctgttaatatttacgacaagccagcagacatgtggtgggcataatacgaactcgaggttagtctgaagtttgtctgaagtaagactggtggcagtgttgaataaatgcatatgtcgccaagccattgccaaaaatttcacaccttaaatcaagtcattgtttgtaaagaaggtgtactttatataagtatatagcgatggtcatacccattcacagtaacaatcctcaccattgaaaagagtatataaccttttcaatagtgaggtatatgataataaaaaaagcctgttgtcacaatggtcatagacacgacatactttaaaggtttctgaatataatatttcagaatgcactttaaagatggacgtcgatgtagactaaagtgatgacaggctttcatctttttaaatattcattaatttctcttcttgtttaatacgtacatataagaaatacgcatacggtactaataaaatagttgtatatgttgcgtgtgttaataataatacaccgattaattcaggaatgatgtttaagaagtaatttgggtgttttgtaattttatataatccagatttaataataggatggttaggtaaaatgaataattttaatgtccaaataccacctaaagttttaataaccataaataacatgatataagcaaagattaatataactaagccaataccatttgcaaagctaaatgtatctttattaataaatgcctctacaccagccaatacataaattaaaacgtgtgttattgctaaaaacttcgaatttttaacgccatattcaactgcaccgtctgcttttaattgttttgagtgattaatagatatctttaagctgacaagtctgatacagaaaaagataagtaatatagatagaatcatgatgtcctccgtcattatgtcatatgtataagcgttgattttgacaacataaagtattttatagataaagcttgtcaaatactattaactatttattaattttagtacataaatatgtttctaagtatgtgtttatgttcagtattttggataatttaataattttaaggatattaagcgcttacaccgacgtgatatatttggcttaacgaaaatgattgaggtgacagagatgaacttttttgatatccataagattccgaacaaaggcattccattatcggtacaacgtaaattatggcttagaaacttcatgcaagctttcttcgtagtgttctttgtttatatggctatgtatttaattcgaaacaactttaaggcggcacaaccgtttttaaaagaggaaattggattatctacattagaacttggttatatcggattagcatttagtatcacgtacggtttaggaaaaacattacttggatattttgtcgatggacgtaacacaaaacgtattatctcgttcttacttatcttatctgcgattacagttttaattatgggatttgttttaagttactttggttctgtaatgggattattaattgtactttggggacttaacggggtgttccaatcagttggtggacctgcaagttattcaacgatttcaagatgggcgccaagaacgaaacgtggccgatacttaggattctggaatacatcacataatatcggtggtgccatagcaggtggtgttgcactttggggtgctaatgtattcttccatggaaatgttatagggatgttcattttcccatcggtgattgcattacttattggtatcgcaacattatttatcggaaaagatgatccggaagaattaggatggaatcgtgctgaagaaatttgggaagagccggtcgataaagaaaatattgattctcaaggtatgacgaaatgggagatctttaaaaaatatatcctgggaaatcctgttatatggattctatgtgtttcaaacgtctttgtatacattgtacgaatcggtattgataactgggcaccgttatatgtgtcagagcatttacactttagtaaaggcgatgcagttaatacgatattctactttgaaattggtgcattagttgcaagtttattatggggctacgtatcagacttattaaaaggtcgtcgtgcaattgtagctattggctgtatgtttatgattacatttgttgtcttattctacacaaatgctacaagtgtcatgatggttaacatttcattgtttgcattaggtgcgttaatctttggtccgcaattattaattggtgtatcattgactggttttgttcctaaaaatgccatcagtgtagcaaacggaatgacaggttcattcgcgtatctattcggtgactcaatggcgaaagttggtttggcggctattgctgatccaacacgtaacggtttaaacatctttggatatacattaagtggatggacagatgttttcatcgtcttctatgttgcattattcctaggcatgattctattaggaatcgttgctttctatgaagaaaagaaaattagaagtttaaaaatttaatataaatcggattaaaagtatcgccaatctattgcaatatagttggcaatcctgccccgacggcatgtgcgtgaagagatgaaagatactgcttctacccttgcaaatatatcatctctatgtctcggggcagatcataattccctgttatgaagtatccttatttgcccgacttagggtgactcaatgaatttactccttacaataaagacatatagcggtgtcaatattgtagggagtattgttttatatttaaactctctaaaaagcggactgaaagaaaagtgaaaacttctctatcagtccgctttttcatagaacaaaatggaggcgccataatcattagttatgtgctaatctattttgcttgcttacaataatcacttggcgacatttgtaaatattttttaaaatgatagctaaacattttatactctgaaaagcctactttgtctgcaatttcatagtgtttgtaatgtcgatctaacaattgcagagattgtaaaatacgatagcgatttaaataatcgacaattgtaataccaacatgatctttaaatgttcgcatcgcatacgattcactaacatcgatatgttgaattaaatctgaaacagtcactttcgtttgataagattgcttaatttgatccacaatctggtttacataataatcatcgtattctacttttaatagtggttggaaggcatcatgacaagatgctaagctacggccgttctgtgattgttgctctaataaggtacggacaagtcttcctaaaataacttctaattgtgcatggtctactggttttaataaataatcaagaacatgatgttgaatgccggctttcatatattcaaagtcatcgtaactcgataatatgatgacattacaatctagatgcgcaatatcattgagtaaatcgacgccatttttacgtggcatacgaatatcagtaattactaattctggctgatgttgttgaattagtgataatgcttcaacaccatctttagcagtgtatattgtattgaaatgatagtctccccaaggaatgatttgctttaatccttctcgaataattcgttcatcatcacaaataactaccttaaacatctacattcccccttgaaagtggtattttataacaaattaacgtaccttgattacgctttgaaaaaatatggagtcgtgcatgtgaaccatattgaatcattgctttattgtgtaaatgatttaatcccaaatgcttagtatcaaatacatcattattaagagattggcgtacatattgcaggcgagatgacgacatcccgataccattgtcgcaaactaaaacatgtaaattctgacgtgccaatgtcaggcgtatagtaatgtccaatgactcagtatctctaccatgtttaatagcattttctatgagtggctgaagcatcattttaccaattgtctggtgacgcgcttcttcagaactttcaatatggagcttaatcatgtcatcaaaacggatgttttgtattgcaacatactgttcaatgtagttcaactcttcgtttaattccactgtatgtgagtttgtacgtaatgagtaacgtaacatttgcgataattgttggaccacagtttgtgctaatttcggagataacgtaattaaatattgtattgtttgcatcgtattgaataggaaatgaggctggaattggcgttctatttcctttaactgaatatcacgcaagcgacgttctgtatgctcgatagaatggatcagttgctcatttgattcaaataaatcgtaaatataattattaatttcttctagttcactgttgttttttaaaggcgtatatgtacctagatgacgatttttggcatagtaaattttttgaataatcgtttcgatatcttttgtttgtcgtttagccatattatctgcgctaatgaaaccaaatattactagtaaaacaagaactacggccataacaattaacaacgtgataccatcttcaatgttttcatgtatatctttataaataatgagacgatggtcagcatggtttaattttacagattcattcataaatccgaattgttgtggtctatacttttcacctatagtaaaacggtcatcgttggcgtataaaatattgtcatattgatcamcgataagtgcgaattgtcggttatctttcttaatttcacttaaacgtggggtgttagccatataaattttaagcatatatgtactatttttgaatttaagctgatgcgttgaaaataaatacatatttttagtgtttaaatgttcataattattggttataaactgatttggtccagataattcataataaagtgttgcgggctgttggkgtattaattttaataattcacgttttgtagcggtcacatcatgatgatttgytaaatcgagctcttgaaacgaattattatgctgtgtaataaatgtctgaatctgcttttcagtatgatgtaaagatgactgactttcatcaacatgttgatgaatcgtacgatgctcaatccaaatatagatggcatagaagcttactagtccaataataatgactaaaaatactggaaaaatagtagacncaaataacgatcgtcttaattgatgtctataaggtttgtatgccntcattgaatcatctccaaaaatttatgatgtggaatatccggtaatttagatttcggtattaaaggtatgttcttaagattttcgatagactgatcgctttgttcactaacatcctttcgaattgacttggcatcgaactctgcaactaatcgttgttgtactgagcggcttgttaaatattgcactaactttttacgcttaggatgagggtgtgcatttttaactaaagcaatrccatcaacatttaacattgttccttcaattggataaacgattgatacaggataacctttgtttttccatgtgcgtgcatcttgttcgtagcttagacctgcgtaatatttaccttttgcaacatcttcaatgactttagacgtctttgacagttgcatcgcatggttttggaattgatgcacatcacttactcgatgatgcatgctataaatagcacgcatatgttgatagcctgtcgttgttgtatttggatttgagtacgcaattttacctttaagtataggttgtaataaatcttgataacctcgaatcttaatatctccttgtaaatctgaattcactactataactgttggcattaatagaaaactagtaacatatttattgttcgagcgataatcctctaattgctgtgttacagatgtatcttgatagggaacaaaatcttctggatgatcaattgtttctgacaacacaccacccataaagacatcaccacgctccgaaaaatcttcgttatgcaagtttgaaagcagtacttgagtagatccgtgtttaatttcaattttgacatgctcttgtttttcaaattcatttaaaattggacgaatcaagtttgattgatacggagaataaactgttaatacatttttatcggattcagagtgacgcgtattagcgcatgctgataaaaaaatgagaaataatagcaagatataaatttttgatttcatgatatcccatcaattctatgtatattttaatacaataattttagcaataaatgacgcataagtaatgttaaatatttagaaatgtttatagatgacttgttaagacgttgcaaatgttgtgatagcacaaaatttttgtttgtcaagacgatttaccgaggctgtaaaatcaaactgttatattttatttgtagctgttatataaaaatcggcaagatattgaacggttcaaaagtgaatttttacgtcaataaaagtatttaatccagtctcttcatatataaaagtaaatctttctaagtgttgatttaacgcttatcaacaatcattttttataaacaaatatatactcctaaattaacttttaaagcaatgaaaatagtgaacattataactgttgtgtaacagaatgcaattagcatattactgttacacaaattagtacagtttctatgttttgacatacatttgatgaaaattgtacataatttatgtgaaaaaaatcacaacaaacatgctacaatgactatgaaaacgttaacatagcatttcaaattcacaacattatacagatggaggcgtttagtatgttagaaacaaataaaaatcatgcaacagcttggcaaggatttaaaaatggaagatggaacagacacgtagatgtaagagagtttatccaattaaactacactctttatgaaggtaatgattcatttttagcaggaccaacagaagcaacttctaaactttgggaacaagtaatgcagttatcgaaagaagaacgtgaacgtggcggcatgtgggatatggacacgaaagtagcttcaacaatcacatctcatgatgctggttatttagacaaagatttagaaacaattgtaggtgtacaaactgaaaagccattcaaacgttcaatgcaaccattcggtggtattcgtatggcgaaagcagcttgtgaagcttacggttacgaattagacgaagaaactgaaaaaatctttacagattatcgtaaaacacataaccaaggtgtattcgatgcatattctagagaaatgttgaactgccgtaaagcaggtgtaatcactggtttacctgatgcatacggacgtggacgtattatcggtgactatcgtcgtgtagctttatatggtgtagatttcttaatggaagaaaaaatgcacgacttcaacacgatgtctacagaaatgtcagaagatgtaattcgtttacgtgaagaattatcagaacaatatcgtgcattaaaagaattaaaagaacttggacaaaaatatggtttcgatttaagccgtccagcagaaaacttcaaagaagcagttcaatggttatacttagcataccttgctgcaattaaagaacaaaacggtgcagcaatgagtttaggtcgtacatcaacattcttagatatctatgctgaacgtgaccttaaagcaggcgttattactgaaagcgaagttcaagaaattattgaccacttcatcatgaaattacgtattgttaaatttgctcgtacacctgattacaatgaattattctctggagacccaacttgggtaactgaatctatcggtggtgtaggtattgacggacgtccacttgttacgaaaaactcattccgtttcttacactcattagataacttaggtccagctccagaaccaaacttaacagtattatggtcagtacgtttacctgacaacttcaaaacatactgtgcaaaaatgagtattaaaacaagttctatccaatatgaaaatgatgacattatgcgtgaaagctatggcgatgactatggtatcgcatgttgtgtatcagcgatgacaattggtaaacaaatgcaattcttcggtgcacgtgcgaacttagctaaaacattactttacgctatcaatggtggtaaagatgaaaaatctggtgcacaagttggtccaaacttcgaaggtattaacagcgaagtattagaatatgacgaagtattcaagaaatttgatcaaatgatggattggctagcaggtgtttacattaactcattaaatgttattcactacatgcacgataaatacagctatgaacgtattgaaatggcattacatgatacagaaattgtacgtacaatggcaacaggtatcgctggtttatcagtagcagctgactcattatctgcaattaaatatgcacaagttaaaccaattcgtaacgaagaaggtcttgtagtagactttgaaatcgaaggcgacttccctaaatacggtaacaatgacgaccgtgtagatgatattgcagttgatttagtagaacgcttcatgactaaattacgtagtcataaaacatatcgtgattcagaacatacaatgagtgtattaacaattacttcaaacgttgtatacggtaagaaaactggtaacacaccagacggacgtaaagctggcgaaccatttgctccaggtgcaaacccaatgcatggccgtgaccaaaaaggtgcattatcttcattaagttctgtagctaagatcccttacgattgctgtaaagatggtatttcaaatacattcagtatcgtaccaaaatcattaggtaaagaaccagaagatcaaaaccgtaacttaactagtatgttagatggttacgcaatgcaatgtggtcaccacttaaatattaacgtatttaaccgtgaaacattaatagatgcaatggaacatccagaagaatatccacagttaacaatccgtgtatctggttacgctgttaacttcattaaattaacacgtgaacaacaattagatgtaatttctcgtacattccatgaaagtatgtaacaaaatttaaggtgggagcactatgcttaagggacacttacattctgtcgaaagtttaggtactgtcgatggaccgggattaagatatatattatttacacaaggatgcttacttagatgcttgtattgccacaatccagatacttggaaaattagtgagccatcaagagaagtcacagttgatgaaatggtgaatgaaatattaccatacaaaccatactttgatgcatcgggtggcggtgtaacagtcagtggtggcgaaccattgttacaaatgccattcttagaaaaattatttgcagaattaaaagaaaatggtgtgcacacttgcttagacacatcggctggatgtgctaatgatacaaaagcatttcaaaggcattttgaagaattacaaaaacatacagacttgatattattagatataaaacatattgataatgacaaacatattagattgacaggaaagcctaatacacacatccttaacttcgcgcgcaaactgtcagatatgaaacaacctgtatggattcgacatgtccttgtgcctggttattctgatgataaagacgatttaattaaactaggggaatttattaattctcttgataacgtcgaaaagtttgaaattctgccatatcatcagttaggtgttcataagtggaaaacattgggcattgcatatgaattagaagatgtcgaagcgcccgatgatgaagctgttaaagcagcctaccgttatgttaacttcaaagggaaaattcccgttgaattataaatacaattcagaccgaaaagaaagcatatgcaacttcaagagtgaaggggcatatgcttctttttcaattgagtattgagtattagcaagacgtagtaagtatatgagacaacttctacaatggttgaaggaagacgtttttgtaagtagctatgctgataaagaatgtgatgtcttgttaaaggtggggttccaatatcatcatttagctgatgttgaatgggttattatttgctacttgcatatgaatatgagtcttttcaaatttttattgaccctgagtaatgaaaaatattaagatgaaacttaatattaaagcaatgcggagcgtgattatgaagagaattagtaaagatatatgggcagtatttaaattactgtatcaaaataaagggcgttttagcattaatgccttactattgcagttaatcatgatttttattagtagtacatacttaattttactatttaatatgatgttaaaagtagctggcaaagccaacttacgattaacaattggacggaaatcgttagtcatcccgccagtgtgatacttcttattatattcatattaagtgttgcctttctgatttatgtagagttttcattgttagtttatatggtttatgccggctttgatcgacagattattacatttaaatccatttttaaaaatgcctttgtaaatgtgcgtaaactcataggtgtaccagttattttctttgtcatttatttaatgttaatgatacccattgccaacctaggactaagttcagtattaacaaaaaatatttacatacctaaatttttaacggaagaacttatgaaaacgacgaaaggtataatcatttacggtacctttatgattgctgtatttatattaaattttaaattaatatttactctaccgttaacgattttaaaccgccagtcgttatttaaaaatatgagactaagttggcaaattacgaagcgaaataagtttcggcttgttatagaaatagttatattagaactcatcattggtgcgattttaacattaattatttcaggagcaacatatcttgctatttgtgtagatgaagaaggagataagtttttagtctcatcaattttatttgttgtattgaaaagcgcattgttcttctattatktatttacgaaattatcattaatcagtgtgttagtactgcacttaa

SEQ ID NO: 113 - DNA, 1214 bp; double-stranded, linear
aaagttttaaaaggggtgagatacttggcgaataatccattccagctttgcgtttaaaaggaattatacttgccattgtcggtgcttgtttatggggattaggtggtactgtttctgatttcttgttcaaatataagaatattaatgtcgattggtacgtcactgctcgacttgtagtcagtggtgttttcttacttattatgtacaaaatgatgcaacccaaacgttcaatatttagcgtattccaagatcgacgtatgttaggcaaattacttatcttcagtatactgggcatgttagtagtacaatatgcttatatggcatctattaatacaggtaatgctgcgattgcaacattactacaatacattgcgccagtttatattattatttggtttgtcataagaggcgttgcaaaactaacattatttgatgtgcttgctattatcatgacactattaggaacatttttattattaacaaatggttcattttctaatttagtcgtcaatcctgcaagtttattctggggtattttagctggtgtagcactcgctttttacacaatttatccttcagacctacttaaccgcttcggttcgattctaattgtcgggtgggcaatgcttatttctggtgttgcgatgaatttacgccatccaatttggcacattgatatcactaaatgggacatatcaattatattatttttaatctttggtattatcggtggtaccgcactcgcattttatttctttatcgacagtttacaatacatatcagcgaaagaaacaacattattcggaactgttgaacctgtcgtagccgttatcgcaagcagtctatggttacatgtggcattcaaaccatttcaaatcgtaggcatcattcttattatgattttaattttattactatcacttaaaagacaacctgaaacattagatgaataagaaaactctgataatcactttagcaagtaactattatttaacaacgtagttaccttataggtgatatcagagttttttattttagttaataatatttttcacttggtataaaaaagcgtcgtcgctctggtaatcggaaatactggaataaaatatggaattgggtaataatcccaggtantaaaagtccatgttccgatancctntccgcanctccaaccaaatttgccgataaggttccaaaaggcatcctgggggtac

SEQ ID NO: 114 - DNA, 9458 bp; double-stranded, linear
attttggtttcattcacgatggggtnatacagcaaacacanctaaaataactatcaatagtagcgttgaaatgcgtaacttgaaattcttcttcatatagacaaaacctcatttttcttacttagacaataaaaaatatgccactacaatcgctaatattacgattaaaaaagaagcgttaacgattactttcatcgttgttctatctctgaacatcatattaaagacaactagactaattgataatgaaacagcaaaaaaagtaatagctaacactaatttcatcataaatagacagactaaacctatgactaataatgtattagaaattacagctgacgtttttaacattctcgaattaatatgcactcaccctttttatttaaataacttacataatcataataatacatgatgtttcataggcctgtcgatgattgattcacaatagcacgtgatttttttgtttttcaatattattcatttattccatcaaaaacaccctttttaatttttacaaaaattaaaaaaagtgctcctacactgcttgcatgtagaaacactttttcattgtaatgttattcttctcgagacataccttttagcatattaagcatgtatgttaaactacggttcatgtcgtcatctttcaatacgcccaatagacttcttatagttgtcttagcatttggactcgcttgattggcaacgtgtaatcctttattaactttatttaggaagtcgcttaaatctgatacattgagttcacctaataaaaataccattgaagccatattagataatagccctgtataaatatctttattaagttcaactgcaaatttatttatgatgacttgacgtcctcgaattgcaccatttaaagcatctaatagttttgcatcatctaatgttttaataagcttgattgcttttaatatactatctttattcgctgcaattgcctctgtaacttcatttaaactttctaacttaatttgttcttctgatttttctaagcgtctaattttagaagatattctctcagccattatttatccacctgatttcccgggaaaacataatctgaacgttcccattttttctgtacttgaacactgtactgcggttgacgttttttattgacacggaaattattagggttcaacggtgacttaccacgtttcgtaattacctccaaacgacagctagtacgtttataagatggtgtatccgtgtattgatcaacatcactattagttaataagttaattgcacctagatctccattttccatcgcatcattatttaatggaatatagatttctttacctttaacacgatctgtcacgtgaacttgtaataccgcttctcctgtytcagaaatcagcttaacttctgcaccttcatgaatgcctctatcttcagcaagctctggagaaatttcaacaaatgcacgtggcactttgtatttaatcattggtgtttgataagtcatattaccttcatggaagtgctctaacaatcgaccattgtttacatgaatatcataaatttcatcttgcttaaagtaattatcaaatgataatgggaataattttgctttaccattatcaaaattgaatccttctaagtatagaataggctcatcagtaccatcaggttgtactggccattgtaaactattgaatccttctaaacgatcataacttaccccagcatatagaggtgttaagcgtgctacttcatccataatttcactaggatgcttgtaattccaatcaaatcctaatctattagcaattgcttggaaaattttccagtcaggttttkaatcaccaagaggttctaatgcttggtataaacgttgaatacgacgttcggtatttgtaaaagtaccgtctttttcaagtgaaggacttgctggcaatacaacatctgcgtatgttgctgtgaatgttaaaaattcatcttggactaccatgaaatctaatttttcaaacgcagcttgtacaaaattaatatttgaatccacaatacccgtatcttcaccatataagtacaatgagtgtacttctccgtcatgtataccttctaccatttcatgattatctttaccagcttttggattcaatttaacgccatattctttttcaaatttagcgcgaatatcatccgcttcaatactttgataaccagtaatcttatcaggcatacttcccatatcactacatccttgaacattattatgtccacgtaatggatacgcaccagtaccaggacgacgataattacctgttactaataataagtttgaaatcgctgtacttgagtcactaccaatgtcttgttgtgtaatacccattgcccaacaaattacaacagattcagctttagcacattcttcagcaaatttaatcaattctgattcaggaatacctgttgcttcttcagcaaaagccattgtaaatgtttctaatgatttgtaatattcatcaaaatcatctacccactcatcaataaatgctttatcgtgtaaatcatgatcaataatatacttagtcactgcacttaaccacgctaaatccgtacctggtttaggttgataaaaacgatccgcacgttctgccatttcatgttttctaatatcaaatacatgtattttttgaccaaataatttttgtgcacgtttcatgcgtgatgcgataactggatgagcttcggctgtattagtacctatcaatacagacattgccgctttttctaaatcttcaatactacctgagtcaccgccgtgtccaaccgttctaaataagccttttgttgcaggtgcttggcaatatcttgaacagttatcaacgttatttgtgccaataacttgtcttgctaatttttgcattaaatacgattcttcattcgtcgctttagaagaagaaatgaatgatagtgcatctgggccatgcttttctttaatagctgtaaaattatctgcaatgacgtttaaagcttcatcccattctacttcatggaactcaccatttttccttactagtggtttagttaatcgttgatctgaattaatatgtccccatgaaaacttacctttaacacaagtcgcaattttatttgctggagaatcatgtgatggttgtacttttaaaatttctctatctttagtccaaacttcaaatgaacaacccacaccacaataagtacacactgttttagttttcttaatacgctctttacgcatttctgcttctgaatctgagattgcaaatagtggaccataaccaggttctgcttttttagttaaatcaatcattgctgctaatgaaccaggttccgtatcagtcatataacccgcattaccttccatattcacttccatcatggcattacatggacataccgtcgcacattgaccacaagatacacatgaagactcattaatcggtacatcattatcccaaataacacgtggatgttcacgatcccaatcaattctaatagtttcattcacttcgatatcttgacatgcttctacacaacgcccacataagatacattgatttggatcataacgataaaatgggccgtaatctttttcgtatggcttctctttatattcatacgtttgatgctgaagcccccatgcatccatcgtattatgaatttcacaatcaccattattataatcacatactgtacaatacagcatatgcttttctaaaattcgatcaagcgcttctttttgagcatctttcacatcattgttcacagtatttacagtcattggacgatcaatcaccgtactacatgaacgttcaattttaccgtcaatctcaacagtacatgtatcacatgtttgaattggtcccatcgactcgttataacaaattgaaggtacaaaagtatcttgtgatttaataaattcaagtaaattcgtacctggttctacaagataatcttttccatcaagtgtaaccaccaaatgttcttgcatattactcaccccgtctatatatattttccgtaaatgacttttaataaattgctcatatccacctaaaataacgatgccccacacatctttcagatagaattaatttaattgtattactttatgtactagttgttaagtaaaattttgtattttgcctttttacaatcatttttatttgaaatattttgcgcgaaattaaatcatctttttgtttaattgaaaataattatcattattagttttccaattatctgtttcacgctttttgccatatctttcacaaccttattaatgacaatatttaataatcacctcacctaaaaatcgttatactatttataaataccctttttctgaaaattaataacccaagtttgataaatatctactatcatttagaaggtaatatttatctttaaattaaatttgtaatggattaatttataaaaatcaaatcaggcattaaataaaatagcccataaatacaaagtgttatcaccttctatttacgggctattagttctattcgttattctatttacagatcattctatctaattaatttgtgtacaattttgataacttattttcccttagtttactactctagattatcttttaataacttagtactttcagcttttgactgctcactaggaatgaagtagtacaatccgtcactttgaatgccgccttgaccactcaattgatgtttattaatcgtgtcattagcatctttataattgcttctaatcgtattcaaatcacctaatgttaaatctgttttaacattattttgaatttcattcattagactattaaaatgtgtaatcgatgatgggcttgcaatcttattggccatcgcttcaagcacaatttgctgacgttgttgtcgaccaaagtcaccaccagcaccttcttctttacgacttctaataaacttcaatgcttgatcaccatttacatgtgtctgctgtccttttgtaaaacgaacaccatcaacagtgaatgtatcattacttactacatcaacaccgccgatgctatctatcatattatgcaaaccatccatatcgattgtcgcataatgatcaattggcacattcattaatttttcaagtgatttaacagccatatttggtccaccatatgcataggcatgtgcaattttttcagtagtaccacggccaacaatttccgctcttgtatcacgcggtatacttactatttcagttttcttcgttttagggttgatagataaaatcataatactatcactacgctctccgccaccctttttcttacgatcagcatctgaatcgacaccaaataaagcgattgtgaatggatcaccatcgtttaaactcacttttttatctcttaattctgaatgattgcgatctaacggattgtgtatcttattaccagtaataaaaattttagcagctacatacacaacagctacaatcgctaagattactaaaataccgaatacccataaaaatatttttttcggtaggctcattttacttttagacgaacgtttcaatcccaccactcctttactattccttacatactttgtctgttttctctatttattatatagtaaaataatttttttactatacttctgtagacgtataactattttttatcattttttatctctagagaatatctatctgtatttttgataaccaccatttgcatttaaaattttaagtaccgtttcatgacatgctttattacttataataaaaggtgcaccctttaaatgatcaattgccttaccatctaaagtcgtcatttttagattcaatagttctgcaaataaaaactgtgcagcaatgtcccaaggtttaggatttgtattaatatgtgccccaaattgaccttttgccactcgcatagaatctaatccgcaagcaccaactaaacgataactaaatgaggcgtcaaataaatcttgcaccgtatctagattcatcacttgtgcattaaacgatataatagcgtcttccaattttaacgatggtggttcttccatcttaattccattacaaaaagcaccttctcctcgtattgctttataaagctttttatgcggataatcatatacgtacgataacattggtttaccttcataaaaatacgccaatataatacaataatcttcttgctgttttactaaattggcagttccatcaatgggatccataatccataaatgattaatttcattcgtaatcatttcattacttttttcttccgctaatagttggtgttccggaaaatgtgttgctaaaaattgttggaattgttgttgaatctgtttatctacatttgtaactaaatcaaatcgatgacgcttagtttctgtagtcatttccataattaattgcggaataacattgtctatttgtttcaaccacgaacatattaacttatctatttgctgtaatgttttatctgtcatttcgtccaccacttctcatatcattatcattttattattaccctatattaaaagaatcaacaatacaactgaagacttcttcattttatgcataaaaaaatcggctagtcacgtgctagccgacaaatagaaaggaaagtaagtaataaatattgaagatgttgtgatgtaacttgaacgattaaaagctatctgttatatagctctacccctttgtttaatcgctccccctgttacaagtaatatcatagcacaatcttttttaaaatgtaagcgttttccacaaaatttttacgatttttttaaaaagatattgaaaatgtcctcattgtcactcttatgttatactttgtgtaatatatcatcttttaggaggtggctgtcatgaataaagctgaaaggcaaaatttaataattactgcaattcaacaaaataaaaaaatgaccgctttagaattagctaaatattgcaacgtatccaaacgcacaattttaagagatattgatgatttagaaaatcaaggtgttaaaatttatgcgcattatgggaaaaatggtggttaccaaatacaacaagcacaatctaaaattgcattaaacttatctgaaacacaattatcagccttatttttagtgcttaatgaaagtcagtcgtactcgacattaccatataaaagcgaaatcaacgcaattataaaacaatgtttaagtcttccacaaacacgcttaagaaaattgcttaaacgcatggacttttatattaaatttgatgacacacaacatatgacactcccaatgctgttttccgacattttaatttattgtacagaacgaaatgtgatgttagtagatcatagggttgatgataatattaaagctgaaaacgttatatttattggccttttgtgtaaacatggacattggcatgcagtcatttatgacattgctcaagacaaaactgccgaactcgaaattgaaaatattatagatatttcgtattcattcggtaagacgattcaaaccagagacatatccattgataactatcatcaatttttaaaccccatcgattcctaaaaaacagcagtaagatgattttcaattagaaaatatcttgctgctgttctctatttatacaatacttcgtattgaatggnttcgctttcctagggtgccgtctcagccttggtcttcgactggcactgctccctcaggagtctcgccattaatactacgtattaacatgtaattttactttgaaatacttaaaaaaataaaacactttgcccaacttacactaccaatagaaactgctgttagaattcctcaaaatgatatttcgcgatatgttaatgaaattgttaaaaagatagctgatagcgaattcgatgaattcagacatcatcgtggcgcaacatcctatcatctaaaaatgatgttaaaaatcacctcatattcatatactcaatctgaattttctggccgtagaatagaaaaattacttcataacagtattcgaatgatgtggttagctcaagatcaaacaccttcttataaaactattaatctttttagagtgaatcctaatactgatgcgctaattgaatctttatttattcagtttcataataaaatgcatatcaaaaaagctgatttctatcaaataattaatagaaatcagcttttttcattgcctaaaaacttaatgtcccgacctctttatctacgcataaatacttattactgatataacgaaagaaacaaaattatttgctatatgtaatgcaattgttgaacctaggtttcttccagattttaaataagtgaaaactaatatgatggatagtatgagatatggaccaaactcaaacggcgactttgcatcagtcacatgaataaatgcaaataagaacaccgaaacaatactcatagctataaaattaaacttcttacctaattctccaattaaaatatgtctaaatacgatttcttcaactattggacctacaatcacaattaataagaatgctacaggtaaaaatgcaggcacttcaaacattttatttagctcaagttcattggctgtttcactatattgcaaatgtttaggtagaaactgtgtcatatattcatatgtataaattaagatgagagcaataatatacgttattgacaatctaagccaatattttttgatatacgcaaaaccagctcgaagccttgatggcatcacttttaaatgaaataaataaaatgcgccaatcccaatcgtatatgctaaagcttgtgtgatagtcgctacaaatatcagattactatcgatttcataataaccaaacaaaattggtcctatgtaagctgcaattgtgagtgcataaaatataacacctataattggaattataagcaaatctctccatgctatatctttaaacgtgtatttctttttttcattttccactgttatatcctttcctgtttaataattgatttttggaggtacttctacatgataaacgaaactaagtatatgagacaacaaattactaatttgattcaaatcattgatacgattaaatataatactttaatgacagattggaacattcaaacgcatatttataaatttaaccaaatagttactaatgaattgaataagttcaaaggctttgaaacatcatatataataaacgaaaatcaagtttcctattatgaaattataacactacttaataaacgtcccctcgacaagtcgactatggtaacaaaattcaatatcttaatttttatcatacagaactatctaacgcattatttgcaattaaatttgcccattaacctatttttcataaaatgtcatttaaacaagttatttattaaaattcactttattacataaattatacaattaraaagtttcttcaaattgtaaagatgcattaatcgagttataatcataatgattaagatggt

SEQ ID NO: 115 - DNA, 910 bp; double-stranded, linear
angcgtatcatgtcacgcattttaactacttctttaccacaagattatacagtcacattagttgatcgtatgccatttcatggattgaaaccagaattttatgctttagctgcgggcacgaaatcagataaagatgttcgtatgaaattccctaatcatccacaagtgaatacagtttatggtgaaattaacgacatagatttagatgctcaaattgtctcagtcggtaattctaaaattgattatgatgagctaatcattggtttaggatgtgaagataaatatcataacgttccaggagccgaagaatatacacatagtattcaaacactctcaaaggctcgggatactttccatagtattagtgaactaccagaaggtgctaaagtcggtatcgttggtgctggattaagcggcatagaacttgccagcgaattaagagaaagtagatcagacttggaaatatatctttatgaccgtgggccgcgaattttaagaaattttccagaaaaattaagtaagtatgttgcgaaatggttcgccaaaaataatgttaccgttgttccaaattcaaatattaataaagttgaacctggtaaaatatataactgtgatgaacctaaagatattgatttagttgtatggacagcaggaattcaacctgttgaagttgttcgtaacttgccgattgatataaatagtaatggacgcgtgatagttaaccagtatcatcaagtaccaacatatcgtaacgtctatgtagttggtgattgtgctgatttaccacatgcgccaagtgctcagttagccgaagttcaaggtgatcaaattgccgatgtgcttaaaaagcaatggctaaatgaaccattacctgacaaaatgccggaactaaaggtacaaggtatcgttg

SEQ ID NO: 116 - DNA, 10182 bp; double-stranded, linear
tttttgattcaaagtggtgatttaacaagcattttaaatagcaatgatttgaaagtcacacatgatcctaccactgattattataatttatctggtaagttgtcgaacgataatccaaacgttaaacaattaaaacgtagatataatattcctaaaaacgcatcaacaaaggtggaattaaagggaatgagtgatttaaaaggcaataatcatcaagatcagaaactttatttttatttttcaagtcctggaaaagaccaaatcatttataaagaaagccttacttataataaaataagtgaacattaatacttatgctgtaattatagaaacatccaaatcatctattanaatcctatattataaaancacctcacataactcgttcaactgtaccaaaccacattacattagattttaggctaactattgtgatgtacatcaaaaacgaatttgtgaggcgttgtatattttacaaaggtgactagcgtttcgtatagcatttccaacattactacactcaagcgtcacgctaaagttcgaaatcgaatcctttcattcaacaaaagctcatatccactacaaacttcatatcaagcgtataaactatcttgtgatactatctcgatcatatctatagtatgcatttgtgttccgtttcactgaagtatatgtatcatcagttaagtataaaccgtcatccttcaatgttacttgataagcatatttccgtgctaaccaggcaatatctatataattttctcctgcgttttcataacttcttaaatcttcaatatgtgcactaacttcagggaaaatgattctaacaacactttcatcaacccaatatttgtcatgcatccatcgcacttgatctgccaataaaggtaactgcacatcattgaaatatagacgaaagccgtcactatcatacatttgccgatatggtaatggctgttttctaatcactaacacctcgccacccattacggtgccttctctagtatcatcacttccacccgaagcttcatacgttgttgggtcaacctgtagtccatgtacatctccaatataagcatctggtttatgttccattgcatgtccatgtgcaatcaatgctaatattgtagattgtgaaaattgaggctcccattcaatgcgattaggatggctactataaattctaggttcatctatagcctgctgaatatccatgccaaacactaatacattgattaatgtttgcgcaacactagcaatgatacttatggcaccaggtgcacctactgttaatattggcttcccgtgatacatcacaatcgttggagccatgttacttagtggtcgtttatatggtgcaatttcgttaataccaccatctactacatcaaagccatccattgtcgtattcaataacacaccgtagcctggaatcgtgatacctgaaccataaatcataccaattgatgtcgtaaatgaagcaatattaccttccttatcaatcacacaaaaatgagttgtttcggtatgattttcttcaacatctgtatgactaatgcaatcagacacaacaccatgctctatatcaatatttgctttattgctatcaatgagcgtactgcgtgcttttaaataatcatcatcaattaatgactgtacaggcacctcatgaaaattatcatccgccaagtattgcgcacgatcactatatgctaaatgcatcgcttgtatcaaatgatgcaagtaatcaacagatcttggacccatagatggtaaatcgacatgttctaataacttcaatatttgaattaccgtgataccgccagaactagatggtcccattgaataaatgtcatagtctttaaatgttgcactgattggcgctttaatctgaatgtcatatttggctagatcctctaaagtgattgtcccaccacatgctttgacaacattgactaattgtttcgcaatgtcacctttataaaatgcattaaacccttgttctcttaatatttgaaatgtcttacctaattcgggttgtacaatccaatcaccttcacgccaatattgattttcatgcgtaaatacttgtgccgtttcatgatactttgtcaatcgtgcgtgttgctggcgcgaatatttttcagtagcccaattggctgcatgaccttcaatggctagttcaattgcaggattaattaaatcttccaatgacaatttagcataacgcttgtgaatataatcaaacagctttggaattgctggcacagcgacagttttaccatgtgtagtcatatcaaaaaatgatttatattcgcctgaatcatctagataaaattgtttgtctacatgttcaggtgctgtctcacgtgcatcaaacgcagttatactgccagtactttgctcataatatagcaaatacccgccaccaccaatacctgatgcaaatggttctaccacattcaatgccagttgaattgcaatcactgcatccatggcgttgccaccttgatctaatacatccttaccaattttagccgcaagaggatgtgatacggaaattaacccttctttagatgtttttgtctgtttgtcatttaagttaatgaccatactatatcctcctactttctgttaaatatttaaaacattattgattaatggctttttctactttttctaaatcttgacgttgctcgttaccagtatcgacaagtggtgtaatcggtgatgcaattttaaatttatcgccacgataaaacttaataaattgatcctgatctatcgcattaactactgcttgtctcaagtttggatgcgtcttaaatataccttttttaatatttagcattaaaaagactgacttgcgtccatttttgcgaataatgcttaaatttttatccgacttaattaaatcaaaatgtttttgattcacatctgccaacatatcaattgaatgatttctaagttctgacaatgcattattcgggtcaccattaaacttcaatgtaatatttttaattttagctggtccataactacctttttctgtttcgttgaatcctggattacgttgaaacgttgcttgatatgcatttttctgtgtcataatgtatgcgccacttgcatacagcgcatttttcccatctgaatttgcaggaattgtactgctatccccatatccttttggatattcttgatttacttgattaacaaattttttagataaaatgcctgccgaagagtgtgttaagtaatttacctctcgaggcatcgattgatctgtcgtaattttaacaatttgataaataccgtctttattatttactttttgaccatctgtcgttaacgatttgacgttataagctttaatcaacttatcatagattgatttatcgtccttgtctttctctttacgcaactgatcgatgtcctcatcttttaatatcttgatgtcatttatatgtttgtgcatattgtaagtattattgttaggcacagactttttatcacgtgctctatctaaagaaaacttaacatcttcagccgatacacgctctccagtattacgtgcttgtccattgaccactttcgcaaaataatcatcatctcttaacaagaaataaaatgctttattgtccttattcacagcataatcatgacttaacgaacctttcgttgttaaatgatcattttcatctaataataataaccttgtgtacatattcatattaattgaatatactgacggcgcaattgaacgtattggatccaatgtaggaatttcaccatcttgttgtgtcatcacaagtggccgcgtatctcgttctctactattgttgtaatcaaattgttgccatattaatgcacgtgaatttggcaatccaacactatttttatctaacactttattgtcatatactaaattcttttttgatccatataaaggcgccatataccctttatcaaatacaacttcatcttcaatttgcttatatgtttgtttaacatctgcttcattttgagtagaagctttatttaacaactggtctacatgtttatctttcaataaactatttgatcctgtagaactaaataatgccgtcatagcatagttcgggtcaccaaacactgtcatccagtcatcaatttggatatcataattgccggcttgacgttgtgtacgatagctaccataatctggttggatattcatcttcacgttaaatcctgcattttccaattgatctttaacgatattcatatcattttcataacttgcttgtcctaggaaatgtattgttggtcgctcgcctttcacttcaactttcgatgacttttgagccacttctgatttcgtagggacaccacaaccacttaataccaacgctaaaactataattgcgatactaatgattttcttcacatctatccctacctttttaatgaattcttggatctagtgcatcacgcactgcatcacctataaaattaaatgctaaaacgacgaacataatacaaacaccaggtacaatagctaaattactgtgcgtttccaagtagttactaccggtacgtaaaatgttgccccattcagctacatcaggtgcaacaccaagtcctaggaaacttaaactacttgttgttaatacaaccacacctatatttaatgaaaaacgtacaatcataggcgcaatcgcattcggtaaaatataacgccatatgatattccaagtgttttcaccagtgatacgtgctgcatctacatattccatgcgtttaatttctaaaacactggcacgcattgtccgtgcaaatgatggtatattaccgatacttaaagcaataattaaatttggaatacttgctccaaatgatgcaataattgccaccgctaacaataatgatggaattgcaaacactacatctaaaattcgcattattaaattatcaatatgattaaaataacctgcgatagtgcctagtaacacaccaaaaataactgcaataactactgaaataattgaaattgaaaatgtcagcttcgttcctacaactacgcgtgtaaataagtctctaccgaaatcatcagtaccaaacggataggctagactcggtccatgtaacagtgcattgaactgatttttagtagccaatgtcgtatcaaatgtaaattgtgacacaattgataatgtcagcatgtagactaaaataagtaacccgataatcgcaatacgatgtctagtagtttttcgtataaacgattcccacccgttataactatgtatttgcgatgtacgttggtaacgtctaatacttacaaacattaataatgtaaatacgttgcctgttaatgtcatcaacaataacaacacttcgacgatacgtcgccataggtcatgatgcttccatgtttgttccgttgttaaaataataattaaaatgatggttaaaacgattagcaatgtttcagcaatatagaacgtatcggccacataacctttaaaaagatttaatgcactcgttaatataactaaaatataagttgctatggcgtaacttgcgaataattttaaggaagctatctttgaattaagttgtgccatatgcctcacttcctttcgttgatttcactacgtaattttggatcgattaaagcataaaatatatcaataattaagtttgctaaagatattacaattgatatatatacgaccccacccatgactgctggaatatcaggtattagttgtttttggacgatataacgcccgataccattaatgttaaatacttgttccgtcactgctgaaccgcctagtaactctgccactagaagaccaactaacgttacaattggaataatggcatttttcaaaatatgtttaataacaacttgtgtcgtcgataatccttttgcataagcagttaaaacataatcgctgcgcattacttcaagtacagaagaccttgtcatacgcgtgatagaagcagcaatacttgttccaatgacaagtacaggtaaaatcaacgatattggatgttctggcatataagatggtggcaaaatatccaatttcaatgagaacgctaaaatgaataatagcccttgccagaaacttggaatagataaaccaattaatgcaattatcattaacgtgatatcaagccaactatttcgcttcatcgcactgataataccaattggtattgcaataattaatgccaccattagcgctaatactgcgacaattattgtaattggaattctttcgccaactgctttagtcacaacctcattccctttgtaagtcgtacctaagtcaaaggtaaaaacacccttgatggtatcccacaattgaataaaataaggttcgttaagatgatgtaatacattgaattgatgtatctgtgcctttgttgcattttgtcccagtatgctataagccgcatcaagcggtgaaaaatacagaatggtaaacacactgacaataacaccaatgatgacaatcacagccatgacaattcgttcaaaaatatatctaactaatggctgtaaataaaaagtcaataagatgaacatcggcaaggccaatatcactttgatcatgatgaacttatgaaataatacattttcaaagtatgttgaaaaatgtgcttgttcaatattctttgaactcgtattagaactttgtgccttgaatatttttaatgcttctttatgtatttgtgtggatgacttttgctgcgataaatatttatatttttgatgtaacgcctgttcaatttctgaaatttcagaattattagcgtaaaaatttttcctcttagcagaaaagaaaaactttatcactgcatataaaaatattggcaagcttaataccgataatacaaacttgtaaaatgccttgtgatacaacgacttaaaagattctaaataagtaattatgataatcactccttgtaaaataatcttgagtagattactatgatatacaaaagtatagaataaatttacacatttgtgaatagggaggcacaacatcatgtcaaatttattagaagtcaacagtctgaatgtacaattcaattatgatgaaactacagttcaagcggtaaaaaacgtctctttcgaattacgaaaaaaacatatcctaggtattgttggtgaatcaggatcaggaaaaagtattaccgctaaatctattttagggctactaccagattatccagatcacacattaacaggagaaattatttttaatgggcaatcgttaaataatttatcaacttcagcgttacaacaaattcgaggtaaggatatttcaatgatttttcaagatccactctcttcgttgaatccaagattaacgattggcaaacaaattacagaagtaatatttcaacataaacgtgtatctaaatctgaagcaaagtcgatgacaatagacattttagaaaaagtaggtataaaacatgcaactcgacaatttgatgcttatccacatgaactttctggtggtatgcgtcaacgtgtcatgatagcaatggcattgattttaaagccacaaattttaatcgcagatgaaccaacaacggcattagatgccagtacacaaaatcaattactgcagttaatgaagtccctttatgagtacacagaaacatctattatttttatcactcacgatttaggcgctgtgtatcaattttgcgacgatgtgattgtaatgaaagatggaagtgtcgttgaaagtggcacggttgaaagtatttttaaatcgccacaacatacctatacaaaacgcttaatagatgcgattcctgatattcatcaaacgcgtccgccaagaccgttaaacaatgatattttattaaaattcgatcgcgtgagygggattacacatcaccgagtggcagcctataccgagcagttaatgatattaacttggctattagaaaaggcgaaacattaggcattgtcggtgaatcagggtcagggaaatcgacattagctaagacggtcgtcggtctaaaggaagtgtcagaaggctttatttggtataacgaattaccattaagtttatttaaagatgatgaattgaaatctttacgacaagagatacaaatgatttttcaagatccattcgcatctattaatccaagatttaaagtcattgatgtgattaaacgaccactaatcattcatgggaaagtcaaagataatgatgacattattaaaactgtcgtatcgttgttagaaaaggttggcctagatcaaactttcttatatcgctatccacacgaattatctggtgggcaacgtcagcgtgtaagtatcgcgagagcacttgctgttgaacctaaagtgattgtttgcgacgaggcagtgtccgctttagacgtttcaattcaaaaagatatcatcgagttattaaaacaattacagttagacttcggcatcacttatttattcatcacacatgacatgggtgttatcaatgaaatatgtgatcgcgttgcagttatgaaaaatggcgaaatcgttgaactgaataacacagaagatattatcaaacatccgcagtcagactatgcaaagcaacttatttcagaagtagcagttattgctaaataaaagtcatgcgttgtgcaactttatcactgtatggtctgaaataaattgcgcgacttctgatgtgttatgttagatgactttgtcatactaactatattgtgctaagttagggctcggcaccatatcaagttttaggtgctttgccatgatttaagagtcacccccatactttgggcattttaacgccagaataaatcccccgccactatgtgaagtgtgggggattatttatattttattagaatattcagatttttgagtgtgtcaacttagcttagtcaatgtatatttaacgtcacttactctttttctttcataattaacacattcaaataaactttgatcaaaaaacacaaagttaaaagtaccatcttgtaatatgctctcatacattatcccgtcatatttaaggcttcgaatataatcagctaaatattgaaatggcaaataatctattccttgttcatcgcttggatttgttattcctttatgaatcttttttaatgtttggtaatttacaaaatactttctaaatccatcatcgccagctttgattgcattactagttaaattagttaaattcgcaattttcaatttctcttttgtcacgtttttttgtaacttaaccttacctatataaataatgtcattatgcttaggtttaacttcttctatactgacctgttcttttgtactaaggtataatacgcttatccatttagaattcaatcttcctgccgttgcaaatccctttggtggtgacattagttcacttttctctgtaatgaacttaactattctagatctatataatggttcaaatctttctctaaattcctcaatactatagtaattagtagtgatatcgagaaagaacgctaaattctctaaattgatcatatttttatgaaatctatttttatacttcaagctctcacaaaatccatcccagtcattatttgctacaattagatttttatttgtatattttttatcgtttatgattttagcgcctactaaatcttccaacactcgtctatctaaattttcatcatctttaaaaagttcatttaaaatacaacttatttgagcttcctcaacattaaatatactccagtcgtcttttaatgctatttcaatctttttaccttcttttgggctaaaagtatctggtaaatttatactaatatcatataattctaatgctggtcttaaataatctctaataagttctaatttatctatgtccttagtcgtatcaaatattttaacaccaagatgattgttatcaatatcacaattgtcaaatttgctatttatcatttgcaatgatttctacgatttcagtattattaaaacatttttcacatattttcattttgagactccaagtatctattcataatttctaggtgatgcatgatagataaccttttaattaaacctaatcctggatacttattattttcatttaattcttcaaattgtcccaagcgcataagatctatttttaatatctaagttttttgaccatgttactaatt

SEQ ID NO: 117 - DNA, 3491 bp; double-stranded, linear
aactcaggcaattgaaacagcattaggtgcttcattacaacatgtcattgtagattcagaaaaagatggacgccaggctattcaatttttaaaagaacgtaatttaggtcgtgcgacgtttttaccattaaatgttatacagagtagagtggtagcgactgatattaaatctattgctaaagaggcaaacggatttattagtatcgcttcggaagcagttaaagtagcaccagaatatcaaaatattatcgggaatttattaggtaatacgattatcgttgatcatttaaagcatgcaaatgaattggcacgtgcgattaaatatcgaactcgtattgttactttggaaggtgatattgtaaatcctggtggttctatgactggtggtggcgctcgtaagtcaaaaagtattctgtctcaaaaagacgagttgacaacaatgagacaccaattagaagattacttgcgtcaaacagaatcatttgaacaacaatttaaagagttgaagataaaaagtgatcaattaagtgaactgtattttgaaaaaagtcaaaagcataatacacttaaagagcaagtgcatcattttgaaatggagctcgatagattaactacacaagaaacacaaataaaaaatgatcatgaagaattcgaatttgaaaaaaatgatggttatacgagtgacaaaagtcgacaaactttgagtgaaaaagaaacttatctagaaagtattaaagcatctttaaaacgactagaagatgaaattgaacgctacacaaaactttctaaagaaggtaaggaaagcgttactaaaacacaacaaaccttacatcagaaacaatctgatcttgctgtggttaaagagcgtattaaaacacaacaacagacaatagatcgattaaataatcaaaatcaacaaactaaacatcaattaaaagatgttaaagaaaaaattgcattctttaattcggatgaagtgatgggcgaacaagcttttcaaaatattaaagatcaaattaatggtcaacaagaaacgagaacacgcttatcagatgaattagataaattgaaacaacaacgtattgagttgaatgaacaaatcgatgcgcaagaagctaaactacaagtttgtcaccaagatattttagctatcgaaaatcactaccaagatattaaagctgaacaatcaaagctagatgtattaattcatcatgcgatagatcattaaatgatgratatcaattgactgttgaacgtgcgaratctgaatatacgagtgatgratcgatgacgcattacgtaaaaaagttaagttaatgragatgycgattgatgractaggtcctgtaaacttaaatgcaattgaacaatttgaagagttaaatgaacgttatacatttttaagtgaacaacgtacagatcttcgtaaagctaaagaaacattagagcaaattataagtgaaatggatcaagaggttactgaaagatttaaagaaactttccatgctattcaaggacattttacagctgtgttcaaacaattgtttggtggaggcgatgcagaattgcaattaactgaagccgattatttaacagctggtattgatattgtggtacaaccaccgggtaaaaagttgcaacatttatcgttactgagtggtggtgagcgtgcattaactgctattgctttactatttgcaattttaaaagtaagatctgcaccttttgttatattagrtgrggktgragctgcactagatgaagcaaatgttattagatacgcaaaatatttaaatgagttatcagacgaaacacaattcattgttattacacaccgtaaaggaacaatggaatttgcagataggttatacggtgtaacaatgcaagaatcaggtgttactaaacttgtgagtgtgaatttaaatacaatagatgatgtgttgaaggaggagcaataatgagcttttttaaacgcttaaaagataagtttgcaacaaataaagaaaatgaagaagttaaatccttaacagaagaacaaggtcaagacaaattagaagatacacattctgaaggttcaacgcaggacgcaaatgatttagcagaaaatgctgaagtgaaaaagaagccacgcaagttgagtgaagcggattttgatgacgatggcttaatatcaattgaagattttgaagaaattgaagctcaaaaaatgggtgctaaatttaaagcaggactcgaaaaatctcgtcaaaatttccaagaacaattaaataatttgatagcgagatatcgtaaagtagatgaagacttttttgaagctttagaagaaatgttaatcactgcagacgtcggttttaatacagtgatgacgttaactgaagaattacgtatggaagcacaacgacgtaatattcaagatactgaagatttgcgtgaagtcattgttgaaaagatcgtagagatttaccatcaagaagatkataattcagaagctatgaacttagaagatggtcgtttaaatgtcattttaatggttggtgtgaatggtgttggtaaaacaacaacaattggaaaattagcttaccgatataaaatggaaggtaaaaaagtaatgttagctgcgggcgatacttttagagcgggtgctattgatcaattgaaagtttggggcgaacgtgttggtgtagacgtaattagccaaagtgaaggttctgatccagctgctgttatgtatgatgcgattaatgccgctaaaaacaaaggtgttgatattttaatctgtgataccgctggacgtttacaaaataamacaaatctaatgcmagaattagaaaaagttaagcgtgtaattaatcgagcagtgccagatgcgcctcatgaagcattactatgtttagatgctacaactggtcagaatgcgttgtcacaagctagaaactttaaagaagtaacaaatgttacaggtattgtattaacgaaattagatggtacagccaaaggtggtatcgtattagccattcgtaatgaattgcacatcccagttaaatatgtaggtttaggtgagcaattagatgacttacaaccatttaaccctgaaagttatgtctacggcttattcgctgatatgattgaacaaaatgaagaaataacaacagttgaaaatgatcaaattgtaacagaagaaaaggacgataatcatgggtcaaaatgatttagttaaaacgttacgaatgaattatttgtttgattttatcaatccttattgacgaataaacaacgtaattatttggaattattttatcttgaagattattctttaagtgaaatcgcagatacttttaatgtgagtagacaagcagtttatgataatataagaagaactggcgatttagttgaagattatgaaaagaaattggaattataccagaaatttgagcaacgccgagaaatatatgatgaaatgaaaccacatttaagtaatccagaacaaatac

SEQ ID NO: 118 - DNA, 4253 bp; double-stranded, linear
agtacgttttataattataagtacgtaattaacatattaacatatcgcaagtatgtatttaaataagattgttataatttcaaagttcatccaagattatggcgtttgcatttacctattaaaaacgttattatatcaaagatgcgaaagataatacgggtttattttatgaaagtgagaaggataaaatggataatgagcaacgcttaaaaagaagagagaatataaggaatttctcgattatagcacatattgaccacggaaaatctacattggctgatagaattttagaaaataccaaatcagttgaaacaagagatatgcaagatcagttactagattcaatggatttagaaagagaacgtggtattacaatcaaattaaacgcgtacgtttaaagtacgaagctaaagatggaaatacttatacattccatttaatcgatacgcctggacacgtcgattttacatatgaagtgtcacgttctttggcagcttgtgagggcgcgattttagtagtagatgcggctcaaggtatcgaagcacaaacattagcaaatgtttatttagcattagataatgagttagagttattgcctgttattaacaaaattgatttacctgctgcagaacctgaacgcgtgaaacaagaaattgaagatatgataggtttagaccaagacgatgttgttttagcaagtgctaaatctaacattggaattgaagagatactagagaaaatagttgaagttgtgccagctccagatggtgacccagaagcaccactaaaagcgttaatatttgattctgagtatgatccatatagaggggtaatttcatcgataagaattgtggacggtgttgttaaagccggagataaaattcgaatgatggccactggtaaagagttcgaagtaacagaagttggaattaatacacctaagcagcttccagttgatgaattaacagttggtgatgttggttatattattgcaagtattaaaaatgttgatgattctagggttggtgacaccatcacattagctagtagacctgcatcagaaccattgcaaggttataagaaaatgaatccaatggtatattgcggactgttcccaatagataacaaaaattataatgatttaagagaagcattagaaaaattacaattgaatgatgcatcattagaatttgagcctgaatcgtcacaagcattaggttttggttatagaactggtttcttaggtatgttacacatggaaataattcaagaaagaattgaaagagaatttggtattgaattaattgcaactgcaccatctgtaatttatcaatgtgttttaagggacggttcagaagtgacggttgataacccagcacaaatgccagatcgtgataaaattgataaaatatttgagccatatgttcgtgcaactatgatggttccaaatgactatgtcggtgcagtaatggaattatgtcaacgtaaacgtggacaatttataaatatggactatttagatgatattcgtgtaaatattgtttatgaattacctttagctgaagttgtatttgatttcttcgatcaacttaaatctaatactaaaggatatgcatcatttgattatgaattcatcgaaaataaagaaagtaatttagtcaagatggatattttattaaatggtgataaagtggatgcgctaagcttcatagttcatagagattttgcatatgaacgtggtaaagcattagttgaaaaacttaaaacgttaattccaagacagcaatttgaagtacctgtacaggctgcaataggacaaaaaattgtagcgcgtacaaatattaaatcaatgggtaaaaacgttttagctaaatgttatggcggtgacataagccgtaaacgtaaattacttgaaaaacaaaaagcaggtaaagctaagatgaaagcagttggtaatgttgaaattccacaagatgctttcttggctgtattgaaaatggatgatgaataattttaaaaaatcaattaacaatttacaatgaataaagtttaataactaaaaagagggagcctaggataaattaacgtcctgggctttacaatgttatattggcagccatcgacagagttaaaatgagcttataacaatggggccccaacacagaagctgacgaaaagtcagcttactataatgtgcaagttggggtggggccccaacatagagaatttcgaaaagaaattctacaggcaatgcaagttggggtgggacgacgaaataaattttgcgaaaatatcatttctgtcccactcccttatgcatgagttttactcatgtaattttatttttaaggacatattacatctggctaatgtgtaagagccactacataataaatcattagtggttctttattatttctatctcactccctctaaacaagaataaatattaaaatgaatcgatatattagacaatcattgattaaacgttaaagttaaaagtaagaataattgcagatagtccaacaggatatagccgattggataaaaagtctgagaagcggggcattaaaatgacggtacaaagtgcatatatacatattccattttgtgtaagaatatgtacatattgtgatttcaataaatattttatacagaatcaacctgtagatgagtacttagatgcactaatcacagaaatgtctacagcaaaatataggatcttaaagaccatgtatgtaggtggcggcacaccaacggccctttctattaatcagttggaaagattacttaaagcaatacgtgatacgtttacaatcacaggcgagtatacatttgaagcaaatcctgatgagttaactaaagagaaagtccaactattagagaaatatggagtaaaaaggatttcaatgggcgttcaaacattcaagccggagttattgtctgttttaggtagaacgcacaatactgaagatatttacacttcggtgttaaatgctaaaaacgcaggtattaaatcaatcagtttagatttaatgtatcatttaccgaaacagacgattgaagattttgaacaaagtttagatctagctttagatatggatattcaacatatttcgagttacggcttaatacttgaacctaaaacccaattttataatatgtatagaaaaggcttgctcaaacttgctaatgaggatttaggtgctgacatgtatcagttgctgatgtctaagatagaacaatctcctttccatcaatacgaaatatctaattttgcattagatggccatgaatcagaacataataaggtttactggtttaatgaggaatattatggatttggagcaggtgcaagtggttatgtagatggtgtgcgttatacgaatatcaatccagtgaatcattatatcaaagctataaataaagaaagtaaagcaattttagtatcaaataaaccttctttgactgagagaatggaagaagaaatgtttcttgggttgcgtttaaatgaaggtgtgagtagtagtaggttcaaaaagaagtttgaccaatctattgaaagtgtctttggtcaaacaataaataatttaaaagagaaggaattaattgtagaaaagaacgatgtgattgcacttacaaatagagggaaagtcataggtaatgaggtttttgaagctttcctaataaatgattaaaaaaaattgaaatttcgagtctttaacattgacttactttgaccaatttgataaattataattagcacttgagataagtgagtgctaatgaggtgaaaacatgattacagataggcaattgagtatattaaacgcaattgttgaggattatgttgattttggacaacccgttggttctaaaacactaattgagcgacataacttgaatgttagtcctgctacaattagaaatgagatgaaacagcttgaagatttaaactatatcgagaagacacatagttcttcagggcgttcgccatcacaattaggttttaggtattatgtcaatcgtttacttgaacaaacatctcatcaaaaaacaaataaattaagacgattaaatcaattgttagttgagaatcaatatgatgtatcatcagcattgacatattttgcagatgaattatcaaatatatctcaatatacaactttagttgttcatcctaatcataaacaagatattatcaataatgtacacttgattcgtgctaatcctaatttagttataatggttat

SEQ ID NO: 119 - DNA, 3395 bp; double-stranded, linear
tccctaatcgaacaaaattatgcgcataaacaaagtagattgatataaaattcttaattatcagaatatatttacaaatctgaattttattagtatattggrtagtrttcatagaggcatgacggtatttgagcaggattttaaatcgggattttataatcgatttaagagaggccactttgcttgcacattaatactgtcaatgggaggggaatgtatatgagtraagcacatcaattaattcaagaggatgaacattattttgcgaaatcaggacgtattaaatattatccgttagtgattgatcatggatatggagcaacattggttgatattgaggggaagacatatatcgatttgttatcgagtgcgagttctcaaaacgtaggtcatgcacctagagaagtaacagaagcgataaaggcacaagttgataaatttattcattatacaccagcatatatgtatcatgaaccgttggtacgtttagctaagaagctttgtgagattgcacctggagattttgaaaaaagagtgaccttcggattaaccggatcagacgcaaatgatggcatcattaaatttgccagagcatatacagggcgtccttatatcattagtttcactaatgcatatcatggttcaacttttggctcattgtctatgtcagctattagtttaaatatgcgcaaacattatggtccgttattgaatggtttttatcatattccgtttccagataaatatcgtggtatgtacgagcagccacaagctaattcagtagaagaatatttagcacccttaaaagaaatgtttgcgaagtatgtacctgctgacgaagtagcatgtattgttattgaaacgatacaaggcgatggtggacttttagaaccagttccagggtattttgaagcgttagaaaagatttgtcgtgaacatggtattttaatcgctgtcgatgatattcaacaaggttttgggagaacaggtacatggagttcagtctcgcattttaattttacgcctgatttaatcactttcggaaaatccttagcaggtggtatgcctatgtcagcaattgttggacgcaaagagattatgaattgtttagaagcaccagcacatttatttacaacaggtgctaatccagttagttgtgaagctgcattagccacaattcaaatgattgaagatcagtcgcttcttcaggctagtgcggaaaaaggggaatatgttaggaaacgaatggatcaatgggtatctaaatacaatagtgtaggcgatgttagaggtaaaggtctgagcattggtattgatattgtttccgacaaaaaactcaaaacacgtgatgccagtgcggcacttaaaatttgtaattactgctttgagcatggcgtagttattatagctgtagcaggaaatgtgttgcgattccaaccgccattggtaataacatatgagcaattagacacggcgttaaacactatagaagatgcactgactgctttggaagcaggtaacttagatcaatatgacatatctggacaaggttggtaatagcgattatcttaatataaaataaaaaatcatttccacatctggatgttaatcagatgggaaatgattttttttattttttattttggtgggtggtattcagctacgtcatttttcttagaatgtctaagtccataacttaaatataggatgataccaacaataaaccaaattaaagtgtataatttcgcttcgaatcctaatccccagaatactagcaatactaaaacaaatgtaattgctggtaacacaggatataaaggtaatttaaatgcaggaattggtagatctttaccttcacgctttctcaaacgatacattgctaatgaaacgaacataaatgcaacaagtgtacctgctgaaattaattgtgctaaaaatgcgaatgggaacatagaaccaattaaaacaccaataatagtaagtataactagtgcgcgattaggtaaatgtttgtcgtttaagtggcttaaccatgaaggtaataagccgtcacgtccaaatgaataaagtaaacgtgagcctgctaacatcataccaattaatgctgtaaacataccgataacagagatagcttgaacaatagctgctacaacaccatgaccactttgacgtaaagcccaaccaacaggttcagcattgtttgcgtattgtgagtaatggaacataccaactaacacaagtgctacagcaataaataatacgatagcaacgcttaaagaaccaagaatacctctaggcattgtcttttgaggatcaagtgcttctgctgagtttgctgcgatagaatcgaaaccgatatacgctaagaaaatcattgaaacaccagcatatatgccttgccatccaccaaagtcacctgtagcagttactttgtgttctggaataaatggcacatagttactaacatttattgctgttaaacctacgatgacaaataaaataatagctaatacttttaaaataactaaaatattttccatacgagctgcttccgacataccacgtgatagtaataatgcagttaataaaataacgatagcagcaataatatcgataaaaccgccatttgtaccaaatggatttgataatgctgcaggtaattcgatgccaattggtttcacaagtccgcgtaaattcgctgagaatcctgatgcaacaaaggctacggcgataaaatattcagctaatagagcccaaccggcaacccatccaaaaaattcaccaaataatacattgacccaagaataggctgaacctgcaaatggcatagcggcagccatttctgcataagtaaatgcaactaaaccagcaacaatagcagcgagtaagaatgataacgcaacggccggtcctgcatgttctgcagcaacaatgccaggtagcgtaaagatagatgtcgatacaattgttcctacacctaaagctaagaaatcacgcacccgaagtgtacgctttaaatgaccatctttattttgatagatagccggatcctcttttcgtgctattttattgaaaaaacttcccataaactttcctcccaaacattcataaacaattctatacggtgttttttaatatgttatatcatagcacaaataatcaatattttgtctaaaaattctgaaaaatcacaactttatgttacgtattaatgacttgtcttgataacatccatagattttttaaatgataaaactgattataacagatattaaatgaataagtactattttttgcnaattttctaacaattttgcacattatatgtttaaaatcaatttcatgtttatggtctgattggctagtgtgtatgaaatgtaantctttgactnnga

SEQ ID NO: 120 - DNA, 13508 bp; double-stranded, linear
atcaggtaatgccatgcgtttagctgaaaattttttcagaacgtttaagtgatatcggacatcaagttgttttgatgtcaatggatgaatatgatacgacaaacatcgcgcagttagaagatttatttattattacgtctactcatggtgaaggagaaccgcctgataatgcatgggatttctttgaatttttagaagacgataacgcacctaatttaaatcatgtgagatattcagtactagctttaggtgatcaaacatatgaatttttctgtcaagccggtaaagatgtagatgttttactagaaaatctaggcgctgagcgtatatgtaagcgtgtagattgtgatattgattatgaagaagacgcagaaaagtggatggcagacatcattaatattattgataccacatcagaaggtattcaaagtgaatcggtgataagtgaatcaattaagtctgccaaagaaaagaaatattctaaatcaaatccataccaagcagaagtattagcgaatatcaatttaaatggtaccgattcaaataaagaaacacgacatatagaatttttacttgatgattttagtgaatcatatgaaccaggagattgtatagtagcattaccgcaaaacgaccctgaattggttgaaaaactaatatccatgttaggttgggatccgcaatctccggtgccaattaatgatcatggtgatacagttcctattgttgaagcactaacatcacattttgaatttactaaattaacattgccattattgaaaaatgcagatatctattttgacaatgaagaattatctgaacgtattcaagatgagtcatgggcgcgtgaatatgttataaatcgggactttatagatttaataacagattttccaactatagaattacaacctgagaatatgtatcaaatccttagaaaattaccaccaagagagtattcgatttctagtagttttatggcaacgccagatgaagtgcatattaccgttggtacggttcgttatcaagcacatggacgtgagagaaaaggtgtatgctcggttcattttgctgagcgaattaaaccaggcgatatagtaccaatttatttgaagaaaaatccgaacttcaaatttccgatgaagcaagatataccggttattatgattggaccaggtactgraattgctccttttagagcatatttacaagaacgtgaagaacttggtatgactggaaaaacatggttgttctttggtgatcaacaccgtagttctgactttttatatgaagaagaaatagaagaatggcttgaaaatggaaacttaacacgcgtagatttagcattttcaagagaccaagaacacaaagaatatgtacagcatcgtataatggaagaaagtaaacgtttcaatgaatggattgagcaaggcgcacaatctatatttgtggcgatgaaaaatgtatggcgaaagatgtccatcaagccattaaagatgtattggtaaaagaacgtcatatttctcaagaagaagcagagttattattgcgacaaatgaaacaacaacaacgctatcaacgtgatgtttattagcgattggtgttaaatattttaaggtgtaatgatgtaaaaagatataaaggatgttgctcaacatgaatatgccattaatgatagatttaacaaataaaaatgtcgtcatagttggtggaggcgtcgttgcaagtcgtcgggcacaaacattaaatcaatacgttgaacatatgacggtcatcagtccgacaatcactgaaaaacttcaaaatatggtagataacggtgtcgtcatatggaaagaaaaagaatttgaaccaagcgatattgtagacgcgtatctagttattgcagcaaccaatgagccacgtgtcaatgaagcggtaaaaaaagccttacctgagcatgccctttttaataatgttggagatgcatcaaatggcaatgttgtatttccaagtgcactacaccgcgacaagctaactatcagtgtatcaactgatggtgcgagtcctaagttgacaaaatcaattatggcagagcttgaggcgttatatccaccatcatacagttcgtatatcgactttttatatacttgccgacagaaaataaaagtacttgatataacatataacgaaaagcaacagttactgtcacaaattgtgtcacaagaatatttaaatcatgacaaacaagctcaatttttagcgtggttggatgtaagataataatagcggaccgtctaaccgtctaaggtaagtcttcttattttaactttaacgcttaatcattgaaattaagacatgggcggctttgtgaatagtctaataatgaaggatttaagcgataatgatatgcgttttaaatatgaatattacaatagagaaaaagatacgtagaacaaacttaataaaataggtggataaattgaaatctggttgaagtcgttactatcatagcgacctttagccagattttttgtgcaatagaaagcaataataaaaatgatagatcaaaatgaaatacaggacaggatatacaaggattagtcatgccatgttatcaagtaggaaaatcaaacttcactattgatagttacgcaaaaaagatttttttgataaaatgagataacttaaatataaaaaattatattaattataatatttaagttaaagagggggattatgtaaattgtattaaaagtggagggagaaaataatatgaatagtgataatatgtggttaacagtaatggggctcattattattatttcaattgtaggtttactcattgccaaaaagataaatccagttgtaggtatgacaatcataccttgcttaggggcaatgattttaggatatagtgtgacagatttggttggattttttgctaaagggttagatcaagtcatcaacgttgttattatgtttatctttgccattattttctttggcatcatgaacgatagtggtttattcaagccgcttgtcaaacgcttaatattaatgacacgaggcaatgtcgtcattgtctgtgcaatgacagctttaattggcacaatagcccaattagatggggccggtgcggtaacatttttgctttctattcctgcattattacctttatataaagcgttaaatatgaataaatatttattgattttactattagcattaagcgcggcgattatgaacatggtaccttggggaggtccaatggctcgtgtagctgcagtgttaaaagccaaaagtgtcaatgaattatggtatggattaatacctattcaaataataggtttcattcttgttatgttgtttgcggtatatcttggatttaaagaacagaaacgtatcaaaaaagcaatagagagaaatgaattaccgcaaacacaagatatagatgtacataaattagttgaagtatatgaacgagatcaagatgtaaggtttcctgtaaaaggacgtgcaagaacaaaatcatggataaaatgggtgaatacagctttaactttagctgttattctatcgatgttaataaatattgcgccacctgaatttgcattcatgataggtgttycgttggcacttgttattaattttaaatcagtggatgaacaaatggaacgattaagagcgcatgcgccgaatgcattaatgatggctgcagtgattattgcagcaggtatgtttttaggtgtactaaatgaaaccggtatgcttaaagcgattgcgaccaatttaatcaaagtgattcctgcagaagtaggaccatacttgcatattattgtaggtttacttggcgtaccattagatttactaactagcacagacgcttattattttgctgtgttaccgattgtcgaacaaacagcagggcaatttggtgtaccgtctgtatcaacagcttattcaatggtcatagggaatattataggtacatttgtcagcccattttcaccagccttatggttggcaattggtttagcagaggcaaacatgggcacgtatattaagtatgcattcttttggatttggggattcgctatcgttatgttagtaattgcaatgttgatgggcattgtgacgatttaagtatgaaaaaatagaaactatggtcacgttgcaaaatgaaataatagttgcataaacatgtcgaaatgacggacgaatctttaaacaattttaaaaattaatgaaataattgtgtagaaatatgaatttcactaaatgttaataactttgtgacgttttagttaacagactaataaaaatttgaaaatactatatatagtggtataacgtaatgagtagacacaatatataggaagaaggggtaaaatgaatcaaatcgaagaagcattaacgggtttgatttctaaagatcctgctattgttaacgaaaatgctaacaaagatagtgatacattttcaacaatgagagatttaacagcaggtatcgtttctaaatcttacgcattaaatcatttattaccaaagcacgttgcagatgcacatcaaagaggggacatacattttcacgacttagattatcatccattccaaccgttaactaactgttgtttaatagatgctaaaaatatgctacataatggatttgaaataggcaacgcgaatgtaacttcaccaaaatcaatacaaactgcatcagcgcagcttgtacaaattatagccaatgtttctagcagtcaatatggtggctgtacggttgaccgcgttgacgaattacttagtacatatgcacgaccataatgaagaacaacataggaatatscgcaaagcaatttgtcaaagaatctgaaattgatcgttatgttgatcaacaagtcactaaagacatcaatgatgcgattgaaagtttagaatatgaaattaataccttatatacatctaatggacagacaccttttgtaacattaggattcggcttaggtacagatcatttaagtcgcaaaattcaacaagctatcttaaatactcgtatcaaaggcttaggaaaagaccgcacgacagcgattttcccgaaacttgtattttcaattaaaaaaggaaccaactttagtccgcaagatccgaactatgacattaaacaactagcattaaagtgttcaacgaaacgtatgtatccagatattttaaattatgacaaactcgtagaaatattaggtgatttcaaagcgccaatgggttgtcgttcatttttaccaagttggaaagatgcggaaggtcattttgaaaataatggtcgttgtaatcttggtgttgttacacttaatttacctagaatggcattagaatctgccggtaatatgacgaaattctgggaaatcttttatgaacgtatcgatgtgttacatgatgcattactttatcgtataaatcgtttgaaagatgctgtaccgaataacgcaccgattttatataaaagtggcgcatttaactataaattaaaagaaacagatgatgttgctgagttatttaaaaataaacgtgcaacgatttcaatgggctatatagggttgtatgaaacagctactgttttctatggtccagactgggaaacatctcaagaagcaaaagcatttacgcttgaaattcttaaagaaatgaaacgttatcaaacgaaatggacagaattatatgacatttggttcagtatttmcagtacgccgagtgaatcgctacggatcgtttttgtcgtttagaccaagagagatttggagatattaaagacattacagataaaggatattatcaaaactctttccattatgatgtacgtaaagatgttacaccttttgaaaagttagattttgaaaaagattatccttattatgcgagtggtggtttcattcactattgtgagtatccgaaattgcaacacaatttgaaagcactagaagcggtatgggactactcttatgacaaagttggttacttaggtacaaatattccgattgatcattgttatgaatgtgattacgatggagattttgaagcaactgaaaaaggatttaaatgcccgaactgtggcaatgataatcctaaaacagttgatgtcgttaaacgaacatgtggttacctaggcaatccagttcaacgtccagtaattaaaggccgtcataaagaaatttgcgcacgagtaaaacatatgaaagcgcctaaagaatgatacttttagacattaaacaaggacaaggttatattgctaaaatagaatcaaatagctttgttgacggtgaaggagtaagatgcagtgtttatgtatcaggatgtccatttaattgtgttggatgttataacaaagcctcacaaaagttcagatatggcgagaaatacactgatgaaatattagcagaaatattagatgattgcgatcatgattatatatctgggctaagtctattaggtggcgaaccattttgtaatttggatattacattaaatcttgtcaaagcatttcgagcacgttttggaaatacaaagacaatttgggtatggactggatttttatatgaatatttagcaaatgattgtacagaacgtcgagagttattatcatacattgacgttttagtagatggtctatttatacaacacttattcaaacctgatttaccatataaaggttctttaaatcaacgcattatagatgtacaacaatcactctcgcatgcgcgtatgattgaatatatagttagttgaatatgtattagaagtcaaggtaacattcgttgccttggcttctttttaggttaggtacataattgaaagttaataaaagcaattctttataaaaatatattgatagaatatgacctaacaatcattttgataccaatactaaaagttgcatatccgttttttaaaaaagttgaaagagaaaagtggtattttagtgggaaggaagtctaactttttggtagcgttttacaataaataaatattcgttaataacgtataaatattcttaaatgccattctagtaaaatttgttaaattcgttaaatcgtaacttaacactgttattttagcgctattaaggttttgtttattacgggaaaaattatataaatattcaataattgccaagtttcaaattgtatgaaatttgcattattattaaatgttagttattgtcaattttgtgaatcaatataattattacattttgagataaatcgaaacaggattcataaaattaataattagggggagcacaattgaaaaaagagaaagttatggactggacgacctttatagggacagtagctgtacttctttttgcagttatacctatgatggcttttccaaaagcaagtgaagatatcatcactggtattaatagtgccatttctgattcaattggttcgatatatttatttatggggctggcgattttttgctttgtaatgtatatcgcatttggtaaatatggtaatgtcacacttggtaaagcaagtgataaaccagaatttaatacatttacatgggcggcaatgctgttttgtgcaggcataggctctgatattttatactggggcgttattgaatgggctttttactatcaagttccaccaaatggcgcgaaaagtatgagtgatgaagcactccaatatgcgacgcaatatggtatgttccactgggggccaattgcttgggctatttatgttctaccagcattaccaattggttatttagtatttgttaaaaaacaaccggtgtataaaattagtcaagcttgtcgtccgattttaaaaggtcaaacagataaatttgtaggtaaagttgtagatatcttatttatctttggattgctaggtggtgcggcaacatcactagcgttaggtgtgccattaatttctgcaggcatagaaagattaactggtttagatggtaaaaatatgattttacgttcggccattttattaacaatcacggttatatttgccattagttcatatacaggattgaaaaaaggtattcaaaagttaagtgatatcaacgtttggctatcctttgtacttttagcctttatatttattattggaccgactgtttttattatggaaacgacagtgacagggttcggaaatatgttgagagatttctttcatatggcaacatggttagaaccattcggtggtattaaaggtcgaaaagaaacgaatttcccacaagactggacaatattctactggtcatggtggttagtatatgcgccatttatcggtttatttatcgctagaatttcaaaaggtcgacgccttaaagaagtcgtgctaggaacaattatttatggaacgcttggatgcgtattattctttggtatttttggtaactatgctgtgtatttacaaatttctggacagtttaatgtaacacaatatttaaatacacatggtacagaggcaaccattattgaagtggtgcatcatttaccattcccatcattgatgattgtactattcttagtatctgctttcttattcttagcaacaacatttgattcgggttcatatattttagcggcagcatctcagaaaaaagtggtaggcgaaccattacgtgccaatcgtttattctgggcatttgcattgtgcttattgccattttcattgatgctagttggtggtgaacgtgcattagaagtattgaaaactgcttcaatactggcaagtgtgccattaattgttatttttattttcatgatgatatcatttttaatcattttagggcgcgatagaattaaacttgaaacgcgtgctgaaaaattaaaagaagttgaacgtcgttcattgcgaatcgttcaagtatcagaagaagaacaagacgataatttataattcaaagcgggtctgggacgacgaaatgaattttgtgaaaatatcatttctgttccattcccctttttttagtagcattgtaggatgaacttttaggttttcattaatgttgtactaaaagatttaattttttagtgctccaagtacttatttattgtatgaagcatattctaaatcgaagtttgaaagactctcattgattattaaattaaataaagggtatgcgtatgtacaattcaaattaatcgaaggatgaaataaaatgactaatcaatttaaaaataaacagtccaaattacatgacagtttagaatccatcacaaaaaacttatatgcgacacctacttcggaactgccttttgataatcgatttctatttaaatcttttattttaaaacgtgaaacagaatattgttatctatcattccggacacttaggtgactcccaacaagacattgcatcattaggtggtgtttcaaaagtattgatgaatcatgatcatgaatctataggaggttctaatcaagttgaagccccttactttatacatgaaaatgatgtggctgcactgaaacataagatttctgttcaaaaacaatttagtaatcgtgtaatgttggataaggatttagaagttattcccgcgcctggacatacaccagggacgacactatttttatgggatgatggtcatcaccgttacttatttactggagattttatatgttttgaagggaagagatggcgtacagttatattaggttcaagtgatagagaaaaatctattcaaagtttagagatggttaaagaattagattttgatgtacttgtaccttgggttactatcaaagatgaaccgttagtttattttgtagaaaatgaatatgaaaaacgtgaacaaatacaaaatattattgatagagtacgtgagggcgagaatagctaattgaaatatattggcgaagcaatgtaacgaatctaagaaagccctagaaaatacctccataattgattgtcatataaaacaaaaacggtaatttctatttattgagatagaaattaccgtttatttcgtggacctattgcattgtttttatcatgcataatcatcattgtcgttgtttgagtcaattttaattttcagaatcagaaggctgttctggaattgggaaatatttgaaaatttcaccgctttcaatcgcttcggttaactgttctaaccattcgtaataaacatgtgtatgatcaagctgagctttaattttttgtgcctcttgtgtttcagcttcagttaaatcactgctttcaagtaatggattgataatagcttgagcatcttttactgcttcgacattgatgtcaatttcacgctggaattttttagtgaaaaagtttcggaaaaagatgaaaaagtctttctcggcgataaaatgttgtttgcggcttcctctcgtaaattgttgtttaacaatatcaaattcctgcaatttcttaacgccagcactcatacttggtttgctcatttgcaattgatgacgcatttcatcaagcgtcatactgccttcaaacaccattgtgccatataagtttcctacacttctattagtgccatacaaatccattgtctgtccaattgaattaattacaatatcttttgcttgttctaattgttgctgtttgttctgagaacgagtcatcattgcacctccgtacatcattttggtcacgttaaaataaatactaatacattataaaaccttttctaaaaaaagacattaaaaatatttaaagcattaaagttaaatgtttcgttaaataaaaatctaacgaacttacaaaacttaattcttgagttgttttgtaaattgacacatttttcatttctatgctaacataagtntgtaaaattcgttaaataaaaatttaacaaacttaacggrggttgttgaakggracttttaaaacatttatctcagcgtcaatatattgatggtgagtgggttgaaagcgcgaataaaaatacaagagatattatcaatccttacaatcaagaagtgatatttacggtttctgaagggacaaaagaggatgcagaacgtgcaatcttagctgcaagacgtgcgtttgagtctggtgaatggtcgcaagaaactgctgaaacaagaggtaaaaaagtacgtgccatcgcggacaagattaaagaacatcgcgaagcgttagcacgattagaaacattagatactggaaaaacgttagaagaatcatatgcagatatggatgatattcataatgtgtttatgtattttgctggattagcagataaagacggtggcgaaatgattgattcaccaattccagatacagaaagcaaaattgttaaagaaccagtaggtgtagttacacaaattacaccttggaattatccgttattacaagcatcatggaaaattgcgccagcgcttgctacgggttgttcactagttatgaaaccaagtgaaattacaccattaacaacaatacgtgtttttgaattaatggaagaagttggtttccctaaaggaacaattaatcttattctaggtgcaggttctgaagttggtgacgtaatgtcaggtcataaagaggttgaccttgtatcatttacaggtggcattgagactggtaagcatattatgaaaaatgctgctaataatgttacgaatattgccttggaacttggcggtaaaaatccaaacattatctttgatgatgctgattttgaattggcagtagaccaagcgttaaatggtggatatttccatgcaggtcaagtttgttcagcaggatcaagaatattagtacaaaacagtattaaagacaaatttgagcaagcacttattgatcgcgtgaaaaaaatcaaattaggtaatggttttgatgctgatactgaaatgggaccagtgatttcaacagaacatcgtaataagatcgaatcttatatggatgtagctaaagcagaaggcgcaacaattgctgttggtggtaaacgtccagatagagatgatttaaaagatggtctattcttcgagccaacagtcattacaaattgtgatacgtcaatgcgtattgtacaagaagaggttttcggacctgtcgttactgtagaaggctttgaaactgaacaagaagcgattcaattagcgaatgattctatatatggtttagcaggtgctgtattttctaaagatattggaaaagcacaacgcgttgctaacaagttgaaacttggaacggtgtggattaatgatttccatccatattttgcacaagcgccatggggtggatacaaacaatcaggtatcggtagagaattaggcaaagaaggcttagaagagtaccttgtttcaaaacacattttaacaaatacaaatccacaattagtgaattggtttagcaaataaaaattagataaggtgagtgccattgtaagaacacaagacactcactttgttttgtataagtggcgaaatgttgattgataatttggactaaacgcaaaatgaatcatagattatttcattactgttagtaacaatcgtaaaaggaaaagcgagtgttttggttagctaagtttagcaattcaacgataaccaatcagccactaacaaatatttcatgcaatactcactttgaaatacaacaaactttggaggtcataacgatgagtaacaaaaacaaatcatatgattatgtcatcattggaggaggcagtgcaggttctgtactaggtaatcgtctgagtgaagataaagataaagaagtcttagtattagaagcgggtcgcagtgattatttttgggatttatttatccaaatgcctgctgcgttaatgttcccttcaggcaataaattttacgattggatttattcaacagatgaagaaccacatatgggcggtcgtaaagtagcacatgcccgaggtaaagttttaggtggatcaagttcgattaatggcatgatttatcaacgtggtaatccaatggactatgaaggctgggcagaaccagaaggtatggaaacttgggattttgcgcactgtttaccgtattttaaaaaattagaaaaaacatacggtgcagcgccttatgataaatttagaggccatgatggaccaattaagttaaaacgagggccagcaacgaatcctttattccagtcattctttgatgcaggtgttgaagcaggctatcataaaacacctgatgtgaatggatttagacaagaaggttttggaccgttcgatagtcaagtacatcgtggtcgccgaatgtcagcttcaagagcatatttacatccagcgatgaagcgtaaaaacttaaccgttgaaacacgtgcctttgtaactgaaattcattatgaaggtagaagagcaactggtgttacgtataagaaaaatggcaaactacataccatcgatgctaatgaagtcattttgtctggtggggcattcaatacgccacaattactacaattatctggtatcggtgattcagagttcctaaaatcaaaaggcattgagccacgtgttcatttacctggtgtgggtgaaaactttgaagatcacttagagg

SEQ ID NO: 121 - DNA, 7646 bp; double-stranded, linear
gtaagtattgtcttgatttcctaataaagttatatcttgtaattcatcttgttgacggccatgtgccatataaagcgctcctttaaatttatttttttattattttggcgtctcggcgtgctttttcaaacatgtaataacttgcaccgataataacgacgtaacctaatgttgcatagaaatctggagattctccgaatagaataaatccaagtattgctgtgaaaattatagatgcatacgtaaaaatagaaatatcttttgctgctgcaaaactatatgctaaagtaacaccaatttgacccacagcggcagctaagccagcccctaatagataaagtatttgcatctgactcattggttcataagtatatgcagtgaaaggtattaaaacgatgacagaaaataaggagaagtaaaatactatagtatatggtgcttytcttgtactaagtgctcgaacacatgtatatgctgatgctgcaaaaatacctgagaataagccagctaatgatggaatcatagatgatgaaaattcaggtttcactattaanagcaacctaaaatagcaattatcattgctgtaatttgatacttccttaccttttcatgtaagaaaacaatgcttaataaaatcgtccagaaaggattgagtttcattaatgaatcggcatcactaagtaccatatgatcaatggcataaatatttaacaatacaccaataagtccaagtgttgatcgtgttattaataagggttgacttgaaagtctgccaaacattggctgatggtatttatatataaaaaataatggaataaacattgctactaagtttcgtgctaatgatttttgaaaaacaggaaggtcacctgcaagtctgaaaaacactgacataaaactgaaaccaatagccgaaattaaaatggcaatgataccttttactttaggattcaattttatcgcctcttttatataaaattaacgtatttatattagcataaaacaacatgttgtgcataaatagttgaaatttactataaaaagactataatagactgtagcgaacaaacgttctgtgtttatttgtcggaataatagggcattacacttttatgaatgtttgtgttattacataaaacaaatatcaattcagtatcaagctaataagctttttcttgatttctgttgatacaattgagattgacacagatttaaaaaaatcaagtgatatctactaaaaaatttttttaaatttgttcaagtttttctaatttagtattggtgcctagttggaacgttttacgaacattcgattagaaaatggcactttaaatcatagtgtgtcttatgtataatgaaacacataatatagtgttggtgaaacgaaaaagacacaatatcttgtgttttgtatgcaaatgctttatttatgaagaaattacatttaaaagtaatttaacacagaaatttaatagttattatcaattaatagtcatatttttagaaaatgtactgagcaaatggaagatatccaatgatgtaaacactacatatagtgatttttatacattcaacccatataagctactattttctcaaatataaatctatgcaattggtttacatttgagaaaataagtagcttcattatagttaatacaatgctgagataaccatagtaaccatgttgttaaagcattttttaattggaatgactactttatttaaaagggttgaagaaagaaggtgatccaatgaaaataatatatttttcatttactggaaatgtccgtcgttttattaagagaacagaacttgaaaatacgcttgagattacagcagaaaattgtatggaaccagttcatgaaccgtttattatcgttactggcactattggatttggagaagtaccagaacccgttcaatcttttttagaagttaatcatcaatacatcagaggtgtggcagctagcggtaatcgaaattggggactaaatttcgcaaaagcgggtcgcacgatatcagaagagtataatgtccctttattaatgaagtttgagttacatggaaaaaacaaagacgttattgaatttaagaacaaggtgggtaattttaatgaaaaccatggaagagaaaaagtacaatcatattgaattaaataatgaggtcactaaacgaagagaagatggattctttagtttagaaaaagaccaagaagctttagtagcttatttagaagaagtaaaagacaaaacaatcttcttcgacactgaaatcgagcgtttacgttatttagtagacaacgatttttatttcaatgtgtttgatatttatagtgaagcggatctaattgaaatcactgattatgcaaaatcaatcccgtttaattttgcaagttatatgtcagctagtaaatttttcaaagattacgctttgaaaacaaatgataaaagtcaatacttagaagactataatcaacacgttgccattgttgctttatacctagcaaatggtaataaagcacaagctaaacaatttatttctgctatggttgaacaaagatatcaaccagcgacaccaacatttttaaacgcaggccgtgcgcgtcgtggtgagctagtgtcatgtttcttattagaagtggatgacagcttaaattcaattaactttattgattcaactgcaaaacaattaagtaaaattgggggcggcgttgcaattaacttatctaaattgcgtgcacgtggtgaagcaattaaaggaattaaaggcgtagcgaaaggcgttttacctattgctaagtcacttgaaggtggctttagctatgcagatcaacttggtcaacgccctggtgctggtgctgtgtacttaaatatcttccattatgatgtagaagaatttttagatactaaaaaagtaaatgcggatgaagatttacgtttatctacaatatcaactggtttaattgttccatctaaattcttcgatttagctaaagaaggtaaggacttttatatgtttgcacctcatacagttaaagaagaatatggtgtgacattagacgatatcgatttagaaaaatattatgatgacatggttgcaaacccaaatgttgagaaaaagaaaaagaatgcgcgtgaaatgttgaatttaattgcgcaaacacaattacaatcaggttatccatatttaatgtttaaagataatgctaacagagtgcatccgaattcaaacattggacaaattaaaatgagtaacttatgtacggaaattttccaactacaagaaacttcaattattaatgactatggtattgaagacgaaattaaacgtgatatttcttgtaacttgggctcattaaatattgttaatgtaatggaaagcggaaaattcagagattcagttcactctggtatggacgcattaactgttgtgagtgatgtagcaaatattcaaaatgcaccaggagttagaaaagctaacagtgaattacattcagttggtcttggtgtgatgaatttacacggttacctagcaaaaaataaaattggttatgagtcagaagaagcaaaagattttgcaaatatcttctttatgatgatgaatttctactcaatcgaacgttcaatggaaatcgctaaagagcgtggtatcaaatatcaagactttgaaaagtctgattatgctaatggcaaatatttcgagttctatacaactcaagaatttgaacctcaattcgaaaaagtacgtgaattattcgatggtatggctattcctacttctgaggattggaagaaactacaacaagatgttgaacaatatggtttatatcatgcatatagattagcaattgctccaacacaaagtatttcttatgttcaaaatgcaacaagttctgtaatgccaatcgttgaccaaattgaacgtcgtacttatggtaatgcggaaacattttaccctatgccattcttatcaccacaaacaatgtggtactacaaatcagcattcaatactgatcagatgaaattaatcgatttaattgcgacaattcaaacgcatattgaccaaggtatctcaacgatcctttatgttaattctgaaatttctacacgtgagttagcaagattatatgtatatgcgcactataaaggattaaaatcactttactatactagaaataaattattaagtgtagaagaatgtacaagttgttctatctaacaattaaatgttgaaaatgacaaacagctaatcatctggtctgaattagcagatgattagactgctatgtctgtatttgtcaattattgagtaacattacaggaggaaattatattcatgatagctgttaattggaacacacaagaagatatgacgaatatgttttggagacaaaatatatctcaaatgtgggttgaaacagaatttaaagtatcaaaagacattgcaagttggaagactttatctgaagctgaacaagacacatttaaaaaagcattagctggtttaacaggcttagatacacatcaagcagatgatggcatgcctttagttatgctacatacgactgacttaaggaaaaaagcagtttattcatttatggcgatgatggagcaaatacacgcgaaaagctattcacatattttcacaacactattaccatctagtgaaacaaactacctattagatgaatgggttttagaggaaccccatttaaaatataaatctgataaaattgttgctaattatcacaaactttggggtaaagaagcttcgatatacgaccaatatatggccagagttacgagtgtatttttagaaacattcttattcttctcaggtttctattatccactatatcttgctggtcaagggaaaatgacgacatcaggtgaaatcattcgtaaaattcttttagatgaatctattcatggtgtatttaccggtttagatgcacagcatttacgaaatgaactatctgaaagtgagaaacaaaaagcagatcaagaaatgtataaattgctaaatgacttgtatttaaatgaagagtcatacacaaaaatgttatacgatgatcttggaatcactgaagatgtgctaaactatgttaaatataatggaaacaaagcactttcaaacttaggctttgaaccttattttgaggaacgtgaatttaacccaatcattgagaatgccttagatacaacaactaaaaaccatgacttcttctcagtaaaaggtgatggttatgtattagcattaaacgtagaagcattacaagatgatgactttgtatttgacaacaaataacaattaaattaaaagaccttcacatgtaaagggaaatagcgattcgtttcgtcttgtctcctacatgttgaaggtctttttttatgtgtatctaactcattatgagtctgagtaagaaatcaatgctctaagatgtacaatgctatttatattggcagtagttggcggggccccaacacagaagcaggcggaaagtcagctaacaatattgtgcaagttggcggggccccaacatagaagcaggcggaaagtcagctaacaataatgtgcaagttggcggggccccaacataaaagcaggcggaaagtcagctaacaatattgtgcaagttcgggcggggccccaacataaagaaaaactttttcctttagaaattatcacttccacatgagttttactcatgtattcctatttttaagtacacattagctgaggctaatgttaagaaccactacttaatcaatcattagtagtttttatcatttccactattcccagacatcaaaatcttaagtgttctattttactttaagtaaacaaaatacacattccgaaaaattaaatttcagtttaattgcaaatatcaataaaattgacactaaattatttgaaaggctattgaaattatggtcaaaaaacgctactattaatgagaaatattatcaatgataatgattatcattaatttaaagggagaaaaatttgtaatgaagtatttattaaagggaaatattttgcttctattactaatattgttgacaattatttcgttgttcataggtgtgagtgaactatcaattaaagatttactacatttaactgagtcacagcggaatattttattctcaagccgaataccaaggacgatgagtattttaattgctggaagttcgttggctttagcaggcttgataatgcaacaaatgatgcaaaataagtttgttagtccgactacagctggaacgatggaatgggctaaactaggtattttaattgctttattgttctttccaaccggtcatattttattaaaactagtatttgctgttatttgcagtatttgcggtacgtttttatttgttaaaatcattgattttataaaagtgaaagatgtcatttttgtaccgcttttaggaattatgatgggtgggattgttgcaagttcacaaccttcatctcattgcgcacgaatgctgttcaaagcattggtaactggcttaacgggaactttgccattatcacaagtggacgctatgaaattttatatttaagtattcctcttttagcattgacatatctttttgctaatcatttcacgattgtaggaatgggtaaagactttactaataatttaggtttgagttacgaaaaattaattaacatcgcattgtttattactgcaactattacagcattggtagtggtgactgttggaacattaccgttcttaggactagtaataccaaatattatttcaatttatcgaggtgatcatttgaaaaatgctatccctcatacgatgatgttaggtgccatctttgtattattttctgatatagttggcagaattgttgtttatccatatgaaataaatattggtttaacaataggtgtatttggaacaatcattttccttatcttgcttatgaaaggtaggaaaaattatgcgcaacaataataaaaaaataatgcttttaattgcagtaacgttattaattagtatgctgtacttatttgtaggtattgattttgaaatatttgaatatcaattttcaagtcgtttaagaaagttcatattaattattttagtaggtgctgccattgcaacttcagtggtgatttttcaagcgattacaaataaccgtctattgacaccatcaataatggggttagatgcagtttatttatttatcaaagtattgccagtctttttatttggaattcaatcggtatgggttactaatgtatatttgaactttatattaacacttataacgatggtgttattcgcactaatcctattccaaggtatctttaaaatcggacatttttcaatttattttatcttacttattggtgtccttttaggaacattttttagaagcataacaggttttattcaactgattatggatcctgagtcatttttagcaatacaaagtagtatgtttgctaattttaatgcttctaattcgaatttagttactttctcagcagtgctattagtaatcttattagtcattacaattttactattgccttatttagatgtattgcttttaggtcgtgctgaagcaattaatcttgggatatcgtatgaaaaattaacgcgaatt

SEQ ID NO: 122 - DNA, 1194 bp; double-stranded, linear
atgaatatatttnnaaataaattattatggattgcaccaatngccactatgattatcttggtaatcttttctttagctttttatcctgcatataatcctaaaccaaaagatttaccaattggtatattaaacgaggataaaggtacaacgattcaagataaaaatgttaacattggtaaaaaattagaggataaattattagatagtgattctaataaaattaaatgggttaaggttgatagtgaaaaagaccttgaaaaagatttgaaagatcaaaaaatctttggagtagctattattgataaagacttttcaaaagatgctatgagtaaaacacaaaaagtagttatggatagtaaaaaagaagaaatgcaacaaaaagttgcttcaggtgaaattccgccacaagtggttcaacaaatgaaacaaaaaatggggaatcaacaagtagaggttaagcaggctaaatttaaaacgattgtaagtgaaggatcaagcttacaaggttcacaaattgcatcagctgtgttaactggtatgggtgataatattaatgctcaaattacgaagcaaagtttggaaacattaacgagtcaaaatgttaaagtcaatgccgcggacatcaatggtttgacgaatccagtaaaagtggataatgaaaaacttaataaagttaaagatcaccaagcaggtggtaatgcaccattcctaatgtttatgccaatttggataggttcaatcgtaacgtctatcttattgttctttgcatttagaactagtaacaatatcgtcgtgcaacatcgtatcattgcttcaattggacagatgatatttgcagttgttgcagcatttgcaggtagctttgtttatatttatttcatgcaaggcgttcaaagatttgattttgaccatccaaatcgtatcgcaatttttgtagcatttgcgattcttggtttcgtgggccttattttaggtgttatggtatggctaggtatgaagtcagttccaattttcttcattttaatgttctttagtatgcaacttgtaacgttacctaaacaaatgttgcctgaaagttatcaaaaatatgtatatgattggaatccattcacacactatgcaacaagtgtaagagactattatacttgaatcatcatattgaattaaatagtacaatgtggatgtttatagggt

SEQ ID NO: 123 - DNA, 558 bp; double-stranded, linear
gaccgacctatacatccgtataagtatttcttgatataagtcttctaaatcataatgattaaatccaaatgttttgatgcgtcgaataattaatggttgtagatccattactaacttttcgaagtctttatcatttattgcattgttacgtttgattgtactgtcttgagttgtcaaatcgtatttcaaatattaaactaaccccttctatctaaaatttaaggttagtttaatattgttacattcaaaatttcaagatgacggaaatgtcatttcttatgatgtcctcttcgtattttttcaaattctgcaaggatttcagaagataacggaattcgagttcttggcttgttttcacttatatcatctaatgatttactcacatcaatttcattttcttttaaatctctccacatttcgcgagatgatattctatatgcacctgatccaaagatagcatgttgctcactcatatcacttgttacaactgtaatatgcttagtatgcttgtcataaagttcataaaccataacggttctaatggaaaccaatcagctg

SEQ ID NO: 124 - DNA, 7762 bp; double-stranded, linear
gcttcagacatntgatgatataatctctcatcatcgattaattcttttgcagcttgatacacatnttgcttatttgttccaatgacttttaatgtgccagcttcaacaccttcaggacgttctgtaacacttcgccaaaactaaaactggcttattaaatgatggcgcttcttcctgaattccacctgaatctgtcaaaataaaataagattttntagcaaaattatggaaatctatacgtccaaaggttcaatcaattcaattctgtcatgactacctaaaatcttttgagccacctctcgaactttcgggtttttatgcattggatataccagtgctaaatcagtatactcatctattaagcgtctaaccgctttaaatatattttccatgggtttcccgatattttctcgtcggtgtgctgtcatragaatgaatttkttgtcatggtatttatccatgatgttagatttataattgtcatcaactgtatatttcatagcatcaatcgcagtattaccagtgacaacaacactttctgaatatttcccttcacttaacaaatgcgatgcagcatttttagtaggtgcaaaatgtaagtcagctaatacaccaactaattgtctattcacctcttctggaaaaggtgaatatttatcataacttctaagccctgcttcaacgtgtccaatcggcacttggttataaaatgccgctaaaccacctgcaaatgtcgtcatcgtatcaccatgtacaagtaccatgtctggtttttctaattgaatcacttgttctaattgagtgattgatttagaagttatctcagaaagtgtctgtcctgatttcataatattcaaatcgtattttggtttgatttcaaaggtacttaatactgaatcaagcatttctctatgctgtgctgtaacaacaacaattggctcgagcattttttcttgttccaaagctttaactaaaggagccatctttatggcttcgggtcttgttccaaatatggtcataatctttttcatcaaactacttatctccgattcttctatttagtaccaaacaatctatctccagcgtcgcctaaccctggtgtgatatatgctttgtcattagcttttcatcaagtgcagcaatataaatatctacatctggatgtgcttcatgcatcttttctacgccttctggtgctgcaattaaacacatgaagcgaatatttttagcgccacgtttcttcaatgaagtaatagcttcaattgctgatgcgcctgttgctaacataggatcaacaacaatgatttgtctttcagtaatatcttgaggtaacttagcaaaatactctacagcctttaatgtttcgggatctcgatataaaccgatatgtccaactctggctgcaggtactaaacttaaaataccatcagtcatacctaaaccagctcttaaaattggaacgatagctaattttttaccagctaatcgtttagccgtcattttagttacaggcgtttcaatatcaacatcctgaagctctaagtctctagttacttcatatgccatcaacataccaacttcgtctacaagttctctaaattctttagtacctgtatttacatctctaatatagcttagtttgtgttgaattaatggatgatcgaaaacgtgtactttactcataaaaattactcctatctttgtgtatgtttattgatatagaggatattcagctgttaatttcgcaacgcgttctttagcttgttgtaatttttcttcatctttactatttttcaatgctaaactgatgatttttgcaacttcctcaaaagctttttcatcaaatccacgcgttgttgcagcaggtgtacctaaacgtataccactcgttacaaaaggtttttcttgatcgaacggaatggtatttttgttacatgtgataccaactgaatctaaagtctcttcagcttctttaccagtaagtcctatagacccttttacatcaacagctactaagtgattatctgtaccgccagaaacaattctaaatccttcattaattaatgcttctgcaagaacttttgcgtttttaaccacttgttgttgatacgttttgaaattattttctaacgcttctccaaaagcaactgcttttgctgcaataacatgctcaagaggtccaccttgaataccagggaaaattgttttatctatgtcttttttatattcttccttacataaaatcataccaccacgtggtccgcgtaatgttttgtgtgttgtagttgttacaaaatcagcatattctactggatttggatgtaaacctgccgctactaatcctgcaatatgtgccatgtctaccattaacttagcgtttacttcatctgcgatttctttaaactttttgaagtcaattgttcttgaatatgctgatgctcctgccacaataagcttaggcttatgctctaacgctaatttacgaacttcatcataattgattcgttctgtgtctttatctactccatattcaacgaaattgtagaatttaccactaaaattaacaggcgctccatgtgtcaagtgaccaccatgactcaaattcatacctaaaactgtgtcgcccatttctaatgcaactaagtaaacagccatgttcgcttgtgaacctgaatgtggttgaacattgacatgttcagctccaaacaatgctttagcacgatcaattgcgatgctttcagtaacatctacaaactcacagccaccataatatcggcgtcctggatagccttcagcatacttattagtcaacactgaaccttgtgcttccataaccgcttccgatacaaaattttccgatgcgattaactctatgttgctattttgtctctgaaattctctctcgattgcttctgcgataactttatcttgcttggtgatataagacataaaatctccccttctttcaaaaaaacttattggtatttagcacgttcgccaccaatctttttcggcctagatgtggcaatagttacaattgcctgtcctacttgctttactgaggtccttacaggtacacatacatgtttaatatgcatgcctattaacgtttgaccaatatcaattccacaaggaacagtaatatgttcgaccacgatcggatccttcatatgctgaaaagcgtatgttgccaaactccctccagcatgtacatctggaacgacggaaacttcttccattgttaatggattatactgagatttttctattgttatcgctctgttgatatgttcacatccttgaaaagcaaaagtaacgcctgtctctttactcacaacatctaatgcattaaaaatagtttctgcaacttccatcgaaccgacagtccctattttttcgccaatgacttccgatgttgaacatccaattaaacatatatctcctttattaaaaaaggacatatcttttaattcgtctaataacattgtcaaatctttcataaaagcccacccttcctaaaaataaaaaaggaatatagcaaagtgctacactcctctattataacttatttaactgttaacatatactaattatacagaattcctactagcaaataatatcttttaattttaaaattaaacttacaagttcttcataggtatgtacatacatttcttttgttccaccgtatggatctataacttctcctgcttcttttacatattcatgcaatgtgaaaacatgattttgcaaaccaaagtgtgcctctattaattctttgtgcgaatacgacatcgtcaaaataatatctgctttcaaatctgcttcagtaaattgttgcgataaggtcgtttcagctaaatgatgttcttcaactaagtcttcaacataattcgaaacaccttgattgttcacagcgaatatacctcttgattcaaattgatgatttggcataacctcttttgcaatactttccgctaatgggctacgacatgtgttacctgtacaaacgaataaaatcttcatagttcacatcctttaataatgtgattacctgcagcttttaacatgcgattcataattgcttctgtattatcattcagctcaaagccgtatatatacgccgctgaaatattttcattttcatcaagtgaatgtaacacatcataaagattatgacttgcttgtttaacatcattgtcatcctgacataattgaatgaattgcgcttcacttggtataaacgccaccttattactcggcacaataaaagctatagaagaccaatctttaccgtcatttccaattttgctctcaatatctgtaataattgtaagtggtgtattgggtgagtaatgcttatacttcatacctggtgcaattggctgttcagtatcattataatcagcatgggcgatactattcggaagtatttctgtaatcattgctgctgttatagaaccaggtcttgcaattttataaggaaaagatgtgcaatctaaaaccgtactttctaatccttcttcactttgttcagcttgaacaataccatcgatacggccattcaaatcttgatatacatgattgaaagttgttggtgaaggtctaccacttaaattagcacttggagcagctagaggttcatttatgatttgtaataattgtctacctacagaatggcttggcattctaacagcaactgatgataaacctccagaaacttttcgacatagatagcctagctttaacggcaatataaacgaaatagggcccggccagaatgcctgcattaacttttctacgcgtggatccaaagtatatgtaaaatcttttaattgacctttactgtgtatatgaacaataagcggattgtcagatggacggcctttagcttcatatattttagctacagcttcttcatctgtcgcatttgctgcaagtccataaactgtttcagttggtaaacctattaaaccaccgtttaaaacaatgtcttttatttcattaattttaggatattgctgtaaatcttcattatattctctaacatcccaaattttagtatccaacttaatcacgcctttcttatttatcataatataaagcaaaaagctatgcacttaactaatcatagcaaaggcataacttctaattaccatttaaatgagacgattcgatcgtggccatttatatctttaataatgtcgatttttttgtcaggaaatttatttaaaattattgatttaagtgcctcaccttgattgtaaccaatttcaaaaacaactgggctgcctttttccataacgtgaggtaaatcttcaatgattgattcataaatagcatatccatggttatctgcaaacaatgcctgatgtggttcgaatctcgtaaccgttggagacatcgtaaccatatctttttcatctatatatggtggattagatatcaagccgttcaacttgataccttcattaattaagggctttaatgcatcccctgttaaaaattgtatttgtgattgatgcttctcagcattattacgagccatattcattgcttcaagtgaaatatcagtagcaataacatttaaatccggcttttcacatttcaaagtaattgcaagtacaccactacccgttccgatatctacgattgttgcatcatcttctaactgttgtaagaaatgcaacattacttcttcagtttcaggtcttggtatcaaacaatttgagtttacatcaaacgttctaccataaaatgaggcaaagccaactatatactgtataggctctcctaataacatacgttgtaatgctaagtcgaacttcataatcatcgctttcggcatatcatcatgcatgtggactacaaagtccgtacgcgtccattgaaatacatctaacattaaccattcagctcgtgtttgttcaaaccctttttgttgtgttaaatgaattgcttcatctaacttttctttataattcaccattattaagttctttcaatttatctgtctgctctgataaagtcagtgcatctataatttcttctaaatggccttccataatttgccctaatttttgaagcgttagacctatacgatggtctgttacacggctttgtggataattataagttcgaatacgttctgaacgatcaccagtaccgactgctgatttacgttgtgacgcatacttttgttgttcttcttgaactttcatatcgtataaacgtgcttttaacactttcattgctttttcacggttttgaatttgagacttctcagaagatgttgcaatgacaccagttggtaaatgggtaatacgtactgcagagtcagttgtgtttacgtgctgaccacctgcaccacttgaacgatacgtgtcgatttttaaatcttcatttctaatttcaatttctacatcttcaacttctggtaaaactgccactgtagctgttgaagtatgaatacgtccacctgattctgtttcaggcacacgttgaacgcggtgcgcaccattttcaaatttcaatttactatacgcgccattaccagaaactgagaaactaatttctttgtaaccaccatggtcactttcagacgcttctactatttcagttttgaatccttgtgattcagcatactttgaatacatacgcattaaatcaccagcaaaaatcgcagcctcatcaccacctgctgctgctcttatttctacaataacgtctttgtcatcattaggatctttaggaatcaataatattttaagctcttcttcaagatttggaagttcagctttaataccattactctcctcttttaacatttctacttcttctttatcatcagtctcacttaacatttcttcaatatcagctaattcttcttttttagctttatagttacgataaacatctacagttttttgtaaatcagcttgctctttagaatatttacgtaatttatctgaatcatttacaacatctgggtcacttaacagttcatttaactgttcgtatctttcttctacaatatctaattgatcaaacacttataattcctccttattattatcactaggtgctacgatatggtgcgcgcgacaacgtggctcataactttcattggcacctactaagataatcggatcatcgattttagctggtttaccatttattaatcgttgcgttctactagatgaagaaccacaaacagcacaaactgcttgaagtttcgttacttgttcactgacagccatcaatttaggcattggttcgaacggttcgcccctaaaatccatatctaatccagcaacaataacacggtgtccatctgctgatagtttttctactatacttacaatttcatcgtcaaaaaattgcacttcgtctattcctataacatcaacattagttaagtcgtgcgtcataatttcacttgctttagaaatattaatcgcttcaatggcattaccattatgagagaccactttttctttatgatatcgatcatcaatcgccggtttaaatacaacgactttttgtttagcgtatataccccttcttagacgtcttattagttcttcggatttaccgctaaacatactacctgtaatacattctatccaaccggaatggtaagtttcatacattgagagtnccacctttttcaaaacataatcgctttattatatcatatttcaaatattcataaatgtctttntcataattatatcgatattgtacatgaacaattatttta

SEQ ID NO: 125 - DNA, 2583 bp; double-stranded, linear
agcgtatgcttatctcattttcgtacaagaaacatggacgatgttgcatgaaaacatgactaaaaaaattattatcaatgatgaactagaattgactgaattccaccaagaacttacttatattttagacaacatanaagggaataataattatggtaaggaatttgttgcaaccgttgaagaaacattcgacattgaataaagcggggtggaagcactatgaatcaatgggatcagttcttaacaccttataagcaagcggttgatgagttgaaagkgaacttaaaggcatgcgcaaacaatatgaagttggtgaacaagcgtcgccaatagaatttgttactggtcgtgttaaaccaatcgctagtattatagataaggcaaacaaacgacaaataccatttgataggttaagagaagaaatgtacgatatcgctggtttaagaatgatgtgccaatttgttgaagatattgatgttgtcgtcaatattttaagacaaagamaagattttaaagtaattgaagaacgagattatattcgtaacactaaagaaagtggttaccgctcgtatcatgtcattattgaatatccaattgaaacattacaaggccaaaaatttatattggctgagattcagattcgtacattagcaatgaatttctgggcaacgattgaacatactttacgatataaatatgatggtgcttatccggatgaaattcaacatcgtttggaaagagcggcagaagcagcgtatttacttgatgaagagatgtctgaaattaaagatgaaattcaggaagctcaaaaatattacacgcaaaaacgttctaaaaaacatgaaaatgattaacgaggtgttataaatcatgcgttatacaattttaactaaaggtgactccaagtctaatgccttaaagcataaaatgatgaactatatgaaagrttttcgcatgattgaggatrgtgaaaatcctgaaattgttattycagttggtggtgacggtacattactacaagcattccatcagtatagccacatgttatcaaaagtggcatttgttggagttcatacaggtcatttaggattttatgcggattggttacctcatgaagttgaaaaattaatcatcgaaattaataattcagagtttcaggtcattgaatatccattgcttgaaattattatgagatacaacgacaacggctatgaaacaaggtatttagcattaaatgaagcaacgatgaaaactgaaaatggctcaacacttgttgtggatgttaacttaagagggaaacactttgagcgatttagaggcgatggattatgtgtatcaacaccttcgggttcaacggcttataacaaagcgctaggtggcgcactgatacatccttcacttgaagcaatgcaaattacagaaattgcctcgataaataatcgtgtgtttagaacggtaggatcaccacttgtattaccaaagcatcatacatgtttaatatcaccagttaatcatgataccattagaatgacgatagatcatgttagtatcaaacataaaaatgttaattcaatacaataccgtgtagcaaatgaaaaagtgaggtttgcacgttttagaccattcccattctggaaacgtgtgcacgattctttcatatcaagtgatgaagaacgatgaaatttaagtatcatatatcacaacaagaaactgttaaaacttttttagcacgacatgatttttctaagaagacagtgagcgccattaaaaataatggcgctttaattgttaatgatgaaccagtcacagtgcgtaagcaattaatgacaaatgatatattagaaattcatttaccgcgagaaataccgagtgttaatttaataccttatgctcgtaagctagaagtattgtatgaagatgcttttatcatcatagttactaaaccaaacaatcaaaattgtacgccttcgagagaacatcctcatgaaagtttaatcgaacaagtactatatcattgtcaggaacatggtgaaaatattaacccacatattgttacgcgtctagatcgtaatacaactggtattgtgatattcgctaaatatggacatatccatcatttattttctaaagtaaacttgaaaaaaatatatacttgccttgtatatggtaaaacccatacatctggtattattgaagctaatattagacggtcaaaggataggattataactagagaagttgcctcggatggtaaatacgctaaaacatcttatgaagtaataaatcagaatgataaatacagtttatgcaaagttcatttgcatacgggacgtacacatcaaattcgtgtacattttcaacatattgggcatccaattgtgggagattctttgtatgatggttttcatgacaaaattcatggtcaagtactgcaatgtacgcaaatatattttgttcatccaatcaataagaacaatatttatattacaattgattataagcaattacttaaattatncaatcaactctaatncacacagggggtgtaagtatgtcaatgancacagatgaaaaagagcgtgt

SEQ ID NO: 126 - DNA, 1818 bp; double-stranded, linear
atcaagtgatacatttaactggtaaaggattaanagatgctcaagttaaaaaatcnggatatatacaatatgaatttgttaaagaggatttnacagatttattngcaattacggatacagtaataagtagagctggatcaaatgcgatttatgagttcttaacattacgtataccaatgttattagtaccattaggtttagatcaatcccgaggcgaccaaattgacaatgcaaatcattttgctgataaaggatatgctaaagcgattgatgaagaacaattaacagcacaaattttattacaagaactaaatgaaatggaacaggaaagaactcgaattatcaataatatgaaatcgtatgaacaaagttatacgaaagaagctttatttgataagatgattaaagacgcattgaattaatggggggtaatgctttatgagtcaatggaaacgtatctctttgctcatcgtttttacattggtttttggaattatcgcgtttttccacgaatcaagacttgggaaatggattgataatgaagtttatgagtttgtatattcatcagagagctttattacgacatctatcatgcttggggctactaaagtaggtgaagtctgggcaatgttatgtatttcattacttcttgtggcatatctcatgttaaagcgccacaaaattgaagcattattttttgcattaacaatggcattatctggaattttgaatccagcattaaaaaatatattcgatagagaaagacctacattgctgcgtttaattgatataacaggatttagttttcctagcggtcatgctatgggatcaactgcatattttggaagtggtatctatctattaaatcgattaaatcaaggtaattcaaaaggtattcttatagggttatgtgcagctatgattttattgatttccatatcacgtgtatatctaggtgtacattatccaacagatattattgccggcattattggtggattattttgcattattttatcaacgttattacttagaaataaattaataaattaaatagtaaaaaaacaaaagcagtaaacctaaagtgtcgtaagggtttactgcttttataaaacgttgttataacgtatattgtcttttacgggcatataanaggggaatatttganaatgaccaatccaacaagaacgaaacgttgtgggggggatgttctatgtggtattgataatcattttcaactactattatacattagtgagaatcattgtcaattagaaactaaaactttttttgaatattttttaagaatagtaaataaaacgcatgattacgctattttagaaaataaaaaaatttgtatttctcattagaattagaatatttaaaagtgatgaggtttaaacattatattgtttacatactccttttgaattcatacattatgaaatgttacttccaagttcaaaatcgcacattgaaatgatgtgtgaaatgtttaaactacggtcattttgtgmaaataaagrtaataactattcattttacaatagtgaaaagtcagtatatgacaacaattaatattgcggtaaggccttgtgttacagtattctatatttaagtactgcaatcagaattaacagaatgccattaactgattattaaatatttgagttaataaataattaatgattgtagcttgaaaaatttaaaacatggttattgatttgtgataaaatttaaacgtaaacaaactaatttaaaaagcaactattgtatagaaaaatacaaaatttaaaatatattaccttattagaaaaa

SEQ ID NO: 127 - DNA, 12658 bp; double-stranded, linear
tgtttaaacaatagggggaatcttatgattgaaaaattagtaacctttttaaatgaggttgtttggagtaagccattagtttatggtttgctaattactggtgtgctatttacattgcgtatgcgattttttcaagttagacattttaaagaaatgattcgattaatgtttcaaggagagaagtctcctaatggtatttcaagttttcaagcgatagccatgtctttagcaggcagggttggtacaggtaatattgtcggtgtatctactgcaatatttataggaggacctggtgcagtattttggatgtggattactgcgtttttaggtgcaagtagtgcttttattgaatctacacttggtcaaatattcaagagagttgaaaataatgaataccgtggtggaccagcgtattatattgaatatggtattggtggtaaatttggtaaaatttacggaattatctttgctattgttacgattatctcagtaggtctattgcttcctggtgtgcaatctaacgctatagcaagttctatgcataatgcgattcatgttccacaatggttaatgggtggtattgttgtagttattttgggattaattatttttggtggtgtacgtattattgccaatgttgcaacagccgttgtaccatttatggcaattatttacatactgatggctgtcattatcatttgtatcaatatacaagaagtgccagcgttatttgcattaattttcaaatcagcatttggattacaatctgcttttggtggtatcgttggcgcaatgatagagattggtgttaaacgtggattatattcaaatgaggctggtcaaggtacaggtccacacgcagcagcggcagcagaagtatcacatccaagtaaacaaggtctagtacaagcattttcagtttatattgatacattatttgtatgtactgcaactgctctgattatacttatttctggtacatataatgtgactgatggtacggttaatgcgaatggcacaccgcatttaattaaagatggcggtatttatgttgaaaatgcaacaggtaaagattattcaggtactgcgatgtatgcacaagccggcattgataaagcgttccatggcagtggttatcaatttgatcctactttctctggcgtaggttcgtactttattgcatttgctttattcttctttgcatttactacaattttgtcgtactactacattacagaaacaaatgttgcttatttaacgcgtaatcaaaataatcaagtttcatcgatatttattaatattgctcgtgtgattattttgttcgctacattttacggtgcagttaaaacagctgatgtagcatgggcattcggtgatttaggtgtaggtctaatggcttggttaaatatcattgcgatttggattttacataagcctgccgtaaatgctttaaaagattatgaaattcaaaagaaacgtttaggcaacggttataatgcagtttatcaacctgatccgaataaattacctaatgctgtcttttggttgaagacgtatccagaacgtttaaaacaagcacgtgccaaaaagtaatctacttttgtttatagtatatgtagtgatcatttgataaaaaagaaaagtattgagaattttaggtgctcagaaatttgaattttaaaaatatagtgtctcttggtacaataacaatacaactactaggggcacttttttatgtcagaatttaaaactggtaagattaataaacatgttttatatagtaatattttaaatagagatgtcacgttaagtatttatttaccagaatcttataatcaacttgttaaatataatgtcattctttgctttgacggattagattttttacgtttcgggagaatacaacgtacatatgaatcgttaatcaaagaagcgcgtattgatgatgcgatcattgttggattccattatgaagacgttgataagcgtagagaggaatttcatccacaaggaagtcgttctcatttaactattcaatcagtcggtaaagaaatattgccatttattgactcgacgttttctacactgaaagtaggtaatgcaaggttattagtaggggatagtttagcgggtagtattgccttattaacggcgttgacctatccaacgatttttagtcgtgtagcaatgttaagtccacattcagatgaaaaagtattagataagctaaatcaatgtgcaaataaagaacaattgacaatttggcatgtcattggtctagatgaaaaagattttactttaccaacaaatggtaagcgtgccgatttcttaacaccgaatagagaattagctgaacaaattaagaaatataatataacttattattacgatgaatttgatggtggtcaccaatggaaagattggaaaccattgctgtcagatatattattgtattttttaagtaaaaacacagatgatcaactttatgaataatttacattagtagatttagtatgaattgtcttcatatagtctggtctataatataatttataaaagattttactgtttaatttaatttaaatttgacgaaattgcaaaagatgtataatgaattatttttaatgtaacggttttcaaagaaatttgatataatagcaataggttaaacaaaggaggaattcagatgattttaggattagcattaattccatcaaagtcatttcaagaagcggtggattcttaccgtaaaagatatgataaacagtattcacgaattaaaccacatgtgacaattaaagcgccatttgaaattaaagatggtgatttagattctgtcattgaacaggttagagctcgtattaatggtataccagcagtagaagttcatgctacaaaagcttctagcttcaaaccaacgaacaatgtgatttactttaaagttgcgaagacggacgacttagaagaattgtttaatcgctttaatggagaagatttctatggagaagctgaacatgtttttgtgccacactttacaatagcacaaggactatctagccaagaattcgaagatatttttggtcaagtagcattagctggggtagaccataaagaaattatcgatgaattaactttgttacgttttgacgatgacgaagataaatggaaagttattgaaacgtttaaattagcttaagtaacataatagtattgttaatcgtagtatgtttgaattaataagaaaatggtcatttttattgaatgtaataaaaatgaccattttctttattttaaaatacgttttaaccttacttagctttttctctatttactataaagtrgcttccataaaatacagctaagactaaaaagattaatgccgagaaataaaatgtattgtttaaattgttggtaaattgtgtaattaatccgccaaataatggccctatcattgagccgaatccttggatactattaaaaacaccccaagtttcttcttgttcatctgatttgataaatcgtgccataaaggtattccatgctggtaataagatgccatacattagaccgatagctaaagcgataatccacaagatgtgaatattaacaatcatagatagagtaaaaattaatatcatgtataaaataaatccgcttagaataacaccatacataaagtttctgctgcggttatctattagtttcgataaaaatagcatcgaaactgcacagccgataccaccaataatgattgcaacagtatattcaattgtgcttacgttaataaccttagtagcatatgttggtaatataggaactagggcagcaattgcggcaccttgtaaaagaataccagggaacaacaataaatggcgctttgtcacatcaacaatttgtctcaattgagctttaactggacgagtattataatttgttaactttacatcgacaaaataatataatatccatgcaattaaaacgactaaagacatcatgaaggcaaagcgtgttgggtgcactttgataagtagattcataaaaaccatacctaccaataggcctaacaaccatgaaaaataaacatagcccatttgtttgccacgtttatcttcttcaacactggataacataatgacccaaataggactaactgcaataccgagcatcatagcactaaatatgattacaaaaggtgatgctggaaaccaaataactaaaaataaacttgtaaatgctaaaataaatccagtcgttaaaacgatttttgtgccgaattttttcagtaaaaatcctataacaaagtttgtagatgcatcagcaataaaatgtattgaaaatgctagagacgttattgctacagcaatggatgtaactgttggcaagaaattaatatagcttaggatatacatgcctctcgcaaattccattaaaaataagataataagcattaaaatgaaatttttatgattagcgtaattatttaacgaagaatcttgcatataaaggaacctttccataaatctcttgtggttgtgatgaatgaccgattaaatcaagtaagtctcgacatattgtctgtgtagcatacttaattttatcttgttccattgtactaatcatgttagttaattgctcattaccgttagttaaacttgctacaatttttattgcttcttctggagtatcagcgattttaccaaaacctttttcttcaaagtaaagggcattttcaagctcttgaccaggtgcaggatttaggaaaatcattggaatacaacgggcgaaaccttcagttattgtgataccaccaggtttcgtaatcataagttgacttgatgccatccattcattcatgtgtttggtataacctagaatcaatacattctcgttagatttaaacttagctgttaaagaacgctttagctctttgctcttaccacaaatcataactacttgtgcatttgcacttttcgctaatatatcagtaatcatcgtgtcaaaacctttagatacaccaaatgcaccagctgacattaaaatagtttgcttatctggatctaagttgttgtctattaaccactgcttttgattaataggcgtttcaaatttgttatcaataggaatacctgtcactttaactgttgaaggatcaatacctacgtctatgaagtcttgtttcgtttcttttgttgccacataatatcttgttgaatacggcgtaatccagtttttatgtaagcgatagtctgtcatcactgtagcaactggaatattaatgttaaattgctcagttagtaccgacataactggtgtaggaaacgttaataatattaaatctggcttttcttttatcaataaattaattaacttattaagtccatagtatttgtaaaaacatttgtctagtttatctgggcggctgtaataaaaccctttgtacatatttctaaaatatttaaagctattgatataccattttttacaaatagaagtcaaaattggatgagcttccataaataaatcgtgctcaatgacgcttaaatggtctagattcatatcattaagttgattaacgatactctgtgtaacttgcatatgaccgttaccgaatgagccagtaataatcaatatctttttattttgagtaaccattaatagccaccctccgttagtttgaaaattttatttaagtgtaacttattttacggcattataaaagaaataaagacgcaaagtcgttacatttatagcaattttaatctatagatgaattgatacaaaataaaacgttattttataaagcaatttattgttctatgttttatttgtatatttaaaattatccagtatacaattatagcatatttttggaaacaattatgatattataccatgttacaagatggttttaataatttaagatgagccataattgtaaaactaattcataataccgtatgttttatttttaatagtagaaattagaaaatgctgattagtaggatataacagtgaaattataaatttattaacatcaacaaaacgtgtataataaacatattgtagaaaaaggagcggttcagtttggatgcaagtacgttgtttaagaaagtaaaagtaaagcgtgtattgggttctttagaacaacaaatagatgatatcactactgattcacgtacagcgagagaaggtagcatttttgtcgcttcagttggatatactgtagacagtcataagttctgtcaaaatgtagctgatcaagggtgtaagttggtagtggtcaataaagaacaatcattaccagctaacgtaacacaagtggttgtgccggacacattaagagtagctagtattctagcacacacattatatgattatccgagtcatcagttagtgacatttggtgtaacgggtacaaatggtaaaacttctattgcgacgatgattcatttaattcaaagaaagttacaaaaaaatagtgcatatttaggaactaatggtttccaaattaatgaaacaaagacaaaaggtgcaaatacgacaccagaaacagtttctttaactaagaaaattaaagaagcagttgatgcaggcgctgaatctatgacattagaagtatcaagccatggcttagtattaggacgactgcgaggcgttgaatttgacgttgcaatattttcaaatttaacacaagaccatttagattttcatggcacaatggaagcatacggacacgcgaagtctttattgtttagtcaattaggtgaagatttgtcgaaagaaaagtatgtcgtgttaaacaatgacgattcattttctgagtatttaagaacagtgacgccttatgaagtatttagttatggaattgatgaggaagcccaatttatggctaaaaatattcaagaatctttacaaggtgtcagctttgattttgtaacgccttttggaacttacccagtaaaatcgccttatgttggtaagtttaatatttctaatattatggcggcaatgattgcggtgtggagtaaaggtacatctttagaaacgattattaaagctgttgaaaatttagaacctgttgaagggcgattagaagttttagatccttcgttacctattgatttaattatcgattatgcacatacagctgatggtatgaacaaattaatcgatgcagtacagccttttgtaaagcaaaagttgatatttttagttggtatggcaggcgaacgtgatttaactaaaacgcctgaaatggggcgagttgcctgtcgtgcagattatgtcattttcacaccggataatccggcaaatgatgacccgaaaatgttaacggcagaattagccaaaggtgcaacacatcaaaactatattgaatttgatgatcgtgcagaagggataaaacatgcaattgacatagctgagcctggggatactgtcgttttagcatcaaaaggaagagaaccatatcaaatcatgccagggcatattaaggtgccacatcgagatgatttaattggccttgaagcagcttacaaaaagttcggtggtggccctgttgattaataaaagatttattgatgaaggtaaaactattgatgtttatttattcgaagcattaaataaccagataatcattgctataccagattggttttggtcatatcagatggcaatgacattagatgaagaaacttgttttgaagcaatactcatgcaattgtttgtttttaaagaagaggaagaggcagaatcgattgcatcacaactaacagattggatagaaacatataaaaaggagaaagactaatgaacttaaagcaagaagttgagtctagaaagacttttgcgattatttcacatcccgatgcagggaaaacaacgttaactgaaaaactattgtacttcagtggtgctattcgtgaagcgggtacagttaaagggaagaagactggtaaatttgcgacaagtgactggatgaaagttgaacaagagcgtggtatttctgtaactagttcagtaatgcaatttgattacgatgattataaaatcaatatcttagatacaccaggacatgaagacttttcagaagatacgtatagaacattaatggcagttgacagtgctgtcatggtcatagactgtgcaaaaggtattgaaccacaaacattgaagttatttaaagtttgtaaaatgcgtggtattccaatctttacattcattaataaattagaccgagtaggtaaagaaccatttgaattattagatgaaatcgaagagacattaaatattgaaacataccctatgaattggccaattggtatgggacaaagtttctttggcatcattgatagaaagtctaaaacaattgaaccatttagagatgaagaaaatatattacatttgaatgatgattttgagttggaagaagatcatgcaattacaaatgatagtgattttgaacaagcgattgaagaattaatgttggttgaagaagcgggtgaagcctttgataatgacgcgctgttgagtggagacttaacacctgtatttttcggttcagctttagctaactttggtgtacaaaatttcttaaatgcatatgttgattttgcgccaatgccaaatgcgagacaaacaaaagaagacgttgaagtaagcccgtttgatgattcattttcaggatttatctttaaaattcaagccaacatggaccctaaacaccgtgatagaattgcctttatgcgtgtcgttagtggtgcatttgaacgtggtatggatgttactttgcaacgtactaataaaaagcaaaagatcacacgttcaacgtcatttatggcagacgataaagaaactgtgaatcatgctgtagcaggcgatatcattggactatatgatactggtaattatcaaattggagatactttagttggtggaaaacaaacctacagtttccaagatttaccacaatttacgccagaaatttttatgaaagtttctgctaaaaacgtcatgaaacagaagcatttccataaaggtattgaacaattagtacaagaaggtgcgattcaatactataaaacattacacacaaaccaaattattttaggtgctgttggtcagttacaatttgaagttttcgaacatagaatgaaaaacgaatataatgttgatgttgttatggagccagtaggccgtaaaattgcacgttggattgaaaatgaagaccaaattacagataagatgaacacatcaagatcgattttagtgaaagatagatatgacgatttagtattcttatttgaaaatgaatttgcaacaagatggtttgaagagaaattccctgaaattaaattgtatagtttactttaacagctcaattgtataatcgaatttgttacattaaaaataattgtttcgttgaagaaaaataaattgtatattttaaaagaaaaaggtatactatgatgtatcaaatgaataacctatggcattttgtcagaggggagtaacttaagaatcatgaccgtataaatgattcgacactttatcgtcattacgargatatcttccggtaaagtgggcaatttaaattgcttagtgagacctttgctatttatttagcataggtctttttgtttgtacttaacttatttatttaaaggagttgtacatgttaatggatccaagtttgatcttaccttatttatgggtacttgtcgttttagtatttttagaaggcttattagcagcagataacgcgattgttatggctgtaatggttaagcacttaccacccgaacaacgtaaaaaagctttgttttacggtttgttaggtgcatttgtatttagatttttagcattattcttaattagtattatcgcgaacttttggtttattcaagctgcaggagcggtttacttaatttatatgtcaatcaaaaatctgtggcagttctttaaacacccagaaattgaaagtcctgaagctggagatgatcatcattatgatgaatctggtgaagagattaaagcaagtaacaaatcattctggggaactgtgttgaaaatagaatttgcagatatcgcatttgccattgattctatgcttgctgctttagctattgctgtaacacttcctaaagttggtattcactttggtggtatggacttaggtcagttcgtagtcatgttcctaggtggaatgattggtgttattctaatgcgttatgcagcaacatggtttgtagagctattaaacaaatatccaggacttgaaggtgcagccttcgcgatcgttggttgggtaggtgttaaattagttgtcatggtattagcgcacccagacatcgctgtattgcctgagcacttcccacatggcgtattatggcaatctattttctggacagtactaattggattagtaattatcggttggttaggttcagttgttaaaaataaaaaatcgcataaataattgatgtgaagcggacaatcttaatttagtttaaggttgtcctttttcatttaattgagtgatttatgaaaaatggattttgaagaatgtgaatcaaaagatgcgatatagtattaagaaaatgtgccttttatatttagcattttttcaatagaaattatatagattttaaagcaaattaggtgttaatgtgtcataatgataagtgattttattgaatggagtggacattagtggatattggtaaaaaacatgtaattcctaaaagtcagtnaccsacgtaagcgtcgtgaattcttccacaacgaagacagagaagaaaatttaaatcaacatcaagataaacaaaatatagataatacaacatcaaaaaaagcagataagcaaatacataaagattcaattgataagcacgaacgttttaaaaatagtttatcatcgcatttagaacagagaaaccgtgatgttaatgagaataaagctgaagaaagtaaaagtaatcaggatagtaagtcagcatataacagagatcattatttaacagacgatgtatctaaaaaacaaaattcattagattcagtggaccaagatacagagaaatcaaaatattatgagcaaaattctgaagcgactttatcaactaaatcaaccgataaagtagaatcaactgaaatgagaaagctaagttcagataaaaacaaagttggtcatgaagagcaacatgtactttctaaaccttcagaacatgataaagagactagaattgattctgagtcttcaagaactgattcagacagctcgatgcagacagagaaaataaaaaaagacagttcagatggaaataaaagtagtaatctgaaatctgaagtaatatcagacaaatcaaatacagtaccaaaattgtcggaatctgatgatgaagtaaataatcagaagccattaactttaccggaagaacagaaattgaaaagacagcaaagtcaaaatgagcaaacaaaaacctatacatatggtgatagcgaacaaaatgacaagtctaatcatgaaaatgatttaagtcatcatataccatcgataagtgatgataaagataacgtcatgagagaaaatcatattgttgacgataatcctgataatgatatcaatacaccatcattatcaaaaacagatgacgatcgaaaacttgatgaaaaaattcatgttgaagataaacataaacaaaatgcagactcgtctgaaacggtgggatatcaaagtcagtcaactgcatctcatcgtagcactgaaaaaagaaatatttctattaatgaccatgataaattaaacggtcaaaaaacaaatacaaagacatcggcaaataataatcaaaaaaaggctacatcaaaattgaacaaagggcgcgctacgaataataattatagtgacattttgaaaaagttttggatgatgtattggcctaaattagttattctaatgggtattattattctaattgttattttgaatgccatttttaataatgtgaacaaaaatgatcgcatgaatgataataatgatgcagatgctcaaaaatatacgacaacgatgaaaaatgccaataacacagttaaatcggtcgttacagttgaaaatgaaacatcaaaagattcmtcattacctaaagataaagcatctcaagacgaagtgggatcaggtgttgtatataaaaaatctggagatacgttatatattgttacgaatgcacacgttgtcggtgataaagaaaatcaaaaaataactttctcgaataataaaagtgttgttgggaaagtgcttggtaaagataaatggtcagatttagctgttgttaaagcaacttcttcagacagttcagtgaaagagatagctattggagattcaaataatttagtgttaggagagccaatattagtcgtaggtaatccacttggtgtagactttaaaggcactgtgacagaaggtattatttcaggtctgaacagaaatgttcctattgatttcgataaagataataaatatgatatgttgatgaaagctttccaaattgatgcatcagtaaatccaggtaactcgggtggtgctgtcgtcaatagagaaggaaaattaataggtgtagttgcagctaaaattagtatgccaaacgttgaaantatgtcatttgca

SEQ ID NO: 128 - DNA, 6048 bp; double-stranded, linear
tgaaatngaatagtactattgcaagtgtaaagaggttaatttttgccncacgcgggacttaaaaaggcaaccactggttgtgacatatccttatttacatttataaatataaggaggaggtagtagtgaaagacttattgcaagcacagcaaaagcttataccggatctcatagataaaatgtataaacgtttttctattcttactactatctcaaaaaatcagcctgtcggacgtcgaagtttaagcgaacatatggatatgactgaacgtgtactgcgttctgaaacagatatgcttaagaaacaagatttgataaaagttaagcctaccggaatggaaattacagctgaaggtgagcaactgatttcgcaattgaaaggttactttgatatctatgcagatgataatcgtctgtcagaaggtattaagaataaatttcaaattaaggaagttcatgttgttcctggtgatgctgataatagtcaatctgttaaaacagaattaggtagacaagcaggtcaattacttgaaggcatattacaagaagacgcgatagttgctgtaactggcggatccacgatggcatgtgttagtgaagcaattcatttattaccatataatgtattcttcgtaccagccagaggtggactaggcgaaaatgttgtctttcaggcaaacacaattgcagccagtatggcacaacaagctggcggttattatacgacgatgtatgtacctgataatgtcagtgaaacaacatataatacattgttgttagagccatcagtcataaacactttagacaaaattaaacaagcaaacgttatattacacggcattggtgatgcgctgaagatggcgcatcgacgtcaatcacctgaaaaggtcattgaacaacttcaacatcatcaagctgtcggagaggcatttggttattattttgatacacaaggtcaaattgtccataaggttaaaacaattggacttcaattagaagaccttgaatcaaaagactttatttttgcagttgcaggaggcaaatcgaaaggtgaagcaattaaagcatacttgacgattgcacccaagaatacagtgttaatcactgatgaagccgcagcaaagataatacttgaataagagataaaaagtttaatactttttaaatatcattttaaaggaggccattataatggcagtaaaagtagcaattaatggttttggtagaattggtcgtttagcattcagaagaattcaagaagtagaaggtcttgaagttgtagcagtaaacgacttaacagatgacgacatgttagcgcatttattaaaatatgacactatgcaaggtcgtttcacaggtgaagtagaggtagttgatggtggtttccgcgtaaatggtaaagaagttaaatcattcagtgaaccagatgcaagcaaattaccttggaaagacttaaatatcgatgtagtattagaatgtactggtttctacactgataaagataaagcacaagctcatattgaagcaggcgctaaaaaagtattaatctcagcaccagctactggtgacttaaaaacaatcgtattcaacactaaccaccaagagttagacggttctgaaacagttgtttcaggtgcttcatgtactacaaactcattagcaccagttgctaaagttttaaacgatgactttggtttagttgaaggtttaatgactacaattcacgcttacacaggtgatcaaaatacacaagacgcacctcacagaaaaggtgacaaacgtcgtgctcgtgcagcggcagaaaacatcatccctaactcaacaggtgctgctaaagctatcggtaaagttattcctgaaatcgatggtaaattagatggtggtgcacaacgtgttcctgtagctacaggttcattaactgaattaacagtagtattagaaaaacaagacgtaacagttgaacaagttaacgaagctatgaaaaatgcttcaaacgaatcattcggttacactgaagacgaaatcgtttcttcagacgttgtaggtatgacttacggttcattattcgacgctacacaaactcgtgtaatgtcagttggcgaccgtcaattagttaaagttgcagcttggtatgataacgaaatgtcatatactgcacaattagttcgtacattagcatacttagctgaactttctaaataattttagtatagtttttattcaaatacgctagtgctcagaactatttagcattaattaaagcttatgagtaagcggggagcacaaacgcttctccgcttatttttatataaaatttcctaattacaaggaggaaacaccatggctaaaaaaattgtttctgatttagatcttaaaggtaaaacagtcctagtacgtgctgattttaacgtacctttaaaagacggtgaaattactaatgacaaccgtatcgttcaagctttacctacaattcaatacatcatcgaacaaggtggtaaaatcgtactattttcacatttaggtaaagtgaaagaagaaagtgataaagcaaaattaactttacgtccagttgctgaagacttatctaagaaattagataaagaagttgttttcgtaccagaaacacgcggcgaaaaacttgaagctgctattaaagaccttaaagaaggcgacgtattattagttgaaaatacacgttatgaagatttagacggtaaaaaagaatctaaaaatgatccagaattaggtaaatactgggcatctttaggtgatgtgtttgtaaatgatgcttttggtactgcgcatcgtgagcatgcatctaatgttggtatttctacacatttagaaactgcagctggattcttaatggataaagaaattaagtttattggcggcgtagttaacgatccacataaaccagttgttgctattttaggtggagcaaaagtatctgacaaaattaatgtcatcaaaaacttagttaacatagctgataaaattatcatcggcggaggtatggcttatactttcttaaaagcgcaaggtaaagaaattggtatttcattattagaagaagataaaatcgacttcgcaaaagatttattagaaaaacatggtgataaaattgtattaccagtagacactaaagttgctaaagaattttctaatgatgccaaaatcactgtagtaccatctgattcaattccagcagaccaagaaggtatggatattggaccaaacactgtaaaattatttgcagatgaattagaaggtgcgcacactgttgtatggaatggacctatgggtgtattcgagttcagtaactttgcacaaggtacaattggtgtatgtaaagcaattgcaaaccttaaagatgcaattacgattatcggtggcggtgattcagctgcagcagcaatctctttaggttttgaaaatgacttcactcatatttcaactggtggcggcgcgtcattagagtacctagaaggtaaagaattgcctggtatcaaagcaatcaataataaataataaagtgatagtttaaagtgatgtggcatgtttgtttaacattgttacgggaaaacagtcacaagatgacatcgtgtttcatcacttttcaaaaatatttacaaaacaaggagtgtctttaatgagaacaccaattatagctggtaactggaaaatgaacaaaacagtacaagaagcaaaagattcgtcaatacattaccaacactaccagattcaaaagaagtagaatcagtaatttgtgcaccagcaattcaattagatgcattaactactgcagttaaagaaggaaaagcacaaggtttagaaatcggtgctcaaaatacgtatttcgaagataatggtgcgttcacaggtgaaacgtctccagttgcattagcagatttaggcgttaaatacgttgttatcggtcattctgaacgtcgtgaattattccacgaaacagatgaagaaattaacaaaaaagcgcacgctattttcaaacatggaatgactccaattatatgtgttggtgaaacagacgaagagcgtgaaagtggtaaagctaacgatgttgtaggtgagcaagttaagaaagctgttgcaggtttatctgaagatcaacttaaatcagttgtaattgcttatgaaccaatctgggcaatcggaactggtaaatcatcaacatctgaagatgcaaatgaaatgtgtgcatttgtacgtcaaactattgctgacttatcaagcaaagaagtatcagaagcaactcgtattcaatatggtggtagtgttaaacctaacaacattaaagaatacatggcacaaactgatattgatggggcattagtaggtggcgcatcacttaaagttgaagatttcgtacaattgttagaaggtgcaaaataatcatggctaagaaaccaactgcgttaattattttagatggttttgcgaaccgcgaaagcgaacatggtaatgcggtaaaattagcaaacaagcctaattttgatcgttattacaacaaatatccaacgactcaaatcgaagcgagtggcttagatgttggactacctgaaggacaaatgggtaactcagaagttggtcatatgaatatcggtgcaggacgtatcgtttatcaaagtttaactcgaatcaataaatcaattgaagacggtgatttctttgaaaatgatgttttaaataatgcaattgcacacgtgaattcacatgattcagcgttacacatctttggtttattgtctgacggtggtgtacacagtcattacaaacatttatttgctttgttagaacttgctaaaaaacaaggtgttgaaaaagtttacgtacacgcatttttagatggccgtgacgtagatcaaaaatccgctttgaaatacatcgaagagactgaagctaaattcaatgaattaggcattggtcaatttgcatctgtgtctggtcgttattatgcaatggatcgtgacaaacgttgggaacgtgaagaaaaagcttacaatgctattcgtaattttgatgccccaacttatgcaactgccaaagaaggtgtagaagcaagctataatgagggcttaactgacgaattcgtagtaccattcatcgttgagaatcaaaatgacggtgttaatgatggagatgcagtgatcttctataatttccgacctgatagagcagcgcaattatcggaaatttttgcgaacagagcattcgaaggctttaaagttgaacaagttaaagacttattctatgcaacattcactaagtataatgacaatatcgatgcggctatcgtcttcgaaaaagttgatttaaataatacaattggtgaaattgcacaaaataacaatttaactcaattacgtattgcagaaactgaaaaataccctcacgttacttactttatgagtggtggacgtaacgaggaatttaaaggtgaacgccgtcgtttaattgattcacctaaagttgcaacgtatgacttgaaaccagaaatgagtgcttatgaagttaaagatgcattattagaagagttaaataaaggtgacttggacttaattattttaaactttgctaaccctgatatggttggacatagtggtatgcttgagccgacaatcaaagcaatcgaagcggttgatgaatgtttaggagaagtggttgataagattttagacatggacggttatgcaattattactgctgaccatggtaactctgatcaagtattgacggatgatgatcaaccaatgactacgcawacaacgaacccagtaccagtgattgtaacaaaagaaggcgttacacttagagaaactggtcgcttaggtgacttagcacctacattattagatttattaaatgtagaacaacctgaagatatgacaggtgaatctttaattaaacactaatattgtaaaagatgttaagtaaacgcttaatgacacttattttttgaaaataatagtaatatcnttttgttaaatgaaagaataaagctataataattatagaataactatttan

SEQ ID NO: 129 - DNA, 5602 bp; double-stranded, linear
aaacaagtgcaagatatcatcgcattaattaagtcgttacaaagtgtaattgtagacatcgcttccaataatgttgatacaattatgcctggttatactcatttacagcgtgcacagccaatttcatttgcacatcatattatgacttatttttggatgttacaacgagaccaacaacgatttgaagatagtttaaaacgaatcgatattaatcctttaggtgcagcagccttaagtggtaccacataccctatcgatagacacgagacaacagcattgttgaactttggcagtctctatgagaatagcctagatgctgttagtgacagagactatattattgaaacattgcataatatttctttaacgatggttcacttatcacgctttgcagaggaaattattttctggtccacagacgaagctaaattcattacattatcagatgcattttcaactggctcatctattatgccacaaaagaaaaatcctgatatggcagaattaattagaggtaaagttggtcgaacgactggtcatttaatgagcatgcttatgactttaaaaggattacctctagcatataacaaagatatgcaggaagataaagaaggtttattcgatgctgtccatacaattaaaggttctttacgtattttcgaaggtatgattcaaacgatgacaattaataaagaacgactcaatcaaactgttaaagaagatttttcaaatgcaacggaactagcagattatttagtaactaaaaatattccatttagaactgcacatgaaattgtaggaaaaatcgtcttagaatgtatacaacaaggtcattatttattagatgttcctttagcaacatatcaacaacatcattctagtattgatgccgatatttacgattatttgcagcctgaaaattgtttaaaacgacgtcaaagttacggttcaacaggtcaatcatcggtcaaacaacaacttgatgttgctaaacaattactatcacaataaatacgttaatctacctacccacaatgtctattaaaattacattgtgggtattttaatgctctcttcgtcttgttgaacatcacatttttaagattcctaaaatgtttgataattcttttaaatttatattacaaaaatgttataaattgtaaaagaaatgtgtaaagcgttttcacaagcaggtttttgtagtattttaaaattgttagactacaaataaagagatgaaaggataaagactatgactaactcttcgaaaagcttcactaaatttatggctgcttctgctgtttttactatgggatttttatcagtacctactgctggcgctgaacaaacaaatcaaattgcaaataaacctcaggctattcaatggcatacaaatttaacgaatgagcgattcactactatcgcacatcgtggcgcaagtggctatgcacccgagcatacgtttcaagcatatgataagagtcataatgagttaaaagcatcttatatcgaaattgatttacaacgtaccaaagatggccatttagttgctatgcatgatgaaactgttaaccgtacaacaaatggacacggtaaagttgaggattatacccttgatgaattaaaacagttagatgcaggaagttggtttaataaaaaatatccaaaatacgcaagagcaagttataaaaatgctaaagtacccactttagatgaaattttagaacgttatggcccgaatgcaaactattatattgaaacaaagtcacctgatgtatacccaggaatggaagaacaattattagcttcattgaaaaagcatcaccttttaaataacaataaattaaaaaatggacatgtaatgattcaatcattttctgacgaaagtttaaagaaaattcatcgtcaaaataagcatgtgccattagtaaaattagttgataaaggtgaactacaacaatttaacgaccaacgcttaaaagagatacgctcttatgcgattggattaggtcctgattatacagatttaactgaacaaaatacccatcatttaaaagacttaggatttatagtacatccttatacagtgaatgaaaaagctgatatgttacgattaaataaatatggcgttgatggtgtctttacaaatttcgctgataaatataaagaagtcattaagtagtaatgttaaactagaaaacataaatacaaaaatatagctattactataaaaaacagcagtaagatatttccaaattgaaattatcctactgctgtctttttgggagtgggacagaaatgatattttcgcaaaatttatttcgtcgtcccaccccaacttgcacactattgtaagctgacttttcgccagcttctgtgttggggccccgccaacttgcattgtctgtagaaattgaggagctaatttctctgtgtcggggctccaccccaacttgcacactattgtaagctgactttccgccagcctctgtgttggggccccgccaacttgcacactattgtaagctgactttccaccagcctctgtgttggggccccgactatttttgaaaagagcgtgttacacgggcattgttttacagtcaactactgctaaaataaaattaacgagcttagggctttgttttctgtcccaagctcgttaaatcacatatgataattaattatgcccaaccacgatatctagctgcttctgctgtacgtttaatacctatgatatatgctgcaagtctcatatctatttttcggttttgagacaattcgtaaatcgtatcaaatgccgcttctaatttttcacgtagcttttcattaacttcttcttcagaccaataataaccttgattattttgtacccattcgaagtaagaaaccgttacaccaccagcacttgctaatacgtctggaactaataatataccacgttcagttaaaatacgtgttgcttctggtgttgtaggtccattagcagcttcaacaacgatactagctttaatatcatgtgcattgtcttctgtaatttggtttgaaatagccgctggtactaaaatgtcacaatctaattcaaacaattctttatttgagattgtttcttcaaataaatttgttaccgtaccaaaactatcacgacggtctaataaataatctatatctaagccatttggatcgtgtaatgcaccgtaagcatcagagatacctacaatttttgcacctaaatcatataagaatttagctaagaaacttccggcattaccgaaaccttgaataacaaccttggcaccttcaatttgcatattacgacgttttgcagcttgttcaattgcaataactacacctagtgcagttgatctgtcgcgtccatgagaaccacccaatacaattggtttacctgtgatgaaacctggtgaattaaatttatctaatgcactatattcatccatcatccaagccataatttgtgagtttgtaaatacatctggtgctggaatatctttgttcggacctacgaattgtgaaattgctcttacatatccgcgtgataaacgttcaacttcatgaatgctcatttgacgtggatcacaaacgataccacccttaccaccaccgtatggtaagtttacaatgccacatttcaaagtcatccacattgataatgcttttacttcttcttcatcaacatctgggtggaaacgcacgcccccttttgttggtccaacagcatcattatgttgcgcacggtaacctgtgaatgtttttactgtgccatcatccattcgtacagggatacgcacttgtaacattcttaaaggttctttaattaaatcgtacattccttcgtcaaatcccaatttatgcaatgcttctttaataattccttgagtagaagttactaaattattgttctcagtcatgatccttttcgcctcttctttacctaatgatttcgctttcaaacatattgtaacataacgtattcctttttaaagcccttacaaactgattgttacaactttttgacattattgaaatacatgtcttattttttcaagtgcaaggtccaattcttctttagtaataattaatggtggtgcaaaacgaatgacagtatcatgcgtttctttacataataagccttcttctttcaaagcttcacaatatggtctagcactttcattaagttccacacctataaacaaaccacgtccacggacttctttaattgatggatgatcaatttgctttaattgttctttaaaataatctcctaattctaaagagcggcctggtaaatcctcatcaacgataacatctaatgcagcaattgatgcagcacaagcaagtggattaccaccaaatgttgaaccatgtgagccaggtgtaaagacatctaatacttctttatctgctaatacaacagaaattgggaagactccaccacctagtgctttacctaaaatatagacatcaggttttacattatcccaatccgtagcaaataatttacccgaacgacctaatcctgcttggatttcgtcagcaataaataagacattatgttcatcacataattctctaattgctttcaaatatccttctggcggtatatttatacccgcttcaccttgaattggttctactaaaactgctgcagtattttcattaattgcagctttcaatgcatctacatctccaaaatcaacttttctaaatccatctaataacggaccataaccacgttggtattctgcttctgaagataatgaaactggcgccattgttcgaccatggaagttaccattaaatgcaatgatttctgctttatttggctcaattcctttaacatcgtatgcccagcgtcgtgctgctttcaaagctgtttctactgcttcagcacctgtattcattggtaaagctttatctttacctgccagtttacaaattttttcgtaccattcacctaagttatcactatgaaaagcacgtgaaactaaagtcactttatcagcttgatcttttaatgcttgaataattttcggatgtctatgaccttggttaacagcggaatatgcagataacatatccatatatttattgccttcaggatctttaacccataccccttcagcttctgaaatgacaattggcaatggtaaataattatgtgctccgtaatgatttgttaactcaataattttttcagatttagtcatcatatctccccttttcatcatttataactattatacatgaaacattatccaaataattacattagttttcaaagcagatacttttccaccaaaaaagatgaaataatcactaagtttcattaaatttgtctattttgaaaacccttacatttataatgacataattacttaaatgattacaagcaaaagaattgataattttacacttaatcaaaagtatattttactaagaatatttttatttataaatattgaaaaccactaacaaattgcatacacaatatcattagtggtaacagttaaacacttatttatctttacggggtaatgggttaaaacccttncattaaaattggatgnccataaaattaggg

SEQ ID NO: 130 - DNA, 5924 bp; double-stranded, linear
taaccccattttacctggaaaaatcgtttgcgatgcaatmgcatttgaatataaatacattttacgtatagaattataaaaggtttcattcaaatcttagggtcaaaaatgttataatatttttatgtcaaatttaaaacagtaacacttatttacaaggttgcaatattttgaagtaataaaggaagtgtcgcgtattttaactttttcagagcaaaatgcactcgcgaaaatagatgatttaatgaatacttattgcaatcaatgtccaatcaaaactcgtctgcgtaaattagaggggaaaacgaaggcgcatcatttttgtatcaatgagtgttcaatagggaaagaaataaaacaattaggaaatgaacttcaataggaggaagtcaaatgaaaattatatctatatcagaaacaccgaaccacaacacaatgaagattacacttagtgaaagcagagaaggtatgacatcagatacgtatactaaagttgatgattcacagccagcatttattaatgacatcttaaaggttgaaggcgttaaatcaattttccatgttatggactttatttcagtagataaagaaaatgacgcaaattgggaaacagtattgccaaaagtagaggctgtattcgaataaatttttcatcaactagtattcggggggaataaagtatatggaaattttacgtatagagccaacaccaagtccaaatacaatgaaagttgttttgtcatatacaagagaagacaagttatctaatacttataaaaaagtagaagaaacacaaccaagatttataaatcagttgttatctatagatggtatcacttccatttttcatgtcatgaacttcttagctgttgataaggcaccaaaagctgattgggaagtcatattacctgatattaaagctgctttttctgatgcgaataaggttttagaatctgtaaatgaacctcaaattgacaatcattttggtgaaattaaagctgaattattaacttttaagggtataccgtatcaaattaagctaacttctgctgaccaagaattaagagaacaattaccacaaacatatgttgaccatatgactcaagcgcaaacagcacatgacaatattgtttttatgcgtaaatggctagatttaggaaatcgctatggaaatattcaagaagtaatggatggtgtcctagaagaagtgctagctacctatccagaatcacagttacccgtattggtaaaacatgctttagaagaaaatcacgcaactaataattatcatttctatcgacatgtctctttggatgaatatcatgcaactgataattggaagactcgattacgaatgttaaaccattttccaaagccgacttttgaagatataccgctgcttgatttagctttatctgatgaaaaagtaccggttagacgtcaagcgattgtattattaggtatgattgaaagtaaagaaattttaccgtatttatataaggggcttcgtgataaaagtcctgctgtaagaagaacagcaggggattgcataagcgatttagggtatccagaggcactaccagaaatggtgctactattagatgatccacagaaaatcgttaggtggcgtgctgctatgtttatctttgatgaaggtaatgcagagcagcttcccgcactaaaagcccatattaatgacaatgcgtttgaagttaaattacaaattgaaatggccatatctcgtattgaaaacggagatgaagcacttggttcagtatggaaacaaatggcaaacagaacaatttaattggaggaattaaatatgaatgcatatgatgcttatatgaaagaaattgcgcaacaaatgcgtggcgaattaactcaaaatggttttacaagtttagaaacgagcgaacagctatcggagtatatgaaccaagtaaatgctgatgacactacttttgtagttattaactctacatgcggctgtgcagctggattagcaagaccagctgcagtagcagttgcaacacaaaatgaacatagacctacaaatacagttacagtttttgctgggcaagataaagaagcaactgctacaatgcgagaattcattcagcaagcaccatctagtccttcgtatgctttattcaaaggtcaagatttagtttattttatgcctagagaatttatcgaaggtagagatattaatgacattgcaatggacttaaaggatgcctttgacgaaaattgtaaatagtacacataaataaatataaaggttaacacattttataatattaaaaatggtgtctgtcattgaaaatagagaatatagttgtattctatttgttaaataaagtccgtttttaccaactatattttctagaaatttaactgttttaataggacatcaaacataatattcaaatcatgtgttaacctcttttttaaaattttttagcattaaagttatagatttgggtaaacaattaccaattggaaacatatatcacgttacgatggggtaggtacttaatcagcattttataaataaagtaacggaattcatgatattaatatcatattcctaaaatgagtgataacaaaatgctacataaagttaagttatatcaaactaaatatacatactataaataatgaaaatgaggtgttatcgcatatgttgaattcatttgatgcagcatatcacagtctttgtgaagaagttttagaaataggaaatacacgaaatgatcgcacaaatacaggtacgatttcgaaatttggtcatcaacttcgctttgacttatctaaaggatttccactattaacgacaaagaaagtttcttttaaattagtagcaaccgaattattatggttcattaaaggagatacaaacatccaatacttattaaaatataataataatatatggaacgaatgggcttttgaaaattatatcaaatcagacgagtataaaggtccagatatgacagatttcgggcatcgtgcattgagtgatcctgaatttaacgaacaatataaagaacaaatgaaacaatttaagcaacgtattcttgaagatgatacatttgcgaagcaattcggggatttaggaaatgtttatggtaaacaatggcgagattgggttgataaagatggtaatcattttgatcaacttaaaacagtaattgaacaaattaagcataatccagattcaaggcgacacatcgtatctgcatggaatccaacagaaattgatacaatggcacttccgccttgtcataccatgttccagttttatgtccaagatggtaagttaagttgccagttataccaacgtagcgcagatatctttttaggtgtgccatttaatatccgcagctacgctttattgacacaccttattgccaaagaatgtggacttgaagtgggtgaatttgtgcatacatttggagatgcacatatttattcaaatcatattgatgcgattcaaacacaattagcacgtgaaagcttcaatcctccaacattaaaaattaacagtgacaagtctattttcgacataaattatgaagatttggaaattgttgactatgaatcacatccagcaataaaagctccaatagcagtgtagtcattgcatagttagctaaccatatagacatcaaaatgacatcatagtattttcaagtgcaaaaaagtacttttttgtgttaaacgttttcataaattatgcaaaatcattatttctatcacactttatgataaaaattgtgttaaattaaagataacttagtaataaaaaatgaaatgatagaagaaggaggataattatgactttatccattctagttgcacatgacttgcaacgagtaattggttttgaaaatcaattaccttggcacctaccaaatgatttgaagcatgttaaaaaattatcaacaggtcatactttagtaatgggtcgtaagacatttgaatcgattggtaaaccactaccgaatcgtcgaaatgttgtacttacttcagatacaagtttcaacgtaganggcgttgatgtaattcactctattgaagatatttaccaactaccgggccatgttttcatatttggagggcaaacattatttgaagaaatgattgataaagtggacgacatgtatattactgttattgaaggtaaattccgtggtgatacgttctttccaccttatmcattkgagrctgggaagttgcctcttcagttgaaggtaaactagatgagaaaaatacaattccacatacctttctacatttaattcgtaaaaaataagggggaaaacgaccatgacaaaacagattatagtaacagactcaacatccgatttatctaaagaatacttagaagcaaacaacattcatgtaattcctttaagtttaactattgaaggagcttcatacgttgaccaagtagatattacatcagaagaatttattaatcatattgaaaatgatgaagatgtaaagacaagtcagccagccataggtgaatttatatctgcttatgaagaactaggaaaagatggctctgaaatcataagtattcatctttcttcaggattaagtggtacatataacactgcttaccaagcaagtcaaatggtagatgctaatgtaactgttattgattcaaaatctatttcttttggtttagggtatcaaatacaacacctagtagagcttgtaaaagaaggtgtctcaacttctgaaatagttaaaaagttaaatcatttaagagaaaacattaaattatttgtagttatagggcaattgaatcaattaattaaaggtggcagaattagtaaaacaaaaggtttgattggtaatcttatgaaaattaaaccaattggtacactagatgatggtcgcttagagcttgtgcmcaatgcgagaactcaaaattckagtatccaatacttgaaaaaggaaattgctgaatttataggagatcatgaaatcaaatccattggtgtcgcacatgctaacgtcattgaatatgttgataaattgaagaaagtttttaatgaagcttttcatgtgaataattacgatataaatgtaactacaccagttatttctgcacatactggtcaaggtgcgattggcctcgtagtccttaagaagtaaatttaatcttttcagtgttaattacttccatttcaatcctttatagactaaatttataattagatagatagaggaggtaattcatatgacaaaagaatatgcaacattagcaggaggatgtttctggtgcatggttaaaccatttacatcatatccaggcatcaagtcagtcgtatctggttatagtggcggtcatgttgacaacccaacttatgaacaggtatgtacgaatcaaaccggccatgtcgaagcagtacaaattacgtttgatccagaggttacttcctttgaaaatatattagacatatatttcaaaacatttgacccaactgatgatcaagggcaatttttcgatagaggcgaaagctatcaaccagtcattttctatcatgatgaacatcagaaaaaggctgctgagtttaaaaagcaacaattaaatgaacaaggtattttcaagaaaccagtgattacacctattaaaccatataaaaatttctatccagctgaagactaccatcaagattattacaaaaagaacccggtacattattaccaatatcaacgtggttcaggtagaaaagcgtttatagaatcacattgggggaatcaaaatgcttaaaaaagataaaagtgaactaacagatatagaatatattgttacacaaganaacggcactgaaccaccatttatgaatgaatattggaatcattttgctaaaggatttatgtagataaanttcnggtaaaccttg

SEQ ID NO: 131 - DNA, 9280 bp; double-stranded, linear
ggccgttnaaaatctccaaaatanaaaaacccatcttgttccaatgttttaaaatcgccatccaacacttgatcaatagcttgcaacaacgttgaacgtgttttaccaaaagcatcaaacgctcccactaaaatcagtgcttcaagtaactttctcgttttgactctcttcggtatacgtctagcaaaatcaaagaaatctttaaatttgccgttctgataacgttcatcaacaatcactttcacactttgataaccaacacctttaattgtaccaattgataaataaatgccttcttgggaaggtttataaaaccaatgactttcgttaatgttcggtggcaatatagtgataccttgtttttttgcttcttctatcatttgagcagttttcttctcacttccaataacattacttaaaatatttgcgtaaaaataatttggataatggacttttaaaaagctcataatgtatgcaattttagaatagctgacagcatgtgctctaggaaaaccataatcagcaaatttcagaatcaaatcaaatatttgcttactaatgtcttcgtgataaccattttgctttgcaccttctataaaatgttgacgctcactttcaagaacagctctattttttttactcattgctcttcttaaaatatccgcttcaccataactgaagtttgcaaatgtgctcgctatttgcataatttgctcttgataaataataacaccgtaagtattttttaatataggttctaaatgcggatgtaaatattgaactttgcttggatcatgtcttcttgtaatgtaagttggaatttcttccattggacctggtctatacaaagaagttacagcaacaatatcttcaaagtgttccggctttaatttttttaatacacttcttacaccgtcagactctaattggaatatgccagtcgtatctccttgcgacaacaattcaaacactttttgatcatcaaacggaatcttttcgatatcaatattaatacctaaatcttttttgacttgtgttaagatttgatgaataatcgataagtttctcaaccctagaaaatctatttttaataacccaatacgttcggcttcagtcattgtccattgcgttaataatcctgtatcccctttcgttaaaggggcatattcatataatggatggtcattaataataattcctgccgcatgtgtagatgtatgtcttggtaaaccttctaactttttacaaatactgaaccagcgttcatgtcgatggtttcgatgtacaaactctttaaaatcgtcaatttgatatgcttcatcaagtgtaattcctaatttatgtgggattaaacttgaaatttcatttaatgtaacttcatcaaaccccataattcttccaacatctctagcaactgctcttgcaagcagatgaccgaaagtcacaattccagatacatgtagctcgccatatttttcttggacgtactgaatgaccctttctcggcgtgtatcttcaaagtcaatatcaatatcaggcattgttacacgttctgggtttaaaaaacgttcaaataatagattgaatttaataggatcaatcgttgtaattcccaataaataactgaccagtgagccagctgaagaaccacgaccaggacctaccatcacatcattcgttttcgcataatggattaaatcacttactattaagaaataatcttcaaaacccatattagtaataactttatactcatatttcaatcgctctaaatagacgtcataattaagttctaattttttcaattgtgtaactaagacacgccacaaatattttttagctgattcatcattaggtgtctcatattgaggaagtagagattgatgatattttaattctgcatcacacttttgagctataacatcaacctgcgttaaatattcttggttaatatctaattgattaatttccttttcagttaaaaaatgtgcaccaaaatcttcttgatcatgaattaagtctaattttgtattgtctctaatagctgctaatgcagaaatcgtatcggcatcttgacgtgtttggtaacaaacattttgaatccaaacatgttttctaccttgaatcgaaatactaaggtggtccatatatgtgtcattatgggtttcaaacacttgtacaatatcacgatgttgatcaccgacttttttaaaaatgataatcatattgttagaaaatcgttttaataattcaaacgacacatgttctaatgcattcatttttatttccgatgatagttgatacaaatcttttaatccatcattatttttagctagaacaactgtttcgactgtatttaatccatttgtcacatatattgtcataccaaaaatcggtttaatgttatttgctatacatgcatcataaaatttaggaaaaccatacaatacattggtgtcagttatggcaagtgcatcaacattttcagacacagcaagtcttacggcatcttctatttttaagcttgaatttaacaaatcataagccgtatgaatatttaaatatgccaccatgattgaatggcccctttctattagttaagttttgtgcgtaaagctgtagcaagttgctcaaattcatcccagctgtccactgaaactcctgacgcattcggatgaccaccgccaccaaaatcttgcgcaatatcattaataatcaattgccctttagaacgtaatcgacatctgatttcattaccttcatcgactgcaaatacccatattttcaagcctttgatgtcagcaattgtattaacaaactgagatgcttcatttggctgaataccgaattgctccaatacatcttcagttattttaacttggcagaatccatcatccataagttcgaaatgttgtaaaacataaccttgaaacggcaacatttttgggtccttctccatcattttatttaaaagcgcattatgatcaatatcatgcccaattaactttccagcaatttccatagtatgttctgaggtattgttaaaaaggaatcgcccagtatcaccgacgataccaagatataaaacgctcgcgatatctttattaacaattgcttcatcattaaaatgtgagattaaatcgtaaatgatttcacttgtagatgacgcgttcgtattaactaaattaatatcaccatactgatcaactgcaggatgatgatctattttaataagtttacgacctgtactataacgttcatcgtcaattcgtggagcattggcagtatcacatacaattacaagcgcatcttgatatgttttatcatcaatgttatctaactctccaataaaacttaatgatgattccgcttcacccactgcaaatacttgcttttgcggaaatttctgctgaatatagtattttaaaccaagttgtgaaccatatgcatcaggatctggtctaacatgtctgtgtataataattgtatcgttgtcttcgatacatttcataatttcattcaaagtactaatcattttcatactcccttttttagaaaagttgcttaatttaagcattagtctatatcaaaatatctaaattataaaaattgttactaccatattaaactatttgcccgttttaattatttagatatatatattttcatactatttagttcaggggccccaacacagagaaattggacccctaatttctacaaacaatgcaagttggggtggggccccaacgtttgtgcgaaatctatcttatgcctattttctctgctaagttcctatacttcgtcaaacatttggcatatcacgagagcgctcgctactttgtcgttttgactatgcatgttcacttctattttggcgaagtttcttccgacgtctagtatgccaaagcgcactgttatatgtgattcaataggtactgttttaatatacacgatatttaagttctctatcatgacattaccttttttaaatttacgcatttcatattgtattgtttcttctataatacttacaaatgccgctttacttactgttccgtaatgattgattaaaagtggtgaaacttctactgtaattccatcttgattcattgttatatatttggcgatttgatcgttaattgtttcacccatctgaggctgtcttcctaaaagttgcatagactttaaaacatcttgtctattaatcacacccactgtctttttattactcgaaacgacaggaatcaattcaataccttcccaaatcatcatatgcgcacaacttgctactgtactcatagcatttacataaataggatttcgcgtcatcactttatctatttcgtcgtcgtcctttgtattaatcatctctcgacttgttacaatacctactaatttatacgactcattgactaccggaaatcttgtatggccagttcgattcgccatacgcttataatctgctattttcatcgtatcaaacagcacagataaatcatctaatggcgtcattatatcttgaactattaagatatcttttcgtattttctgattaaaaagtgctttgttgataatatttgcaactaggaatgtatcataacttgatgatagaacaggtaaatcatgttcattcgcaaaattaataactttattagatggcttaaatccaccagtaattaatatagccgtacctctttttaaagcttcaatctgcacatcttcacgatttccgacaatcaataatgtctttggaccaatatactttaaaatatctttgagttccattgctccaattgcaaatttagataccatcttagtgatacctttgttgccacctaacacttggccatcaataatattgacaatttcattaaaagttaaatgttcaatttcattacgattacgtttttcgattcgaaccgtaccaacacgatctatcgttgcgaccatgcccattttatcagcatctttmattgcacgatatgctgtcccytcagatacgtttaaaaatttagcgattttacgcaccgaaattttagagcctatagataacgattcaatataatctaaaatttgttcatgttttgtcattctttacctcttcttttcgaacagtattaactacattataactttattttggataaaaagcattgaagtgaaatgaaataatgatcgtttcacctattttattttttgaaaatatacaacaaacacaaagatcacaaaatctttaattttaaatggaaaaatccattattatttattagaatgtaagtgaggagggatgtactaatgtataaaaatatattacttggtgtagacactcagttaaaaaatgaaaaagcactaaaagaagtgtctaaattagctggcgaaggtacagtcgtaacagttttaaacgcaatcagcgaacaagatgctcaagcatcaattaaagcaggtgttcatttaaacaaacttactgaagaacgaagcaagcgattggaaaaaacacgcaaagctttagaagattatggtattgattatgaccaaataattgttcgtggtaatgcaaaagaagaactattaaaacatgctaatagcggtaaatatgaaattgttgttttaagtaaccgtaaagcagaagacaaaaagaaatttgtacttggaagtgtcagccacaaagtagcaaaacgtgcgactatccctgtattaatcgttaaataaaatttttatccagaatcacaaataatctttcaatcatgatgcagtctcaaacgactgagtaaatacaagaaacgattatgactgtggttctggattttttatatcgtagtaaatttataatcaatgtctaattgtataaaactaaaattacgagagtaggtcagaaatgataaagaaccactgatgtcccccgtccacgtcgtaactgaatcagtagaatataaaaacacccactaaaaatatgcagacgataacttccacatagattagcgaggtgttttttagtgtaaaatctatattctatttaaaactgaacagattcacctggttttaaaatttgcacgtcccctacattaacagcatctttaaattgttgtggatcttgttcgattaatgggaatgtatcataatgaatcggtacagaaatttttggtttaataaattcattaatagcataacttgcatcatcaatacccatcgtaaaattatctccaattggtacaaaacatacatcaactggatgacgtttcgcaatawgtgacatgtcataaacagacctgtatcaccagtatgataaattgtttttccttcaacttcaaacacgatacccattggcatacctaaataaactgggaataccattttcatgtgtaaaacttgaactatgaaatgcttgaacaaatttaacgcttccgaaatcaaagtttgctttaccaccaatattcataccatgaacattttcaacaccgtgatatgaagaaagatagtcagccatttctgcacttccaattactgttgctcctgttttctttgctagttccacaacatcaccaaaatgatcaaaatgaccgtgcgttaaaacgatatagtctacctgcactgtttcaatattcaaatcacacttagggttatttgaaataaacggatctacgataacctttttgttgttcccttctaaataaatcgttgattgaccatgaaatgataacttcatttgagcatcctcctatcaattactatataaatttagtacccttttgccacttaattataacaaattctcaaattttaaaaattgaaaatctagttaatgtattagctcgattttgaaatctaataataattggcataaaatggaagtaatattatgttgaggagtgtttataaaatgacaaaaatatcaaaaataatagacgaattgaacaatcaacaagctgatgcagcatggattacaacaccgttgaatgtatattattttactggataccgtagcgaaccccatgaaagattatttgcattattgattaagaaagatggtaaacaagtactattttgtccaaaaatggaagtcgaagaagtcaaagcatcacctttcacaggtgaaatcgttggatatttagacactgaaaaccctttttcactttatcctcaaacaatcaataaattactaattgaaagcgagcacttaacagtagcacgccaaaaacaattaatctctggtttcaatgtcaattcattcggagatgttgatttaacaatcaaacaattgagaaatattaaatccgaagatgaaattagcaaaatacgtaaagctgctgagttagcagataagtgtatcgaaataggtgtttcttatttaaaagaaggtgtgactgaatgtgaagtagtcaaccatattgagcaaactatcaaacaatatggcgtcaatgaaatgagttttgatacgatggttttatttggagatcatgccgcatcacctcatggcacaccaggagatcgcagattaaaaagcaatgaatatgtactatttgatttaggtgtaatttatgagcattattgtagcgatatgacacgtactattaaatttggtgaacctagcaaagaagcacaagaaatttataatattgtattagaagcagaaacatctgcaatccaagcaattaaacctggaataccattaaaagatatcgatcatatcgctagaaatattatttcagaaaaaggttatggtgaatatttccctcatcgcttaggtcatggcctaggattacaagaacatgaatatcaagatgtttcaagtactaattctaatttgttagaagctggcatggttattacaatcgaaccaggtatttatgtacctggtgttgcaggtgtaagaattgaagatgacatacttgtcactaatgaaggatatgaagtattaacacattacgaaaaataaggagtgggataaaaatgaaaagcttgttacaagcgcattctcattcagtcaaacactgccaatataacattgtagcgcctaagacataaatttttatccaagtctaaatgcaatatgtaacaaacaagctagaaacacatatgcaggtatgttcatcagtaacatgtaatgaatcaaatcaatatcattcatgttcgatgatttcttcgcattgtttctagctttaatttatcattatttaattttaataaccaaggagatgataacgtcattctttagtacgctgtaatccattcccttttcatcaaattcaaattataattgtaatgcttcttctacagatttatattccatttcaaatgcctctgcaacgcctttattggttacgtgacctttgtaagtatttaaacctaatgataatggttgatttgatttaaatgcttctctataccctttattagctagcatgagcgcataaggtagcgtagcattatttaaagctaacgtcgaagtacgcggtactgcacctggcatatttgcaactgcataatgaaccacaccatgcttaatatatgtaggatcatcatgtgtcgtaattttatcagttgtttcaaaaataccgccttgatcaatagcaatgtcaataataactgacccatttttcatttgtttaatcatgtcttctgttacaagtcttggcgctttagcacctggaattaaaactgcacctattactaaatcactttgtttaacatacaactcaatattcaacggatttgacataattgtatgtacacgtccaccgaataaatcatctaattgttgtaaacgctttggattaacatctaaaatcgtaacatctgcacctagtcctagtgcaattttagctgcatttgttcctgcttgaccaccaccgataatagttactttacccttaggtactcctgggacaccacctagtagaattcccataccaccattaagtttttgtaggaactctgcgccaacttgagctgacattcttcctgctacctcactcattggtgataacaatggtaaagatcggtctggtaactgcacagtctcatatgcaatactaattacttttctatctatcaaagcttgtgttaatttttcttcatttgctaaatgaagataagtgaataatacaagcccttctttaaaatatggatattcagattcaagtggttctttaactttaataaccatatccacatcccaaacttttgcttgttcagcaacaatctcagcacctgcttctttgtaatctacatcttcaaagaatgatcctgaacccgcatttgtttccactaaaacagtatg

SEQ ID NO: 132 - DNA, 4669 bp; double-stranded, linear
ctgattaatctcttgttgtcgtgtatttactaattgaatcgttggtgtctgaacacgtcccagggatagctgtgcatcatactttgttgttagtgcacgcgttgcattaatcccaacaatccaatctgcctcacttctcgctaacgctgcataatacaaatcgttatattgacgaccgtcttttaaatttttaaaaccttgttgaatagcttttttagtaactgagctaatccataatcgacggattggctttttgttaccaactttatccaaaatcaatcttgcaactagttcaccttctcgtccagcatctgttgcaataataatatctttcactttattatctaaaattaacgcttttactgttttaaattgtttgcttgttttaccaataacaacagttttcatatatttaggtataattggaaggtcttctaatcgccattcctttaaatttttatcgtattgttcaggtgtcgcatttgtcactagatgacctaacgcccacgtgacaatatattggttattttcaaagtaaccattacgcttctgatttatttgtaaagcatcagcaatatctcttgcgactgatggtttttcagctaatattaaagatttcataaattatcctttctcatacgttcttttatttcgaacgtgcttcatctattccactaatctttgatttaaattcaatgattgcaaatgatgtgttaaatgtattgtaacatgttaatatcactattaactttcatttcagttgaaatactatataataaaagtaacaaaaagtacggaggtaatgacatgagcatagttcagttatatgatattacacaaataaaatcgttcattgaacattcgaattatgaatcagcatcatacttatataaacttcctcaacagtacaatgaaatagatgtattaataaccgatgcgattgaatcacctggtgtattttcgattaaagaaaacgattcaatcaaagcaatcatattgtcttttgcatacgataaaaataaattcaaagtcataggccctttcgtggctgacaattatgtattatctgtcgatacgtttgaaacgctatttaaagcaatgacttcgaaccaacctgacgatgccgtctttaacttttcttttgaagaaggcattcaacaatacaaaccattaatgaaagttattcaagcaagttataacttcactgactattacatagaagcccgtacaagattagaagaagatatgcaccaaccaaatatcattccttatcacaaagggttttatcgtgctttcagcaaattacacacaactacatttaaatatcaggcacagtcaccacaagatatcattgatagtttagacgaccatcatcatttgtttttatttgttagcgaaggtttacttaaaggttatttataccttgaaattgattcacaacagtcaatcgccgagattaaatacttcagttctcatgtagattaccgtttgaaaggtatcgctttcgagttgcttgcgtatgcattgcaatatgcttttgataattttgatattagaaaagtttattttaaaattcgtaataaaaataataaactcatcgaacgatttaatggtctaggtttccatatcaactatgagtacattaaattcaaattcgaatcacgtaacgtaaaagatcaaacaatccctgaataaaacaccaagcaaataccctacagtacatcattagcatgtattgtgggtttttctactttttgtaaatattgaaaattataagtagttgttttttactattagggcagaatgctttacaataacatgcaagtgtcaattaaggggagcacttgcataaatagtataggagagtgagtagtcttgcaatttcttgatttcttaatcgcacttttacctgctttattctggggaagtgtcgttcttattaatgtgttcgtcggcggtggaccttacaaccaaattcgtggtacgacgctaggcgcactcattgttggattaggtttacttattactggtttcgcaaaattcaataatcctactgtaattattgtcggtcttatttctggtgcattatgggcgtttggacaagcgaatcagcttaaatctattagtttaatcggtgtatcaaatactatgccagtttctacaggtatgcaattagttggtacaacattattcagcgttatctttttaggtgaatggtcttcaatgactcaaattatctttggtttaatcgccatgatattattagttactggtgtagcacttacttcacttaaagctaaaaatgaacgtcaatcagataatcctgaatttaaaaaagcaatgggtattttaattgtatctacagttggatatgtaggtttcgttgtacttggtgacatctttggtgttggtggaactgatgcattgttcttccaatctgtcggtatggcaattggtggctttatcctatccatgaatcataaaacatcacttaaatcaacagcacttaatctattgccaggtgtgatttggggaattggtaacttgttcatgttctattctcaaccaaaagttggtgtagctacaagtttctcattatcacagttacttgttatcgtttcaaccttaggcggtattttcattttaggagaaagaaaagatcgtcgtcagatgacgggtatttgggcaggtattattattatcgtgatagctgctataattctaggtaatttgaaatagaaagttaaatactcatgtaacgtaaaaatgtaatcacttctgaaaataaccattcacttatagaatgattaaaattaattttcgggaattttacgttgaatgttcctctatatgtcctaggaaatacgtggctctaaaaacaaaacgcaataacacatcatgacattaatcatgcgttttaagactttaaaattagcgatacttttaaaatcttgatgatattcatatatcaagtatgcgccatacatatgaagtggatagctgcataacgcactgcattatcaacttgaatgtatgagttgaacaactatgtcataaataaaagcccccttttcacaatatacatttacatattgtggtaaagggggctctcattttctacgaatactaaaatggattttattttcaaatgtgtaaactagacaaacactgcctgatacacgtacaaaataatgatactaataatgattgtcaaattggtcgtcatacctataaatggcagtgttcgatatttaaactgaataccataagaaataattgcaacacctaccgggaacatccaagtgaccaacaatgtcgtcttaatcatatcatctgatactggtaacaacacatatactaacaatcccgcaactaatgctaatccataatgcaaacataaatatttaatagtagcaggtatatactttctttccagagtaaaattcaacatgacacctagcaaaatcattgataacggcatatttgcatgggaaagtatgctaaagaaatcgattgccacatgtggtaaatggatgtgacttatattcaatataaacattacaatgtatgtaacgagtggcactgattgtaataatttcttacctaaatatttaaaatcgaattgatcactaccttcactaaagtagctacctacaaagtaagtaattccaaacatcacaaaggcaccacctatatcagccataacaaaataaataagtcccgttttaggccatatcacttcaattagtggatatgcaaacaatccaatattcatagcaccagtcatcatacctactgatccacgcatgtgattatcatattttctaaaaaaccagacagcaatcattttcgccacaataccatatataatcattaaaattggtaaaatggagaatgacaattttaattctgcactgtttaaattcacaataactaaagatgggagtgtgacattaagaactaatgtagcaatgacttgactatctgttgcttttataaaattaatgcgcttcaaaaagtaaccaagcgcaattaataaaataatcatagtaaattgttctgtcactgttatcccttctttcaataatcttcataatttataactttaacatactccacagatattttagaagtctactgtttcatgctataatctacattaaatgcacttaattatatttcaaaggagtgttatagtatgtctttagaaaaccaactagccgaacttaaatatgattatgttcgtcttcaaggtgacatagaaaaacgggaatctttgaatttagatacttccgcacttgttcgtcaacttaaagatattgaaaatgaaattagaaacgttcgtgctcaaatgcaagattaataatctatcattcaagcaataaatgctttttgttacataaatttgactagcattgctctgaatacgttatattgatgaattgcttcatttttcgctcaattacatctagaatcacaagatgttgtcgtgttatgatttagtgtttcattaacaacatacacgcatatctatcccaacactgctatttatgttttctacgctgntgtactacatgaaccctttgaaacggagaggaagttatcatatgcaattttanctgattttactagcaatactttaacnaattgntagtttaatagaatttta

SEQ ID NO: 133 - DNA, 2785 bp; double-stranded, linear
tttgcacccatctgatacaatgcaccatgcggtttaacatgattaattttaacttgatgaatgcgacaaaacccttgtaatgcacctaattgataaatcatcaaattataaatctcgtcgttagagatatctatatttcgtctgccaaagcctttcaaatcaggtaaaccaggatgtgcacctactgcaacattatgtgctttggcaagttttaccgtttcattcattacattttcatcaccagcgtgaaaaccacaagcaacattcgcacttgtaattaacggaataatttgatgatcaccaccaaaggaataatttccaaatgcttcgcctaaatcacaattcaaatcaactcgcattataattccacccctttaacaatttgatgtttttctaaaaatttaatatcaacatcttttgcatctccatcacgatatagtggataatttaaaactgcatataaaaaatcggcagttgtagaaaatccatctatcaccatttcatctaaggtgactttcaacttatcaattgctgaagctctatcatgagattttacaattactttagctactaaagaatcataatatggtgaaacttgataaccgtgatatagtaaagaatcgactcgcacattaaagccttgaggtaaatgtaacgctgtcactttacctggtgttggttgaaatttcttttcaggattttcggcatttattctcgcttctatcacatgaccattaaattgaatatcgctttgtgaaaaaggtaaatgattatgttccaataaatacagttgtgctgcaaccaaatcacgttctgctcgcatctctgtaacagtatgttcaacttgtattcgagcattcatttcaataaagtaatgtgcggtatcagttactaaaaattcaatcgtacctgcacttctataatttgctgcacgtgcaactttaacagcatcgttacatatttgttgtcgtctttcttcagttaatgctgcacaaggagattcttcgattaatttttgatttttacgttgtacagaacaatcacgttcccctaaatgtacataattatcctgcccatctcccataacttgaacttcaacatgttttgcaacaggtataaaagcctcaacataaacacgatcatcatcaaagtatttttttccttcacttttagcttctttaaatgccttttctaaatcttcagctttctttacaatacgtatacctttaccaccaccgccactggcagctttgataacaactggataaccgatgtctttggcaagattctcaatttcagacacatgattcacagcaccatttgatcctggaatcacaggaacacctgcatgatgaactgtttgtcttgctgttattttatcccccatcatttccatcgtttttttagtaggccctataaacgctatgccttgttcctcaacggtttgagcaaattttgttgattctgataaaaagccatatcctgggtgaattgcattagcaccagtgatttgtgcagcagatatgatgcggtcaatatttaaataactatctaaagcattarcwtccccaatacatatagcttgatctgctaaatgtacatgcaagctttgctcgtccccttttgcataaactgctacagtttcaatcccatattctctgcaagctcttataatccttacagcaatttcacctctgttcgcaattaaacaacgaagcatttacttaccccctttacttaatacgtaccaaaacttggtcgtattcaacatttgtgccatgatcagctactatttcagtaatttctccagcaacatctgttgttacctcgtttaatactttcatcgcttcaacatatcctataatatctcccttgttaactttgtcaccgacattcacaattggttcagttaattctttactatcttgtaaaaagaatgtacctatcattggtgatttaatgtcatgataatcatttgtcgaaacatcggagttatcattcgcttttgaagctgtcaaatcattattgttcatactttgatttgattgattactgtgtgcagccaaatgattcgagtcagtgaagtcaatttctatttcatcttcaaaatttttatatttaaatttcttaacatcattttccttcactaatttgattatttgttcgatttnttcaatattcattttacaaatccccttttaaaattgttgctaattttttcgaagtatgtcgcaagctagatgtatcaaaaattggagtcttttgatgactcttaagaatttcattaaacagagacatttgttcccgattcttatctacagcttcttggaatgatatccatttaaattgaattgtatcttgtggtttcatctgtgctaactttggcagatcaaatttgcatacagttgcaattttggtataaccacctatcgtttgtttatcattaagcagaataataggttgaccatcatttggtacctgaacactaccaagagcaaccggttcagaaatgatatctgcttgattaattggtgcaacgctgtcaccttccaaacgatagcccatacggtctgattgttcagtaattaaatatggatgatttacaattttcgctctagcctcttcagaaaatgcctcgaattgaggtccttgaagaatgtgtataatattattttctggcaataaatcgtcctgtaaatgaatcgtctttccaatgttttctttaaagtcattatttattttcactgttattacatcatcagctaataactttctacctttgaat

SEQ ID NO: 134 - DNA, 1010 bp; double-stranded, linear
aatggaaacggttgaaacagcaattattactatttctatgggtgaaggtatttcagagatatttaaatcaatgggtgccacacatatcattagtggtggacaaacgatgaatccttctacagaagatatcgttaaagtcattgaacaatcaaaatgtaaacgtgcaattattttaccgaataataaaaatatcttaatggcaagtgaacaagcagcgagtattgttgatgcagaagctgttgttattccaacgaaatctattcctcaaggtataagcgcactattccaatatgatgtggacgcaacacttgaagaaaataaagcgcaaatggctgattcagtaaataacgttaaatctggttcattaacgtacgctgttcgtgatacgaaaattgatggcgttgagattaaaaaagacgcgtttatgggcttgattgaagataagattgtaagcagccaaagtgatcaattaacaacggttactgagttgttaaatgagatgttagcagaagatagtgaaatattgactgtgattattggtcaagatgcagagcaagcagttacagataacatgataaactggatcgaagagcaatatccagatgtagaagtggaagttcatgaaggtggacaaccaatttatcaatatttcttttcagtagaataaaaatttaaaataaaaaactaccaatgataaatcatcagttggtagttttttattttgctattttagtgatattgcgggttaaaagtatcgttctcgagttgctaacaatgtcatgttcaacttagtcatgataaaataaataacatactaaatgatacgtaaaatcaaataaaacataggtgatttattttggctaaagtaaacttaatagaaagtccatattctcttttacaattaaaaggtataggtcctaagaaaatagaagtattgcaacaactaaatattcatacagtggaagatcttgttctttatttgccaactagatatgaagataatacagtga

SEQ ID NO: 135 - DNA, 1540 bp; double-stranded, linear
tgtagttgaacatgaacaacaaaagaaagaaaagacaaaaaagcaatacaagccattttggattgtcatgagttttataatacttatagttgtactattactcccggcaccttcaagtctgccgataatggctaaggcagtactagctatttwagcttttgcagttattatgtgggtaacggaagctgtatcatatccggtgtcagcaactttaattattggcttaatgatattacttttaggatttagccctgttcaaaatttaggggagaagctaggtaatccgaaaagtggcagtgctattttagctggaagtgaccttctaggaactaatcatgcattatcattagcgtttagtggatttgcaacttcagctgtagctctcgttgcagctgcattatttttggctgctgctatgcaagaaacgaatttgcataaaagactagctcttttagtgttatcaattgttggtaataaaactagaaatatagttattggagcaattatcgtttcaattgtacttgcatttttcgttccttctgcaacagctagagcaggggcagttgtaccaatcttgctgggtatgattgcggcatttaaagtttccaaagatagcaagttagcgtctttattaataattacttcagtacaagctgtgtcaatttggaatattggtatcaaaacggcggcagcacaaaatatcgtagcgattaattttataaaccatcaattaggatttgatgtttcatggggcgagtggttcttatatgcagcgccttggtccatagttatgtccgtagctttatatttcatcatgattaaagtgatgcctccagaaattaatacaatagaaggtggtaaagatttaataaaagaagaattgcataaacttggccccgttagcccacgtgaatggcgtttaattgttatatcgatgttattattactgttttggtcaactgaaaaagtattacatccgattgactctgcatccattactattattgctttaggtgttatgttaatgccgaaaattggtgtcatgacatggaaacatgttgaaaataaaataccatggggaacaattatcgtgtttggtgtaggtatttcactaggtaacgttcttttgaaaacaggtgcagctcaatggttaagtgatcaaacttttggtgttttaggtttaaaacatttacctattatcgcgacaattgcacttatcacgctttttaatatattgattcatttgggctttgcgagtgcaacaagtttatcatcagcgttaatacctgtttttatttcgctaacctctacgttacacttaggagaccagtctataggatttgttttaattcaacaatttgttattagttttggtttcttattacctgttagtgcacctcaaaatatgttggcttatggcactggtacttttacggttaaagatttcttgaaggcaggtataccattgacaattgtagggaatatctagtgatagtttttagcatgacttattggaaatgggtaaggttgcnttaattaa

SEQ ID NO: 136 - DNA, 11823 bp; double-stranded, linear
acttctcacaataagaaatatgaaattgttatgtgttagttgagattcagtgatgaattacttttatcatttaaaatgttgttatcattgtcatgcgttaccaaatcgcttacgtatacacgattcccaatcttaacatagacgatttgtatatcagaattttctgattactaacagtttacctaagtttaaatatctgttcaatgattttcagttatttttaaaagaaaaatcgtaatgctgccatgataacaatcccactaataattgtaatagttaaatacgcgtgattatagataaaataaccgtcggaatgagcgcgataatgtaagggatgtttaatgtatacccctcaccatgaggcgtctgttgaataatgctgtcaatgacaagtgccgtaaatagtgtgattgggataaatgatagccatcgaaccacgacatcaggcaattgcacttttgaaatcatgataaaaggtataattcgaattaatagcgttacgataccacacaataaaataagtattaacatgttcatatgagttatcattgttccatcatcactcctaacgctgctgaaattgtggctgcaattaatattgctagatatgaaggcataaacatacttagcgataacatcattactatgacggcaataatgagtactatgtaaattcttaatcgcgatttagtaattgattcaaattgcgcaatggccaaaaagataaacatagccgtgatagcaaaatctaaccctagcgtttgcggatttgagatatattcgccaaataaagccccagctacacatgaaattgcccaaaataaatatgctgtgatgttaagaccatgcatccaacgatcattgatagcttctccttttaaataaggtgtaatggcgacgccaaacgtttcgtcagttactaatgaacctaatccaacacggttccaaaacccatatgtcttgaagtttggtgcaagcgacatacttaaaaggaacattcttgaatttacgataaatacagttagtacaatcgctgatataggtgtacctgctataaacaacgcgcacataataaattgcgcagcaccggcatatataacaagacataacaagacaatttctaaaatactaaagttttgagacgaagccacaataccaaatgaaataccaacaccggcataacccaataatgttgggatacactcttgcacgccttgtctaaaacttaaatgtgttgtcatctcaattacctcctttgccactttatatttatataattacgaaaaaataatatacctagtctaatacagttctataccctaagcaataacattagacatcagtttgtctgaggttagacattccggagtctttagtcagcttcatattaactttttatttttgagaattttcaattttttatttaagactacctccatattttctatggatttgtagttgtttttaagtatcaattttataaatttttatatctgatgatgagtctgggatattgattcatgtaccactcccttataatcatcccctccccctaccctactccatcgatataactcatactacatatcaacgaaatcagtattttatcgcttcctttcctatattagtgatgctcaaacttgttacgttttagattgttttagttcatcataattatcccgtattgttgctataatgaaatgcgttcaccccattaaaccacaaacttaatttattgttgttatgtgcattggctcactattatatttttacagcacaaaaaaagtggcgacagttcgtcaccactttttaaaatattatttaaagtatcttgcccttgctttaagtatacgtagatatatactttttaaagcttgtagctaaagcctttatttaactggttttgaaatttgtgttttaccacccataaatggtactaatgcttctggaattgttactgttccatcttcattttggtaattttcaacaatagcagcaaatgtacgtccaactgctaaaccactaccatttaatgtatgtgctaattctggtttagctgctttgtcacgcttgaagcggatgttagcacgacgcgcttggaaatccgtacagtttgagcatgaactaatttctttataatcattgtagcttggtaaccaaacttctaaatcatatgttttgcttgcactaaatccaatatcacctgtacataaaataacacgacggtatggtaaacctaactcttctagaattgcttctgcgtttgttgtcatttcttctaaagcattccatgaatcttcaggttgttcaaaacgtaccatttccactttatcgaattgatgtaaacgaattaatcctcttgtatctctacctgctgatcctgcttcactacggaaacatgcagattgaccagtgaatttttcaggaagtacacctggttgaataatttcattacggtagaaattcgttaatggtacttcagcagttggaattgtatataatccttctttttctactttaaataaatcttcttcaaatttaggtaattgacctgtaccatacattgtatctgcgttcacaagctgtggtaccatcatttctgtataaccatgttgtgttgtatgttttgtaatcatatagttcattaaagcacgctctaattgcgcaccttcatttgttaaatatacaaaacgcgcacctgaaacttttgctgcacgatcaaaatcagccattttcaattcttctacaatatcccaatgtgctttgggttcaaatgaaaactcacgtggtgtaccccactttttaacttcaacgttatcttcatcagattcaccttgaggtacatcatcacttattaaatttggaatacgacaaaggatacctgtcattttattatcaatttcatttaattgactatctttttctttaatatcgtcacctaatgtgcgcatttcagcaatcacatcatcagcattttctttattacgtttttttaatgcgatttcttcgcttactttattacgacgtgctttcatttcttctgttgcactaattaatttacgtcgttgctcatccaattctaaaatttcatctacaacttttggatcatctccacgtaattcaattttgctcttaactgtgtcaggctcatttctgaataatctaatgtctaacattaaccttcatcctttcccaaataattatcatttattatggaatgacgtacgtctttattttttagaaaataaaaaaagaccacatccctacaagggacgtggtctacgcgttgccaccctatttaacaatttaagttataaagatacactaaacctaaattgcacttcactaaaataacggttatcaccgattgttcttttaaattaagtaggtagattcatatatatgttgattcttgttcacactaaccacaagctctctgatatcgaacactatatattacttgtcctacgaacaatgtcttattaagttatttttaatatagcaaactatatttgctttttcaagtaacgatttcaaacatcactcatgtcgatttagtgacatgcagtcgtttgataaattgattgctttaaatactgtgcaaccgcttcaatatctttatgaaattgacgatcatgtgtaatggatggcacgatacttcgaaactcatcatacttgcgacgtgtttttggtgataatccttcaacaccttttaactctgctgcttgtaatgcaataacacattcgattgccagcacacgtcttgcattttcaataatttgataaccatgtctagcagctgtagttcccatagatacgtgatcttcttggttcgcagatgaagtgatagaatcaacactcgctggatgcgctaaagttttattttcagaaacgagacttgcagcagcatattgcataatcatcgcgccactttgcaatcctggctctggactaagaaatgctggtaaatcaccatttaattgaggatttactagtcgctctagacgacgttccgatacgtttgctaattcacttacacctaatttaagatgatctaatgcaaaagcaataggttgtccatggaagttaccacctgaaataacaaacgtttcatttgcttcctcaaatataagtggattatcattagccgcattcatttcaaattctaattgctgtttaacataattgaatacttgaaaactcgcgccatggatttgtggtatacaacgcaacgtatatgcatcttgtacacgtatttctgattgtcgcgtcgttaatgttgatccttctaaccaatcacgcatacgcgctgccacattaatctgttcttgaaaattacgaactgcgtgcacatcatgtcgatatgcatctataatgccattaagagactgatgcgttaatgcagcaatccattcagattggtaacctaaatcttctgcttctatataactaatgacaccttgagctgtcatagcttgcgtaccattaatcaatgctaaaccttctttagcctgaaggttcaaaggttgtctatttaattctcttaatacatcgtcactatccttttcttcccctctgtacaatactttcccttcaccaattaatgctaatgctaaatgtgataatggcgctaaatctcctgatgcaccgagagagccttgctgtgggattatcggtataatacgttcatttataaaaaattgtaattgtctcactaattctaaagtggcacctgaatgaccttttaataatgtattcaatcgtaaaatcatcatgactaatgctacttcttttgaaaatggctcacctagtccacaggcatgtgagcgtatcagattcacttgtaattcattatattgcgtcgggtctatacgtacatcactaaataacccaaaacctgtagtaataccgtaaaccgtttcctcattttcaataatacgttcaactaccgctctactttttttgacacgttctaacgcatcatcaataatttcaatctttgattgttgttgtaaaaatgatttaatatcctcaattgttagtgtttcaccatctaaatataaagtcatatatgttacccccttgtttatattaagtaacccatccttcttgaagtatacgttttcatttttattgaaacaatggttttacgtacatttataacctattatcagagcactattgtagtgcgttaaaggatattaagattgttgtaagcatatttaataatttatctattgacgaattgcatatacaggtatagtattttctattgtatttaacgacaaataataatgaattcagaaatttataatacattttgttaaaagttactatatatttttaaaattgaataaattcggaaaaggcttttacatgggaggttatatcactatggaaacgttaaattctattaacattcctaagcgtaaagaagattcacataaaggtgattatggcaaaattttattaattggtggatctgctaacttaggtggtgccattatgttagcggctcgtgcatgtgtatttagcggtagtggtttaatcactgtagctacacatccaacaaatcattcagcattacattctcgttgcccagaagcgatggttattgatattaatgatacgaaaatgttgacgaaaatgattgaaatgactgacagtatactaattggtccaggtcttggcgttgatttcaaaggaaataatgccattacattcctactacaaaatatacaaccgcatcaaaatttaatcgtagacggcgatgcgattacaatctttagtaaactgaaaccgcaattacctacatgtcgtgtgatctttacaccacacctcaaagaatgggaacgattaagtggtattcctattgaggaacagacatatgagcgtaatcgtgaagcagttgatcgtttaggtgcaactgttgtacttaaaaaacatggtactgaaattttctttaaagatgaagactttaaattgacaatcggtagcccagcaatggcgactggtggtatgggcgatacacttgctggtatgattacaagctttgtcggtcaatttgataacttaaaagaagcggttatgagtgccacatatacacatagttttattggcgaaaaccttgcaaaagatatgtatgtggtgccaccatcaagacttatcaatgaaataccttacgcaatgaaacaattagaaagttagtcattactaatcattgaatatagtaaagcattactttctagcataaaaataagactcccctacatatagggaagtcttattttttattattcttcatctgatgattgttgtatatcttcttcaacacgatccatgaaatcttgtcttacttcaatacgtccatcttcatcattttcttctgaatcaatcacttcagtatgaattgcatttcctggtgtttcatcatttacaaccgcttcacgttgttgttcagtaccatcttcagatacagttgaagtagattgctcatcttcattcgtttcatcttctgcatcttcttttactttagcaaccgttgaaacaaattgatcatcacctaagcgaattaagcgaacaccttgtgctgcacgaccattttgagaaatatctgcaacatctagtcgaataatgacacctgcattagtaacaatcattaaatcttcttcaccagttactgtagtgatacatacaacattaccattacgctcagtaatcgtagctgttttaatacctttaccaccacgatttgataagcgatagtcattaactggcgtacgtttaccataaccattttcagtaactactaatacttcatcaacactgtttgcatgagctacatcaagccctacaacttcgtcaccttcacgaagtgtaatacctttcacacccgttgctgtacggcctaaaggacgtaatgttgattcagggaatcgaattaatgatgcatgtgatgtaccaatcaagatatcttcttgaccacttgttaagcgaactgcaattaactcatcatcttctctgaacgaaatcgcaatcttaccatttctatttattcttgagaagttacttaatgctgaacgtttaacgacaccacgtttagttgcaaacactaagaagttgtcttcactttcaaggtctttaacagcaatcattgtactaatgacttcatcattttcaagttcaatagcattcactacaggaatacctttagactgtcttgataactcaggcacttcgtaacctttaagtttgtatacacgacctttgttagtaaagaacaatacatggtcatgtgtacttaaagttaccaattgactgacaaaatcttcttccaatgtattcataccttgaacaccacgaccaccacggttttgagcacgatatgtagataccggcaaacgtttaatgtagttattatggcttagtgtaattactatttgttcttctggaattaagtcttcgtcctctaagtcttcaaatccacctaattgaatttctgtacgacgatcatcaccgaaacgatctctaatttcagtcaattcatctctaactaactgtaataacacttcttcatcagctaagattgcttctaattcactaatataatttaataactcattatattcagcttcaattttgtctctctctaaacctgttagacgtcttaaacgcatgtctaaaatagcttgagcttgtttttcagaaagtttgaagcgttgttgcaagctttccattgcaactttatctgtatctgactcacgaatcgttgaaataatttcatcgatatggtcaagtgcgatacgtaatccttctaaaatgtgggcacgatctttagctttacgtaagttgtattgcgtacgtcttctaacaactgtcttttgatgctctaaataatgtaccaacgcttcttttaaattaataagcttcggtctaccatttacaagtgcaatcatattcacaccaaatgatgtttgaagaggtgtttgtttgtataagttatttaaaatgacactagcatttgcatccttacgcacatcaataacgacacgcacaccagtacgtaaacttgtttcatcacgtaaatcagtgataccgtcaattttcttgtcacgaacgagctctgcaattttttcaatcatacgagccttattcacttggaaaggaatttcagtgacaacaatacgttgacgtccgcctccacgttcttcaataactgcacgagaacgcatttgaattgaaccacgacctgtttcatatgcacgtctaataccactcttacctaaaataagtccagcagttgggaaatcaggaccttcaatatcctccattaactcagcaattgaaatatcagggttcttacttaagctaagtacaccattgattaattctgttaagttatgtggtggaatattcgttgccatacctaccgcgatacctgatgcaccattggctaataagttagggaatcgagcaggtaagactgacggctctctttcattaccatcatagttatcgataaaatctattgtatctttattaatatcacgtaacagttcaagtgtgattttagtcatacgcgcttcagtataacgcattgctgctgcgccatctccatccattgaaccaaagttaccttggccatcaacaagcggataacgataactgaaatcttgagccatacgtaccattgcttcataaatagatgagtcaccatgagggtgatatttacccattacgtcaccaacgatacgtgctgattttttatatgatttatccggtgtcataccttgttcatttaatccatatagtatacgacgatgtactggttttaaaccgtcacgaacatctggcaatgcacgagcaacgataacactcatcgcataatctaaaaatgattcacgcatttcactggtaatatttcgttcatttattcttgattgaggtaattcagccatcaagagttcctccttcaaaagttcagttcacagcgcttagaagtctaagtttgcataaactgcattatcttctataaattgtctacggttttctacaacgtcacccattaacatttcaaatgtttggtccgcttcaatcgcatcttcaagttttacttgtaaaagagcgcggtgctcagggttcattgttgtttcccataattgatctgcattcatttctccaagacctttgtatcgtgcaatagaccattttggtgttggattcaattcagatttaagtttatcaagttccctatcattgtatacataatacttttgtttaccttgtgtcagtttatacaacggtggctgtgcaatatacacatagcctgcttcaattaacggtctcataaatcgatagaagaatgttaataacaatgttctaatatgcgctccatccacatcggcatcagtcataatgacgattttgtgatatcttgctttcgctagatcaaagtcgccaccgattcctgtaccaaatgctgtgatcatttgacgaatttcattgttattcaaaattctatctaatcgtgctttttcaacatttaatatcttacctcgtaatggtaaaatcgcctgcgttctagagtcacgaccagattttgtagaccccccggcagagtccccttcgactaagaaaatctcacattcttcaggacttttactagagcaatcggctaatttacctggaaggcttgctacatctaacgctgatttacgacgtgttacttcacgcgcttttttcgcagcaacacgtgcacgtgccgccataatacctttttcaaccactgtacgtgcgacttgtggattttcatataaaaatcgttcaaagtgctctgagaataatttatctacaacttgacgcacttcagaattacctaattttgtcttcgtttgaccttcgaattgaggatcaccatgtttgatagatataattgctgtcataccttcacgtgtatcttcaccagaaagtctatctttttcttctttcataatcttgctacttaaaccataactatttaagacacgcgttaatgcacgtttgaatccgtcttcatgcgtaccaccttcatacgtatgaatgttatttgcgtaagttaaaagatttgtggcatatcctgagttatattgaatcgcaatttctacttcaatatcatctttagattgatgaatataaattggctcatcatgaataggttctttattttcgttcaataactcaacgtacgatttaataccgccctcatagtgataggagtcttctctaacgttttcttcatcacgttcatctcttaatgtgatttgaattcctttgtttaagaaagcaagctctctaatacgctgctgtaatgtttcatagttgtatacagttgtctctgtgaagatttctccatctgctttaaaacgaatgacagtacctgtcttatcagtngtgccaacttcttttaagtcaaattgaggtacaccttttttatatgcttgatgatatatagtctcatttctgtgtacatatacttctaagtcttgtgacaatgcgtttacaactgatgaaccaacaccatgtaaaccaccagatactttgtatccgccaccgccaaatttaccaccagcatgtaaaacagttaaaataacttcgacagctggacgtcccattttttcttgaatatcaactgggataccacgtccgttatccgttactttaatccagttatctttttcaataacaacttcaatttgatttgcataaccagctaatgcttcatcgatactattatcgacaatttcccacactaaatggtgcaaacctctctctgaagtcgatcctatatacatacctggtcttttacgtactgcttctaaaccttctaatacttgtatttgcccagcaccataattatccgtgttgtttacatctgacaatgcagtcaccatcgctttctgttactttataatttcaccttgattaatacgatacaatttagcgttattcatgatttcatgatcaataccatctacagatgtcgtagtgacaaatgtttgtactttatgctgaatcgtacttaataaatgcgtttgacgcgaatcatctaattcactgagtacatcgtctaataataagatgggatattccccaacttcgatattcattaactcaatttcagctaatttaatggacaaagccgttgtacgttgctgtccttgagaaccatatgtttgagcatccatgccattcacatcaaaacttatatcatctcgatgtggtccgaataagctaatgcctcgttctttttctctttgcatattatcgctaagaatagacataatttcttcaagtcgtgccgcttcattttgagcataatcaaatttaagactaggtaaataattcagcgacaacgcttctttatcatttgtgataccagcatgaatcggtttagctaacgactctagctcttgaataaaatgtgcacgtttatcagttactttcattgcatattcagcaaactgctgatttaatacttccaacattgttaagtcctttttttggcctaattgtaactgctttaagtaattattcttttgctttaaaatacgttggtattgagctaaatcatttaagtaaacagcagaaatttggcccaactccatatctataaagcgtcgtcttatttgrggrgagccttttacaatattcaaatcttctggcgcaaatagaaccacattgaggtgtccaatatattgagttagacgactttgctctaagtgnattcactttggacttgtttacctttnttagttataaacattgttaatgggcatcgtgccgtgt

SEQ ID NO: 137 - DNA, 692 bp; double-stranded, linear
ataattattaacatggtgtgtttagaagttatccacggctgttatttttgtgtataacttaaaaatttaagaaagatggagtaaatttatgtcggaaaaagaaatttgggaaaaagtgcttgaaattgctcaagaaaaattatcagctgtaagttactcaactttcctaaaagatactgagctttacacgattaaagatggtgaagctatcgtattatcgagtattccttttaatgcaaattggttaaatcaacaatatgctgaaattatccaagcaatcttatttgatgttgtaggctatgaagttaaacctcactttattactactgaagaattagcaaattatagtaataatgaaactgctactccaaaagaaacaacaaaaccttctactgaaacaactgaggataatcatgtgcttggtagagagcaattcaatgcccataacacatttgacacttttgtaatcggacccggtaaccgctttccacatgcagcgagtttagctgtggccgaagcaccagccaaagcgtacaatccmttatttatctatggaggtgttggtttaggaaaaacccatttaatgcatgccattggtcatcatgttttagataataatccagatgccaaagtgatttacacatcaagtgaaaaattcacaaatgaatttattaaatcaattcgtgataana

SEQ ID NO: 138 - DNA, 7900 bp; double-stranded, linear
atactgtagcgcaaatttcacaatggcatgttatagaagatttagttacgaatgaattaggtattagtattttaccaacatcaatttcagagcaactaaatggagatgtgaagctgtacgcattgaagatgctcatgtacattgggaattaggtgttgtttggaagaaggataaacaattaagtcatgccacaacgaaatggatagaatttttgaaagaccgtttaggctaacatattaataaagcactcattatttaaggcgcatcattacgtgggtcattgaaataatgagtgtttttttgtgaaaatgaagtgaaatttagagagcgtttccatagaaaatagtaatacaaactataaaaaaagagtatttttatattgtgtacgccatctttataatagttattgtaacaatttagacatatttagaaagggatggcgccatgcacaaagtccaattaataatcaaactactactacaactaggaatcatcattgtgattacttatattggcacagaaattcaaaagatttttcatcttcccttagccggcagtattgttggtctatttttattttatttactattacaatttaagattgtaccgctaacttgggtagaagacggtgcaaactttttattaaagacgatggtctttttcttcataccgtcagttgtaggtattatggatgtgcttccgaaattacgctaaattatatactctttttcgcagtcattatcataggaacatgtatcgttgcattatcttcaggttatattgctgaaaaaatgtcygttaaacwtaaacatcgtaaaggtgtagacgcttatgaatgattacgtgcaagccttattaatgattttgttgactgtcgttttatattatttcgctaaaaggttacaacaaaaatatccgaacccatttttgaatccagcattaattgcatctttaggaattatttttgtcttacttatctttggaattagttataacgggtatatgaaaggtggcagttggatcaaccatattttaaacgcaacggtcgtatgtttagcgtacccactttataaaaatagagagaaaattaaagacaatgtctctatcatttttgcaagtgtattaactggcgtcatgctgaatttcatgttagtgttcttaacacttaaagcatttggctattctaaagacgtcattgtaacgttattgccccgatctataacagccgcagtaggtatcgaagtgtcacatgaactaggtggtacagatacgatgaccgtactttttattatcacaacgggtttaatcggtagtattttaggttcgatgttattaagatttggaagatttgaatcttctatcgccaaaggattaacgtatgggaatgcgtcacatgcatttggcacagctaaagcactagaaatggatattgaatccggtgcatttagttcaattgggatgattttaactgcagttattagttcagtgttaatacctgttctaattttattattctattaatttagatatttaaaatgatagacagaaagggaggctattagtaataatggcaaaaataaaagcaaatgaagcattagttaaagcattacaagcatgggatatagatcacttgtatggtattccaggagactcaatcgacgcatagtcgatagtttacgtacagtgagagatcaatttaaattttatcatgtacgtcatgaagaagtagcaagcttagcggctgctggttacacaaaattaactggtaaaatcggtgtggcattaagtatcggtggccctggtttaattcatttattaaatggtatgtatgatgccaaaatggataatgtaccgcaattaatattatctggacaaacgaatagtacagcacttggaacgaaagcattccaagaaacaaatttacaaaaattatgtgaagatgtagccgtttataatcaccaaattgaaaaaggtgacaatgtgtttgaaatcgttaacgaagcaattcgtacggcatatgaacaaaaaggtgtagctgttgttatttgtcctaacgacttattaactgaaaaaattaaagatacaacgaataaaccagtagatacatcaagaccaacagtagtatcaccaaaatataaagacatcaaaaaagcggttaaactaattaataaaagtaaaaagcctgtcatgttaattggtgtaggtgcgaaacatgcgaaagatgagctacgtgaatttattgaaatggctaaaattcctgtcattcattcattaccagctaaaacaatcttgccggatgatcatccatatagtatcggtaacttaggtaaaatcggtaccaaaacatcttatcaaacaatgcaggaagcggatttattaattatggttggtacaaactatccatatgtggattacttacctaagaaaaatattaaagccattcaaattgacacaaatcctaaaaatatcggacatcgtttcaatattaatgtaggaattgttggagatagtaaaattgcgttgcatcagttaactgaaaatattaaacatgttgctgaaagaccattcttaaacaaaacgttagaacgtaaagcggtttgggataaatggatggaacaagataaaaataataatagtaaaccattacgtccagaacgattaatggcatcaatcaataaatttattaaagatgatgcagtgatttcagcagatgtaggtacagcaacagtttggtcaactcgatacttaaaccttggtgtaaataacaagttcatcatttcaagttggttaggtacaatgggttgcggtcttccaggtgcaattgcatcaaaaattgcatatccaaatagacaagccatcgcaattgctggtgacggtgcattccaaatggtaatgcaagacttcgctacagcagtacaatatgatttacctttaactgtatttgtacttaataacaaacagttagcatttattaaatatgaacaacaagcagctggtgaattagaatatgcagttgatttttctgatatggatcatgcaaaatttgctgaggcagcaggtggtaaaggttatacaattaagagtgctagcgaagtagatgctatagtcgaagaggcattagcacaagatgtaccaacgattgtagatgtatatgttgatcctaatgctgcgccattaccaggtaaaattgtaaatgaagaagcgcttggttatggtaagtgggcatttagatcaattactgaagataaacatttagatttagatcaaattccaccaatttcagtggcagcaaaacgtttcttataactgatttaaaggttatcacaattgaattgaactataaaaacggtaatttctatttcaacaaaatgggaattgccgttttgtttatttatcacaaatgatcgtactgaattgatgataaaattgtgaaaaagttgttgaaaacgcttttacaaatatgtataatagctatgaattagatatcacttgcgtgttactggtaatgcaggcatgagcaaacaaccgcactatgagaatagtcttgtttgttcatgcctgctttttttgtacatggaagcggaaattgagataggggatgtttatatgtttaagaaattgtttggacaattgcaacgtatcggtaaagcattaatgttacctgttgcgattttaccagcagctggtattttattagcgtttggtaacgcaatgcacaacgaacaattagtagaaattgcaccatggttaaaaaacgatatcattgtaatgatttcgtcggtcatggaagcagcaggacaagttgtatttgataacttgccattattatttgcagttggtacagcacttggattagcaggaggagacggtgttgcagcattagcagcgctagtaggttacttaattatgaatgcaacaatggggaaagtgttgcacattacaattgatgacattttctcatatgccaaaggggcaaaagaattaagtcaagcagcgaaagaaccagcacatgctttagtattaggtattccaacgttacaaacgggtgtgtttggtggtattatcatgggtgctttagccgcatggtgttacaacaaattttataatattacactaccaccatttttaggattctttgcaggtaaacgatttgtaccgattgtgacatcggtcgtagcaatcgcaacaggtgtgcttttaagctttgcgtggccaccaattcaagatggattaaatagtttatcgaatttcttattaaataaaaatttaacattaacaacgtttatattcggtattattgaacgctcattaattccatttggtttacatcatattttctattcaccgttctggtttgaattcggaagttatacaaatcacgcaggtgaattggttcgtggtgaccaacgtatttggatggcacaattgaaagatggcgtaccatttactgctggtgcatttactactggtaaatatccatttatgatgtttggtttaccagcggcggcatttgctatttataaaaatgcacgaccagaacgtaaaaaagtcgtgggtggtttaatgttatcagcaggattaactgcatttttaactggtatcactgagccattagaattttcattcttatttgtagcaccagtactttatggaattcacgtattattagctggtacatcattcttagtaatgcatttattaggcgttaaaattggtatgacattctcaggtggtttcatagattatattttatatggtttattaaactgggatcgttcacacgcattattagttattccagtcggtattgtatatgctatcgtgtattacttcttattcgactttgcaattcgtaagtttaaattgaaaacaccaggtcgtgaagatgaagaaactgaaattcgtaactctagtgtcgcaaaattaccatttgatgtcttagatgcaatgggtggaaaagaaaacattaaacatttagatgcatgtattacacgtctacgcgtagaagtggttgataaatcaaaagtagatgtagcaggtattaaagctttaggcgcatcaggtgtattagaagttggaaacaatatgcaagctatctttggtccaaaatcagatcaaattaaacatgatatggccaagattatgagtggtgaaattacgaaaccaagtgaaacgacagtgactgaagaaatgtcagatgaaccagttcacgtagaagcacttggaacaacagacatctatgcaccaggtatcggtcaaatcattccattatcagaagtacctgatcaagtattcgctggtaaaatgatgggtgatggtgttggctttatccctgaaaaaggtgaaattgtagcaccgtttgatggtacagtgaaaacaatcttccctacgaaacatgcgataggattagaatctgaaagtggcgtcgaagtacttattcatattggtatcgatacagtgaaactgaatggtgaaggattcgaaagtctgattaacgttgatgaaaaagtaacacaaggtcaaccattaatgaaagtgaatttagcatacttgaaagcacacgcaccaagcatcgttacaccaatgattattacaaatcttgaaaataaagaacttgtcattgaagatgtacaagatgctgatccaggtaagctaattatgacagtcaaataatgattaaaaatgaaacagcatatcaaatgaatgaacttttagtcattcgtagtgcgtatgcgaagtagcgagttgaaagagaatacgttacaaaaggcagtagcttaaaatgaagctactgcctttttagtgcgcaatgatgtatagcaggtgtgttgatgrtaataagttaaatattagtgttagatatagaaaacattgcttatgtttttgtcacattttagaaaaatgcatcttcgcgactagccaaattaatagtctcattgaaaagtttgattttccgtaataaagttcaattgcttgtatttttatcatgaaagtaataaaaataaattaacatgattttaaatctatttgtaagataaggagatttgtcattatgacaacagaaggtctattagttgcagagaaagaaatcgaagtgaatggttacgacattgatgcgatgggtgtcgttagtaatatcgtttatattagatggttcgaagatttgagaacagcgtttattaatcagcacatgaattactcaacaatgatcaatcaaggcatttcacctatacttatgaaaacggaagcagagtataaagtacctgtcacaatacatgacaaaccagtaggtcgtatttacttagttaaagcaagcaagatgaaatgggtgtttcagtttgaaattgtgtccgcacatggcgtgcattgtattggtacacagacaggcggtttttacagattgagtgataagaagataacctctgtgccacaagtgtttcaagacattttagcaacaaaataatgacttcattttaaaatataaaaagtaagaaggtgttcgaaatggttaagcaattaaatagtgtcgaagcattccgtgaatttattcatcaatatccgttagcagttgtacatgtcatgcgcgatcagtgtagcgtgtgtcatgccgttttaccacaaattgaagacttgatgcaatcatatcccaatgtgccattagctgtgattaatcaaagtcaggtggaagctattgctggagaattaaatattttcactgtacctgtggatttaatttttatgaatggaaaagaaatgcatcgtcaagggcgttttatcgatatgcaacgttttgaacatcatcttaagcaaatgaatgatagtgtaaataacgatgtcgatgagcattaatatcgcaaatgattagcattgctaagattatgtagacatcataacttatttcccagtaaatattggtagtaattagaatcagcatggtacagtagaactatagtagaaatcatcaaagaggagtgacgacaaatgcgtaaaaaatggtctacacttgcgtttggatttttagttgcagcatacgcacatattagaattaaagaaaaacgcagtgtgaaaagttatatgttagaacaaggtatacgattatctagagctaagcgtcgttttatgtataaagaagaagcgatgaaagcattagaaaaaatggcgccacagacagcaggcgaatatgagggaaccaattatcagtttaagatgccagtaaaagtggataagcacttcggttcaaccgtttataccgttaacgataaacaagataagcatcaacgcgttgtattatatgcacatggaggcgcatggttccaagacccactcaaaattcatttcgaatttattgatgaacttgcagaaacactcaatgctaaagtcatcatgccagtatatccgaagattccgcatcaagattatcaagcgacgtatgtgctttttgaaaagttgtaccatgatttattgaatcaagtagcagattctaaacaaatcgttgtaatgggtgactctgcgggcggtcaaattgctttatcatttgctcaattgttaaaagaaaaacatattgtgcaaccaggacatattgtattaatttcaccagttttagatgcaacgatgcagcatcctgaaattcctgactacttaaagaaagacccaatggtaggtgtggatggcagtgtgttcttagctgaacaatgggcaggggacacacctttagataactacaaagtatcaccaattaatggtgacttagatggtttaggtcgtattacattaactgttggtacaaaagaagtactgtacccagatgctttgaacttatcgcaattgttgagtgcgaaaggtatcgaacatgactttatacctggatattaccaattccatatttatccagtatttccga

SEQ ID NO: 139 - DNA, 1984 bp; double-stranded, linear
gtctaaataaacaaaattatcattgattactgaactggcatttcgaagtaatgcttcaatatcattcgaatatttcttcaatttatgattgtgaaataattcttgcatcaaaaatggtctttggtcacatgaatgtgcatctgaagctacaaaatgagccaaattacattctataaattgtaatgataacttttgaatgtttttaccaaatccaccaactaaagaactcgatgttaattgactcagtgccccatttgcaaccaattcatataatatttccggatttttggcgatacttctatttctttcaggatgtgcaatgattggtatgtaacctctcgattgtatttcaaaaaacaattgttttgtataatgtggtacttcgcccgttggaaattcaattaataaatatttcgaacgattaataccttgaatactaccattatctaagcctttcagaatcgaatctgtaattctaatttcttgcccgggaaataatttaatatccaatgcttgaacttctggatgcgttcttaactccgccaatttcacaagcacttgttgaaatgtattatcatatctcggatgcaaatgatgaggtgtcgctacaatacttgttacaccttcatccttagcttgctttaatagtgcaatactcttttcaattgttttaggaccatcatctatatcaactaatatatggttatgaatatcaatcatgattcatcagtcccataatatgcatagtaactagcacttttatctttaggcattctatttaagactacacctaataatttagcacctgttgcttcaataagttcttttccttttttaacttcatctctattattattttccgaattaactacgtagacaacattgccggtaaactttgaaaataattgcgcatctgtaactgtgttcactggtggcgtatcgataattacaaagttataattcatcaataatgtgtcatacaaatttgcaaatgcccttgatgtaattaactctgacggattcggtgggattggcccagacgtcaagacgtctaaatcttgaatttcagttgagataatactgtcttgataagttgaccaatttagcaataaacttgataggccttcattgtttggcaaattaaaaatataatgctgcgtaggtttacgcatatccccgtctacgattagtgttttataacctgcttgcgcatatgcaactgctaaatttgctgcaattgtagacttacctgcgcctggtgcctctgaagtgattacaatgctttgaactgcactgtcaggatttgcaaacataatatttgatcttatgcctcgaaatttctcgctaataggtgactttggttgttcatggacaattaaacttgatgtacttcytcgtgtattcgtcatggtaattcctcgtaaattaaaatttttgtattgaacctaaaataggtaatcctagttgcgattcaacatcttcttctgtcttaatacgcttatctaataattcttttaagaaaataatcaatattgctaaaacaataccaacaataatgctgataactaagttgacagatactattggagatacttttacagcattatcatgtgctgaggaaagtatcgtaacattatcaacactcataattttaggcatgtcatgagcaaaaactttagatattttattaacaattttgtcagattcagatttattcccagtggtaactgatacagtaataatttgagagtttgtttgattggttacttttaaaaatgaattcaactcagctgttgaatactgaccatcaanttctctagatactttatctagaattctaggacttttgataatttccgtatatgtattaacagactgcaaactactttgaacattttggaaagctaaatcacttgaggactttttcatgttcactaatatttgagtagaagcagtatatttgtcaggcataacaaaaaaggtt

SEQ ID NO: 140 - DNA, 6272 bp; double-stranded, linear
caaatcccttggtgatgataaatgtattgctgtgtagccaaataatcttcgtatatatgactgacgttcaacaacagcttgcaatcgtttcgttggtacagttactttcttcttgttaaagagaccatattcaattttaagttgctcattttcaagcatcaccgaaaagccataaaatcttatcattgttataatcgttccaataatatatgccactattaatactagtaaaatgatgattaatactgaaatacttacaatttgaacccattgactaatttcatgatttagcttcgaccatgggatcaactctcttacagccccgtaaatcggtactaaagctgctaacgttacaccaatggcgccactggtcattgccataaatagtgattctttaaaattcatctgatatataggaatgcgtttatttttctgattaagcatactatcagtgttctgcacttcatctaagcgaccttctgcgatgtcttccacattaccttcaatgtcatgattacagttgtcattcttctcagcactagacttttgcgccacttctgtcttcaactctgtttgcaattgatcaatatatcgttcaagatattcaccttgttttttcgaaataacacttaagacaataccatcacttggtgttttgatttgtaaatccacaccaccaataatttgattgacgaccccttgtgtcatatcaacggactgaatacgttttatatttaattctttacgctttttattaaaaatacctgttgttaaaatgaaataattatcctcaatccaatatcgcgtgttcataattccgacaatttgagaaatgtatgatattaaaaagaatacaaatacaatacctatccataaatatgattcgggattcgtataatcaaaatctttcaattgaaagataatgaaaataaaaaagacgactatgttttgtttgatagcattgattatgccattaaaatatgaaatcggatgtaatttttgaggttcagacatcactttcaacccctctcaaattcgacatagttctctcttcgattattttaacatcgtcatgagacatcatcggtaaataaatagtatgacctgcagtcataaatccaactttatacaaattaagcactttactaattggattagatttaatcgacaagtattgtaaacgttcaattcgactcgtttcttctttatatataaaaaatgatgtacgatattgtacacttagttgatcaactttataaaagcgacaatgatattgccataaaggcttaataaataattttaatgtactcagagcacctaaaaccaacaaaatataaagtaagtaatgtggccattcaaatcttaaccatataaaataaaaaatgacatacacagctacactcaatataaattctaagccattcgtaatgtagtaatacaacaatgctgacttaggactcttagtcaacttagtataatctgacatatacccctctccccaaataaaaaattatacggatttataatctatttcattttatttttatatgatgataattatagcatatggaatatttcatgctaatttattcttcctaaaggtacatctaaaaatttaattaagcagaaagtgcttgaattgctaaaaagacaccatgttataattttatcaacatgatgcctttcatctataatcaatctttcatcttatcaagagcgatatttagttcaagcacattcacataatcatttgttaacacaccacgctgcttacgatgttgaatcaagtcggccactcttgaagtagatacatgacgagcatcagcaatacgaggtgcttgcttcaatgcattttcgaccgtaatatgcggatctaagcccgacccagaacttgttgcagcatctattgttacatttgaattcccaaatttaacatgatgtttcatgcgtgctattaattcggtgtttccattcgattcattacttccacctgaagatacgccgtttttatataatttttcaggattcatattataatcaactgcactcggtctcccgtgaaaatatcgtgtctctgtccagtgctgtccaatcaattttgatccaactatacgattgtcatacgtaattaaactgccatttgcttgttgataaaaaaatatttgaccaattaacgtgatagctaacgggaataaaaatccacataataccatagttattatcgttaaacaaatactatttcttatcgtattcatggtacaggctccttcctctttacacaaaaaattgtacaatcatatctattaatttaatgcctaaaaacgggacgattaatccacctaatccataaatcaacatattatttataaagattctatcaatgctgtaaccctttacttttacacctttcatggcaattggaattaaggcaacaatgattaatgcattgaatatcaaagctgatataattgcagatttaggtgacgataaatgcataatatttagtgaagtcatttctggaattgttgacatcattagtgcaggtaaaattgcaaagtattttgctacgtcattagccaaactaaatgtcgttaatgcacctctcgtcattaataattgtttgcctatttttacaacctctattaactttgtaggattcgaatctaaatcaattagattagctgcctctttagcactaattgtccctgagttcatagctaatcctatattcgctttgtgctagcgcaggtgcatcatttgtaccatctcctgtcatcgcaacaatatggcctttcgcttgttcatctttgatgactttaattttatcttcgggtttacactctgcaacaaatctatcaaccccggcttcttttgcaattgtagctgctgttaaagcattatcacctgtacacataactgtttcaatccccatttttctcaattcagtaaatcgttctacaagaccatctttaatcacatcttttaaataaatcacgccaagcatgacattgttttcaatgactattaatggngtgccacctttactcgatacatccatacagagagactcaatattaagaggaatattgccttgttgttgtttgacaagatttatcatactattaggtgcacctttgaataccgatatttcatttgtaatgattccgctcattctagtttcagctgtaaaaggcttatatgtgccatcaatgtctttaggcagctcatttatatacatctgcttcgctaatcgtacaatactttttccttctggcgtatcatcgtagattgatgacatataagcagcgactatcaatttttcaagcatttgttgattcactggtaaaaattcactagcgattcgattgccataagtgattgtgcctgtcttgtctaaaatcattacatcgacatctccacatacttctacagcacgcccacttttcgctaatacattgaattgagtaacacgatccatgcctgcaataccaatcgccgataacaaaccaccgattgtcgttggtattaaacatactgttaacgcaatgagcatcgcaataggtaaaattaaatgcaggtaagatgctattggatataacgttacaataacgactaaaaatataattgttaacgttgttaataatgtaaaaagtgcaatttcatttggtgttttatttctttccgccccttcaactaaggcaatcattttatctaaaaaagatgtacncgcttcactctcaacacgtatttctaaccaatcagatgttacaagtgtaccgccaatgactccatcaaaatcgccacctgattcttttatcacaggtgcagactcaccagtaattgcagattcatcaacggttgctaatccatttattacaacgccatcagcagggattgtttctccattttctacccgaatattttgtccggcttttaactctgtggcgttcactatccgatacgcaccattttcttctatcaatcgagcagttaaatttgattgtgcttgtcttaaactatcagcttgcgcttttccacgaccttcagcaaaggcttctgaaaaattagcaaacaatatagttattaataatatgataaaaattgtaatcaaataacctcgcgatagatagctagttccaaatatgtcaggaaaacatattaatatcaacgttaaaatcattccaacctcaacgacaaacattatcggattttttattaattgtttaagattcagcttataaaaactcattttcaaagcttctatcaccattgtttgattgaaatatttatttacatgatgcattttttccatccctttactttattttaaagttaaaaattcaccaataggaccaagtaatagtactggaataaatgtcaaaccacttagtaaaacgataaatacgattagtgatacgccaaaataaggtttatcaatcgctattgtatatttatcttgatggtatgattttttattcactaaacttgatgcaatcattaattgcaaaataattggtatataacgagaaagcaacataatgattcctgtagagatattccagaatgttgtatcatctttcagtccttcaaaccctgatccattgttcgcagcagctgatgtcatttcatacataacttgtgaaataccatgaaaagacggattcgttatactttcacttgctccaggaatcataaaagcaagtgctgaaaatactaaaattaaaattgggtgtatgagaaagactaagacaatacatttcatttcacgggcgccaattggcatatttaaatattctggtgttttaccaaccatcaaactgcatataaacaccgtcagtaagacaaatatcaataaattcatgagtcctacgccttcgccaccaaatacaacatttagcatcattaataccattggtcctaatccacctataggcgttaagctatcatgcatgttattaacagaacccgttgtaaatgccgtcgtaataactgtaaatagtgctgacaaacctgctccaaaccgtacctctttaccttccatattcggtccataaatgcctaaattcgctagtattggattaccacgatactcactccacatagttaatgtaagaattgctataaaaatgaaaaacattgcgacaaataatatcaacgcatgacgatgtactcgtttaccatgtctacttaacatgcgaccaaataagaacaacattgacataggaagtaacatcatactgcccatttctataaaattgctccaaatatttggattttcaaaaggtgttgcagaatttcctgctaaaaatcctccaccattcgtaccaagatgttttattgattcaagtgatgcaataggtccaaatgcaatatgttgaatatgtccgcttaaagtccgaatcattaaattagcatgcaacgtttgtggtacaccttgagtcatcaataaaatactaattaaacatgataatggtaaaagtactcggacaataaaccgaacaatatcttgataaaaattaccaatgatattagttaatccagttaaacgtctcaacatcgctatacaaacggcgtaacctgatgcactagatgtaaacattaaatatgtcattacaatcatttgcgttaaatatgtcacatctgattcaccgttatagtgttgtaaattactatttgttaaaaaagatattgctgtattaaacgctaaatctatcgattggtttaaattatgatttggatttaaaaaaagccattgctgaactattagcaatacaaatgttataaaccccataaatccattaaatgccagaaaatgtttgacatatgttttagctgacatgtgttctaaatctgtgccgataattttaaaacacatattttcaaatctagtaaatattaaatctactcttgacgattgcaccaatgctacgcgatatagatatccactaaaaacatacgtaatcataaccatcattgttagaaacaaaattatttccatgataaccctcacttaatatatttctaaaatttttcactacgaattaaggcataaaataaatacaaaactaatgcaataactaccagtaataaaacgatgagcattgccataaccnccttacaacacaacaacatcgtaacaacttgtttatgagagaaatnttaattttcaaacttagttattaagaaancattaagatgtgtatgcagaaataaattttatagcatttaattgtgaagaatattatgatattgctatcgaggtgaaggttatg

SEQ ID NO: 141 - DNA, 1978 bp; double-stranded, linear
aaatgatgttttacaataaatatanaaacgtatcaacatatatcatcatatttttagtttcaagtgcagcctttgcaatattcttgttaagtgcgnacattagtgctcactcggaacaagtgtacgaaatgactgaccatcaaattaagaacaatacgataaataaagcatacgaacataaagaccctacaaacaatagcgaacaaagagatgggaaagtgttcgctttaataaattgatacattgtcacaacgttattttgcctatttttgcgmaatagcgttttttattacwtttttgctgatsttaaatttgttatattttgttaaagtattataatgattgaataaacaaattgaaggtaggttttttaattgagtaattctgatttgaatatcgaaagaattaacgagttagctaaaaagaaaaaagaagtaggattaactcaagaagaagcaaaggagcaaacagccttaagaaaagcttatcttgagagttttagaaaagggtttaaacaacaaattgaaaatactaaagtaattgatccagraggtaatgatgtaacacctgaaaaaattaaagagatacaacaaaaaagagataataaaaattaaatcacaaatctgtaaagaattttctgacattataacttgaaataagtattttacttatctttttattttaaaataagttataatgtatttgataaaattgaagaagggaagatacacaagatgtttaatgaaaaagatcaattagctgttgatacgctacgtgcactaagtatcgacacaatcgaaaaagcgaattctggtcatccaggattacctatgggagctgccccaatggcttacactttgtggacacgtcatctgaattttaatccacaatctaaagattacttcaatagagaccgtttcgtattatctgcagggcatggttcagcattattgtatagcttgttacatgtttctggtagtttagaattagaagaattaaagcaatttagacaatggggttctaaaacaccaggtcatcctgaatacagacatacagatggtgtagaagttactaccggaccacttggacaaggttttgctatgtcagtaggattagctttacagaagatcacctagcagggaaatttaataaagaaggatataatgttgtagatcattacacatatgtattagcttctgacggtgatttaatggaaggtatatcgcatgaagcagcttcatttgctggacataataaattaagtaaattagttgttttatacgattcaaatgatatttcattagatggcgaattaaacaaagctttttctgaaaacacaaaagctcgttttgaagcatatggttggaattacttactagttaaagatggtaatgatttagaagaaattgataaagcgattactacagctaaatctcaagaaggaccaacgattattgaagttaaaacaacaatcggatttggttcaccgaataaagcaggaactaatggtgttcatggggcacctttaggtgaagttgaaagaaaattaacattcgaaaattacggtttagatcctgaaaaacgttttaatgtttcagaagaggtatacgaaattttccaaaatactatgttaaaacgtgctaatgaagatgaatctcaatggaattcattattagaaaaatatgcagaaacatatcctgaattagcagaagaatttaaattagcgattagtggtaaattgcctaaaaattataaggatgaattaccacgttttgaactgggtcataatggtgcatctcgtgctgattctggtactgttattcaagcaatcagtaaaactgtcccttcattctttggtggatcagcagaccttgctggttcaaacaaatccaatgtaaatgatgcaactgattatagttctgaaacacctgaaggtaaaaatgtgtggtttggtgtacgtgaatttgctatgggtgct

SEQ ID NO: 142 - DNA, 7588 bp; double-stranded, linear
tagtagtatttattaaattatacgaagggacccaacacagaaaattcattttattgaattttacatttatgtgccaagttgggaaaaatgtcttattttttcaaagtatttaaaagtaaaattacatgttaatacgtagtattaatggcgagactcctgagggagcagtgccagtcgaagaccgaggctgagacggcaccctaggaaagcgaagccattcaatacgaagtattgtataaatagagaacagcagtaagatattttctaattgaaaattatcttactgctgttttttagggatttatgtcccaacctttttagaatattaaatttctacaatttcgtcatcttcaacaataaagcccattgtattgacgctgttatttaagaaagtcagaatataacgcattacttcatcacgttctggctcattgtgaacctcgtggtaaaaaccttgccaagctttaaaatataattcaggtgtttgatatttttctttaaactcatcaattgccctagtatcaacaattaaatccttcgttccatacattaatagcgttggcattggttgaatgtcatgaatatgagccatcgtatctttcatcgtctcattaattgtattataccaatgatacgttgctttttttaacattaaaccatcgttaactgtttcttcaacaatttctaaattacgtgttaaatcttttggttctacaccaacattaaaacgtgtgtcttttgaaattttacctatatttgaaacaagtttatctttacgattttttccattcttttgaagttctagcataggagaaattaacatcatcccctcgattggcaattctactttttcaagtaaatttaataaaatcaaaccgccaagtcctacccctaatacataagtaggaattttatattcattagctatctttaaccagtctagcaaactttcgtgatacgtttgaaagttttcaatttgtcctttattagctcttgaagtttgaccttgaccaggcaaatctcccataatcacatgatagccatttcttcttaacatcgtaataacatatgcatatcttcccgtatgttctaatatattatgagcaataacaacgacgcctttcgcatcattttcagcttcccacttccacattattatactgcccctttttcattaatcttcaataacataattatagcaaattcactatgtagatttctatttatagtattattgttgtccatattattatatataaatgaaatcaacatcaataatagtgtaattatacataattatttttgattgtttttgatgaaaacgctttctcgaatatttttttcatgctaaacttattgtaaacacaagggtttggaggagtagcaatggcactattaaagaatttttttatcggattatctaataatagttttttaaacaacgcagcaaaaaaagtgggcccacgtttgggcgccaataaagtcgttgccggaaatacaattccagagttaattaatacaatcgaatacttaaatgacaagaatatcgctgttacggtagacaatttaggggaatttgtcggtacagttgaagaaagtaatcatgctaaagaacaaattttaacaattatggacgcgcttcatcaacatggcgtaaaggcacatatgtctgttaaattgagtcagttaggtgcagaattcgacttagaattagcttaccaaaatttaagagagattttacttaaagcaaatacttacaacaatatgcatataaatattgatactgaaaaatatgctagcctgcaacaaattgttcaagttttagatcgcttaaaaggcgaatttagaaatgttggtactgtaattcaagcatatttatacgatagccacgaattagttgataagtaccaagatttacgattacgtttggttaaaggtgcatataaagaaaacgaatcaattgcatttcaatctaaggaagacgtagatgcaaattacatcaaaataattgaacaacgtttgttaaacgcacgcaatttcacttcaattgcaacacatgaccatcgcatcattaatcatgtaaaacaatttatgaaagaaaatcacattgaaaaagatcgtatggaattccaaatgctctatggttttagatcagagttagcagaagaaatcgcaaatgaaggctataatttcactatttatgtaccttatggcgatgattggtttgcgtattttatgagaagattagcagaacgcccacaaaacctatctcttgctgtaaaagaatttgtgaaacctgctggcttaaaacgtgttggcataattgcagctttaggagctacagttatgttaggtttaagtacaattaaaaaattatgccgtaaatagagcaagacataaacaataatttaggagtctggaacaataatcaatgttctaggctcctaaatgttatattggcagttctgaaacatttataaatctttgattatgaactcacaacagtgctctatgcttttatagattttaataaattagccatttcaattgcacttactgctgcttcagcacctttattgccagctttcgtacctgctctttccacagcttgttcaatactttcagtcgttaaaataccaaatatgactggtacattagtttgatcattcactttagaaacacctttcgcgacttcattacaaacataatcataatgagacgtagcaccgcgaattacgcatcctaatgtaattactgcatcataatttcctgatgaggctaattttttagctactaaaggaatttcaaacgcacctggcacaaatgctacatcaatattgtcttcattaacatcatgtcgaatcaaagtatcttttgcaccttcaagtaatcttccagtgataaaatcattaaatcgactaactacgattgcaactttcaaatcttttccaattaatttaccttcaaaattcatgttaaaatcctcctatattaaatgacccatttttatttttttcgtttccatataatcatgattatgtaccgtttctggtacgataacttcaattctttctgcaatatcaatgccatattgttttaatccctcaaatttacttggattattacttaataaattgatatgttcgatgttaaaatattttaaaatctgtgcagcaatatgataatctcgcaaatcttcatcaaaacctaatgctaaatttgcagttactgtatcatatccttgctcaattaattcatatgcgcgtaatttgtttaacaatcctatgccacgaccttcttgaggtagataaataatcatgccaccatgttcattgatatacttcatagacgattcaagttgagcaccacaatcacaacgttgactatggaaaatatcgcctgtaaggcacgcagaatgtaagcgtacattttcatgttgtcgaattgcaccttttgtcagtacaactatctcttcatctgtgtatgtcgctttaaaaccatacatatcaaatgttccgaaatctgtaggcattttcacttttgccttaaattcaatttctggttctaattttttacgatattcaattaaatcatcaatcgtaatcatctttaattgatgtttttctttaaacttttgtaaatcttgtcctttcgccatcgtgccgtcatcattcataatctcacaaatgacaccagcgggcttggcaccagtaagtttagctaaatcaacagccgcttctgtgtgtccatttctagctaatacgcctttatcttgtgctactaatggaaataaatgaccaggacgattaaaatctttagcttcactactaggatcaatgagctttttggcagtcaatgtacgttcataagcactaattcctgttgttgtatctacatgatcaatactcactgtaaattgcgtaccaaagatgtcggagttatcatcaaccatttgtaccaaatccaaacgttgtgcaatatctttagacactggtgcgcatattaatccccttgcttctttcgccataaaattaatggtattatcgttcatccattcagtaaccgctactaaatcaccttcattttcacgattctcatcatctactacaataattggttctccattttttaaagccattaaagcactgtcaatattatcgaattgcatgctacccctcctaaaaaccaaatgctcttaatttatctacagataattggtctttatctttatttaaaatattttcaacatatttaaacaaaacgtctgtttctaaatgtactttatctcctaattttttggatgataaaatcgttgaacgcctcgtttctggaataagatgaatgtcaaaactgttatcatgcttatcaaataccgttagactaacaccatccacagtaatagacccttgcttaactaactgattattaatatgttggctacattgaatcgtaataatttttgcattggctgtttcatttatttttgaaactgttcctagttcatctacatgaccgaggacaaaatgtccaccaaacctaccgttaccactcatggcacgctctaaatttacttctgattgtcgcttaacatctgctaaataggttttattttcagtgcctttaattacttgaacagtaaaagatgtctgattaaaatcaatcactgttaaacatgcaccattaacactgatggaatcaccaatatgcatatctgccgtaatcttatgtgcttcaatttcaatcgtcctgactgattgacgaatttgaacacttttaacgacacctatttcttcaacgatgccagtaaacatgcatcatcacttctttcgtaaagttaatttaacattttgatttaataactcggaatgaacaatttcaaattggttcgcatctggtatctcaatcacatcatttgtttgataaaattgataatttccagatccgccaattaatttcggggcataatagagaataaattcatctatataattagattggagaaattctgaagtagtggttggacctgcctcgactagcaaagttccaactcctcttttatataaattgtgaagaattgttgttaaatcgcaagacttcaagtaaataatttcaatatgtgtttgattggttgttaaatttggattttcagtatatatccaaattggtgttgattcatcttgataaatttgctgattaaaatgaatattcccagacttagacaatattacttttatagggttttttccatcttgaatacgtgtagtatattgtggatcatctaattcaactgtacgtcttccagttaacactgcgtcgtgtcgatgtcttaacttatagacatcttgtttaacctctttgttagtaatccattgactttgtccattatcattcgcttgtttaccatctaaacttgcagatactttcactgtaatttgtggcagttgctttgcttttgctttaaaaaagtcttggtataattgtgatgcccgttcatcatcaacgcattcaacctcaataccgtgagcccgtaacgtctcatcaccatgtgtgtctaacgaattgtcttttgttgcgtatactacttttgctatcttacaatcaattattttgttaacacagggtggtgttgaaccaaaatgactacatggctctaacgtaatataaatcgtcgcaccttcagcattttgttgtgccatatcaagtgcttgaacctccgcatgcttgtcaccttttctcaagtgtgcaccaataccaacaatcctaccttctttaactacaacagcgccaacgggtggattaacacctgtttgaccttgtaccatatttgcaagttgaatcgcataatccataaattgactcaaatgatcacctctataaacaaaaatcctcacatcatgaattaagatgcaaggagaaaaatttatcgttaaataagcctatttgtacacatttttacaaatacgctacattatctttgtcgataattaacattctttctcccatccagactttaactgtcggctctagaatctcactagatcagccactaatatgaaacatattagcaggtcgcaggctttatttactgccggttgggaatttcaccctgccccgaaagaattatatatgaaattgttatagattatttgagtacgtagtatgtcaactacatttaaaatgatactatatgttttctgaaaaaacaattaatgacggttttaatttaatataatctgagtactataggcatctcattgatatgattcttactaacagacattaaaatcaaaccttcaattcgtctctatagagcgttctctttattatcttctagttacaaattattgattgtcactgcgctgttgttgctcattcgattctaaagcatcatataattgagatactgtatgcgcaacttgttctacaatcattttcacaccgtttcgtagtttattaacaccgtttgtcatttgacctatcgcaatcatatttgttaatgttccaaaccttggactaataacttgattggtttccggaatgatttgtatgcctcccattgggtgtgcttgtacaatttgtctattttcaagatttctaattaattgatcatcttgatccaattcatttaaatgactttttgcacctgtcgcgttaatgacaacattatatatgtctactgattcttggtttttgtatgaaaaataatacaacttgccatacatgttcacatcttctaaatcttttttcaaaattaaagacttattttctattaattcaataattagttcagcagttcttggaggcattggatttgaatttaattgaatcatctttgagtatttttgattaaattgatgttggtcttcaatacttaagctattccatatccaatttaaattctctttcaaatgttcaatcatactttggaaaatgcccatttctgttggacgcgctaaatcatacttcaaatctgcaatatgatttcctgtacgtctatgtactaattttttaaaatcaatgtcatattcagcacattcttttaaaaataaagaaactaaagtatcaagcggtgcattgccgaaatgatgttttttaatgtcatttaatttgtctttagttaagtacttgaatgtcacgtctatcattgtacctcttacacttggtaaatgagcagaacgactcgtcatagtaattggtaattttggatgatgagcagcaacataacggacaacatctaaactggcaaggcctgtaccaataatcgcaatatcgtccagttcatttacttcgtctaacgtattatatgttggataaggcgtagcgatatatccttttttaccctttaagttatatggatcatggtaggcaaatgtaccacatgttaaaaatacataatcgtacgcttgccatgattgtcctgaatttgtagtacatatgtaataagttaaattcgtttcatcgatattagaatttgtataaatctcttgaactttattataattagttgatatatttggatattttttcgtgaacatagataaataagatttcatataatgtccgaatacaaatctcggtaaatatgcag

SEQ ID NO: 143 - DNA, 10320 bp; double-stranded, linear
nctaggtattttaaacctaatctagataaactagcttcgtaagcagctgctacattttcacgaccgaaatcctcaaaatataattttgaagtaataaataagtcttctctagcaataccagttgactccaatccggcacgaatgccagcacctacttgttcttcattcccataaacttttgcggtatcaatactacgatatccttgttcaatggcatacttaacactttccatgcaattttcatcattttccacacgaaatgtccctaaaccaatttgtggcatcgtgtttccattataaaatgttttaacctccataaatatcgcctcacctttttgatgtattataccctgttatcataacaaatctgagttgaatacatgagaaaaaacacttagagcaatcaaccactaaaattctagtaatatctctcaaatattaatcaaattgtaaaagtaattctgtttaatttatgacaaactaaaaaagccgaagtaacaacatatagtcatcacttcagcctaacatttaattgaatgattcaattttatccatcatttgttgtaagtcttccacgttgtattgaatacgaccatggaatacaaatttgttaaagaactcgtctaattgttcagcaccgacaagcactttgacagcactattttgattataatttgaaatcgttacatcgccttcatttttaagattaaagtataaaattgaagttggtgtatatttggcacctaattctttttgtaagtcttcagccaattgtttaatcgcctcaatttgatctgaataatttacaaatgataatgaacgtttgtcatcattttgatccatcacaatagtttgcggtctagatttatctaaatccaatgtatcaaatacttgttccattggtggtaaatctttaaattgaccgccactaataccattataaacatgaccttttaacaattgagaatcaataatataaagaccagttcttgttaatactaaatgactaattcgttcaatattattaaagccatcctttggtaaaaagatatttgccataatgtgcatatcttctggtcgaattcgtttttctttaactaatctttcacgaataccaattaatctcatgtccgttacatattcactatgatttttcgagaacaattttaatgcgtcaatctcacgatcttttgtactaaccatgtgattataatcttcttgttgttttgtaattgtctttttattttgaatacgctctttctctaaagcttcttcatgagactttttaatgttttgttcttgttgttcatacttttcttctgtttgtcgcttaacttttttcttactacctaaggcaactaaaaaaaggacaaaaaagattaatgcaatgagctactgcaataatgagtccaatgactatcggtgaagataaatccatcacaacaacgctcctttttaatatatgaataactttaattataatagaaaagctaaagattttcgatacatattatcatttatataccgaaaatcttttatttagctatattcaattcatcttattattttactgcgtcttttaattcttccactttgtctaatttttcccatgggaataagacatctgtacgtccaaaatgaccataagcagcagtttgtttgtaaatcggttgtttcaaatcaagcattttaataatacctgcaggtcttaggtcaaagtgttttctaactgcttcgacaagttgcccttcagaaactttacctgttccaaatgtatcaattgcaattgacactggttctgcaacaccaatcgcatatgccaattgtacttcacattgatctgctaaacctgctgcaacaatatttttagccacataacgtgcagcgtatgcagctgaacggtctacttttgtaggatccttaccactgaagcatccgccaccatgacgtgcatagccaccgtacgtatcaacaatgattttacgtcctgttaatcctgcatcaccttgaggtccaccgattacaaagcgtcctgtaggattgatgtagaatttagtttgttcattaatcaagttttctggaacagttggataaatgacatgtgctttaatgtcttcttgaatttgttcaagtgtcacatcctcagcatgttgtgttgatacgacaatcgtatcaatacgtactgggttatcattttcatcatattcaacagtgacctgaactttaccgtctggtcgtaaataatttaacgtaccatctttacgcacatctgataaacgttttgccaattgatgtgataaataaattgctagaggcatatacgtctctgtttcattcgttgcgtaaccaaacattaaaccttggtcacctgcacctgttgcttcaatttcttcttcgctatctttatcacgatactctaatgctttatccacgccttgtgcaatgtcaggtgattgttcatcaatcgcagttaaaattgccattgtttcataatcataaccatattttgctcttgtgtatccaatttctttaattgtttctctaacaactttcggaatatcaacatatgttgttgtagaaatttcgccggcgatcaatgccatacctgttgtaacagttgtttcacaagctacacgtgcatttggatcgtcttttaaaatagcatctaatattgcatctgacacttggtcagcgattttatctgggtgtccttctgtaacagactctgaagtaaataatcgtttgttatttaacatagtttgctcctttaaatttatattacgaaaattctctctctgtgagctaaataaaaaagaccttctaactattaatatagagagaaggcctaatacgtccattcgctcttatcgttcagacctatttgtctgcaaacggtttggcacctttcttttataaaaaagaggttgctgggtttcattgggtccatgtccctccaccactcaggataagagaatccgttaaaaataatagtacctaattaatgaattaatgtcaatttttcacaaataaatttacagtaaaatattgtagattaattatgttaatgtgttatactaattaaatgtaaaggcttacatttaaattatcgctttggagggatttaggatgtcagtagacacatacactgaaacaactaaaattgacaaattactgaaaaaaccaacgtcacattttcaactttcgacgacacaactttataataaaatcttagacaataacgaaggggtattaacagaacttggtgctgttaatgcaagtactggaaaatatactggtcgttcgcctaaagacaaattttttgtctctgaaccttcatatagagataacattgattggggagaaattaatcaacctatcgatgaagaaactttcttgaagttataccataaagtactagactatttagataaaaaagatgaactatacgtatttaaaggctacgctggtagcgataaagatacaatgttaaaacttacagtcatcaatgaattagcatggcataatttatttgctaaaaatatgtttattagacctgaatcaaaagaagaagctacaaagattaaacctaacttcactatcgtttctgcaccacattttaaagcagatccagaagttgatggtactaaatctgaaacctttgtcattatttcatttaaacacaaagtcattttaatcggcggtactgaatacgctggtgaaatgaaaaaaggtatcttctctgtaatgaattatctcttaccgatgcaagatattatgagcatgcattgctcagcaaacgttggtgaaaaaggcgatgttgcattattctttggtctatctggcactggtaaaacaaccttatcggctgacccacaccgtaaactaatcggtgatgatgaacacggctggaataaaaacggggtctttaatatcgaaggtggctgctatgcaaaagcaattaatctttccaaagaaaaagaaccacagatttttgacgcaatcaaatatggtgcaattttagagaacactgtagttgcagaagatggttcagtggactttgaagacaatcgttatacagaaaacacgcgtgccgcttatccaattaatcacattgacaatattgtagtaccatctaaagcagcacatccaaatacaattattttcttaactgcggatgcatttggtgttattccaccgatttcaaagttaaataaagaccaagcaatgtatcatttcttgagtggtttcacttctaaattagctggtacaagcgtggtgtgacagaacctgaaccatcattctcaacatgtttcggagcaccgttcttcccgttacaccctactgtttacgctgatctattaggtgaacttatcgatttacatgatgttgatgtttatcttgttaatactggatggactggcggaaaatatggtgtaggacgtagaatcagcttacattacacacgtcaaatggtaaaccaagcgatttctggcaaattgaaaaatgcagaatatacaaaagatagtacgtttggtttaagcattcctgtagaaattgaagatgtaccgaaaacaattttaaatccaattaatgcttggagcgacaaagagaaatataaagcacaagcagaagatttaattcaacgttttgaaaagaacttcgaaaaatttggtgaaaaagttgaacatattgctgaaaaaggtagcttcaacaaataaatttgaatactaaatcaaaaccacccgtgtgaacgggtggtttgttctgcggctataagccttccttactggccagccctaaaagggcactgacaagtcagccaactgcactactattccagcaaccctaaagggttactcttttttctttctttttttatttttctctccagtgaaaggatctaaatattcttccattgagatttggtctgcaacgatatcctcttgtaattgattacgaatataattttcaatcacttttttatttctacctactgtatccacataaaatcctttacaccaaaactttctatttccatatctatactttaagttagcatgtctatcaaatatcattaaactactttttccttttaaatagccaacaaatgatgataccccaagtttgggtggtatactaactaacatatggatatgatctttacatgcctctgcttcaattatctctacaccttttctttcacataattgacgcaatataatccctatatctttttttatttttccatatatcacttgtcttctgtatttaggtgcaaagacaatatgatacttacaattccattttgtatgtgctaaactgtttgtgtcagatgacattaaatagcatctcctcgtgttgattattttggttggctgaccaatatttattctagcacgtagagatgcattttttgtgacaatggtagaaccttttctgaaccatacgcatagcgtatggttttctttttacaattaaagagccaaccgttgttatagtctaacaatggttggctcctcttattttatgtgctaaaaatttataggcaattttattacaacaatgtacatttaaggtgaccttcatgccaaaatcgcatcactcatttaatggaagcagcacgtcttcatataaagtaccgatccctaattcaacgcatgtagtaccacatcttcaaagcttgatagttcccatgcgcacaccacgtttcatactagctatgcgactcaacttggttcataaactctttaatataagtcaatgtttcaaccatcgctggtggtcttggcacatgtccttctgccatttgataaaatgtttcatgcgtggcaccttttaactctagttggtccgctaaataatacgcatgatgaataccaacttgctggtctttccctccatgtacaattaatattggcggactgttttcattaatgtttggaatcgcttggcgtgcctcatatgccgctcgatcttttttcggatgaccaatcattcttcgtagcatgcctcttaaatcgacacgttcttcatacattaaatcaatatctgagacaccaccccagattgtataacttgttactggtaagtcttgaaatgtcaacaatccttgtaaaccacctcgcgaaaaaccaaccatgtggataaatgcatgtggatatttatcatgtagcaaccttaataattgcgtcacatcatttaaatcgccacggtaaaattcgtctttgccttcactcccattgttacctcggtagtatggcccaatcactaaagtttgactatctgaaaattgcattaatctacctgcgcgcacacgtcctacttgacctttgccacctcgcaaataaactacaatgcgatttacttcatgatgtggtgtcatcattaaagcttttacttgtaagtcatctgacaaatatgtaatttcttcgaattgatgcgtaaaatattcaattggcattcgtttacgtttgataaaacccaagtgattgcaccctctctacgcattttaaaatggtactatcttgcagtaagaaactccgttgtgcgagttcaatatcattgatacagttaaacaacactggccctgctgtttctaaataatcgttcttgcttaccaatgattcaacttcgataaaatatacatcttttacaaaatcagtttgatcatgtgtttcaatggtatattgtgctatgtaataaatatttttaactttggcgcctgtttcttcatataattcacgtgtaactgcttcagcactactttccccgcgttcccttttaccaccaggaaattcaatcccccgtaaattatgtttggtaaaaagcaattgatttttaaacgttggaatagctagcacatgattgccatctgctatctcattatcctttttaaatgtcaaattaacttgacgattatctttatccctaaacttcacgcgcatcacatccctacattgtatgttaatataatagttaattactatcgttggaggcattaattatgaaaaagatattcttggcgatgattcatttttatcaacgtttcatttcgccactcactccaccaacttgtcgtttttatccaacatgttcagagtacactagagaagcgattcaataccacggtgctttcaaaggcctttatttaggtatccgtcgtattttaaaatgtcatccgcttcataaaggcggctttgaccctgttccgttaaaaaaagacaagtcagcaagcaagcattcacataaacataaccattaatatggttgtaattgagttatatccactaaaggggggcgaaattcgagtcgcccctcttttaatatgcctgaatgcgccaccacatcttgttcaaaataataacctgctggtgtaacatctcctggataatcacctttacgagcaagcatcgctgtaaaatagcggcttaaaccatattcgtacatgccgccaataaccacttttgcaccatgacttttcaaagtatcaattgccgtttgcactttatcaatgccacctagacgaaatggttttaatacaacaactttcacattgtataattctatcaaattaattatgtccaacaacgatgttgccttttcatcaagggctattggaggtattgttccatccgctacttcatcaagcatggagatatctttaaatggctcttcgatataaagaacctgttcacgcgctaataactgtaactgtgtgaaatcttgacgatccaaggactcatttgcatctataaccaattgaaagtgaaagtctaattcccgtaacactctaatttgatgcatgatttgaggcgtccattttaatttaattctggtcggctttgttgcttttaatgactctagttgtttatttgataagccgctcgctgtcgctccatatgctactgaaaatgaaggcagtacatgaaacatttgatacaatgccatgacaatagttgcccttgcagcaggcgtattttccaatgaatctactaattttagtgctgcttcatacgtttcaaatgatttatttctattatcttcgaaccattgctcaattacatgtttcactgaggcaattgtttcatgatcataccaatctgtttgaaaagcgttacattccccgaaatatgcatttcctttgtcatcaatcaattcgataaacaaacaatcacgatgcgttaaagtgactttcggtgttacaatttgtgacttaaatggctcactatatttataaaaatgcaaagctgtcaacttcatcaaatcatcctctatacaacttatttctttgtaatttacctgttgatgtataaggtaaagtatcaaccttttcaaagtgtttcggtactttatatttcgctaaatgttgtgataaatatgcaatcaattgtgcctttgaaatgtcactttcactgacaaaatataatttaggcacttggccccaagtatcatcaggatgccctacacatactgcgtcactgatacctggaaattgcttcgctaccgtttcaatttgatatggataaatattttcaccgccactaataattaaatctttacgtcggtcataaatcatgacataaccttcatgatctatttcagcaatgtcacccgtattaaaataaccattttcaaacgtacccgttaaatctgttggatacaaatatacattcatcacattggcgcctttaatcattaattctccatgaccttctttattaggatttttaatttttacgtcaacattggcacttggcatccctacagtgtcaggacgtgcatgcaacatttccggtgttgctgttaaaaattgcgaacatgtctcagtcataccaaatgaattataaattggcaggttatattgtaatgccgtctctatcatagtggcagataatttagcaccgccgagtaatattttttgtaaattataaggttcatgtaaaccttgttgcataagccaatttaaagtttgtggcacaagcgaaatgtgcgtgattcgttcatttttaatcatcgttaaaatttgttcggcattgaatttatcaacaatgcgcacagtaaaaccttcaataacagctcttaaaagtacactgagacccgaaatatgataaatcggcaagacagatagccaattagtgtcacgatcaaatcccaagctctctttacatccgattgcactggcataatgattacgaaacgtttgtggcaccgctttttgagggcccgttgtccctgatgtaaacataatcgatgcaatgtcatctaaattaaatgatgtatttaatatgttggacggcgactctttcggcaccacagtttcattcgatgtttcatattggatacccattgtgttgtccaacaaactgttcgttgtaatatcccttccagcgaattcaatatcatccagcgatacaatttgaaaccctcgtaattccagtggcaaggtacaaaaaatcaattgtacatcgattgacttcatctgattcgtcatctcattaggtgtcaaccttgtattaatcatcgcaatttcaatatttgccaaccaacatgcatgtattaaaatgatcgattgaatcgaattatctatgtatagcccaacacgagattgttgataagccttgagtcttttagccaatagactcgcttcacagtataaattttgataagtataagattcttgaccgtctgttatcgcaatatgatgtccattttgttgtgcttgtttatataaccaaaagtccatgcgttattcctccaaaatcatttacattataattataacgattttatgacattctagcagtggttatgtttaaaaatataaaaaagtagacgaattgatgcattgatatgattgttataatgctcaatacatatcgttatatcattcgtctactattatcagttatttttatttaattttagtgtcattctgtcattttgatgtggtgatttacccattgttgccacatcatctgcaatgtcaattggtatacggttcatgtcttgtaatgcacttaaatggaatacttcatcatctaaattttcaatgagatatacataatatgttaccttgtcctttttatattttaacgttttccaaaagtccggcttgcaattcaatacattatccggaatatattcaataaataagtaacgtttgctgcctactttgtctatgaaatattttgcagtgcctttttctatacctcttatatgtgcatagtctgctgaaaagtaaatactacctattgtttcattatgttgttgtatttcaaatcgttggcctactattttattatttgtgctacnggggactta

SEQ ID NO: 144 - DNA, 1477 bp; double-stranded, linear
tcccccctaattttagcataatccatctcccggctaaacgagaancagcctgtnannggcgtgtggattggattttaaaatcaccctcataaatactgtcatcaatatgataagttacaatttcacctattattaaatcagccccatctaatacatctccaagcaatatcatttgcgmtagtttacattcgaatctcattttcgcatctttaattcctggcgtcttaatcgttgtagatgttaaaagtgataattctgtacgactcaactcactgtcaccatatgctaacggcgctgcagtctcattaatatcttgaacattatcttcgtctgtaatatgcacaacaaagtctccagtccgttctatatttaatgcagtatcttttctcttacctcctgcacgttgaactgcaatagcaatcattggcggatgattattaacaatattaaaaaagctaaatggtgctgcatttactgatgcatcttgatttaatgttgtaacaaaagctataggtcgtggaataattgaaccaattaataatttatagttttctctagcagttaatgattgtgcatcaaacgtatacataatacctacctcttttctaagtatatctaggtatttctccgattttggttaatttaaacatctattctcctctgaaaatcacttgtatttatttagcaaatcttttgaaatatgacacatatgcatatcttctggatatttttctaaatgttgctgatgttcttcagcacttttaatgtagttagacagcggtaagacttccactgcaatttgatctctgtctttacgtcgttcaatgaactgacgcgcttcaattaagtggtcatctacacaactatataaacccgttcgatacttttgtccaatatcatttccttgttgattcacactgtaaggatcaatgatttcaaataaataattcataatgtctgtaattgttaacatacgatcatcgaaatgaagtttgacacattcagcataaccatcatacggaccgtctaatttagagcttcttccatttgctcttcctgcttctgtatgtataattccaggtattgttgcaaaaaatgcttcaacaccccataaacatcctcctgctacataaacaactgccatatttacacctcatcatccttttttatatttttaacaaggttataccatttaataccgccatgacatgattctgatacaccttcattacgatacccatatttttcataaaatgaaattaatgattctcgacatgttaacgttacaccatgtcgatgatgattcttagcaagagtttcaaaatagtttagtaagcgacctgcaataccctgaccttgataatttggtgctacaacaagacctaacacactaatatagccaccttcactattatttgtggagacatttttaaataaatcatcgctaatgtaacgctcttttatgactggaccgttg

SEQ ID NO: 145 - DNA, 3976 bp; double-stranded, linear
aggtgattatcctaaaaatgctcatgaggtcgctattaatgataagttagctgcagacaacattagagtcggggatagattacattttaaaaataattcaactagttatagagtttctggtattttaaacgacacaatgtatgcgcatagttccattgtgctattgaacgataacggatttaatgcattgaataaggttaatacggcattttatccagtgaaaaatttaacacaacaacaacgtgatgagcttaataaaataaatgacgttcaagttgtgagtgaaaaagatttaacaggtaatattgcgagttatcaagcagagcaagcaccgttaaatatgatgattgttagtttgtttgctattacagcaatcgttctaagtgcatttttctatgttatgacgattcaaaaaatatcacaaattggcattttgaaagcaattggtattaagacaagacatttattgagtgcgttagttttacaaattttaacactaacaataattggggtaggtattgctgtgatcatcatagtaggactatcatttatgatgccggtaacgatgcctttttacttaacaacgcaaaatattttattaatggtggggatatttatattagtagcgattttaggtgcctcactatcatttatcaaattatttaaagtggatcctatcgaagcaattggaggtgcagaataatggcattagtcgttgaagatatcgtcaaaaatttcggagaaggtttgtctgaaacaaaagttttaaaaggtattaattttgaagtggaacaaggggaatttgtcattttaaatggtgcctctggttctgggaaaacaacattgctaacgatattaggcggattgttaagtcaaacgagtggtacagtgctttacaatgatgcgccattgtttgataaacagcatcgtcctagtgatttacgattggaagatattggttttatttttcaatcttcacatttagttccttatttaaaagtgatagagcaattgacactcgtaggtcaagaagcgggaatgaccaaacaacaaagttcaacaagagcaatacaacttttgaaaaatattggtttagaagatcgcttgaatgtatatccgcatcagttatctggcggtgaaaagcaacgtgttgcgattatgagagcatttatgaataatccgaaaatcattttagcagatgagcccacagcaagtttagatgccgatagagcaacaaaagttgttgagatgatacgtcaacaaattaaagaacaacaaatgattggtattatgattacacacgatcgaagattatttgaatatgcagatcgagtgattgaattagaagatggcaaaataactgattagtggcttgtaaagacgctaaatgttaatgatttaagacatagtagtataaaagttagataacagaatacgatttgggtttacaaaaaacaggctgggacattaagttcttaggcaatgtaaaaaagctgatttctattaattatttgatagaaatcagcttttttgatatgtattttataatgtacagctcgttgcattcatatagcttgaagtcacgtttaaaaccatatctatcattatggtatgcatatcttttaaaacctattcttttgttattaggacatataaattcatcattaagttcgtcatatttccaattttgagtgttaaaaatgtcacttttaaactttctagttttatctttaataaacatgacatacgtaataagtggcgttttattaaaatcatctataatagccatatagttttgctcactatcataacatgcatcagctacaatatactccggtaaataaccgaagntattttgaatcattgttaaaaatggaattaaagttctagtatctgttgggttttgaaataggtcataggataaaacaaattgagaatttgtcgctatttgtaaattgtatcctggcttaagttggccaaagtgtcttatttttttaaagtatttaaaagtaaaattacatgttaatacgtagtattaatggcgagactcctgagggagcagtgccagtcgaagacaggggccccaacacagaarctgacatatagtcagcttacaacaatgtgccggttggggtggctgagacggcaccctaggaagggacccgtcatcaaaaattctatttatagaattttacagtaatgtgccagatgggcatagcgaagccattcaatacgaagtattgtataaatagagaacagcagtaagatattttctaattgaaaattattttactgctgttttttttagggattaatgtcccagactctttagtttatttattttcaatataacaattgtctaatcaaggattaacgaatatttaaagatagtttgacgcaatattagaaacaacctataataatagtttgtttgtggattaactattataaataaaagcggcgtaaagacatataaaccaactacttgaacaatataacgttaataacaatctatactgatacattacgcctagataatctttgatgagcacatgtaagaaaaagtgatatggtgtatgacttccgacaccatcgatagataaacctaatttttgggctagtcgtaaggcgcgcaatacatgaaactgacttgttacacaaacaattttaactgcttcatgatacaaattgttgatgatttgtttagaatataaaaagtttgtgtatgtatttatagagtgagattccattagtatatctgttttatcaacaccatgtgcaatcaaataacgttgcatagctaaagcttcagaaattggttcgtctggtccttgtccgccagatacaatgatctttgttgctgatgcttgttgttgatagatatcaagtgcacgatctaaacgcgctgcaagcattggtgtgacaaattcggtaaaaataccagcacctaacacaattatgatatcaacttctttgttgtatgatctatgtctatatgatactgtccaaacgagataacaaataaaggttagtaacagggaaagacataatatagctaaccacatagacaaacctttcacaataggtgactgaatcgtacttataaatagaagtgctgatgtgtagagtacaaatttatatgaaaaagataataattttttaataaataagcgactagaagtatgagaaaataaatatctatgtttgaatagcatgataatactgattattataaatgttacaaacatagaccaagggaaagtataggtcatgatgctatagatgagtgacaaaaatatcgatatgacaactaagatgtagcatgttaaatttaacgtcagagtatagttgaaaattaacggacaaataacgataagtataaatattaataataaattcaataacatactgacacctcgcttataataaatattaaatataaatgtagatgatttaatttattaaagcaaggagaaagcagcaacatgtaaatcttaatttgttatattatatatgggtcaatatttttgtgttttttagatgtgcgatacaatgattgctgaggatactttataaaaatagtaattagggagaaataattatggtaaaacatttacaagaccatattcaatttttagagcagtttataaataacgttaacgcattaactgcaaaaatgttgaaagatttacaaaatgaatatgaaatttcattagagcagtctaacgtattaggtatgttaaataaagaacctttgacaattagtgaaatcacgcaaagacaaggtgtaaataaggccgcagtaagccgacgaattaaaaagttaatcgatgcttaattagttaagttagataaaccaaatttaaatattgatcaacgtttgaaattcataaccttaactgacaaaggtagagcatatttgaaagaacgtaatgcgattatgacagatattgcgcaagatattactaatgattta

SEQ ID NO: 146 - DNA, 3346 bp; double-stranded, linear
gctacctaggcatttaagagatcaaaaaatgtatgaatatgaacgttatttttatgagcaagaacttaatggcgttgatgaaggggaaattttaaagaagttaaaagacccacaagatgttgcagctgaaacaaaagctagaagtgttattgattatgctgaatctaaaccaacatttgaaaatatttcaagagctgttgctgcttcattaagtttaggcattctatctatttttgtcatccttataccagtatctatagttggattatttgtattagcattatttttaatatcacttttgctgctgttttgtccaattattttattagcatcagcaatatccagaggaattgtggactcaattagtaatgtattttttgccatatcatattcaggattaggattagtatttatcattgtcatatttaagattttagaatacatttatcgtttaatcttaaaatatttactttggtatattaaaactgtcaaaggaagcgttagaaaatgaagaaattcttttttattgggcttttagtgtttgttgtcttttttacagcagcaaccattatttggttcagctatgataaaaacaaatatggtactaaacaatatgataaaacattcaaagacgatgcttttgacaatgtatctataaatttggatagtacagaacttcgtataaaacgggggaatcaatttagagttaaatatgatggtgacaatgatatattaattaatatagtagataagacgttgaagattagtgataaaaggtctaagacaagaggatatgcaattgatatgaatccttttcatgagaataagaaaacgttaacgattgaaatgcctgataaaatgattaaacgtttaaatctatcatctggagcaggaagtgttagaatcagtgatgttgatttagagaacacaagtattcaaagcattaacggtgaagtagttattaaaaactcaaatcttgacgcactagattcaaagacaaataatagttctacttatattagtaaaagtaacattaaaaatagcaatattaaagttgttattggtacgctacaaatcgacaagagtcaaattaaacaatccatatttttaaacgatcatggtgacattgaatttaaaaacatgccatcaaaagtagatgcaaaagcttctactaaacaaggagatattcgttttaagtatgatagtaaacctgaagacactatactaaagctaaatccgggaacgggtgatagcgtagttaaaaataaaacatttactaatggtaaagttgggaaaagcgacaatgttttagaattttatacgattgatggtaatatcaaagttgaataaataaaggatgtaagcaccgatattaggaagcataatttctctaatatcggtgttatttatttgttggcaaaagttaagtcggtatctatattgccagtaaagtgagtgatattaaggtcttgaccatctaaccatgatttgaaatctattatttctggtggcgcattttctcccaatgtaaaatatgcagttaatgtttcaggttgatacattgatgtatggatggtgccagaccagcttttgaatagtttactgtaaatttcatactgaggattattgaataacttaaatgctgtagtcatatctaaattatcattagtttgtgaaatggtacgcgccagtctttctttagattcttttgtataattacgattttcatgtgttaatatttcaaaatgatttgtacatatattatcataacgaacatctattgatctcggtgtcacttcaacaattgcatggttcaatgatttgtccatcagtatgtagctaaatgagcttctgtgtggtatttctttcaataattggattgcttctgttacatttcggcaattttcaagaattagacgaccaatcatataacatacaaaaccatttgctggtttcttccggtgcataaagttatagcccatagttaatcctgactcattcataccatccattcttccagttacccttgatacaggaccaatttgagctaaaccgctatctgtaggttgataaagtaagtagcgaccatcataagttgcagggtggtaatcataatttctaaccatgaagtctttgccttgaaagaccgtgcaaccactttcttttaaatcggtaaaacgataatgtccaaagtttaaaataatttggcgtgttggcattttgagtatactttgtagtcccattaattcttcccatatttgaggtgcgtatgtttggaatatttgataagtttcatttacatctatatcgaaacgtgggacacnttttttccattctttttctcgattttttagaagaggtgtttgttgaagccatttaccagttttaacacctaactcgaaatgtgaacctctaaaagtcatgatatctgatgtcacttgttgcatatcatcggcccctttctttttagttgtaatatattgtaaataaatagtaatcgtatgtatattgaatgtcatgttaaataaagttatattttactaaatgaaatataaaattgtttgaggtgatttctcggtgtataagacttatcaatcagttaaaacatatttttatagatggtggggatattgagttaaaaacttaaaatcatcttatcataaatatcaatcttaagttagcattcacgataatagtcattgttaacattagcatataaggtcatgtcacgttgaaacagaggttcctcggcatttttgaaaataatcattagcttgctcactatataatttgatgaatatatttcgtgaaagtgggtatttatttaatgattattctatatatgatagtataatgaaatgtagataggtatttaatttaacagaggtgaaattgagatgtggaattttattaaatgtgtgkttaaattcgtatttagcttagttgctattacaacattagttgctggtgttggtgtagtagcatttgcttatatctttaaaaaagattttgaagatattgaaagaaaaactaaagaaattatttctgatattgaaagtaaaaataactaataacatttagaggctgggacataaatccctaaaaaacagcagtaagataattttcaattagaaaatatcttactgctgttctctatttnatcamtacttcgtattgaatggcttcgctttcctagggtgccgtctcagccttggtcttcgactggcactgctccctcaggagtctcgccattaatactacgtattaacatgtaattttactttggaaatacttttaaaaaataagacactttggcccaacttggcacataaatgtaaaattcaat

SEQ ID NO: 147 - DNA, 2375 bp; double-stranded, linear
gttgaagaaagaaatataacagtcaattataattataaccttgttgaaatcgacggtgacaaaaaagtggctacattcgaacatatcaaagcatacgatagaaaaacaataagttatgatatgttacatgtaacaccacctatgggtcccttagatgtagtaaaagaaagtacactttcagatagtgagggttgggtagatgttaacccaaccacattacagcataaaagctactctaatgtatttgcacttggtgatgcttcaaatgtacctacttcaaaaacaggcgcactattcgtaagcaagcacctatcgtcgctaataatttattgcaagtgatgaataatcaaatgttaacgcatcattatgatggttatacttcatgccctattgttactggatataataggttaatacttgcagagtttgattataataaaaatactaaagaaacaatgccgtttaatcaggccaaagaacgtagaagtatgtatatatttaagaaagatttattacctaaaatgtattggtacggcatgctaaaaggattaatataataaagtacagaaaacaataaatttttaatgaaaaatcttttactataaaagattaagtatttaaatgacgtgtcagtgttgtgtttatatgtcgtgaatttttagctctaaatagtataagattgaaaaagttgttactgttttaaatgatcacgatgaagtcattcaataagaatgattatgaaaatagaaacagcagtaagatattttctaattgaaaatcatctcactgctgttttttaaaggtttatacctcatcctctaaattatttaaaaataattaatggtatttgagcacgtttagcgactttatgactgacattaccaatttccatttcttgccagatattcaaaccacgtgtactcaaaatgatagcttggtatgtacctccaatagtaatttcaataactttgtctgttgaacactaagagcaattttaatttcataatgtgttgtaaacattttttttgattggagtttttttctgagttaaacgatatcctgatgtatttttaattttgcaccatttccaaaaggataagtgacataagtaaaaaggcatcatcgggagttatcctatcaggaaaaccaagataatacctaagtagaaagtgttcaatccgtgttaaattgggaaatatcatccataaactttattactcatactataattcaattttaacgtcttcgtccatttgggcttcaaattcatcgagtagtgctcgtgcttctgcaattgattgtgtgttcatcaattgatgtcgaagttcgctagcgcctcttatgccacgcacatagattttaaagaatctacgcaarctcttgaattgtcgtatttcatctttytcatatttgttaaacaatgataratgcaatctcaayaratctaatagttcyttgcttgtgtgttcgcgtggttctttttcaaaagtgaatggattgtggaaaatgcctctaccaatcatgatgccatcaataccatatttttctgcaagttcaagtcctgtttttctatcgggaatatcatcgttaattgttaacaatgtgtttggtgcaatttcgtcacgtaaatttttaatagcttcgattaattcccaatgtgcatctactttactcatgcgtttgataaaaacttaaataatattaattcggtcatcagtggcgttaaatcttttatcatttttagttatagttgataaatttatatttataagcatatatggatatttcatcaaaaatttttatttatataaatccgaactgcatacatatttgtttaaataagaggtattatttttcgggaaattgctgtctgagttaaaaggattagttttataaaatgagttgaactatagccaaaaacgattaaaatactgataatccatttttgtattatgttagggacttttttacttaattttaaccctattggagcmaatataatactccctattataaggaataaggcgtcatataaagggatataaccttgaataagtttgatgacaaaagcaccaattgaagatataaaagcaattactatactattagcgactacagtattcattggtaatttgaataaaaccaataatataggaataataatgaaggcaccacctgcacctactatacctgaaataataccaatgaaaaggccaatgataactaataaatatttattaaatgaagacttttcggaactaggtttcactttaataaacattaatgttaatgcaagtaaagcaataatgatatataccgtatttacaaatgtagcatcaaataaatttgctagaaatgcacctaacatactccct

SEQ ID NO: 148 - DNA, 6115 bp; double-stranded, linear
gaggtttctagacaagcttttaataacttaccaaactcattaagrtggttgtgttggactgcctattatcmaagtattatgagttgtttaatattagtgctaaracatacgaagagtggtttaaacaatttagtagtaagaaagcacaattcagtattaatctcacggataaatggataattcaaatcgcatatggtaaattaataataatggctaaaaataatggcgatacatattttagagttcaaacaattaaaaagccaggtaattatatttttaacaaatatcgattagagatacattctaatttaccaaaatgtttatttccgcttacagtgagaacacgacaaagtggcgatacatttaaactgaatgggcgcgatggttataagaaagtgaatcgcctgtttatagattgtaaagtgccacagtgggttcgggatcaaatgccaatcgtattggataaacaacagcgcattattgcggtaggagatttatatcaacaacaaacaataaaaaaatggattataattagtaaaaatggagatgaatagcgttatgcataatgatttgaaagaagtattgttaactgaagaagatattcaaaatatctgtaaggaattgggagcacaattaacaaaggattatcaaggtaaaccattagtatgcgtgggtatcttaaaaggctcagcaatgtttatgtcagatttaattaaacgaattgatacccatttatcaattgatttcatggatgtttctagttatcacggaggcactgagtcaactggtgaagttcaaatcattaaagatttaggttcttctattgaaaataaagacgtattaattattgaagatatcttagagactggtactacacttaagtcaattactgaattattacaatctagaaaagttaattcattagaaatagttactttattagataaaccaaaccgtcgtaaagcggacattgaagctaagtatgtaggtaaaaaaataccagatgaatttgttgttggttacggtttagattatcgtgaattataccgaaacttaccatatatcggtacgttaaaacctgaagtgtattcaaattaattttttaatcaatttcagttattattactatgcgtttgagaaataatagtgtagactcaaaaatatgaaaaatgtatttcatatatatttaattttagacaagacatatgtcttgaaaagttgaaaaatatagagattgataaaactaatacgggtgtgaatgacattgatgttaagctcaattactagcttataaaacatgtcatatgttacaatttttgttagttttattatgggaagtaggaggaaatgacgcatgcagaaagcttttcgcaatgtgctagttatcgtaataataggcgttattatttttggtctattttcatatttaaacggtaatggaaatatgccgaaacagcttacatataatcaatttactgagaagttggaaaaaggtgaccttaaaactttagaaatccaaccacaacaaaatgtctatatggtaagtggtaaaacgaaaaatgatgaagactattcatcaactattttatataacaacgaaaaagaattacaaaaaattactgatgctgctaaaaagcaaaacggtgtaaaattaacgattaaagaagaagaaaaacaaagtgtctttgtgagtatactttcaacattaattccagttgtagtcatagcgttattatttattttcttcctaagccaagcacaaggtggcggtagtggcggtcgtatgatgaactttggtaaatctaaagcaaaaatgtacgataataataaacgtcgtgttcgtttctctgatgtagcaggggcagatgaagaaaaacaagaattaattgaaattgttgatttcttgaaagataataaaaaattcaaagaaatgggatctaggattcctaaaggtgtcttacttgttggacctccaggtactggtaaaacattacttgctagagcggttgcaggtgaagctggcgcaccattcttctctattagtggttcagactttgtagagatgtttgttggtgttggtgcgagccgtgttcgtgacttattcgataatgctaagaaaaacgcgccttgtatcatctttatcgatgagattgatgctgttggtcgtcaacgtggtgcaggtgttggtggcggtcatgatgaacgtgaacaaaccctaaaccaattattagttgaaatggatggtttcggtgaaaatgaaggtatcattatgatagctgctacaaaccgtcctgatatccttgacccagccttattacgtccaggtcgttttgatagacaaattcaagttggtcgtccagatgtgaaaggccgtgaagcaattcttcatgttcatgctaaaaacaaaccacttgatgaaacggttgatttaaaagcaatttcacaacgtacacctggtttctcaggtgctgatttagagaacttattaaatgaagcatctttaattgctgtacgtgaaggtaaaaagaaaattgacatgagagatatcgaagaggcaacggatagagttatagccggacctgctaagaaatctcgagttatttctaagaaagaacgtaatattgttgctcatcacgaagctggtcatacaattatcggtatggtacttgatgaggcagaagtagtgcataaagttactattgttccacgtggacaagcaggtggttatgcaatgatgctacctaaacaagatcgtttcttaatgactgaacaagagttattagataaaatctgtggtttacttggtggacgtgtatcagaagatattaactttaacgaagtatcaacaggtgcttcaaatgacttcgaacgtgcaacacaaatcgcacgctcaatggttacgcaatatggtatgagtaaaaaattaggaccattacagttcggtcatagcaatggtcaagtattcttaggtaaagatatgcaaggtgagcctaattattcaagccaaatcgcatatgaaattgataaagaagttcaacgaatcgttaaagaacaatacgaacgttgtaaacaaattttattagagcacaaagaacaattaattttaattgctgaaacattattaacagaagaaacattagttgctgaacaaattcaatcattattctacgaaggtaaattacctgaaattgattatgatgcagctaaagttgttaaagatgaagattctgaatttaatgatggtaaattcggtaaatcttatgaagagattcgtaaagagcaattagaagatggacaacgtgacgaaagtgaagatcgtaaagaagaaaaagatattgctgaggataaaaaagaagctgataaatctgatgaaaaagatgaaccagcacatcgacaagccccaaatatcgaaaaaccttacgatccaaatcacccagacaataaataatcgattatattcagtacctctttctatgataaagttatagaaagaggtacttttatcgtttttgaaaatacgtattagattttaagtcgttgaattgttatagcagaaaataattgtaaaacaagttacttcattatttagaatgatgggtgtagaataagtacaattgttgcattttatgaagtaaagtaattttttaaatatagagtaatagaggagattgaaataatgacacacgattatattgttaaagcattagcatttgatggagagattagggcttatgctgctttgacaactgaaactgttcaagaagcacaaacgagacattatacatggccgacagcatctgctgcaatgggaagaacaatgcacagcaacagctatgatgggcgcaatgttgaaaggtgatcaaaaattaactgtcactgtagatggccaaggacctattggacgaattattgccgatgcaaatgctaaaggcgaggtgcgtgcttatgtagaccatccacaaactcattttccattaaatgagcaaggtaaacttgatgtaagacgagcggtagggacaaatggatctattatggttgttaaagacgttggaatgaaagactatttctctggagcaagtccaattgtttcaggagaacttggtgaagattttacttattattatgctacaagtgaacaaacaccttcatcggtaggtcttggtgtattggtaaatcctgataatacgattaaagcagcaggaggatttatcattcaagttatgccaggtgccaaagatgaaacaatttcaaaattagaaaaagcaattagtgaaatgacaccagtttctaaattaattgaacaaggattaacgccagaaggattactaaacgaaatcttaggtgaagaccatgtgcaaattttagagaaaatgcctgttcaatttgaatgtaattgtagtcatgagaaatttttaaatgctattaaaggattgggcgaggctgagattcaaaatatgattaaagaagatcatggtgctgaagcagtatgtcatttctgtggaaataaatataaatatactgaagaagaattaaacgtgttgctagaaagtttagcgtaatttaatttaaatcaatacgctaaaatgtttatttttagcggtttagtgaaatgtagaactaaatagttgtataatccttagtgattttgtttgctttctagaatttatttgataaaataattctatatccgataaataaactaagatttcaacaactaactaaaaaggagtgttcttaatggcacaaaaaccagtagataatattactcaaattattggcggtacaccggtagtcaaattgagaaatgtagtagatgacaatgcagcagatgtttatgtaaaattggaatatcaaaatccaggtggttctgtaaaggatagaattgctttagcaatgattgaaaaagcagagcgagaaggcaaaattaaacctggcgatacaattgtagaaccaacaagtggtaatacaggtatcggtttagcatttgtatgtgctgctaaaggatataaagcagtatttactatgcccgaaacaatgagccaagagcgtcgtaatttattaaaagcatacggtgcggaattagttttaacgcctggatcagaagcgatgaaaggtgcaattaaaaaagctaaagaattgaaagaagaacatggttacttcgagccacaacaatttgaaaaccctgcgaaccctgaagttcatgagttaactacaggtcctgagttattacaacaatttgaagggaaaactatcgatgcgttcctagctggtgttggtactggtggtacgttatctggtgtaggtaaagttctgaaaaaagaatatcctaacatcgaaattgttgctatagagcctgaggcttctccagtattgagcggtggtgagccaggtccacataaattacaaggtttaggtgctggatttattccaggcactttgaatacagaaatctatgacagtattattaaagtaggaaatgatacagcgatggaaatgtctcgtcgagttgctaaagaggaaggtattttagcaggtatttcatcaggtgctgcgatttatgctgccattcaaaaagcaaaagaattaggaaaaggtaaaacagtagtaacagtattgccgagtaatggtgaacgctacttatcaacacctttatattcattcgatgactaattaatgtcatttaaaagagtgagttatctttttgagataacttgctctttttttctaccatgtatatttttaaaaatatgagcgttaaattaaacatttttctgataaaaatatccagtgaatgataagataataaacgtacatactaataactagtaaatagcaggagtaaattttattagagttaaacaatacataattaaagggtggttaacatgactaaaacaaaaattatgggcatattaaacgtcacacctgattcattctcagatggtggaaaatttaataatgttgaatcagctataaatagagtgaaagccatgatagatgaaggtgctgacattatagatgttggaggtgtttcaacgagacccggtcatgaaatggtttcattagaagatgagatgaacagagtattacctgttgttgaagctattgtcggttt

SEQ ID NO: 149 - DNA, 10401 bp; double-stranded, linear
tagatactgggntaaacatcaaaaatatytgcttattcacgtgtttacgctccctcaaacgcaacgttaattgcgtgtaatcatttagtgtgaattcagacgcttcttccatgactatgtctgatatgccttttatcgactttattttctctgggttatctaatcctttaaacaaaaaaactgcgccgtttggcaattcaactttgttatcagtcttattccaaaggcacatgtcccaaataccaaagtttatcaaacaatctttaacatcttcgaacaaactatctttaattgttgattgtacttttctaagccacagtatacgcctaggatatttccaatcttgcaatgctttgagtacaactttttgtataacgccgtgagacttaccgctcgaacctccaccgtaatgkacttcagtgaagttatcgtaattggttagtatttcgaatatgtttctattgaaaacattagacggtttgttaaagtttaatttaactttcgtcatcgtactcaccaatattaatctcaatattcttctgagtaatttcttttttatcgatatacgcaccatgtacttttagtatgtggtcaatagatctctgacgctcttcaaaagttggtgtgattgtgtaagtaacctctttttccacttcatcgtttaaatggtcatatttcttactgtaagcctcttgaggttctcctctagcaatagaagcagataacgctaaagcttctgtaatactcattaaacgctcttcttgtatctgttctaatcgttctttaatatattccgaaacattaacatttcttaacaatcgacttgctaaagactctgctgttttcttactataacctgctgtaattgctgcttttttaccattacatccattcattatatattcatctgcgaatctcttttgtttttcgttcatttcatttaccaccaactctcgcgctatacgctttttaaaattaaaaaaggattggctataatcagccaacccacatagatcctttattcctaattgcgataagggaaacgcagtacgatagtcaatatcctacactatcataatatctcatttaaggtatcaaaaactgccactttactgccaatttcagtcttcccctaactcttccgccaatctagatatgatttttcttttgattctatgagcagttctatcagaaatgtgtatgtcaacacaaactttcactaattcctttttattaaaataatactcttgaatgaattcgcgttctttcctgcttgatgtgttgattatacgttcaatagcgctcttaaactcaaggattttacctcttcgtatactacaaagataattagttactgccatttctgttttcgatgtattagacggtacaaactccccgcctatatttgtatctgttggaatccacggtgtcattatttcacttcttaaatcttcaagttgtttatgataattaggataatcacacaactcatcttctaactttcgaactgttgataattttaatccgtatttctttttagtcatgaataccctccgtacaaatatgtttaatcttcaaagtgtctcaatctacttcttaatatctctatctctcgctctttaacttttacatcaccttttaactgttccgcttgtaacatcacaccaaacaataagatgactagtaatataattgctatgattaaccacatcatctactccgacacctccgccctcatcaaatcagactgatcactcaactttgcgaagtcacttggcgcctctacatcatcattagccgtcatcataatatatacttgctcagttacatacttacctaactcatacatcgctagtaagaataatagtctcaaaatttctttaaccaccactaaacaccccatgttaatttatcgataatttgtatagcttgttttaatgcgtctcttttttctttgatatctctattatcgccatcttcatcagctgacattaactcactgtcatattcatataatagttctgatatttcattactagctactactaataagttttcatctacatcaatcgttaccgttttctttggcatctccatctctccttatcttaacttgtgcctcgtatttgcgctcagcttcttctttactctctgcctcaacaactgtaaacgtctgattatctctagcagtagtaaaatgttcatgtggttgtcctgttgaatctttgaatgttgtgactaagtattgcgtcacttcttatcactcctttgaatgattctaagtttttctacgaataaaagtattagtacaacactcaatgtagccaacatatttttttgctttgcaaaatctactataacgattaagactaataacattccaattctgcatgtaaataaatctaattctttgtacaaaaccatatatctgttaagtaaattgttaaatattactatgaatacaagtattggaactaatgtaatgatgtaactcacttccccaaaacctccttgactcgatctaagatgtctttacactccgctacttccgaagcctttttctccacgttctgaaacactttcgaattcctccacttgctttagttcaggtgtccatataggcacgataaccaattgagctagtttgtctccttcgttgatttgataagttccgtattgtcttatggcgtcactcaaatcgatttctcctttaatatcaaaaacacctggtgtgatataaccattcgatgcaatagcgtcattcttgatattaatccctaaattgccgtgatatcccgcgtctatcttgcctgtttcaatcactaaatgcgttttactacttacaccactacggctagttaatagtccgacatagccctctggtatgcttacagctacatctgttttaatcactgccttttcttgtggctcaagtacgacagtttcagctgagaatatgtcataacctgcatccgtcttatgatttcgttcgggcattctagcattttctgataatagccttacttgtaatgtgttagtcattttcctgctcctccctagctgtagcaaacgctattctcaatttcaatctttcaacaatatgaattagtgcggtattgaggaatatttcaaattcttcaatgttctcatctataaaatcaagtatttcttcctcttgttcactgtcaaactcgcttagtacatcccaaatatttatgtcgcttttgctcgtttctaatactcttttgattatttctgaattacttttattactcattttccttgttcctcctcatatttatagacaacttgacctgccataatccctactgcttcatcaagttcaataccttctttaactgaatgttgaatagcatttgtcattccctcaagtatttcatcaaacgcttgtgctctcttatacacgtcctcaatctcttttagtaatccctctgtgtcattaccgttatacgcactagcactgatcactgattgttcaatttgttcgcggttattcatcatttccatctcctctaaaataaagttagttgcttctgctcctcgtattccaaaccatgttgctttatatatgtttcgagctcttccgctgtatcaaatgtctttttcacgccttgccaacctggcacgatatgcccatgaaagtaataagtgccgttcactacatggatatgtgccactcgttcgttatcctgatacagatatctcttagatccgaaaaattggtttaagtattctttacatgcgctatcggttttaggcatttatgcttcctgccatttcttaaacatttggttataagtagtatcaaaccagtacggatcacgtgaatgtttttgaggcacattaaacaaatgtggcttcttcttacgtagttcagcctctttacgtcgttgcctagccatttcacgctctttgctctctcgctccatgattttggataacacaatttctttatactcagctaagcgcataccataaggtgcatgtaaggcttctaacaacgcccagccacctcgtactctttttgcaaccattcctggagttaaaccgttcttttttatcaattcattttcatgttcggtaaatttatatggtttaccgttaatctttacgatactcatttattccacctctatacatttactttttttaatccaatcctctaatttgtgcgtgttgtgatttctagtaaatagttcacttacattaacacctagagcatctgccaatttatctaatacatttaagttaaccatctcagcttttccgtttttatatccactaatagttgatcttgatacgccagtttcattgtgcaaatcttggacacttacgttatctctagccatgattacccttaaattagttgcgaatacttcgttcaacttcatttattccacctctatatatgcatgtcttattgttatgttgtcatactttagtaattcgtccggattgtcatctaagcgctttgccagcgtatctttttctttatccacatcatcgtaatgctgatattcaacttctgtaggtattcttatatcaatcgttgcgtttatatatgcttgttgttgcattagatcacttcatttctctttttcttttacgtctgactttcactaagtcctcatataccatccattcttgacctgtgtatttaggcgctttacatatccacgttaaattcacatctctatactgatatctgaatatcttcgctttgatgttggcaacttcagtcgccttacctttaacgtctataacttcaaccagtttcccttccttccacaaagagaaatcggctatatacgtaatcggtctttgtttcccgaatttaggttgtaattcaaatttcggttgtatttcgatacgatcatagttagtgccattcatattactttctaaatattggtaatattcgcactctactttgctatcaaatacaattcctttgtactcaactttcttagcattgtatttactcattgtgccacctctaaatatcaaatatcgttgcttgcaatcctagctcttgctcatatagaagcccgtgagcgcctttgaatcgttttaggtcactatcagtcataattttcttttcgtcgctgaaatgggctcctgtgagcgaataaacttcatttacgttgtctttatacttgatgaccttaatatcttccgtgccatcttctcggtataagtaatatttttctttcggcattttttaacactccttaatgtgtgttttcttccagttgatttcattcatgattttcttttcaactctgtcgtaatcatcgaaaggcgataactcgttattgtccaacaatctattgaccgcccaaccagtctcgatatatacatttgctacaatcgggtcgctttgctttgtctcttcatacatcgatttcaataagcttttgaattgcattatattcatgtgaaaaacctctgagtcttcttgtaatactcaaattcaattattccggtttcgccgtctttgtttttggctatgttacattcaacaatagatttgccagtgatactgtcatcttcgtcacggttataataatcatcacggtaaagtagcatcgctaaactcgcatctgcttctattccgcctgattctttcatgtccgatagcattggtcttttatcctgtctagactcgacaccacgattcagttgtgaaagtagtacgatgattgcgcctgtctcgttagcgattatctttaagtcacgtgatatcttttctactgctacacgtctatcaactttcgcatcagtatccatcagttgaagataatctataaaaataacttgttgcctgtctgaatgcctcattgttgcgctcgcacatcttgcggtgtgatattacttttatcagaaatatcgatgcctaatttcatgattttatccatcgcattcgttaactttgttaagtcatccggcgttaagttcctgatttcttttatctttgttaactcaataccagtaattgttgataacatacgtttcaataccgatgtgccggttgtttcgagactaaagaaagatgttttgtatccattttgtgctatgttcagcatcatgtttaatgcaaaacctgtcttacccactgagggacgcgctgcgatgacgattaattgtgatggttctaatccccctattttgtaatccattagcttgtaacccgtcttaatttgcttcttagggctatcgctgtataactcttcgacaaactcctcaacaaacttcttggttccatcttcttttttgttagtaattgtttttaaatccttgagttcatcaatcaagttgttaaagttttggttcgtaggttgttgtttgaactcagttaccaattcgttagctttgttgagctgataactttccaataattcttgttgataacgttcaaagaagccatatccaatgaaatcggagttgtaaagtttagttatagtatctgcatctaaaaattctttatctttagttgcttttaaatagatttcttgatgatctatctttccgacgtccattacataattgaaaaaggttttaaacttttcgttcgtaaacatgtaatctttaactcttatcttttctaatacgtccggttgtttaagtagcgtagcgattattgtactttcaatttcgaattgtccgtaattcattcgttttcgcccccaaattctgccaacttattcatgaacttatctagcgctatttttctttgtctgacatattcggggtcattctgcattttccattggtgtgtagcggtttcgttatctactggctcgatagatacttttttaggttccttacgcatgattgctggtaagttaggcgggtacgggttgttactgttgatataaacatctaccgcttttacagttggttgataatctccattttgacttaatacatcaatccacatttctaacttcggtttatcaaaatcaatgttgtatacgtacctaacttttttaataatttctaatgcttgtgttttgctcatcggcattagtcatcactcaattctttttccatttgtgcaatgacatcatcagtagtattttttctaggtgctattttattttctgcatcttcttttgttttgacattctctttagcccagttgtttaaaactttaattaaatagccaccatgcgcacttttgcttttagtgtactcaacacctacttttacaacttcaaaagcgtttgtacctatatcatcaatagcaaaccctaattgttccatttgattaggtgttaacttatcatccaaatttgcaattatatattttattgaagatgagaagacggcttctctttcttcttctttattcttatattcttcttctttttcttcttctctttcttcttcttcttctgtatcgttacgtaacgttacggtaacgttacgttttgcttctagtaactttttctgtttctcacgatagcgttgttgtcgcaatttatttttttctttatgcttagctttgctatctaagctttgatgcttctcccagtttgtcacttttatgacaccattaactttttcaatcatgcccaatgtctcaaaagtttgaattgctaaccttattgagttaataggtctattaaattcatttgctaacatttcttcgttgtacggcaagttttcggatagcataatataaccttgttcattgtactttcctgataaagttagtaacttaacccaaatagttatgatcgtatctctttcgggtaaagcttcgatatatttgattttgctgtcatcaaacatgccaactttaagttttatccacgatacttctcccattgttttctcctttcagcattttgttgagcctctcatcaacttttatccacgagtcatgcaagtgatatttatcatcaaacgacttaacgccaattgcgtgctgttcattatgatgttgtctacacagtgctaacacatgtttgtcgtagtgattcattttgtttctgttcatgcctctgccgactgcttcataatgtgccaggtctgcgtgaggctttccgcatattacacagttgcggttgattgtagcccaatataataacgctttatcttcgcttaacaacttactcgtttctacactcataggtatttgatgatgaaacataaacgctataatcagttctattaactcccttgcaactttcatagaacagtcgcgcagactgatttcttcataacctttcataatttccaattctgtttgtaataattttctagttgattctactggttcgccccagtgaagttctatatctctacacattgcgaatatttttttgcgttgttctatagatagttttttattgtccggaacctctacttctgcttttagtggatatccgttttctagtaagtcaatgtgactttgttcaagttcaacaccagtagcaacgacggaataagtaccgtcattgtctttctggtatcttgtaatgtattgcatttaaaccacgtcctagaacggtaaatcatcatcattgatttctattggaccattagcattagcgaatgggtttgattgttgactcattggcgtctgtttcccatttgcttgctgttctttttgtttcatctcatcagttttaggttctggtttattaactacttcatcgtctttattccaaacttttacatatgagagtcttacaaaatacttgccttgttcctcgttaaatttatttttaagtacaatagttccgattttgttaattaattgatctgtgtcaaaagttaaatctggtaagttcaatttaattcctaatctactaagtaactcgatatattgtttttcttgataatcttgttggaatggtgggacgaattggttgtgtttgtattgtttaccttcgttgttttcaaaaacaatcgtgaagtatctgttttctctgtcgttaaactcgacatttgcaacttttactgtaaattctccagctcctaaaaagtccccacctttcatgaatgcctcttgattagtttcttgaatgtattgtgttctaccagtgattttcataatttttataccgtccttttaattaatttttaattaccatttctaattgcttgtacaacatcgttaatacttggattaatgaaacgtttgttgttaattttgatgttgcttgagtgtcttatctttgtctcgaataaatttgatggttcagcgttaagtacatattgataagttttttcgccgtcttgctcatgttcttctattgtcattcttgctaacacgtcagattgactgatgactgctttttttatttggtcttgtgcctctatcgtgattgttggattgatagtacttccctcatcatctttgtctttgttaatgccctcgtgtccgcttatagcaagatgaaattgataatgttcttgtaatttagaaatataacgataaatacttacaatgcgtgtagcacactcgccccaatcattaaatgtcggtttctttgatttaccgtccatgatgtcgtccatagtgatatcacgtaacttttggattgtttcaatcactacaacatcaatttgttttccgttttctcttagttgttcaataattttaggcagcattttaatcactgcactaaaatgcttataattcttaatctgcacaactgccccatcttctgttaccgttgttccgtcctcatttatatctagtactaaggcattgttatcttttgttaaaaacgtagttttaccagtaccgaacttgccgtatatcgcaaatttataaaacttgtttgcattttgtttgctgatgtcttttacacctagttgcgttaaaatatcgacatcttgattagttttttcagtcatctattctcccacctttaccgtgtatgacgttggtttctccacaatgctagcaccctctaaaacttcgccgtttgcgtcaatcaatgtgccgttttcagttacattgaaatctttcttaatgtctgattggctaagttttttagttacttttacatagttgtcaaaacctcgttgctcaagttgtntaatgacttcttgctcattgctaacttgaatgacttttgaaccttttctggctgtcacttttccgtaagtgtattcaacttgaatttgctatcttgttctttttgtattctgtaatattcaattacaaggctttgtaaatattctttgccactctgtaatttttctacttctttatctttccattcgtttatgcgttcaatttctttatttgctaaatcgttgatttcattctctttagttgtgattgcatccagtttctnaaaaacccagttagcactgtctagatcagtnactttgaatcggtcgtcttgttcgaatgtn

SEQ ID NO: 150 - DNA, 2989 bp; double-stranded, linear
tttctctctattattctcgatgcgtagataattgtttaaatttaagtttatagtaatgttgagtttataatttcatatatctaaaaacaggtgttgtatatataatcattcatctagttatacttactttaaaaataatataatttcatgcgatgcaattcattgatggatgtttttaatcttaatcaaatccaaataaagcatatatttttaaattcactttctttcgaatcgatttttatctcttgnattaaacttttccattgtttcattaaagctctctgtcatatctattcccattgaattcgctaaacataacaacacaaataaattatcacctaattctgctttaatcgtatttgcttcctctgaatctttcttctttttttcaccataggtatgatttatttcacgtgcaagttcgcccacttcttcagtcaatctagctaagttagctaatggtgaaaaatatcctgttttaaattgtccaatatattcatcaacttcacgttgcatttctaccattgatttcatttctacgttctccttatattgcatttctaatatagtatatatcaatttgaagtctcatgcatgtttagtgcaatctactgactctagctaaactagatgacaagttgtttattttagaagtttaataattcagtttatataaatgtaatgcattcctaactaaattaaatcaattgaaattgggattataactttatgatacgtaccactacaataaaataatatagtgaataatctaccattagaaaaataagcacaaaaaaactagcaaccacacaaaaatgtgattagctagttaataagtgtctaatttaagttaattgttaatctataagattaatcacttgaacgcgcaatcaaaataatacgtacaagctctgctacagcgactgcagttgctgcaacataagtcattgctgctgcagataatactttacgcgcatgcttgtattctttttcatttacaatgttcaatgccgtaatttgtttcatcgctcttgaactcgcatcaaactcaactggtaacgtaacaattgagaataataccgctaatgacattaaaccagcaccaatccataaagcagttgaaccaaatgcactacctatcgctgttaagataatacctaacatgatgatcatataacttaatgaactccctaggtttgcaacaggtactaatgctgctctgaatcttaagaaccaatatccttggtgatcttgaatggcatgaccaacttcgtgggctgcaattgcagttccagcaactgatggtctgtcatagtttgcaggagatagtgaaacaactttctttttaggatcgtaatgatctgttaagaatccttcacctttaacaacttcgacatcataaataccgtttgcatgtaaaatttctaatgcaacttcacgacccgttttaccactagttgatctaacttgtgaatatttctcatagttagatttaactttgtgttgtgcccataaaggaagcaccattaatattacgaaataaattatcatagtaaaaattgaagacaataaactcactctcctttataaatattttactgtcatttgccgtttttatcaaatcatttacactttaataatttgtttaattcaatataaagcaaaagtccaaaaacacttagacaacatgataatacaccaatttgccacacatgtgtagttataaaatcataatatggaaattgaaggtgaaaatagtcaatataatcattcaaaaacacccaaatcatygctacactgattccaatcatagaacgtttaaacctaggatagaagtaaattgcctgaacagccattatactgtgggaaaacattaataccaaaccatttactgtaatatcaccttgttcaataataaataatatattcattataactgcccaaatcccatatttgaataatgttacaaatgccagtgcatcgataatactattttgtttttgaattaatatcaatgagatagaaataactaagtataatattgcagttgggctatctggaacaaaaatcttaaaatgccagggcgtatgacttaattgttcaccataccatatataaccataaatcatccctaatatattacaaatgagtagcatcattaaccaagaacgttgataaagtgtatattgccaaaatgctttaattgtcatctgctaagtcctcaaattgattatgtttatttactagcttgagtgtatttaaaatttgcgttagttgataaaaacgttgcttttcattcatctgtaaacttaaatcaatattgtgtaacaagtaatctattaataacgcatgtttatgccgatctatagccatactatttaagtcatgaagataagtttgataactgggcgattccgttagttgagcaactattaaatcatctagcctttgctcacgctttgacacgtttgcgaagtgaatttgaatatcaaaagcacagttatgattagcgatataatcaaatatttcatttgtattcattaactttatattacgcttagtaaattgaattgcagaagcgtgacttcccacttctgcaatttctaatgtttcatgatgattaatttttgtatctacaaaatgaatgtttgccaatttcgcctcattcacttttatatagttaagcacccaaactgcaatacgcgacttaaatcgatattgaaaaagtaaatattcaataaaactttctttaatttgattgagtgtctctgacatcaaataccccattttaagattgcaatcttgataattcgtcatgccaattttcgttacttggctctagttccaacaattgatttaaaatagtaattgcttgttccttttgaccaatttcaattaaatagaaataataatcactcataaaatcaatatttgttttcatcgttggatatgctaattcaaagaaatgttgagcttctttatctcgctc

SEQ ID NO: 151 - DNA, 1143 bp; double-stranded, linear
catcaactccttaattacactgtaaatgatatgcgtctttttgacaactatatttgtcaaatctacaccaaaaaatatgattatccacctatgtatgacattttgaaacaaacacctcaacgcctacaagtcataattgtttactttcgttacaccttcctgcataattaacagcattctaattttagtatgatgcacgcattttcactaaatcaaaccattcaaaggagactattatggcatttacattatctgcaattcaacaagcacatcaacaatttactggtgttgactttccaaaactattcaaagcttttaaagatatggggatgacttacaatatcgtcaacattcaagatggcactgcaacatacgtacatcaatcagaagatgatatcgttacgtcatctgtaaaaagtaatcatcctgttgctcaaaaatcaaacaaaacaatagttcaagacgtcttaactagacatcaacaagggcaaacagattttgaaacattttgtgatgaaatggctgaagctggcatttataaatggcatatcgatattcmagcgggcacttgtacttatatcgacttgcaagaccaagctgttatttcagaattaatccctcaataaactatatttatagcaacattttaattatttcataaaattttattgataatcattatcgttcggtataaagtaaatactatatactacttatgagtgaggttgattatcatgataactaacacttttattttaggcatcacaggcccaacaagtcttgtcgtcattagcattatcgctttaattatttttggtccgaaaaaattaccacaatttggccgtgccatcggttctactttaaaagaatttaaatctgcaacagaagatttagataaagagtctcacgatacacccagtaaggaatcgaaacaacagcgagagcaatagcactgaccacaccttactggttcactttagcgaactacgccatcggttagtaaaaattttattgtcgttcgtcattacggtcatcgtcgtatatgtytcatcattttggtggatgacaccattcataacgtatatyacccggcacatgtgtccttacatgcatttcattcacagaaatgatacaaataacgtg

SEQ ID NO: 152 - DNA, 7953 bp; double-stranded, linear
caacgcctgaacgtaaaccatatcgtttcgcgatttcctcatcttgactatttactaaaaactctctcatggcgattaatgtttctttttcttctttagttaatggtaattctaactcagctgctttttgacgcaaagttggatgaccatctctaatgatgtctttcattgttaacatatattgcaccttccttattttaatttgttttagttgaatgacagtaaaaaggttgttaagatactcatacatttttatgtgtaaatatctacaaagttaaccaactactgccaatgtttattttagatagtatatgtaaattttcaagatatgcgtaattgcgttaaaaaatgattaaagtgttggtttcaagcaatgatactttagaaatttatttatcatcttgactttaaaaattatattataaatgacgtaactgtcaacagatatacttagtartgaagatgtgtaatgtaattgtttaaaattgatttccaagcagattttatttatcatttaatttaaatagcaagtggaggtacaagtaatgaaatttggaaaaacaatcgcagtagtattagcatctagtgtcttgcttgcaggatgtactacggataaaaaagaaattaaggcatatttaaagcaagtggataaaattaaagatgatgaagaaccaattaaaactgttggtaagaaaattgctgaattagatgagaaaaagaaaaaattaactgaagatgtcaatagtaaagatacagcagttcgcggtaaagcagtaaaggatttaattaaaaatgccgatgatcgtctaaaggaatttgaaaaagaagaagacgcaattaagaagtctgaacaagactttaagaaagcaaaaagtcacgttgataacattgataatgatgttaaacgtaaagaagtaaaacaattagatgatgtattaaaagaaaaatataagttacacagtgattacgcgaaagcatataaaaaggctgtaaactcagagaaaacattatttaaatatttaaatcaaaatgacgcgacacaacaaggtgttaacgaaaaatcawaagcaatagaacagaactataaaaagttaaaagaagtatcagataagtatacaaaagtactaaataaggttggtaaagaaaagcaagacgttgatcaatttaaataattaatataatacagatggtaggaaacaactaatacagttcctattatctgtatctttttttattaaaacagaactttttcaaatggtttaacagtcccatttatttgtggtacaattagtaaggataaaatgaatttctatacaattatgggaaaggtattgtgaattgaatggctcctaagttacaagcccaattcgatgcagtaaaagttttaaatgatactcaatcgaaatttgaaatggttcaaattttggatgagaatggtaacgtcgtaaatgaagacttagtacctgatcttacggatgaacaattagtggaattaatggaaagaatggtatggactcgtatccttgatcaacgttctatctcattaaacagacaaggacgtttaggtttctatgcaccaactgctggtcaagaagcatcacaattagcgtcacaatacgctttagaaaaagaagattacattttaccgggatacagagatgttcctcaaattatttggcatggtttaccattaactgaagctttcttattctcaagaggtcacttcaaaggaaatcaattccctgaaggcgttaatgcattaagcccacaaattattatcggtgcacaatacattcaagctgctggtgttgcatttgcacttaaaaaacgtggtaaaaatgcagttgcaatcacttacactggtgacggtggttcttcacaaggtgatttctacgaaggtattaactttgcagcagcttataaagcacctgcaattttcgttattcaaaacaataactatgcaatttcaacaccaagaagcaagcaaactgctgctgaaacattagctcaaaaagcaattgctgtaggtattcctggtatccaagttgatggtatggatgcgttagctgtnatatcaagcaactaaagaagcacgtgaccgcgcagttgcaggtgaaggtccaacattaattgaaactatgacatatcgttatggtcctcatacaatggctggtgacgatccaactcgttacagaacttcagacgaagatgctgaatgggagaaaaaagacccattagtacgtttccgtaaattccttgaaaacaaaggtttatggaatgaagacaaagaaaatgaagttattgaacgtgcaaaagctgatattaaagcagcaattaaagaggctgataacactgaaaaacaaactgttacttctctaatggaaattatgtatgaagatatgcctcaaaacttagcagaacaatatgaaatttacaaagagaaggagtcgaagtaagccatggcacaaatgacaatggttcaagcgattaatgatgcgcttaaaactgaacttaaaaatgaccaagatgttttaatttttggtgaagacgttggtgttaacggcggtgttttccgtgttactgaaggactacaaaaagaatttggtgaagatagagtattcgatacacctttagctgaatcaggtattggtggtttagcgatgggtcttgcagttgaaggattccgtccggttatggaagtacaattcttaggtttcgtattcgaagtatttgatgcgattgctggacaaattgcacgtactcgtttccgttcaggcggtactaaaactgcacctgtaacaattcgtagcccatttggtggtggcgtacacacaccagaattacacgcagataacttagaaggtattttagctcaatctccaggtctaaaggttgttattccttcaggcccatacgatgcgaaaggtttattaatttcttctattagaagtaatgacccagtcgtatacttagagcatatgaaattgtatcgttcattccgtgaagaagtacctgaagaagaatatacaattgacattggtaaggctaatgtgaaaaaagaaggtaatgacatttcaatcatcacatacggtgcaatggttcaagaatcaatgaaagctgcagaagaacttgaaaaagatggttattctgttgaagtaattgacttacgtactgttcaaccaatcgatgttgacacaattgtagcttcagttgaaaaaactggtcgtgcagttgtagttcaagaagcacaacgtcaagctggtgttggtgcagcagttgtagctgaattaagtgaacgtgcaatcctttcattagaagcacctattggaagagttgcagcagcagatacaatttatccattcactcaagctgaaaatgtttggttaccaaacaaaaatgacatcatcgaaaaagcaaaagaaactttagaattttaatacattttaaaagttaacgaagttagcgtattttagtctcattgattaaaatgaaatgtttaatttacgaaatcttaggagggcaaaaacgtggcatttgaatttagattacccgatatcggggaaggtatccacgaaggtgaaattgtaaaatggtttgttaaagctggagatactattgaagaagacgatgttttagctgaggtacaaaacgataaatcagtagtagaaatcccatcaccagcatctggtactgtagaagaagttatggtagaagaaggtacagtagctgtagttggtgacgttattgttaaaatcgatgcacctgatgcagaagatatgcaatttaaaggtcatgatgatgattcatcatctaaagaagaacctgcgaaagaggaagcgccagcagagcaagcacctgtagctactcaaactgaagaagtagatgaaaacagaactgttaaagcaatgccttcagtacgtaaatacgcacgtgaaaaaggtgttaacattaaagcagtttctggatctggtaaaaatggtcgtattacaaaagaagatgtagatgcatacttaaatggtggtgcaccaacagcttcaaatgaatcagctgcttcagctacaagtgaagaagttgctgaaactcctgcagcacctgcagcagtaacattagaaggcgacttcccagaaacaactgaaaaaatccctgctatgcgtagagcaattgcgaaagcaatggttaactctaagcatactgcacctcatgtaacattaatggatgaaattgatgttcaagcattatgggatcaccgtaagaaatttaaagaaatcgcagctgaacaaggtactaagttaacattcttaccttatgttgttaaagcacttgtttctgcattgaaaaaatacccagcacttaacacttcattcaatgaagaagctggtgaaatcgttcataaacattactggaatatcggtattgcagcagacactgatagaggattattagtacctgttgttaaacatgctgatcgtaagtctattttccaaatttcagatgaaattaatgaattagctgttaaagcacgtgatggtaaattaacagccgatgaaatgaaaggtgctacatgcacaatcagtaatatcggttcagctggtggacaatggttcactccagttatcaatcacccagaagtagcaatcttaggaattggccgtattgctcaaaaacctatcgttaaagatggagaaattgttgcagcaccagtattagcattatcattaagctttgaccacagacaaattgatggtgcaactggccaaaatgcaatgaatcacattaaacgtttattaaataatccagaattattattaatggaggggtaaaacatggtagttggagatttcccaattgaaacagatactatagtaatcggagcaggtcctggtggatacgttgcagcaattcgtgcagctcaattaggacaaaaagtaacaatcgttgagaaaggtaatcttggtggtgtttgcttaaacgtaggatgtattccttcaaaagcattactacatgcttctcaccgttttgttgaagcacaacattctgaaaacttaggtgttattgctgaaagtgtttctttaaacttccaaaaagttcaagaattcaaatcatcagttgttaataaattaactggtggtgttgaaagcttacttaaaggtaacaaagttaacatcgttaaaggtgaagcatatttcgtagataacaatagcttacgtgttatggacgaaaagagcgcacaaacatacaactttaaaaatgcaatcattgcaacaggttcaagaccaattgaaattcctaatttcaaattcggtaaacgtgttatcgactcaacaggtgctttaaacttacaagaagtaccaggtaaattagttgtagttggtggaggatacattggatcagaattaggtacagcatttgctaactttggttcagaagtaaccatccttgaaggtgctaaagatatcttaggtggcttcgaaaaacaaatgacacaacctgttaaaaaaggtatgaaagaaaaaggtgttgaaatcgttactgaagctatggctaaatcagctgaagaaacagataacggagttaaagttacttatgaagctaaaggcgaagagaaaacaatcgaagctgattatgtattagtaactgtaggtcgtcgtccaaacacagacgaattaggcctagaagaattaggtgttaaattcgctgaccgtggattattagaagttgataaacaaagccgtacgtctatcagcaatatctatgcaattggtgatatcgttccaggtttaccacttgctcacaaagctagctatgaagctaaagttgctgctgaagcaattgatggtcaagctgctgaagttgattacattggtatgccagcagtatgctttactgaaccagaattagctacagttggttattcagaagcgcaagctaaagaagaaggtttagcaattaaagcttctaaattcccatatgcagcaaatggtcgtgcattatcattagatgatactaacggatttgttaaacttattacacttaaagaagatgatactttaatcggtgctcaagtagttggtactggtgcatcagatattatctctgaattaggtttagcaattgaagctggtatgaatgctgaagatatcgcattaacaatccatgcacatccaacattaggtgagatgactatggaagcagcagaaaaagctatcggatacccaatccatacaatgtaataactgattatctataaagattcagtcattaaaagctgtagcatatgctacggcttttttgttttaggtaaagtaatgtaaggaaattgatttgagatatcgttaacatgtgacatgcatgttatactagcgatgctaataaaagaattgaaatggagggttcaacaatggaatatgagtatccaattgatttagactggagtaatgaagagatgatttcagtgataaatttctttaatcatgtagagaagtattatgaatccggcgtgacggcaggcgactttatgggtgcatataaaagatttaaagaaattgtgcctgctaaagcagaggaaaaacaaatttttaatactttcgaaaaaagtagtggctataatagttacaaagcagttcaagatgtaaaaactcactctgaagaacaaagagtaacagctaaanaataattcgttcgaaattaacacaatttaataggaatttttctttaaaactattgctaataaagctatattttgatacctttatcaagtgttaaacaaaatgtttgataaaagtaaacttaatatagcttttttaggtggaaaaataaatgaacataggtaataaaattaaaaatcttagaagaattaaaaatttaacgcaagaagaacttgctgaacgtacagacttatcgaaaggctacatttcacaaatagaaagtgaacatgcctcaccaagtatggaaactttcttaaatattatagaggtgttaggaacgacgccaagtgaattttttaaagacagtgaaaatgaaaaagtattatacaagaaggaagaacaagttatttatgatgagtatgatgaaggttatatattaaattggttagtttcaaagtcaaatgaatatgatatggagccattaatattaactttaaagcctggagcatcatataaaaattttaatccatcagagtctgatacgtttatttattgtatgtcaggtcagataacacttaatttaggcaaagagatatatcaagcacaagaagaagacgttttgtattttaaagcacgagataatcatcgtttgtcaaacgaatcaaacaatgaaacacgaatacttattgtagcgacagcttcatatttataggggggatcttatttggaaccgttattatcattaaaatcagttagtaaaagctatgatgatcttaatatcttagatgacatagatattgatattgaatcaggatacttttatacattattaggtccttcaggttgtggtaaaacaacaattttaaaattaattgcagggtttgaatatcctgacagtggtgaagtgatttatcaaaacaaaccaattggtaatttaccaccaaataaacgtaaagtgaatacagtctttcaagattatgcattatttccacacttaaacgtctatgataatatcgcttttggtttgaaattaaaaaaattatcaaaaaccgaaattgatcaaaaagtaactgaggcattaaaattagtaaaactttcaggttatgaaaaaagaaatattaatgaaatgagtggcggacaaaagcaacgtgttgcaattgcacgtgctatcgtaaatgaaccagaaatattattgttagatgaatctttatccgcattagatttgaaattgcgtactgaaatgcaatatgaattacgagaattgcaatctagattaggtattacatttatatttgtaacacatgatcca

SEQ ID NO: 153 - DNA, 2347 bp; double-stranded, linear
ggcgtgatcatacgaccgtcattcatgctcatgaaaaaatatctaaagatttaaaagaagatcctatttttaaacaagaagtagagaatcttgaaaaagaaataagaaatgtataagtaggaaactttgggaaatgtaatctgttatataacagcactaatgatnacaatcattttttacatttctatatgctaatgtggcaagatgagcaaaactcattttgtggataatgtttaaaagtcatacacaccatacacaagttatcaacatgtgtataaytcgccaaatctatgtttttaagacttatccaccaatccacagcacctactactattactaagaacttaaaacctatataattatatataaacgactggaaggagttttaattaatgatggaattcactattaaaagagattattttattacacaattaaatgacacattaaaagctatttcaccaagaacaacattacctatattaactggtatcaaaatcgatgcgaaagaacatgaagttatattaactggttcagactctgaaatttcaatagaaatcactattcctaaaactgtagatggcgaagatattgtcaatatttcagaaacaggctcagtagtacttcctggacgattctttgttgatattataaaaaaattacctggtaaagatgttaaattatctacaaatgaacaattccagacattaattacatcaggtcattctgaatttaatttaagtggcttagatccagatcaatatcctttattacctcaagtttctagagatgacgcaattcaattgtcggtaaaagtgcttaaaaacgtgattgcacaaacaaattttgcagtgtccacctcagaaacacgcccagtactaactggtgtgaactggcttatacaagaaaatgaattaatatgcacagcgactgactcacaccgcttggctgtaagaaagttgcagttagaagatgtttctgaaaacaaaaatgtcatcattccaggtaaggctttagctgaattaaataaaattatgtctgacaatgaagaagacattgatatcttctttgcttcaaaccaagttttatttaaagttggaaatgtgaactttatttctcgattattagaaggacattatcctgatacaacacgtttattccctgaaaactatgaaattaaattaagtatagacaatggggagttttatcatgcgattgatcgtgcctctttattagcgcgtgaaggtggtaataacgttattaaattaagtacaggtgatgacgttgttgaattgtcttctacatcaccagaaattggtactgtaaaagaagaagttgatgcaaacgatgttgaaggtggtagcctgaaaatttcattcaactctaaatatatgatggatgctttaaaagcaatcgataatgatgaggttgaagttgaattcttcggtacaatgaaaccatttattctaaaaccaaaaggtgacgactcggtaacgcaattaattttaccaatcagaacttactaaaaataaatataaataaaggatgacgtgattaattaaaacgtcatcctttattttttggcaaaaataattctaggtgcgtatgtaaaataaatttggcagcattttaaacagcaaataaaagacgccaattaaatttatgacaaatgtatccaaaatttaataagtgtgcttatatgccctttaaatttaaaattttaatagtcaataacaagttgaatataaaagttaaacgccgttaaatagcgttaaaaaattgaaaatgacagtattgccaaaaaataagaattaattatttatatgtaaacggtttctacctctattttaaatgaaatttgtgacaaaaaaaggtataatatattaatgacatacaaagaaatggagtgattattttggttcaagaagttgtagtagaaggagacattaatttaggtcaatttctaaaaacagaagggattattgaatctggtggtcaagcaaaatggttcttgcaagacgttgaagtattaattaatggagtgcgtgaaacacgtcgcggtaaaaagttagaacatcaagatcgtatagatatcccagaattacctgaagatgctggttctttcttaatcattcatcaaggtgaacaatgaagttaaatacactccaattagaaaattatcgtaactatgatgaggttacgttgaaatgtcatcctgacgtgaatatcctcattggagaaaatgcacaagggaaagacaaatttacttggaatcaatttataccttagctttagcaaaaagtcatagaacgagtaatggataagggactccataccgttttaatgc

SEQ ID NO: 154 - DNA, 13542 bp; double-stranded, linear
acaagacgtntctataacttatctgaaatcgctcgtcaagataaagattatgcaactatctcattcttaaactggttcttagatgaacaagtcgaagaagaatcaatgtttgaaactcacatcaattatttaactcgtatcggcgatgacagcaatgcattatatctttacgaaaaagaacttggcgctcgtacattcgacgaagaataattaaacatcactacaatagacagataaatatcatacgacatgataggcatttgggtcacttacaataacccaatgtctatattattttgctttacggagatcactagattcattttctgaatcattgatctgcgttttttcattttcaaggctaattattgtatttttagtcatttattttttaaactactaatgttaataactctaaatttgatgttgaattaatttgacgattttaaagcatatcatcatttactttttaatcagagttacatccaaatgatagatttcacgttataccttcacgtataatattatgtatcgtttgtaagcaaatgactaaaagtctattaatatatacatttaattaattgaaaggattgactacatgatacaagatgcgtttgttgcacttgattttgaaacagcaaatggtaaacgtacaagtatttgttctgtcggaatggttaaagtcattgatagtcaaataacagaaacatttcatactcttgtgaatccgcaagactatttttcacaacaaaatattaaaattcatggcatacaaccagaagatgttgaaaatgcacctacgtttgactacgtatttccatatatgatgcaatttattgcagatttacctgttgtcgcacataacgcggcatttgatatgaacgtcttacatcaaagcattcaaaatattggtttaccaactccaaatttaacttacttttgtagttatcaacttgctaaaagaaccgttgattcgtatcgatacggtttaaaacatatgatggagttttatcaattagattttcatggtcatcatgatgcattgaatgatgccaaagcatgcgcaatgattacttttaggctactgaaaaattatgaaaatttaacatatgtaactaatatttatggtaaaaatctaaaagataaaggctaggactaaataaaatactcccttcaaaagtaagcattgtaaaaatgtaaactttgcagggagctttattttatataaagtcatatatcgtcatatttttataagttgattgttctaaattacctacagtgacaccaataagtcgaattggtacatcagggtcttttaaatcgttataaagtaaatatgcaatattataaatatcttcttcagaactaaccgaatctcttaaactcatctgtttagatagcgtttcaaattgataagttttaattttaaccgttacagttttagctgacttctgtaatttatttagacgttcagctgttttacctgnacaattcccatacttttcttaaaatctcttcatcatcattcacgtctgttgcaaatgtgcgttcagtccctactgattttcttactcttgatgatttcacttcactatggtcaataccgcgtgccttgttatataaaccccgacctctttttccaaacaaacgtattaattcaaattccgttttctcatataaatctctaccgttaaaaataccattatcatgcattacttttttggaagctttacctacgcctggaaaatctccaatatccaatgtcatcaaaatatcatggacattttgataatcaatcacagtcataccatcaggtttattcataccactcgctaatttagctaaaaatttgttataagaaacacctgcagatgctgttaaatgtgtctgctctagaatatcttttctaatatactgagcaattttcgaagcaggaaggtctggtctcactaattctgtaatatctaaatacgcttcatccaatgacatcggttctaccttatctgtataacttcggaaaatagacataatctgcgcagatgtttctcggtaagcaccaaaattacttgtgacaaagtatccatttggacataatttatgcgcttgtgacataggcattgctgaatggacgccgtattttcgtgcttcataggatgccgtagagacaacacccctactgcttgctttaccaccaacaatgactggtttccctttcaatttggggttatctctcatttcgacttgtgcaaaaaaatagtccatatctatatgaataattcgtctctcagtcaagtgctcacctccctactaatttttacttttataacgcacaaaaatatctcaacataattatacgctgtgtacgatttttttacataaatcttgcacttagcgataactatattgagataactacaagttgttataaaatcaattgctatttaagcatgatgatgaagacgattgagtaagaaaacataggtaatctgaaataattcaagcaaattcattttgttggtatcatcatattaaaatttattattgagtcggcttttgatgatacaaataaatactatcttcatcttgttgaacatatttaaaactactagatattgttaatgcaacaagcagaatatctataaagcaataagcggtatgcatactaaacataaaaataagtgatgaataaccaaataccttaattaaaataagcaagccagtacttaataggattagtggtgacagcataataattgagaattgccatttgttgaagcaagcatctgctgtttggaataagattctgtctttttttatattaaacataggtttgctatcttttttaaataaaagaaataatgctctatggataagttcatgtaaaatcaataaaataatgaatccagcaaacccatatacaagattgatgatgatattttgatcgacaaccgctgtgacacctaacgcccacttatacgtaaataaaatcacgaataacgcaataacaagttgcaagataataaaccttcgcatttgaaaattatttgtcgttaaatcaattttatgcattaccaaccctcccgatcatgacattcttattcttctttaaatatagtatacaatgtcacatttaatttaaaaagttcatatcaagaaagtaaattggctgtaataaaattttaatatacgacttctttcttcacttattaaggcgaaattttatctcaaatcatgtgcgctatttcaaattgaataatgccactgtctcaacatgtgttgtttgtggaaacatatctaccggtgttacctcttcaagttgatatttttcagctaataataatgcatcacgttgctgtgttgcgggattacatgaaatatagacaatacgcttaggttctaatgtaagcaaagtctgaataaacgtttcgtcacagccctttcttggcggatcaaccattacaacatctggtttaatcccttgtgctttccattgtaaaataacttcttcagctttcccacagacaaaagttgtattattgcattggtttatagtcgcattttgttgtgcgtcttcaattgcagaaggtactacttcaacaccgtatacatgttttgcaagtggtgccatatatagccctattgttccaataccacaataggtatctaatacaacttcattacctgtcaattgcgcatactcaattgctttattatataatttctctgtttgttcagaattaatttggtagaatgactgatcacttattttaaatgtactatctgttaattgatcaataattgtatctttaccatatagcgttatagattgacgtcccataataacattagagtggctatcattaatgttttgtttaatgcttgtcacattaggaaatgcatctaatatcttctcaacaacagcatttttttgtggccactttttaccattagttacaaaaataatcatcatttcgtctgtatgatatcctgttcttacaaccaaatgtctcattaaaccttttttcaattgttcttgataaatacttacatttaaatcttttaaaatagatttaacttcattcatcacttcttgatgttgtgaatcttgtattaaacaactttccatgtcaataatgtcatggcttctttgacgataaaagcccataataacttcattctgttcattcttaccaactggaatctgggacttgtttcgatatctccaaggatctgtcatgccaactgtatcgttaatcttagaattatcaaaatgcgcttttcgctgaaacaaattaatcacttgttcctttttcatttcaagttgtgcttcgtatgataagtgttgaagttggcacccaccacaacgttcataatatatacatggcggtgcaacacgattctcacttctcgtatttatattaagcaacttacctatcgcaaagttcttttttactttgataattttatattcaatttgttcattaattaaagcttgtggtatgaaaataggaaagcgatctatttttacgacaccatggccttcatgcgttaaatcaacaactgttcccgtttttatgtcatttttagctattgcttgcaaaattttacctccaaaatgaacaggttaggaacaaaattatgcgcttcctaacctgccattatatatttcactatttctgtttattcttcgattaaattgtcatcaacatgatcattatttattaactcttcatttacaatatcattaggtgcaaagacatctatatgacgttctagatttaagaaattcgctggtaatttaccaccatattctccatctacatttagttgtaagtctgtgaatgatgaaatattaattgcctttgctttttcataaataactttaggatgcttagtatgttctcctcttgaagctaaagtcataatatgaccaagttctgcaaggtttgatttttcaactataattaacgtaaaatagccgtcatctaacttagcgtccggcactaatttttcaaatcctgccattgaatttgttaaacctaaaaagaataataatgcttctccttggaaaacattaccatcatattcaattcttaaatctacagctttcatttgaggtaacatttcgaaacctttgatgtaataagcaaatggaccaacaatagatttcaatttactcggtgtttcataagagacttgcgtcaattgtccgcctgcagctaaattaataaagtatcgattattcattttaccaatatctactttagtagaatgaccttcaatgatgacatcaagtgcccccatgatgtcattaggtatatgcaatgcacgtccaaagtcattaacagtacccataggaatgacacctagcttaggacgattaggcttttctgcgataccattaactacttcatttaatgttccatcaccacctgcagcgattaatacatcataattttcatgcatagctctttctgcttcaagtgtggcatcacctattttctcggttgcatatgcactcgtttcatatcccgctttttctaattttattaaggcatcaggtaattctcttttaaatagctctttacctgatgtcgggttataaatgattctagcacgtttcctcatatcttatccctctacttaaaattcatatattttaacttcatctttgtttcgtctaatagggagtgggacagaaataatatttaacaaaatttatttcgttctaccccaacttgcattgtctgtagaatttcctttcgaaattctctatgttggggccccaccccaacttgcacattattgtaagctgacagaaagtcagcttctttgtttgggggccccgccaacttgcacattattgtaagctgacagaaaatcagcttctatgttggggccccactagaattgaaaaaagcttgttacaagcgtattttctttcagtcaactacagccaatataacattgtagtgcctaggacattgaatttatgacccaggctcagtcttatttcatcattcttaatatcgttaaagaccaacttgtatcttaaacaaatactatctcaatatgtacaaagcttgttatttattcagcattttttgccgttcttcattatatagcttcgtcagttatgctattttacctttaaaatgatgttgtaaatataatgttgtctttatacaaaaatgttttatacctttttattatacagtttgccttaatataattanaagtaacgcattaataaaattaatatttttaccattaacatgtacaatgaataaagttaaaagtaatttgacttctatagatataaataaaccctcgattgcatctaagtcagcaatcaagggtttattttttaaatcttcatagtttgatgatttaaattatcttttatctaattcttgttttaatagttgatttactaattgtggattagcttgacctttagacgctttcataatttgaccaactaagaagcccatagctttgcctttaccatttttgtaatcttcaactgattgttcgttattgtctaatgcttcatttacaaattttagaagtgttgcttcatcagaaatttgaactaagccattatcttccataatctgtttagcattaccacctttagctgctaactctgggaagactttcttcgcaattttactgctcattgttccgtcttcgataagtttaatcatacctgctaaattttctggtgttaatttagtatctaataattctacttgatttttatttaaatattcgtttacgccacccattaaccagttagatgttaatttaacatctgcaccgtgttcaattgttgattcaaagaaatctgacatttctttagtcaatgttaatacgtgtgcatcgtatgcaggtaaacctaattcatttacatacttagctttacgttcatctggtaattcaggaattgtctgacgaacacgctctttccaagcatcatcaatatataaaggtacaatgtcaggctctgggaagtaacggtaatcatcagaaccttctttaacacgcattaaaattgttttacctgtagattcatcaaatcgacgtgtttcttgtccgatttctccaccatttaacaattcttcttcttggcgtttttcttcatattctaaacctttacgtacatagttaaatgagtttaagtttttcaattcggctttagtaccaaatttttcttgaccatatggacgtaaagagatgttagcatcacaacgtaaagatccctcttccatcttaacgtctgatacaccagtgtattgaataattgaacgcaatttttctaaatatgcatatgcttctttaggtgaacgaatatctggttcagatacgatttcaattagcggtgtaccttgacggttcaagtcaactaatgaatactcacctttatgtgttgacttaccagcatcttcttccatgtgaagacgagtaataccgattcgttttgtttcaccgtcgacttcgatatcgatatatccattttcaccaattggttgatcaaattgagaaatttgatatgcttttggattatctggatagaaatagttcttacggtcaaacttagattctgttgcgatttccatatttagtgccattgcagcacgcattgcccagtctactgcacgcttattaacaactggtaagacacctggatatgctaagtcgataacatttgtatttgagttaggttctgctccaaaatgcgctggtgatggagaaaacatttttgagtccgtttttaactctacgtgaacttcaagtcctataactgtttcaaaatgcatgatttccactccttataatttttcataaacgtcatgtaaattgtattgtgtttcatattgataagcgacacgatataacgttttttcatcgaatggtttaccaatgaactgtaaaccgattggtcggccatttgattgtccacaaggaacagaaataccaggtaatccagctaagtttactggtgttgttaataaatcattggcatacattgttaatggatcatcaatttcttcacctaaattaaacgcagtgtnaggcgctgttggaccaactactacatcataattttcgaatactttatcaaagtcatttttaatcaatgttctaactttttgagattttttatagtaagcatcatagtaacctgaacttaatgcaaatgtacctaagaaaatacgacgttttacttctttaccgaaaccttcagatcttgacattttatataattcttctaatgaatgagcttctttagaatgataaccataacgaattccgtcaaaacgagaaaggtttgacgaagcttctgatgatgcaatcacgtaatatgatggaataccaaatttagtatttggcaatgatacttcctcaacgacagcacctaaagattttaaagtttctacagcgttttgaactgcttcttttacgtcatcagctacaccttcacctaagtattctttaggtaatgcaacttttaatcctttaatatctttaccaatttcagatgtaaagtctacatcatcaactggtgcacttgtagagtcattaacatctgcaccagaaatagcttctaatacgattgcattatcttttacatttcgagtcaatggaccaatttggtctaatgaagatgcaaaagcaactaatccaaatcgagatacacgaccgtatgttggtttcataccgacaacgccacaatatgcagccggttgtctaattgaaccacctgtgtctgaacctaagctaaatggtactaagccagctgcaactgctgctgcagatccacctgatgaaccacctggcactgctttatggtcaaatgggttaactgtttttttgaaataagatgtttctgttgaaccacccattgcaaactcatccatatttaatttaccgattaaaacggcattttcattatgtagtttttccattacagtagattcgtaaattggcacaaaaccttctaacattttacttgcacatgttgtttctaatccgtttgtaataatgttatcttttatacccattggaataccaaataatttgccatccatttgatcttttgcttgtaattcatccaattcttgcgcttttttgattgcattttctttatccagcgctagaaaagacttaattgttggatcagtctcttcaattgcatcatatatatctttaacaacatcagatggtttgatttttttgtcttttattaaagttaataaattctcaaccgattcgtagcgaatgctcatcttacgcgtcctcctcattcatgattgtaggcactttaaattgtccatcttctgtttctttggcatttttcaaagctaattcttgtggaatacctttaattgctttatcttcacgtaaaacgttttgtaaatctaaaacgtgatatgtaggttcaacgccttctgtatcagcgctatcattttgttttgcaaaatctaaaatgctttctaatgtgttggccatttcttccgtttcttcaggagaaatttgaagtcttgcaagattcgcgatatgctcaacttcttcacgtgttacttttgtcattaataaaagcctcctttaagtcattcatcactaaattgtatcaaatttccaattaaaaatctaagtatttatgaggtgctactttaatttcatataaactgtataaacattatcattcgtttatcaaatcattttttatgaaaacaacactcttttaatattagacaacccaattcaatattatgattatgcaattttaattataaaaatttgctcatatccaaaaaatacgaaagcgctttctatattggtatgcaagtatttcaaaaagaataaatttaattttcctacttttctaaacatttatctttatgtataatgttttcaagtaactaaattataaattaaataaagggagtgtttatcatgcttacaatggggacagcattaagtcaacaagtagatgccaattggcaaacttatattatgattgccgtctacttcttgatactaatcgttattggcttttacggttacaagcaagcaactggtaacctaagcgagtacatgttaggtggacgtatattggaccgtatattactgcattatcagctggagcttcagatatgagtggatggatgattatggggctacctggttctgtctatagcactggtctatcagctatgtggattacaatcggtttaacattaggtgcttatataaattactttgttgttgctcctagacttcgtgtttataccgaattagctggagatgcaattacattaccagatttctttaaaaatcgtttaaacgataaaaataatgtgttaaagattatttctggattgattatcgtagtattctttacattatatacacattctggtttcgtatctggtggtaaactatttgaaagtgcttttggattagattatcatttcggtttaatattagttgctttcattgtcattttctatactttctttggtggatatttagctgtatcaattacagatttcttccaaggtgtcattatgttaattgcgatggttatggtccctattgttgctatgatgaatttaaacggctggggaacgtttcatgatgtagcagctatgaaacctacaaatttaaatttatttaaagggttatcatttataggaattatctctctattttcatggggattaggttatttcggtcaacctcatatcattgtaaggtttatgtctattaaatcacacaagatgctacctaaagctagacgtttaggtattagctggatggctgttggtttattaggcgctgtggctgttggtttaacaggtattgcattcgtacctgcttatcatattaaactagaagatcctgagacattattcatcgtgatgagtcaagtactcttccatcctcttgtaggtggtttcttacttgctgcgattctagctgcaattatgagcacgatttcttcacaattacttgtaacatctagttcactaacggaagacttttataaattaattcgtggtgaagaaaaagctaaaacgcaccaaaaagaatttgttatgattggaagattatctgtattagttgtagcaattgttgccatcgcgattgcatggaatccaaacgacacaattctaaacttagtaggtaacgcttgggccggatttggtgcatcgttcagtccacttgtgctatttgcactttactggaaaggtttgacacgtgccggtgctgtaagtggaatggtttcaggtgccttagtcgttatcgtttggattgcatggattaaaccattggcacatatcaacgaaatattcggcttatatgaaattattcctggatttattgtaagtgtaatcgttacatatgttgtaagtaaacttactaaaaaacctggtgcatttgttgaaactgacttaaacaaagttcgtgacatcgttagagaaaaataattcataagtcttaacaaattaaaaaggtactaatgttaatcaaaattatgactaacattggtacctttttattatctttaatttacaattaattactgtaaatatgaacttgcggttctttgtcatcttttgtcttactaattaaagcacgtggttggttaccatctttaatacgaatttcatagttatcgattttatcgaaatatttattcgcttgttcagtaacgtactgtgtaataccaattgtttcagcttgtccatagtaatcgattggtaaatctactactaatcgttgtggctttttatcaacaaatttaactttccctactgcttgtgtgaaattagaaaaatatgattgcaaattatcattaaattgcttgaaattattatttaaattttcatcataatctgctgctgttgaagaaggtaataaagctgatttttcattgatattatgccattcattaagctttgtttgactcttttctgcagtcgcttgagtgataaattcacctggtgtgattgaatcttcacttgattgcttataaattgcaaaatgaattggtatatcttttaaatcatcattttcacgtaaccttgataatatctcactagccatttgtttaccttgctttttaactcgctatcatctagttttttactaaaagtcgatccatctttttcttttttatagtaataaacactattcatagctaaaccaatcgtcatacctttaatattcttaccttttgtatctccaccaccataaaaatcttgctctaaaatgttagataaataggctggtgatttttctgcaatcttttcaggatctgtttcaccttcgtgtgatggattaagtcctaaattttcattcgctttcttgtcttttttatctttttcagacattttatcgatttcacgttttgtatacttaggatttaaataggcattaattgttttcttgtccaaaaattgaccatcttgatacaaatatttatctgttggaaatacttctttacttaagttcaataaaccatcttcaaagtcgccgccattataactatttgccatgttatcttgtaaaagtcctcttgcctggctttctttaaatggtaacaatgtacgatagttatcaccttgtacatttttatccgttgcaatttcttttacttgatttgaactattgttatgtttttgattatcttttccagcctggtcatccttatggttaccacaagcagcgagtataaagatagctgtaatcaataatactaatgtacgcttcatcgacatacccctctaactatttaattcattttgcttatctacaaattgttgctctgtccaaatttcaatacctaaactttgtgcttttgttaattttgaacctgcatcttcaccagcaataacgacatctgtatttttagtaacgctacttgtaactttagcaccttgtgatgcaagccatttagatgcttcattgcgtgtcatttgatgtagcttaccagtcagtactatcgttttaccactaaattcaggatgtccttcaatatctgatgttttgatacctttataaatcatattaacatgtttatcttttaatttttgaattaaagcacgaatatcttcattttctaaataagtaactacagattgtgctactttatcacctatatcatgaatttctactaattccgcttcagttaccgttagtaatcgatctatcgtttcatatttttctgctaacacttggctcgctttaacacctaaatgcctaatacctagaccaaataataaattttctaaagagttgtccttagcttgttgaatggcagctaataaattatcaacttttttctgccccattctgtctaaaggtaataaatcttcttctgttaaatagaaaatatcagcaacatctttaattaattcgctttgataaagctgttgaataattttagtgcctaaaccatcaatattcatggcttgtcttgatacaaagtgnatcaatccttcaacaagttgtgcttggtcattttgg

SEQ ID NO: 155 - DNA, 1893 bp; double-stranded, linear
cagtaaacacctctgattacgaatatttatacatttattttaacacatgcactgatttacgactactaaacacctttacgtaaaaagggtaaacatggtttatctatcttggttatctatttataaatatttntcatattacgcataacaattgcttaaaatatgtataaaaatgaatatatgtgtaataaacttgctaattattagatttaataagcgtcaattgtttgaacatatttaattaaaatcacattgatatcacagatacgaatattgtcgtatagaaattgaaaattctattttttaaatgaaagtcttcaacataattttaagtttcaacatgagaaaaatcgattaacaaacaacgtcagttgaatatgccttttgagacatttcaaactttacaattgttgctaatcgatatatttgcttttagtgatccctgctataaaataaatcaacgatttctaataagtgttttgtattgaattgttcatcaatttgcgttagttcatccactgctgcgtctctatgataagtcaatttatcttctgcgccatctttccctaataaactcacgtacgtacttttattattttcaagatcgctgcccacttttttacctaactttgcttcatcaccatagcagtctaataaatcatctttaatctggaacatcatacctaaatgataactataactttctaaatgttctttagttgtatcatcgacattagcgatatctgctgcactcataaccgcaaaagttaataatgctcctgtttttgttttgtgtatcatttccaaagtttcaagatcaattggttggccttcgctttgcatatctaacatttgaccgccgaccattccaacatgaccacttgctattgacagccgttgtagaacttttatttttacttcatcagttaatctatcatcacttgaaataagttcaaatgctttagttaataaagcatcacctgctaatatcgcagtccactcaccatatactttatgatttgttaattttcctcgtcgataatcatcattatccatcgctggtaggtcatcatgaataagtgaatatgtatgaatcatttctagtgcaattgcgctcttcatacctaactcatactcggtatttagtgaatctaaagtgagtaataacagaactggtcggatgcgtttacctccagcatttaatgaatacaacatactttcttctagctgagtatccattactgatttatttatcgcaaccgataattcattattgacttcatctattaatttattcatcggtagattcgtcattttttacatcctcagcttcttcttttattaagtcattcacctttttttcggcattttttaaagttgtgtcacaagctgctgatagtttcataccacgttgatataaatctaatgattcctctaaagatactgtttcattatctaatttttgaacaatttgctctaattcttgcatcatttcttcaaaactttgcgtttctttagtcattattacaccttactttcgtaacttttgcatctactaagccatctttcattgttaacgtcaattgatcattttctgttaaatctttagtactcgtaatgacttcgtcttttttattaacaattgcatatccacgcaacattgtattagttggacttaaattgtttaagttttctactttatttttcaaatcatttttataacttaatatcttagaattcaataatttaacaagttggtttgtcaattgaagattatnttgttgttcttgattaacactacttagtaatgcttttaaatnataacgttggtgcaacagcattaaatcgaggccccggtggtccaaagttgcccgaattngtggtttcaggccc

SEQ ID NO: 156 - DNA, 821 bp; double-stranded, linear
aaaatatattccttcacttaatattcaattagagaaaaacatggtgattgtaatatgttgtgcaatatttctgggtgttttaatactttttttatttctgaatcgtaagctaaggttggaaatttataataataactctagtaaagggaaaataattttatttccttcattaaaaaacttttgtttcacaatattttattattttttatttggcggtctttcaataatggctctaagtatgttattaactttaaatcctcaaaatataataggctttattggttggttggtaatgactgcaggtttctttctgttaaacatgtcatcgattattgacaaaaaaatttatgtattatctaaaactaacacggtggaaaaatgatggtttagctggatttactgcaggttctatttcggcaatacttgtatattggaccaatcaaaaaaatgaatttggaataaaagataaaaacgattggataggacataaactagacgttggtatagatgctgtagaaaaatctgcagaaaaaacagtagatggtgttgaaaatgtcatggtgaagcttcaaaaagtatttctaatcatataagccctaagaaatggagctggtaaatgttgctatgcgaatctaaaatcatcaataaaaacccaaaatatagaattattaaatataatgatgaatacttaatggtcgatataataagcacttggattagtttattttttccttttattaattggttcatcccaaaagaatacgtcaaaattagtagagaagagtttgaaaacttaaatattgttaaacctgctaaaaaga

SEQ ID NO: 157 - DNA, 2343 bp; double-stranded, linear
agtaagataattttcaattagaaaatatcttactgctgttctctatttatacaatacttcgtattgaatggcttcgctttcctagggtgccgtctcagccttggtcttcgactggcactgctccctcaggagtctcgccattaatactacgtattaacatgtaattttactttgaaatacttttaaaaaataagacactttgcccaacttgcacataaatgtaaaattcaataaaatgaattttctgtgttgggtcccttcttataatttaataaataccactaaactaaattaacgaggtgccttatgtataaaaattataacatgccccaactacactaccaatagaaacttctgttagaatccctcaaaatgatatttcacgatatgttaatgaaattgttgaaacratacctgatagcgaattcgatgaattcagacatcatcgtggcgcaacatcctatcatccaaaaatgatgttaaaaatcatcttatatgcatatactcaatctgtttaattatgttcaaagcattaaggtaacaagacaatatctaagatatcaaagatagaaattttttgacgttgttgctgattgtaaacataaccatcaatttcataattaatagcatcaatacgataaatggttaagcgtactgaatctacaaagccattattataaaatttaacttctacaggttgggcatattgtagcgcctcgtgtagccgaatgtttagctcagccaattgatcatctgataatacaggacgtgtaattttgttttggtcgataatgtattgttgaatcgtttcgaattgttcgggtaatgttgcaaaaggagcccatttaatcatgcctcttcccataggtatattgttatctagtaattctcttggaacgttacgataatcagtttcttcttcataacttgtcatccttaattcaccccaatctgataattacattatacgaacatgtgttctattttgcaacaaaaattttgtggaagcataaacgcgttaataattaatgctcgtgtaagtaaaaaagagggattaattaaaatcgaataatgacatatcacagcaaatagttcttttaaagtagttaaatagttttagctttaaggaaatgataaatgattgtwaattctagctaaaatttaataaaatgaaaataagactaacatggaggggtaaaagtaatgacaaatggatatattggttcttacactaaaaagaatggtaaagggatttatcgttttgaattaaacgaaaatcagtcacgtattgatttattagaaacaggatttgaattagaagcgtctacatatttggtgcgtaataatgaagttttatatggaatcaacaaagaaggagaacaatgcggtgttgcaagtttgaaaattgatgacaatggtgaattgcatttattaaataaatgtttgtcttcaaaagctggtacaggttgttatgtatcgatttcagaagataaacgatatttatttgaagcggtatatggtgctggcatcatacgtatgtatgaattaaatacgcacacaggtgaaattatacgtctaattcaagaacttgcacatgattttccaacaggtacacatgaaagacaagatcatccacacgcacattatattaatcaaactccagatggtaagtacgttgcagtaacagatttaggtgctgatcgtatcgttacttataaatttgatgacaacgggtttgaattttataaagaatctttatttaaagatagtgatgggacaagacatattgaatttcatgataatggaaaatttgcttatgtcgtacacgaattatcaaatactgtgagtgttgcagaatataatgacggtaaatttgaagagctcgagcgtcatttaacaattcctgaaaactttgatggagatactaaacttgcagcagtgcgtttatctcatgatcaacaattcttatatgtatctaatagagggcatgatagcattgcaatttttaaagttcttgataatggtcaacacttagaactagtaacaattactgaaagtggtggtcaattcccaagagattttaatattgcctcatcagatgaccytttagtttgtgctcakgagcaaggagattcagttgtaactgttttcgaaagaaataaagaaacaggtaaaattacgctatgtgataacactcgtgtagcatctgaaggtgtatgtgtcatattttaatctttaattaatcatgataaaaagaaaaccatgtttccaaaaaatttgtgtataccttgaaatttattgntttccagnacatcaattatgggaagcatggnttatttttgt

SEQ ID NO: 158 - DNA, 4837 bp; double-stranded, linear
aaattgccagttggtatcgcttctggtgcagtagtcgaaggtttcttccaaggtatcattccgattggctatatcgttatgatggcagtattgttatacaaaattactgttgaatctggacaatttttaacaattcaagatagtattacaaatatttcacaagaccaacgtattcaagttttacttattggatttgcattcaacgcatttttagaaggtgcagcaggatttggtgtaccaattgcaatttgtgcacttttattaacacaattaggatttaatccattaaaagctgcgatgttatgtttagtcgcaaatgcagcgtctggtgcttttggtgcgattggtatccctgtaggtgttgtagaaacgttgaaattacctggagatgtttcagtattaggtgtttctcaatcagcaactttaacattggcaatcataaatttcattattccattcttacttatctttattattgatggttttagaggtgttaaagaaacattaccagcaattttagtagtttcaatcacttatacacttactcaaggattattaactgtattcagtggacctgaattagcagatattattccaccgttattaacaatgttagcattagcagtattttctaaaaaattccaaccaaaacacatttatcgtgttaataaagatgaagaaattgaacctgcaaaagcacattctgcaaaagcagtattacatgcatggagcccattcattgtattaacagtcattgtaatgatttggagtgcgccattctttaaaaacttattcttaccaaatggtgctttatcatcattagtatttaaattcaacttacctggaacaatcagcgaagttacgcataaaccattagtattgactttaaatattattggacaaacaggtacagctattttattaactattattattacaattttaatgtctaaaaaggttaactttaaagatgcaggtagattattcggcgttacatttaaagagttgtggttaccagttcttacaatttgtttcatcttagcaatttctaaaatcacaacttatggtggtttaagtgcagcaatgggtcaaggtattgctaaagcaggtaatgtcttcccagttctatcaccaattttaggttggataggtgtgtttatgacaggatcagttgtaaataacaactcattatttgcaccaattcaagcttctgttgcacaacaaattggaacaagtggttcacttcttgtatctgctaatacagttggtggtgtagcggcaaaattgatttcaccacaatcaattgcaattgcaactgcagcagtaaaacaagttggtaaggaatcagaattattaaaaatgacattgaaatacagtgtatgtttactaatattcatctgtatttggactttcatcttgtcattattataaaaaaacgtatttcaaaatataaatatacagaaggtgagatgttttctaacatctcatcttttttttatggatcattaatgaaagaagtttgacattataataatggtagcgctttatgttaaaatgaatagtgagtaatcagcaatcaaattaaattggttgatagctgttaaggtttgtggttttgtctttgtgctatcgcncataaagtatataattaaagtagtttcgttattataaaatattaatatacatagtagatagtaatagagcatcaccatgggaacctattgagacacttattgatttaaagtggtattaatatgtcgtatttctcgaacgttccattattcattttaaaaagggggactgtatttgttatgacaacacaacatagcaaaacagatgtcatcttaattggtggcggtattatgagtgcacattaggaacattacttaaagaattatcacctgagaaaaatattaaagtgtttgaaaaattagcacaacctggcgaagagagttcaaatgtatggaataatgccggtacagggcattcagcactttgcgagttgaactatacaaaagaaggtaaggatggcacagttgattgtagtaaagcaattaagataaatgagcagtaccaaatttcaaaacagttttgggcatatttagttaaaacaggacaattagataacccagatcgctttattcaagcggtgccacacatgagttttgtcattggcgaagataatgtagcttttataaaaagtcgtgttgcaacgttaaagaaaagtattttattcgaaaaaatgaaattatcgcaagatgaagaagaaatgaaatcttgggtaccgttaatgattgaaggtcgtaagtctgatgaaccaattgctttaacttatgatgaaactggtacagatgttaactttggtgcgttaactgcaaagttatttgataatttagagcaacgtggtgtgggaattcaatataagcagaatgtattagacatcaagaaacagaaatctggggtatggctagttaaagttaaagatttagaaactaatgaaacgacaacatatgaatctgattttgtatttattggtgctggcggtgcgagtttaccattactccaaaagactgggattaaacaatcaaaacatattggtggtttcccggtaagtggattattcctgcgctgtacaaatcaagaagtgattgatcgtcatcatgctaaagtgtacggaaaagcagcagtgggtgcgccaccaatgtcagtgccgcacttagatacacgttttgtagacggcaagcgttcattgttatttggtccatttgcaggtttctcacctaaatttttaaaaacaggttcacatatggatttaattaaatcggttaaaccaaataatatcgtgacgatgttatctgcaggtatcaaagaaatgagtcttacgaagtatttagtgtcacaattgatgttatctaatgatgagcgtatggatgatttaagagtctttttcccaaatgctaaaaatgaagattgggaagtgattacagcagggcaacgtgtccaagtaatcaaggatactgaggattctaaaggtaacttacaatttggtactgaagttattacgtcagatgatggcacattagctgcattacttggtgcatcacctggtgcgtcaacagctgtagatattatgtttgatgttttacagagatgctatcgtgatgaattcaaaggatgggaaccaaagattaaagaaatggtgccgtcatttggttatcgcttaacagatcatgaggatttatatcataaaattaatgaagaagtaactaagtatttacaagttaaataataaacgaaacggtaatgtcttttttaatgtgatagacattaccgttttttagtggttaataaaaatcattttaattgtttcagttgcttgttaatagtgtctacgtagttcttgtttttaaagaattgaattatccaaattaatacataaaccacaatgaagataattgtgaatatgattagataatgcactgttagtggaaaccaaccggcaagcattgctaaaggcaagaatccgacatacgttgttatgaaatgcattatagttgctttagtaatgctccaatctgtgtatttaaagataaaatctccaaggaaaaagacgacgcctatgagtaaccataaaatgatagaaatcaacattacggtagtttctgtgaaatgcgtataatacaatatgccaatagttgattgtgggttcagtggataatatttgccgtctgcaaataacatactaaagaacagtgaaagggacaaaccaatgattaagctaataaataatgagtttttcaaatttttcatattgataagcgctcctttatagattttaaataacgtctagaagaataggtgtagtgtgcatctttaagatacatacgtataagtccatttggctctaataataatttttcaatgtaatacttgttgacgatttctgatttggaaatgcgaatgaaatgttgtggtaactgtttttctagttcataaagtcgtaattttagtttgaatttttgattgcttgtaatggctgttacatttttattaataacttggaatgttataacatctgatacattaatgatatggatttctttgtctatgtatccgactaatgtatgtgatttgtctaaatcattgactgcattaataatactttgaacgttatcattcattttaggtgcatgtatatcaatataagattccgtctcatttgcattgataaataaattgagtttcatcataggttaatgcctccttcaaaattattaaaccataaatgaccatcgatatatttaaattttgttgaatggtagaaattaaatgttaagtggctagaaagcgctaatcaatataaaagatacctcctgaaataaaaacagaaatgttttttcaggaggtagagattaaagtgaattatttggcagtgtaatagtaaaggtggttacatactcgttactttgtgtgaattggattgtaccatgatgcaattcaatgatggattttgtaattgcaagacctaaaccattgctattatcatgtttgctcactttataaaaacgttcaaataaacgtgcttcagcttgtggactaattggtgaaccatcattacttattgtgaaaatgatattgttgtgactatgttgcaaagcgatgtcaatggcaccaccaacatctgtatacttaatagcatttattaataaattactcaatgcttgatgtaacaaacgttgatttcctaggaaattgatgattctaggtcagctaanatgattaacgacttttcatcagcagcanattgttcatgtcgaatgatatcnttaatgagctg

SEQ ID NO: 159 - DNA, 1600 bp; double-stranded, linear
acaattattggattattatcaagcaacgttaatggatgacttccacttacaacagaaatgcccatagattctaaatcttttgcatgagcatcttgtgataagtcttttccatcattgacagttacattcgcacctaatttacttaataatttagctgcttcataaccactttttgccaaaccgacaactaatacatttttattttctaaccctgtataattaagcatcttaatgcactccaatccataaaccgattaaacctgaaatcagaccaacagcccaaaatactgtaactactttccattcgctccatcctatcaattcaaaatgatgatgaatcggactcattttaaatatacgctttccagtcaatttaaagctagcgacttgtaacataacagataatgtttcaattacgaatactaaacctataaaaattaatgataattcctgattaagcatgattgaaatggtagcaaatataccacctaaagctaagctacctgtatctcccataaacactttagcagggttaatgttatatggtaaaaatcctaaaagtgcaaacaacataatgatacagaaaataccaattgccgtttctcctaacacaaagctcatgatggcatacattgtaaatccgataattgacagtccagttgctaatccatctaaaccatctgttaaatttactgcattagaaaaacctacttgccaaaaaacaatgaaaataacatatgcaaatgatagtgggattgctacattcgtaaatggaatatgtatgctcgtagaaaaattcaccaaatgaaacacattacttaaaacaaagaatataatcgcaataccaatttgcgccaaaaacttctgtttacttgttaaaccttggttattctttttaacaacaataatataatcatctataaaaccaattaacccaaaaccaatcgtcacaaataataacagtatgattggattagcttgatctacaaatataatagccaccaaagacgttatcacaatacttaatagaaatgttagtccacccatcgttggtgtaccagtcttcttcatatggctttgtggaccttcttctcgaatactttgaccaaatttcatcctttttaatgtaggtattaaaacaggtaccaaaacaaatgtaatcactagcgctaataacgcatatacaaaaatcataactatctcctcttcttaatccagacttttttaaccactaatatattatcaatttttcaattaaataaacaaagttgtaatcaaaatttataatttttcttttttacggcataagaggccagtataaaaagtttgcctataacaaacaagttaatctgacctcgtctaccttaaaattctctatcaacacttatttataaagattaaatgaagatgttgttttctatcacagcattactttagtaaaaacaaatagtgacaatacatcctaatttaatgtagccattcttgttagtccgacttatccttgtcagttttactgtcagatttcntcttatcatctgaatttgaatcagaattattcgtcgaattgctgtctacattctctggatggaaaattctacgt

SEQ ID NO: 160 - DNA, 1186 bp; double-stranded, linear
attgcctttgttttaattttaaatcaaaatmgcctatgaaagatttaaatcaattaatttctataatattatcatttttaaagcatatcattgtttagtttttttataattggataaatactaatagttactttataaaacattacatagagaaaggttaaggagtgcacatgtcgaaaaaggatcactcttcttcaaaataccttaattctgttaaggaagcgcaagaggagtcaaaaaagaaaaataaaagtaatcccaaaattgatgttgatcgtacatatattgaacctcaacaattccaatctaagaaacctaaaaaagatgatcaggttttcttcttatcaagattaaataaacctgcaaaatataagaaagactctaatttcttatcatatctcatctatcgcataggaaaagatgatgcctcaggactagcagcacaaatgacttaccatttcgtacttgctatgttccctatgttgcttttcctattaacattattaccatttttcaatattaagcagagtcaaattactaatatgttaagcaatgcacccgctgaaacatctactctaattaagagtgtaattggtgatataactcaaaactccagtggtggcttattatctatcggtttgattttagcaatttggtcagcttcaaatggaatgactgcaattatgaattctttcaatgttgcttacgatgtagaagatagccgtaatggaatcgtattaaaactactaagtgttgtcttcactgtagttatgggcgttgtgtttgtagttgctctagcattaccaacgcttggttctgtaattagtcatttcctattcggtccacttggatttgacgaacaagtgaaatggatttttaaccttattagaattgtgttaccaatcattattatatttatcatatttatcgtgttatattcggttgcacctaacgttaaaacgaagcttaagtcagtattaccaggtgcagtatttacttcaattatttggttagctggttcatttggttttggttggtatatttcaaattttggtaactattctaaaacatatggcagtatcgcgggtatcatcattttgttactatggttatatatcacaagttttattataattgtcggngctgaaatcaatgcaatcattcatcagcgtagtgtaattaaagg

SEQ ID NO: 161 - DNA, 7872 bp; double-stranded, linear
tcttgagccatcttttgagctaactgactagattgatacccaaaaatcatagttaccaacataaactttaattttaccgaagtctaaatcagcgatatgagtacatacattatttaagaaatgacggtcatgcgatactacgataacagtattatcaaagttaattaagaaatcttctaaccaactgattgctggaatatcgagaccgttagtaggctcatccagtaatagtacgtctggttcaccgaataaactttgcgctaataatactttaattttttggttgttttctaattcagccatttttttatcgtgtaaagttggatcgatacctaaaccagataaaaggttagcagcatcagcttcagcattccaaccattcatttctgcaaattcaccttcaagttcagcagcacggataccatcttcatcactgaaatctggcttcatatagatttcatctttttctttcataacctcataaagacgttcgtgacctttaattacaacatcaagcacgcgttcatcttcataagcatagtggtcctgttttaaaacagctagacgttcatttttccctaatgaaacatgtcctgtttgagaatctaattcaccagataatatttttaagaatgttgatttacctgcaccattcgcaccaattaatccataacaattaccttctgtaaatttaatatttacatcttcaaatagtttacgatctccaaaacgtaaactcacatcagttacttgtaacatgcattttctcctttttttcattcgatattctaacggaagaattatatcatattatcgtcacagtttcgacctcatataagttgtaatgatagaatgactcacacatgttataataataaagaatacaagaatcgaaggagaataacatggcattagacaaagatatagtaggttctatagaattccttgaagtagtagggttacaaggttcaacttaccttttaaaaggaccaaacggtgaaaacgtaaagttaaaccaatcagaaatgaacgatgatgatgaattagaagtaggtgaagaatatagtttcttcatttatccaaaccgttcaggtgaattatttgcaactcaaaatatgcctgatattacgaaagataaatatgactttgctaaagtacttaaaacggatcgcgatggggcacgtatagatgttggattaccccgtgaagtgttagtaccatgggaagatttaccaaaagtgaaatcactatggccacaacctggtgattatttgctagttacattacgaattgaccgtgagaatcatatgtatggacgtttagcgagtgaatctgttgtagaaaatatgtttacacctgtacacgacgataatttaaaaaacgaagtcattgaagccaaaccttaccgcgtattacgaattggtagctttttattaagcgaatcaggttacaaaattttcgtacatgaatcagaacgtaaagctgaaccaagattaggtgaatctgttcaagttagaattatcgggcataatgataaaggtgagttaaatggttcatttttaccacttgcacatgaacgtttagacgatgacggccaagtcatctttgatttactagttgaatatgatggtgaattaccattctgggacaaatcaagccctgaagcgattaaagaagtattcaatatgagtaaaggttcattcaaacgtgcaatcggtcacttatataaacagaagattattaatatagaaacaggtaaaatcgctttaactaaaaaaggttggagtcgaatggactcaaaagaataatcatttttacacgtgtcgtaggatgcgtgttttttttattcaatattaaatcggacagatgaagtagttttttaaacattcctttcaaagtaaaaaattaaataattcaaacgaataggctgggacattaagttcttaggcaatgtaaaaaagctgatttctattaattatttgatggaaatcagcttttttgatatgtattttataatgtacagctcgttgagctgctattttccttatattaagtgccattaatacaaaacctagctctcgtttaactttatttattcctcgaactgacattcgagtgaaacccaaaatagccttcataaatccaaaaacaggctctacataaatttttctatgactatagatttttttcgtttctggttcagaaagcttttgattaatttgggctttaatgtatttcaaagtaaaattacatgttaatacgtagtattaatggcgagactcctgagggagcagtgccagtcgaagacaggggccccaacacagaagctgacatatagtcagcttacaacaatgtgccggttggggtggctgagacggcaccctaggaagggacccgtcatcaaaaattctatttatagaattttacagtaatgtgacagacgggcaaagcgaagccattcaatacgaagtattgtataaatagagaacagcagtaagatattttctaattgaaaattatcttactgctgtttttttagggatttatgtcccagccatttttgtattcatatttaaatttcgataatttttcaggaagcattttaattttactaatgaagcaatattttttagattaacaaaaattaatatttacattttcttaacaattttttatgtaacatttacagtttctaaaaatgaggttaataattcaaggttaagataaagatgtaatcaatacaaatactatttgttgttcatacagggaggatatttcaatgaaaaaatggcaatttgttggtactacagctttaggtgcaacactattattaggtgcttgtggtggcggtaatggtggcagtggtaatagtgatttaaaaggggaagctaaaggtgatggctcatcaacagtagcaccaattgtggagaaattaaatgaaaaatgggctcaagatcactcggatgctaaaatctcagcaggacaagctggtacaggtgctggtttccaaaaattcattgcaggagatatcgacttcgctgatgcttctagaccaattaaagatgaagagaagcaaaaattacaagataagaatatcaaatacaaagaattcaaaattgcgcaagatggtgtaacggttgctgtaaataaagaaaatgattttgtagatgaattagacaaacagcaattaaaagcaatttattctggaaaagctaaaacatggaaagatgttaatagtaaatggccagataaaaaaataaatgctgtatcaccaaactcaagtcatggtacttatgacttctttgaaaatgaagtaatgaataaagaagatattaaagcagaaaaaaatgctgatacaaatgctatcgtttcttctgtaacgaaaaacaaagagggaatcggatactttggatataacttctacgtacaaaataaagataaattaaaagaagttaaaatcaaagatgaaaatggtaaagcaacagagcctacgaaaaaaacaattcaagataactcttatgcattaagtagaccattattcatttatgtaaatgaaaaagcattgaaagataataaagtaatgtcagaatttatcaaattcgtcttagaagataaaggtaaagcagctgaagaagctggatatgtagcagcaccagagaaaacatacaaatcacaattagatgatttaaaagcatttattgataaaaatcaaaaatcagacgacaagaaatctgatgataaaaagtctgaagacaaaaaataataagacgcaatttcaaatgtgtcttgaaacatgattttgatggtgaatcattatttagagtacaaagcttgatttatcgagacgctgattttgacattcagttagtctacaagcttatcaacttaaaatagtggttcatcattattttacaaatctaattattttgggagtaatagaaagaggtttgattatgacttcatctactaatgttaaagctttaatcgaaaaaaataataataaaaaaggaaagcataatgacaaaattataccagttattttagccgcaatttcagcgatttccattttaacaacactaggtatattaatcacattgcttttagaaaccatcacttttttcaccagaattccaataactgaatttctattttctactacttggaatcctaccggttcagaccctaagtttggtatctgggcattgataatagggactttaaaaatcacagttattgcgactatatttgcagttccagtcgggcttggtgcagcaatttatttaagtgaatatgcaagtgaccgtgcacgacgcataattaaaccgatattagaaattttagcaggaataccaacaattgtgtttggtttctttgcattaacctttgttacaccagtattaagatctttcataccaggtcttggagagtttaatgctataagtcccggcttagttgtcggtattatgattgtccctctcatcacaagtttgagtgaggatgcaatggcatctgtaccaaataaaattcgagaaggtgcctatggacttggagcaactaaattagaagtagcaactaaagtcgtacttcccgcagcaacatcaggtattgtagcttcaatcgttctcgcgatttcaagagcaattggagaaacgatgattgtatcattagcggcaggtagttcgccaacagcttcattaagtttaacaagttcgattcaaacaatgactggatatattgttgagatagcgacaggtgatgcaacatttggatcaaatatttattacagtatttatgctgtagggttcacactatttatctttaccttaatcatgaatttactttctcagtggatttctaagcgttttagggaggagtattaatatggaaacgacagataataatagacaatcactcgtcgatcaacaacttgtccaaaaacatttatcatccagaacggttaaaaataaagtgttcaaactcatatttttagcatgtacattattaggacttgtcgtacttattgcgttgttaactcaaacattgattaaaggggtaagtcatttaaatttacagtttttcactaatttttcttcttcaacaccatctatggctggcgttaaaggcgcgttaatcggttcactttggttaatgttaagtatcattccattatcaatcatcctaggaataggtacagctatatacttagaagaatatgcgaaaaacaacaaatttactcagtttgttaaaatcagtatttccaatttagctggtgtaccatcagttgtatttgggttattaggttatactttgttcgttggtggtgcagggattgaagccttgaaaatgggtaacagtatattggcagcagcgctaacaatgaccttactgatattaccaattattattgtttcaagtcaggaagcaattagagctgtacctaactcagtacgcgaacttcttacggcttaggtgctaataaatggcaaacgataagacgtgttgtcttaccagcagcgttacctggtattttaactggattcattttgtctctttcaagagcactgggagaaacagcgccacttgtgctaatcggtataccgactatattattggcaacacctagaagtatattggatcaattttcagcattacctatccaaatatttacttgggcgaaaatgcctcaagaagaattccagaatgttgcatcggcaggcattatcgttttactagttatcttaatcttaatgaatggcgttgcgattattttacgtaacaaatttagtaaaaaattctaatttaaacaatcaatctcatttatctattaaaaagggagttttaaatatggcgcaaacacttgcacaaactaaacaaatatctcaaagtcatacgtttgatgtctcacaaagtcatcataaaacaccagatgatacaaactcacattctgttatatattcaacacaaaatttagacttatggtatggcgaaaatcatgcattacaaaatattaatttagatatttatgaaaaccaaattactgccattataggtccatctggttgtggcaaatcaacatatattaaaactttgaatcgaatggttgagttagtaccttctgtgaaaacagctggtaaaatattatatcgagatcaagacatttttgatcaaaaatattctaaagaacaattacgtacaaatgtgggcatggtctttcaacaacctaatccatttccaaaatcaatatacgataatattacttacggtccaaagattcacggtattaaaaataaaaaagttcttgatgaaatcgttgagaaatcattacgtggcgctgcaatttgggatgaattaaaggataggttgcacacaaatgcatatagtttatccggtgggcaacaacaacgtgtttgtatcgcgcgttgtttagcaattgaacctgaagtcattttaatggatgaaccgacatcagcattagatccaatctcaacattaagagtagaagagttggttcaagaactaaaagaaaagtatacaattattatggttacacataatatgcaacaagcagctcgtgtatcagataaaactgcatttttcttaaatggttatgtcaatgaatatgatgatactgataaaattttctctaacccatcaaacaagaaaacagaagattatatttcaggaaggtttggttgatatataatggcaataattagacaacgatatcaggagcaacttgatgatttaataaaagaattacgtcggttaggtgcaaatgtctatgtgagtattgaaaatggtataaaatcattaagtattgacgatagaggctttgcacgacaaacagttaaaaacgataaacatatcaatcaattaaattatgatattaatgagcgagttatcatgttaattacaaagcaacagcccattgcgagtgatttgcgtatgatgatttcttcattaaaaatcgcctccgatttagaaagaataggagataatgcctcgagtattgccaatattcgattgcgtacaaagattacagatgattatgtgttaacccgtttaaagacaatgggtaaattagctatgttaatgttaaaggacttagatcaagcatttaaaaagaaagataccgtattaataagagaaataattgagcgtgatgaagatatcgatgacttatatagtcatattattaacgcaacgtatcttattgataacgtccatttgtcgctgcacaagctcatttagcagcaagacatttagaacgtattggtgatcatattattaacatcgctgaaagtgtttatttttatttaacaggtacacattacgaacaataacttaaagttattactataaaatcccttacgataaatatatatttctattattcataaaccctcaaaaaaaccaagattctcacaattagtaatgtgaaaatcttggtttatattgttctactataaattgtctcgcatcttagttatttgcttgctcaatttcatctgttaatttttcaacttcatcgactaaatcagaaatatattgaattgtagatttaagtggctgttctgtagtaatgtctacacctgcaatgtttgcaagttcgacaggtgatacactaccaccttttttcaatgtttctaaccaagcatcaacagctggttggccttcatttttaatcttttgagaaacgacagttccgattgttaagccagcagaatacgtatacgaatataatcccatatagtaatgaggttgacgcatccatgttaattcagcaccctcagtcatgtctactgcatctccaaaaaattgtttataaacatttagcattatttcatttaatgtncggcgcatttaaagatt

SEQ ID NO: 162 - DNA, 798 bp; double-stranded, linear
ttttttcttttcttcatttgaaaattgatcattcagcaatataagcgtatttgttaatgatttaggtgttccaatttcataatcccaccaatttaagttggtattcttgccagttgttttagtaaaattctcacttaattcttttacttttttatctggttcttttccatatgcatttttatgcagccactcaagggcatctttcactttcttcttattttcgtcagtatttaaagtggttttaggattcctcatcgcttctgcgattttctcaatattacgataggtacgagtcatatgagaagaattagtttcaagggtttccgctcctgaccacaagtatttcctaccactttcagttttcatttccttgagtaaattcgtcgcctctttctctgtagcatcaaacttcttcttcatatctggattattctcatcatacttatcataaccatagttaacgtccagccatgtgttcctcaatttttcataatctggcgtttgaacattcgtatcagccacagcgatttgatgtttatcaacacttctgaattcaccaccattcaaagtaatcacaccagccattaataacgtaatggtggataatttttgccatttctttattctatatgtcattgacatgtctcctttttgtgttgcgcgtgcgcaatgaatattatgattaaataatgattcaatttttcaaaattcgttaacgtatacaaatgactgtctactgtcaaacaatccacaaagaatgttgatgtcatataaacaatcgatcacccaaattttccg

SEQ ID NO: 163 - DNA, 5132 bp; double-stranded, linear
tacaggttttactataatggatggtattttggctaaacgacattggtttagtcttctttttttnacttcctanatttacaatggtataaataataatgctatatttagaatgatgagtatacttactgaaactaaattaaaagtgtctggttctttactaaagatagctgctatccttgctatcaaacttggcaatgaaattaccaacacgatgagcgcataaattttctgtttaattaaaatacaagttccaatgagcgcaattaaaagtactaacccaacgatgaaactctgtttgtcacttaactcaaagaaactatagataggatattttttaataatcaagccacctaaaatcatccataaaaatacgataattccataagtcacatttataacatacgttattttttggtcaccaaatcggactaatgtatttcgtagaatcagcataccaatgacaacacctaaaataacgatactagctatataaagtaaaaatgcaattgtcacatcaaatgtacccaaatctaaaaacctaggaattayaaygactgctaaaataaaagcgaagyacaaagtaatatakttatacaaaccggtagtaagacttatctcaggtgataattgatcagccattgacttaatcggtgtattaataattgaacttgtatcttcgttatttttttcagccatagttaaatgatcttcgagctcttccaataactcttctacttctgcttcagtcttacctctaaataacaattcaacacgtaatttttctaaaaaatcttgagattgtttacttaacatcgttttcccctccaaacaagttaatcatccctttattcaaaacttgccatttcgatttaaatacttttagttcctttaaacctgaatcggtaatcgtatagtatttccgcctcgggccgccattactagatttttttattgtcgtatcaacgtatccttttttgtttaaacgcattaaaactggataaatactaccctcacttatctctggaaactcttgattcttaagtttcgtcataatttcatatccatacgtttcgccttgggcaatgagacctaatatcgccccatctaagagacctttcataatctgatctgacactgacattttaatcacctactatcttacataataagatagtacattgagaacttttcgtcaactatcttttattgtaaggtagttgttgtacacattccttaaatgactaacaactttgttaatagggtaatacttacggaagtatattttatttatgggggaggaattaataatgactacaaaaacagtatttgatgtcattgatatggggttaggatatttagtaaatgtgtatgatgcttggaaagttgaaaaggtacttgatgattatcataagcctttttctaataccattcattggcaatttggtcatgtattaacaatttttgaatcggccttagctgttgctggtaaagagaatattgatttaaatatctatagacctttattcggaaatggttcgtctccagatgaatggaaggatgaagtaccgagtattgaaaggattttagaaggtctccaaactttacctgaacgtgcacgaaatctaactgaagatgatttagcaattgaattgaaacagccaattgtcggttgtaataacttagaagagttattagtattaaatgccattcacatcccacttcatgctggtaaaattgaagagatgtctcgtatattaaaaaatttaaaataaatatgtgcttattaaccgttaacaacacgttaacgggttttttatttgtttaaaaggtcacttttttgaatttaataaacaccatctataccagttcttcaccgattctcgaaaaataattatattaatgatttcgttaatttaattttatatttaattattactgtacatcttttgtagttagctttattcttaaattgaaatatgtataaaacatagaaagaaggacgttttaacatggaaaacacggttaaatatcgtaagtttatactccctatcgttgtaggtctccttatttgggcacttacaccttttaaaccggatgctgtggatccaacagcatggtatatgttcgcaatattcgtcgcgacaatcattgcttgtattacacaaccgatgccaattggggccgtctctataattggatttacaatcatggtactcgttggcattgttgacatgaaaacggctgtcgctggttttggtaataatagcatttggttaattgctatggcatttttcatttcgagaggatttgtgaaaacaggtcttggtagacgtatcgcacttcatttcgtcaaattatttggtaaaaaaacattaggattagcatattctatcgtcggtgtagatttaattctagcgcctgctacaccaagtaataccgcgcgtgctggtggaatcatgttcccaattatcaaatcactttctgaatcatttggttcgaaaccgaaagacggatcagcacgcaaaatgggtgcatttcttgttttcacagaattccaaggtaatttaattactgcggctatgtttttaactgcaatggccggtaacccccttgcacaaaatttagcatctagcacatctaatgttcacattacatggatgaattggtttctagctgctttagttcctggacttgtttccttaattgttgtaccttttattatttataaaatttatccaccaactgttaaagaaacaccaaatgctaagagttgggctgaaaatgaattagcgactatgggtaaaatcgctttagctgaaaaatttatgattggtatttttgtcgttgcgttaacactatggattgtcggaagtttcattcatattgatgcaactttaacggcctttattgcgctagcattgttattattgacaggcgtcttaacatggcaagacattttaaacgaaacaggtgcttggaacacattagtatggttctcagtattagtgttaatggccgaccaattaaacaagcttggatttattccttggttaagtaaatccattgctacaagtcttggtggcttaagctggcctatagtcctggtcattttaatattgttctacttctattcacattacttatttgcaagttctacagcacatatcagtgcgatgtatgcagcattactaggcgttgccatcgcagccggtgcaccaccattattcagtgcattaatgttaggtttcttcggtaacctattagcttcaacaacacactatagtagtggtccagcgccgattctattctcttcaggttacgtgactcaaaaacgttggtggacaatgaacttaatattaggtttcgtctactttattatctggattggtttaggatcactttggatgaaagtaattggtatattttaaaatatttaaattagcgctcgaatctcattgatttgggcgctttttaatttgtatttaaaatcaacctttgctaaatcaagactccctttttaaaatacgtttatcctttaaatcattgcgtgcttcactgaaaatttgtataaagatttaagtcattacgtaacatcacataaaatacatttctatactattccgcttcattgattaacattacgtatgccctcataaatcatcatacaaaaaacaccttcgtttaaattcattttaattgcgaattcaacgaaagtgccttatttcatatttaatgtttcaaatttatacgtctgtcactgttactgcacacatacctcagtctcacctcatcatgacacaaaggatattgaaaacacgtataattatctttcctcgtattttatagggtttttgcgaccggatgtttcttcaatttaatgtattgagaaagactatataacacaatacctgtccaaataaatataaacgtaattaattgatctatactaaaaggctctttgaaaacaaatatgccgagtacaaacattattgttggtccaacgtattgaataaatcctattagcgaaagtggaatacgttttgccccggctgagaataggattagtggtattgccgtaatagcaccagaaaataacaaccaaaatgatgacatgttcaatccaaatgacatctgatgttgctgccataaataaataacgtatattagtccagcaggtgcggtaacaatacattcaatcgtaatactgctgatggcatcaatatgtactacttttttcaataatccgtatgtaccaaaggataacgctaatataatagagacgattgggaattctccaatcttgagcgtcatatataatacaccgatgaatgcgaataaaatggctagccattcaaatttattgaatctttcttttaaaaagataagtgcgagcaaaatgctaacaagtggatttatataataacctaaacttgtttgtaggacgtgaccgttcgttacagcccaaataaatgtaccccaatttaatgtaatgacatagcctgctacgacaatcgctaatagctgaatgggcttgcctaacaattgattcatatctcgttgaaatgcattgcgttgtttttgtccaaccgcgagtatgaaaatcatgaatattgctgaaaatataatacgaaaggctaaaatttcaaatgcgcctattgcatcaacgaactgccaatatataggtagtattccccacagaatgtatgcactgagtgctaaaaatatgccttttttatactctgaattcaccttcaaacctccttactttcctaatttttaatttactgcatacgctcacttggttatgctaatataacgattttactaataatatttcgataaagatatcattttgtttatatttcccacatttattcaccaaccactaaacaatattaattttataaataattctgtacaaatcagggtatattgccagaaagactaccatacaacataaaggatggatacaaatgactttacctaaaattggaaagcctgcaacacgcgcgctaaattcacaaggtatatacacattagaagcagtatcacaatatacgaagtcatctctaatggagatgcatggcgttggtcctaaagctatatcaatattggaacaagctttatttcag

SEQ ID NO: 164 - DNA, 22243 bp; double-stranded, linear
aagtaaattatattatgaatttgcctgtcaatttcttaaagacattcttaccggaactaattgaaaaaaatgtcaaagttgaaacaattggatttactgataagttgccaaaatcaacgatagaagcaattaataatgcymaagaaaagacagctaataataccggcttaaaattaatatttgcaattaattatggtggcagagcagaacttgttcatagtattaaaaatatgtttgacgagcttcatcaacaaggtttaaatagtgatatcatagatgaaacatatataaacaatcatttaatgacaaaagactatcctgatccagagttgttaattcgtacttcaggagaacaaagaataagtaatttcttgatttggcaagtttcgtatagtgaatttatctttaatcaaaaattatggcctgactttgacgaagatgaattaattaaatgtataaaaatttatcagtcacgtcaaagacgctttggcggattgagtgaggagtagtatagtatgaaagttagaacgctgacagctattattgccttaatcgtattcttgcctatcttgttaaaaggcggccttgtgttaatgatatttgctaatatattagcattgattgcattaaaagaattgttgaatatgaatatgattaaatttgtttcagttcctggtttaattagtgcagttggtcttatcatcattatgttgccacaacatgcagggccatgggtacaagtaattcaattaaaaagtttaattgcaatgagctttattgtattaagttatactgtcttatctaaaaacagatttagttttatggatgctgcattttgcttaatgtctgtggcttatgtaggcattggttttatgttcttttatgaaacgagatcagaaggattacattacatattatatgcctttttaattgtttggcttacagatacaggggcttacttgtttggtaaaatgatgggtaaacataagctttggccagtaataagtccgaataaaacaatcgaaggattcataggtggcttgttctgtagtttgatagtaccacttgcaatgttatattttgtagatttcaatatgaatgtatggatattacttggagtgacattgattttaagtttatttggtcaattaggtgatttagtggaatcaggatttaagcgtcatttcggcgttaaagactcaggtcgaatactacctggacacggtggtattttagaccgatttgacagctttatgtttgtgttaccattattaaatattttattaatacaatcttaatgctgagaacaaatcaataaacgtaaagaggagttgctgagataatttaatgaatctcagaactccttttgaaaattatacgcaatattaactttgaaaattatacgcaatattaactttgaaaattagacgttatattttgtgatttgtcagtatcatattataatgacttatgttacgtatacagcaatcatttttaaaataaaagaaatttataaacaatcgaggtgtagcgagtgagctatttagttacaataattgcatttattattgtttttggtgtactagtaactgttcatgaatatggccatatgttttttgcgaaaagagcaggcattatgtgtccagaatttgcgatcggtatggggccaaaaatttttagttttagaaaaaatgaaacactttacactattaggttattgcctgttggtggatatgttcgtatggcaggagatggcttagaagagccaccagtcgagcccggtatgaacgttaaaattaaacttaatgaagaaaatgaaataacacatatcatattagatgatcatcataagtttcaacaaattgaagcgatcgaagttaaaaaatgtgattttaaggatgacttattcatagaaggtatcactgcttatgataatgaaagacatcattttaaaattgctagaaagtctttctttgttgaaaatggtagcttagttcaaattgctccgagagacagacaatttgcacataaaaagccatggccgaaatttttaacattatttgcgggaccgttatttaactttatattagctttagtcctatttattggtcttgcatattatcaaggcacgcctacgtctactgtagaacaagtcgcagataagtatccagctcaacaagcaggattacaaaaaggtgataagatcgtccaaattggcaaatataaaatatctgaatttgatgatgttgataaggcgttagataaagttaaagataataagacgactgttaaatttgaacgtgatggtaaaacaaagtcagttgaattaacacctaaaaagactgaaaaaaaactgactaaagtaagttcagagacgaagtatgttctcggattccaaccagcgagtgaacatacactttttaaaccaattgtattcggatttaaaagctttttaatcggtagtacttatatttttacagctgtagtaggtatgttggctagtatatttacgggcggattctcatttgatatgttaaatggtccggttggtatttatcataacgtcgactcagttgttaaagcgggtatcattagcttaattggttncactgcgttattaagtgtaaacttaggtattatgaatttaattcctattcctgcactagacggtggtcgtattttatttgttatatatgaagcgattttcagaaaaccagttaataaaaaagcggaaacaacgattattgctattggtgccattttcatggtcgttataatgatattagtaacgtggaatgatattcgacgatatttcttataatttaggaggataaataattatgaagcaatccaaagtttttataccaacgatgcgtgacgtgccatcagaagcagaagcacaaagtcatcgtttattattgaaatcgggtttgataaaacaaagtacaagtgggatttatagttatttaccgctagcaacacgtgtgttaaataatattactgcaattgtgcgacaagaaatggaacgtatcgattctgttgaaattttaatgccagcgttacaacaagctgaattatgggaagaatcaggacgttggggtgcatatggcccagaattaatgcgtttacaagatagacatggaagacaatttgcattaggtccaacacatgaagaattagttacatcaatagtaagaaatgaattgaaatcatacaaacaattaccgatgacattattccaaattcaatctaaattccgtgatgaaaagagaccacgttttggtttaytcgtgggcgtgaatttattatgaaagatgcatattcattccatgctgacgaggcatcattagatcaaacgtatcaagatatgtatcaagcgtatagccgtatttttgagagagttggcattaacgcaagaccagtagttgcagattcaggtgctataggcggtagccatacacatgaatttatggcattaagtgctatcggtgaggatacaatcgtttacagtaaagaaagtgattatgctgctaacatcgaaaaagcagaagtcgtttacgarccaaatcataagcatactactgtgcaacctttagaaaaaattgaaacaccaaatgttaagactgcgcaagaattggcagacttcttaggtagaccagtagatgaaatcgttaaaacgatgattttcaaagttgatggcgaatatattatggttttagtgcgtggccatcatgaaattaatgacattaaattaaaatcttatttcggcacagataatattgaattagcaacacaagacgaaattgttaatttagttggtgcaaatcctggttcactaggtcctgtaattgataaagaaatcaaaatttatgcagataattttgtgcaagatttaaataatttagttgtcggtgctaacgaagatggttatcacttaattaatgtaaatgtaggtagagacttcaacgttgatgaatatggcgatttccgttttattttagaaggcgaaaagttaagtgatggttcaggcgttgcacattttgctgaaggtattgaagttggtcaagtattcaaattgggtactaagtattcagaatcaatgaatgctacattcttagataaccaaggaaaagctcaatctttaattatgggttgttacggaattggaatttctagaacgctaagtgcgattgttgaacaaaatcacgatgataatggaattgtttggcctaaatcagttactccgtttgatttacatttaatttctattaatcctaagaaagatgatcaacgagaactagcagatgcactatatgctgaatttaatactaaatttgatgtgttgtacgatgatcgtcaggaacgtgcaggtgttaaatttaatgatgccgatttaattggtttaccactgcgaattgttgttggtaaacgtgcatcggaaggtattgtagaagttaaagaacgtttaacaggtgatagcgaagaagttcacattgatgacttaatgactgtcattacaaataaatatgataacttaaaataattaagatcgaatgaattataagagtaggaaaaagctgaaagaaatctgatgcttatgtcctgctcttattatttttgatataatgattattcgatgaaaaatgactgaagacatagtataattaaagataaatttgttttaacaatataatgattagccaaatataaagcatttaattttctatcattactatgctcacataatctaaatattgttcgaacacgtaaaagtaatttctatttaaggtggtaattgtcttggcaatgacagagcaacaaaaatttaaagtgcttgctgatcaaattaaaatttcaaatcaattagatgctgaaattttaaattcaggtgaactgacacgtatagatgtttctaacaaaaacagaacatgggaatttcatattacattaccacaattcttagctcatgaagattatttattatttataaatgcaatagagcaagagtttaaagatatcgccaacgttacatgtcgttttacggtaacaaatggcacgaatcaagatgaacatgcaattaaatactttgggcactgtattgaccaaacagctttatctccaaaagttaaaggtcaattgaaacagaaaaagcttattatgtctggaaaagtattaaaagtaatggtatcaaatgacattgaacgtaatcattttgataaggcatgtaatggaagtcttatcaaagcgtttagaaattgtggttttgatatcgataaaatcatattcgaaacaaatgataatgatcaagaacaaaacttagcttctttagaagcacatattcaagaagaagacgaacaaagtgcacgattggcaacagagaaacttgaaaaaatgaaagctgaaaaagcgaaacaacaagataacaacgaaagtgctgtcgataagtgtcaaattggtaagccgattcaaattgaaaatattaaaccaattgaatctattattgaggaagagtttaaagttgcaatagagggtgtcatttttgatataaacttaaaagaacttaaaagtggtcgccatatcgtagaaattaaagtgactgactatacggactctttagttttaaaaatgtttactcgtaaaaacaaagatgatttagaacattttaaagcgctaagtgttggtaaatgggttagggctcaaggtcgtattgaagaagatacatttattagagatttagttatgatgatgtctgatattgaagagattaaaaaagcgacaaaaaaagataaggctgaagaaaagcgtgtagaattccacttgcatactgcaatgagccaaatggatggtatacccaatattggtgcgtatgttaaacaggcagcagactggggacatccagccattgcggttacagaccataatgttgtgcaagcatttccagatgctcacgcagcagcggaaaaacatggcattaaaatgatatacggtatggaaggtatgttagttgatgatggtgttccgattgcatacaaaccacaagatgtcgtattaaaagatgctacttatgttgtgttcgacgttgagacaactggtttatcaaatcagtatgataaaatcatcgagcttgcagctgtgaaagttcataacggtgaaatcatcgataagtttgaaaggtttagtaatccgcatgaacgattatcggaaacgattatcaatttgacgcatattactgatgatatgttagtagatgcccctgagattgaagaagtacttacagagtttaaagaatgggttggcgatgcgatattcgtagcgcataatgcttcgtttgatatgggcttcatcgatacgggatatgaacgtcttgggtttggaccatcaacgaatggtgttatcgatactttagaattatctcgtacgattaatactgaatatggtaaacatggtttgaatttcttggctaaaaaatatggcgtagaattaacgcaacatcaccgtgccatttatgatacagaagcaacagcttacattttcataaaaatggttcaacaaatgaaagaattaggcgtattaaatcataacgaaatcaacaaaaaactcagtaatgaagatgcatataaacgtgcaagacctagtcatgtcacattaattgtacaaaaccaacaaggtcttaaaaatctatttaaaattgtaagtgcatcattggtgaagtatttctaccgtacacctcgaattccacgttcattgttagatgaatatcgtgagggattattggtaggtacagcgtgtgatgaaggtgaattatttacggcagttatgcagaaggaccagagtcaagttgaaaaaattgccaaatattatgattttattgaaattcaaccaccggcactttatcaagatttaattgatagagagcttattagagatactgaaacattacatgaaatttatcaacgtttaatacatgcaggtgacacagcgggtatacctgttattgcgacaggaaatgcacactatttgtttgaacatgatggtatcgcacgtaaaattttaatagcatcacaacccggcaatccacttaatcgctcaactttaccggaagcacattttagaactacagatgaaatgttaaacgagtttcattttttaggtgaagaaaaagcgcatgaaattgttgtgaaaaatacaaacgaattagcagatcgaattgaacgtgttgttcctattaaagatgaattatacacaccgcgtatggaaggtgctaacgaagaaattagagaactaagttatgcaaatgcgcgtaaactgtatggtgaagacctgcctcaaatcgtaattgatcgattagaaaaagaattaaaaagtattatcggtaatggatttgcggtaatttacttaatttcgcaacgtttagttaaaaaatcattagatgatggatacttagttggttcccgtggttcagtaggttctagttttgtagcgacaatgactgagattactgaagtaaacccgttaccgccacactatatttgtccgaactgtaaaacgagtgaatttttcaatgatggttcagtaggatcaggatttgatttacctgataagacgtgtgaaacttgtggagcgccacttattaaagaaggacaagatattccgtttgaaacatttttaggatttaagggagataaagttcctgatatcgacttaaactttagtggtgaatatcaaccgaatgcccataactacacaaaagtattatttggtgaggataaagtattccgtgcaggtacaattggtactgttgctgaaaagactgcttttggttatgttaaaggttatttgaatgatcaaggtatccacaaaagaggtgctgaaatagatcgactcgttaaaggatgtacaggtgttaaacgtacaactggacagcatccagggggtattattgtagtacctgattacatggatatttatgattttacgccgatacaatatcctgccgatgatcaaaattcagcatggatgacgacacattttgatttccattctattcatgataatgtattaaaacttgatatacttggacacgatgatccaacaatgattcgtatgcttcaagatttatcaggaattgatccaaaaacaatacctgtagatgataaagaagttatgcagatatttagtacacctgaaagtttgggtgttactgaagatgaaattttatgtaaaacaggtacatttggggtaccagaattcggtacaggattcgtgcgtcaaatgttagaagatacaaagccaacaacattttctgaattagttcaaatctcaggattatctcatggtacagatgtgtggttaggcaatgctcaagaattaattaaaaccggtatatgtgatttatcaagtgtaattggttgtcgtgatgatatcatggtttatttaatgtatgctggtttagaaccatcaatggcttttaaaataatggagtcagtacgtaaaggtaaaggtttaactgaagaaatgattgaaacgatgaaagaaaatgaagtgccagattggtatttagattcatgtcttaaaattaagtacatgttccctaaagcccatgcagcagcatacgttttaatggcagtacgtatcgcatatttcaaagtacatcatccactttattactatgcatcttactttacaattcgtgcgtcagactttgatttaatcacgatgattaaagataaaacaagcattcgaaatactgtaaaagacatgtattctcgctatatggatctaggtaaaaaagaaaaagacgtattaacagtcttggaaattatgaatgaaatggcgcatcgaggttatcgaatgcaaccgattagtttagaaaagagtcaggcgttcgaatttatcattgaaggcgatacacttattccgccgttcatatcagtgcctgggcttggcgaaaacgttgcgaaacgaattgttgaagctcgtgacgatggcccatttttatcaaaagaagatttaaacaaaaaagctggattatctcagaaaattattgagtatttagatgagttaggctcattaccgaatttaccagataaagctcaactttcgatatttgatatgtaaaatgaaataatcaaggtatttatttaatgcgtatggcgtagtcaaagaaatacaaaattgttgctggacacaaaattatgcccgtatttcttttcaatgtcttacgagtctattcaaatgtaatggtgaaataaaggaacaaacttttacaagaatctctgattaatagtgaagtcatttgtttcaagcataaacttatgctataattaagttgcttaaaaattagtgaactcaggcagaagagtgggagattcccgctcttttctatttgccaaaaagggaggcctgtatgagtaaaattacagaacaagtagaagtgattgttaaaccaattatggaagacttgaattttgaacttgtagacgttgaatatgtcaaagagggtagagatcattttcttagaatctctattgataaagaaggtggcgtagatttaaatgattgtacgctagcttctgaaaaaataagtgaagctatggatgcaaatgatcctattcctgaaatgtattatttagacgtagcgtcacctggtgcagaacgtccaattaaaaaagaacaagatttccaaaatgcaataactaaacctgtatttgtttctttatatgtaccaattgaaggtgaaaaggaatggttaggcattttacaagaagtcaataatgaaacaattgtagtacaagttaaaatcaaagcaagaacgaaagatatagagataccgagagacaaaatagcaaaagcacgtcacgcagttatgatttaacgtgatgaggaggaaaaaacgtgtcaagtaatgaattattattagctactgagtatttagaaaaagaaaagaagattcctagagcagtattaattgatgctattgaagcagctttaattactgcatacaaaaagaattatgatagtgcaagaaatgtccgtgtggaattaaatatggatcaaggtactttcaaagttatcgctcgtaaagatgttgttgaagaagtatttgacgacagagatgaagtggatttaagtacagcgcttgttaaaaaccctgcatatgaaattggtgatatatacgaagaagatgtaacacctaaagattttggtcgtgtaggtgctcaagcagcgaaacaagcagtaatgcaacgtcttcgtgatgctgaacgtgaaattttatttgaagaatttatagacaaagaagaagacatacttactggaattattgaccgtgttgaccatcgttatgtatatgtgaatttaggtcgtatcgaagctgttttatctgaagcagaaagaagtcctaacgaaaaatatattcctaacgaacgtatcaaagtatatgttaacaaagtggaacaaacgacaaaaggtcctcaaatctatgtttctcgtagccatccaggtttattaaaacgtttatttgaacaagaagttccagaaatttacgatggtactgtaattgttaaatcagtagcacgtgaagctggcgatcgctctaaaattagtgtcttctctgaaaacaatgatatagatgctgttggtgcatgtgttggtgctaaaggcgcacgtgttgaagctgttgttgaagagctaggtggtgaaaaaatcgacatcgttcaatggaatgaagatccaaaagtatttgtaaaaaatgctttaagcccttctcaagttttagaagttattgttgatgaaacaaatcaatctacagtagttgttgttcctgattatcaattgtcattagcgattggtaaaagaggacaaaacgcacgtctagctgctaaattaaccggctggaaaattgatattaaatcagaaacagatgcgcgtgaagcgggtatctatccagtagttgaagctgaaaaagtaactgaagaagatgttgctttagaagatgctgacacaacagaatcaaccgaagaggtaaatgatgtttcagttgaaacaaatgtagagaaagaatctgaataataggttggagtgaagtatctatgaaaaagaaaaaaattccgatgcgaaaatgtattctttcaaatgaaatgcatcccaaaaaagatatgattcgtgttgttgttaataaagaaggcgaaatctttgcggatgttactggaaagaaacaaggccgtggcgcatatgtttctaaagatgttgctatggttgaaaaagcacaacaaaaagaaattttagaaaaatattttaaagcatctaaagagcaattggatcctgtttacaaagaaattattagattaatttatagagaagagatcccaaaatgagtatagatcaaatattaaactttttaggattagcaatgagagctggtaaagtaaaaacaggtgaatcagtcattgttaatgagattaaaaaaggaaatttgaagctcgttattgttgcaaatgatgcgtctgataatacagctaaattaattacagataaatgtaagagttacaaagttccattcagaaagtttggaaatcgaaatgaattgggaatagcacttggaaaaggtgagcgtgttaatgtagggattactgacccaggctttgctaaaaagttgctatcaatgatagatgaatatcataaggagtgattatatgagtaaacaaagaatttacgaatatgcgaaagaattaaatctaaagagtaaagagattatagatgagttaaaaagcatgaatattgaggtttcaaatcatatgcaagctttggaagatgaccaaattaaagcattagataaaaagttcaaaaaagaacaaaagaacgacaataaacaaagcactcaaaataatcaccaaaaatcaaacaatcaaaaccaaaataaagggcmacaaaaagataacaaaaagaatcmacaacaaaataataaaggcaacaaaggcaataaaaagaataatagaaataataagaaaaataacaagaataataaaccacaaaatcaaccagctgctccaaaagaaataccatcaaaagtgacatatcaagaaggtattacagtaggcgaatttgcggataaattaaatgttgaatcatcagaaattatcaaaaaattattcttacttggtattgttgctaatatcaatcaatcattaaatcaagaaacaatcgaattaattgccgatgattatggcgttgaggttgaagaagaagttgtgattaatgaagaagacttatcaatctatttcgaagacgaaaaagatgatccagaggcaattgagagaccagcagttgtaacaattatgggacatgttgaccatggtaaaacgactttattagattcaattcgtcatacaaaagttacagcaggtgaagcaggcggaatcactcaacatattggtgcatatcaaattgaaaacgatggcaaaaaaatcactttcttagatacaccgggacatgctgcatttacaacgatgcgtgcgcgtggtgcacaagtaacagatattactattttagtagtagcagctgacgatggtgttatgccacaaacaattgaagcaattaaccatgctaaagaagcagaagtaccaattattgttgcagtaaataaaattgataaaccaacttcaaatcctgatcgagttatgcaagaattaactgaatatggtttaattcctgaagattggggcggcgaaacaattttcgtccactttctgcattaagtggtgatggtatcgacgatttattagaaatgataggattagttgcagaagttcaagaacttaaagcaaatcctaaaaaccgtgctgttggtacagttatcgaagctgaattagataaatcacgtggtccttctgcatcattattagtacaaaacggtacattaaatgttggtgatgcgattgtagttggtaatacttacggccgtatccgtgcaatggttaatgacttaggtcaaagaatcaaaacggctggtccatcaacgcctgttgaaattacaggtattaatgatgtgccacaagctggggatcgctttgttgtatttagtgatgaaaaacaagctcgtcgtattggtgaatcaagacacgaagctagcattatacaacaacgtcaagaaagtaaaaatgtttcattagataacctgtttgaacaaatgaaacaaggtgaaatgaaagatttaaacgttattattaaaggtgatgttcaaggttctgttgaagctttagctgcatcattaatgaaaattgatgttgaaggcgtaaatgttcgtatcattcatacagcggttggtgcaattaatgagtcagacgtgacacttgctaatgcctcaaatggtattatcattggtttcaatgttcgtccagacagtggtgcaaaacgtgctgcagaagctgaaaatgttgatatgcgtttacacagagttatttataatgttatcgaagaaattgaatcagcgatgaaaggtttacttgatccagaatttgaagaacaagttatcggacaagctgaagttcgtcaaacattcaaagtttctaaagttggtactattgctggatgttatgttactgaaggtaaaattacgcgaaatgctggtgtacgtattattcgtgatggtattgttcaatatgaaggcgaattagatacacttaaacgtttcaaagatgatgctaaggaagttgcaaaaggttatgaatgtggtattacaaytgaaaactacaatgaccttaaagaaggcgatgttatcgaagcatttgaaatggttgaaattaagcgttaattaaataaattacaagctaaaagtatagttaagattgatatgctccctataaatattgcactttttaagtgtctactttatagggagcatatttgatactagcttttggttttttattagaatagattacctattaaaagttacgttatatggacatgattttgtataaaattttgtggtggcctagaatgatttttaatgacaaaatataatgtcgactattattggaaaattttctgttgaaatgcctatcttacggcaaactttatttgattttataggcttaatttattaaaataacgtgtgagctaaaataattgtttaagcattgttacactaaaaaatgcaaataacaattgaacttaaagataaagaggtgacaagaatgagcagtatgagagcagagcgtgttggtgaacaaatgaagaaggaattaatggatatcatcaacaataaagtcaaagatcctcgagttggttttattacaattacagatgttgttttaacaaatgatttatcgcaggctaaagtatttttaactgtattaggtaacgataaagaagtagaaaatacatttaaagcacttgataaagcaaaaggcttcattaagtctgaattaggttctagaatgcgattacgtattatgccggaattaatgtatgaatatgatcaatcaatcgaatatggtaataaaattgaacgaatgattcaagatttacacaaacaagatagataatttagtgttaggtatctggaaaatgtttgataatttcttaatatcggtatattaacattaaacagttaatacatagatgtgtagaaatagttaacattttccagtttttttatgaataaatttagttgatacgctattaaaatatattttaaaaaagaaggtgactatatgtataatgggatattaccagtatataaagagcgcggtttaacaagtcatgacgttgtattcaaattgcgtaaaatattaaaaactaaaaaaataggtcacacgggtacgcttgatcccgaagttgcaggcgtgttaccggtatgtataggtaatgcaacgagagttagtgattatgttatggatatgggcaaagcttatgaagcaactgtatcgataggaagaagtacaacgactgaagatcaaacgggtgatacattggaaacaaaaggtgtacactcagcagattttaataaggacgatattgaccgattgttagaaagttttaaaggtatcattgaacaaattccgccgatgtactcatccgtcaaagtaaatggtaaaaaattatatgaatatgcgcgtaataatgaaacagttgaaagaccaaagcgtaaagttaatattaaagacattgggcgtatatctgaattagattttaaagaaaatgagtgtcattttaaaatacgcgtcatctgtggtaaaggtacatatattagaacgctagcaactgatattggtgtgaaattaggctttccggcacatatgtcgaaattaacacgaatcgagtctggtggatttgtgttgaaagatagccttacattagaacaaataaaagaacttcatgagcaggattcattgcaaaataaattgtttcctttagaatatggattaaagggtttgccaagcattaaaattaaagattcgcacataaaaaaacgtattttaaatgggcagaaatttaataaaaatgaatttgataacaaaattaaagaccaaattgtatttattgatgatgattcagaaaaagtattagcaatttatatggtacaccctacaaaagaatcagaaattaaacctaaaaaagtctttaattaaaggagatagaatttatgaaagtcatagaagtgacacatcctatacaatctaaacagtatattacagaggatgttgcaatggcattcggatttttcgatggcatgcataaaggtcatgacaaagtctttgatatattaaacgaaatagctgaggcacgcagtttaaaaaaagcggtgatgacatttgatccgcatccgtctgtcgtgttgaatcctaaaagaaaacgaacaacgtatttaacgccactttcagataaaatcgaaaaaattagccaacatgatattgattattgtatagtggttaatttttcatctaggtttgctaatgtgagcgtagaagattttgttgaaaattatataattaaaaataatgtaaaagaagtcattgctggttttgattttacttttggtaaatttggaaaaggtaatatgactgtacttcaagaatatgatgcgtttaatacgacaattgtgagtaaacaagaaattgaaaatgaaaaaatttctacaacttctattcgtcaagatttaatcaatggtgagttgcaaaaagcgaatgatgctttaggctatatatattctattaaagkcactgtagtgcaaggtgaaaaaaggggaagaactattggcttcccaacagctaacattcaacctagtgatgattatttgttacctcgtaaaggtgtttatgctgttagtattgaaatcggcactgaaaataaattatatcgaggggtagctaacataggtgtaaagccaacatttcatgatcctaacaaagcagaagttgtcatcgaagtgaatatctttgactttgaggataatatttatggtgaacgagtgaccgtgaattggcatcatttcttacgtcctgagattaaatttgatggtatcgacccattagttaaacaaatgaacgatgataaatcgcgtgctaaatatttattagcagttgattttggtgatgaagtagcttataatatctagagttgcgtatagttatataaacaatctataccacacctttttcttagtaggtcgaatctccaacgcctaactcggattaaggagtattcaaacattttaaggaggaaattgattatggcaatttcacaagaacgtaaaaacgaaatcattaaagaataccgtgtacacgaaactgatactggttcaccagaagtacaaatcgctgtacttactgcagaaatcaacgcagtaaacgaacacttacgtacacacaaaaaagaccaccattcacgtcgtggattattaaaaatggtaggtcgtcgtagcatttattaaactacttacgtagtaaagatattcaacgttaccgtgaattaattaaatcacttggtatccgtcgttaatcttaatataacgtctttgaggttggggcatatttatgttccaaccttaatttatattaaaaaagctttttacaaatattaacatttattatatgttaagctaatattgagtgaataataaggttacaatgagataaagatgatataagtacacctagagtaataatcaagatattaaaaataaagtatgtttttttaaaaaatataacttatatttatactgataagggtgggacgataagtctattttgtaaataatagatggatatcccgctctctttttttccaattcaatattttataactaatattaaaatacgataataaatgatatgatataactattagattcaagagaggagatttataatgtctcaagaaaagaaagtttttaaaactgaatgggcaggaagatctttaacgattgaaacagggcaattagctaaacaagcaaatggcgctgtattggttcgttatggagatacagtcgtgttatcgacggcaactgcatcaaaagaacctcgtgatggagatttcttcccattaacagtgaactatgaagaaaaaatgtacgctgcgggtaaaattcctggtggatttaaaaagagagaaggacgtcctggtgacgatgcaacattaactgcgcgattaattgatagaccaattagacctttattccctaaaggatataagcatgatgttcaaattatgaacatggtattaagtgcagatcctgattgttcaccacaaatggctgcaatgattggttcatctatggcgcttagtgtgtcggatattccattccaagggccaatcgccggtgtaaatgtgggttatattgacggtaaatatatcattaacccaacagtagaagaaaaagaagtttctcgtttagaccttgaagtagctggtcataaagatgcggtaaacatggtagaggcaggcgctagtgagattactgaacaagaaatgttagaggcgattttctttggtcatgaagagattcaacgtttagttgatttccaacaacaaatcgtcgaccacattcaacctgttaaacaagaatttattccagcagagcgtgatgaagcgctagttgaacgtgtaaaatctttaaccgaagaaaaaggacttaaagaaacagttttaacatttgataaacaacaacgagatgaaaatcttgataacttaaaagaagaaatcgtcaatgaatttatcgatgaagaagatccagagaatgaattacttattaaagaagtttatgcaattttaaatgaattagtgaaagaagaagttcgacgtttaattgcagatgaaaaaattagaccagacggccgtaaacctgatgaaatccgtccattagattctgaagttggtattttacctagaacgcatggttcaggtctatttacacgtggtcagactcaagcactttcagttttaacattaggtgctttaggcgattatcaattaattgatggtttaggacctgaagaagaaaaaagattcatgcatcattacaacttcccgaatttttcagtaggtgaaactggtccagtacgtgcgccaggtcgtcgtgaaattggacatggtgcgttaggtgaaagagcattaaaatatattattcctgatactgctgatttcccatatacaattcgtattgtaagtgaggtacttgaatcaaatggttcatcatctcaagcgtcaatttgtggatcaacattagcattaatggatgcgggcgtaccgattaaagcaccagttgctggtattgctatgggccttgttacacgtgaagatagctatacgattttaactgatatccaaggtatggaagatgcattaggtgatatggactttaaagtcgctggtactaaagaaggtattacagcaatccaaatggatattaaaattgacggtttaacgcgtgaaattatcgaagaggctctagaacaagcgagacgtggtcgtttagaaataatgaatcatatgttacaaacaattgatcaaccacgtactgaattaagtgcttacgcgccaaaagttgtaactatgacaattaaaccagataagattagagatgttatcggacctggtggtaaaaaaattaacgaaattattgatgaaacaggtgttaaattagatattgaacaagatggtactatctttattggtgctgttgatcaagctatgataaatcgtgctcgtgaaatcattgaggaaattacacgtgaagcggaagtaggtcaaacttatcaagccactgttaaacgtattgaaaaatacggtgcgtttgtaggcctattcccaggtaaagatgcgttgcttcacatttcacaaatttcaaaaaatagaattgaaaaagtggaagatgtattaaaaatcggtgacacaattgaagttaagattactgaaattgataaacaaggtcgagtaaatgcttcacatagagcattagaagaataatatttaaagtcatatgacgacaatgtatcgtcatgtgatttttttatgccactttttacgaagtgacccgttttgaatttgttgtattgaacattttaaaacgctttattattttgtgtgcaactgttaattatcctgtatgtatagtgattaatagtgtacatcaagtgttttttaacttataatgaatagtgagtttatatatggacgggtaacaaatttaggaggtaagattttgagtttaataaagaaaaagaataaagatattcgcattataccattaggcggtgttggcgaaattgctaaaaatatgtatatcgttgaagtagacgatgaaatgtttatgttagatgctggacttatgtttccagaagacgaaatgctaggtattgatattgttataccagacatttcatacgtacttgaaaataaagataaattgaagggtatattccttacacacggacatgagcacgcgattggtgcagtgagttatgttttagaacaattagatgcaccagtatatggatctaaattgacaatagcgttaattaaagaaaatatgaaagcccgtaatattgataaaaaagttcgctactatacagttaataatgattcaattatgagattcaaaaacgtgaatattagtttctttaatacgacacacagtattcctgatagtttaggtgtttgtattcacacttcatatggtgccattgtgtatacaggtgaatttaagtttgaccaaagtttacatggacattatgcaccagatattaaacgtatggcagagattggtgaagaaggcgtatttgtcttaatcagtgattctactgaggcagagaaacctggatataatactccggaaaatgtgattgaacatcatatgtatgatgcttttgcaaaagtgcgaggtcgcttgatagtttcatgttatgcttcgaactttatacgtattcagcaagttttaaatattgctagcaagctaaatcgtaaagtgtcatttttaggaagatcacttgaaagttcatttaatattgctcgtaaaatggggtatttcgacattcctaaagatttgctaattcctataacagaagttgataattatcctaaaaatgaagtgataattatagctactggtatgcaaggagaacctgtagaagccttaagtcaaatggcgcaacataagcataaaattatgaatatcgaagaaggcgattctgtatttttagcaattacggcttctgctaatatggaagttatcattgcgaatacattaaatgagcttgttacgnctggcgcacatattattccaaataacaaaaagattcatgcttcaagtcatggttgcatggaagaattaaaaatgatgattaatattatgaaacctgaatactttattcctgtacaaggtgaatttaaaatgcagatagcacatgcgaagctagcagctgaagcaggtgttgcaccagaaaagattttccttgtggaaaaaggagatgtcattaattacaacggtaaagatatgatattaaatgaaaaggtaaattcaggaaatattttaatagatggcattggtattggggatgtaggaaatatcgtgttgagagaccgtcatcttttagcagaagatggtatctttattgctgttgtaacgttagatcctaaaaatagacgtatagctgcgggacctgaaattcaatctcgtgggtttgtatatgtacgtgaaagtgaagacttattacgtgaagcagaagagaaagtacgtgaaatagtagaggctggtttacaagaaaaacgcatagaatggtctgaaattaaacaaaatatgcgtgatcaaattagtaaactattattcgaaagtacaaaacgtcgtcctatgattattccagtaatttctgaaatttaatcaaaaagtcattaacataaaagaggtcagaacaagtcactgaaatataatggttgtcatggacaatttacttatattttatgatagtcaattgaaggggtaacgattaatctgttatcttaagtaaattgatacatagatgatattgttctaacctctttcatcgtctgtttggactacatattctaaacatcaaataggaaattatatataataacgtcgttttaactaaggcaacataaggaggtgcgtcaattggcacaagcaaaaaagaaatcgacagctaagaaaaaaacaacatcaaaaaaaagaacaaattcgaggaaaaagaagaatgataatccgatacgttatgtcatagctattttagtagttgtattaatggtgttgggtgttttccaattaggaataataggtcgtctaattgacagcttctttaattatttatttgggtacagtagatatttaacatatattttagtactcttagcaactggttttattacatactctaaacgtattcctamaactagacgaacggctggttcgattgtattgcaaattgcattgctatttgtatcacagttagtttttcattttaatagtggtatcaaagctgaaagagaacctgtactttcttatgtgtatcagtcataccaacacagtcatttcccaaattttggtggcggtgtattaggcttttatttattagagttaagcgtacctttaatttcattatttggtgtatgtattattactattttattattatgctcaagtgttattttattaacaaaccatcaacatcgtgaagttgcaaaagttgcactggaaaatataaaagcttggtttggttcatttaatgaa

SEQ ID NO: 165 - DNA, 5510 bp; double-stranded, linear
ttattaatnattaatatttttatttttaaaaataaagcgaggagctatcaatggaacaaattacttctgcacaaaataatagaattaaacaagcgaacaagctaaaamagaaacgtgagagggataaaactggattagctttaattgaaggtgtgcatttaattgaagaagcttatcaaagtggaattgtaattacacaattatttgcaattgaaccggcaagattagatcagcaaattawcgcatacgcgcaagaagtttttgaaataaacatgaaagttgctgaatctttatcaggtacagtgacaccacaagggtttttcgcaatcattgagaagccgcattatgatatttctaaagcacaacaagtattgctcatcgatcgtgttcaagatcctggaaatttaggcacattaattagaactgcggatgctgctggaatggatgctgtaataatggagaagggtacgacagatccttatcaagataaagtgttgcgagcgagtcaaggtagtgttttccatttgccagttatgacacaagatctcgatacgtttattactcaatttaatggtcctgtttatggtacagcacttgaaaacgcagtggcatacaaagaagttacttcaagtgattcttttgcattactattaggtaatgagggagaaggtgttaatcctgaattattagcacatactacacaaaatttaatcatacctatttatggtaaagctgaaagtttaaatgtagcgattgcaggtagtattttactttatcatttgaaaggttgaccgtgttgaaagttttccgatataattataattaattgtttaacagaacatttctacgtgaatgcatacacaattgaatataaaccaataaaaaggcatggacatttatataaataattgttttagggagaataatcgtgactgcaagttattccaattatttaaagtcttttcacctttttggttacttaaagagatttaagtcggaaagacaatccgttatcaatattaaacaagtgtatgcttaggcataaatttgggtggtaccacggaaatgactttcgtcccttattttttaagaggatgaaagtctttttttagttaaacaacaaatatgataaatagaaaatgaatagttcgaatagggaggtcagtgacatatgtctgaacaacaaacaatgtcagagttaaaacaacaagcgcttgtagatattaatgaagcaaatgatgaacgtgcactgcaagaagttaaagtgaaatacttaggtaaaaaagggtcagttagcggactaatgaaattgatgaaggatttgccgaatgaagataaacctgcgtttggtcaaaaagtgaatgaattgcgtcaaacaattcaaaatgaattagatgaaagacaacagatgttagttaaagaaaaattaaataagccaattggctgaagaaacaattgatgtatcattaccaggtcgtcatattgaaatcggttcaaagcatccattaacacgtacaatagaagaaattgaagacttattcttaggtttaggttatgaaattgtgaatggatatgaagttgaacaagatcattataacttcgaaatgctgaatttacctaaatcacaccctgcacgtgatatgcaagatagtttctatattacggatgaaattttattacgtacgcatacatcaccagtgcaggcacgtacgatggaatcacgtcatggtcaaggtccagttaaaattatttgccctggtaaagtgtatcgtcgtgactctgatgatgcgacacatagtcatcaatttacacaaatcgaaggattagttgttgataaaaacgttaaaatgagtgatttgaaaggtactttagaattgttagctaagaaattatttggtgctgatcgtgaaattcgtttacgtccaagttacttcccattcactgaaccttctgtagaagttgatgtgtcatgttttaaatgtaaaggaaaaggttgtaatgtgtgtaaacacacaggatggattgaaattttaggtgctggaatggtacatcctaatgtattagaaatggctggttttgattcttcagagtactctggatttgcatttggtatgggaccagaccgtattgcaatgttgaaatatggtatagaagatattcgtcatttctatactaatgatgtgagatttttagatcaatttaaagcggtagaagatagaggtgacatgtaatgttgatatcaaatgaatggttgaaagaatatgtaacaatcgatgattctgtaagtaatttggcagaacgtattacgcgcacaggtattgaagtggatgatttaattgactacacaaaagatatcaaaaatttagttgtcggcttcgttaagtcaaaagagaaacatcctgatgctgataaattaaatgtttgccaagttgatatcggagaagacgaacctgtacaaatcgtttgtggtgcaccgaacgttgatgcaggacaatatgtcattgttgctaaagtaggtggcagattgcctggtggtattaaaattaagcgtgccaaattacgcggtgaacgttcagaaggtatgatttgttcgttacaagaaattggtatttcaagtaactatataccgaaaagttttgaatcaggcatttatgtatttagtgaagcccaagttccaggaacagatgccttacaagctttatatttagatgatcaagtaatggaatttgatttaacgccgaatcgtgcagatgctttaagtatgataggtactgcttatgaagttgcagcattatataatacaaaaatgactaagccagagacaacatcaaatgagcttgatttatctgcaaatgatgaactgactgtgacaattgaaaatgaagataaagtaccatattatagtgcacgtgttgttcacgacgtgacaattgaaccctcgccaatttggatgcaagcacgcttaataaaagcgggtatacgtcctattaataatgttgttgacatttcaaattatgtgttattagaatacggtcaaccattgcacatgtttgatcaagatgcgattggttcacaacaaattgttgttcgtcaagctaatgaaggcgaaaaaatgacaacattagatgatacagaacgtgaattattaacgagcgatattgtcattactaatggacaaactccaattgcattagctggtgttatgggtggcgatttttcagaagttaaagaacaaacatcaaatatagtgattgaaggtgctatttttgatccagtttcaattcgtcatacatcaagacgtttaaatttacgcagtgaatcatctagtcgttttgaaaaaggaatagctactgaatttgtagatgaagcagtcgaccgtgcatgttatttattacaaacttatgcaaacggaaaagtgctaaaagatagagtgtcttcaggagaacttggtgcatttattacaccaatcgacatcactgctgataaaattaatcgcactattggatttgatttgtcacaaaatgatattgttactatttttaatcaactagggtttgatacagaaataaatgatgatgttattacagtgctagtaccatcacgtcgtaaagatattacaattaaagaagatttaattgaagaagttgcacgtatatatggatacgacgatattccatcaacgttacctgtcttcgataaagttactagtggtcagctaactgatcgccaatataaaactagaatggttaaagaagtgttagaaggtgctggattagaccaagctattacgtattcgttagtttctaaagaagatgctactgcattttcgatgcaacagcgtcaaacaattgatttattgatgccaatgagtgaagcgcatgcgtcattacgtcaaagtttattaccacatttaatcgaagcggcatcatataatgtggcacgcaaaaataaagatgtaaaattatttgaaatcggcaatgtcttctttgctaatggagaaggtgaactaccagatcaagttgaatatttaagtggtattttaactggagattatgtagtcaatcaatggcaaggtaagaaagaaacggttgatttctatttagcaaaaggtgtcgtggatcgagtatctgaaaagttaaatcttgaatttagttatcgccgtgctgatattgatggattacatccaggtcgtactgctgaaatcttattagagaataaagttgttggttttattggtgaattacatccaatattagcagctgataatgatttaaaacgtacgtatgtttttgagttgaattttgatgcattaatggctgtgtcggtaggttacattaattaccagccaattccgagattcccaggcatgtctcgtgacattgcattagaagtagatcaaaatattccagcagctgatttattatcaacgattcatgcacatggtggcaatatattaaaagatacacttgtctttgatgtatatcagggcgaacatttagaaaaaggtaaaaaatcaattgcaatacgtttaaattatttagacacagaagaaacattgacagatgagcgcgtttcaaaagtacaagcggaaattgaagcagcattaattgaacaaggtgctgttattagataatgatttaaaccccatgtataaggatatctgaagtagattgatatccctaacatggggttttatttttgggttcaccaatttggttccaatgcatttaaaaagtcaaagaggaacagcggaatacagatgatgcttcgcacaactgcataaaagcctctaatgattaaaaatcaaagaggctttaaaattttttgggctttttcacgatttttaaaatgcttttttgaaatggtatctaaacgtgaaagaccgtatttttttataattttggcggcgattacatcgactttagcaccggcacctttaggaatcgtcatattaatattttttgatatttgatccatatatgtaacaaatgcgtatcgagaaattatgcttgccactgcaatggctaatgacttcgattctccttttgtttcaaattttgttttctttggaagtggtatatctgataatgcgtaatggctatacacttcgcgttttgcgaactgatcaatgacgatatagtctaattgagacgaatcaattttttcaagtacatttttgatggcttcattatgaagggcagctttcatttttacttgagtccagccttttgcttgctgaatattatatttttcattgtgtagtgttaataatgaatgtggtatgaaagtaaccaattgctcagcaagttctacaattttggtatcggttaatttttttgaatcatctacacccaaagtttttaaaatagggacatgctctttggtaacgaaagcagcacacacagtcaacggaccaaagtaatcgccacttccagcctcatcactaccaatacagttaaattgrtcatacattaaagttgtccagaaaagaattagccatatttnccttt

SEQ ID NO: 166 - DNA, 9623 bp; double-stranded, linear
gnttatacttataaattttacgggggtaatataatacttatttacctgtaatatatgataattcttcagcggcagctgcgttgatagttctatgagaaatgatacctaatcctttaacattggattctgaaataacgatagaaccatcactgttaactttttcaacaaatgctacatgaccgtaatgttgatctgcaccaaattgtccagcctcaaatacaacagcagcatgacgttttggtgtatgacttacttgataatcacggtattgagctcgattattccaattatgtgcatcacctaaatcacctgagatagatgtaccaaattgtttcatacggttatatacgtaccaagtacattggccatgtggatatggcatactatcagatacctcacggaaaggtttgaattcatctgatgaatcatcataatccttgatagaacgttcatatttatctaaatctggcatgcgttcatcgtcaaactgagttaattgatagtgtttaataatactgtttaatttcttagcatagtttggatctgtagcatatgttttagataagtgtgatgttgcatctttataagaatcggcttccgatttccatgttggtttataaattgttcgattgccatcaataccatttttaataaggtcagagtaatcttttagtgattctttcgtgcttggatattttcggaatccagcattaatactatacaattgattaccatcagcttctaatgtgttaaaaggaacagaattcccttcaaaagcacctttgataccgaataaattatggtttggtgacwtagctaaagcactacgacctgagtcagattctaagattgcttgggcaatcatgacagacgcataaatatcgttatcttgaccaatgcgatgtgcatctttagcaattgatttgacaaattgacgtgtatcttttgagtcaacaacgttaaattgtccgctatcatcattgttagatatactaggatctgtttcgaataatgatgttgcacgtgtatccttttgattaacatcgttattgaatgattgagcaggtttagatttatgtttcaattcatcttgtgttggtaactgtggattctttgtattagatttttcatttttgtcttttttagattgagatgcataatctttttgtgttttctttgcatcttcactgtattgatccaaaatagagtctaaagccgaatctgacattgattgattatctttcgatgaagatttttgatttgctttatcgtcacttgctggttgactatttgattgattaggttgtgttggctttggcgaatttggttgcttattagatgtacttggttttgtattgtttgatttaggtgctttttgattgtctgctttatcttgtttagatgattgcgtatcagtgtcatttttgatgctattgtcactgtttttattcgaatcatttgttgacttttcgccattacgaggttgttcgtaatcagaaatatccgaatttaaattgaataagttttggattaaagttgttaatgagtaattatcatcgtatttatttttggttagcaattggtttatattggtttgtggtaaattcttataaataaaatcaatgatattgttagagtctgaagtgctgtcgtctatagttttaaattttttgtcgttattgtcttggttacttgtattatttttgtctgctttatcaatatctttacttgtagtatccttagaagtttcatcgtcattagatttttttgaatcatgagatgttgtcttagctgtagtatctttttgaggtgtatcagcataagcggtaggtgaaactaaagtaggtaatacgagcgtagttgatagcaaataaattaaaattttatttttaggcatatttcgtattctcccttgaaaaatataataattaagtgtgataataaactatgatttgttataatttatcgtatgctgaaaatagttgataggtatcaatcgactaaatatcttccagtaaattgattatactaattcacaacgcaaaaataaattaatttacaaaaaatatataaaaaatatgaataattcctacataggagtgtgacaatgaagaacgcatttaaattatttaaaatggatctgaagaaagtagctaagacgccagctgtgtggattatcttagcaggcttagctattttgccatcgttctacgcttggtttaacttatgggcaatgtgggatccatatggcaacacgggacacatcaaggtcgcagtcgttaatgaagataaaggcgacacaatcagagggaaaaaagttaatgtcggtaatacgatggttaatacactcaagaaaaataaaagttttgattggcagtttgtaagtagagagaaagctgatcatgagataaaaatgggtaaatattttgcaggtatttacatcccatctaagtttacacatgaaattacagggacactacgtaagcagcctcaaaaagcagatgtagaatttaaggtgaatcagaagattaacgctgttgcgtctaagctaacagatactggttcgtcagttgtcgttgaaaaagcgaatgaacaatttaataaaacagtaactcgagcattattagaagaagctaacaaagcaggtttaactattgaagaaaatgtgccgacaattaacaagataaaaaatgcggtatattcagcagataaagctttacctaagattaatgactttgcgaataaaattgtatatttgaataaccaccaagcggatttagataaatatgccaatgattttagaaaactaggaaattataaaggtgatattttagatgctcagaaaaaattaaacgaagtcaatggtgctattccgcaacttaatgaaaaggctaagttgatattagctttaaataattatatgccgaaaattgaaaaagcgttaaattttgcagctgatgacgtgccagcgcagttccctaaaattaatcaaggacttaacattgcgagtcaaggtattgatcaagctaatggacagttaaatgatgccaaaggcttcgtcacacaagttagaagtagagtcggtgattatcaagatgcaattcgacgcgcgcaagatttaaatcgaagaaaccagcaacagattcctcaaaatagcgcggcgaacaacgaaacatcaaatagtgcacctgcagctggtaatggtgtagcatcaacgccaccaagtgcaccaagtggcgatactgcaccaaataataatgttacgcaaaataccgcaccaaatagtaataatgcgcctgtatcgactacaccacaaagtacaagcgggaaaaaagatggtcaaagttttgtagatataacaacaacacaagtcagcacagctaacgagaacacacaaaacattacagataaagatgttaaatcaatggaagcggcattaacgggctctttattatcattatcaaataatttagatacccaagcgaaagccgcacaaaaagatagtcaggcattacgtaatatttcgtatgggattttagcatcggacaagccttctgattttagagagtctttagataatgttaagtccggtttagaatacacaacgcaatataatcaacaatttatcgatacattaaaagagattgagaagaatgaaaatgttgatttatcaaaagaaattgataaggtaaaagcagctaataatcgaattaatgaatcattaaggttagttaatcaattaagcaatgcattaaagaatggtagttcaggaactgctgaagctactaaattactagatcaactttcaaaactagattcatcattatcatcatttagagattatgttaaaaaagatcttaacagctctttagtatcaatatcacaacgtattatggatgaattgaacaaagggcaaactgcattatccaatgttcagtctaaattaaatacaattgatcaagtcattaacagtggacaagctattttaaaaaatggtaaaacacgtattgatcgcttacaaacagtattaccaagtattgaacaacaatacattagtgctgttaaaaatgctcaagcaaacttctcgaaagtgaaaagtgatgtagctaaagctgctaactttgtgcgcaatgacttaccacagttagaacagcgattaactaatgcgacagcaagtgtgaataaaaatttaccaacgttattaaatggttatgatcaagcggtaggattactaaataaaaatcagccacaagcgaaaaaggctttatcagatttagctgatttttctcaaaataaattgcctgatgttgaaaaagatttgaaaaaagcgaataaaattttcaagaaattagacaaagatgatgcagtcgacaaattaatcgacacacttaagaatgatttgaaaaagcaagcgggtattattgcaaatcctattaataagaagactgttgatgttttcccagttaaggattatggttcaggtatgacaccattctatactgcactgtcagtatgggtaggtgcactcttgatggtaagtttattaacggttgataataaacataagagtctagagtcagtcttaacgacaagacaagtgttcttaggtaaggcaggattctttataatgcttggtatgttgcaagcactcattgtatcggttggagatttgttaatcctaaaagcaggagttgagtcacctgtattatttgtacttataacgattttctgttcgattattttcaactcaatcgtatatacgtgcgtatcattacttggtaacccaggtaaagccattgcaatcgtattgcttgtattacaaattgcaggtggtgggggaacattcccaattcaaactacgccacaatttttccaaaacatttcgccatacttaccatttacgtatgcaattgattcattacgtgaaacagtaggcggtattgttccggaaatcctaattacaaaattaattatattaacgttatttggtataggattcttcgttgtaggtttaattttaaaacctgtaacagatccattgatgaagcgcgtatctgaaaaagttgaccaaagtaacgttacagaataaaaattaaatccacacattagggttatagctccttaatgtgtggatttttatgtttttagacagaagagatagtaatttctgtcttttatgggacggttgttatcattgctattatccaggatgacttactatagcactaatattaccgacaaagtgaatatcctcgtcttccgtagttaaaataaagctagaacctttttggatgtcatagtgcttatcgtttactgttaaagtaccagtaccatcgataattgtaactaagcaataagcatgtggtttattgaattttaaatctccatgaatatcccatttatatactgcaaaatattgattatctacaaattgagttacagtgtgtgtgtcgatgtgagttgttataggagtagtatttggttcatgattgcctaattcaatcacatctttactttgctctaagtgcaaatcacgcaattgaccattttgatctcgtctatcatagtcataaatacggtatgtcgtatcggaggattgttgtgtctctaaaattaaaatacccgaaccaatggcatggacagtgccagcaggaacataataaaagtcaccgggcttaacaggtatacgtttgaaaagactgtcaaattcatgattatcaatcatgtctattaacgtctgtttattatgtgcatgtacgccatatataatttcagcacctggggctgcatctaaaatataccaacattctgttttacctagttcgccttcgtgttttaaagcgtagtcatcatctgggtgaacttgaacagataatttatcattggcatctaatactttagttagcagagggaaactatctcgtgaatcattatcgaataattcacgatgttgtgaccaaagttgatctagggtcatatccttgtatggaccattgataattgtattaggaccatttggatgtgcagaaattgcccagcattcaccagttgtttcattagggatatcatagttaaatgcttttaatgcatgaccgccccaaattctgtctttaaaaacgggttgtaaaaataatgccatagttaaaactcctctatattttcattaataagttataaatttctgtagtactgtttgcattaattagtgattggcgtgtctcatcattcattaacgctttagataagcgctgaagtatttttaaatgtgtatcctgactgttgtttggtacggcaattaagaatatcaattgaggtagactaccatctagactgtcccatttaacaccatgattatttttcataacagctacaatcggttgttttacaacatcagactttgcatgtggaatggccacgttcatgccaatagctgtcgtagmtccatttcacgttctagtattgcattttttaaatgcgatgtgtgctctacataacggcaaattttaagtttatgaatcaacatatcaattgcttcgtttcgagacatgtcgtgatcagtaattatcatagtttgttgatcaaaaacatgagaaggtttattgagatgtgaatgtttcgcggtgttatctacattgtcaacctctgtatcatgttgtgtaatatctgtatcatgaagttgcgtgtgttgcgctggtgcatctactgctataactggtgtattgcgttttaataatagtacagtagtcattgtgacaagactacctactatcactgcaaagataaaccataatacatgatcaataccacctaatacagccacgattggacctccatgtgcgactctatcgccgacaccaccaatggctgcaatgactgatgcaatcattgcaccaatgatgtttgcaggtataatgcgcaatggatcttgggctgcgaaaggaatagcaccttcagtaataccaaatagtcccatagtgaaggaagccttacccatttctctttcggaatgattgaatttatacttttgaacaaacgttgctaaacctaaaccgattggtggtgtacatacagcaactgcgaccatacccataacggcgtaattaccttcagcaataagtgctgagccaaataaaaatgctaccttgtttactggaccgcccatatcgaaggcaatcatcgcacctataatcatcgcaagtataataatattagcaccttgcatactttttaaccaggttgttaatgcctcaaaaatattagaaattggtgcaccgattaaaaatataaatatcaatcctacaacgaccgatgaaataatgggaataataatgataggcataattggtgccattgcttttggaactttaatatctttaatccactttgcgatataacctgctaagaaaccagcaacaataccacctaaaaatcctgcgcctgcatcactgccataaaaactaccgtcagcagcgatagcgccgccaatcataccaggaacaagaccgggcttgtcagcgatactaacagcgatatatccagctagtattggaaccataaatttaaaggctaaactaccaatgttttcaatggatttccaaaatgaatcatctgggatgactaatccttttgatgtcgtttcaccgcctagagtcagcgcgatggcgataaggagtccaccaactacgataaaaggaaccataaacgatacaccgttcattaaatgttgatacaccatttgaataccatttttagacttaccgcgatctttcgaatgataatttgtttcagattgataaataggcgcatcttgattaatgatacgttgaattagacctctcggattatgaatcccttcgcgaacattttcattaatcaaccgtttaccaacaaatcgggacagatcaacttgtttatcagctgcaattatgacaccgtcagcttcttcgatgtcttgcgtagttaaaacattttcagcaccaacaccgccctgtgtctctactttaatatccacacccatttcttttgctacctgctcaagcttttcttgagccatatatgtatgtgcaatgccatttgggcatgaggtaatagctacaattttcataaaatcatctccttttctatattgtaagcgtattctcgatactaaaaaaaagaataattaccgttactagtggcaattattcttgtaagtattcaaataactgttgctttaaactatgatcatctaaactacataaatggttcactgaatcatcatccaagttagcaattaattgcatcatttgttttgtaaaagctttgtctttatgcgaaatcgctaagaaaaagacaagtttgacatcgtgttgtcgccaaggaaaaacatcttttgtgcgaaaaataagcacatgtgattgtaaaactttttcaggatctccatgaggaatcgccataaaattacctatgtatgtagaagatgatttctcacgctctaaagctgattcgatatatccttctacaatcgcatgatgtgcttgtaatattttttgagcttcttcaaaaatttgcacagtatgccgtgatttttgttcagtatttacgacaaggaaattgacagtgtccatatgatgatgtgcttgaaccggattttgcttttgcttcacaacgtgtctgattttgtgacgatcatcttcagaaaataatggtgcaaccttgatagtcgtcaggtgcttaggaagtatgtttagcgtttgtttaggaatatcatgggtcgttattaataaatctacattgtcaaagtgatagtgtgttatattttctagtttaatcgtatttatcactgacaactcttcggataagttatttattttagtttctaaaaaattcgacacacctagaccataataacaagcaatgactacatttaattgtgttttggtacgacgctcgatggcagcttgaaaatgaattgttaaaaatgcaatttcatcttcgctcatctctatatcagtatcaattgctaatttatcaatcgcttcaaaaagtgtgttaaacacaaagggatagagttttttaatctctataactaaaggattgtttaaataaatgttttgagtgatacgtaaatatgctttactaaaatgattatataaattttgttgtaaaatcgaatcttcattgaaaggtacatgaatacgttgctgcatcaattcgattaagcgatcaatataactttgtataaatatacgttctatgccaatatcgagtttattaaaatgataagcaataaagaatgaaaacatattgattactttttcgttcaagtcataacctaatctttcgttgatttgcttaatgcaagattgagatatcaattttgaatcgtggtttaacgtgtctagctcacttaaagatygcttacgtttaatgattaaaatgagatgaattaaaagctgttgtatttgaatatcagttgtttcaatactatgttgttgaagtgtctcttgtataatatgcgaaatcatcctttggtgtgaatcaggtaattcatttaaaattaggtcttcaacatgtacatgccctgatgataattgatttaaatggatgatggcattagtgatatcattatctgttccatcgac

SEQ ID NO: 167 - DNA, 1021 bp; double-stranded, linear
accgtggaaacacgtctagtcaatcagaaagcgataaaaatgtgactaaatcatctcaagaggaaaatcaagcaaaagaagaattacaaagcgttttaaacaaaattaacaaacaatcaagtaagaataattaaaaaattttgatattgtctatgtttatagttcacaagccattcaacgtattgtaaactaaggatagtgtatttttttaatagtaatttgtcaggaggtgcctatctatggaagaacattactacgtaagtattgatattggatcatcaagcgtaaaaacaatagtaggcgagaaatttcacaatggtataaatgtgataggtacaggacaaacctacacgagcggtataaaaaatggtttaattgatgattttgatattgcgcgacaagcaatcaaagacacaattaaaaaggcatcaatcgcttcgggtgttgatattaaagaagttttcctgaaattacctatcattggaacggaagtttatgatgaatcaaatgaaatcgacttttatgaggatacagaaatcaacggttcacatatcgaaaaagtattagaaggtattagagaaaaaaatgatgtgcaagaaacagaagtaattaatgtgttcccgattcgttttatagtcgataaagaaaatgaggtttcagaccctaaagaattaattgccagacattcattaaaggttgaagcaggcgtaattgctattcaaaaatcgattttaattaatatgattaaatgcgtagaagcatgtggtgttgatgtattagatgtttactctgatgcatataactatggttcaatcctaacagctactgaaaaagagttaggtgcatgtgtcattgatattggtgaagacgttacgcaagttgctttttatgaacgcggtgaattagtagatgctgattctatcgaaatggcagggcgtgatattacagacgatattgcacaaggrttaaacacttctnatgaaactgctgnaaaaagttaaacaccaatntggtcatgcat

SEQ ID NO: 168 - DNA, 7963 bp; double-stranded, linear
taatctattataaaaactgtccataccctttgattaccttctcttcaggtacaggccacacttgaggccataagccatatgcttgctgtgaataaaattgtgccatttgtaacaatataatatatacaaataaacacccaataattgctgtcactaatggatatgataaccaaaccattaataaaactgcaataattactaacctaaagataatattaaatgcgtctctccctcttataaagcttctaataaataagaataaatacatcgcattagagttaaatttactaccctttggaactggtaaaagtatatctagataacttcttctgactgcagattctttcaaatgttttacatcggtgaacatattaacaaatttataataattcatatgatgtcgatgttcgattgcaatcattttctcccaaggatacaaaaagcctggtttatattttttaactaaaaattctattaacacaggcaaagcaaccatcacaaatgcgatgtaccattttggagctaatagtaagtaatatgttagagcaaaggtgatgaatgatattaaattaacttgccatgttttaagtcccgattgataccattgccatcttaagcgtaaaccaacatatggaaaaattaatgcactgactccaaaacaaatataaaatgccacattatgttgattaatattgtaaaacaacgggaacattacaataacaataatgagttggattaatatgcgcgcaaagtaactatataaaatcgcatgacgcataaattgagacatgtgtttttcaaatggtaataaaaagattttatccgcttcttttaacagtggtcscmttggaaaaatagrtgtcaacgcaacaatcactgctgctattaatgaaaaattgatattcgttggaatatgttttaaccattcaccatatccaraaataaatgcacccagcaaaataagtaaaaagaccatgaaatgaccattaaatataaacttattataataatttttctctttacgaagggcatgtaatcttttattaaataatgtggtagcttggttacgcatgtacatctccaccttgcgtcacatgaatatatatatcgtctaatgtttgattatgtaagccagtttgttgtctcaatgcttctaaatctccaaatgcaacgacttcaccttcgtctagtatgataaaacgatcacagtaacgttcagctgttgctaaaatatgtgtactcattagaacggttctaccttcgtttttcttttcaaccattaaatctaacatggattgaattcctaatggatctaggccaaggaatggttcgtctataatatacaattcgggattaacgataaacgcacaaataatcatgactttttgtttcatccccttagaaaaatgactcggaaaaactttcaactcattttctaaacggaatgtctttaataatggcattgctcgattcatcgtttcatcacgatcaatatcatatgccattgctgtcatctcaatgtgttcctctaatgtgagttcttcataaataaccggtgattccggaatataagataactttcttctataagcctctatgtcatcattaatgttgatatctgaaattgatagagatccttccataggtgtaagcaatcctagcatatgtttaatcgttgtactcttaccagcgccattaaggccaataagtccaacaatttcgcctttgtttaattcaaaatttatatctttaattacagggcgttttccatatccacctgtaagctgttctactttaactgtcataaggcacctccatgacttatattgtaccaaaaattataaaatgctcatattaaatacacatgtcctaatatcgaatttttagcgacaatgttataatgaatggtaatactagttgaaaaggagtgtagtcatcatgtcagaaacaattttcggcaaaattttaactggagaaattcctagctttaaagtatatgaagacgattatgtctatgcctttttagatatatcacaagttactaaaggacatacgttattaattcctaaaaaagcttctgctaatatctttgaaactgatgaagaaacaatgaaacatatcggtgcagcattacctaaagtagcaaatgctattaagcgtgcatttaatcctgatggtttaaacattattcaaaataatggtgagtttgcagatcaatctgtatttcatattcatttccacttaattcctcgatacgaaaatgatattgatggatttggttataagtgggaaacacatgaagacattttagataacgatgcaaaacaacaaattgctgaacaaattcaagcacaattttaaatgtatgcttaatctaagctcgaacgggtataatatgattaatattataacaattgcgtttgaagtgataacatcaaggttagcaattttaaacaaaatgagttatcaagataacagatgttaaaagtgaggagaatataaatgaaagcatcacgcattctattcggtatcggtgttggcgtagcagctggttttgtagttgcacttcaaggacgtgacgacaaaagtgtcaagaacaacacgatcgatcgtactgcccctactggttcaaaatcagaactacaacgtgaatttgaaacgattaaacaaagttttaatgacattttaaactatggtgttcaaattaaaaacgaaagtgcggaatttggtagttcaattggtggtgaaattaagtcattacttggaaacttcaaatctgacattaatcctaatattgaacgtttacagtcacacatcgaaaatttacaaaatcgtggcgaggatattggaaacgaaatttctaagtagcaggttacgttctcgatcacaactatttttattagtaacagcatatttattttttaaaattaaatgccaaataaacgagatgacattagaaattagatatttcttgtcatctcttttttaaaactcaaatgaacttatgtttacaaattataggaagacattgtttgtagtgattttcgcttaaatcatatttatgaattgattgaaaacattgcttaggattcattgtgttatccttgcactttgattacgctttacttaaatcattatcgacaaacaacatacttatattttcattgagccgaaccttatatacacattacatataccttacttgcacaaattattaatctggtgtttattataattacatatcactatatttttagcatttgtataacttagttggtcaaaagatgcttttgcatatgccctgccatatccattttttatattattcaagttttcaaatactcatgtcacacgcgcctttttcataagtgatgctttattagcaagaatatgtgttcgcagaaatttgttctgcattctacttctacgctagtcaatcagacaattttaccaatccccactttcgcgtttcaaatcaaacaatacgtcgctcctttcttcttatataacaattcttctaacatgatatgttactattgaattactgaacctgagttagttataatctaacttatattgaaaagagatgaggcgtaagatatgtttttatgtaaaagacaaattgatatcaatgcacgatttggtttgcctagaattgcatttatgagtgcagttgcaaccatcattatgtttttagttagttatgaagtaatgtattttttatctaatacgccattatcagatagacattttctcatctttttattacttgtatttatgacgtatccattacataaaagtatacatttattatttttcttaccatatagaaaatcgtttaaagttcataagttaactaaaagaaaatggcttatattctataatacctacgtcaatcaacctgtacacaaattttatttttgcattaacttaatattgccgttaattatcttatctgcaatgttcgtttatctaacaatttcattcccgcaatatggacattattttatgttcttattggcattgaatttcggtatttccattacagatttattatatttaaaaataattatattttctaattatggacaatatatagaagaacatagtacaggtattaatattttgaaaaaaattaaaaatccatatcatttataacaaaataattatagcaaggtgttattatttgtttttaggctatgtaatagcttacaatcaaatgtatatagaccttgtttttttattttcatcaatttctacccctaaacctaatgctctagtctgatgtcatgggttattgattggtgataatataaaactatgttatattcacgatgattaacttacaaaggagtttcaactatgaagatgataaacaaattaatcgttccggtaacagctagtgctttattattaggcgcttgtggcgctagtgccacagactctaaagaaaatacattaatttcttctaaagctggagacgtaacagttgcagatacaatgaaaaaaatcggtaaagatcaaattgcaaatgcatcatttactgaaatgttaaataaaattttagctgataaatataaaaataaagttaatgataagaagattgacgaacaaattgaaaaaatgcaaaagcaatacggcggtaaagataaatttgaaaaggcccttcaacagcaaggtttaacagccgataaatataaagaaaatttacgtactgctgcttatcataaagaattactatcagataaaattaaaatctctgattctgaaattaaagaagacagcargaaagcttcacacattttaattaaagttaaatctaagaaaagcgacmaagaaggcttagatgataaagaagcgaaacaaaaagctgaagaaattcaaaaagaagtttcaaaagatccaagtaaatttggtgaaatcgctaaaaaagaatcaatggatactggttcagctaaaaaagatggcgaattaggttatgttcttaaaggacaaactgataaagattttgaaaaagcactatttaagcttaaagatggtgaagtatcagaggttgttaaatcaagctttggatatcatattattaaagctgataaaccaacagactttaacagtgaaaaacaaagcctgaaagaaaaattagtcgatcagaaagtacaaaaaaatccaaaattattgactgatgcatacaaagatctattaaaagaatacgatgttgactttaaagatcgtgatattaaatcagttgtcgaagataaaatcttaaaccctgaaaaacttaaacaaggtggcgcacaaggcggacaatccggcatgagccaataacacaaaaccgagcgaccgtggttcaaaaatcataccacggccgctcggttttttcgcattaaaaatcggacagatgagctcatgtttcagtatactcatctgtccgatatcttttaattcttaatcgagtgattcaggattgtagaatctacgattttcaagaccaaatattttatctgtaaactgacccttgtcagtttttttatatgccttttcaaacatattcattctagcatcgatattatcgatatagcataaaatttctgcttcttttaagtatggcagttttggagaaccatactctaacttaccatgatgagataaaatcatatgtcttaacaacatgatttcttctccttcaatgttcaattcacgagctgcttcaactacttcatcactcgcaatcgagatgtgtcctaataagttaccttcgactgtatacgacgtcgcaacaggaccactcaattctctaactttaccaatatcatgcaaaataataccactatataacaaacttttgtttaacaatggataaatgtcacaaattgattttgcaatacgtaacatcgttaatacatgatagcttaagccactcgcaaagttatgatgatgagaactagcagctggatatgtgtaaaatcgttcttgatattttttcaataaatgacgtgtgatacgttgtaaattagcattttcaatatctagcaaataatgagaaatctcttcttgtatttctgccggtgataaaggtgcaccatctacaaattgttctgtttttaattgatcttcagttgtcgctagtctaatttggttgactttcatctgtttatttccgcgatagtttatgatgtcacctttaacatgtacaatttcttcaggcttgattgttgccatatcattttttgtagccgtccaaaatttcgcttcaatttcaccacttttatcttgcaaatgtaatgtcatataatctttaccttgtgctgttacaccctgtgtagctttatgcactaagaaaaagtgatcaactgaatctccgggatttagattctctatatttctcatcgtttcccgccttcctctattttgtttaatgtaatcacttcttttgatggaacaatattatcttttacacatgtaaagtatagtacttgatagtgttctgataatgatcgtaaataattcaacattttttcagtacgttttttatcaaaatgaacaaatgcatcatcaacaattaatgggaacggataatatggtcttagtaccttaattaaactgatacgtaaagctacataaagtaattcttttgtagattgacttagttcaacaggatcatataattgaccattaacatgtttaaccgtaattgaatcttcattatagttaatcatcgtatatctgccatctgttaaatgcttcaatatttctaccgcttcattaataacttgaggcaaacgtttatctttaatttgtttaatgtgttcatcaactaaactttgtaaataacttaaacttgcccaatcttttgcgatatcattaagttgatttttaagactgtgatattcatgtcttaaattagcaagcgttgtatcagtttccatgtgattgatttgtgcacttaaatcactgacttgtgcttgcatttcaagatattgctcattatattcgtcaacttgagtagccaataaatgatcttcttcttcaagttgtgcagttgttttttcacttaaactagaacttaattcataagaatagttttggttctcaagatatttagttaaatcattaaaacgactcaaattactagtataagtttggtaatcttcatgatgttggtaaaaatcttcttcagtaccaacattgataaaatcgaatagtgctgtaatttctttattattttcttctaattgagcatttaaatgatttaattcatttgtaacaagtttggtattttcagcattaatacgccatttttcattcgtgtcttcagctgatttcaaccattgttgcacatcgtggaataaagataatttgttgaaataaacaaattgtgattttgtaacagcttcagcatgattgtagaatgtatctaattcttgaaccaattgctggcgttgttgatttaaatcactgatatgttgatctaatgctttaatattcgccattgtagaaatactatcaacaattaaatcatttgaaattttagatgataagtataattcatccttaacgttctcaactgtcgattgtaattcatcatgacgccctttcgcatcatttaaacgaccttcaatatactgacgtttctcttctaaaatatctttatttttcaaagcttgttgccagtgatcacgaatgcgatattgctcatcaagatcaaaatctaagtcataattttcatctaaaatggctagttgtgctttaatttcttcgatttcatctgtgatggcctcgctataatctacttcttttgatttagacatgatgataccgataacaaatactaaagttaatactgcgaaaataataccaaacaacatgttgtttgaaataaatgagaaggcagttaaaccaatacctactaatgttaaaagrataaacgttgttcgkaacaatttttgacgtttttgtttttctt

SEQ ID NO: 169 - DNA, 3958 bp; double-stranded, linear
atattgtctttacaatagtttgctatggaggtaattaaccaataggaggaatttataatggcagtaatttcaatgaaacaattactagaagcgggtgttcmcttcggtcaccaaacacgtcgttggaacccaaaaatgaaaaaatatatcttcactgagagaaatggtatttatatcatcgacttacaaaaaacagtgaaaaaagtagacgaggcatacaacttcttgaaacaagtttcagaagatggtggacaagtcttattcgtagganctaaaaaacaagcacaagaatcagttaaatctgaagcagaacgtgctggtcaattctacattaaccaaagatggttaggtggattattaactaactataaaacgatctcaaaacgaatcaaacgtatttctgaaattgaaaaaatggaagaagatggtttattcgaagtattacctaaaaaagaagtagtagaacttaaaaaagaatacgaccgtttaatcaaattcttaggcggaattcgtgatatgaaatcaatgcctcaagcattattcgtagttgacccacgtaaagagcgtaatgcaattgctgaagctcgtaaattaaatattcctatcgtaggtatcgttgacactaactgtgatcctgacgaaattgactacgttatcccagcaaacgacgatgctatccgtgcggttaaattattaactgctaaaatggcagatgcaatcttagaaggtcaacaaggcgtttctaatgaagaagtagctgcagaacaaaacatcgatttagatgaaaaagaaaaatcagaagaaacagaagcaactgaagaataatcaactgttgaatctgacttagatatagtttaaatgggtgataagatattaatgcttatcaccttttttaaaaagaaaatcgaggcaaattacaaatattcaattagagtattggcaatcttgcctataataatgctaaaatcataatatataanatgataacttattggaggaataatgaatggcaactatttcagcaaaacttgttaaagaattacgtgaaaaaactggcgcgggtatgatggattgtaaaaaagcgctaactgaaactgatggtgacatcgataaagcgattgactacctacgtgaaaaaggtattgctaaagcagctaaaaaagcagaccgtattgcggctgaaggtttagtacatgtagaaactaaaggtaacgacgcattatcgttgaaatcaactctgaaacagactttgttgctcgtaacgaaggtttccaagagttagttaaagaaatcgctaatcaagtattagatacaaaagctgaaactgttgaagctttaatggaaacaactttaccaaatggtaaatcagttgatgaaagaattaaagaagcaatttcaacaatcggtgaaaaattaagtgttcgtcgttttgctatcagaactaaaactgataacgatgctttcggcgcttacttacacatgggtggacgcattggtgtattaacagttgttgaaggttcaactgacgaagaagcagcaagagacgttgctatgcatatcgctgcaatcaaccctaaatatgtttcttctgaacaagttagcgaagaagaaatcaaccacgaaagagaagttttaaaacaacaagcattaaatgaaggtaaaccagaaaacatcgttgaaaaaatggtggaaggacgtttacgtaaatacttacaagaaatttgtgctgtagatcaagmttcgttaaaaaccctgatgtaacagttgaagctttcttaaaaacaaaaggtggaaaacttgttgacttcgtacgctatgaagtaggcgaaggtatggaaaaacgcgaagaaaactttgcggatgaagttaaaggacaaatgaaataatctgtcataaagtaaaacaaggaagaagacacctttaatgttgctttattaaaatgtaaatcattctaataaaacgacaactgtgtcttctttacttgtatatgttacatatattcacgatagagaggataagaaaatggctcaaatttctaaatataaacgtgtagttttgaaactaagtggtgaagcgttagctggagaaaaaggatttggcataaatccagtaattattaaaagtgttgctgagcaagtggctgaagttgctaaaatggactgtgaaatcgcagtaatcgttggtggcggaaacatttggagaggtaaaacaggtagtgacttaggtatggaccgtggaactgctgattacatgggtatgcttgcaactgtaatgaatgccttagcattacaagatagtttagaacaattggattgtgatacacgagtattaacatctattgaaatgaagcaagtggctgaaccttatattcgtcgtcgtgcaattagacacttagaaaagaaacgcgtagttatttttgctgcaggtattggaaacccatacttctctacagatactacagcggcattacgtgctgcagaagttgaagcagatgttattttaatgggcaaaaataatgtagatggtgtatattctgcagatcctaaagtaaacaaagatgcggtaaaatatgaacatttaacgcatattcaaatgcttcaagaaggtttacaagtaatggattcaacagcatcctcattctgtatggataataacattccgttaactgttttctctattatggaagaaggaaatattaaacgtgctgttatgggtgaaaagataggtacgttaattacaaaataaatttagaggtgtaaaataatgagtgacattattaatgaaactaaatcaagaatgcaaaaatcaatcgaaagcttatcacgtgaattagctaacatcagtgcaggaagagctaattcaaatttattaaacggcgtaacagttgattactatggtgcaccaacacctgtacaacaattagcaagcatcaatgttccagaagcacgtttacttgttatttctccatacgacaaaacttctgtagctgacatcgaaaaagcgataatagcagctaacttaggtgttaacccaacaagtgatggtgaagtgatacgtattgctgtacctgccttaacagaagaacgtagaaaagagcgcgttaaagatgttaagaaaattggtgaagaagctaaagtatctgttcgaaatattcgtcgtgatatgaatgatcagttgaaaaaagatgaaaaaaatggcgacattactgaagatgagttgagaagtggcactgaagatgttcagaaagcaacagacaattcaataaaagaaattgatcaaatgattgctgataaagaaaaagatattatgtcagtataaaactaatatacaatgacatattaaaatgccagtattaaacgataatgtaacatttaaaatgggcatgtttaattaaatcaaagatgcatgtgataatttaaattcacaatgagcataaaaatggtgtttaaacaagttaattaaacatatactttataaataataggcattaggtatattgctataataaagttatgtaatttttaacctcagtatgtatgtcacatttctggtgtaaactgtaccgagtcagactttggtacagtttttttatttgcttattcaatgcattaaatgagtatgataaaatgataatgattgtttagtaacttatactatatgacagagatgatcaggctcggaggaaagaccatgtttaaaaagctaataaataaaaagaacactataaataattataatgaagaattagactcgtctaatatacctgaacatatcgctattattatggatggtaatgggcgatgggctaagaagcgaaaaatgcctagaattaaaggtcattacgaagtatgcaaacaataaaaaaaattactagggtagctagtgatattggtgttaagtacttaactttatacgccttttccactgaaaattggtcaagacctgaaagtgaagtaaa

SEQ ID NO: 170 - DNA, 5333 bp; double-stranded, linear
attaaaacaacttaatatacctatttatggtggtcctttagcattaggtttaatccgtaataaacttgaagaacatcatttattacgtactgctaaactaaatgaaatcaatgaggacagtgtgattaaatctaagcactttacgatttctttctacttaactacacatagtattcctgaaacttatggcgtcatcgtagatacacctgaaggaaaagtagttcataccggtgactttaaatttgattttacacctgtaggcaaaccagcaaacattgctaaaatggctcaattaggcgaagaaggcgttctatgtttactttcagactcaacaaattcacttgtgcctgattttactttaagcgaacgtgaagttggtcaaaacgtagataagatcttccgtaattgtaaaggtcgtattatatttgctaccttcgcttctaatatttaccgagttcaacaagcagttgaagctgctatcaaaaataaccgtaaaattgttacgttcggtcgttcgatggaaaacaatattaaaataggtatggaacttggttatattaaagcaccacctgaaacatttattgaacctaataaaattaataccgtaccgaagcatgagttattgatactatgtactggttcacaaggtgaaccaatggcagcattatctagaattgctaatggtactcataagcaaattaaaattatacctgaagataccgttgtatttagttcatcacctatcccaggtaatacaaaaagtattaacagaactattaattccttgtataaagctggtgcagatgttatccatagcaagatttctaacatccatacttcagggcatggttctcaaggtgatcaacaattaatgcttcgattaatcaagccgaaatatttcttacctattcatggtgaataccgtatgttaaaagcacatggtgagactggtgttgaatgcggcgttgaagaagataatgtcttcatctttgatattggagatgtcttagctttaacacacgattcagcacgtaaagctggtcgcattccatctggtaatgtacttgttgatggtagtggtatcggtgatatcggtaatgttgtaataagagaccgtaagctattatctgaagaaggtttagttatcgttgttgttagtattgattttaatacaaataaattactttctggtccagacattatttctcgaggatttgtatatatgagggaatcaggtcaattaatttatgatgcacaacgcaaaatcaaaactgatgttattagtaagttaaatcaaaataaagatattcaatggcatcagattaaatcttctatcattgaaacattacaaccttatttatttgaaaaaacagctagaaaaccaatgattttaccagtcattatgaaggtaaacgaacaaaaagaatcaaacaataaataatcaaaaagctactaactttgaagtgaagttttaattaaactcaccacccattgttagtagctttttctttatatatgatgagcttgagacataaatcaatgttcaatgctctacaaagttatattggcagtagttgactgaacgaaaatgcgcttgtaacaagcttttttcaattctagtcaggggccccaacatagagaatttcgaaaagaaattctacaggcaatgcgagttggggtgtgggccccaacaaagagaaattggattcccaatttctacagacaatgtaagttggggtgggacgacgaaataaattttgagaaaatatcatttctgtcccactcccgattatctcgtcgcaatatttttttcaaagcgatttaaatcattatcatgtccaatcatgattaaaatatcacctatttctaaattaatatttggatttggtgaaatgatgaactctttgcctcgtttaattgcaataatgttaattccatattgtgctcttatatctaaatcaatgatagactgccccgccatcttttcagttgctttcaattctacaatagaatgctcgtctgccaactcaagataatcaagtacacttgcactcgcaacattatgcgcaatacgtctacccatatcacgctcagggtgcacaaccgtatctgctccaattttatttaaaatctttgcatgataatcattttgtgctttagcagttactttttttacacctaactcttttaaaattaaagtcgtcaacgtacttgattgaatattttcaccaattgccacaatgacatgatcaaagttacggatacctaaacttttcataactgcttcatctgtagtgtctgcaacaaccgcatgagtagcgatatcactatattcattcactctattttcatcatggtcgatggccattacatccatgtctaatgcattcaactcacgaacgatactacctccaaaacgacctagaccgatgactacatattctttacccatactcgccctccattaaatgattttcatcaattcattgaaaatataaatttaaaattattataaatgagtaccccaactaaattatctaaatgcagtaatgcaagtaaatgaaagttggggtatcgtctcaacttatgatttctttccttcaacatattctttgtcgaaaacaaataatcttaataataatattaacgatggaagtaataaaagtaaacctaaaataaagacaatcactaatgtccagcccatttctggattaacatatgcatctgtaatttttacaaacggatataaaaggtatggcaatttactaattccatagccaaagaacgcgaacatcatttgtaaaataacaaatacaaaagccaaaccatgttttttcttaaagaatgttaacaatgaagctaatgcaaagaataagaaacttataccaaacatccaccaatagtcaaaaacagctgaataaaaatgttcagaattttgaatgcgtaatgatagaaatacgaataaacaaatgataatcatcggcggccctaaaaatatgtgccattgtcttgttaaattatatgctggttcgtcatttgcttttttagcataatatgtcaaaaatcctgatgaaatatataaaactgaaataattgccaagaatactacagaccaagcaaatgggcttaataataactgcacccaatctagatcgataacattgtttcgaacattaatatagccaccttctgtaatagttaaagcagtagataatgaagctggaattaataatccacttaccccatacatgatcatccatgctaattttgtatcttgaccataattttcaaatgcataaaaactgtttctcaacgatatcataatcagtgctattgaacctggtattaacaataccgtgcctaaatatttgattgactctggaaagaaacctacgaatcctacgaagaagaaaacaaagaatacattcgtaacttcccaaactgggtttaaataacgtgaaattaagtgattaattttcttttcatcaccagttaactttgaatgcaatgcgaagaaacctgccccaaaatctatagaagcaataatgatatagcaaaataaaaacaaccataacactgttatacctataaatgcataaatcatttttctatttctcctccttgcttcttggctaaacgatttacatcttcatacgccggtttatttttaaacatacgaattaatacgtatgcacatgtatacattaaaatgatgtacaatatgccaaataaaattgtaacgaaggttattccgcctgcttgtgttgctgcttctgccacgcgcatataaccacgaacaatccaaggctgtctacccatctctgttaagaaccatccaaattctatagctagcattgaagctgggcctgttaataatattccataaagcatccatttatgagtagaaaactttctaagctttttaaacattaaagttaagacataaacacctgaaatgacaaaacataaaattcccatcgttaccattaaatcaaagaaataatggacgatcataggcggatgtaaactttttggaaaatcatttaacccttgtactttagttttgacactattatctgctaagaaactcaatagtccaggtaattcaatcgcacctttaacttgctgagtcttttcatctaacacaccaaataataataatttggcatgggaagatgtatcgaaatgccattcataagctgctaatttttcaggttggaatttatgcaaaaattttgcagataaatcccctgccaacatagaaagtaatgttgaaaagaatccaactatcatagacattttcaaagctttcttatggtagacagtatctttaggttgacgattacgcaataatttaaaagctgctattgatgcaataacaaatgccatcgtcataccggctgtagtaattacgtgaaatgatcgaactataaacgatgggttaaacatcgcttctataggttgaacattgaccatctttccattcttcaactcaaaacctgcaggcgtattcataaatgaattcactgaagtaatgaagaatgctgagaaagagccaccaataattactggtatactaattaagaaatgtgtccatttatttttaaaacgatcccaagtatataaatatatacttaagaaaatagcttcaaagaagaacgcaaatgtttccataaataatggaagtgcaataacgtgtccacccatttccataaatgtaggccaaatcaatgataattgaagtcctataattgtacctgtaacaactcccactgctacagtaattgtataagctttagcccatcttttggccatagctatatattgaagatcatttttgcgaatacctaaaaattctgcaattgcgaacattaaaggcataccaacaccaatcgttgcaaaaatgatatgaactgctaaagtcatagctgtcaaaaaccgactgatttcaactgtatccatttaaaaacatcacctttttctttttttgatgacaacacaatgaacttaattataattgctataatgtgtatttttaaaacattatgcgctatgaaattgtgtataatttatgtcagttcacaatgtgttcacaaatttgaatttcaatgtataattgtgtatattacattagaataaagcacgaaggagcatgatacatgtcagaaataatcgtttatacgcagaatgattgtccaccttgtacatttgtaaaaaattatctaaatgagcatcacattgattttgaagagagaaatatcaacaatcaacaatatcgaaacgaaatgatagattttgatgctttttcaactccgtttattttgttgaatggc

SEQ ID NO: 171 - DNA, 11126 bp; double-stranded, linear
atacgtgaccctttatccgaaaatttcttttcatattctgttaaaatattactgccatcgtcttcttgatgtaaatttagatttatttttgtaaaatacattccaaattgagacatactttctaaactgtaggcaaatagtcctctgttatcagttttaaaatgtaaatctccttcatcatttaagatttgttgatacaacgctaaaaacgtatgatacgttaaacgtcgttttgcatgacgattttttggccatggatctgaaaagttcaaataaatacgcgaaacttcgccgtctttaaaatattcatttaattcaatggcgtcattacaaataatctttaaatttgttaaacccatctctttaactttatccaatactttataaacgatacttttctcacgttccattgaaatatagttaatatgaggattttgagcagctaatgttgtaataaactgccccatacccgaaccaatttcaatgtgtatcggttgcgttttatcaaaccattcagtcattttccctgcatgttgaccgtccatgtcaaccaattcaggatgatcttttaaataatcttcagcccatggtttgtatcgaactctcatattttattctcctcttaaataaacatgttactattcataacttcatttaggaatttaagccaagtgttcatatccttatatcttttttgctcttcataccattgaacaagacctatagattgaattaccgtataccatttcatacgtttatttaaattcaagctctcttgaacaccatatgtttcaagccattcagaccattgttgttgtggaacatagttgtaaagcagcattccgatatcaattgccgggtctgcaatcattgcaccttcccaatcaactaaaaatagttcatctcgatcggataataaccaattattatgattcacatcaccatgtacaacagtgaaaaaacgcgaatctaaactcggtatatgctcttctaaataggttaatgattttctcacaatatgatgtgttaaaacttctcttgataaagaggcattaattttattaagcataatctcaggagtaataggttccatttccatacgctttaacatacttaataaaggtctagaattgtgtatcttctttaataaatgtgcaactcttgtttgcttcatttcgtttgaagatagttcacgcccatttttccaatgttgtgctgtaacaacctcgcctgtttctatgcgtttcgtccatactaatttgggcacaataccttctgctgataatgccgcaataaatggatttgaatttcgttttaaaaacaacttttgtccatcttgttcagccatatatgcttcaccagatgcaccacctgctgaatcaagtgtccaccctaattgataaaactgctccaactcgtccacctcactttcaattagaaaatggctctagaaataggtttttcaagagccatatattctaatttataacaccatactggtacaaatattatgtccagataattattgtaaatcctcaaccaatgcctacattacacgactaaatttaaatcgtaatgtctgtcattgacaccatacattctatagtcacttacttgacatataatgttaccgtgtctaaaactacatgtttttgaatctctgtaggcgataaactctagttttcaaaataattgctatcccattttcatggttagcataaatttatgaactgtaacatttacgtacttagtaaaatatgatgcacatcatatttgtractcatagaaaattttataatttttatcattatatttcaactgaaaatgagaaacaaaatggcactttttactaatatgtgttttctaaacaacacttttaagcttcgttttaaattataacataattcacttacgaaagttgataaatttaagtaatttaatctaaaaatatgatgaaagaattttaaatactgtgtgactctatatacttttcaaatccttcttgtagttgacgtgtaattgggccaactttaccatcattaactggttcaccatctaatttaataacaggtgtaacctcagctgaagtacttgaaacaataacttcatctgcgtttttcaagaaatctacagtaaacgtttcttctttaaatgggatgttatagtcttcggcaatttttttaattacaattcgtgtaataccattaagaatatagttgttaatcggatgtgtataaatcacaccgtctttaattgcataagcattacttgaagatccttcagttacagtttcacctcgatgttgaattgcttcaactgcattatatttcacagcatattcttttgctaatacattctcctaataagttcaagcttttaatgtcgcaacgtaaccatcggatatcttcaacggtaacaccattcacaccattttctaaatgatcataaggacgatcataactctttgtataagcaacaattgctggttctacttcaggtgtcgggaagctatgattcctttcagctacaccacgcgttgctygaatataaattgccccagtttcaatttgattcatatcaactaatttacgagatagttcaattaattcttctacagaataatttaaatctaaaccaatctcattggcactacgtwaaawtctttcataatgttctgttactgtaaataacttaccattatatactcgaatgtattcataaataccatcgccaaatacgtatcctctgtcgttgtatgaaacctttgcttcacttggacttacaaactcaccatttaaaaaaattttttccatatattattcctccacgcataatgaataaattgcttctaagtaaatactagttgcgttaaataactgttttttagtgatatattcatttttctgatgcattaaatcttcagaatcactaaacattgcgccaaatgctacacccttgtctaagtttctcgcataagtaccgccacctatagtataaggttcagtcatatcatttgtttgatttctatatgcagtaactaacttttgtacaaaaggatcatttttatcaacataatgtggtggttggactttacctaatttcacttcaaagccatattgttgaatctcatttgcaaaacgatccatagctttttcaaattcaaatccttctgggtagcgtaagttgataccgaaaagacctgcgttttcattatcatatgtaataacaccaatgttagttgtcacgtcacccatgacatctgtatggaatttcattcccatcttttcaccaaaatctgaattaaataagtagcgattactaaatgctacaaacgcttgtgcattattatcaagatttaatgatgctaagaattttagtaagtaaagacccgcattcacaccgatagatggatccataccatgaaccgctttaccttcaactgttaaaactagaatgccactatcaacagtactatcaccttgtaaatgattttgttctaaaaagtactcaaagtcttgaataacatctgtcatattttctttaacaagcactcttgcttctgcatgatcaggtaccatgttgtaacgttcaccagatttaaaagttattaattcataatcaggttcatcttgatcttcagtaagtttattttgaactaaatcaaatgttgtaatgcctttttcaccatgaatacatggaaattctgcatctggtgcaaaacctaatgttggcatttcttctgttttaaaatagcgatccgtacatttccaatcagattcttcatccgtaccaataatcatatgaatacgtttcttccaatccacattcatatcttctaatatcttaattgcataataagcagcaattgttggacctttgtcatcaagtgtacctctagctatgatagcatcttctgttacaaccggctcgaacggattactatcccatccatcaccagcaggaacaacgtcaacatgacataagatacctaatacgtcatttcctttacctgcctcaattcttcctgcaatatgatccacatcatgtgttgtaaatccatctctatgtgcaatttcatacatgtagtctaatgccttacgaggacctggaccaactggtgcgtcttctgatgcttttgcatcatctctcacactttcaattgctaataatccttttaagtcattaatgatttgatcttcgtattgttgaactttttctttccacattcgaaatcgacttccttttttctataagttaaattctattttacatgaaaagatataaaaactacaataagatgtcagaaaataataaaaaggaacaaaacgatgctattgatatgacacaaatcataaatagctgctttgttccttttttaatttatatatttaaaatacacatattcaagagctcgagatataagtcaatgtactaggcacacaatttaatattgacagtaattaaccgaacgaaaatgcgccccggggccccaacatagagaatttcgaaaagaaattctacagacaatgcaagttggcggggccccaacatagaagctggccaatagttagctttcaataatgtgcaagttggggtaagggccccaacacagaagctggccaatagtcagctttcaataatgtgcaagttggggtaagggccccaacacagagaatttcgaaaagaaattctacagacaatgcaagttggcggggccccaacacagaagctggccaatagtcagctttcaataatgtgcaagttggggtaagggccccaacacagagaatttcgaaaagataaagaaatacgttttctttagatattagtatttcttatgaatgagtttcacgcatgtattcttctttctatatgcatattagctatgactaacgataaagaacctgaaacactaataaatgtcctatagtttacaatattatattggcagtagttgactgaatgaaaatacgcttgtaacaagcttttttcaattctagtcaaccttgccggggtgggacgacgaaataaattttgctaaaatatgatttctgtcccactcccttatcatttctgtcctactcacatcttattctttatcagataatgcatttttattcttttttaaatcttcttcagtgacgatacgtaaattattatttggtgtgcgccaccttcatcatcaaatttacctttttcaatactttcgtcagtcttattgtcatattcggtaaattttgatttttcttctttgaaaaatgcttttggattattttttaatctattagcatattctttcggatttgtttttacttctttaattgtttcattagcaattgttcctaattgcgtcgctttatccttagcattatctttatagctttgaggatcttgtttatatttattatattcctgctttcagcttgtcacgactatctttacgtgtaacaagtacagctgctacagcgccacctatacctaaaatcgctttaaataaattaccttttgccatatcaatcgtctcccttttatttataatttaatttgtcaaaatcattttcagttaataaacgatattctcctgaatctaaattgctgtccaattctaaatcagcaattttgatacgtcttaaatgtaatacctcattttgaatgctatgaaacattcgtttaacttgatgatattttccttcataaattgttacgtgtgacgtttgattatcaatataagttaatattgcaggcttaaccttgccatcagtcagtgttacaccctctttaaaagcttgaatgtcgtcttcagtgataggatttgctgaaataacttcatattttttagaaacatgtttgtttggactcattaattcatgattaaaatcaccatcattcgttatcaataaaagcccttctgtatctttatcaagacgaccaaccggaaaaatatttagatgttggtattcaggtattaaatcaataacggtttttgaatgatgatcttcagttgctgatatataaccttttggcttatttaacataatatagacattttcaatgtattctattaattctccacgaactgttatcttatcgttttctggttctatatgtgtttttggtgatttaattacttgttcgttgacatttacaaggccttttttaagtaactgtttgacctcattacgtgtaccgacgcccatatttgctaaaaatttatctattctcatcgtaaaaacctaactctacgtcttaatttttcaggaatttcacctaagaattcgtccgcaagacgcgttttaattgtgattgtaccgtaaattagaatacctactgtaacacctaaaataataatgattaagtaaccaagtttagtaggttctaagaatagatttgcaaggaaaaatactaattctacacctagcatcataataaatgaatacaagaatatttttgcaaaatgaatccaactatagctgaatttaaacttcgcatattttttaagaatatagaaattacatccaattgcaaataataatgcgatactagtacttaaaattgcaccaggtgtatggaataacataattaatggatagtttaacgctaacttgataactacagaagctaaaataacataaactgttaatttctgtttatctataccttgtaacattgatgccgttacacttaatagtgaaattagtattgctacaggcgcataatagaataataagcgactaccatcatggttagggtcatgacctaaaacaattggatcgtaaccatagaaaactgtgaataatggttgtgccaaggccataattccaatactagctggaacagttataaacattaatacaccaatagatgttctaatttgatgatgcatttcatgtaagcgaccttctgcaaatgtttttgtaatataaggaattaaactcactgcaaaaccagcacttaatgatgtcggaatcattacaattttattagttgacatatttagcatattaaagaatatatcttgtaactgtgaaggtataccaactaaagataaagcaccgttatgtgtaaattgatctactaagttaaataatggataattcaaacttacaataacgaacggtatactataagcaataatttctttatacatcttgccatatgacacatctatatctgtgtaatcagattcgaccatacgatcaatattatgcttacgctttctccagtaataccagagtgtgaatataccaataatcgcaccaactgctgctgcaaaagtagcaataccattggctaataaaatagagccatcaaagacatttagtactaaataacttccgattaatatgaaaatcacgcgtgcaatttgctcagttacttctgacactgctgttggccccatagatttataaccttggaatatccctctccatgtcgctaatacaggaataaagataacaaccatactaatgattcttataatccaagtaatatcatcgactgaccaaccgtttttatcatgaatgtttctagctaatgttaattcagaaatataaggtgctaagaaatacagtaccaagaaacctaaaacaccggtaatactcattacaataaaactcgatttataaaatttctgacttactttatatgccccaatagcattatatttcgcaacatatttcgaagctgctaatggtacacctgctgtcgcaactgcaattgcaatattatatggtgcataagcgtatgtgaacggcgccatattttcttgtccaccaattaaatagttgaatggaatgataaaaagtacgcccaataccttggtaattaatatactaatggtaattaaaaaggttccacgcaccatttctttactttcactcattacgaatctccctatctcatgtttattaaagttttgtaaactaaaagctgtttctctgtaaaatcatttttcattattatgaatatatcacaaaactttatttcattgtcgtatattcaatgaattatcataacaaaattatcaacacattgtcattgaatactagattttgattagaatattacgaaatttcatataaacattatactactatttgagatgaacatcgcataacagtagaaaaatcattcttatcatacacatacatcttcattttttatgaagttcacattataaatatattcaacataattgtcatctcataacacaagagatatagcaaagtttaaaaaagtactataaaatagcaattgaatgtccagtaacaaatttggaggaagcgtatatgtatcaaacaattattatcggaggcggacctagcggcttaatggcggcagtagctgcaagcgaacaaagtagcagtgtgttactcattgaaaaaaagaaaggtctaggtcgtaaactcaaaatatctggtggcggtagatgtaacgtaactaatcgattaccatatgctgaaattattaagaacattcctggaaatgggaaatttttatatagtcccttttcaatttttgataatgaatccatcatagatttttttgagtctaggggtgttaaattaaaagaagaagatcacgggcgtatgtttccagtttccaacaaagcacaagacgtggttgatacattagtgacaactatcgaacgccaacatgtaacgattaaagaagaagaagctgttagtagaatcgaagttaatacagaccaaactttcactgtacatactcaaaataatagttatgaaagccattcgctagtgattgctacaggtggtacaagtgtccctcaaactggttcaactggtgatggttataagttcgcacaagatttaggtcataccattactgagttattcccgaccgaagttccaattacatcagctgaacctttcatcaaatccaatcgtctaaaaggtttaagtttaaaagatgttgaattgtcagtacttaagaaaaatggtaaaaaacgcatcagtcatcaaatggatatgttatttactcattttggtatcagtggtccagctgcattaagatgtagtcagtttgtttataaagaacaaaaaaatcaaaagacacagcacatttctatggcaatcgatgcatttcctgaattaaaccatgaacaattaaaacaacacatcacatcattattatcggacacaccagataaaatcattaaaaacagtttgcatggtctaattgaagagcgctacttactgttcatgctggaacaagcaggaatcgatgaaaataccacatcacatcacttatcaaatcaacaattgaacgacttagtaaatatgtttaaagggtttgtatttaaggtgaacgggacattacctatagataaggcatttgtcacaggtggtggtgtgtcacttaaagaaattcaacctaaaacaatgatgtctaaattagttccgggattatttttatgtggtgaagtattagatatacatggttatactggtggttataatattacaagtgcactcgtaacaggacatgtcgctggattatatgccggacattactcacatgcatcaatggaataatagtataaaatttggttcgattctctttagtagatcaactttttcattcaaataaaaatgaccttaatataactgagtcactaaaaagtgtcgttatattaaggtcatttcgttaattatgattctttttcgtttttagtacgtcttctagctaacaaagccgcacctgtaatcagtgcaaattctttcaatggtaaatccattccttcagaacctgtatttggaagttctttttcaactttgcgcgattcatgtgtctcttcttttttaataggcgtacaaacttttggagctggctgaatttcttttggtgatactttcgtcgcttcagctggtaatttaattgctaaaatttcatcaacaatgaattgcgtgtgttgtttgatgtcatttaatgtcgcatcttcatcaatcattctattgccatctgcaacatattgatcaattaatacttttactttagctaattgttctggtgttgcgatcgctttgaatttcgcatatgtttgttgagcaatgttatcaattcgcagtaagctattttctttttcagtaattactgcttctatatcgcttaatgcaacattaaatcgttttaaaactgcatcaacatcagcattagtgcgtgctgtttttaattcttcatccatttgtaattttaaagcagttatagcttttaatgcatcagccttattacgattacttacttttcgataattttgcactaaagcagtgacgcgtgcaagatcatcattaatcgttttttcagcatctggctttttaataggatgtacatctaaatcatgtattgtttgtagatttaatgatgctgttttatcaacttgtgcattgctacgatcttgatcaatttgtccaatagcagtgtcataaatattttgtaactgtgctaatatactatttctttcttctaccgttgcttgaatattcgcttcaattgcttgttttttatcgttgaataatgttgtcaattgttctcgagcagacgcctttctgttaataacaggttcgatttcacgaatttcgtttttctcatcatgcaataaatatgccacatctgcattagtcactgcactagcaatttgttgtttagctttaattaactctttttcaacttgtgctattgcaatattttgttcttcatctgtcgcttcgttatttgctttaattaaattaattttatttgtagcgatattttgaatttgttgtaatgctgttgctttaactgttgtcgctggtttaatttttgaaataatattttgagcatttatactatcttgattaacttgggcagtcttatctgcatgattgatctgatcaatagcctgattaagtgcttgttctactaaatgtttagcagctagtctttcttcttcagttgataaatcgctttgatcgattagtgcattttgagcttcggcttttacaccaacagattgacgcgctgctggtttaacttgaactttaggtaaaatcactttgatgttgtcgttgccatcagtcncagtncgatccacttctgcattcgttttgttttgtgcaatgtcattt

SEQ ID NO: 172 - DNA, 3660 bp; double-stranded, linear
ttgccccgcacggcggtgtgnttcctagaaataatgaatataaagagaaatatataacaacgattttgaattatgaacctggtgatatcgttacaatcaaacgtgtgagagataagaccgatttgctaatatatttgtctagtaaagatatttctattggtaatgaagtggaaattgtatcgaaagatgaaatgaataaagtaattatcattaaacgtaatgataatgtaattattgtcagttacgaaaatgcaatgaacatgtttgctgaaaaataaaataaagaagccataaagatatccatgattgaactgataaagacatatggataattgctttaggcttcttttttattagttaatttatcaagtgagtatatttgagtaaaatattcactgcataaagattgaagataatccagattgtactataaatgaagataggtacatgactgagttctttaagtgcactaccatcccactgtggactcggacgctggaaagtcaatttagcaatcgtccaactagattgtagaacttcgcctaataatacacctaaaatatattgataactcattgtgacaagtagttgaatttctactatattttcatcttttaatataaaatacaacatgatagaaattaaagttataacaacaatgggtgagccttttctagatgttaaaattaaaaaataaataaatatcaataaataggtaaatataaagaaactaggtatctgataatggctcgacgctaaacctatcaataacataataggtggcataaaataaccaccaatcgttgtaagccattggcctgctagatgtctagattgtgtaattgcgaatccttgttgtaatgtctgttgtcgctctcgtggacttgttacaatgactaaatcttttgcacggccaccagcgagtttattaaacagtacatgaccaaattcatgtgttaaaacagggatatagtttaaaatgacatctaaatagttcaaaacaggcttatgtctatattgatgaatagcaatataacaagctgcaacaataacgataatgtatatattaagttgaattgtcgtattaaaaaagtttgataaataattcattgttaacctcatataagatattaatttaaagtttgcttatcacttattataaatgatattggcatcaatagcgttagactttagacttaccttagttaaactaattttaatttttgaaaaggtgaatatgtgttaaaataaagcaaaatcatttcgatataaataggatgaatataaatactgttaatattgattacactaacataataatgaaataagataggagattcctgttatgactgttgaagaaagatccaatacagccaaagttgacattttaggggtcgattttgataatacaacaatgttgcaaatggttgaaaatattaaaaccttttttgcaaatcaatcaacgaataatctttttatagtaacagccaaccctgaaatagtgaattacgcgacgacacatcaagcgtatttagagttaataaatcaagcgagctatattgttgctgatgggacaggagtagtcaaagcttcgcatcgtttaaagcaacctctagcgcatcgtatacctggtattgagttgatggatgaatgtttgaaaattgctcatgtaaatcatcaaaaagtatttttgctaggggcaactaatgaagttgtagaagcggcacaatatgcattgcaacaaagatatccaaacatatcgtttgcacatcatcacggttatattgatttagaagatgagacagtagtgaacgnanttaaactgtttaaacctgattacatatttgtaggtatgggattccctaaacaagaagaatggattatgacacatgaaaaccaatttgaatctacagtgatgatgggcgtaggtggttctcttgaagtatttgctggggctaaaaagagagcgccttatatctttagaaaattaaacattgaatggatatatagagcattaatagattggaaacgtattggtagattaaagagtattccaatatttatgtataaaatagccaaagcaaaaagaaaaataaaaaaggcgaaataatcatgatgacaaaaataaaaccgaggaaatccttaaatggagattctcggttttttcggtttatttaataacgaagcgggactcatcgagtttgtttctaaattctttttgttcggctttggatttctttttaaaatcgttaaggaaagcttcatatttaggtaatacatcatcaagttcaccgtaatcttttaactttccgccttcaatccaagcaatcttagtacaaaattgtctcacttgtcctaagttatgactaacgaaaaagatggttttgttttgctctttaaactcgtaaattttatctaaacatttttgtgcaaaagtttggtcacctacagataaagcttcgtcaatgactaagatatctggattaactgtgatattaattgaaaaaccaagttttgcacgcataccacttgaatactttttaactggttgataaataaactcaccaagttcactaaattcaataatcttaggtgtcatcgctttaatttcttttcgcttaaagcccatacataacattttaaattcgatattttcaatccctgtaagttgtccactcaagccagcactaattgcgataacgctgacttcaccattacgatccactttgccaacagtaggcgacaaagaaccgccaatgatattgctcaacgttgatttgccggaaccattgatgccaacaagccctatgacgtcaccttcatatgcttttaaactaatgtcatctaaagcgaaaaatgttttgtttttatgtttgggaatgagcgcatctttcatacgttctttatttgtacgataaatacgatattcttttgttacatttttaatgtttaccgaaacgttcatttgtagaccttccttattcacatttatctagattataatatactactcaacagttgttaaattttaaaacctgttgtaaagtgtatagaagattttgttattatcagagtgggtgttttgacacaaaatgttaatcatcaatgataacaatgatatttaaaaactaaacttatttcaacttacatgattgtatactataatgtatttgtaataaactaatattttaaagaactagacaataattttgatagcatccatgtatagtgatagtatttacaacaattattataatactatttagttaagtagagaaatagttaaacatttgaaagtgtggtttaatggaatgtcagcaataggaacagtttttaaagaacatgtaaagaacttttatttaattcaaagactggctcagtttcaagttaaaattatcaatcatagtaactatttaggtgtggcttgggaattaattaaccctgttatgcaaattatggtttactggatggtttttggattaggaataagaagtaatgcaccaattcatggtgtaccttttgtttattggttattggttggtatcagtatgtggttcttcatcaaccaaggtattttagaaggtactaaagcaattacacaaaagtttaatcaagtatcgaaaatgaacttcccgttatcgatataccgacatatattgt

SEQ ID NO: 173 - DNA, 13868 bp; double-stranded, linear
tatcgcgattaatagaaacgctaggaaaccaacgattctccatttaaatacttttaaaaaattaatcacttgttgtgtagagtcttgtccgttttggttatgattgttagccatgatatacctcccttacaacactcgtggaccagaagttttctgatctctcacattaacttctaacttacgtactggcatttctgtgaaatattctacattctttttaatatccgaacgaattgcttcagttaaagattgaacttgaacattatttggtacgaaaaagtcagttttaatgtcgatataagatttattttttttgttatatagtttcgcaactacatttggttgtcttacttgatcatattttgcaaccgtatcgaatgccgtcttttcaacagctttacgagatacgtaaacatgaccatcatcgaagtctttgtataatccaggttttcgatgcgtaggtttgaagatactaaatactaatataagacctattaatatcaatagtgcagcaagtgaaataagtaatggttggaaccattcaaattgaaggaagtagtcttgatattcagttatacgtccatcttggatatacatgaataacaggaaccccacgattactactattaataagccaaggataaagtttttaagtcgtttcacccctaacgacacctccttagttaaagttaatttaaaaacatattaaatatgtacccatcagtttttttcttaaacataataaattaataactttaaatttatttttaatatataagatgaagtaccatttagtaatatattccctagtttttgtaaataaaacctcattattaattaattytcgtcaatatgttttgaagaacgatattctaaaatatctgggtcacgatgtttaattaaaaccttattactatttctcggtttctcctcactcaaagattttataagcgaccatatcatcgctataatgaccacggaaaatggtaacgcagcaatgattaataaattttgaattgcttgagtaccacctgtgtaaatcatgatgattgcaaataatgccataatgataccccaactcactttgacaaatgacttcggattaatatcaccacttgaactcaacatacctaaaacataagttgccgaatccgctgatgtaacaaagaaaatcataataacaagtaaagtaattaagcttaatacaaaacctagcggataatgttgtagcgtcgcaaaagttgctgtttctgtcgcagctttagcaatatcggcaatatgattatcttgtaagtaaattgctgacgcgccgaataccgcaaagaatataaagcaaactaacgccgggacaaaaagtacacctagaataaattctttaatcgtacgtccttttgacacacgtgcaataaatatacctacaaatggtgcccaagatatccaccatgcccagtaaaagattgtccaattttgtaaccattggaatttttgaccacctgtcggaatgcgtaaactcatactaaagaaatttgcaatataattacctagaccattcgtaaatgtatttaaaatgtatagcgttggcccaacaataaaaagaccaataagtactacaaaagcaagtaacatgttgatattactcaacgttttgatacctttatcgatacctgaccatgctgaccaagtaaataatatggttgcaatgacaatcaagattacttgcatcgtgaagttactcggtacattaaataaaaaatgtaaaccttcgtttatttgcaatgcaccgaaacctaatgttgcagcaacgcctgttactgtagctatgactgccaatacatcaatggcaccacctaaaggtccacgcattgccttttcacctaataaaggcgtcaatgtagcgctgactaagccaggatatcctttatgaaagctaaaatatgcaaacactagcgcgacaataccatagactgcccatgcatgaatcccccaatggaaaaatgaaaactgcattgcatcattaattgcagattgcgtgccagctttatgaataggcgttaatttgaaggcatgactgattggttctgccgttgtccagaacacaagtcctattcccataccagcactaaataacatagcaaaccaagacggcaatgagaattcaggatcttcgccttcttcacctaatgtaatgtttgcgtatctcgaaaataaaatatacacacagacaaataaaataactaaaacgagcaataaataataccaagaaaaatgtagcgcaataaatgtagtaatgttttgcgtgagtttttctaactgtttcggaaatattgctccaaaagcaacaaatatcgtacatatcactaaagatacccaaaacactagacttactgatttatttttcataaatacaaaccctttctgtgtaatggtaagttcatacccataactgcaacattttaatcatttgtaattttatatagacacaattaataatgcctcatcttttaaaaatgatatataaaacacactcaaattatttatcattgagcaacaaagtattttattgtatttaagtaatgcctttctagtgcattattgatttgatacctgcaaagttgccatatttccgtttagaatcaatagtcgctagacacaaaaaataagtcgcctatacagtattttctgcataaggcgactttacttactaatctatatattaattactaattttccaatcattgattgtttttccaacaattgatgtgcttgatataagttttcaggtgataaaccttcaaaaacttgtgtcgttgttggttggtaatgccctgattctatatttttcgtaatatcttctaaatactcatgttgtttaatcatatcaggcgttcgatgaattggacgcgcaaacataaattcatgtgtaaatgttatactttttaattttaatgcatttaaatcttgatcttcattaaaagctacgatagtcgtaatatgccctaatggttttatcagttcaatcatagtattgtaatacaagtctgtattataggtgcaaaatatataatctactaatggaatttctttaaattgacgcactaaatcctctttatgattcaatacgatatctgcgcccatcttttcacaccactctgttgtttcttgtcgtgatgctgttgtaatgacagttaaaccataccgtttagcaatttgagtggctatactgcctacaccaccggcaccattaatgattaagacagacttcccttcgttttcagcaggattcgtagaaattttaaatgtatcaaaaaacgtttcatatgccgtaataccagttagcggtagactaaccgcttcattagcacttatgttgtgtggtgcttttgcaactatagcttctgacaccaattgatatgtcgcatttgatccttgtctatttggcgatccagcataaaatacaacgtcacccggactaaataatgtaacgtctggtccgatagcttcaacagtaccaatagcatcaaacccaagtacacgaggtgcttgagtgacttccatttgtcgttgctttgtatctacaggatttacactaatgctatttactttgactaagatatcatcgttttctggcgttggctttctttgttcgtatactttaaataaatttccttcttccaatttaaagggcttctcaaatcctatcattttcatatcgtttcacctcatttatgaacttatttcttattatacaaaatagaagccatgtgtgcttatatcgcagcatcatgactcctttttcatttgaatatataaataattacagacgactttcgtattaaattttagacttatttctaccatgttgctgaacaaatttactttagataaaaaattattaaattttggtcaattaacaaagttagtttgttaaaacgtgatactttattattccgttactttaataacttgtttaccaaagttatcgccagtaaataaatttttaaatgcatgtggcgcattttcaaaaccatcttcaatggttacttgtgactgaattttaccttcttgaacccatgttgcaagctgttcactagcttctttaaaagcattagcgaattcacttaccaagaagcctctcatcattacttgcttcttaataagcgtaccttgaatacgtggtccgatatcggcttcaggatgattatatgacgaaattgcgccacatactggtacacgtgcaaaacgatttaaatgcttaaatacttcatcgccaactgttccaccaacattttcaaaataaacatcaataccatctggtactgcttgtgctaacgcttctgcaaaatcctctttcttataatcaataccagcgtcaaagcccagtgtctctgttaaataatttacttttttgtcgccacccgcaatacctactacacggcaacctttaatcttagcaatttgacctacaactgaacctacagcaccagatgcagctgaaaccacaacagtatcaccggctttaggttgtccaatatcaagcagaccatgatatgctgtttgtcctggcattcctaaaacacttaaatataaatcaagtggtacatctgtcgttggaactttagtaatttgatccgcttggacatgattaatgattcgccaaggcaacatacctacaacgacatctccttttttataatctgcgagtgtcgaatcaattacttttgcaacgacatggctaacaatcggtttaccaatttcaaaaggctgtacatacgaatctgccttagtcatacgtcctctcatatatggatccactgaaatatacagcgtttgtacaagtacaccatcgctctcaagtttaggcgtgtcaatctcttcaattttgaatgtatcctcttgaggcatgccktctggtattttgttaaaaagaatttgtttattttgcatcattaatcacctttctttatttgaaacttttacttatttgttacttaagcgttaagtttgaattgtgtcttcgtgatgtctgtatgcaaatacattcttagttgttatattttgacttaagcactgattcattcatgtaacttcaaccacattatatttgctataatcataaatttaaaatgttacgacttagacattttatggaaactctcaaacaatagataatttttgaaaagctctaatattacaagcttttttgccccagaaaaactagcagttgctttattttttccataagaagtcgattaactcattagcaacattttcattctcatgaagctgactatgttgtgcaggctcaccttcatatttagattctcgataacttttcggactatttcccagtaaatattttaatgatttcgaagaactattagacactctgccgtctgaatgtgtaccatctttcaaatccccataaatatttagcacttcgatacctttacctttataaatatcttttagcacgcgtaattgctgataaggttgattcattcgacttggtttaccatctttatcaactgtaatttcattgacatcttcattcatatttaaaacaccattaaatgtccctgcaatattcacttgtttgtttaactgtggcagtgacttgtcgttaccatatgtcatcatatattgtgcaaatgttaagttccccattgagtgaccgacaaagttgaatttatcgaaattgtattcagattgtaacttagtcagtacatttttaaaccacgcagcattcttatccaaatagccttgtctgttattttcaagttcaattttcacaataggattcactgcatcttttcttagtttccctttaaatgtcactgcaccatcctttgaaacgtaagcagtgatgatatctttagttacccctcttttttctgcttgcttcaccataaacttttcagaattggcactaccaccaaatccatgtaagaacaatgttggaattggctttttaacaaattgctgttgttgtattttaaatgtttgtgcctgtcgttgactaaacaccaccataataatagagcctataataatagcgaccgctaacaatgtcgtaataattacaaaaattttcttcacacttttaactcccattcatgtcttttatataagtataaaggatgtgattaaaaatgtcctttagttgattttgaatacatcattaacttttaagatgactttggaaagttgtccgttaacgtttgttaattgattgcttctttagctttcaatggtgtgtcacccattgattaatatataaatatgtatatgcatgtttaatttatctctttctataaataaagacctaccagcactcgactgataggccttttaatatctataattatttaatttcttttgtttcggctaactctttgtaccaataagcacttttcttaggataacgttcttgagtctcaaaatcgacatagaataaaccatatcgtttttcataaccatttgaccaagagaacacatccattaatgaccaaataaagtaacctttaacatttgcaccatctataatagcatctgcaataacgttcaaatgttgtcttacataatcaatacgtgcatcatcatgaactgttttttcagattcaataaattcatctttatatcctaaaccattttcagtgatataaatcttatgatagttaggataatctttaacaacacgcatgatttgatcatataaaccttgaggatagatcatccagtcccagtctgtgcgaggtacgtcgacatcaaattcacgttgtccgacacctttaagttggtatttagaaccgcctttatcacctgtcgcattatgcgtgatttcagattctccatcgtaacctctcatccaatcactcatgtagtaattgatacctaagaagtcgtttaaatctttggctgcatctaaaatggcataatcttcatctgtaatgtttaatttaccgccattaacagataagatatgttgcacaccttccatcgtttcacgagaatacttacctaaatatgttgcatctaagatgaatttattatggatgatatcttctaattctgctgcacgaacatcttcaggatttgatggatcgaacggatattttgttggcaatgcgtgtacaacaccaatttctcctttgtatccgccatctttaaataattttactgctctagcatgagccaccatcatgttatgatgtgattggaatactttttcaaaatcatatttaatacctggagggaatttacctactaaatattgaccatcaccaataggtccaatttcattgaatgtagtccaatattttacttctgggaattctttaaaacaatattcagcataatctacaaagtagtcaatcgttttacgatttagaaaatcgccatctttgtgtaacacttctggtgtatcaaaatgatgcaatgttacaaatggttcaacatgacgtttatgacactctgcaaataacttatggtaatactcaacacctttagggttaacttcgccatatccatttgggaagatacgagaccatgcaattgaaattcggataccattaacaccgaatttttcacttaattctaaatccactggatatctgttataaaaatcactcgctggttctgcagtgtaccaatagttttcttctaaatacgtatcccatgctacgcgacctttaccatccgtatttgtcgcaccttctgcttgatatgctgctgttgctccaccaaaaataaaatcttcaggtaatgttttagtcatatgaaaaactcctattcttaattttcaaattgttgttgaacgaaatcaagggctgcttggccatctcgtgtcaatttgatatattcagcaccttgagtcttcgctaatttaatacctaatctatctgtatcttgcttaatatcttcatagttagacgcaacttgtggcgctaaaatgattaattggtactctttcataatgtccatatgtgcgccatatccgccagctgccgctttcactggcacatgatattcttcagctgctttattaagtgcattggctaataatccacttgtaccaccaccggcacaaagtactaagacatttgtttgttctgtgatatttgaagctttagctgcatcgtctgatacaccacttgccgctaaaattgaatcagcttttttcgtatcaaagtttgctgcaactttttcttttaaatctgaattactttctttacgtccttcttcttcatcaagaatttcactatcataaacttttaggaatgggtagtaaataataatatctacaacaatcaaagtaatagctagtacgaatgaccataaaccaaaacctgtacccatgataatgcccaatggacctggtgttgtccaaggtaaattcacactaaaactattcattcctaacacttcaacgaaaagtttgaaaatccatacgttaacaattggtgctaatacaaatggaataaagaacacaggattcaatactagtggtgcaccaaataaaattggttcgtttacaccaaagaatgttggtacaactgatgcacgtccaatcgctttgtttcgtttagatttcgtcatccacataaacatgaacgggacgaccaatgttgcacccgtacctccaaatgtaacgataaacatttgtgtacctgatgtaataattttatctgcgtgttctccagcttgaagcaacttgaagttcgcttcgatattcgcatatgtaatggctgcaattgctggctctacaattgacggaccatgaatacctacaaaccagaataatgcaaaggcaccaaagataattgtgacaccaatccatccatctgctgctgtaaataatggttcgaataattttaaaataccttccgctacatttgatttaaagctgttgcgaatgactaaatctaatgcataaagaatgatgattaccgctgaaaatggaattaagtccttaaatacttgtgaaatattcggcggtacttctttcggcattttaattgtaatattgcgcttcacacagaagttataaacaataacagttacaaatgctgataagaatgctgttaataaacctttagttcccataaatgcacttaagaatccaccatctttggctggatcagaagctaagaacaagaatccacacatcgctgctagcattgtagaaataaagttaatttgatttgtactttctagcttacggttaaatgaatctgttaaagatttcgctgtcgttcctgctactaaaaatgctacaagccccatcgtatagttatatggtttcattaaaatggcttccatgcctttatcccatttaaaaccaaatatatttggcacatatgcaattaatagaaagatacttgagaataagatgacaggcattgcagaaataaatccatcacggatggctcttaaatatatgttacgtgataatttctcgaaaaatggcttccctttttcaatttgtgcgatcaatttttgcatcattgtcatcaccctcttttataaaattctaataaatgcttcattaaatctttcagtaaaattgttgtcattaaatgatcttgaccatgcatcatcgttacactgtatgcaatatcatcaccttgcgcttctttagccaacaggcttgtttgtgctctatgcgcttccgcaatgcaattgtttccttcttcaatcagtgcatctgcttttgcaaaatctccagcttgagctgctgttaatgcttctaaaaacttagaacgtgcatcccctgcaaatgcaacaatttcaaaacctaataattggacttcttctctattcatagcattaatccccttttaaacttattttctttgtttccaagatgtcgcagtatcttttaatactttatttaagtcatcaatatttttgaaaccagttgtacgtaaccattcacgagcagcatcttcaccttgttcaatgtatacttgaacagcaccagaccatgtagcacggccacaaagtaccccgttgaatttagcaccagcttcgtgagcaaattttaaagtttcttggaataattccgcagaaacaccagcacttaagtaaatgtatggtaaatgagttgctgcatcttgatctttaaagtgttgtgccgcttcctcttttgtataaaccacttcaccttcagcaaagccttctacatatttcatgtttactggtacttcaactttcaatacatcaacgttaaagcgtggttctgagaataatttcattgcttcgttaacctttctaggcttaacttttgcgaattcaacactaccgttatcaggaatgttgtcatcgtatgttaatacttctaaaaagaatggaatatcttctgcaacacattctgaaccgattctttcaatgtatgctttcttttgaatgttaatttcttcagcatcatcaacatcatagtaaagtaagaatttaacagcatttgcgccttgttcttttaaacgttttgcagaccactctactaaacagtcaggtaaacgacctttagcgtttacgtcatatccagttttttcataagcaagtaataatccacaatctttgttacgtgcatctgaagctggtaaaccatattcaggatctaataaaattgaagatgcatattgtgttaattcttccgcaactaatacttttaattgttcaatttgagctacagttggttcttcagtttgatgttttgccatcatgcgttttaaagcaccacgttggtcaaatgctaatgcagaaatgataccttcgttgttacttaattgttcaattgatgcgattttttgattcgattttgacattttttacacctctaaaacttcaatttgattgaataaatcatcataattatttaaattgacataacctgtttgtgcttcttgtgcattcagcatgcctaaagtattggctttttttagtaaatcgtggtcgttttcatgattaagaattgctgaagtaattccagcaactgtagaatcacctgaaccaaccggatttaatacacttattgtcggaatattcactctatagaatgtatgattgtgcttagcgaatgcaccttgtgcacctaaagacacaataatccactcaatcccttcgaataagggttgtgacactgcctgtttcaaactttctaaactttcatcaagtggctggttaagcaattgatatagttcagaaatgtttggtttaatgactgtaggtttgtatggattttccaaaactgtttgcaaagttgcacccgagcaatctaatatcacaggcacacctttgttttggcatcgttcaatgatttgtgcataataatcttgatttaatcctttaggtaagctacctgaaatagcaactgcttcaactttttctaataattgttcaaaatgtttaataaatcctgcagcctcttgattatcaatctccggtccctgctctaaaatttctgtttgttgcccttcatgtaaaattgcaatgcagtttcgtgtttcacccttaatgttataaaatgcatgcttgatgtcggcatgatctaattttttagcaataaattgacctaattcaccgccaataaaaccactcgcaaggactggctcacctacttgcgcaagtactcttgttacatttaaacctttaccaccagctgttttacttacttcttgaacacgattaacatcatctaatttcaatgctgttaatgggtatgaaatatcaacggatggatttaatgttaaagttaaaatcatatgtgtcgtcccttaatcgtggtattcgcctctgtcccatttttctaagaattcatcaaagaaatgtggatcagcttgatctgcattgcttgtttctaaatgtttaattttagcgattaattttttgttctcttcagttggtttatattcagcattaataaatgcatcgataatatcgcacattaataactcacctataatacgtccaccgaagccaataacgttcgcatttaattcttctttagcgtataacgctgatgtcatatcacgtactagtgctgaacgaacgccaggtactttatttacagcattgttaataccaacacctgttccacaaatacaaacacctaagtctgcattaccgctaacaacttgttcgccaacttttttaccaaaaattggataatgtgttcttgtgaaatcgtatgttcctacgtcaatgacttcatgtccttttgattttaaaaattcagatacacgcatttttgtatctgtaacaatatggtcgcatcctaatgcaatcttcatagtaatttttcctccttagcacattttattaagcatatctacgcggatttggtgtctaccaccatcgtatttaccttcaacaaaacctttaacgacatttttcgctaatgtgtctccaacaatttcagatcccatagtgatcattcttgaattgttatggcctctagtcatatatccagagcgttcatctgatacttcagcagcaatcatgcctttgatttttgtagcaaccataaagctacctgcaccaaatgcatcgataacaatacctaagttaccttcttgactttgaacatcttttgctacagccaaagttgcatcaacaaagtcaacttcctgtccttctgttacgtcaacaacatcatatttattgtctaataagtatgatttgatgacttcttttaatcgtttgccagcttcatctgaaccaataataatcgccataataagactcctttttactttaattttgaaatacctttcttaaaatgtgacatatttatttgtaggttatgaaaatcttgagaaaaggctttcaatttgattacgtttaaattataaacataaacaaacaataaatcaacataatatgtttataatatgtttgtttatgacgtattttcaaacaataagtgaacattcatattgtggtgttgttttaattaggtattcgtctgaaattgtagtaaaactttgtcgaggttcccgttgacataaatttgcataaaaaatagcccataaatgaatgcaaattcacattcacttatgagcatatagatacatattttaacaatgcagttatacttttaatttagtcgactacttcaatatatgttttaatcgtttctactttttcttcatcttcatagtccatgaccactgcagtcaattcgtttaactgacaaaatgatgtaaaatcttctttgccaactttcgtatgatcgattaacaagtatttttcaattgaattacttagtgccagttgttgcgtataggcttcatctaatgtagatgtcatcacagcacctttatttactgcgttactactaaagaacatcttgctaaatcttagtttttccaacatggcgttcgccatttcacctacaaatgcttctgtaatatggcgcatttcaccaccaattaaatagacacgaaaatgtgctgtttgtttttctaacaaaattttatacaccggcaaacaattcgtaataattgtgagcgtatgatgattgacttcttctgctaatagttccactgttgttcctggtccgaaaaacaaagtatccccatcttcaattaatgatgcagcttttttagctataaatcgtttttctgcaatttgacgggtatgtttttctttatgcgatatttctttatactgaaatgttgaattactgcgtgcaccaccatgaatcttcgttaaaatccctttattttccaattcaattaaatctcttcgaactgtcatatcagacacatttaaaccttcgacgatttcattcgttcttatcgtgccctttttattcactagtttagcaatttcgtccaaacgttcatgtttattcaatgtaaaattgcctc

SEQ ID NO: 174 - DNA, 4549 bp; double-stranded, linear
ttaagtcaactttgtctatacggtttggatcttctacccaatgtcttataaaagacaatcccgcacctgaaacataactcatgaaataagaaaatggtataccattaatttgatcattttcatttttataacgttgtaaatgacacataattaaatcataaagtttttcgtggatatttgaatctttacccatacgaaacatcaattgataaaatgcgatgtctttttctatcatttctattaaaacggtcataatttgatgtatgttatccgtggataacttaactgctccatttaacttctcatcatgaatgaagtctcttatttcctccaactgctggtcctctaatttttcaagcaaatcatacttatcataataatgcgtataaaatgtactacggttaacatcagctaaatctgcaatttgttgcacagtaatctcttctaattggtgttgatgtaaaagttcaataaatgcatttctcattgcaacttgtgattttctaatacgtcgatctatagtcatttatatcaagtcctccccaatgattataaacgttatgttcattatcccacaaatctccaacattgatgattggcacacaatgtttacctgtttaatataggtgatacaaacaaacagaaaaaggtgataacaatgaaccaacatttactaggaaatccaaaattaactgtaactcatgtcaatgaagttaaagccggtattaaccacatcgttgtcgacagtgttcaatatggaaatcaagaaatgattatggaaaaagatgtcactgtggaaatgcgcgatggcgaaaaattatatattaatattttcagaccaaataaagatggcaaattccctgtagttatgtctgcagatacttacggtaaagataataagcctaaaatcacaaatatgggtgccctttggccaacattaggtaccattccgacatctagttttacacctgaagaatcaccagacccaggattttgggtgccaaatgattatgttgtagttaaagttgcattacgcggtagtgacaaatccaaaggcgtcttatctccatggtcaaaaagagaagcggaagattattacgartgattgaatgggcagcaaatcagtcatggagtaatggaaatatcgggacaaatggtgtttcttatcttgcggtgactcaatggtgggtcgcatcattaaatccaccacatttaaaagcaatgattccttgggaaggcttaaatgatatgtatagagaagtagcctttcacggaggtatmccagatactggcttttatcgtttctggactcaaggtatttttgcgagatggacagataatccaaatatcgaagatttgattcaagcacaacaagaacatcctctgttcgatgatttttggaaacagcgtcaagtgccattatcacaaattaaaacacctctactaacatgtgctagttggtctacacaaggtttgcacaaccgtggctcttttgaaggatttaaacaagctgcatctgaagaaaaatggctatatgtgcatggacgtaaagagtgggaaagttactacgctagagaaaatctcgaacgccaaaaatcattctttgatttttaccttaaagaagaaaataacgattggaaagatacgcctcatgtcatttatgaagttagagatcaattttataaaggcgaattcaaatcagcgtcacgtgtccctttacctaacgcagaatatacaccattgtatttgaatgctgaaaatcacacattgaatcatgcaaagattagtagcgcgcatgtcgcacaatatgactctgaagataaacaacaagatgtaagttttaaatatacgtttgacaaagatactgagttagttggaaacatgaacttaaaactatgggtaagcactaaagactcagatgatatggatttatttgcaggtattaaaaagttagatcgtcgtggtaatgaagttaacttccctgattttaatcatattgaaaatggtcaagtagctactggttggttacgcgtatcacatcgtgaattagatcaagaaaaatcctcaatcgcgcaaccttggcataaacatgaaacagaattaaagttgtcacaagatgagattgtacctgttgaaatcgaattgttaccttcaggcacgctatttaaacaaggcgaaacattggaagttgttgtaaagggtagtgaaattgtaattggtaatagtactcctggcatgaaaacacgttatgaacatgaagaaaccgtaaataaaggcatgcacatgatttatactggtggtaaatatgattcacaattaatcattcctatcgttaattgatatgcagcaattacggtcgcttttgattaaaagtgacatagtgataggactgtataacaagagaaagccacacgcttggaatcttaaaccaaggtgtggccctttttattattgatggctatttaattttataacactatcgtattttctttttcatgaatcatttcaataatgacattatcttcattcattactgctactttaggtgcatggtttttaatttcttcttcattcaactgtgcataagtcatgattatgactacatcgcctacttcaacaagtcttgacgctgcaccgtttaaacaaattttaccactacctctttcaccagctattacgtatgtttcaaaacgtgcaccattattattattcacgatggctactttttcatttggcaagatgtctaccgcttccaatatatctgaatcaatcgtaatgctacctacataatttaaatttgactcagtcactcttgctctatgaattttagcattcatcattgttcttatcactttattcagctccaattattatattatctattaaacgcgcttttgaaaatttaacagctaacgagataaatatgcgtccagttatttcgtgttgttctactaattgaggataactataaacagcaacttcttcaatgcgttcacttatatgtgattcaagatattcagtaaccctgtctataattactttactttgacgttcaccgtcttgatacaacgcttgtgctaatagcaaacttttacttaaatgtaccgcttcttgtcgttcttgctccgttaaataaacatttcttgaacttttcgccaaaccatctgcttctcgaacgatatcaataccaataatttcaacggcatgattgaagtcttttaccmtttgctcgacaatagccaattgctgggcatcttttttaccaaaataagcataatccggcataacaatattaaatagcttattaactactgttaccaccccatcaaaatgccctggrccgttcgctccttctaacacatcagctaatgggcctactttgacatcaatacctaattcacctggatacatatcttctactgcaggatgaaaaacaatgtccgctcctacttctgatactaattctaaatctttatcaatttgtctcggataagcatcgaaatcttcgtttggaccaaattgtaatggattaacaaatacactcacaattgtaatatcatttgtactaactgattcgcgtaccatcgttaaatgtccatcatgtaaggcacccattgttgggataaaaccaatcgttgtgcctgagcgtttggctgctttaacaatgtgttgcatctcttttaccgtagtaatcagcttagtcattgttattaacctcattcataattttctttttatacgtatattcttctgatggaaatgcaccagatttaacttcttgatcgtattgttttaaaccatccacaccaacactaaaatcagcaaattgcttcacaaatttcgctttatgttcaacaccataatttaacatatcgtgataaaccaatacttgaccatctgtaccttttcctgcaccaataccaatgactggaattgttaagtgcttgctaatttcttctgctaaatcatttggaattgcttcaagtactaacgcaactgcaccagcttgttctacatttttcgcgtctaaaataagttgctccgctgcttctttcgttgcaccttgtaatttataccccataacgccaacactttgaggtgttaatcctaaatgtgcaacaacaggaataccaattgccgttgctttttcaataaatggtgtaatatgcgctccttctgctttaattgcatttgcattcgtctcctgataaagctttagagcatgatttaagtcttgtgtcatagagatgcctactgcaccaatcggcatatcaacaactacaaatgtatttggtgcgcctcttcttactgcacgaccgtgatgaatcatatctgctaacgtcacttgtacggtactttcataacctaatacagtcataccaagtgaatccccaacaagaatcatatcaatacccgctgcttccacttgtttagcacttggaaaatcataagctgttaccatagaaattttagtttgcttttgtttcatatctattaattgacttactgttttcaatgttattcaacctctttttgcagtatnattaga

SEQ ID NO: 175 - DNA, 8339 bp; double-stranded, linear
ttatcttttgttgtttccttagacaaacgactaaccacattataatggactaatttattaattttatttaattccattaagttatccgtaacactaagtgaagatgcggagttcactctcgtttgtactcttcgttttaataaagcacctcgtaataatacaatcattcttcttattaatgatgcttgtctatatacctgtgttctttcagcataacgcatatagttttcaagtacactattcgttatttgtccttcatctactaaagactctaatgttttkgtttctacattaaaagcaattttttgtagacgttctaattctttagagttttcatcatctttctctacagtttttaaaaatgctaatttatcatgatattctttaatcacgttaccatatttaaaacttgtttcgaaagtagatttttgatttagataatcaataacttgttctaatatataaattctagcaactttaaacgacatattgccaattactgttttaggtgcaggtttcgttaataatggcaataatacttgcgcaactaccaaactaataataaccataccagatgcaataaataataagtcgtttctatacgtaaaagcatgatgccctgctaaaaaatacggtaacgttaatgcgattgctaaagaaattgttccatgcacaccacataacgtcataattaaagcgtataaacttcgctttggtggtttctcagtcgttggattatcatcatcatttttagtcatcattttttggaatggactgatggctaaataaaaataaggatataagacataaacccaaacaaatctaaatagatagacagctaaagcaacaacaatagtgatgcctattaaaaagattaaattgtgcggttctgttttgataattttaataataacttcaggtactaaaaatcctaatattgaaaaaacaaagccatttaaaacataacctagtatattccatgtatgattgtaactcatttgcagttgtgtacgtacttgcataattctgtcacgttcgaaaccatgtacaagtcctgcaactactgctgcaatgattcctgatgcgtgaaacaattcagcaattaaatacgtaacaaatggtgttaacaattgaataattgtaaacatattaatgttttcatatcctcgacgcatcaatgttaatcggaaccttactaatgccatacctataagtaaaccaaccactgcgccaccaattgatgcaattaaaaacaactgaacagcatcaacaagtgaaaaagcacctgtaactaatactccaacagctattttaaatgaaataataccagcagcatcattcaataatgactcaccttcaagaattgtcattgctccttttggcaagacctttcctttagtgattgcttgcactgctactgcatcagtaggacaaagaatggcagcaattgcaaatgctgctccaataggtaaatctggccaaatccaatgaataaataaacctacacctatcacagtagtaatgactaatcctaatgccatcatcatcactggcttaatatatttccttaaatggactctagaaacattaacaccttctacaaataacaaaggcgcaatcattgttaccataaacaattcagaatcaaaattaaattgaacagggattggggtaataaatagtaacatgcccaagaaaatttgtataaatgctaggggtactttaggtatgaaagtatggacaaacgaacttagtatcacaacagctataaatataagaattgtttcaaatatttccaaactttcacctctctaaaaagtattgtttaattgaaaattaagtatcacatctcgttgtaattatactttagaggataaattgagttagcgaccacaaaagcactttaatatagatatatgtctacgattgcagtacttaaatttgcaattatttaattttattttatcactaattgtttgtataaataaacaacttgctttcacataacaacattaacttataatacaaaaaatgagcaccttaaaatcgactaaccaatttcaaagtactcttttaatgattaattttgaaaacagattttcaaaagcattgttatgcttaacaatttagccaacacttcaatcgttttgataccatttcttacgatgctcttctcgtttttcagcacgtaattgtaatgcttctgtagagttttgttcatttgaacttaataatattgatgcatgtgtgtgagcatcattttttcgatacatataagcgccgttgcgataagcagcgcgagcgactaagtgcatgccgactggtgaagttaaattaataaaaacaagtgacagtaataaacgcacactgaaaaatcctgtattcacaataaaataaattaatacaccgattaaagttaataacacggataaagttgaactttttgtcgcagcgtgacttcttaagaaaacatcttggaatttcacgatacctattgcactaataagagcaataaaactacctaacaacaacatcacagcagcaataagactaaagatttcttttgttatttccattaaacacatgccccccaccaataaagcgtgatattgaaacagaacttacaaaagatataatggcaatgagcatgattgaatctaagaaagaaacggtgcccataagtacacttaacacacccacaattgacattacgacagcacttgttgtatcaaatgtaacgacacgatctgctgttgtaggtcccttgattaatctaaataaacagatgattaatgcaattccaaaaataatgagtgaactaataatcataatatgtgttattgtttgtatcatcgcgacacctccaatattaagtcttcataatgcttaatacttcttaacaaactatctttttctttttctgacacgtcgatactatgaataaaaaactttttagagtcttgagaaattcgtattactgtagaccctggagttataataattaaaattgttaaaaatgttattgaccaatcacttgttagtcttgtttcatatgaaagtaatccagggttcatatcttttgttttaaaaagaatataattaatcgtgctaatgctagatgttattaattgatataaataaacacctaaaaatttaatagctacccatatttttctaacataaaaatcatcgctgaaaaacctgtgtaatatataaatgacaattaaaccaattagatatccagaaaagaaagtcgagaatttaaaatgatcttcatcttgaaataatacccataagaatgcaatgataatatttaaaactatttgattcatttagtcctctcctttcaaatgcggatttacaagtttttgatataattgatcactcgtgttcaactcagttgcatcacttgtaacatttaacacaacaggtgcagcaattccgattgcgataaccacaactactaaaatacttaaaattctttttcgatatagcgggattttcttaaaattaacttcctccccatctttatctccaaaatacatataaaaaagtatcctaaataaactgtacattgcaattagactagtaataatcattaacgctagtccaatataattgccattttgcaatgcaccttggaaaataagtactttccccggaaagccactaaatggaggcacgccgccaatagcaaaaatcattataataaacgcaactccaaataaaggttcttttttagctaagccattcaaatattgatattgtcgatagcctgtaatgtaaactaaactaccaataataaaaaatagcaatgtttttacaacaatgtcatttaccaaataaaatattgcaccattaatacctgcaaacgtgtttgttcctaaacctaaaatgataaatcctattgagattatgacttggtaagctgcaatctttttaatatctttataagcaatgacacctatagcgccgatgaccatagttatagcagccatagttgctagcaatggatgtatgagatcattatgttgatcaaatagtaaagtgaagaatcgaattaatgcataggcccctactttggtcattaacgctgcaaataatgctgcaagctcagtatttaacacagcgtaggctttgggtagccacataaaaaggaccagcgctgctttcgcactaaatgcgactaagaagattaatgaaatcattgtaacagtgcgattatctcccatgtcattcaaacgcattgcaatatgtgaaaagtttaatgtacctactgttttataaagtaaacctatacctaataagaatagccatgaaccaataatattcaagacaacataaataattgcagcacgtaattgttctacagattgtccaagtgtaatgagtacaaatgacgctagtaacataatttcaaacatgacgtataaattaaataaatctgatgttagaaaagagcctatcacgccaacacttaaaaataatatgaacgatggcaagtgataacgatttgctttatgttcgccacgcccaaatccgtatgccataattaaagtaatcacaaacgaagcggttgtaaccataattaaacttaaagaatctcctaaaaactgtataccaaagggcgctgaccatcctccaaagtctagcgtaattggacggtgacgctgaacataaattaatagcattaatgaaataattgtggtgatagtcattgtacctaagtataaatatttagaaatacgatcattattttttaaaaatacaaggattaaggcacaaaggaatggtaataacattggtaaaatcaataagttacttagcatcatcttccccccttaggccttcaatttcatcttcttttgttactttataagttctataaacaagtacaagtaaaaacgcagtcatcccaaaccctataactattgcagttagtacaatagcttgtaacaagggatcaacaaacaattggtttccaccagttattagtggttctgatctactagaaccatacgttcccatactcataataatgagattaccagcatgagtatatattgaaattccgattacaatacgaattaaattgattgataaaatcatatatgttcctataaacactaaaaatcctataactagtaataatattaaattcatgatcgacctccgctaagcgacaacatcactgtgacaataacaccaacaactgagaataaaatacctaattcaaaaagtgttattgtacttacatgaatttgtcctaaaattggaagtatccaagttgtttcatattgagacaaaaatggttttccaaaaaacataggtattatcgcagtaatagatgataccaatgctccaataatcattaaaattctaaaatcaatcggtaaactttctaaaacctcttcaacattaaaagccagaaacattaaaataaacgctgaactaaatattaaaccaccaataaacccaccaccaggattattatgacctgcgaagaagacatagaatccgaaagtcaataaaataaatacaacaagtttcgtgaccgttcttaacacgacatcattctctttcatcttgtcccctccgatcttgataatttaataatgtgtaaatacctagcccagtaataattaacactaatccttcaaataatgtatctaatgctctaaagtcaccaagtatcgcatttacaatatttttaccacctgttagtttgtcagcttttaaataaaagtctgatattgatgataaaccatctgtttgttgtgtaataaaaattaatgatacaacaataagtgccatcaagagtgatacagaaattttaattatttctctttttttgttagcgttagatcttggcacgtttggtaatcttgaaaaactgacaataaatagtatcgtcgttattgtttcaactactagctgagtcaatgctagatcaggggctttcattgctataaagaataaggtcacaacaaatccgatgacyccatttaaaatgaccattgtcagtcgttgacgtataaaaattaaagaaataccaattgtgacagttacgattgctaatataatttctaatgccccaaattcagaaacatgtaactgatgtactttaggaagtccaattcgaatataaccatatccaatgataatcataaatatgcctaaggtcataataatgtactggtttaaacgatcttgcataacacgtttaaatcgcttcgtagcaaacttttcaaaatgtcgatataccatctcatagctttttgaaactgaaatctgtctaattttacctgtgaacacttttttccaatctactttgattgctagtacactacccaataaaataatgatgatggttaaaagaagcggtatgttaaatccatgccattgcgaaacatgtggtgccaattgatcaatttgatgattaccacctgatacagctcttaatgcnagaacgataatccccttcccaaatatatntggtacaaaaaagattacaggtactagcaccattaatataagagatggtaaactaaacaaccatggttcgtggatattttttttagtaaaaaccttagaatcatattttgtccaaaatacttcttttaccatgtatagtgcatatgtgaatgtaaaaacactcgcaataacaccaacaaacacgatagctatcattgaaatcaaactaaattgggataattgtccagtttgtgttaatgcatctaaaaacatttctttacttaaaaatccatttaaaaatggtactccagccatagatagagccgctatcgtcatgactagattcattttaggaaatagttgacgcattccacttaaaattcgtatatcccttgaacctgcttcatgatctaaaatacctactcccatgaaaagcgcacatttaaagatggcatgattcattagatgaaatagcgcaccarataatacmaatacataaatagatgctattgcgtcttgttggtgttgagcatatccgccacctatacccaccatagccataatcatcccaagttgactgattgtagagtacgctaggataccttttaaatcccattgttttaaagctgtaattgaaccaaataacattgttattaaaccaacaaacgtaacgatatatacgtacatattgctangacctaataatggtgtaaatcgaagtaatagaangataccagcttttaccatcgtggctgaatgtaaataagcacttacaggtgtaggtgcagccattgctctaggtagccagtatgaaatggarattgtgctgattttgtaaatgcacctaataaaaacataaaaatcatagggataaacaatccatgattcttaatatgatctgcttgtcctaatatctctgtgatgttattcgttcctgtcatgatatacagcataataaaaccaactaataacgccaatccaccaaatactgtaatcataaatgattgaatcgcaccaaattgactgtcaccattgttataccaatatganatcaataaaaatgatgatmcactcgttaattcccaaaaaatgtacatcmatatcgtattgtctgataatacaataccaatcatactgaacataaataacgttaaataaaaataaaaccttggtaaattgtcttttcgagaggataaatattgagttgcatagaagaatactgcaattccaataagtgaaataataagagaaaacattaaacttaaaccatctaaacgtaaatctaaattaatatctaatgtcttaatccatggaatagaggtagaaagatattgcagtttagctactgatggtatttgaatcaaaaaatagatagatgaaattacaggtgcaaccaacgctatgtacccggcatatttagccaatgctctacgtttagacattagaagtatcatcgccataatcacaagtatagcaattaataaataaaccaaactcattattagcctcctttgtttctataattgtaatgaaatataaatactatgttcacactcattttctaaaccgataaaatttagtgtttcaatagcagattgatgccctaaatacttttgaatgactggtataagtatacctttttgataagcatgatatgcaaatgtcttacgcaatgtcgttagtcctacattatctataccagcttcaattgatgcttggtgaattattcgatatgcttgctgtctagataatacttgatttgttcgtagtgattgaaaaagaacgtcttcattcgaaagactcctgtcctctatatattgaagtagttctttcgataatgtttctggtaacctaattttaatcaa

SEQ ID NO: 176 - DNA, 588 bp; double-stranded, linear
cccgatttttttacgtaatctaatacatacggcaaaatcaactttaatcaaaaaagactcatacacaatgcctttaaagcacatgtatgagtcctttttagtagtttatatcaaaaaatagtttaatgtataaattagtttttgtttacagatgcgtcgtagattgattctacagcatcacctaaagctttatcgaattcttctttagattgatcagctcttaaatcactagctaatgcacgtgagaaacttgcgataagttcagcgttatctttaagtaattcatttgctttttctctgctgtaaccacctgataatacaacgacacgaacaacattaggatgttcagctaactctttgtataagtttggttcagtaggaattgttaatttcaacattactaattgatcagcatttaagctatctaaaccttttttaagttcagcttttaatactttttcaatttcagctttgtcttttgcattaatattaacttctggttcgataattggaactaaacctttagcaataatttgtttagcaacttcaaattgttgttcaacaacgtctttgataccttgctcattt

SEQ ID NO: 177 - DNA, 2841 bp; double-stranded, linear
atagagtnctggnacttactatgacatatggcgctagaatggctgagccaggtgaatttacaaaacgtgcctttttaaatggtcgtattgatttatctcaagctgaagcagttatggactttattcgctcgaagacagatagagcttctaaagttgcgatgaatcaaattgaaggtcgtctaagtgacttaatcaaaaaacaacgtcaatctatattagagatactcgctcaagtggaagtgaatattgattatcctgaatacgatgatgttgaagatgcgactactgaatttcttttagagcagtctaaagaaatcaaacaggaaattaatcgtttattagataccggtgcgcagggtaaaattatgcgtgaaggtttatctacagttattgttggtaaaccaaacgtaggtaaatcatcgatgttaaataatttaatacaagataataaagcgattgtaactgaggtagcaggtactactagagatgtcttagaagagtacgtcaatgttcgtggcgtgccattaagattagttgatactgctggtatacgtgagacagaagatatagtagagaagattggtgttgaacgctctagaaaggctcttagccaagcagacttaattttatttgtattaaacaataacgaagcattgacwcaagaagattacacattatatgaagtggttaaaaatgaagatgtaatcgtaattgttaataaaatggatttagagcaaaacatagatattaatgaagttaaagatatgataggtgatacgccattaattcaaacttcaatgttaaaacaagaaggtattgatgaattagaaatacaaattcgagatttgttctttggtggagaagtacaaaatcaagatatgacttatgtttctaattcaagacatatttcattattaaaacaagcaagacaaacgatacaagatgcgattgatgcagcagaatctggtgtgcctatggatatggtacaaattgatttaactagaacttgggaaatattaggagaaattattggtgagactgcaagtgatgaactcatcgatcagttattcagtcaattctgcttaggtaaatagtaattgaaatagacggaataccgtcttaagaaggctagtaagatatcaaataaggaggtttatattgtggttcaagaatatgatgtaatcgttataggtgcgggacatgcaggtgtagaagcaggtttagcatctgcaagacgtggtgctaaaacattaatgctaacaataaatttagataatattgcatttatgccatgtaacccatctgtaggtggaccagctaaaggtatcgttgttcgtgaaattgatgctttaggtggacaaatggcaaaaacaatcgataaaacacacattcaaatgagaatgttaaatacaggtaaaggacctgctgtaagagcactaagagcgcaagcagataaagtactttatcaacaagaaatgaaacgcgtgattgaagatgaagaaaatttgcatataatgcaaggtatggtagacgaacttattatagaagataatgaagttaaaggtgtacgtacaaatattggtacagagtatttatctaaagcagtaattattacaacgggaacatttttacgtggtgaaatcattttaggtaatatgaagtattcaagtggaccaaatcaccaattaccatcaatcacattatcagacaatttaagagaacttggttttgatattgttcgttttaaaacaggtacaccaccgcgtgtaaattcaaaaacaattgactattcgaagactgaaatacaaccaggtgacgatgtaggtcgtgcattcagctttgaaacaacagaatatatattagatcaattgccatgttggctaacgtatactaatgctgaaacacacaaagttatcgatgataatttacatctatctgcaatgtattcagggatgattaaaggaaccgggccacgttattgcccttcaattgaagataaatttgttcgatttaatgataagccgcgacatcaacttttcttagagcctgaaggtcgtaatacaaatgaagtatatgtgcaaggattgtctacaagtcttcctgaacatgtgcacgtcaaatgttagagacgataccaggtcttgaaaaagcagatatgatgcgtgccggctacgcaattgaatatgatgcgattgtgccaacgcagttatggcctacacttgaaacgaaaatgattaaaaacttatatactgcaggtcaaattaatggtacatctggttatgaagaagcagcaggacaaggattgatggcaggtattaacgctgcaggtaaagtgttaaacacaggcgaaaagatattaagtcgttcagatgcatatattggtgtcttaatcgatgatcttgtaactaaaggtactaatgaaccttatcgtttactaacatcacgtgcagaatatcgtttgttactacgtcatgataatgctgatttgagattgacggatatgggatatgaacttggtatgatttctgaagaaagatatgcacgttttaatgaaaaacgtcagcaaattgatgcggaaattaagcgtttatcagatattcgtattaaaccaaacgaacatacgcaagcgattattgaacaacatggtggttctcgcttaaaagatggtattttagctatcgatttattacgcagacctgaaatgacttacgatataattttagaacttttagaagaagaacatcaattgaatgcagatgttgaagaacaagtagaaatacaaacaaaatatgaaggttatatcaataaatcactacaacaagttgagaaagttaagcgtat

SEQ ID NO: 178 - DNA, 3025 bp; double-stranded, linear
atctaatttcaaacccggtgataaattgccaagcgtgacgcaattaaaagaacgttatcaagtaagtaagagtactatcattaaagcattaggcttattggaacaagatggtttgatctatcaagcacaaggcagtggtatttatgtgagaaatattgctgatgccaatcgtatcaacgtctttaagactaatggtttctctaaaagtttaggtgaacaccgaatgacaagtaaggtacttgtttttaaggagattgcaacgccacctaaatctgtacaagatgagctccaattaaatgcagatgataccgtctactatttagagcgattaagattcgtggacgatgatgttttatgtatcgaatattcttattatcataaagaaatcgtgaaatatttaaatgatgatattgctaagggctctatcttcgactatttagaatcaaacatgaaacttcgtattggtttttcagatattttctttaatgtagatcaactcacttcaagtgaagcttcattactacaattgtctacaggtgaaccatgtttacgttaccaccagactttttatacaatgactggcaaaccctttgattcatctgacatcgtatttcattatcgtcatgcacagttttatattcctagtaaaaagtaataaatacataaaaacgtctatatcccagttataaactggagtatagacgtttttttacgataataacaatggctcaaattgctattatcttgcttaggtttttcgttttagaagaatattgctacaaagacaggcacaactgctacaacaactacaccaactaacactaaagctatacttgccattgattcttctacaggtcctaattctttggctggtgctacacctaatgtgtgaccacttgttccaagtgctaatcctcgggcaatagggttagtaattcggaaaagctttaagaatttattacctagggcataaataatgacaccatttaaaataactgctaatgatgttaattcttttataccaccgataccagctgatactggtaacgcaatcgctgtagttgctgcttgaggtaacattgataaaataacatcattggcaaattgtgctaacttcgcaaaagttaaaataattaataacgctacaactgtaccgataccaatacctccgatgatacgatgccaatgtttaacaagcacttcacgctttttatataacggaatcgcaaaacagattgttgccggttctaagaagaagtaaataatgtctccacctattttgtaagtcttatacggaatgcctgttaaatagaggaaggccacaccaaataccatactgacaaatagcggtgcgaataagaagaaacgattagttttttcaaataatatggtcgctaagaaaaatggtataacggataacagtattccgaagtaaggtgtgtttagtgctaagtggttaatcatgagcttgtgcctcctctattttgatcttttttgtgactttgtcacctttagatctcgaagtaactttcataataatttgtgtgacatagccagtacaaataagtaatagtattgttgagacgattattagtccaatgattaaaaatggtgcttggctaatgacacctaaagagttaacaactgagataccggctggtacgaagagtaagccaatgttatttgttagtgtcgttcctactttttcgacttcgcctaacttaacagcaccagtacataataatacaaataataatactaaaccgattactgatgcaggcataggaattggcataaatgattcaattattttcgatacaaagagtactaaagcaattacaatgacttggtgaaaaaagtgtgctggttttgatgcgtctttttgttgtttcacgaccattgcctcctacgtttgatttaactaaagtatagatggctcacttcgatttgcgtgatttttagtccgaaatacaaaatatcataggtaaaatgcataaaaaaaaggattactgttaaagtaatcctatcgacgctttaaaatctttcataaatgaacgtccaacttgcatcttgacaccatttgtcaatattaccatataagtatagttaaaccattgttgcacttctttaatgtgtttcgtgttaataatatatgaacgatgaatacgtataaaataagtgggattcaatcgtttttcataacgattcaatggctctgttgtttcgtatttatgattcgttgtatgtatggttgtaataccattatgtgtgccaatcccaataatattttgttgctttaacatgtgaattttatcgtcaatttcaacaggtaagctttgatcaaaattcgccgacatatcattcgcaattgcacttgcgttattatcatctttggctttagtcgcacgcactttattgactgcttgttcaatacgtttttgaccaaacggtttcaaaatatagtctgtcgcatttaattcaaatgcctgtactgcgtattggtcatgtgcagttgcaaaaataatcgcaggtggctctttcatcttttgaatcttagctcctaattcgatcccattttcatccattaaattgacatctaaaaatataatgtcatattgattgatcagtagtgcttccaatgtttcttttacattttctgcctcattaatttcttcaaaaccaccaatttcatttaataaatatgttaattcattacgtgctaatggctcatcatctatgattaatgctttcatatttattcctcctcttgtctttcataaggaagtacacaccaaaaagtggtaccgctcgatgtcgattcaaattgtaatgctgcggattttccaaataatccttttaggcgtaagtttaaattttctaaagcactaccagttccagactctgattctacagatgtntctcccaacaaatgcattttatctttagaaataccctgaccattatcttgtacaataatacgtacatgtgttgcagtttctttaatcactgacacgtcaatatcgtt

SEQ ID NO: 179 - DNA, 1689 bp; double-stranded, linear
acagaatttcacagcatttttagatgaaaaaataagccagtcatagcgttgatttaacaaatgaatatcaaaatttagtggctttatatcaataaagggtttgtgaataattgatactaaatcactttgcatgtcatttgtttgtgtcataactacaactggcttcatatttaaacgtcactccattatttaatgttgttcatttaagcgttttataatttcataagcaccttgctcttttaatttgttactcactgttttgcctaactcaaccggatctgttccgttcattgtatattcaaatcgttctttaccatctggggtcataattaaacctgtaaattcgatttcgttttgatctgagattgtagcatatcctgcaattggcacctgacaactaccatccatttctgctaaaaacgttcgttcagcagtcacacattttgcaacctcatcattatgtactttgcttaataatgttaatagttcttcatcgtcactacgacattctatccctaaagcacctkgtccgattgcaggtaacaatgtatctctatcaagataagatgttncaatatcatctgaccagcccattcttcttaaaccagctgcagctaaaataatcgcatcataatcttcagtttgtaacttttctaatcgtgtatctatattacctctaatccatttaatctctaaattaggatacttagataatatttgtgcaccacgacgtaatgaactagtaccaataatactgccttctggcaattgggatagtggtgtatgtgttttagaaatatacgcatcaaaaggtaattctctatcagggatacaacctaatgttaaaccttccggaattacacttggtacgtctttaagcgagtgtattgccatatcgatatttttttcaaaaagttcatgttgtatttctttaacaaataagcctttgcctccgactttagacaattgtttatctactatacgatcgcctttcgtgacaatttctttaatttcaatttctagatttggctcgacagcttttaatttatcaataaattgctggctttgtgttaaagctaatttacytcttctggagccaacgactratttacgcatgttcaattcctcctaggaacggattgctctagattattttctcaattcacaaaatgtgttgcaaaaaataaattaatcatatttaagcaaaataaaataatgttatagtatattaaatatcttgaattcaaccatttgttgattctaagtaaaatataacttccatataatactgtaataattgaagagagtattaccttcgggtcaatgaatatacgttcaccaactgaaattacaccccactgtgtacctaaaataatactaaatatgagaattatccacccacttaacgttgagtaaaacacaattgattcaagtgtagcaacgctaccaattctaaagtatttttgatcaaaacgtttttccttcaaattacggtattgcatgatatacagtaatgcattgacaaaagctaaggcaaagaagacataacttaacacagctagaccgatatggactaacagtaactcgtctacaacagcaattttctgaaccttattagtataatgtgtcggttgaaatgtattcatccctaanagtgttaaccctattaaattccaaggaaaaacacag

SEQ ID NO: 180 - DNA, 1209 bp; double-stranded, linear
ntggntggcttttcctattggaccaaatggaccntttacctggccnttcccaggacaccccgcttgtgcccacattccaatcggaaaaggtgtatgtggtacagccgtttcagaacgtcgtacacaaattgtagctgatgttcatcaattcgaaggacatatcgcttgtgatgctaatagtaagtctgagattgtcgttccaattttcaaagatgataaaattatcggcgtcttagatatcgatgcccctataacggatcgatttgatgacaatgacaaagaacatcttgaagcaattgttaaaattattgaaaagcaactcgcataaaaggacatcagcattttcaataaagtgttgacagttagcaggaaaatgttacaataatctttgtgtgaattaacgaaagtagcagttgtatattattgagcgctatgttgttcccaatgcggacgtgtcacgtaactgtcgctataaggtgaagacacataaaacaatatatcttagtaagcatgcaacactcttttttgtttattcataacaacaaaaaagaattaaaggaggagtcttattatggctcgattcagaggttcaaactggaaaaaatctcgtcgtttaggtatctctttaagcggtactggtaaagaattagaaaaacgtccttacgcaccaggacaacatggtccaaaccaacgtaaaaaattatcagaatatggtttacaattacgtgaaaaacaaaaattacgttacttatatggaatgactgaaagacaattccgtaacacatttgacatcgctggtaaaaaattcggtgtacacggtgaaaacttcatgatcttattagcaagtcgtttagacgctgttgtttattcattaggtttagctcgtactcgtcgtcaagcacgtcaattagttaaccacggtcatatcttagtagatggtaaacgtgttgatattccatcttattctgttaaacctggtcaaacaatttcagttcgtgaaaaatctcaaaaattaaacatcatcgttgaatcagttgaaatcaacaatttcgtacctgagtacttaaactttgatgctgacagcttaactggtactttcgtacgtttaccagaacgtagcgaattacctgctgaaattaacgaacaattaatccgttgagtactactcaagataatacggtcaataccaacacccacaattgtgggtgt

SEQ ID NO: 181 - DNA, 698 bp; double-stranded, linear
aaatccctttgttaaagtscaaatttttccaacrgctttaatargacccatattaccttcttggattaaatcmaggaatgacataccacgaccacgtatcttttagcaatacttacaactaaacgtaagttcgcttctgcaagtcttgattttgctacttcatcaccttgttcaatacgtttggctaattcgatttcttcttgtgcacttaataagttaacacgcccaatttctttaaggtacatacgaactgggtcatttattttaacacctggaggggcactaagatcacttggattcagtttctcgtcagtatctgaactatctttttcattaactagtgaaatatcattatcatttaattgatcaaagaaatcatccatttgatcagagtcgatatcaaaattctgaagtttttcagcaatttcttcatgacttaaatgaccctcttttttacctttttcaattaattgcttcttaacatcttctaatgttaatgtcggatcaattgtttgttttttaattttaactgtgttatcagacatgaaacggcctcccgattttaaatatgaacattcgaaatttattcaatattgctattttaaacgaaattcttaattaattccatccatattttnaattttattttacaaattgggaactaaatccccaatatttatttttcaatagtggtggtt

SEQ ID NO: 182 - DNA, 5147 bp; double-stranded, linear
acttgatgatgtatacaatgtatttcaagaatattatcaaaaaacatctaacattaagttttgtagaattcacaattctagctattatcacttctcaaaataaaaacatcgttcttcttaaagatttaattgaaacaatccaccataaataccctcaaactgttagagctctcaataatttaaaaaagcaaggctatctaataaaagaacgctcaactgaagatgaaagaaaaattttaattcatatggatgacgcgcagcaagaccatgctgaacaattattagctcaagtgaatcaattattagcagataaagatcatttacatcttgtttttgaataatatctctattacgcaagtgtgctgtattctaaagtgcacttgtgttttctattttttaataaaacctcagcacataatgaacaactttctattttctatatcacttaaaaccatttccgaaattaaacctcagcacattcaaagccccactttattcttaaaaatattttttaactcatatgtattaaaccgctttcattataaaaaatatctctatattttatctgtttttattaatcgaaatagcgtgattttgcggttttaagccttttacttcctgaataaatctttcagcaaaatatttattttataagttgtaaaacttacctttaaatttaattataaatatagattttagtattgcaatacataattcgttatattatgatgactttacaaatacatacagggggtattaatktgaaaaagaaaaacatttattcaattcgtaaactaggtgtaggtattgcatctgtaactttaggtacattacttatatctggtggcgtaacacctgctgcaaatgctgcgcaacacgatgaagctcaacaaaatgctttttatcaagtcttaaatatgcctaacttaaatgctgatcaacgcaatggttttatccaaagccttaaagatgatccaagccaaagtgctaacgttttaggtgaagctcaaaaacttaatgactctcaagctccaaaagctgatgcgcaacaaaataacttcaacaaagatcaacaaagcgccttctatgaaatcttgaacatgcctaacttaaacgaagcgcaacgtaacggcttcattcaaagtcttaaagacgacccaagccaaagcactaacgttttaggtgaagctaaaaaattaaacgaatctcaagcaccgaaagctgataacaatttcaacaaagaacaacaaaatgctttctatgaaatcttgaatatgcctaacttaaacgaagaacaacgcaatggtttcatccaaagcttaaaagatgacccaagccaaagtgctaacctattgtcagaagctaaaaagttaaatgaatctcaagcaccgaaagcggataacaaattcaacaaagaacaacaaaatgctttctatgaaatcttacatttacctaacttaaacgaagaacaacgcaatggtttcatccaaagcctaaaagatgacccaagccaaagcgctaaccttttagcagaagctaaaaagctaaatgatgctcaagcaccaaaagctgacaacaaattcaacaaagaacaacaaaatgctttctatgaaattttacatttacctaacttaactgaagaacaacgtaacggcttcatccaaagccttaaagacgatccttcagtgagcaaagaaattttagcagaagctaaaaagctaaacgatgctcaagcaccaaaagaggaagacaataacaagcctggcaaagaagacaataacaagcctggcaaagaagacaacaacaagcctggtaaagaagacaacaacaagcctggtaaagaagacaacaacaagcctggcaaagaagacggcaacaagcctggtaaagaagacaacaaaaaacctggtaaagaagatggcaacaagcctggtaaagaagacaacaaaaaacctggtaaagaagacggcaacaagcctggcaaagaagatggcaacaaacctggtaaagaagatggtaacggagtacatgtcgttaaacctggtgatacagtaaatgacattgcaaaagcaaacggcactactgctgacaaaattgctgcagataacaaattagctgataaaaacatgatcaaacctggtcaagaacttgttgttgataagaagcaaccagcaaaccatgcagatgctaacaaagctcaagcattaccagaaactggtgaagaaaatccattcatcggtacaactgtatttggtggattatcattagccttaggtgcagcgttattagctggacgtcgtcgcgaactataaaaacaaacaatacacaacgatagatatcattttatccaaaccaattttaacttatatacgttgattaacacattcttatttgaaatgataagaatcatctaaatgcacgagcaacatcttttgttgctcagtgcattttttattttacttacttttctaaacaacttctgaaacgcctcaacactttctactctgattacatatatgacatttttaggcattaaaaaatcgaactagacaagatgctcattgcatttcgtactagttcgattcatgaataattagatttaaaatgtcatttgaatccaagtgacaacattatttatatttagaatattaacgttagtataaacgtccaaacacaaataaaagcaacaaatataatactgtattttaacgtcatttttaataatgcagattcttcaccaacttttttaacagctgcagtcgcaatggcaattgattgtggtgaaataagtttcgctgctacaccacctgcagtgttagctgccacaagtaatgaaccgcttgttgaaatttgttgtgccactgtcgcttgaataggtgcgaataaagtattgttatttacaactgaaccagtcataaacacaccaatccaacctaatactggagagaataatgggaaaattgctcccgctttagcaataccttgtccaattgctacagtcaaaccaccgtatgtcataactttagcaatagctaggatagctgaaattgtaaggatcggtaaccataattctttaattgcttcgaccaataaagcacctgcacttttccattttaacttcgtaattaaaattgtaataattactgttaataaaatcgctgtcccagttgcaccaattaaatcgagacgcaacgcaattcctttaggcgataaatcactcacagtatttggaattggcaattttattactaaactttcaagtgcacctccaggttggaataattttttgaagaatggtgcactccatactaatacaaaggcagttaaaattacgaacggactccaagcaaagacaatttctttaggcgttcgtttttgaattttatgttcagacgcttccaatctgaaaatgtttttcggtttaaatttacgacaaacaaatgctaacaccaccattgttgctagtgatggaataatgtctgctagttctggaccatggaatattgttaataataattgtaatccagtatatgtaccactcactgttaaaatgacaggtaaaatttctttaatacctttcataccatctacaatgaatactaaaacaaatggaataataaagtttaaaattggaagtgttaatgctgagtatctcgcaacatctaatgttgtaacgcctccacttaagttaaacgtatcaataatactaactggtaaaccaattgcaccaaaggcacccgccgcaccattagcaattaaacataacatcgctgcttttaatggttcaaatccaagttgaattaataatactgcacaaatcgcaattggcacaccaaatcctgctgcaccttctaaaaatgcgttgaaacaaaatccaattaataatagttggattctttggtccactgaaatacttgcaatactatcttgaataatagaaaattgtcctgttttaatagaaactttatataaccaaactgccattaaaacgatatatcctattgggaaaataccggcaacaacgccttctgtaatcgcacctgctgatacacgcgctggtaattcaaatacaaataaagccacaatcaatgtaacaaccaaagttgtcaatgctgcataaatgcctttcattttaaaaacggttaagcataataaaaataaaataataggtactgctgcaactaaggctgataatccgacattatcgaatggatttacagtaagtagtgtcataatgactccctctctttatataaaatatttatcattctgattaatctacaacctatttcaacttatattttgcgatgatcacatatttaaaatgtaacactcctatatgtgacaggcaatcgaatttttacaaaaagttcacaaaatatacacaatatttaactataatamataatatatcatnttaattataaatactagatattatttataataatctcaggaattcgcttcaaaactgcatcatgagagtttatatttttattgagaatctctcattttatgaattgtaggaagtaaacaaaatatgacaagcgtcaaaccaatgataatgataaatatcatattaaaccatagtaaattgaattgatgatggtgttgtatttgccaaatttctaatactgtgaagatagacatatagctcataatctctaaatttaacgtacttaaaaataatttaatcgctcgaatttcacgtggtgtatgattataatgtgaccatttggcaaatcgttcatagtatctacctgcaatgaaaaatataagccaaatcactataaatgcgctattaatcaaaagcagcacccatttatcagcaaaattatcagcatcccctgctaaattataatgaataggcactttggttggtaattttggataggtcactactgtatagcacatcatagctaagtaaataagtagacttaatattgtaaaagacctgattttagacattctatcgcctcttctttacattttatgtataacactctgcctattttaccttttaatacattaccccaacgattaaacaatatgtaatgatactataattgcgtcaggagtatccgcttgttaaatgtgcatagcttatatttagctgtttaacatgccacataatgattcgaattatt

SEQ ID NO: 183 - DNA, 1312 bp; double-stranded, linear
cacttacttccaccattatcataactttaaaatggatatanttcatcaaacattatctaaaggcgtcgcacctacaccaacaccatccaacaattaacttacaactctgcgattacttcttcagcagcaactttcacntgcgtaatacaatcaggtagtccaaccgcttcaaaagatgcaccagttactctaagtcgtggatatgtttgtttaatatgtgcttgaatctgtctaatttgttgaatatgaccgacatggtactgtggcatacttttcggcaaacgattgacaattgtaaattcaggatcacctttaaatgtcatcatttgacttaaatctctacgtacaatcgatactaattcattatctgtatgatcatcaaccacagtatcacctggtttacctacatacgcacgaatcaaaaccttaccttccggtgtagtaaatggccattttttcgatgtccaagtacatgcggtaatgtctgtatcactcgttctcgcaattacgaagccagtaccatcatgggtattttcaatgtctttttcatcaaatgccaatacaacagttgcaacagtcgtactatccatcgttttaaagtaatcaaatgctggatcttgtccgaaccaatttaaaaacacttgatgtggtgtcgttactaatacgccatcatacacttcttctagttgatcattgtaaacaattttatattgtttttgagatgtaattatatcatccactgacgtattgtagcgtattgtcacacctttatttttaacatcttgttctaatgcttcaataaatgagcttaaaccatgcttaaattgtttgaattgtcctttcggtgcgccaggatataattgtctttgtttcagacgcttatttttctcatccttcataccttttatcagacttccgaatgcctcttctttttctttaaaattaggaaacgtactcatcaaacttaatttatcaatatcggtaccataaataccacccattaaaggctctattaaattctcaagtacctcattacctaatcttgctctgaaaaatgcaccaacagaaatgtcaccatcctgcatttgagtaggtttttttaataaatcaaaccctgctcttaatttaccaagtggcgatattaattttgtagtaacaaatggtttaatatctgttggaatacccataattgaaccacctggaatcggatataatttatttttcgcaaaaatatatgattgtccagtcgtatttgtaacaatatcttgttctaatccaatatctttcgctaattctgtcataatcgtttttc

SEQ ID NO: 184 - DNA, 6157 bp; double-stranded, linear
ttttacaataaaaatatgatatactacttgtcgtatataaggaacggaggacaatttatgcatacatttttaatcgtattattaatcattgattgtattgcattaataactgttgtactactccaagaaggtaaaagcagtggactttcaggtgccatcagtggtggtgctgagcagttattcggtaaacaaaaacaacgtggcgtcgatttattcttaaatagattaacaattattttatcaatattattttttgtacttatgatttgcataagttatcttggtatgtaaggtccggcgatgtaaatgtcgggcttttttatttataattaagaatgtaatagtttaacaataagctatgtaaaatatatagcctagttaagtatgcaaagggagcgttagatttatgcagataaaattaccaaaacctttcttttttgaggaaggtaaacgtgccgtgttattactacatggttttacaggcaattcgtctgatgttcgtcaattaggtcgatttttacaaaagaaaggttatacatcatatgcaccgcaatatgaaggccacgcggcaccaccagatgaaatactgaaatctagtcctttcgtttggtttaaagatgcgttagatggttatgattatcttgttgaacaaggttatgatgaaattgttgttgctggtctatcattaggtggggattttgctttaaaattaagcttaaatagagatgtaaagggtattgtaacgatgtgtgctcctatgggtggcaaaactgaaggtgccatttatgaaggctttttagaatatgcacgcaattttaaaaagtatgaaggtaaagatcaagagactattgataatgaaatggatcattttaaaccaactgaaactttaaaagaactaagtgaagcattagatacgattaaagagcaagttgatgaagtgttggatcctattttagtgattcaagcagaaaacgacaatatgattgatccacaatccgcaaattatatatatgaccatgtagattctgatgacaaaaatatcaagtggtacagtgaatctggacatgttattacgattgataaagagaaagaacaagtatttgaagatatttatcaatttttagagtcattagactggtcagaataaaaagagattttaacattagaaaggaggggcataatgaatttaaagcaatctatagaagagattattaatcaacctgaatatgaacctatgtcagtgtcagattttcaagatgcattaggtttaagcagtgccgactcgtttagagatttaattaaggtgcttgtggagttagaacaatcaggattaatcgaacgtacaaaaacagacagataccaaaaaaagcatagttatagaggtcaatcaaaattgataaaaggaacgttaagtcaaaataaaaaaggctttgcattcttaagacctgaagatgaggatatggaagatatatttattcccccgacgaaaattaatcgtgccttggatggagatactgttattgtagaaatccatcaatcaaaaggtgaacataaaggtaaaatcgaaggggaagttaagtcgattgagaagcattctgtaactcaagttgttggtacgtatagtgaagctagacattttggctttgttattccggatgataaacgtattatgcaagatattttcattcctaaaggtcaaagtttaggcgcagtcgatggtcataaggtacttgtacaaattactaagtatgctgatggttcagataatccagaaggacatatttctgctattttaggacataaaaatgatcctggcgtagatattttatctattatctatcaacatggcatagaaattgaatttcctgatgaagtgttacaagaagctgaagcagtacctgatcatattgaaaatactgaaattaaaggccgtcatgatttacgtgatgaattgacaatcacaattgatggtgctgatgctaaagacttagatgacgcaattagtgttaaaaagttagcgaacggtaatacgcaattaactgtaagtattgctgatgtcagctattatgtaacagaaggttctgcattggataaagaggcatatgatagagcgacaagtgtatatcttgttgaccgtgtaattccaatgattccacatcgattaagtaatggtatttgttcattgaatcctaatgttgatcgtttaactctaagctgtcgcatggaaatcgatgctagtggtcgcgttgttaaacatgaaatttttgatagtgttatacattctgattatcgaatgacgtatgatgcggtaaatcagattattactgaaaaggatcctaacattcgcgaacaatataatgaaattacgcctatgctagatttagcacaagatttatctaatcgtttgattcaaatgagaaaacgacgtggtgaaatcgattttgatattagtgaagcaaaagtattagttaacgaagacggtataccaacagatgttcaattaagacaacgtggcgagggtgaacgtctaattgaatcatttatgttaattgcaaatgaaacagttgctgaacattttagtaagttagatgtaccttttatttaccgagtgcatgagcaacctaaatcagatcgcttaagacaattctttgattttattacaaactttggcatcatgattaagggtactggcgaagatattcatccaacaacacttcaaaaggttcaagaagaagtagaaggtcgacctgaacaaatggtcatttcaacaatgatgttgcgttcaatgcaacaagcgcattatgatgatgtgaacttgggacattttggcttatcagctgaatattatacgcattttacatcaccaattagacgttatcctgatttaacagttcatcgtttaatccgtaagtatttaattgagaaatcaatggataacaaagaagtgaagcgttgggaagacaaattgcctgagttagctgaacatacttctaaacgtgaacgtcgtgctattgaggcagaacgtgatactgatgaattgaaaaaagcagaatatatgattcaacatattggtgatgaatttgaaggtattgtcagctcagtagctaacttcggtatgttcattgaattgccaaatacgatagaaggtatggttcatattgcgaatatgactgatgattattaccgttttgaagagcgtcaaatggcattaattggtgagcgtcaagctaaagtatttagaattggtgacacagttaaggttaaagtgacgcatgttgatgtagatgaacgattaattgattttcaaattgtaggtatgcctttaccgaaaaatgatcgatcacagcgcccagcgcgaggtaagacaattcaagccaaaacgcgtggtaaatcattagataaatcaaaatctgatgataagggtcgtaagaaaaaaggtaagcaacgtaaaggtaaaaaccaacgtaataatgataaatcaggtaatagtaagcataagccattttataaagataaaagtgtgaaaaagaaagcacgtcgtaagaaaaaataagcagcaatgaggtgagtatgaatggctaagaagaaatcaccaggtacattagcggaaaatcgtaaggcaagacatgattataatattgaagatacgattgaagcgggaattgtattgcaaggcacagaaataaaatcaattcgccgaggtagtgctaaccttaaagatagttatgcgcaagttaaaaacggtgaaatgtatttgaataatatgcatatagcaccatacgaagaagggaatcgttttaatcacgatcctcttcgttctcgaaaattattattgcacaagcgtgaaatcattaaattgggtgatcaaacacgtgagattggttattcgattgtgccgttaaagctttatttgaagcatggacattgtaaagtattacttggtgttgcacgaggtaagaaaaaatatgataaacgtcaagctttgaaagaaaaagcagtcaaacgagatgttgcgcgcgatatgaaagcccgttattaagcgatttagttgcttaatcgggctatatttgatatagttatatgtgcttttgtaaattacaaaagtatgatttgtttgatttattatttcggggacgttcatggattcgacaggggtcccccgagctcattaagcgtgtcggagggttgtcttcgtcatcaacacacacagtttataataactggcaaatcaaacaataatttcgcagtagctgcctaatcgcactctgcatcgcctaacagcatttcctatgtgctgttaacgcgattcaaccttaataggatatgctaaacactgccgtttgaagtctgtttagaagaaacttaatcaaactagcatcatgttggttgtttatcacttttcatgatgcgaaacctatcgataaactacacacgtagaaagatgtgtatcaggacctttggacgcgggttcaaatcccgccgtctccatatttgtagcctacagcctttgtggttgtgggcttttttattttgtgtttttcaggggataatgcattgcagaatttgttgtgagtattgatatagcagtgtttgtataggtgtttatttgatggaggaaagagtaataagtgattatgaattagtttttgagatataaggggacagtgatgtgtgtcaaataagtgtcaaaaaagttggattctgagttttacattcaacattgttcatgaagaaacttctttatacgcaaaaaattctccatgttatatatgtcaatataaaaatgtgaatcgtctacacttaattggataaatggctactgaaaaagaacttttcatttttgttacgtcactaagtgggtgtagttataaagagatgagccgagttttgatattttcattagaatcaatatgcctattaacacaatcagcaatagttgacgagacggaaataaaagaagtcgtagttaagaaatgcatttcacaacataccattgtagccatttttattgttttggatgataaactctttttggaatttttagtttttataatttgcaactacactacttcttttactaatattaatgtctaagtaatcgataaaaaattttccattgaataaatgagaagttaaaaactttacttaacctttcycattgcattttcctattcacgattttaagaacccaacatactacaaacgaattttaaaaggcgagagtaaagcttacttgtttattatacatatttaaaatccaagagtcagaacagactactcctctttataactataaaaaatagctatgaaaaaatctatcgtcatagattccttcatagctaatcttagtatgtttatttttattttaggatgctatttatcaactcaacatataactcactatttttataaccttctaatatatcattaacttgtctaataggtatttctggtacttctctaatgttttccaattttgttttaaattgtttttttgttatttgctctttatttgtagccaattggaacaagtaagaatctagcatattaatttctttatatgaatacatatatcttaataacactaaatctctagtttttaagttaggcgctagttcttcttgtaattgttctattgattgtytcattaataacaatctcatttctaattcttcattattcattttatcacactctttttatattaatgcttgaccaacttgggaaacccaaaaccctatgcttcttgcagtagaatctttaataccagttcccatcaatgcttgtgaaacttgaccttgtacatttccccatgtagcctcttcttgttttaatgcattattcaatgcgggatttacaaatttatcccatcttttttttatgattttccggcacggggactgatttctttaacaccattaaacacagattttttatttttaatcatagctttatagtatcatgttggctaagctataaataagtcagtttctctaaaaattaaataactgaatgtaagacaatcaacaawccaaatttatacttcatctaaaccactgtggtcgtcatctttttgcttttctttttctttctctcgttcttgttcttttttgtactcttcttcaaattctttttctttcttttctacttcttctct

SEQ ID NO: 185 - DNA, 884 bp; double-stranded, linear
catttgttattctgagtagccaatttggcaaagatgaacaaacgtctgaacaaacgtatcaagttgcagtcgcattagagttaattcatatggcaacacttgttcatgatgacgttattgataaaagcgacaagcgtcgaggcaagttaaccatatcaaagaaatgggatcagacaactgctattttaactgggaattttttattggcattaggacttgaacacttaatggccgttaaagataatcgtgtacatcaattgatatctgaatctatcgttgatgtttgtagaggggaacttttccaatttcaagaccaatttaacagtcaacagacaattattaattatttacgacgtatcaatcgcaaaacagcactgttaattcaaatatcaactgaagttggtgcaattacttctcaatctgataaagagactgtacgaaaattgaaaatgattggtcattatataggtatgagcttccaaatcattgatgatgtattagacttcacaagtaccgaaaagaaattaggtaagccggtcggaagtgatttgcttaatggtcatattacgttaccgattttattagaaatgcgtaaaaatccagacttcaaattgaaaatcgaacagttacgtcgtgatagtgaacgcaaagaatttgaagaatgtatccaaatcattagaaaatctgacagcatcgatgaggctaaggcagtaagttcgaagtatttaagtaaagcyttgaatttgatttcygagttaccagatggacatccgagatcactacytttaagtttgacgaaaaaaatgggttcaanaaacacgtagtatttatgnaaaagtattgaaagcgctttaccaacctgttaatatataatagtaatatac

SEQ ID NO: 186 - DNA, 6876 bp; double-stranded, linear
aatttcatctgctcgtgcaaaatctttgtttttccttgcttcattacgctcttcgattaatttttcaacatcttcatccaataattcatctgcatttttagattttaacggtacacctaaaacatcgctgaaaatttgataaactgctttaaatttatcaattacttctgttgatgttgtgttctctagtacatatttattcgcaagtkttgctaaatcataccaagctgtaattgcattagctgtattaaaatcatcattcataactgtttcaaaacgatttaaaatcgcatcaatttgatcaatatatgtctgttgattttcaatattagtagcaatttgtgcgcgctcttcaattaattgataactattgcgaatacgctctagtccactacgtgctgattctaccaattctagattatagttaattgggcttctataatgtacgctaatcataaagaatcttagtacatctggatcaacttctttaataatatcgtgaactaaaataaagttgcctagtgatttactcattttttcattatcaatattaatgaaaccattatgcatccaataattagcaaatggcgcatgattatgtgcttctgattgtgctatttcattttcatgatgtggaaattgtaaatctgaaccacccgcatgtatatcaattgtaggtcctagctcatgaaatgccattacagaacattctatatgccatcctggtctaccttcaccaaatgggctatcccaactaatctcgccaggttcgcttttttccacaatgtaaaatcaagtgcatcttctttatgctctcctgcatctatacgagcacccacttttaagtcatctatggattgatgacttaatttaccataaccttcaaatttacgtgttctaaagtaaacatcgccaccactttcatatgcataaccttgatccaccaaatctttaataaattgaataatgtcatccatatggtccattacccttggatttgaagtcgcttttctaacatttaacgcaccaacatcttcatgaaaagcagcgatatatttttctgcaatttcgggaacagactgatttaattcttgagaacgtttaattaatttatcatctacgtctgtaaaatttgatacatattctacattatatccttggtattcaaagtaacgtctcactacgtcataattaattgcwggtcttgcgttaccaatatgaatgtagttatatacagtaggaccacatacatacatttttactttccctggttctataggcttgaacacttctttttgacgtgtaagcgtattatataatgtaatcatcttgaatctctccattcctagtcttttcaagttgtcgttctaaatgcttaatttgttcataaattggatcaggtagatggcgatgatcaaatgtttttccaactcgaacaccatcttgcttaacaatatgtcctggtataccaacaaccgttgaataacttggaactgattgtaaaacaactgaatttgcaccaatatttacatttgaatttattttaatatttcctaaaactttcgcaccggctgctattaaaacattgtctcctatatctgggtgtcttttccctctttctttccctgtcccaccaagtgtcacgccttgatagattgtcacattatcaccaattgtacatgtttctcctattacaacgcccataccatgatctataaatagacgctttccaattttagcacctggatggatttctatacctgtgaaaaatcttgaaatttgagatatcgcgcgtgctgcaacatattttttttggttgtataacttatgtgcaatcaaatgactccaaactgcatgtaaacctgcatacgttgtaatgacttctaatgttgaacgtgccgctggatcctgctcaaataccatttttatatcgtctctcattctttttaacaagatcatttcctcctcaatgattgaactacgtaaatacataattgaagtacctgcgaaattaaatatcaaaaaagcaccactaacatacaaattgtattgttagaggcgcttccgcacggttccactctgaatttagcgaataacattaataatattgcgggcgcttccaaattatcaaggaaactaagtcaacttaatgctcatcactctcattatatatttaattcattttacgaaggtgcattcattaatttctacgttgtactcacagcaaccgtacactctctgcatcgtataaatttaattactaatccttcgttttatataaaatactttattcatattgttgtaatttgttaatacaactttatcatatgtggttacgttataaaattcaagtatatactaccttgatcttgtctatttcattacttatattgttttaaacggtttagcactttttctttaccaagtacttcaattgtatttggtaattcaggaccatgcatttggcctgttacagcaacacgaataggcataaataattgcttgccttttattcctgtttctttttgaacttctttaattgtctttttaatttcagccgcttcaaatggttcaagtgcttctaatttactgaataagtgcgtcattaactctggtacttgctctccattaatcacttgttgttcttcttcaccaagagctggcatttctttaaagaacatttctgataaaggtacaatttcaccggcataactcatttctttttgataaagcgcaattaatttgcgtccccaagataaatcctcttctgacggcacctcaggaatcaaatttgctttaattaaatgaggtaatgctaattggaatactgtttcagtatctttttgtttcatatattggttattaacccatgctaatttttgcttatcgaaaaatgctggtgattttgacaaacgcttttcatcaaagattttgataaattcttctttagaaaagatttcttcttcaccttcaggagaccaacctaataacgcaataaaattaaataacgcttcaggtaaataacctaagtcacgatattgctcaataaattgtaaaatttgcccatcacgtttacttaactttttacgttcttcattaacaattaatgacatatgaccaaaacgaggtggctcccagccaaatgcttcataaatcataatttgtttaggcgtgtttgaaatatgatcatcaccacgaattacatctgaaatttgcatgtaatgatcatctatagctactgcaaaattgtacgttggaatgccatctttttttacgataacccagtcaccaataccatttgaatcaaatgaaatatttccttttaccatatcatcaaatgaatacgtttggttttgaggtactcggaaacgaattgatggttggcgtccttctgcttcaaattgttgacgttgttcttcagtcaaatgcgcatgttgaccaccatagcgaggcatttcaccacgagcgatttgcgcttcacgttcagcttctaattcttcttctgtcatatagcatttatatgctttatcttctgctagtaactgatctattaatggttggtagatatgttgacgttcagattgacgatatggtccgtagccattgtctttatctacagactcatcccaatctaatcctaaccatttaagattatcaaattgtgatgtttctccatcttctaaattacgttttttatcagtatcttcaattcgaatcacaaaatctccgttgtaatgtttagcatacaagtaattgaataatgctgttcttgcattaccaatatgaagatacccagttggacttggtgcatatcttactcttatacgatcgctcatttttttcactcctaaattaaatatcagattttcaagttagttcatataaattgttcatttgctatcttcgaccgtcataacaaatgtctaactcgtcttattgttaaaacgaaacaatgctttttaacatgaccttaaaataatttcattgtttaatcataacataattccctgggtaatatgcttaaattttaaatagaaagctgttgttttttcaacactttaaaaaagctatccctaagaatcaagactgcactacataaacatttcaacgacttaaaaatgaatattatgtactgtgaaattaaacttcaaattaactattcaaatacgttaaaattgattctaattttgtatgtcttgattgctataagaataactttattaatatctaaaatttaacacttaatgaacttgtttcaatgatatattagcactatttgtattttttgataactaatatgttttgcatttatttatagttatacttcaaattacaaacttcgccatttcatataccttttaatatctattttgttttcgtcaactacagtttttataatgatactgtatcttcgatttttttagcaaaaacaattcttcctgaagatgtttgcaataagctgactacttctaaattgacatgactgccaataagatttttagcattatcaacaactaccatcgtaccatcatctagatatcctactgcctgaccaggctccttacccatttttgtcagtaaaatatgcagttgatcaccttgatgtacattaggtttgattgcttctgataaatcattaacatttaatgctttgataccatgtacatgacaaactttatttaggttgaaatctgtcgttataatacttgcatgatattgttttgctaattttaataacatcgtatcaatatcactatgtgttttagttggatgtataacctttgtaggatagtctaaatcatacaattcatttaaaatatctaagcctcttttacccttttcacgtttaacactgtcatttgaatctgcaacaatttgtaattcattaataacaccttgtggaattaaaatattgccatcgataaaaccgcaacgaatgacttctaaaatacgaccatcaataattgcgcttgtgtcgataatttttggcgtagcacttttagtatgttgtgacatggaacgcgctatattctcaggtaaaaacattaacatttcatctcgttttttaaggccaaattggaaaccgaaataacatagtaatatcgtaattatgacaggaatgaaatgattaaaaatagagttgccaattgattctaatataaacgacaccataacagaaataagtaatccgattattaaacctattgttgcgaatagtatttcaacagcacttctacgcataataaaatgttctaaaccttttatagcgttagtaactcgtctaataaatacaccaaaaattaagaacataaaaatactaccgataatgccatctacatagtgattttttaaaaagctggagttttgtaatccaagatcatttgcaatttcaggaataataattattcctaatgcgctcccaataattaagtaaataataataaccattagtttaacgatattcacacaatgtcctcctttcttgatgttttatgaatgaagagcaaatgacaatacttcatgtacagtagttacacctattacttgtataccttcaggatatgtccatccgcctatattatttttaggaataattacacgtttgaaacctagttttgcagcctcttgcacgcgttgttctatccgagatacacgacgtacctcacccgttaaaccaacttctccaatatagcaatctaatccgtcgacagctttatctttaaagctagatgcagttgctacaattacacttaaatcaactgctggctccgttaactttacaccgccagctactttgatataagcatcttgttgttgtaatagataattttctttcttttccaaaacagccatcaacaaacttaatcgattatgatcaatccctgttgccattcgtctcggattgttaaaagtcgttggagttaccagcgcttgaacttctattaaaagtggtctggttccctccatggttgcaacaattgttgaacctggaacatttgttgaacgttcttctaaaaacatttcagatggattatttacaccttttaatccactttgcttcatttcgaagattcccatttcattcgttgaaccaaaacggtttttaacagctcgcaaaattcgatatgcgtggtgttcatcgccttcaaaataaagcacagtatcaaccatgtgttctagcaatcttgggcccagcaatttgaccttctttcgttacatgacccactataaaagttgcaatgttcatttgtttagcaatattcattaaactttgtgtactttcacgaacttgtgaaacagaacctggcgcagagctgatttcaggatgatatattgtttgaatcgaatccactactaataaatcaggttgttcttcttttactgtttgataaataacttcaagatctgtttcagctaatacttgcaattcacttgaatcttcatctaatcgctctgcacgtaatttagtctgactaagcgattcttctccagtaatatatagtacttttttcttttgagataacgatgcacaaatttgtaaaagtaacgttgacttaccaatacctggatccccaccaataagtactaacgatccgctcacaatacctccacctaatacacggttgaattctgctgaatctgttaacactctcggcgttgtttcatgtttaatactatttaatttttgtactttacctgctaattccttggttttaactccatgtttaggattggctgctttttcaacaatttcctccatttgattccaagcgccacaattaggacatttccccatccatttaggagattgataaccacaagccatacattcaaaaatcacttttttcttggccaraattgcacctccactttctt

SEQ ID NO: 187 - DNA, 1193 bp; double-stranded, linear
caactcaaacagcagaacaacgtcgtgagttgattaatggtgtatttactgacattaatcccatacattaaaaatatgatgtacgtgttagcagataatagacatatctcattaatagctgacgtattcaaggcgttccaaagcttatataacggacactacaatcaagattttgcaacaattgagtcaacatatgaattgagtcaagaagagttagataagattgtcaaactagtaactcaacaaacgaagttatctaaagttattgtagatacaaaaattaatccagatttaattggtggatttagagttaaagtcggcacaactgtattagatggtagtgttagaaatgatcttgtccaattacaaagaaaatttagaagagttaattaattataaagaggagtgacatagatggccataaaagctgaagaaatcagtgcattacttcgctcacaaattgaaaattatgagtcagaaatgtccgtaactgatgtaggtactgtattacaaattggtgatggtattgcattaattcacggattaaatgacgttatggctggtgagctagtagaattccataacggcgtacttggtttagcccaaaaccttgaagagtcaaacgtgggtgtggttattttaggaccatacacaggtattactgaaggtgacgaagttaaacgtactggtcgtatcatggaagtaccagtaggtgaagaactaatcggaagagttgttaatccattaggacaacctattgatggacaaggaccgattaacacaactaaaacacgtccagtagagaaaaaagctactggtgtaatggatcgtaaatcagtagatgagccattacaaacaggtatcaaagcaattgatgctttagtaccaattggtagaggtcaacgtgagttaatcatcggtgaccgtcaaacaggtaaaacaacaattgcaattgacacaattttgaaccaaaaagatcaaggtacgatttgtatctatgttgctattggtcaaaaagattcaacagtaagagcaaatgttgaaaagttaagacaagcaggcgctttagactacactattgttgtagcagcatcagcttctgaaccttctccattattatatattgcaccatattcaggtgtaacaatgggtgaagaattcatgtttaacggtaaacatgttttaatcgttta

SEQ ID NO: 188 - DNA, 5549 bp; double-stranded, linear
tgctaagaagtcaaaataaactaactatnaaacatctagtacgattattaaagtgacagatnataaaattgaattattnagagaaggagatataaagtttgaagaaataaaagaaagactaggtacaggtattatttatgaataagttaatacttgggatttatttataccgaattttttcacgagcatacttttatttaccgtttttattaatttactttttgattcaaggttattccataatacaattagaaatattaatggcgtcttatggcattgcagcatttttattctctctatacaaagagaagtgttttaaaatttgtaacttaaaagattctaataaattagttgttagtgaaatattcaaaatcatcggtttattgttgttattatatcaaaatcaatatttaattttagtagtggcacaaatattattagggttaagttactcaatgatggcgggtgttgataccgcaataattaaaagaaatataacaaatgagaaatacgtacaaaataagtcaaatagctatatgttcctatcattattaatttcagggattataggtagttatctttatggaataaatattaaatggcctataataatgactggtatattttcaattctaacaattataattattcgatgcacattagttgaaaatagggaattaaatttaataggagaaacaaagggaaagataaagaaatttctaccagaagagaagttttggatattgcattattcttttttaagagcgttaatattaggattttttataggatttattccaattaatatatataatgatttaaaactgaataatttacaatttatttcagtattaacttgttacacagttatgggttttgtatcttcacgttatttaactaaatacttgaattataagtttgtgtcagaaatttgtttagtaatatttttaataatatatacatatcaaagtttcatagcagttactatttctatgatatttttaggtatttcttcagggttaactcgtccacaaactataaataaactttctagcagtagtaacttaagagtgatgcttaattatgcagaaacgttatattttatttttaatatcgcatttttacttatgggtggttacttatatacaataggaactattcaatacttaatattatttatttcgttattaatttttatatatttaataataatatttyattttacaaggagagagcaacatgaaaataaaaactgaatttaaagggaacaatataccatatgaatacgcagcaggtgcagatgtgagtgattctattaacgggaatccaattaagtcatttccatttgaagtaattgaattaccggaagggactaaatatcttgcttggtctttaattgactatgatgcaattcctgtatgtggctttgcttggattcattggagtgtagctaatgtaagtgttagtggcaattcaatttctataaaagcagatttatcaagaacaaagggcgactatgtacaaggtaaaaatagctttactagtgggttgttggctgaagatttttcagaaatagaaaatcactatgtaggacctacaccacctgatcaagatcatcaatatgaattaacagtttatgcgttagatcattctttaaatttgaagaatgggttctacttgaatgaatttttaaaagaagtaaatcaacataaaattgatcaaacaagtattaaccttataggaagaaaaatttaatactaaatatctcatcaatataaaattgttcaattaaaagtacaaagaaacaaaggttttaatttatatattaggtacggcgttcgctataatgcaaagaagtaattaaatttaagaaatgtaaacttagttattgtaatgtgaatttatttgaaaaaatagaaagtattaacaattatagcttttacattaattaaaatttatttttaaaaacaagtaaacaatttacatacttataatttttgaaaattttcaatttgtgttatattgattttgtaagatactttaactcacaaaggagagagagtatatgaaattaaaatcatttataactgtaactttggcactgggcatgatcgcaacgactggcgctactgtggcaggtaatgaggtatctgcagcagaaaaggacaaactaccggcaactcaaaaagctaaagaaatgcaaaatgttccatatacaattgcagtagatggcattatggctttcaatcaatcttacttaaatttaccaaaagatagccaattatcatatttagatttaggaaataaagttaaagctttgttatatgatgaacgcggtgtaacacctgagaagattcgaaatgcaaaatctgccgtttacacgattacttggaaagatggtagtaaaaaagaagtggatcttaagaaagatagctacacagcaaacttgtttgattcaaattcaattaaacaaattgatattaatgtaaaaactaaataaacacttaaaattatcaaattcaacatgaagcatttaattttacagtgatgattataaaataattgccttgatacaaagattactcgtaaatgacatctttgtattaaggctttttctaaatttaaaagtgatgggttagaggtcattgagctttaaaatattcaaaatacaaaacattaatggccaaaaataaaagccgcctttatctgggcagcttcaataataagaaagacatatttcattttatactaaatagttattgtgatgaatctttcggcggtttaattactgcagcaaaaattgctgtgaaaatcgtgaacaatactgccatgataattggattcactacatttaagctgtctccacctactaggctattaagtacaaagttaaccatttgcattaataataatgcccaaaagaatgttacgaggtgtttcatgtcattctacctccactttaattatatatattttattttaagtgaaagttagaaatttgtatagtaacatctcatatattttgaccatattatacagtttaaataaatgattttatctgaatggctattctaaattaagcgcattaaaaccaatttcatactgaaatttgacgataataaagcattaaaattttattaactagtcaatattcctacctctgacttgagtttaaaaagtaatctatgttaaattaatacctggtattaaaaattttattaagaaggtgttcaactatgaacgtgggtattaaaggttttggtgcatatgcgccagaaaagattattgacaatgcctattttgagcaatttttagatacatctgatgaatggatttctaagatgactggaattaaagaaagacattgggcagatgatgatcaagatacttcagatttagcatatgaagcaagtttaaaagcaatcgctgacgctggtattcagcccgaagatatagatatgataattgttgccacagcaactggagatatgccatttccaactgtcgcaaatatgttgcaagaacgtttagggacgggcaaagttgcctctatggatcaacttgcagcatgttctggatttatgtattcaatgattacagctaaacaatatgttcaatctggagattatcataacattttagttgtcggtgcagataaattatctaaaataacagatttaactgaccgttctactgcagttctatttggagatggtgcaggtgcggttatcatcggtgaagtttcagatggcagaggtattataagttatgaaatgggttctgatggcacaggtggtaaacatttatatttagataaagatactggtaaactgaaaatgaatggtcgagaagtatttaaatttgctgttagaattatgggtgatgcatcaacacgtgtagttgaaaaagcgaatttaacatcagatgatatagatttatttattcctcatcaagctaatattagaattatggaatcagctagagaacgcttaggtatttcaaaagacaaaatgagtgtttctgtaaataaatatggaaatacttcagctgcgtcaatacctttaagtatcgatcaagaattaaaaaatggtaaaatcaaagatgatgatacaattgttcttgtcggattcggtggcggcctaacttggggcgcaatgacaataaaatggggaaaataggaggataacgaatgagtcaaaataaaagagtagttattacaggtatgggagccctttctccaatcggtaatgatgtcaaaacaacatgggagaatgctctaaaaggcgtaaatggtatcgataaaattacacgtatcgatactgaaccttatagcgttcacttagcaggagaacttaaaaactttaatattgaagatcatatcgacaaaaaagaagcgcgtcgtatggatagatttactcaatatgcaattgtagcagctagagaggctgttaaagatgcgcaattagatatcaatgaaaatactgcagatcgaatcggtgtatggattggttctggtatcggtggtatggaaacatttgaaattgcacataaacaattaatggataaaggcccaagacgtgtgagtccatttttcgtaccaatgttaattcctgatatggcaactgggcaagtatcaattgacttaggtgcaaaaggaccaaatggtgcaacagttacagcatgtgcaacaggtacaaattcaatcggagaagcatttaaaattgtgcaacgcggtgatgcagatgcaatgattactggtggtacagaagcaccaattactcatatggcaattgctggtttcagtgcaagtcgagcgctttctacaaatgatgacattgaaacagcatgtcgtccattccaagaaggtagagatggttttgttatgggtgaaggtgctggtattttagtaattgaatctttagaatcagcacaagctcgaggtgccaatatttatgctgagatagttggctatggtactacaggtgatgcttatcatattacagcgccagctccagaaggtgaaggtggttctagagcaatgcaagcagctatggatgatgctggtattgaacctaaagatgtacaatacttaaatgcccatggtacaagtactcctgttggtgacttaaatgaagttaaagctattaaaaatacatttggtgaagcagctaaacacttaaaagttagctcaacaaaatcaatgactggtcacttacttggtgcaacaggtggaattgaagcaatcttctcagcgctttcaattaaagactctaaagtcgcaccgacaattcatgcggtaacaccagatccagaatgtgatttggatattgttccaaatgaagcgcaagaccttgatattacttatgcaatgagtaatagcttaggattcggtggacataacgcagtattagtattcaagaaatttgaagcataactataanaatcttcagtaacgttgttttagttactgaagattttttcagtttctttatactaagatgagcgacacacaatcgtcataataaaatatgaatatttattaataataa

SEQ ID NO: 189 - DNA, 4832 bp; double-stranded, linear
agattatagtaagattgatagtttggcgactgaagcgcgagaaaaattatcagaagtaaamcctttaaatattgcacaagcttctagaatatcaggggtaaatccagcagacatatctatattattgatttacttagaacaaggtaaactccaaagggtgagtgactaatgactgtagaatggttagcagaacaattaaaagaacataatattcaattaactgagactcaaaaacaacagtttcaaacatattatcgtttacttgttgaatggaatgaaaagatgaatttgacaagtattacagatgaacacgatgtatatttgaaacatttttatgattccattgcacctagtttttattttgattttaatcagcctataagtatatgtgatgtaggcgctggagctggttttccaagtattccgttaaaaataatgtttccgcagttaaaagtgacgattgttgattcattaaataagcgtattcaatttttaaaccatttagcgtcagaattacaattacaggatgtcagctttatacacgatagagcagaaacatttggtaagggtgtctacagggagtcttatgatgttgttactgcaagagcagtagctagattatccgtgttaagtgaattgtgtttaccgctagttaaaaaaggtggacagtttgttgcattaaaatcttcaaaaggtgaagaagaattagaagaagcaaaatttgcaattagtgtgttaggtggtaatgttacagaaacacatacctttgaattgccagaagatgctggagagcgccagatgttcattattgataaaaaaagacagacgccgaaaaagtatccaagaaaaccagggacgcctaataagactcctttacttgaaaaataatgcataatcctttacaactaacataaaaggagcgaatggataatgaaaaaacctttttcaaaattatttggtttgaaaaacaaagatgacatcattggacatattgaagaagatcgcaatagtaatgttgaatccattcaaattgaacgtatcgttcccaaccgttatcaaccaagacaggtgtttgaaccaaataaaattaaagaacttgctgaatcaatacatgaacatggtttactacaacctattgttgtaagaccgattgaagaagatatgtttgaaattattgctggagagcgccgatttagagcaatacaatcactaaatttacctcaagcagacgttattattcgtgatatggatgatgaagagacggctgttgttgcattaattgagaatattcaaagagaaaatttgtctgttgttgaagaagcggaagcctataagaaattattggaaattggtgatacaacgcaaagtgaattggcaaaaagtttaggtaaaagtcaaagctttattgcaaataagttgcgtttattgaagttggcgccgaaagtactacttcgcttaagagaaggtaaaattactgaacgtcatgcgagagcggtattatcattgtctgatagcgaacaagaagcgttgattgagcaagtcattgcacaaaagctaaatgtgaacagactgaagatagagtacgccaaaaaacggggcccgaaaaagtcaaagcacaaaaccttcgctttgcacaagatgtcactcaagcacgagatgaggtaggcaaaagtatccaagcgattcaacaaacaggattacatgttgagcataaagacaaagatcatgaagattattatgaaataaaaattcgaatatataaacgttagtagtaggatgtcgtatacatgatgactaacacataaaagacaaagctaagatcataacagctttgtcttttttttttgttttacgtgaaacataaaaatttatatttatatgttgatcaggctggtacataaatcaatgttctatgctctacgaagttatattggcagtagttgactgaacgaaaatgcgcttgtaacaagcttttttcaattctagtcaaccttgctggggtgggacgacgaaataaattttgcgaaaatatcatttctgtcccactccctaatttgagctggatatactttcatttgaaccctttattgctagtttatgaaagtatcatgaaagctttatgaacatcgcttgagttgcctttacagtagaaaatttaagttttacactttgtgtgaatgatacgttttgtattgaattaattatagaaaggtacgttgaagatgttttcaattggaagtgcaattcttcattttgtcattggtggtatcgctgttgcattagcttcaattattgctgataaggtaggtggtaagttaggaggtattatagctactatgccggcagtctttcttgcggctattatcgcattagctttagatcatcgtggtacgcaattagtggagatgtcgatgaatcttagtactggagcaattgtcggtattctgtcttgtatattaactgtatttttgacatctctctacattaagcataaaggttatcggaaaggcgcaatattcacagttgtttgttggtttgtcatttccctcgcaatattcagtattagacatttatagtttggaaaatgcgtgataattagttgtattcagttattaagtaataaattattggaggcagaacatcatgaaattaacattaatgaaattttttgtggggggatttgcagtattattaagttatattgtatctgtaacactaccttggaaagaatttggcggtatatttgcaacgtttccggcagtatttttagtgtctatgtttattacaggtatgcaatatggtgataaagtcgctgtgcatgtaagtcgtggcgcagtgtttggtatgacaggggtattagtttgtattttagttacatggatgatgttacatatgacgcacatgtggttgattagcattgttgttggtttcctaagctggttcatcagtgcagtatgtatttttgaagcggtagaatttatagcacaaaaaagattagaaaagcatagttggaaagctggaaaatcgaatagtaaatagtgtgaacgtaatctcttaactaggactaactttgcaagcattgaatagcatggaaaagttgcatcattaataagtgaaattcaagttggcattgagaaaattacaagcgcgtaatcatacaggtctgtcttaagggagtcttcgaaccccgatgttgtcgtatgtcaaaacatttagtcaatcataaaggtgacttgatttaactttatctgatagtctgattgtaatgattgtactaattgactggaggcgtatgtaattgaatctgagtaaacaaattaaaaagtatagggaacgagatggttattcacaagaatatcttgctgaaaagttatatgtatctaggcagagtatttctaattgggaaaatgacaaaagcttaccagacatacataacttattaatgaygtgtgaattgttcaatgtaactttagatgatttagtaaaagggaccattccatttgtacctgatattaaagcgcaacgaagtcttaacttatggacatatgtgatgcttattttcatgacattagctgcaattttaatgggacctttagttgtttattggaattggacttggggtgtaacggtggcaatcattttgggaataggtttttatgcatctatgaaaatagaagatttaaaaaaagtgcataaaatggacaactacgatcgaattgttgcttttatgaatggaaaagatcctagtgaagtacaaacgacyaaagctagaaatacgatgacaaatgcgctttctattatatcagtaattggtatactcagcctcataattttccttagtgtgtatttggcaaataagtttttataaatcatcgtggtatcgtctcatattatttatattatccaaaatagcataaaaaaataccaacaagatttagaaccttgttggtaatcaaagcgattcatttataatgagtcgttttatgttgtaagattaaacagtttgtacgttaactgcttggtctccacgttgaccttcagtgatttcgaaagtaactttttgaccttcttctaaagttttgtagccatcgctagcgatacctgagaaatgtacgaatacgtctccgccattttcttgttcgatgaaaccaaaacctttttctgcrttaaaccatttwactgtaccgttattcatatwgaawacctccgtgtgcttttgcacttaatatttgtaacaaattcataactaaaaaagaggatattctaaacaaatacactacaatttaattcacgagcttttattacgtaagaccaactatacgctcatattggcataatgtacagtgttttttgaaaataaattaaaaaagatttttaaaaaccttagaaacgttgatttaaaggggtttataaaaatwawaaaattgtagtcttttatggtgtttgctagttttcaaagtgacatatcgtttaaacatgatgattttataagcaatccataaaaaacaagcagcgataaacgctacttgttgatattaaaatctgacttgaaaggtcatagcaatgttctataccgatggaatgtgcttacttgcctttttcttcacgacgttttaaataataagagccacctaataaaccagctggaatgcctatcattggtgttgtgaatgagcttaatacaataacaagtattgttaaagcaatgacgttataccaagttacagtcaaatttttcaaatcctcatatgattgttttactaattctctaaatttcatgattcaatctctccttttttataaatctttagattgtcaaattaagctggaca

SEQ ID NO: 190 - DNA, 5727 bp; double-stranded, linear
caaagctgttcaaaaggcttataatttaaatttagataacatacgtacaatggaacctaagttgagatatcaagcgatcaataaaggtaatattaatttaatagatgcatattcaactgacgctgaattaaaacaatatgatatggttgtgttaaaagatgataagcacgtatttccaccatatcaaggagcaccattatttaaagaaagctttttaaagaaacatccagaaattaagaaaccgttaaacaaactagaaaacaaaatatctgatgaagatatgcaaatgatgaactataaagtaacagttaaaaatgaagacccatatacagttgcgaaagattatttaaaagcaaaagggttaatcaaataacgaccaacgccacataagatgcgtaacaccaaattatatcttatgtggcgttgttatatttaaatctataattatgttcaatttaaacatgcaataatgattaaaaaatatgacatgttaaacacaatgtaagctattatgatgtgaaaatagtagcattgcattttagaaacatagagcgatataatgaatataagttttttgaaatttcagttaattctaaggaggttgtttttattatgaaagaacaacttaatcaactatcagcatatcagcctggtttatctccaagggcattgaaagaaaagtatggcattgaaggagatttatataaacttgcatcaaatgaaaatttgtatggaccatcgcctaaagttaaagaagcgatatcagcacacttagatgagttatattattatcctgaaacaggatcaccgacattaaaagcggcgattagtaaacatttaaatgtagatcaatcacgcattttatttggtgcgggattagatgaagttatattaatgatttctagagctgtattaacgccaggggatactattgttacaagtgaagcgacattcggtcaatattatcacaatgcgattgttgaatcagctaatgtgatacaagtacctttaaaagatggtggcttcgatttagaaggtattttaaaagaagttaatgaagatacgtcattggtatggttatgtaatccaaataatcctacaggtacatattttaatcatgagagcttagattcgtttttatctcaagtacctccacatgtaccagtaattatagatgaagcttattttgaatttgtgacagcagaggactacccggatacacttgctttgcaacaaaaatatgacaatgctttcttattacgtacattttcaaaggcgtatggattagcgggtttacgtgtaggatatgtggtagcaagtgaacatgcgattgaaaaatggaacatcattagaccaccatttaatgtgacacgtatatctgaatacgcagcagttgcagcacttgaagatcaacaatatttaaaagaggtaacacataaaaatagtgttgaacgcgaaagattttatcaattacctcaaagtgagtatttcttgccaagtcaaacgaattttatatttgtaaaaacmaagcgggtaaatgaactttatgaagcacttttaaatgtagggtgtattacgcgaccatttccaactggtgttagaattacaattggttttaaagaacaaaatgataaaatgttagaagttttatcaaactttaaatacgaatagtaagtggggagtgggacagaaatgatattttcgcaaaatttatttcgtcgtcccaccccaacttgcattgtctgtagaaattgggaatccaatttctctttgttggggccccgccggcaaggttgactagaattgaaaaaagcttgttacaagcgcattttcgttcagtcaactactgccaatataactttgtagagcattgaacattgatttatgtctcaagctcaatgcagtgtgaatgatgaggtgagagtattcagtgtaaaaagcaacaatagatgatattgttttgtatcaattgcttttttgctatactgaatcaatactgatattttcaggagaagattaaaatgacccgtaaatcaatcgcgattgatatggatgaagtattggcagatacattaggagaaatcattgatgctgtcaattttagagcggatttaggtattaaaatggaagctttgaatggtcaaaaacttaaacatgttattcctgaacatgatggattaattacagaagtattgagagaaccaggcttcttcagacatcttaaagtgatgccgtatgcacaagaagttgtgaaaaaattaactgaacattatgatgtatatattgctacagcagcaatggatgtaccaacatcatttagtgataaatatgaatggttactagagttctttccatttttagatcctcagcattttgttttttgtggtagaaaaaacatcgttaaagctgattatttaatagatgacaatcctagacagcttgaaatttttactggtacaccgattatgtttacagcagtgcataatattaatgatgatcgatttgaacgcgtaaatagctggaaagatgtagaacagtattttttagataatattgagaaataaaatatatcacttgaaaaatttcatgtagaaaagatgatggataggctataaagtaattgtgactgagatgaacttttatgtcttagacactacaacactatattggcagtagttgactgcggggccccaacatagagaaattggattcccaatttctacagacaatgcaagttggggtggsccccaacataaagaaatactttttctttagaaattagtatttcttatgcatgagtgtaactcatgcattcatatttttaagtacacattagctgtgactaatgataaagaatcgctacataatcaatcattagtcgttctttatcatttccgtcccgctctcaataaatgttagtctatcttattattataaatcggatgaatgtgttaatctatggcagattacacgtcatccgattttttatagaatttgaaaaagacgcataaaccactatgatttaaaatacaacatcaatcattttagtggcatgcgccaaaattatatgtctgtttttgaaacagggtaatagcttaaagctaataaaaacgaatataaggtgcgttgaatcttatgattacactccaaacctaatataatatcgggttaagatcattccggatgcttacaaatcattgacagtaagtaactgaatggcatttggtataacctcaatatcaataggtgtttctaatgaaatttcgccatcaatatcaactttcattgctggatctgttgtaagtgaaatctttttaccaggtatatgctcaataccttgagtaatttcattccaattcatgctatcacgctttttaaaaatatcatttaaaatactgaaactttgttcattaaaaatgaaagtgttcagttcaccatcttgaggagacaaatcagtcaatggtatacgactaccaccaatgaatggaccatttgctgttagtatcatggtcgtttcgccagaatatgtcttatcatctattgataattgataattaaattgtgttggatttagcagtgttttgacagttgatccaatataactcaatttaccaaatatatcttttgaaccatcttgtacgttttcagcgttttgaacaatgagacctaagccaacaaagttgagtgcatattgattatttattttaattacatcgtatgtaccaacttgtgcagaaatcatttgttcactagcttgtttatgattaggtgctatatttagcgtttttgtaaaatcattaaaagtaccgcctggtaaaatgccaatagggagttgaaggtcatgtgtcataacaccgtttataagttcgttaaccgtgccatcaccgccaagaataaataatatatctacatcttttgcatagtttttagttttgatttcttggcaatatttaataatgtcaccttcgttttcactcaattgaatagaaagatgcttacaaattgaacttaatgctgttgtaacttccccaataccttgattaatattttttaatccactgtgttcatggtaaaagaggacaccatgtgtatatttattttccatagtttagcctactttctaaaaattggttcattaaatatatatacccacttttaattgttaataccaaaaatatgtttttaaatagagaaaatggtaataaatgaaattgatttctatagagtgggacgagaaaatatagttatagctgtctataatgagcatattaagtttttatttatactgatatcttgaatttaattaatagaaacctataaaaaaacagtaagccatttaaatgacttactgttttttgaattaggccaacaatattaacgtatacctttcatcgctttgatgattaaaggtgagaatgctaatacaattgttgtaacaataattgcaacaacacctaggaaaataaagtaatttgtttgacctagtggttctattaacttaactaaagtaccattgattgcttgtgcagaagcgttagttaagtaccaaatactcatcatttgggcattaaatgctttaggtgctaacttaacagcagcactattacccgttggtgataagcatagctcaccgataacacaaataatgtacgataaaataacccagttaactgaaaagtttgatgaacctgatgcataacctacaataccaattagtatgtatgacgcacctgctaagaacgtaccaattgcaaattttactggcaggctaggttgtttagttccaagcttttgccataaaagtgaaataattggagctagtaataaaataaataatgggttaattgattggaagatcgcttcaccaaagtttgttttccaaccaaataagtttaatttcatatctgaatgttcaattccatatatgtttaatacattagacccttgttcttgaatagcccagaacaccattccaagaataaataatggaataaatgctttaacacgagaacgttcagtatcagtgacatctttacttctaataattaaagtgaagtaaatgantggtaatgcaatacctaatactaaaacagtattactaactaagttaaatgataatgagttagttaatgcaccaataacgataattaatacaattgctaaaacaacacttccgataataagaccatactttttcttttcagctggtgtcaatgggttagtaggtttcataccaacgctacctaagtttttgcggttgaaaagtacataccatactaaacctaatgccataccaactgctgcaatcaagaatccgccgtggaagtttttaacattaacaaagtgttgcaaaataataggtgataataatgcacccatattaactgacatatagaaaataacaaaacctgcatccatacgtctatcattttcaggatataaacggccaacgatatttgaaatgtttggcttcattaaacctgaaccaataatgatgaagaacattgatgtgaataagccgattaatgcaaatggtaagcttaaacaaatatgtccgataataataaagactgcacctaataaagtagcgcctctagtgcctgtaattctgtcagcaatccatccgcctggtattgatgtcatatagattaatgaaccataractgacataattgacatagctgttgttttatcaattccaaggccattatctgttacggcaagtac

SEQ ID NO: 191 - DNA, 14078 bp; double-stranded, linear
tggactattaacggcgaagaagatttaacgaaatacttacaaaccaatgttgatggtattatcacagatgacccagcattagctgatcagattaaagaagaaaagaaagacgaaacatacttcgatcgttctataagaattttgtttgaataatataaacaaagacctctaaagttatcaagatgataccttcagaggtctttttaatgttgccatctatgggataggcaatcgtttcattcgtttatattcatatgacaagtatttgtatggcaatttggcgtcacaaacacttacatgatttattggtgaattattaattgttttgtgaatgcaaagggttagaaattgaattgtaaatactttctaatctttgtttcgctttagtcatttgatccaaatttttagtgcgtatagcggattttgcaatatagtgcgcactaaaatatcgcgtttttgaaacgcatctaaatttaggtacgataatttatttaagtcagtgtttgctattaattcatgtaattgatctacaagcgcttgatgttgatacgtatgtgatgtagtttcagatttgcttgctaatttaataccagtcgtatcaaggagcgccgctttaataccagcaactaaatatgttttgattttcatttgtgttgtcatgctttgttactcctttgatgtacattaatcaaaaaaattatacactattgtatattgcaaagctaattaactataacaaaaagatagttaatgctttgtttattctagttaatatatagttaatgtcttttaatattttgtttctttaatgtagattgggcaattacattttggaggaattaaaaaattatgaaaaagcaaataatttcgctaggcgcattagcagttgcatctagcttatttacatgggataacaaagcagatgcgatagtaacaaaggattatagtgggaaatcacaagttaatgctgggagtaaaaatgggacattaatagatagcagatatttaaattcagctctatattatttggaagactatataatttatgctataggattaactaataaatatgaatatggagataatatttataaagaagctaaagataggttgttggaaaaggtattaagggaagatcaatatcttttggagagaaagaaatctcaatatgaagattataaacaatggtatgcaaattataaaaaagaaaatcctcgtacagatttaaaaatggctaattttcataaatataatttagaagaactttcgatgaaagaatacaatgaactacaggatgcattaaagagagcactggatgattttcacagagaagttaaagatattaaggataagaattcagacttgaaaacttttaatgcagcagaagaagataaagcaactaaggaagtatacgatctcgtatctgaaattgatacattagttgtatcatattatggtgataaggattatggggagcacgcgaaagagttacgagcaaaactggacttaatccttggagatacagacaatccacataaaattacaaatgaacgtattaaaaaagaaatgattgatgacttaaattcaattattgatgatttctttatggaaactaaacaaaatagaccgaaatctataacgaaatataatcctacaacacataactataaaacaaatagtgataataaacctaattttgataaattagttgaagaaacgaaaaaagcagttaaagaagcagatgattcttggaaaaagaaaactgtcaaaaaatacggagaaactgaaacaaaatcgccagtagtaaaagaagagaagaaagttgaagaacctcaagcacctaaagttgataaccaacaagaggttaaaactacggctggtaaagctgaagaaacaacacaaccagttgcacaaccattagttaaaattccacagggcacaattacaggtgaaattgtaaaaggtccggaatatccaacgatggaaaataaaacggtacaaggtgaaatcgttcaaggtcccgattttctaacaatggaacaaagcggcccatcattaagcaataattatacaaacccaccgttaacgaaccctattttagaaggtcttgaaggtagctcatctaaacttgaaataaaaccacaaggtactgaatcaacgttaaaaggtactcaaggagaatcaagtgatattgaagttaaacctcaagcaactgaaacaacagaagcttctcaatatggtccgagaccgcaatttaacaaaacacctaaatatgttaaatatagagatgctggtacaggtatccgtgaatacaacgatggaacatttggatatgaagcgagaccaagattcaataagccatcagaaacaaatgcatataacgtaacaacacatgcaaatggtcaagtatcatacggagctcgtccgacatacaagaagccaagcgaaacgaatgcatacaatgtaacaacacatgcaaacggccaagtatcatacggagctcgtccgacacaaaacaagccaagcaaaacaaacgcatataacgtaacaacacatggaaacggccaagtatcatatggcgctcgcccaacacaaaacaagccaagcaaaacaaatgcatacaacgtaacaacacatgcaaacggtcaagtgtcatacggagctcgcccgacatacaagaagccaagtaaaacaaatgcatacaatgtaacaacacatgcagatggtactgcgacatatgggcctagagtaacaaaataagtttgtaactctatccaaagacatacagtcaatacaaaacattacgtatctttacaacagtaatcatgcattctatgatgcttctaactgaattaaagcatcgaacaatcggaagcatatttctaaattatttattcattatagtcttaaacataacatgacctaatatattactaacctattaaaataaaccacgcacatctaagtgatatacgacaatcacagcaataataattgctttagaaagtcgtgccgaactggaacttacaagtctagttcgaacacacactgatgtgagtggttttctttattttaaacatgaacaatcagataagttactagcattagcaaatattattaaatcaaagggcttcgattcataaaatttaaaacaatgattaaaattagacgtgtaaatgttaaattctaaaacggaaataaccaccatcccattaaaccactttttttgttcaatcactatatttcacacagcttcattaataaaacgaaattgcttcaacccgcttcaacttcaactggcttcaacttcagcctacttcattcaataacaaaacgaatccgcttcatccaaaatcaaccattctaacgcacatattcaaatatagcagctgcacccatgccgacaccaatacacatcgtaaccatgccgtaacggctatcgggacgtctacccatttcattaagtaaacgcgcggttaacattgcgcctgtagcacctaatggatgacctaaagcaatagcgccaccattcacattcgtacgtgatatatctagacctacttctttaatagatgcaatcgtttgagaagcaaatgcttcgttcaattcgatcaaatcaatgtcttcaacagatagattgctgagtgacaatacttcaggaatcgcatatgcaggcccaatacccataattttcgggtcaacgcctactgccttaaaaccaacgaatcgtgcaataggtgtcacgccgagttctttcactttatctccagacattaaaactacaaatcctgcaccatcagaaagtggggcagatgttcctgcagtcatagtgccgtcagctttaaatactgtacgtaatttggctaatgcctccatcgtggtgtcagggcgtataaattcatcttggtcaaagatatttgtgtgtacttttggtcctgcgtttgtatattcaactgagtttacttgtattggaataatttcatctttgaaccgaccatcacgttgtgcgtcataggcacgttgatgacttctgacagcataagcatcttgatcttcgcgtgatacgtcaaattgggatgctacattttcagcagttaaacccataggatatgacgcacctatatcatcatattgtaaggttggattgtttgtgggctcgttgccacccattggtacggcactcatcaattcaacgccaccagctacaagtatatctccttgaccagccataatttgattggctgcaatcgcgatggtttgtaatcctgatgagcagtagcgattcactgtttgacccggtaccgtgtcagataatcccgcacgcaatgcaatcgttcgtgcaatgttttggccttgtaatccttctggaaaagccgtaccaacaatgacatcttcaatcatattcttattgaattttccgtcaatacgtttcaatacgccttgtaatactttggctgcgacatcatcaggtctttcgtggaataatgcgccttgctttgctttcgctgcggctgaacgcccataagctacaatgtatgcttcttgcatggttatcatcctctcttaatgactatcttttaattacgtaatggcttaccagtttttaacatatgtgcaattctttcatatgattttttagattttagtaagtcaataaagccaattttctccaacgattgaatgtaacgttgattgataaatgtatttcttggtaaatcaccacccgctaaaattgtggcgatatttaaggcaatatgataatcatggtcgctaataaaatgaccccgtctttgcgcatctaattgtccttggatcaatgctttgaagtcttcacctaaagcgatatattgatgtctaggattcggaatatagtttgtttctgcttcatatttcgcacgtttgagcgcaacttcgacacgttgtgctgtattgaaaataatcgtatctgtatcacgtaaataaccataacgacgtgcctcaaaggcatttgtagagactttcgcaaatgcgatattcgtcagtacttttgtcatggaagcttgtttgtcatcaaacttatgcgatgtgcgtaatatgcgatcagccatttctgcaaggccaccgccactcggtaataagccaacacctgcttcaacaagaccgatatatgtttcacttgcagcgacaacaataggtgagtaaagtacaagctcacagccaccgcctaaggcacgaccttgaacagctgtgactactggtttcaaactatacttcaaacgattaaagctataatgtaatttatcaattgattgtgcaacgacatcatctacaagaccgtcttcatgcgcctttttcattaagaaaaggttagcacccacactgaaattgttaccatctgcataaataaccatacttgtgtaatggtcattttccagtaaatcaatcgcatcaactaacgcatcgttgaattcatcggtaatgacattatttttactttgtaatttcagtaacagttgatcatcatgagttacggaaagtttggcatcacctttatcccaaagttcatcttttacgaagtgagaaataggtgttgcatattcaatggtctcatcttgtttataaaagccaccatctaaatcactaatccattgtggtaagtctccaagttcgtcttccatacgtgttttaacacgttcgtatcccattgcatcccataattggaatggaccaagtttccagttgaacccccagacaagcgcacggtctatgtctcggaaatcatcggtagctttaggtacattgatagcagagtaatagaaattattacgtaatgtctcccataaaaatagtcccgcttcgtcttgcgcattgaatatggtatcaaggttatgcactaagtctttattaaattcatttaaaattggtaattgtggttgcgatacaggtacataatcttgtttttcaacatcgtaaacaagtcgagctttagtttctttatcctttttgtaaaatccttgtttcgttttacgtccgagtgcgccattgtcaaacaacgtatttacaattttgacatcatgaaaataaggtgtttcttcaggtacttgttgcatgcctttaattacagacactgcaatatctaaaccgactaggtcagatagcgcatatgtacctgttttaggacgaccaatcgcttgcccagttaaagcatccacatctacaatgcttatcttgtgttgctcggcgcgatacataatatcattcattgtttgcgtgccgactctatttgcgacaaagccaggcacatcattgacgacaatgacacctttacctaacacattttgcgcgaaattttttacatctaatataatagattccttcgtgtgtgacgtaggtattaactccactaatttcataatacgtggtgggttaaagaaatgtagaccaaagaatcgttcttgatccttctcgttaaatgcttgagcaatcgcattaattggaatacctgatgtatttgtagcgaataaagcatcttctttagcatgttgtagaacttgttgccaaacagcatgcttaatttcaatatcttctttgactgcttcgatatataaatcagcatcatcatttaccaagtcatcatcaaaattaccatatgttaaatgactcgctagatttaagtcgaatagtagcggccgtttcttatctgtaattttatcgtaagattttttcgcaatgagatttggatcgtttttgtccactacaatatctaatagttttactttaagtccagcattcacaaaaagtgctgccagttgagcgcccattgtgcctgcgccaagaacggttactttattaattgtcatagtgattcctccaatttagttgaggataagataaccattaagataattggaataacgttgctattttataaaattaattaagtatctttgacagtcatcttagcctcttatttaaggaaaaagctttatgcttaaaataagtcttttttagtgaaattaatgcatctcatataattatttgctatttatacgaaagcagaatctccagtcaaagcgcgtccaattactaaggcattaatttcatgtgtaccttcgtacgtgtaaatcgcttctgcatcagagaagaaacgtgcaatatcataatcgtcagctagtatgccattaccacctgtaataccgcggcccatagctactgtctcacgcaaacgtaaggcattcatcatcttcgccgttgaagttgcaacctcgtcatattcaccatgtgcttgcatattagctaattgagcacatgttgccattgcttgagctaaattaccttgcatcattgctagcttttcttgtattaactgatatttactaattggtttgccgaattgcttacgctcagtgacataatctaatgtggcacgtaaagcgccagccataccacctgtagccatataagcaacgcctgctctcgttgaataaagaattttggcaatatctttaaagcttgttatgttttgtaagcgatccgcttcatctactttgacattagttaatttaattagggcgttaggaacaatgcgaagtgcgattttattatcaatgacttcaatatcgacgccatcttgttctggtctgactacaaagcaatggggtttgccagtttctttatttactgcgaatactggaatgacatcagatacatgtgcaccaccaatccatttcttttcaccattgataacccaagtatcgccttggcgttcagcgactgtttcaagacctcccgcaacgtccgaaccgtgttctggttcagttaaagcaaagcatgtacgcagttcatgtgactgtaatttaggtacatatttcgcaatttgttctttgctacctccgaaatagaaagtgttatgccctaaaccttggtgaacaccgagtagggtagctaaggaaatatcaaatcgcgcgagtaggtaagacatgaaaaactgaaatagttgactaggcattttggcgtttggacgatccttgtaaagtaatggattgttaaaataatttaattctcccagatctttaaaatagtcctcgggtacagtagcgtctatccaatgttgattaatattttcacggtacttactttctagcaatgaatctacttgttgtaaaaattcgacttcaccgtctgttaaacctttagcaatactaagtacatcttcaggaaataatgtttttaagaccgtttctttttcaaatgtcatataaattcctcctaaaaataatatgaatactaatgtgaaatgcatttaattcaaaaacaacacgctttatttgtaaacgcttacactaaatgtcaaaaatttttatcacctttaaagtgtttgcgagactttgtcattcatcatttgtcgaatcgcaagtttatctggtttctgcgtactgtttaacggcatatgtgtcactggtacatacattcttgggactttataacctgctaaacgacttcgcatatgttgatttaaaatttcagcgtaatgaggttcatcttcgcgaagtataatggctgcagcaattgattcaccatattttggatgatcatagccaacgaccacacaccggtctactagtggatgctcagctaaagcattttcgacttcggatggtaagacattttcgccaccagttatgattaattcttttttgcggtcaataataaatatatcgccatcgttgtccatcttcgctaagtcaccagttaataaatatcgaccatgaaatgctttggcagtctctgctggtttattccaatatcctggcgtgacatttttagccttaattgcaagttcgccaatctcaccagtaggtacttcctcaccgttatcatcaaggatacgtgcatcaacgaacatgactgctttaccaatactcattggcttacgttttgaattttccggtgtattaacaagtacaagaggtgcttcagttaaaccatagccgttaataatgtttatgccatattgtttaaaagctgcttggatacttggtaatggttgtgaaccaccttggatgatataatccatagctctaaaattttcaggattaaaattactagcacgtagcgtactataatacattgtcggaatcatgataataaatgtagggtgatattgtgcaatcatgtcattcaattcttcgccgttaaagtaacgttgaagaataagtgtgccacctgacattaatactggtaatacagtatcgttaaaccctaaaacatggaacattggtgttgatacaatcgtaatatagtttgaattgaacttatacgtcagctctaagtttgcaccgttatgaacaaatgattcatatgagaacatcacacctttaggtgatccggttgtaccacttgtataaattaatgctgcaagatcttgtggttcaacaggtgttgcttgaaaaggttggtgataatctggatttacgatttcatcatattgcgccacatcaatatccatatgcaataagttttggtcaatatcggtgagtgaacttaaatgtttttcagcatagaagagcagttttaattgtgcatcttccacaatggctgcaatttcttttgggttaagccgccaattcaatggtaaaaaaaccgcacctgttttaaaacaagcaaacaataaatctaatattgcaatatcatttggcgcaaaaataccgataacatcgccttttttaacaccttgagatgttaaataatgtgccatattatcagcgcgtgcattgagttgttggtatgtccaagatgtttgttttgcgtgatcaataacggcaggcttgtcatcatcgaagtctgaacgcgtttttatccaatcgaaattcattagtataccccctttagcttcactttcatactttatgaattgattgtttaagttgtccccatttttctttgtaaatgctggtatcaattaattttaaatgatcagcaataattggtttaaaagccatttgattcaaaatatctttatgcaaatcaagacctggtgcaatttcaattagtttcaagccttgattggtgagttcgaatactgcacgatcagtaacaaaatagatttcttgctcgagtgattgtgaatattgtgcattaaagtcgatatggctcacatctgatacaaatttctggttttgtccttcagtttcaatgtttaatcgttgattatggcatgagacatgactgccagctacaaaagtacctgaaaagataattttatttacagattgcgtaatgtctataaagccaccacatccatttagtcggtcattgaagtaagacacgttgacattgccgtattgatcaacctcagcaaagctaagataggcaactgatacaccattgttataaataaaatcccatgctcgatcatgaggcatgcgcacatctgcattgtaattcataccaaaatgttcacgactcccaacgaatccaccgaaaatgccaacatctaaaatcggttgcacatcatgttcaacacattcttcatgcaataaattagagagttcattattgatgccataaccgatgctaattgtatcgccataagttaaaaactgagcagcacgtcggagaatcaatttgcgactattaaaaggtaatgcgggttcaggtattccatcaattcgttcttctccagacaaggctggtaaataatgactttgaattacttggcggtgattcttttcatcttctgtgacgtatacataatcgacaagatttcctgggataacaacttcattcggttttagttgatagtcgtcaactaaagctttaacttgtacaataactttcccatgattggctttcgcgtttaatgcgacatgataacactcgctcaagtacgcttcttgagttaaataaatgttaccttgttgatctgcgtatgttcctctcagtagtgccacatcaacgctagggaatgtgtaatgtaagtatgtttcatcgttgatggttactaatgaaactaaatcatccgttgttcgtgtatttactttaccgccaccgtatctaggatcaacagctgtgtttaatccgattttagtaataactccaggtaataattgattactctgacgataatgagttgcaatgataccttgtggtaaaaaataagcttcaatgtcattatttttcattgcttgtgccgttttggaagaagccgttaaaatactcataatgacacgtttaatcatgcgacgttctataaaatcatctaaatccggtgcggcacctaaactatgaatatcattcgctaatataaacgttaaatcattgggcgtatgatatgtgtcatgttgcgctaacacagcacgtagaacttcggcgggtaagttggctacagctaatgctggtaaaccaatcacatcaccatctttaatgatatgttgtaagtcgtgccatgtgatttgtttcaagcaagtcacctccatcacatttgataaaatatagcgtttttacactttgtgtaaacccttacaagaaatataacataacgacgtttaaaatcaattagaaatatctttttattctgataatagacacagtatagacacattttgatggtcgataacaattgtaatatcaagggtttgtaatgaattgaatatcattaaaatacttatataaaaatattgttcggaatataaaaagttaaataggttttgatttttaaatatgaaatacaaagtgcccaatcgaacaaagtatttatattaaaatatggaaaatccatcaatattaaattaaaatagttttattatgaaaagtgaaagtaggtaagtctatggaaggtcttaatcatcgaagaaatacagaaaaagaagagacaacacaaacgcaatcagttgcacctaatacaggtgaagaggggatgtcatcagcaagtacacaatcaactaagacgtccgacatacataatgaatctatcgataaacaaatggaagctaaagcgcatgaaacagcgcaaaatacagatttaaaaaacgaagcaagaagtttatttgataatgcaaccaaatcaatcggtagactagcgggcaatgatgaaagcttaaatcttaatttaaaagatatgctttctgaagtatttaagccgcatactaaaaacgaagcagatgaaatatttatagcgggtactgctaaaactacgccagcaatttgtgacatatcagaagaatgggggaagccatggctcttttctcgagtattcatcgctttcacagtaacatttattggattatgggtcatggcagcaatttttaataacactaacgcgattccgggtctcatttttataggggctttaacagtaccattatcgggtttgttcttcttttatgaatcaaatgcgtttaaaaatattagcatttttgaagttattatcatgttctttattggcggcgtattttcattactaagtacgatggtattatatagatttgtcgtttttagtgatcaattcgaaaggtttggttctttaacatttttcgatgcatttttagtaggattagttgaagaaactggaaaagcactcattattgtttatttcgtcaataaattgaaaacaaataagattttgaatggattattaatcggtgctgctattggtgcagggttcgcagtttttgaatcagcaggttatattttgaatttcgctttaggagaaaatgtcccattattagatattgtcttcacacgtgcgtggactgcgattggtggtcatttagtttggtcakcgattgttggtgctgcaatagttattgcgaaagaacagcatggctttgaattcaaagatatttttgataaacgctttttaatattctttttatcagccgttgttttacatggcatttgggatacatctttaactgtacttggcagtgatacgttgaaaatatttattttaatcgttattgtgtggatacttgtattcattttaatgggggcaggtttaaaacaagtgaatttactgcagaaagaatttaaagaacaacagaaaaaagtagacgaataataattaaagcttatgttgctcatatgtttgtgacataagctatttttataatttgtctttaaaagagtggaataggaatactttttggagttaaaaaagtgtttcacgttaaacaaatagtgacaattagatttatataaaatgaacatgattcactgaaagtatgtaataatcattttattgaaattcatcaaacagaaattaatacaatcatataagcaaattaaaccacgccataatcatattggatgacttcggcgtggtttttatagttgaagcagggctgagacataaatcaatgtcccacactcccttatcgttcaatcgttgttcgataatcgattaaatagataccttcaggtgttactttataatttttaaccttagagttagcagcgactatttgatcgttgtaagcaatataactgtttggtacatctcgacttgataatttaataatatcattagaaatattgtgacgttccttaacatctacagtatgattcaattgattaattaaatcatcgacgttgctattattgtagtctcctttattaatagcaccatcttttttatatgcttgattaaagaaataacctgtatctccacgaggaattgttccgaaactatacatcgttgcatcccatgcagaacggtcttttaagtaaccttctatgtcatcaacacttttaatgtcgatttcaatatttgcttttttagcatctgattgtaatacttgcgcaattttcgatagctctggacgaccgtcatacgtaattaacttaatttttaaagggtgttcttttgtataaccatctttagctaataacatttttgcttgttcgatattttgtttggttaacttaggttctttaatatatggaattttatcattaaatggactcgttgcaggtttcgcataaccttgataaatatgatctgcaataccttgtctatcaatgatatgatctaatgcttcacgaacggatttagtcatttttttattagtatgattatacataagtaagaagttctaaan

SEQ ID NO: 192 - DNA, 486 bp; double-stranded, linear
tgaaaactaaagtgtttctaatgcgtgactaaaattagtaataattaagttctcatgataataggtatttttgaaaaatggaggagtctataaatgggtaaaaaaatgggtctaggtttatctattgcattggttgttattggtattgccgttgtatgtttaatgattttttctagtcaaaaaacgacttattttggttatatgaatagtaatacaaatgcagaaaaagttgtcagtgaaaaagatggattagtcaaacataatatcaaagtagaaccatctaatgatttcaagccgaaaaaaggagactttgtaaaattagtttctaaagatgatgggaagacattttataaacaagagattgttaaacatgatgacgtcccacacggtttaatgatgaaaattcacgacatgcatatgaattaataaaaaagcatctataacgtaattttgaagaagtagagttatcttcttatgcgttttaga

SEQ ID NO: 193 - DNA, 1626 bp; double-stranded, linear
gaggtctatatacaattatggttgttccagttaaacgaactgatggctttattactaagtttaatagattaattgaaagacgattattacgtcatttcagtaaaaaaggttatatcacatgggaggaaaattgattgtctgacattttaaaatgtatcggttgtggtgcgccacttcaatctgaagataaaaataaacctggttttgtaccagagcataatatgtttcgtgatgacgtgatttgcagacgttgtttccgcttgaaaaattataacgaattcaagatgtaggattagaaagtgaagactttttaaaattattatcaggacttgcggataaaaagggtattgtcgtcaatgtcgtggatgtatttgactttgaaggatcatttattaatgcagttaaacgtattgtcggaaacaaaaaaatcattttagcagcaaataaattggatttattgccgaaacaaattaataaacgtcgagttaaagaatggttaaaacgaacagcaagaaaatatggtttggaagctgacgatgtcgtattaatttcagctgaaaaaggctggggcatagacgacttattatcatcaattgcgaatattcgagaaaatgaagatgtgtatattgtagggacaacgaatgttgggaaatctacattgattaataaactgattgaagctagtgttggtgaaaaagatgtagtaacaacttcaagattccctggaacaactttagatatgatagatattcctttagatgaaacatcatttatgtatgatacaccaggtattattcaagatcaccaaatgacgcatttagttagtgaaaaagaattgaaaattattatgcctaagaaagaaataaaacaacgcgtatatcaattaaatgaggcgcagacattattcttcggcggtctagcgcgcatagattatgtatcaggtggtaaacgtccgttagtttgtttcttttctaatgacttgaatatacatcgtactaamacggagaaggctaatgatttatggcgtaatcaacttggcgatttattaacgccacctggaaatccacaaaattttgatcttaatgaggtaaaggctgttagacttgaaacaggcaaagagaaacgcgatgttatgatctctggtctaggctttataactataggaccaggggctaaagtaatcgttcgtgttcctaaaaatgttgakgttgtattaagaaattctattttataaggtgattaaaaaaatgaaatttgcagttataggaaatcctatttcacattccttgtcgcccgttatgcatagagcaaattttaattctttaggattagatgatacttatgaagctttaaatattnccaattgaagattttcatttaattaaagaaattatttcgaaaaaagaattagaaggctttaatatcacaattcctcataaagaacgtatcataccgtatttagattatgttgatgaacaagcgattaatgcaggtgcagttaacactgttttgataaaagatggcaagtggatagggtataatacagatggtattggttatgttaaaggattgcacagcgtttanccagatttagaaaatgcatacattttaattttgggcgcaggt

SEQ ID NO: 194 - DNA, 635 bp; double-stranded, linear
agggttaattgtcggtttaattgcaatgaataagttccatgtattagctggctatagagcgaaattcatcttaatggtgattttaactatgatggtcttcgtacttattaatacgtatttactaagacaggtaaaatctatcggtatgttcttaatgattgctgcattgggtctatactttgtagctatgaataatttgaaagcagctggacaaggtgtgactaataaaatttcaccattgtcttatatcgataacatgttcttcaattatttaaatgcagagcatcctataggcttggtgctagtaatattaacagtacttgtgattattggctttgtactgaacatgtttataaaacactttaagaaagagagattaatctaatgttgatgaatagcgtgattgctttaacttttttaacagcatctagcaataatggcggacttaatattgatgtgcaacaagaagaggaaaagcgaatcaataatgatttaaatcaatatgatacaacgctatttaataaagacagcaaagcggttaatgatgcgattgctaagcagaaaaaagaacgacaacaacaaataaaaaatgatatgtttcaaaatcaagcgagtcactcgactcgcttgaatga

SEQ ID NO: 195 - DNA, 13715 bp; double-stranded, linear
ctgaaatgggtattatttgtcttcttcatcataaagtaataaagattgttcatcattgcgacgttgccaattttcatttggcgatcttggaacgtataataattgcctagtagcatacgctttgattgaaacatacaagtcattccttgaacttgcacctcaatttccacatttgaattttcttttatattaataatttcatccaaattcagctcacgtgctaagacagctcttgatgcgcctcttttaccccagtaattacattgaaaatgattagttactaacgtctctgcattccaatgaagtggtattggattttcttgcgccttcacatacattactactgctggatccccgaaaataattctgtcaactcgtatttcatgtaaaaaattaatataatcttctacagcatctaaatgataattatgaaataatccattcactgccgcatatacttttttatcgtttttgtgagctaatgcgacagcctctgtcatttgttgtctattgaattcccctggaagtcttaaaccaaacttttgctcgccaattacaaaagcatctgcacctaaatcaataagtgtttccatatggcttaatgacttgggtgtgacaagtaattctgtcatagtcattctcctttaattgaaatcgctaatccatcgtctatatttaaaaaattcgttgtatatcctggttgctttattaaccactcattataatcttgaacctttttaaccatttgtcttacatttctcgatctaacaatcccaatatccgatacaaaaccgtgatataaaacattatctgtaattacgagaccttggtgctttaaaagtggtgtatatatttcaaaaaatttctttgattgcgcttttgctgcatcaataaatatcatatcataaactttgtcatttacattttcaaattgctctaaagcattaccttcaataattcgaacctggttttcaaaatgataagtagctaaattttgtntagcatattgaatcatcgtttcattacgctctatcgttgtgacatgaatgtcatcagatatagaagcgaattgcatagaactatagccgattgctgtaccaatttctaaaatatttttaacattattcatacgaattaattgcttaattaaatctaatgttaaacgatctacaattggcacttcatttacctcggcaaattcacgcaaaacttcgattgaactattttgatgttgatgtaaatctattaaatattttttatttaggtcatccatgttttaaacttcctttatgtaaaataagtcaatatgattatgacaataaaataaatcagccttcacaattgattataattttgccaaccaattaaatgactgatttcgtgttagacgcaaagctattttatttatagaagcgaatcattcatataaaatttaactttagatattttaccatattttcaataaaattataagcgttaattatttatacattgcttgacttaaaaaatactcttgcctccccatctttaaggttagcaagagtaaaatctttttaattattcttccatttcagtatttacaacttcttcaatcatgtcccattcttcatcagtttcgattggtactaacttaccaccgtcacctgactcatctggttcattgatcattggtacaagctcaatcatatcgtcttcatctgattgagcaccttcttcagctaagataacatactcttttttgaattcaggatgataaaattctaaaacttttcggtataaaacttcatttccctcttcatcgaataaagttaataattcttcttcgttattaatttctagttgtgaatcatgattatgttcagtcatagtaaaatctccttttaatgtagtgaatctaaatagccttgtaaaataaataccgctgccattttatcaatcacttgttttcttttttgtcttgaaacatctgcttctaataatgatcgttcagcagccattgtgcttaatctttcatcccacatcacaatctcaatagaaggataagcttctaataatttttctttatatgttaacgaagcttcgcctcgaaatcctattgaattattcatgtttttaggtagtcctattacgactgtacccacattatgttttttaataatgtctactaattggtcaatacctaattcattattttcttcattgattcggagtgtgtctaatccttgtgccgtccaacccattatatcactaattgcaattcctaccgttctactaccgacatcgagtcctaaaattttatgttgtaacataaattatttattttgctcttttaaatagtaagaaacaagctcttccataataacatctctatcaatatgacgaatttgatttcttgcttcattttggcgtggaatatacgcagggtcacctgataataaataacctacaatttggtttacggcattatatcctcgttcatctaatgttcgataaacattatttaaaacatctcttacatcttgcgttggaagttcttcatagtcgaatttcattgttttatcaaagttttccatttgcgacactcctttaattacaaatataactcactatcatcatacaatattatggctttaaattatagatttttaatgtaatctttaataaagcttaatgattttgagatattttcaggttgtgtaccgccaccttgagccatatctggacgaccgccacctttaccaccaacgattggtgccatttgtttgataagatcaccggctttaacgttatttgttaaagatttagggacagttgcaaccatcgatactttatcatcaacattacttgcaagaatgataattgtatcttgtagtttagatttaaaatcgtccattgtcgagcgaattgctttcgcatttggtacatccacttcagtaaccaatactttatagccattgatttcttcaacttgatcttcaatattacccattttaagtgatgtgatttctttgtcacgttgctctaattgttttaataatgctttttcttcatcttgtaattgtgttaacttatcgactacttgatcatcagatttcactttcagctgtgatttcatcgtattaaatttctcttgaatatcttctaaatataagaaagctgctttacctgttaatgcttcaatacgacgcacaccagctcctgtacctgactcacttactattttgaataagccaatttcagaagtattgcggacatgaataccaccacataattcaattgaaaatggtgccatatttactacacgcacaacatcaccatatttttcaccgaataatgccattgcgcccatttctttagctgaagcaatatccatttcttgaatgttaacgtcaatacctttccaaatttcttcatttactaagcgttcaacttgatcaatttcatcattagtcattggaccaaaatgagagaaatcaaaacgtaaacgatctgcttctactagtgaaccagcttggttaacatgatcacccagtactgatttcaacgctgcatgtaataaatgtgttgcactatggttcttttgaatgtcacgtcgatcattttggttcacttcagcagacactgtagcgccaacatttacttggccaaattgtactactcctttatgcaagttttgaccatttggtgctttggttacttcactaacagcaatttcaaaattgtcattataaacaatacctgtatccgcaacttgtccaccactgattgcataaaatggtgtttccgttaacatgaagtatactgtttcacccgcttcaacttgtgaaacttcttcaccattgtatatcaagtgtgttagtgttgtttgagctgtcgcagtatcataaccaacaaaagtacttgcagatgtaatatttttcaatacttcactttgaacttgcattgattgagaattttgacgtgcttgacgtgcacgatcacgttgttgttgcatttctgactcgaatgttgtcatatcaactttcaatcctgcttgcactgctatttcttcagttaattcaattgggaacccatacgtatcatacaatttaaatgcatctttcccattaatttcatttgttgtcgctttagcttttttaattaattcatttaaaatcgctaaaccatcttctaatgtttcatggaatcgttcttcttcagactttataacacgcttaatgaaatctgctttttccttaacatttggataatatggttccataatgtctgcaacaatatcaacaagtttgtacataaatggctcattgattcctaacgtttgactaaaacgaacggcacgacgtaacaatcgacgtaatacataccctctaccttcattggcaggtaatgcaccatcagaaattgcaaatgcaatcgtacgaatgtggtcagcaattactttaaatgccacatcttgttcgttgtttactaaatattgtttacctgatactttttcgatttcattcattataggcataaataaatctgtttcatagttagtacgtacattttgagaaactgaggccatacgctcaagccccatgccagtatcaatatttttattaggtaatggtgtgtaactatgatctttattatgattgaattcactaaatactaagttccatacttcaagatagcgttcattttctccacctggatacatttcttctgccggatcgtcttgtccatatgcttctccgcgatcatagaaaatctcagtgttcggtcctgaaggcccttcaccaatatcccagaagttaccttcaatgcgaataatacgactttcttcaagcccaatatctttatgccaaatgttgtatgcttccatatcttccggatgaatcgtaacgtacaatttatctggctccatacccatccatttatcactcgttaaaaattcccaagcaaattcaatcgcttcttgtttaaaataatcaccaattgagaagttacctaacatttcaaagaatgtatggtgacgcgctgtgaaaccaacattttcaatatcatttgtacgaatagctttttgagagtttacaattcttggctttttaggtgtttcacgtccatcaaaatatttctttaatgttgctacacctgaattaatccataataatgtatcatcatcaattggcactaatggtgcagaaggttcaaccatatgtcctttttcaacaaagaaatctagatatttttgtctaatttcactcgcttttaactttttcatcatttacacatcctatttactgtttttaaattaccattccataaaaattgatgacacagatagtcgatttgcaaaactagtataaatcaatatcattttttattattaaaaaataaaaaacgcccatcctcaaaagggacgaacgttatcgcggtaccaccctagttataaatgcaattcaacacatttatcactttaattcgactatacagttgtgcataaagtagcgttcactaatgtttgttgtacttttcaccaaccagtacatctctgataaacaaatcattaactactcatctttatacgaatttaattctattttagttacatttacgcttgttgtcaacgttctataaagtcatacggcgtgatttctcccatattaatcattgggtcaattttaaacattgtagcttccgttaatacatttgtatctgtttttgttgaatcagacataacttcttcactatcattcgatgacattggcgcttctacttgatcatctattgtcgtttgtgaagctcctgtatcattagttgctgtgttttccagcatttcttcatcttctgaattaaaataatttttcaacaatgtacataattgtgttaaacgcgcttgaccatttgttttcaatccaatatcaaatgcttccggatcaccaagtaaaactaaactcgttttcgctctagttaaaccagtatataatatcggtctttgtaacattctaaaatactgtttaacaataggcatgataacaataggaaattctgaaccttgtgatttatggattgatgtacaataagcatgtgttaattccatcatatcttgtttcgtaaatgtaatttcattaccttcaaaatccacaacaagtacatctttattaagggcattttctttcgcccaaaaaataccaacaataactcctatgtcaccattgaatatgttatcatttggcctattaacaagttgtaatactttgtcaccttttctaaagactacatcaccaaactcaatttctcgtgtgtctttctttttagggtttaaaatatcttgtaaaacttgatttaaacgtttaataccggcatttcctttatacattggtgcaagcacttgaatatcagccatagtataccctttattaacagcactagtaactaccttctcaacaactgttggtatttggtttgcctgacagttaataaaacttctatcatgaaaacgctgtgtaatatcaattttctgacccaacttcattcgatgtgctaattctataatgcttgaaccatcttgttgacgatatacttcagtcagatttactcgtggtatagctttcgattcaattaaatctttaaatacttgaccaggacctacagaaggcaattggtcctcatcacctacaaatatcaattgtgcatctaaaggaactgcacttaaaaattggtggaacaaccaagtatctaccatagacatctcatcaatgattatgagtcgtgcgtttatttcattttctaatatatcctctggctttgtgtcttgattccaacctattaaacgatgaatcgtcattgcttctaatccagttgactcttgtagtctcttagacgctcttcctgttggcgctgctaatacaactggataatcatcattgacataatcatcataatctaatgataagccatgaatctcagcatataattcaacaatacctttaattactgtcgtttttcctgttcccggtccaccggttaatagcatcaccttagaattgatagccgtttgcaaagcttctttttgtgaagctgcatagttcacttgattcgcatcttctatttcaccaatatgcatttgtaaatctgactgttcaatttctgtaagtttatttgtatgcgtctttattctgaataagttttgaacacttttgatttcagaataatacaaacttggaattgcaacttgttcattgtcaataattagtcgtttttcctcatttaagtattgcaacatttcgtctaatttttcaggttcgatgacctcttcatcttgataatttaatacatcaaccgttaaatctataacaacattgataggcaaatatgtatgtccctgtttaatacattcttcttctaacgtatagagcaacgcagcttttaatcgttcattatcgttataagcgataccaatatttctagcaagttgatctgctttattaaaaccaatacctttaatatcataaatcaattgatatggatttcgatctaaaatagtcagtgtatcgccgagataaaactgataaattgccattgaaagtttaggaccaaaccctaaatcatgtaaacgaatcattattttttcagattcttgatttgctgaaatttgttctgcaatttgtttctgtttctttttagataatcccgaaactttttctagcactgaatggtcatctaatatatcatttatcgcattgtcacctaatgtattaacaatattttgagctgtctttttacctacacctttaaacaaatcactagataaataacttataattgcttctttcgtttgtggcatttctttttcaaaagtctctgcttttaattgtttaccataacgtggatgatcaacaacttgccctttaaatgtgtagacatcgccttcaacaatattcggaagaaaccctacaacagttggcattgtatcaaagtcttcatttgtttcaatagtatctactttaagcactgtataaaaattatcactgttttgaaacaatatcgcttcaacagtacctttgatcattgaataatcaaatagtgtagggtctgacatgttactcctcctctttcattttagtgaatgttttcagcgcatgctgacttaataagtgtttagggtcgatagtcacagcttctttaaaatgagttattgcttcatcaatatcttcatttttcataaataacgctaagcccaaattgtatcttgcatcaacatgatttttatcaatcgttaatacatgtttaagttgagttatggcttcattaaacatttctaattgacataatacaagaccatattgaaattgaacttctgcatctttgtctttatctagttccgcagcagtcattaaatacggcaatgccaagcttaaatgattctaactgattaaacgccataccgatcatataattacaatcaacttgttcaatctctgtttgtaatgcttgttgatataatttaatagcttcttgataacgttgctgattataatatacatttgctagattaaaaaatacgacgccattcttcggatctattgtnaaagctttttggaaaaaacgctctgcctttycaaycycattcgcatcagcaagtacgatmccagcattaatataattttcaataattgtaggattttcttcgatatttccgaacaatgcttgtaacgcttcttctatttttccattttgtatgtattgataaattgtttgttgatctatcatttacgaacctcatttctcatcaattataacatcttgataaattgtatgtctcgaatcacttaacaacgaataaaatataatctaatatcatcttcattcatgaaaaagcgggaatggaatagaaatgcttaagaaccattaacggtttattatgtaatggttcttccacattagccaccactattatgtacttaaaaataagaatacataattagattcatgcatagggagtgggacagaaatgatattttaacaaaattaaattcgttatccccaactggcattgcctgtagaatttctttacgaaattctctatgttgtggtcccgccaatataacattgtagagcctaggacattgtgatgtcccagactctatcctcatgaattattctcatcaaaaactgtctttcgtcattttcaacgttgaaacttcaaataagtaatttattgttgccattgtttatacaacataatttaattgaccttcatttttgaacacatcgtcaattgttgcaccaccaagacacacatcaccttgataaaaaacaactgcttgtccaggtgtgattgctcttactggctcagcaaaagtaacacgtaggcatggtcgttttcacgtttcacaaaaactttcgtatctttttggcgatatctaaatttagctgtacattcaaaaccttgatctaagtcattatcttctggatttacaaatgaatagtctgaagcaattaagtaatcactgtataatgcatcgtgatggaatccttgttctacatataaaacattatcttttaggtttttaccgacaacaaaccaaggatcgccatctccacctatacctaatccatgtctttgtcctattgtgtaatacatcaaaccactatgtttacccattttcttaccatcaagtgttatcatatcacccggttgtgcaggtaaatattgtgataaaaatgttttaaagtttttttcgccgataaaacaaatgcctgtagaatcttttttcttagcagtaacaagtccttgttcttcagcaattcgacgcacttcactcttttcgatgtcgccaattgggaacatcacttttgaaagttgttgttgagataattgattcaagaagtatgtttgatctttattattatctacaccacgtaacatttcaacatgaccatcttcatgacgatgtatgcgtgcgtaatgtcctgttgctacataatctgcacctaaattcatcgcatgatctaaaaaggctttaaacttaatttctttattacacataacgtctggatttggagtacgaccttttttgtattcatctaagaaatacgtaaagactttatcccaatattctttttcaaaattaacagcgtaatacggaatgccaatttgattacacacttcaataacatcgttgtaatcttcagttgcagtacatacgccattttcgtcagtgtcatcccagtttttcataaatatgccaatgacatcataaccttgttcttttaagacgtgggctgttacagaactatctacaccgcctgacataccaacgacaacacgtatatctttatttgacaattatgactcctccttaaatttaaaatatattttatgaatttcagctacaattgcattaatttcattttcagtagtcaattcgttaaaactaaatcgaatcgaatgatttgatcgctcctcatcttcgaacattgcatctaaaacatgcgacggttgtgtagagcctgctgtacatgcagatccagacgacacatagatttgtgccatatccaacaatgttaacatcgtttcaacttcaacaaacggaaaatatagatttacaatatggcctgtagcatccgtcattgaaccatttaattcaaatggaatcgctctttcttgtaatttaactaaaaattgttcttttaaattcattaaatgaatattgttatcgtctcgattcttttctgctaattgtaatgctttagccatcccaacaatttgcgcaagattttcagtgcctgcacggcgtttcaattcttgttcaccgccaagttgaggataatctagtgtaacatggtctttaactagtaatgcaccgacaccttttggtccgccaaacttatgagcagtaatactcattgcgtcgatctcaaattcgtcaaacttaacatcaagatgtccaattgcttgaaccgcatcaacatggaaatatgcatttgtctcagcaataatatcttgaatatcataaatttgttgcactgtgccaacttcattatttacaaacatratagatactaaaatcgtcttatctgtaattgtttcttcaagttgatctaaatcaatagcacctgtatcatcaacatctagatatgttacatcaaaaccttctcgctctaattgttcaaaaacatgtaacacagaatgatgttcaatcttcgatgtgataatgtgattacccaattgttcatttgcttttactatgcctttaattgccgtattattcgattctgttgcgccactcgtaaatataatttcatgtgtatctgcaccaagtaattgtgcaatttgacgtcttgactcatctaaatatttacgcgcatctcttcccttagcatgtattgatgatggattaccataatgcgaattgtaaatcgtcatcatcgcatctactacttcaggttttactggtgtggtcgcagcataatctgcataaatttccatgtttggacactcctcacaattttatcaatgttccaataatagcaccttacatactatttttctacttttctgtttaactttatttataatgtttttaattatattttaccattttctacacatgcttttcgataggcttttttaagtttatcgctttattcttgtcttttttataaattttagtatttgcagatatttttttatttgtaaaatgtaacgtactattattttggttatgagcaatttaatatttatctggttattcgattggtatacttcttatatcataaaaaaggaaggacgatataaaaatggcgattaaatattcagcattaaaccttgtccctattcgagaaggtgaagatgaacaaacagcaattaataatatggttaatctcgcacaacatttagacgaattatcatatgaaagatattggattgctgaacaccataacgctcccaacctagtaagttcagcaactgctttattaattcaacatacgttagaacatacgaaacacatacgtgtaggttctggaggcatcatgttacctaatcatgctccattaatcgttgcggaacaatttggcacgatggcaacattatttccaaatcgtgtcgatttaggattaggacgtgcacctggaacagatatgatgaccgcaagtgcattaagacgagatcaacatgatggtgtttataaatttccagaagaggtttcattattacaacaatatttcggccctgctcaccaacaagcatatgttcgtgcttatccagcagtaggtaaaaatgtgcctttatacattcttggttcttcaacagattctgcacatttagctgctcgcaaagggcttccatatgtgttcgctggacattttgcacctcaacaaatgaaagaagctatcgaaatttacaaaacgttatttgaaccttctgatgtattagacgaaccttatgttattgtatgtttaaatacaatcgttgctgaaaatgatgacgaagcacaatatttagcttcatctatggcacaagtaatggttagtatcactcgtggcagaatgcagcccgttcaaccgccaacacatgaactacaaaatatattaacgccgagagaatacgcgatggctatggaaagacagaaaatatcattaataggttcagaaaatactgttcaacaaaaaattcaagattttatggaaacttatggtgaagtcaacgaaattatggcaataagttatatttatgataaagatatgcaattagactcttatcgtcggttcaagaatgttataaatcagataaatgaaaaaaacactttataatgtgataaataaactaagtgaaagtatgtatccataatattaataaaaatatacagtaacagcattttgaatgaaagatgtctttattgttcaatcatttattttagtaatgattcaaattcacttaaaatyctaatgcaaatatgaaagcgccccttcactttacactgtgtaagtgtttatttgatggggcgctttcaaaatattgaaaagcatatccaaaatttaaagaaatttatttctctttatcttcattttcttttttctcttcgttattcgatcctgtatattcatttatcttatcttttacatttttaacttgttcattatcgctatttttaaatttttctacgcgtctttagctttatccataaaactcatattaatcgctcctcttatatttgattagtttaattgaacttattttttaagtttatcaattgcatcagttattttgtttttagcattttcaacaacttcttttgctttaccagtcgctttatcttgctgaccttctttttctaattctttgttatcagtaacgttacctactgtttctttaacatttcctttaaattgatcgaacttactttcgtctgccatagtgaaacctccttggatgtatatatttatataccactaaggaggttcgctmmmcayymyaatatgaagtttttatgttatagtatagtatttatacgattaaatataaaacatgtatccgtctaaatcttcacttgtatctacatattccgctaaatatttcaatgttgtattatctaaaacatctctcactgcatctstcatgcgaatccatagttgtttttgcgcaggtggttctgattcaatactttcaacaaatgtaattggaccttctaacagtcttataatatcccctgctgagatttctt

SEQ ID NO: 196 - DNA, 873 bp; double-stranded, linear
aaatccataatgtcatgataatctgcatatgcttcatataattcaatcattgtgaattcagggttatgtctagttgatacaccttcattacggaatactctaccaatttcatatactttttcaagtccaccgacaattamacgttttaaatgcaacycaatagcaatacgcatgtataacgttgcatctaatgcattatgatgtgttacaaatggtctagcagctgctccaccagcaatttggtgcatcataggtgtttctacttccaagaaacctttattatttaaataattacgcatttcttgaatgattttactacgattaataaatgtacgagtgctatcttcgttcgtaattaaatctaaatatctttgacgatatctctgttcaatatcctgtaaaccgtggaatttatccggtaatggtcgcaatgatttagttagtagcgtgaatttcttcgctttaaccgataattcgccagtatttgttttgaacattacaccttcaacaccaacgatatcgcctaaatcagcatttttccataaatcaaattcgtcatcgccaacttgatctttacgaacgtaaatttgaatttgtccagctaagtcctgaacgtgtgcaaatcctgctttacctttaccacgcttagtcattaatcgtccagctatagcgacatgactatccgcttctttttctaccaattcttctttagaatactggtcccactcttctttcaaatcactagataaacctgaacggtcaaatttagaaccaaacgggtctataccaagatcatataattcttgtaatttttgacgtcgaaccaacatttggtcattcatttcttctgacataactttctctcctttaact

SEQ ID NO: 197 - DNA, 452 bp; double-stranded, linear
ttgtctacttcctcatagctttcaatacgtttatcaaattcttcttctgtttctccaggaaccataatatgaatggcttcaggatcaaaataaagaccaacttcactgcctacttcagcttttttagtcgtttgtattacccattcataacctttattgtctatacaacatatttcatagtggacccctctaaataacatagaatcaacagttgctttaaataatccttcttcagctttgattaatgatatatcttctggtcgaataacgacttctacttttttattttcaggaatacccatatcgacacattcgaaatcttgcccataaatattcacgacataatctctaaccatgcgcccttcaacaatattagattctccaataaaatcagctacaaatcgattcactggttcgtcatatatatctgttggtgtgccaaattgttgaat

SEQ ID NO: 198 - DNA, 2308 bp; double-stranded, linear
taggttgggttctaacatacgataaagctcaacaaatcaacacagctttctttgtaaaattgtttaatactgcattagcagaacgtgattattattttaatatagatggaacaaatgcttttagattatttaatgctgaaggtgatggtgttgggggattaacaatcgacaattacgatggtcatttgttgattcaatggtactcaaaaggtatttataaatttaaatatgccattcttgaagcggttagaaaagtatttgattataaatctatttacgaaaaagtaagatttaaagacagcgaatatagtggtggttttgttgaaggagatgcacctgagtttccaattgttatcgaagaaaacttcacattttataatgtagaccttgaagatggtttgatgacaggtatctttttagatcaaaaagaagtgcgcaagaaattaagggatcaatatgccaaagaacgccatgttttaaacttatttagttatacaggtgctttttctgcaatagcagcaagtgaggcatcttcaacaacaagtgtagatttggctaatcgttctcgtagtttaactgaagaaaattttggattaaatgctattgatcctaaatcccaatatatttatgtcatggacacttttgatttctataaatatgctgcacgacatggacatagttatgacacgatcgtgattgatccacctagctttgcgcgtaacaaaaaacgtacattttcagtgcaaaaagattatgacaaattaattaatggcgccttaaatatcttatcatctgaaggaacattattgttatgtacaaacgcaagtgtatatccattaaagcaatttaaaaatactattaaaaagacgcttgaagagagtggcgttgattatgaattaactgaagttatgggattaccaaaagattttaaaacgcatccacattataagccatctaaatatttaaaagctgtttttgtaaatattagacattaatttgataaaaaggggtatagtaacttattgagaaaaagaagggtgataatattatgggattcaaaaacaatttaacatcaaatttaacaaataaaatcggtaattcagtctttaaaatagaaaatgttgacggaaaaggtgcaatgccaacgacgattcaagaattgagagaaagacgacaacgtgctgaagcaattgtaaagagaaagtctttaatgtcatcaacaatgagcgttgttccaattccgggtttagattttggtgttgatttaaaattaatgaaagatattatcgaagatgttaataaaatttatggtttagatcataagcaagttaatagccttggggatgatgtgaaagaaagaattatgtctgcagcagcaattcaaggtagtcaatttattggtaaaagaatttcaaatgcatttttaaaaattgtaattagagatgtagctaaacgtactgctgcaaaacaaacaaaatggtttcctgttgtaggacaagctgtgtctgcatctattagttactattttatgaataaaattggaaaagatcacattcaaaaatgcgaaaatgttattaaaaatgtcatgtaggtgctataatagttttgcaatttgcaaattttactgaaaccggttttaaacgaattgaatttaaagcatggttttggtaaagttaatgtataaaactaagttagyattgtaataatatkgaagattctaactatacgaaggagaaatgtaattatggaacaaaattcatatgtaatcatcgacgagamtggtattcacgctagaccagcaacaatgttagtacaaacagcttcaaaattcgattctgatattcaattagaatataacggtaagaaagtaaacttaaaatcaatcatgggtgttatgagccttggtgttggtaaagatgctgaaattacaatttatgctgacggtagtgatgaatctgacgccattcaagcaatcagtgacgtcttatcaaaagaaggattgactaaataatcatgtctaaattaattaaaggtattgccgcatctgatggtgtcgcaattgctaaagcttatttattagttgagccagacttaacattcgacaaaaatgaaaaagtcactgatgttgaaggagaagttgcaaagttcaatagcgctatcgaagcttctaaagttgagttaactaaaattagaaataatgcagaggttcaactaggtgctgataaagctgctatctttgatgcacattggggggtggtagatgaccctgaattaattcaaccaatccaagataagattaaaaatgaaa

SEQ ID NO: 199 - DNA, 5559 bp; double-stranded, linear
aagtaataaatcgtctcatttggcaactgacgcataatttctttagctactgtcaaacctccgacaccagagtctattacacctattggtttattcatattcggtcatccttacttttaatttaatttttagtttatcataactaagcattggattttagtattatgcactgtgtttaccatttttgtcattataatatttattttaaatcagcccactatcatattgtcatgtaatctgcttattaaaaaaatcccttccaagttattgtgtatctccattcaatttaattttgaaaggaacataacwttttaactcaaaagggattaatttntantctacttcatggtctgaaccaaagaatgatttaaacatgtggaatgttgtttctctgttcattgctgcaatggatgttgttaatggaatacctttagggcaagcattaacacagttttgtgaattaccacactgctgtaagccaccagtacccattaatgcatttaaacgttcatctttagtcatagatcctgttgggtgcaaattaaacaaacgaacttgcgagattgcttgtgcaccaacgaatttattattttcagtaacattaggacaaacctctaaacatacaccacatgtcatacatttagataattcataagctgtttgacgttttttctctggcatacgtggtcccggacctaaatcatacgttccatcaattgggatccatgctttcatacgttttaagttatcgaacattctagaacgatcaacttgtaagtcacggataactgggaaagtattcattggctctaaacgaataggttgttctaattgatcaacaatcgcagaacaagattgtcttgcacgaccattgataaccatagaacatgctccacatacttcttctaagcagttcatatcccagacaacaggtgttgttttttcacctttaatattaactgggttacgtctaatttccattaaacaagcaatgacgtttaaattttcacgatatggaatttcaaatgtttcttcataaggcttagaatcacttgtatcttgtcgtttaataattaattttactgttttttgtttcggtttagattgtgtttcatgttgtggagtgtttttcactgattgttcagtcattattttttaccccctttagacttacttgtgtaatcacgtttacgaggtggtattaaactcacatcgacgtcatcataagtaaactgcggtttttcaaatgcgccttggaatgaggccattgtcgtttttaaccactcttcatcattacgctctgggaattctggtttataatgggcaccgcgtgattcgttacggttatatgcaccaatcgtaataacacgtgcaagtactaacatgttccatagttgacgggtaaagaataccgcttggttactccaagtttgagtatcttccatatcaatatcttcataacgtttcatcaattcaacaatctttttatctgtttctaacagtttttcattttcacgaacaacagttacatttgctgtcataatttcaccaagttcacggtgtaatttatatgcattttctgtaccgcgcatagctaataatttatcaaaacgttcttgctcttcagctttacgcttttcaaaaatactttcgtccatatcagtatatgatcgatcaatatttgaaatataatcaatcgcgtttggacctgctactgtaccaccataaatcgctgataacaatgaattggcacctaagcggttaccaccatgttgagagaagtcacattctccagctgcaaataaccctttaatatttgtcatttgatcataatctacatatagaccacccattgaatagtgaacagctgggaaaatcttcattggtactttgcgtgggtcatcaccagtgaatttttcataaatctcaatgataccacctagttttacatctaactcatgtggatctttatgtgacaaatcaagatataccatgttttcgccatttatacctaatttttggttaatacatacatcgaaaatttcacgcgttgcgatatcacgaggtactaagttaccataatcaggatatttctcttctaagaagtaccaaggcttaccatctttatatgtccaaattcgtccaccttcaccacgtgctgattcactcattagtcgcagtttatcatcaccagggattgcagtaggatgaatttgaatgaactcaccattagcataaatagcgccttgttggtaaacaatggaagccgctgatcctgtattaatcattgagtttgttgttttaccgaaaataataccagggccacccgttgccataataactgcatctgaaccaaatgtttcaatctcagcagttgtcatattttgtgcancgatacctcttgcactatcatcgtcacctttaactatgccaaggaattcccatccttcatacttcgtaactaatccatctacttcatatgcacgaacttgttcatccaatgcatataataattgttgtccagttgttgcccctgcatatgctgttctgtgatgtaatgtaccaccgaaacgtctaaaatctaatagaccttcatttgttctattgaacattacgcccatacggtctaataaatgaataattttaggtgctgcctctgtcatcgctttaacaggtggttggtttgcaaggaaatcgccaccatacactgtatcatcaaagtgaatccaaggagaatcgccttcccctttagtattgaccgcaccattaatgccaccttgggcacaaacagagtgcgaacgctttactggtacaactgagaacaaatctacatgtgcacctttttctgccgctttaattgttgacattaagcccgctaggccacctccgacaacaataagatgtttctctgccataaaaatttcactcccctaaattttcaatctatatttgttaaatgcgatgtattacataaaggcaataattgcagtaacaccaatatacgaaataactaaaaatacgattaatgaaacccatgtaaatactcgttgtgattttggagattgaagtccaccccaagtaactaagaatgaccataagccatttgcaaagtggaacacaacagcaataatacaaataatataaaatattgcccatccaggatgttgcaatgtttcgtgcattaaatcgtaattcacttctttgccgtaaaatgctttttgtaaacgtgtttgccataaatggataccaataaagataaatgttaagataccactcactctttggaagaagaacatccagtttctaaaaatcgagtaatgtccaacattttcttttgctgtaaatgcaatgtgtataccaaacaaaccgtgatataacaacggaatgtatataaataaaaattctacaataattagaaatggtaatgattccataaagttagatgccttattaaacgcttcagcaccttgtgttgcttggtgattcactaataaatgaacgaccaaaaatgcacctattgggataatacctaataacgagtgaatacgtcttagataaaattcattttttgattgagccaaaaggagtcccccctgtgaacgaatatttaatttattgagctatttatattaaacgtacgcttaaccccctaaagtgatatcgtttctagcgttgtcattatcattaagcgaaacattttaaagacaaatacacactgcacgatcaccaaactgcatgtcgaacaatgtaacatttggattcgatatttaaaattgcttgtgatgataaactttctcatttagaaaacgcttccacgtacattcaaaaaaataactttgttaaccatattgtaacattatttcatatattttggggcatgagaatgattctcacgcccagtaatttatttatgcaattgttcatgtaggttctttgcgacgttttcaggaatacctatatttttaaaatcttcaagtgtagcttccttcattttcttgattgaaccgaatgaacgcaataataatgttttacgtttgttaccgataccatctatatcatcaagtattgatttcaagcctgtcttttgacgtgtttgtctatgaaatgtgattgcgaatctgtgaacctcatcttggatacggtgcaacaaataaaatgcctggctatttttcttcagtggtacaatttctgcactagcgccatataataattcagatgtttggtgtttatcatttttctgcaaacctgcaacagggatatcaagacctaattcgttttgtagcacatcaataaccccgttcatatgtcctttaccaccatctactattattaaatcaggtaatggtaatccttcgtttaaaacgcgagaatatcgtcgtcttactacttctctcattgatttgtaatcatctggacctttaaccgttttgattttatactttctataatttttcttatctggtttaccgtcgacaaatgtaaccattgctgacactggatccacaccttgaatattagaattatcgaatgcttcaattctaattggtgtttgaattcccatttgtgttccaagttcttcaatagctttaatcgttctggactcatcacgtgatattaattcaaatttattatttaaggatactttagcgttatgtgcagctaggtcaaccatatcttttttgggacctcgcgcgggttgaacgattttagtgtccacaacagattgaatcatttctttatccaaattacgtggtacatgaacttccttaggtaaaatatgttggtttaagctataaaattgtccaataaatgtataaaattcttcttcttctgtttgctgtaatggaatcatcgttgtatctcgctttatcatattaccttgtcgtataaagaaaacttggatacacatccatcctttatcaacactataaccaaagacatcacgaatcgttttatctgatgacataattttttgtttgtttgtcagattttgaatatgttgaattaaatctctatattctttagcccgttcaaaatcaagtgattcacttgcagttaacattcgctcttctaaactttttaaaattgttttgtcttccccattcagaaaatcagtaatttccttcgtcatttgtgcgtatttactcaaatcaacgtcatatacacatggtcctaaacattgtccaatatggtaataaagacataatttatctggcatcttatcacatttgcgatatggatatattctgtctaataactttttagtttcttgagcagaatatgcattcggatacggtccgaaatatttgccagtaccttgttttacagttctcgtcactagtagtctaggatatttctccttcgtaattttaataaatggataacttttatcatcctttaataatatattatatcttggttgatattgtttaatcagattcaattccagtaaaagtgattctgtttcacttgacgtgacaataaactcaaagcgacgtatttcaccaaccagtctcgttgttttagcatcatgagcacccgtaaaatatgatcgcaatc

SEQ ID NO: 200 - DNA, 4594 bp; double-stranded, linear
aaatcaatcgagtggcatgtcaaggtcatatcaatattttagaatctgcgactatgagagaggaaataaatgaaattgcgcgacgtatcatcgttgatattcgtgataagcaattacgatatcaagatattgctattttatatcgtgatgaatcttatgcttatttatttgattccatattaccgctttataatattccttataatattgatacaaagcgttcgatgacacatcatccggtcatggaaatgattcgttcattgattgaagttattcaatctaattggcaagtgaatccaatgctacgcttattgaagactgatgtgttaacggcatcatatctaaaaagtgcatacttagttgatttacttgaaaattttgtacttgaacgtggtatatacggtaaacgttggttagatgatgagctatttaatgtcgaacattttagcaaaatggggcgtaaagcgcataaactgaccgaagatgaacgtaacacatttgaacaagtcgttaagttaaagaaagatgtcattgataaaattttacattttgaaaagcaaatgtcacaagcggaaactgtaaaagattttgcaactgctttttatgaaagtatggaatatttcgaactgccaaatcaattgatgacagagcgagatgaacttgatttaaatggtaatcatgaaaaggcggaggaaattgatcaaatatggaatggcttaattcaaatccttgatgacttagttctagtatttggagatgaaccaatgtcgatggaacgtttcttagaagtatttgatattggtttagaacaattagaatttgttatgattccgcaaacattggaccaagtaagtattggtacgatggatttggctaaagtcgataataagcaacatgtttacttagtaggtatgaatgatggaacgatgccacaaccagtamtgcgtcaagcttgattacagatgaagaaaagaaatactttgaacagcaggctaatgtcgagttaagtccaacatcagatattttacagatggatgaagcatttgtttgttatgttgctatgactagagctaagggagatgttacattttcttacagtctaatgggatcaagtggtgatgataaggagatcagcccatttttaaatcaaattcaatcattgttcaaccaattggaaattactaacattcctcaataccatgaagttaacccattgtcactaatgcaacatgctaagcaaaccaaaattacattatttgaagcattgcgtgcttggttatatgatgaaattgtggctgatagttggttagatgcttatcaagtaattagagatagcgatcatttaaatcaaggtttagattatttaatgtcagcattaacgtttgacaatgaaactgtaaaattaggtgaaacgttgtctaaagatttatatggtaaggaaatcaatgccagtgtatcccgttttgaaggttatcaacaatgcccatttaaacactatgcgtcacatggtctgaaactaaatgagcgaacgaagtatgaacttcaaaactttgatttaggtgatattttccattctgttttaaaatatatatctgaacgtattaatggcgattttaaacaattagacctgaaaaaaataagacaattaacgaatgaagcattggaagaaattttacctaaagttcagtttaatttattaaattcttcagcttactatcgttatttatcaagacgcattggcgctattgtagaaacaacactaagcgcattaaaatatcaaggcacgtattcaaagtttatgccaaaacattttgagacaagttttagaaggaaaccaagaacaaatgacgaattaattgcacaaacattaacgacaactcaaggtattccaattaatattagagggcaaattgaccgtatcgatacgtatacaaagaatgatacaagttttgttaatatcattgactataaatcctctgaaggtagtgcgacacttgatttaacgaaagtatattatggtatgcaaatgcaaatgatgacatacatggatatcgttttacaaaataaacaacgccttggattaacagatattgtgaaccaggtggattattatacttccatgtacatgaacctagaattaaatttaaatcatggtctgatattgatgaagataaactagaacaagatttaattaaaaagtttaagttgagtggtttagttaatgcagaccaaactgttattgatgcattggatattcgtttagaacctaaattcacttcagatattgtaccagttggtttgaataaagatggctctttgagtaaacgaggcagccaagtggcagatgaagcaacgatttataaattcatccaacataacaaagagaattttatagaaacagcttcaaatattatggatggacatactgaagttgcaccattaaagtacaaacaaaaattgccatgtgctttttgtagttatcaatcggtatgtcatgtagatggcatgattgatagtaagcgatatcgaactgtagatgaaacaataaatccaattgaagcaattcaaaatattaacattaatgatgaatttgggggtgagcaatagatgacaattccagagaaaccacaaggcgtgatttggactgacgcgcaatggcaaagtatttacgcaactggacaagatgtacttgttgcagccgcggcaggttcaggtaaaacagctgtactagttgagcgtattatccaaaagattttacgtgatggcattgatgtcgatcgacttttagtcgtaacgtttacaaacttaagcgcacgtgaaatgaagcatcgtgtagaccaacgtattcaagaggcatcgattgctgatcctgcaaatgcacacttgaaaaaccaacgcatcaaaattcatcaagcacaaatatctacactccatagtttttgcttgaaattaattcaacagcattatgatgtattaaatattgacccgaactttagaacaagcagtgaagctgaaaatattttattattagaacaaacgatagatgaggtcatagaacaacattacgatatccttgatcctgcttttattgaattaacagagcaattgtcttcagatagaagtgatgatcagtttcgaatgattattaaacaattgtatttctttagcgttgcaaatccaaatcctacaaattggttggatcaattggtgacaccatacgaagaagaagcacaacaagcgcaacttattcaactactaacagacttatctaaagtatttatcacagctgcttatgatgctttaaataaggcgtatgatttgtttagtatgatggatagcgtcgataaacatttagctgttatagaagatgaacgacgtttaatggggcgtgttttagaaggtggctttattgatataccttatttaactggtcacgaatttggcgcgcgtttgcctaatgtaacagcgaaaattaaagaagcaaatgaaatgatggtcgatgccttagaagatgctaaacttcagtataaaaaatataaatcattaattgataaagtgaagagtgattacttttcaagagaagctgatgatttgaaagctgatatgcaacaattggcgccacgagtaaagtaccttgcgcgtattgtgaaagatgttatgtcagaattcaatcgaaaaaagcgtagcaaaaatattttggatttttctgattatgaacattttgcattacaaattttaactaatgaggatggttcgccttcagaaattgccgaatcataccgtcaacacttccaagaaatattggtcgatgagtatcaagatacgaaccgagttcaagagaaaatactatcttgcatcaaaacgggtgatgaacataatggtaatttatttatggttggagatgttaagcaatccatttataaatttagacaagctgatccaagtttatttattgaaaagtatcaacgctttactatagatggagatggcactggacgtcgaattgatttgtcgcaaaacttccgttctcgaaaagaagtactgtcaacgactaactatatattcaaacatatgatggatgaacaagtcggtgaagtaaaatatgatgaagcggcacagttgtattatggtgcaccatatgatgaatcggaccatccagtaaacttaaaagtccttgttgaagcggatcaagaacatagtgatttaactggtagtgaacaagaagcgcattttatagtagaacaagttaaagatatcttagaacatcaaaaagtttatgatatgaaaacaggaagctatagaagtgcgacatacaaggatatcgttattctagaacgcagctttggacaagctcgcaatttacaacaagcctttaaaaatgaagatattccattccatgtgaatagtcgtgaaggttactttgaacaaacagaagtccgcttagtattatcatttttaagagcgatagataatccattacaagatatttatttagttgggttaatgcgctccgttatatatcagttcaaagaagacgaattagctcaaattagaatattgagtccaaatgatgactacttctatcaatcgattg

SEQ ID NO: 201 - DNA, 6313 bp; double-stranded, linear
ggttttcntggaaagatagtgaaaatctcgtgttttttggttttgaggtgttgtttgtattttataaaatggcttacatatatgaagcgttgattaagtatggaattgttaattaattgaacctatttagctttaagaaggcataacaagatgaccttattttatgctataatatttctattatgcgaagattaaggtgagtagtaaattggataaaaaagtaagtattcaaacaaagcaagtgttgaaacagcacaacgaaaaagaaaaatttgaatttactactgaaggaacttggcaacaaaggcaatctaactttattcggtatgtagaacaaattgaggatgcaacagttaatgttacaataaaagtggatgatgatagcgttaagttgattcgtaaaggcgacattaatatgaatttgcattttgttgaaggacaaacgacaacaactttttacgatatatcggctggacgaattccactagaagttaaaacattacgcattttacatttcgtaagtggagacggtggcaagctaaagattcattatgaattatatcaagataatgaaaaaatgggttcttatcaatatgaaattaactataaggagataggcgaatgaatattattgatcaagtgaaacaaacattagtagaagaaattgcagcaagtattaacaaagcaggattagcagatgagattcctgatattaaaattgaagttcctaaagatacaaaaaatggagattatgctactaatattgcgatggtactgactaagattgcaaagcgtaatcctcgtgaaattgctcaagcgattgttgataacttagatactgaaaaagcacatgtaaaacaaattgacattgctggtccaggattcattaatttttacttagataatcagtatttaacagcaattattcctgaagcaattgaaaaaggtgatcaatttggacatgtaaatgaatcaaaaggtcaaaatgtattgcttgagtatgtttcagctaaccctacaggagatttacatattggtcatgctagaaatgcagcagttggtgatgctttagctaatattttaactgcagctggctataatgtaacacgtgaatattatattaatgatgctggtaatcaaattactaacttagcgcgttcgattgaaacacgtttctttgaagctttaggtgacaatagttattcaatgccagaagatggctataatggaaaagatattattgaaataggtaaagatttagcagagaaacaccctgaaattaaagattattctgaagaagcacgtttgaaagaatttagaaaattaggcgtagaatacgaaatggctaaattgaaaaatgatttagcagagttcaatacgcattttgataattggtttagtgaaacatctttatatgaaaaaggagaaattcttgaagttttagcaaaaatgaaagaattaggttatacgtatgaagctgatggcgctacatggttacgtacaactgattttaaagacgacaaagacagagtattaattaaaaatgacggtacatatacgtatttcttaccagatattgcgtaccacttcgataaagtaaaacgtggtaatgacattttaatcgatttatttggtgctgatcatcatggttatattaatcgtttgaaagcatctcttgaaacgtttggtgtagatagtaatcgtttagaaattcaaatcatgcaaatggttcgtttaatggaaaatggtaaagaagtgaagatgagtaaacgtactggtaatgcgattacattaagagaaattatggacgaagttggcgttgacgctgcacgttatttcttaactatgcgtagtcctgatagtcactttgattttgatatggaattagcgaaagagcaatctcaagacaatccagtttactatgctcaatatgcacatgcgcgtatttgttcaattttaaaacaagcgaaagagcaaggtattgaagtgactgctgcgaatgattttacaacgattactaatgaaaaagcgattgaattgttgaaaaaagtagctgatttcgaacctacaattgaaagtgctgctgagcatagatcggcacatagaattactaattatattcaagatttagcttctcatttccataaattctataatgctgaaaaagtgttaacagatgatattgaaaaaacaaaagcacatgttgctatgattgaagcggtcagaattacattgaaaaatgcattggcaatggtcggtgtaagcgcacctgaatcaatgtaagaacatttatatacactccaacgtagagtttctcgaaagatactttgtgttggagtgttttttttaggtatgtgacatattggggaatgcttagtatgtgaataaggttaagaggaacacagttggatgctctgcacaactgcataagagagcctgagacataaatcaatgttctatgctctacaaagttataatggcagtagttgactgaacgaaaattcgcttgtaacaagcttttttcaattctagtcaaccttgccggcggggccccaacaaagagaaattggattcccaatttctacagacaatgcaagttggggtgggacgacgaaataaattttacgataatatcatttctgtcccactccctctaaaatggagggtgtaaatgttaggaactgatgaattatataaagttttatatgaacatctcggaccacaattttggtggcctgctgataatgacattgaaatgatgttaggtgcaattttagttcaaaatactagatggcgaaatgcagaaattgcattgaatcagattaaagaacatacgcattttaatccaaatcatatattagaactacctattgaaacgttacaatcattgatacattcaagtggcttttataaaagtaaatcactgacgattaaaacattattaacatggttagcacgacatcatttcaattatcaagagattaatgagcgatataaaggtggattaagaaaagaattattatctttgaaaggtattggaagtgaaacagcagatgtcttacttgtttatatattcggacgtattgaatttattccagatagctatacaagaaaaatatatgataaattaggatatgaaaacactaaaaattatgatcaattaaaaaaagtagtcacattaccaaatcattttacaaatcaagatgctaatgaatttcatgctctgttagatgtatttggtaaacattactttagagacaaagatataaagaattatgattttttagaaccttactttaaaaagtaaacgctgtgaagttagatagatgagtttatatgaaatataaaaaataatttactattttcttttagtatgtggacttatataataaatagaagcatataaagaaaaaaacagttgtttgtttgtgcagcaactgcataagagcccctaatcgctaaagctcaaggggagtaaaggaatacagttgtttgtgcagcaactgcataaaagcctctaatcactaaaggtgaagaggaacgcagttggatgctaaggcacaactgcataaaagcctctaatcgctaaagatgaagaggaacgcagttggatgctaccgcacaactgcataaatccctctaatcgctaaagcgaaaagtgggattaaaaaggagatgtgatagtgtgaagaaatcgttaattgcttttattttgatttttatgcttgtcctgagtggctgtggtatgaaagataatgataaacaaggtagcaatgataatggctcgtctaaatcgccgtaccatagaattgtttcgttaatgcctagtaatactgaaattttatatgaattaggattaggtaaatacatagttggtgtttcaacggttgatgattatccaaaagatgtgaaaaagggtaagaaacaatttgatgctttgaatctaaataaagaggaacttttaaaggcaaagccagatctaattcttgcgcatgagtcgcaaaaggcaactgctaataaagtattgtcatcattagagaaacaaggcatcaaagtagtgtatgttaaagatgcacaatcaattgatgaaacttacaacacatttaagcaaattgggaaattaacgcatcatgataagcaggctgaacaacttgttgaggaaactaaagataatatcgataaagtcatagattcaattcctgctcatcataaaaaatcaaaagtatttattgaggtttcatcaaagcctgaaatatatacagcagggaagcatacattttttaatgatatgttagaaaaattagaagcccaaaatgtgtatagtgacattaatggttggaaccctgtaacgaaggaaagtattattaaaaagaacccagatatattaatttcgacggaagctaagacaagatcagattatatggatatcatcaaaaaaagaggtggattcaataaaattaatgctgtcaagaatacacgtattgaagttgtaaatggtgatgaagtatcaagaccaggtccacgtattgatgaaggattaaaagaattaagagatgcaatttatagaaaataaaccattctaattatgccccttattgctacatgtaaaaaatacatgtttgagataaggggtttttaaaatatatttagtgaatgatagcaacgcgagtatgtgattgctataatgaatgtaattatcgatgaacaaaagagaatgctatgacatttaataaagtattattgagctggatagtcmtattgattataacaactagcatatatctattttggcagttgggcgatatcaatgatgtatttaaccagtctattttaatcaatgttagattaccgagattattagaagcattgttgacaggtatgatattaactgttgcaggccttatatttcaaacagttttaaataatgcattggcagatagctttacattaggattggcaagcggcgctacatttggttcaggattagcattatttttaggtttaacaacgttatggattcctgtattttcaataacatttagtttgataacattaataactgtattagtcattacgtcggtattgagccaaggctatccagttagaatcttaatattaagtggtttaatgattggtgcgttattcaattcacttctatattttttgattttattaaaacctcgcaaattaaatacaattgccaattatctgtttggtggttttggtgatgcagaatactcaaatgtatctataatagcaatcacatttatcattgcattgtttggtatatttatcattcttaatcaactaaagttattgcaattaggagaactaaaaagtcagtcactaggcttaaatgttcaattgattacatatatcgcgttatgtatagcttctatgataacggcgataaatgtcgcatatgttggcatcattggattcattggtatggtgataccgcaactcattagaaaatggcagtggaaacaatcattaggaagacaattggctttaaatattgtaactggaggacaaataatggttatggcagattttattggtagccatatattgtcaccagtacaaataccggcaagtattatcattgcattaattggtataccagtgttattttacatgckaawatctcagtcgaaacggttacactagcacacgacatttgctaaaataaaaataactataaacataaagagggcataagcgatggatttgaatcaaattaaagcagttgtatttgatttagaaggtacgttgttggacagagttaaatctcgagagaaatttatcgaagagcaatatgaacgatttcatgactacttaattcatgttcaactggcagattttaaaaaagcatttattgagctagatgacgatgaagataatgataaacctgatttatataaagaaatcattaaacgtttccatgtagataggttaacttggaaagacttatttaatgattttgaaatgcatttttatcgttatgtatttccttattacgatactttgtatacactagaaaagctatcgcaaaaaggctttcaaattggtgttatcgcaaatggtaaatctaagattaaacaatttcgattacattcacttggtttgatgcatgttattaattatttatcaacatcagaaacagttggttttcgtaaaccacatcctaaaatttttgaagatatgattgatcaactaggggtattacctgagcaaattatgtatgttggcgatgatgcgttaaatgatgtagctccagcacgagctatgggcatggttagtgtatggtata

SEQ ID NO: 202 - DNA, 2174 bp; double-stranded, linear
ccgtaaacacatcaacaaaagaaggctatattacaaaagaagacttggacttatgctgcacgtcgctctaattcagctggaatgcaagtcaccggacgactggcttacattgaaccttatggggcaacaagtcgcacaaaataaacgcgcgagaagcaagaataggaagtgatatctatgaaatggttatcacgaatattaacagtaatagtgaccatgtctatggcgtgtggtgcattgatatttaatcgtagacatcagctaaaggcgaaaacgctgaacttcaatcataaagcattaacaattattattccggctagaaacgaagaaaaaagaataggtcatttactacattcgataatacaacagcaagttccagtagatgtcattgttatgaatgacggatcgacagatgaaacagcacgtgtagcacgttcatatggtgcgactgtagtagatgttgttgatgatactgacggcaaatggtatgggaaatcacatgcttgttatcaaggtgtgacgcatgcatgtacgaatcgcattgcctttgtagatgctgatgtaactttcttaaggaaagatgctgttgaaacgttgattaatcagtatcaattacaaggtgaaaaaggattgttaagcgtacagccttatcatataacaaagcgtttctacgaagggttttcagcgatatttaatttaatgacagtcgttggtatgaatgtattttctaccttagacgacggtcggactaaccagcatgcatttggaccggtgacattaacaaataaagaagattattatgcaactggaggtcataaaagtgcaaaccgtcatattattgaaggatttgctttaggaagtgcatatacttcacaatcattgcccgtaacagtttatgaagggtttccatttgttgcatttcgcatgtatcaagaaggatttcagtcattacaagaaggatggacaaagcatttgtcaactggggcaggtggcacaaagcctaagatcatgacagcaattgtgttgtggttgtttggttctatagcgagtattttagggctatgtcttagtttaaaatatcgccaaatgtctgtaagaaaaatggtagcactttacttgagctatactacacaatttatttatctgcatcgaagggtcggccaattttctaatttattaatggtatgtcatccattgttatttatgttttttactaaaattttcatccaatcttggaaacaaacgcatcgttatggtgtagttgaatggaaaggtcgtcaatattctatatctaaagaacaataaatcaaggtaatggcatttcaatataggaggactagtatgacaatgatggatatgaattttaaatattgtcataaaatcatgaagaaacattcaaaaagcttttcttacgcttttgacttgttaccagaagatcaaagaaaagcggtttgggcaatttatgctgtgtgtcgtaaaattgatgacagtatagatgtttatggcgatattcaatttttaaatcaaataaaagaagatatacaatctattgaaaaatacccatatgaacatcatcactttcaaagtgatcgtagaatcatgatggcgcttcagcatgttgcacaacataaaaatatcgcctttcaatctttttataatctcattgatactgtatataaagatcaacattttacaatgtttgaaacggacgctgaattattcggatattgttatggtgttgctggtacagtaggtgaagtattgacgccgattttaagtgatcatgaaacacatcagacatacgatgtcgcaagaagacttggtgaatcgttgcaattgattaatatattaagagatgtcggtgaagattttgacaatgaacggatatattttagtaagcaacgattaaagcaatatgaagttgatattgctgaagtgtaccaaaatggtgttaataatcattatattgacttatgggaatattatgcagctatcgcagaaaaagattttcaagatgttatggatcaaatcaaagtatttagtattgaagcacaaccaatcatagaattagcagcacgtatatatattgaaatactggacgaagtgagacaggctaactatacattacatgaacgtgtttttgtggataagaggaaaaaggcaaagttgtttca

SEQ ID NO: 203 - DNA, 4715 bp; double-stranded, linear
gaancagntagacaaattatggaaamcggtgtgaatcaaggattctttggtgtagctggttttgacctactcgtcgatgaggatgataacgtttatgcgattgatttaaactttagacaaaatggttcaacgagcatgttattacttgctaacgagttgaattcaggatatcaaaagttttatagttatcattcaaaaggtgataacacacatttcttcaatacgattttgaaatatgtcaaagaaggtagtttatacccgttatcttattatgatggtgattggtacggtgaagataaagttaaatcaaggtttggctgtatttggcatggtgattcaaaagaaacagtactggagaatgaacgcgcatttttagctgaacttgaacactattagagttcggaacataaggcgctacaatgttgtgttgccagtagttgactgaatatgcgtttgtaacaagcttttttcgattctagtcaacagtaattaaatttatgatatggcaatactttgtaatactaatattaaatggcgacttttatttcactatgttataagagttgccattttgttgataaaggtatactaaaggttatcgttttgaaatttttagtaactagatatgtttcgtgttatagaccgaatttgtgtatacgtaaaatttaatgctattgaatttttaaaatgaaaaacatgacattaaattgaattcataatatgtctaattgactaacttgttggagtcatttactattttatgtatgacatattttaaaaagtgagggtcaagcatgtcttataaagcatatccattctttagagatatattaataaatgaatgtatttatttcgcctctaaaaataaaaaactagtacgcctaaattataaaagtgaagcgnatgtaggcgtttggacagaagaaagtgtggccgtatcatttttaacaagtcgtgatattccatttgataaagttgtaaaaatggacgttgatcgttttgctacttatgaattagatgaattgtttgatgaacaagaccatattattatgaatcaaacaatggaagawgaagggcatctactaaacgttgtagctgttacacaagaagtgatgacggaattagataaaattagaatcaaagaatttgtccaagatgtagcgaaatatgatgaagtatacggcttaactaaaaaaggtagtaagcagtttattctcattagtgaaaatgatagcgacgaaaaaaagccgcatattatgcctgtatggagtattaaaaacagagcgttaaaagttcgagatgaagattttgaagagtgtgatttaattacgattgaaggttctgttttcggagaatggctagatgaacttagagatgatcataaagccgttgcgatagatttaaaaactggcgtggttggtacaattgtttcagcgcaaaaattgtctaatgaacttacattttaattgaattgagttgtaagtaattaagtgataataaatggaacaatacgtattcaaaacacttagaccataaaataaaaggccatttatatagcgtttatttaaaacaacgcgcatataaatggtctttttctatttttctaaatataatgcaccaatagcacctgnaaaatgcgccgttttcaacatagtacggtttgcaaccgcgtaacacagtataatcttccacaactttgcgtaataaagcgttattatgaaatgaagaaccgatataaacgatattttcagttttaaattcacgtgcaacagtaatggccattgtcgtaacaacttcgccaacgacaccaataacggctgctaatttattgctaggtgtaaaatcagcatctaaatgatgtagtacatgaccaaaattagctgctgttaaatcaccgggaatgggtggttcggtatctttataaatatgtctaacctttaaatcgatagtgttacgatcaccgtgttgtgccatgtcagttaactgtttataatcagtgatttgacttagtaaataaccgagtccttgaatcatgcctccacctgtaccgataccgcctacacgacgttgtgattggccgtcgaaataatgtagtgacgtaccggtaccaacatttgcaaaaatataatctgctaagtcatggccttgctcttttaacaaaatacctagtccttgagatgcagcatcaaactctacaaaaatttgtgcaggaatgttgatgttttcagcaatgacacctgcattacctccagttaagcataatttttcaatttgctgttggtttaaccattccacaacttgatcaatatttttagttaattcagttttaaaagtacgttggttatcttgctcttgaacgattttaattagtgtaccgccagcgtcaatgccaactttcataagattcccacctcattattaatgtctatccttaaataatagtatagtaaaatgactaaaaaacaagtaataatagtaattattaacaaatttgatgccattgcatttcaacattgtaagcgtatcgcaattaatgttttacaaacgtggacgttaagttatatatattattttctaggaattttgaagttgtataggattgttagttagtgacgcaatattaaaagtagttcgtacgcagtgtatttgtaagtctctgattaaaatgataagtaatgaggaatagtacattaattttgaaatttaaaaaatataaataagtaatttatttaacttagagcaaataatggtatcgtagtgaaataataggtaaaataatatggggattcatgcttcatatataaaaagataggggttaaatatatggctaaagaactttgttttgaaggtatcactttaaaagcatttgatgaacaatatcgttcagcaattaatgattttgacttgaatgaaagacaacaaatatattcatctttacctaaagaagttattgatgatgcaattaatgatgctgataggattgctaacgtagcawtaamcgataaaaatgaagtggtgggcttttttgtattacatcgttactatcagcatgaaggttatgatacacctgaaaatgtcgtttatattcgttcattatcgattaatgaaaaatatcaaggttttggatatggcacgaaaataatgatgtcattgccgcaatatgttcaaggtgtatttcctgattttaatcatctatatctagtagtagatgcggaaaatgacaatgcttggaacctatacgaacgtgctggattcatgcatacagcgactaaagaagaaggaccaattggcaaagaacgactatattacttggacttagattcaaaacatgtttcatcattaaagcttgaagaagaaagtcgttcagaagtgaccaatgtacatatcattaatttaatgattgatggccaaaaggttggctttatcgcattggagcagattggtgaacgcatgaacattgctgctattgaagtggataaatcatatcgctttaatggtattggttcaagtgctctgcgacaattgccaacttacttaagaaaaaactatgacaaccttaatgtgattacgatgattctgtttggagagaataatgattttaaaccattatgtttaaatagtaatttcgttgaaatcgaacaaactgatgattatgtcgttttcgaaaaatatttaaattactaacagtgattgcgaaatatgatattgtcatttataatttagttttgttactatatataaatgaattcagacgtataaatttagattatatccttcgaaaggaagtattgggcaatgaaaattcaagattatacaaaacaaatggttgatgaaaaatcatttattgatatggcttatacattattgaatgataaaggcgaaacaatgammttatatgatatyatcgatgaatttagagcgttaggtgattatgagtacgaagaaattgaaaatcgtgttgtacaattttacacggatttaaacacagatggtcgttttttaaatgttggagaaaatttatggggattacgtgattggtattcggtagatgatattgaagagaaaatcgcaccaactattcaaaaattcgatattctggatgcagatgatgaagaagatcaaaacttaaaattattgggcgaagatgaaatggatgacgacgatgatattccagctcaaacagatgatcaagaagaactaaatgatccagaagatgagcaggttgaagaagaaatcaatcattcggatatagtcattgaagaagatgaagatgaactagacgaagacgaagaagtgtttgaagacgaagaagacttcaacgattaattttttgtttgacttttagttgaaagatgataaaattttattcgggctcctttaaataggacacgtgtataaaatttatacgctccccttacagaatttgtgagagggagcgtttttttatttaattgagtaaatcaagaaatgataacgcaaaaatcaaagttgtaaatgatatacatagtgacatagcagtatggaaacggtaagtaaacagaatttaattttgtcgattcgacaataaacaacttgaatgagcttgctttaatgttatgtnntacgtaatttttacaattgatgaggaagcattccctttaataattaggaggtcaagacatgacaaaatttatttttgtaacaggtggcgtagtttcatccattaggggaagggt

SEQ ID NO: 204 - DNA, 918 bp; double-stranded, linear
ataataactgaaattaaaattgctaaatmgtgttaagctatcgcmacaatgaaaatwccgattttgcgttgttgaaaatatctttccaaaccaagaatcgataatggcaataaatataataaatttccataaaatgaccaagtaaaattaaagtatataacgacagttgacatgccgtataaaatcgtagcgatcatatttgctgagcgtttaaagtgtaatattttaaataagtagaaggtcacgacaaatgttatgatagctcgtatcatagccataataagttggtttgtcggccaaaaatgtattgtcgtcggattaaatataccaaccgtttctcctattttaatgaakagaaaatttagccacattaaaggtgacagcgaataataatntgatagtcctttcatataatcgccacctamtccaaacgatgcatcatrtaaactagaanaactacgtagatgttcatacanatacatttgaaatggcatcatttgacggaatccatctccagccccgctaaaaacagtaccattcacaatataatcatagatatgagtagaaaataaaataagcgttaatattacactaatgaaagttataacaaagaattgtttgacgtttgaatttagccacttttttaacacaacattatcctcaactttcaaatttaaaattaagtttaactgaaactaaagttaatgaggttcttgataggtaaagacgaagatgactgtggaacagataccttatcatagttacttaaactttggatcattttcagtttatcattaaacaaatatattgaataataaaaatgtcatactgataaagatgaatgtcacttaataagtaacttagatttaacaaatgatgatttttaattgtagaaaacttgaaataatcacktatacc

SEQ ID NO: 205 - DNA, 16397 bp; double-stranded, linear
tcgcccnataatcaatttatttttcatgtgccactcctatacaagctnacaatgcttcttcagttaaggcaatatcttttaattttgtttgatatttttgttcaaagtcatattgtaactgaacaatttctggcaaaccaatatgccaatccgccaatttttttttayctttgaagagctcttttggtgatgkttgcgacactatactaccttctttcataacgatgacttcatctgcataacgcgcgacttcattcatatcatgtgaaattaggataattgccttattttcatctgtttgtagtgactttagtaatctcattacttgtcgtttactttgtggatcaagtcctgctgtaggttcatcaaccacgataatatcaggattcattgccaatatcgatacaatcgctattttacgcatttgtccacctgacatttgaaatggtgattgtgacattacatctcttgaaaagcctaaatccatcaacagacgatgggcatagtttttggcttcatctaaattcattttaaagtttttaggtccaaatatcatttcacgctctactgtgtcctcaaataattgagattcgggaaattgaaataccattccaattctttttcttacaggtctaatatatttatctttggtcttatgtgtaatagtaatgtcatcaactgtaactgtcccagtagtcggctttaacagcgcattaatattttgtatcaacgttgatttaccactacccgtttgtccaacgatggcgtaatatttaccttgttcaaattctgtattaacatcatgaatagcttgatgctgatatggtgtccctttttgataggtataacttacattgtcaaaccgtatagtcatagttgatccaccagcccttcataagttaagaatgatgtttggtgtcccagcatttgatttattttgattgggaatggcaaatctagacctattcttgttaactcttctgcattgtcgaaaatttcagtcgctgtgccttctttatagacagtccctttattcataacgataacatgatctgcttccatcgcctcagataaatcatgcgtaatagaaatgattgtaatattatgttctgatttaacttttctcactaaatccaataaattttgacgtgcatcaggatctaacatagaagtcgcctcatctaatataatgacagaggggttaagtgctaatacacttgctatagccacacgctgcttctgtccccccgataatgcattaggttcataatctgcacgttctaacatatcaacttgtttaagtgcttcgctgactcttctatgcatttcgtcatatggaaccgcatgattttcgagtccaaatgccacatcgtattttacaattgaaccaacaaattgattatccggattctgaaatacaattcctatgtcttttcttaacttttcaaaattatcatcagttatagcttgattattataaaaaatttctccagatttaactttctctatgccaatcattaacttggcaattgtagattttccagaaccgttatgaccaacaatagatgtccactgacctttaggtatattaaaagaaacatctttcaatgtgaaggatgcatcactttgatattgaaatgaaacatttttaaatacaataactgaattcttatcctccacttgtctctctcctttacgattcgtgtatctatcatattttacaatatttataaatcgctgtatatgacattgactgggttctctatatattactagtattttctgactcatttctagtctttaaagtgttgtttaacaactaatgataaggacttttattcctctctaacaattatgtataaacgttaataaaataaatgatttactaatataggggtggtcgcgtttgattcaacgataatactttcacttcattcagttctagtgaaattgatcaaactagcttcatcatatttttagattcgcactcaaaaaagtaaatataaagaaatcggacttaaaaacatttctgttcataagtccgatattttattcaataaaaaagcgcgcaccccatcataagtttgttgagttcacgctttaaatctttatttagttgatggggtactctgagctagacaatatttgtatgtggcaaacattatcgttgcactcatttgctttatataaaagtagttagtgtatttatataaattcttatactaattcgataattactgattcagcaccgtcaccgcgacgagggccttgtttaaggatacgagtgtaaccaccttgacgttctgtgtaacgctctgcgatttcaccaaataatttttgaagtgcagtttgtgtagtttcatcttcgtttaagatttcaacattacgtaaagttttagctgcattacgacgagaagctaaatctccttttttacctaaagtgattaatttctcaacaacactgcgaacttcttttgcacgagcttctgtagtttcaatacgttcactaataataagtgatgtagctaagtcacgtaacatagctttacgttgatcagaagtacgacctaattttctgtaacccatgagttaacctcctttatcaatcttcttttcttaatcctaatcctaaatcttctaatttgtatttaacttcttctaaagatttacgacctaaattacgcactttcatcatgtcagcttcagatttgtcagctaactcttgaacagaattgattcctgcgcgttttaagcagttatatgaacgtacagataagtctaattcttcaatagacatttctaatactttttctttttgatcttcttctttttcaatcatgatttcagcgttttgcgcttcatcagtaagaccaacgaagatattcaagtgttcagtcattatttttgctgctaatgaaactgattcttgtggtgtgattgaaccattagtccaaacatccaatgttaatttatcaaaatcactgctttgacctacacgtgtattttcaacagtatagttcacacgttcaacaggtgaatacaatgaatcaacagggattacaccaattggtaaatcactagtattattttgttctgctaatgcgtaacctctacccttgttagcaactagacgaatttttaagtgaccacctttagatactgttgcaattttaagctctgggtttaaaatttcaacatcactatcatgtgtaatgtcgcttgctgttacttcgccttcatcacgtacatcaatttctaaagttttatcttcttcagagtaaattttcaatgctaattgtttaatgttcataataattgtagaaacatcttcaactacattgtctactgctgagaattcatgtaaaactccctcaatttcaatatacttaacggctgcacctggtaatgaagatagtaggatacgacgtaaggagtttcctagtgtagtaccgtagccacgttctagtggttcaacaacgaacttaccgaatttagcatcttcactaatttcaattgtctcaattctaggtttttcgatttctatcatttaaatatcctccttatatacgtcgacttaatttaaaatgtttgctcagtgacctgtaacaataccatcataaattatacacgacgacgttttggtggacgacaaccgttatgaggtactggagtaacgtctctgatcgcagttacttctaaacctgcagattgtaatgcacgaatagctgattcacgacctggaccaggtcctttaactgttacttcaactgtttttaaaccatgctccatagctgatttagatgcagtttcagaagccatttgtgctgcaaatggtgttgattttttagatcctttgaatcctaatgcaccagctgatgaccatgataaagcattaccgaactcatcagtgatagttacaatagtgttgttgaatgttgaacggatgtgtgctacaccattttcaatattctttttcactctacgtttacgagatacttgtttacgtgccatttaaaatttgcctcctttacctatkattttttcttgttagctaccgttttaactggtcctttacgagtacgcgcgtkgtttttcgttttttgaccacgaactggtaaaccacgacggtgacggatacccacggtatgatgaaattnccattaaacgtttgatatttaagttagtttcacgacgtaagtcaccttcgactttataaccgtctacaacttcacggatgcgacctaattcgtcatcagttaaatctttcacacgagtatcagctgatacgttagcttcttcaagaattttttgagcagttgacgtaccgataccgtatatataagttaatgagataactacgcgtttttcacgtggaatatctactcctgcaatacgtgccatattaatttacacctctcttttattaaccttgtctttgtttgtgttttggattttcacaaattaccattactttacctttacgtttaatgactttacatttttcgcaaataggttttactgatggtcttactttcatttttatacctccctatattatggagtgacgattatttataacgataagtaattcttccgcgtgttaaatcgtacggagacatctcaacagttactttgtcgccaggtagaatacgaatgtaattcattctgattttaccacttacgtgagcnaaaatctcatgaccattttctaattctactttaaacattgcgttcggtaaagtatctaatacagtaccttctaattcaattacatcttgtttagccattgattaacttccccctttttgcaatagtaaggtaatcgtcaatagacaactttattgttacgaatctatcagtgattaattttataagttaaacaaaaattacgggaattaattatcgttaattgccactctcatctatctaatatgattaaatcatgcctcacttaaaatagaccgctaaaagttgatctattacaaatgatctaaaatatcaatgacatctttggtaacgtcgctaatatcttttgaaccatcaatatttttcaatacacctttttgatcatagaaatctaaaataggcttagattgtttaatattaacactcaaacgattagctaccgtttcaggattatcatcttctcgttgatacaatttaccaccatcgatatcacaaataccttcgacttcggaggattaaatacaagatgatacgttgtaccacatgactcacagattcgacgacctgtaagacggttcattaattcttcttccggaacttcgatattgatgacagcatcaatgtttctgtcaagctcagacataatattatttaatgcctcagcttgctcgattgttcttgggaagccatctaataaaaagcctttttttgcatcgtcttcagaaattctttccttaacgatacctacagtcacttcatcaggaactaattcgccacggtccatataagacttagcttctttacctaattcagtttcttcttttatagcttttctgaacatgtcaccagttgaaatgtggggtattgggaatttcttgacaatttcacttgcttgagttcctttacctgcgccaggtaaacccatcaaaatgatattcataagtgccctcctaaaattatctaccaccaaagcctttatattctttttgagatacttgagcttctaaagatttcattgtttcaatcgctacaccaataacgataagtaaacttgtaccaccaatctgaattgattgtggtaatcccataaacttagttgctaatatcggtagaattgaaataacggctaagaagatagaacctacaaaagttaaacgatataaaactttagtaatatattttttggtttgttcaccaggtctaatacctggaacatagctaccttgtttcttaaggttatcagccattttttccggattaacttgtacaaatgcatagaagtatgtgaatagtataattagtacaatatatacaaccataccaacattacttgaaggatttgcagcattcgcaatgttttgtgcccattctttatctggatagaacaacgttaatgttctaggcagtaagaagaacgccattgcaaagattacaggaataacaccggctgagttcacttttaaaggtagataagttgcctgtgaacctaatctttgagcagtttgtttcttagcatattgaatcggaattttacgaacggcttcaagtacataaatagcacctacagttaatagtatcagtgacactaaaagtcctaatactttcaaccatgctaatgatgtatcttcttgcccaacgaacgcatttgtccaaattgaattagactggctggcaacgttgataaaatacccgcaaatatgataatagaaataccattaccaacaccgaactgagtgatttgatcaccaagccatattaagaaagcagttcctgctgtncaaaactagtgctattaataaataactcataattgactgattgataatcagcgcacctttgagataattattaaattggaatgccatacctatagattggataaatgctaaagaaattgctaaataacgagtaacgttatttaactttcttctacctacttcaccttgttttgcccattctgagaatttagggacaatatccatttgtaataattgcattacgattgatgcagtgatgtagggtacaatacccattgcaaaaatagaaaatcgtttcaaggctccgccaccaaaagtatttaataactcagtggcaccttgagaaccttggggattatcaaaagctgcaggatttactcctggagctggtatataagtccctattttaaaaattactaacattgctagtgtgaagaaaatcttgttacgaacctcttttgttctaaagaagttcacaagggtttgaatcattagatcacctcgtgtgctccacctttagcatcaatagcttctgctgctgaagctgagaatttatgagctttcactgtcaatttcttatcaagtgaaccattacctagtattttgataccagatttttcattcttaacaacaccagattctactaataaagctggagttacttcagtaccatcttcaaatttattaagttggtctaagttaacaatagcatattctttacgatttatgttagtaaaaccacgttttggtaaacgacggaataatggtaattgaccaccttcaaatcctggtcttacaccaccgcctgaacgagctttttgacctttgtgtccgcgaccacttgttttaccgttacctgtcgcaacaccacgtccaacacgattgcgttctttacgtgaaccttctgccggttttaactcatgtaatttcatttcggcacctccttgattatttttcttctactgttactaagtgcttaactttgttgatttgcccacgaatagcagggttatcttcaacaactactgaactgttagtctttttaagacctaaagcttcaacagttttacgttgtgtttcaggacgaccaataacactacgagtgagggtaatttgtaatttagccataactagttttccctccttaattgtataattcttctactgttttgccacgtaatttcgcaacatcttcagcatttttaaggttttgtaaaccatcgattgtagcacgaaccatgttgattggtgtgtttgatcctaatgatttacttaagatatcagtgatacctgctaattcaagtacggcacgaacaggaccaccagcgataactcctgtaccaggtgcagccggtttcataaatacgcttcctgaaccgtaacggccagtaattgtgtgtggagttgtaccttcaacacgtggaacaactactaaatcttttttagctgcttcaacagcttttttgattgcttctggtacctcttgagctttaccagtaccgaaacctacacgaccatttttgtctccaactacaactaatgcagtgaaacggaaacgacgaccaccttttacaacttttgctacacggttgattgtaacaacgcgttcttcaaattctttcgtctcttcttctctacgagccatgtatttgtccctcctttaaattaaaattctaatccgctttctcttgctgcttcagctaatgctttaacacgtccgtgatataaatatcctccacggtcaaatacgatttctttaatgcctttgtcagcagcttttttagcaattgcttcaccgactttagttgctaattcaactttagttgctgtagtagcaatgtcgctgtcttttgaagaagcttgagctaatgttacgcctttattatcatcaataatttgagcgtagatatgcttgtttgaacgatatacgtttaaacgtggcttttcagctgtacctgataagttagtacgaacacgagcatgtctttttaaacgcactttatttttatcaattttactgatcatttcaatactcctttctttagagtttatctattatttaccagttttaccttctttacggcgaacgtattcaccttggtaacgaatacctttacctttgtaaggctctggaggtcttactgaacggatgttagatgctaatgctccaacttgttcttttgaaataccttcaactttaacgactgtgtttttctcaactgagaaagtaatgttttcttcagctttaatttctactgggtgagaataaccaacgttaaggattaagtctttaccttgcatttgagcacggtaacctacaccaacaagttcaagtacttttacgtatccttgagaaacaccttgtaccatattgtttaataaagcacgagttgtaccatggtttgttctatcttctttagaatcagatggtcttacaacttcaattgtgttttcttcttgtttgaatgtcattctttcatttaaagttcttgataattcacctttaggacctttaacagttacatgatttccatcaaaagttactgttacgtcactagggatgtcaataattttcttaccaacacgactcatgttatggcacctccttattttttattaccaaacgtatgcgataatttctccaccaacattacgttttcttgcttctttgtcagtgattacaccttcagaagttgatactaatgcaatacctaaaccatttaatactttaggcatttcgctagcttttgcataaacacgtaaacctggttttgaaatacgttttaatcctgtgataacacgctcatcgttttgaccatattttaagaataaacgaagtacaccttgtttatcatcttctacgtattcaacatttttaatgaaaccttcactctttaagatttcagcaatttcttttttaatatttgatgcaggtaattctaacttctcgtgacgcaccatgtttgcgtttcttacacgagtaagcatatctgcgattggatctgtcattgtcattgattgttgcctcctttcagactcttttttattaccagctagctttacgaacgccagggatttggcctttgtaagctaattcacggaaacaaatacggcataatttaaatttacgatatacagaatgtggacggccacaacgttcacaacgagtgtattcacgaactgcatatttttgttttttttgttgcttagcaaccattgaagttttagccacttaattagcctcctttaaataattatttacggaatggcataccgaagttagctaacaattcacgagcttcttcatcagtgttagcagtcgttacgataacaatatccattcctctaactttacttactttatcatagtcgatttctgggaaaattaattgttctttaacacctaaagtgtagttaccgcgtccgtcaaatgcttttttagaaacaccttggaagtcacgtacacgtggtaatgatactgaaattaatttgtctaagaattcatacattctttcaccgcgaagtgttactttcgcaccgattggcataccttcacgtaaacggaaagtcgcgattgattttttagctttagttactaatggtttttgaccagtgatcaattctaattcttcaacagcattgtctaatactttagaattttgtactgcgtcacctacacccatgttcacaacgattttatctatttttggtacttccattactgaactataattgaattttttcattaagttttcagtaacttcagtgttaaacttttcttttaaacggttcaaagtgggatcctcctttcaacttgttattaattattagakttaatttcttcgccagattttttagcgatacgaacttttttaccatcaacaaatttgtaacctacacgagttggttcgtttgttttagggtccaataattgtacattagaaacatggattgctgcctctgtttctaagattccaccttcaggatttaattgagttggtttttggtgttttttcataatgttaacaccttccacaacgacacggtcttttttaggtagagtagcaattactttaccttctttacctttgtctttacctgcgataactttaacgttgtcaccttttttgatatgcatgtgggcacctccttatttgtattggttgttattaattaaagtacttctggtgctaatgatacgattttcatgaagttaccttcacgtaattcacgagcaacaggtccgaagatacgagtaccacgtgggcctttgtcatcacggatgataacacatgcattttcatcaaatttgatgtatgaaccgtcattacgacgaacacctgacttagtacgtacgattacagctttgacaacgtcaccttttttaacaacgccacctggtgttgcatttttaacagtacatacgataacatcgccgatgtttgctgttttacgaccagatccacctaatactttgattgtaagaacttcacgagcaccagagttgtctgctactttcaagcgtgtttcttgttggatcattagttaaacctcccttatctctaaacttgtattaaataattactgactcttcaacaatctctactaaacgaaaacgttttgttgctgataaaggacgagtttcttgaattttaacaatgtctcctaatttagctgaattgttttcatcatgagttttgtattttttagagtattttactcgtttaccgtataatttgtgtgttttgtaagtttcaacaagtactgtaatagtcttgtccattttgtctgaaacaactttacctacataaactttacgatcgtttctttcgctcacttttgtaacctcctcttacttaattattgattagccttactttgttcaatttctctttcacgagcaacagtttttagacgtgcaatcgtttttcttactgtacgaatacgtgcagtttcttctaattgacctgtagctaactgaaagcgtaggttaaaaagctcttcttttgaagatttgatttgttcttcgatttctgaagtggttaagtctctaatttccttagctttcatttgtttcaccacccaattcctcacgttttacaaacttagtttttactggaagtttgtgacttgctaaacgtagtgcttcacgcgcaacttcttcagaaacgccagcaacttcgaataaaattctacctggtttaacaactgcgatccagccttcaaccgcacctttaccagcacccatacgtacttctaaaggttttttagtatatggtgtatgtgggaagattttaatccaaactttcccgccacgtttcatgtaacgtgtcattgctatacgagcagattcgatttgacgagatgtgatccaagacgttgttgtagcttgtaaaccaaactcaccaaatgttacgtattaccgcctttagaacgaccagttgttttaggacgatgttgacgacgatattttacacgttttggtagtaacattattattttcctcctccactagtgttcttagtaggaagaacttctccacgataaatccatactttaacgcctaatttaccgtaagtagtgtcagcttcagcgtgtgcataatcgatgtcagcacgtaacgtatgaagtggaacagttccttctgaatattgttcagcacgagcgatgtcagctccgcctaaacgaccagatacttgagttttgatacctttagcaccaagtttcatagctctagtgattgcttgtttttgtacacgacggaatgaagcacggttttctaattgacgtgcgatgttttcagctactaaacgagcgtcaagatcaacttttttgatttcaattacgttgatgtgtacttttttatcagttaacgcatttaatttgttgcgtaatttttcgatttctgaaccgcctttaccaattaccataccaggtttaccagtatgaattgcaatgttgatacggtttgcagcacgttcaatctctacgtgagaaactgatgcttcttttaattcattatcaataaatttacggatttttaaatcttcgtgtaaaagtgaagcgaagtctttttcagcataccatttagcttcccaatcacggataataccaacacgaagtccgattggattaattttttgacccacagtattccctccttaaaagttaattaagcttctttagcttcttctttaccgtcacttacgacgattgtaatgtggcttgtacgtttgttaatcgcacttgcacgaccttgcgcacgtggacggaaacgttttaatgttggtccttcgttagcatatgcttctttaactactaattcatctgtgttcatgtcatagttatgttcagcattagctaaagcggacattaatactttttcaattactggtgatgaagctttgtttgttaattttaaaattgcaatagcttcagcagcatttttacctctgattaagtcaagaactagtcttactttacgaggtgcgattcttattgttctagcaaccgcttttgcttccattaggatgtcctcctctacttaatagatattatcttcttgttttcttgtcgtctgcaacgtgtcctttgaatgtacgagtaggagcaaactcacctaatttatgacctaccatatcttcagttacatatacaggtacgtgtttacgtccgtcgtatactgcaaaagtatgtccgatgaaattagggaaaattgtagaacgacgtgaccatgttttgattacttgtttcttttcgcttccttcttgagcttcaacttttttcattaaatgctcatcgacgaaaggtccttttttaatactacgagccatttgggcgcctcccttcttattatgtgcgtgcagctttaagccgcacacccaaataagttgattatattattttttcttacgtccacgaacgataagtttgtctgatgattttttaccacgacgagttttcttaccaagcgtaggtttaccccatggtgacattggagatggtctaccgataggagcacgaccttcaccaccaccgtgtgggtgatcgttagggttcattacagaaccacgaactgttggacggatacctttccatcttgaacgtccggctttaccaacgttaactaattcgtgttgtaggttaccaacttgaccgattgtagcacggcaagtagataagatcatacgaacttcaccagatcttaatctgattaatacgtatttaccttctttaccaagtacttgagcacttgcaccagctgaacgagcgatttgtccacctttaccaggtttaagctcgatgttgtgtactactgtaccaactggaatgttttgtaatggtaatgcgttaccaactttgatgtcagcttcagcaccactttcaacgatttgacctacttctaatcctttaggagcaatgatatatcgtttttcaccgtctgcatatacaactaaagcgatgtttgctgagcggtttggatcatattgaatagaatcaacttttgcattgataccatctttgttacgtttgaaatcgataacacggtattgacgtttgtgtccaccaccatggtgtcttacagtcaatttaccttggttgttacgtcccgcttttttcggtagcggttttaataatgacttttcaggtgtagttttcgtgatttctgcgaaatctaacgaagtcatattacgacgaccatttgttattggcttatactttttaatagccattgtcgcttacctccttaatggtaattgttttattagttaaataagtcgattgatccttctttaagagttacaatcgcttttcttcttttgtttgtatagccttggtaacggcccatacgttttttcttaggtttgtaattcatgatattaacacttgcaacttttacgttgaagatttcttcaactgccatttttacttgtgttttgttaacacgagtatcaacgtcgaaagtgtatttgtcttcagccattgcttcagaagatttctcagtgattacggggcgcttaagaatatctcttgcttccattatccgagcacctcctcaacttttttagcagcagcttcagtaattactaagctgtcagcattagtgatatctaaaacatttaaaccttgagcagttgtcacttgaacgccagggatgttgcgtgctgataattcaacatttacatcttcgttttcagtaactactaatacttttttaggttgttctaatgtagataatacatttttgaattctttagtttttggagcttcgaagttgaatgcgtcaactacagttaagccattctcttgagctttgaaagataatgctgagcgtaaagctaaacgacgcattttcttaggcattttgtatgcataacttcttggagttggtccgaatacgataccaccgccacgccattgtggagcacggattgtaccttgacgagcacgacctgttcctttttgcttccatggtttacgtccgccaccgcttactgctgaacgattcttaacagcatgcgtaccttgacgtaatgaagcacgttgtaaattaatagcttcgaataaaacgctattatttggctcaataccgaatactgcatcgcttaattcgattgaacctgatttagttccgtctaattttaaaacatcataattagccattatgcatttcctcctttcacttcttattatttattaccttttttaattgaagttctgatttctactaaaccttttttaggtccaggtacgttaccttttactaagataactttgttttctgtgtcaacttgaactacttctaagttttgaacagttacagtgtttccacccatacgtcctggcattttttggcctttaaatactctagaagcatctgaagccatacctacagaacctggtgctctgtggaaatgagaaccgtgtgacataggtccacgagattgtccgtggcgtttaattgcaccttggaaacctttaccttttgatacgcctgttacgtcaataacgtcgccagctacaaaagtatctactgagacttcttgaacctactcgtaagcatccacgtctacattgcggaattcacgaatgaagcgcttaggtgctgcgtcagcttttttagcgtgaccttcagctggtttattagcatatttattagattttgcatcttttttgtatgcttttttgtcttcaaatccaacttggattgcgttgtatccatcaacttctacagttttcttttgtaatacaacattttctttagcttctactactgttacagggattaattcaccgttttctccgaatacttgtgtcatcccaatttttcttcctaagattcctttggtcatcgaaagtccacctcctaaaattgtctattataatttgatttcgatgtctacaccagatggtaagtttaagcccattaaagcgtcaactgtttttggtgttgggtttacaatatcgattaaacgtttgtgtgtacgttgttcgaattgttcacgtgaatctttatacttatgcacggcacggatgattgtgtaaactgatttctcagttggtaacggaattggtccagaaacatctgcaccagaacgtttcgctgtttctacaatcttctctgctgattgatcaattacgcggtgatcataagcttttaatctgattctgattttttgttttgccataattttccctccttattcgtctacatttagtgatagacttctccacgaaaactatcttacacagcgccatggcaaagcggccgggtgtgtcagtaacctttcgcttcatcgcttttcttaaagtccaacgttagttatattacacgaaaaacatcgataaatcaaggcttttcacataatttttctatctgtctaacacatacttttatatttnactttatatacttagtcagttcaactattttcgagatattttnaatttccn

SEQ ID NO: 206 - DNA, 29555 bp; double-stranded, linear
tnagttgtttctgccacgaaagattcaatggcttttcttgctttacgcttttctttcaatggcaaatcaccaatcatttttttaaggtgatgtgggtttacaacaccactatactggtagtcatttgaanttgtttttagggcttgttcatcgatagatctctctccagcaaatcctttgaactccgcttcttttttaatactttcgaaattaacatattcttgatcgatatcatcatccttatttaaagaaggtacaacattgtcgatgaattctctaattagatctcgttttaacctcaatgtcggatcatctgcatgatctaaaatgcgtctaatttgttcttggttacgacgttgttccgctttgtcttcaagatcaatttgtctcaatatattcataatataattcacattaatcgtatcattacgcatcatttctatttcgaaatcaatatcatttaaaatggatactttatttttctcagccgtcgctctttttacttgatcgtacacagctaaatatttacttttatagtcttcattctcttgttcatccattccaatttcatcaattgtaaactcaaactcgtcaaatgcttttaaacgtaatattattttagctaataaacgataagcttcaacaaagcgctttagctcttcttcatcttgaatgtcatcaaccatgtgtggtgtcggcacaatcattttaagctcacgataagcgtccataaattcttttttatactcttcataactgcgcattaaaattgtatccgtatcatttgtttgtgagaatactctcagtgcatcgtctgtctcttttttcaagtcacgatagtttacaattttaccaaatggctttgattctttttcaaccctatttgtacgtgaatacgcttgaattaaatcatgatacattaaattcttatcaacatataaagtgttcagtactttactatcaaaaccagttaagaacatattaacaacgattaagatatcaattttactatctttaacgccctttttaacgttttttgaaatatgattaaaatactcattagttgtggctgntgaaaaattcgtctcgaactttttattataatcactaatcattatctctaatttttcacgtgaatgatatggcacttcaccatcacgatcatcttcattaggtttaaacgtaaatataccagctatcgttaacggttgttccaactttttgttaagtcgcttaaatgtctcataatatttaataagcgcgtgaatactttggactgtaaatatacttgaatattgacgattacgtgtatatttatcatgattattgatgatatgtcgtgttactaattccacacgtttatccgctaaccatacttcttccgtatcaattgcttcaaccatgctgttatcttctgcttttaaagctttatttttaaaagtattaatatagtcaactgagaaaccaagtacattaccatcatgaatggcatctctaattaaatacgtatgtaagcatctaccgaaaatatctgcagttgttctaccatcttgactactattttctggaaaacgtggcgtaccagtgaatccaaagtattgggcatttttgaaatgttgtttaactagacgatgcatgtcaccaaattgactgcgatgacactcatcaataataaatacaactttattcgttttatactgttctaataaaggggcattcccttgaatcgctttagccattttttgaatcgtcgttacaataagtggcaaacttttatcatttagttggcgtaccagttgcgaggtattaaaagttttgtctacagcacccttagcaaatttattaaattcctcttctgtttgactatccaagtctttacggtcaaccaaaaagataactttcttaatgtcatcttgctgtgataaaatctgactcgctttaaaagaagtcaacgtcttaccacttccagttgtatgccatacatatccattattccctgtctcagtcgcttgttgaataagtgcttctaccgcatacacttgatacggacgcattgccatcagtattctatctgtttcattaataatcatatagcgcgatatcatcttagctaattgacaaggtctcataaatgactcagcaaacgattgcaatgtattgatacggttattctgtttatcactccaataaaacatgtgactcttcaatagttcgctatcattattagaaaagtatcgcgtttcaacaccattactaatgataaacatttgtatgtagcggaataagcctgtgtaattttgtttgcggtaacgttttacttggttaaacgcctcattaatatcaatacctcgacgtttcaattcaacttggacaaggggtagtccgttgattaatatcgttacatcataacgtgctttatatgtatcctcgacagatacttgattcgtcacttgaaacttatttttacaccaacttttcgtatctaaaaacgacaaataaatctcagactcatcatcacgtctaagtggtaatttatcacgtaaaatacgggcactctcgaaaatactttttccatcaatcatcgttaacagacgttgaaattctttatctgttaagggattgccttctaatttgtccgcatgacgctcatttaaaatcgttctaaaattatcaagcaattgcttattatcacgtatcgttactctttcgtaacccaattgttcaagttgattcatcatttcattttctaatgcgtattcactttggtatgccattcatatccccttccatacactttctattgctctaaatatatcataaactttaatgaaaaatgtttgttttttatcttcaaacgtaaatttattctaattttattgtcttatcttttaatatttgtctttgaggtaagtcgtatactaaaatttgaatacaaataatcaaatcattgataaattttttgtctacgattaatggagggacttgaatggtgttaattacctatcaaatcattttattttttattattagtctaagttactatttaactttaaatcattacatggcagtcactgtaggtaacttcacttcaatattcggcatgttcgcagccatactctttatgtactactacctactctataaaagtcccgaatacaatcaacgcaaacgatttaaacatttcattcatatcactaatttgataataattgcttttagcaccttcgtattagttcatttagcattaaaattattcttcagcatttaatttccatctatgaaaaaagcaaagctcaaatctgaactttgctttaatttgtcacgcctttatcattttcaaaatagcctctatgccagttttacaaacttgtagcaacaatttttcatcaagcaactgaatcacatcaaaaacttcaattgtttacgttgcaactaactttatgttagaacgcacacaatatctaatgtttaaaatctatcgtcgcaagatgcttcctgtaattatcaagtgccattttcgattgggttatacaatctagaatcgcatgataatttaatgctacaaatcgatagtacaatatatctaccgtgaataactgtgcaaatagtgacgttgtagccgccatacgcatttcattttcatcagttctgccataaatcaatgcatagtctgcaatttgagccactggattattagctgtactagatatagttatgatgggaatactgtaatgtgtggccacctgtgcaattgactgcaattcactatgactaccttgattcgtcacaaaaatcatgcaatctctatcatcatgcgtcgcaaatgttgacacaagtaaatgcgtttcatgtaataacctgacatttaagccaatacgagataacttttgaaaaagatcaccaatagtcaaactcgatgcgccaaatccaaataaaaatattgtcctggcatttttcaacacatcacaaattgcatcaatttgcgcatccataatattagtagctacaaatcgcatcgtattcgttgctctagcaatcattttatttttcaaagtttctacagattcattttcaatcaattctaaatgtggattggttgcaatatcttcgggtaagtatcgagatatcgcaatctttagctcttgaaaaccttgatgtgtcattttccgactaaatctaacaattgatgctgtactaacattcgtaacatctgccaaatcattcacagtcatatcaatgattttatgtggattctttaaaatgtaatcagcgattatcttttctgtcttcgtaaaatcactcaactgcttatcaatgcgatataaaatatttgtcatcattaatcacccaacaaatctgtctgtcgcatcgcctttgtcgttccaaataaatatgtacaaacgaatccaccagcatacgcagcaagtaatcctgcaatataacctaaatacatattatctgagattaatggtaatagtgacacaccacttgggcctattgctttggcaccaatatgtccaattccacctattacagcgccaccaataccaccaccaatacaagcagttaagaaaggtcgacctaatggcaaagtcacaccatagattaatggttctccgatacctaggaaaccaactggcaatgcaccttttaaagtattacgtaatgttgtgttgcgtttacatcttacccaaagtgctaatgcggcacctacttgtccagcaccagccatcgctgcaattggcaataagtaagtagcacctgattggttaatcatttctatatgaattggcgtaaaaatatgatgaagccctaacataactaacggtaggaagcttgcaccaatgataaatccactaaatacgccaccaatactaataattccgttaactactgaaactaaactgtctgaaacaaaacctgctaatggcataaagataaagatagttaatagtcctacaatcaacaatgcaatagtcggcgttacaataatatcaatcgcatttggcacaattttatgtaatctcttttcgacaatacttaaaatccaaacggcaaaaataacgccaataatcccaccttgtccaggttgcaatggttctccagtgaagacattcattaaaatatttttaccagcaatacccgttaataacgttgtaccaccaatcacgccaccaagtcctggtgtcgcaccaaattctttagccgcattaataccagtgaaaatagctaagtatgctaacataccgtctttaatgacattaaatactgttataagttgcgtaatccaagcacctgaaatatagcctgccaccattaagttactcagtactgctgcaataccaccaattaatccagctccaataaatgcaggaatcaacggtataaagatattggcaattgatttcaatactttattcaacttaccattcttttgttttgctttatgcgcttccttattcgcctttgctttatcagctgcatatgatttatagtccattttttcactatcattgtgatggtgtggtattgggtcacctagtttaacaccacttaattccgccatatgattagccactttattgatgtaccaggtccaaccacaacttgaatgcgttcatcgtgtataacacccatgacaccatcaatatgccttagttcttggtcatctactttattctcatctaatactttaatacgcacacgtgtcatacagttcatgacactatctatattatccataccacctactgcagcaataattcgttctgcaagttgttgttctttggtcatttaaatccctcctaaggttgtctatctctgattgctcgtttaaaatgtcaccattgtttaataaccgtcttgttgcttcttccttagaaatgccacacatacccataactgtcgcaactttcacatcatgctcagatacctgatataacgccattgcttcatcatatgtgatagcacatatttcttgaataatacgcactgaacggtcgatcagtttttgattggttgctttaacatcaatcatgaggttatcgtaaacttttccgacaccaaccattgtgatggttgaaatcatatttaaaattaacttttgtgctgtaccagactttaaacgtgttgaaccagttaatacttctggaccaactttaacttctactggatactgcgcaatttcacttataactgcatgttcattgcatgaaatagatactgttgtagcaccgattgtgttagcaaatgttaaaccgcctataacatatggcgttttgccactcgcggcaattcctataacgacatcttttgatgttaaatctatatttttcaaatcttcttccgctaattttttgtgatcttccgcaccttctacagccatcgtcatagcatgttgtccaccagcaataatacctataatttcatgagggtcagtattgaatgtaggtacacactccgctgcatctaagacacccaaccttccacttgtacctgcaccgatataaatcaatcgtccaccctttttatactgtgcaattgtttttttaattacttttgtcaattgtggtattgcctttcgaactgctaacgggacttgctgatcttctttattcatcgtaattaaagcctcttccacagtcatttcatcaagatgcatcgtcgcttcattacgcgcttcggtcgtactattttccatcacttcttacactccctagttttttgaaaatcaaatgtatcattcggctcgatacaacttaacagtggtaagtcttctttaataatttgtgcaacaacattcacattgtcatgtgcactaagcgtttgtctcacaatttgcatttcgccttgataacgtccgttattcaaattatcaacggttactgaaccaatgcgtcgttgcgtcgtaaactgtggttgaatcgaatgtggacatatttgtcttgacgtttccgaacgaatgacattttccggattatccgggcgtactttatgacacatatcgaaaaggtaagtcactgtcgtatcaaacacttcttcaatacataacgtgaaatgcctatgcttgcaaaaatctataagttgttttgcctgcctcatttcaatcaatgagtctccaactaacacttcagatacaccagtttcttgtaataatttagctgcaacgacaggatgactatgtctcgttgcttcaattgttggcaagcctttatgcaaaggacctcgcaaatcactccctacaataaaaccatatatttgtgcctttggattaaattgataaatgagttcatttttcttattgaccaagtcaacagataatcccgtatctggtcttggataatagttatgacaaaatgaaagtaatgtaaaatcattcaattgttgatgtaagcttgttaacaattcccgggaaataatacttgcattcaaacagcactttaaaccctgtgccattatcgcttcgattgcctcaattgatgtactatgatcgatacgaatcataaattgtgcatcatattgtcgaagatggtcataaaaagatggtgttaaaatagatggattagcatctatgaggtaagtcacttgttcatgttttaataaattgagtagttttgtgaaataatgatattttgtctcgtcatcttcttctggtatttgtacagatgtaaaaatcatttggtaaccttgtttaatcattcgcttaatatacgcttcatctaaaggttgtcctaaatacactgaaaagcctgtcaaagtagccctccttaacaatataattattaggaaaatatagttgatttgtgtaatcgcttacattttactataagagaaaacacattacaatattaatcagttaaagcctgttcattgtaataatcttacatatttctgtcacaagttaattattacaccatcaaagattatcctttcttttaagtgctgataatagctgctactgctggattattacaataacttttatacattttattcaggattatcttatattatgttttaataataatctgtgaacaattaagagatttgaaattgaatttaataattgtattgaaaacgcatacttcaccatgctaaaataggagtcgcaaacaaataagattcaataagatgtgatggttaccaacacagtctatttgctcgtgtctttttttattgaatcttaaataataaatacaactttggaggttggacaagtgaggaagaaacttttcggtcaattgcaacgtattggtaaagcgctaatgttacctgttgcgattttaccagcagctggtctgttattagctatcggtacagctatgcaaggtgaatcattacaacactacttgccgtttatacaaaatggtggcgtacaaactgtcgctaaattaatgacaggtgctggtggtatcatttttgataacttgcctatgattttcgcattaggtgtcgcaatcggattagctggcggtgatggcgtagcagctatcgcagcattcgtcggttacataatcatgaacaaaacaatgggcgactttttacaagttacacctaagaatattggtgatccagcgagtggttacgctagcattttaggtatcccaacattacaaacaggtgtgttcggcggtattataatcggggccctggcagcttggtgttataacaagttctataacattaacttaccatcttatttaggtttcttcgctggtaagcgtttcgtacctattatgatggctacaacatcatttattttagcattcccaatggcattaatttggccaacgattcaatcaggattaaatgcattcagtacaggattattagattcaaatactggtgttgccgtattcttatttggtttcatcaagcgtttattaattccattcggtctacatcacattttccacgcaccgttctggttcgagtttggttcatggaaaaatgcagctggtgaaattattcacggtgaccaacgtatctttatcgaacaaattcgtgaaggcgcacatttgacagctggtaaattcatgcaaggtgaattccctgttatgatgttcggtttacctgcagcagctttagcaatttatcacacagctaaacctgaaaataagaaagtagtagcaggtttaatgggttctgctgctttaacatcattcttaactggtattacagaaccattagaattctcattcttatttgtagcaccattattattctttattcacgcagtacttgatggtttatcattcttaacattgtacttattagatcttcatctaggttatacattctcaggtggtttcatcgactacttcttactcggtatactacctaataagacacaatggtggttagtcattcctgtaggtcttgtatacgcagttatttactacttcgtattccgattcttaattgtaaaattaaaatacaaaacaccaggtcgtgaagataaacaatcacaagcggctactgcttcagcaactgaattaccatatgcagtattagaagctatgggtggcaaagcaaacattaaacatttagacgcttgtatcacacgtctacgtgttgaagttaacgacaaatctaaagttgatgttcctggtttgaaagatttaggcgcatctggtgtattagaagtcggcaataatatgcaagcaatttttggtcctaaatctgaccaaatcaaacatgaaatgcaacagattatgaatggtcaagtagtagaaaatcctactactatggaagacgataaagacgaaactgttgttgttgcagaagataaatctgcaacaagcgaattgagccatatcgtgcatgcaccattaactggtgaagtaacaccattatcagaagtgcctgatcaagtgttcagcgaaaaaatgatgggtgacggtatcgctatcaaaccttcacaaggtgaagttcgtgcaccattcaacggtaaagtacaaatgattttcccaacaaaacatgcaattggtcttgtatcagatagtggtttagaactattaatccacatcggtttagacactgttaaattaaacggagaaggctttactttacatgttgaggaaggtcaagaagttaaacaaggtgatttattaatcaactttgatttagactacatccgcaatcatgcaaagagtgatattacgcctattatcgtgacacaaggaaacattacaaaccttgattttaaacaaggtgaacatggcaacatttcatttggcgatcaattatttgaagctaaataatgcttactataaacaggtgcgtataccttcataaggtgacgcgcctgttttttctttgctattgtattttgcagcatcattgatagttcgctctccccttaaattttgaattttaagatcatcaattaaagccccccttcatactcatttcctaaaaaatattaattgttcactattgttagcgttttcacaacaaagtcaacttccttgaccttacactatattcgaggctatcattttaagtgtaaatatagagaaaaggtggctttttttatgaaacaacgcattggagcttacttaattgacgctattcatcgagcaggcgtcgataaaatttttggtgttcctggtgattttaatctcgcttttctagacgatattatcagcaatcccaatgtagattgggtaggaaatacaaatgaattaaacgcaagttacgcagcggacggttatgcccgtcttaatggactcgctgcattagttactacatttggtgttggcgaattaagtgccgtcaacggtatcgcaggttcatatgctgaacgcatacctgtcattgcgattacaggtgcgccgacacgtgctgttgaacaaggcggtaaatatgtacatcactcacttggtgaaggtacatttgacgactatcgaaaaatgtttgcacatataaccgttgcacaaggttatatcacacctgaaaatgcaacaaccgaaataccacgtttaattaatacagcaatcgccgaaagacgcccagttcatttacatttaccaatcgatgtcgcaatctctgaaattgagataccgacaccatttgaagtgacggcaactaaatatacggatgcatcaacatatatagagttattagcaactaaactgcatcaagcgaagcagcctatcatcattactggacatgaaattaacagttttcacctccatcaagaattagaagattttgtaaatcaaacacagataccagtagcacaactttcattaggaaaaggtgcttttaatgaggaaaatccatattatatgggtatttacgatgggaaaattgccgaagataaaatacgagattatgtggacaacagcgatttaattttaaatattggagccaaattaacagattcagcaacagcaggtttttcataccaattcaatatcgatgatgtcgttatgttaaatcatcacaatatcaaaattgacgatgttacaaatgatgaaatatctctaccatcattgttaaaacagttatccaatatttcatatacgaataacgcaacgttccctgcgtatcatcgtccaacatcacccgattatactgttggcacagaaccattaacacaacaaacttattttaaaatgatgcaaaatttcttaaaaccaaatgatgtcatcattgctgatcaaggtacatcattctttggtgcttatgatttagcattatacaaaaacaatacttttatagggcaaccgttatggggttctatcggctatacattacctgcaacattaggttcacaattagcagacaaagatcgtcgtaacttattattaattggtgatggctcattgcaactaactgttcaagctatttcaactatgattagacagcatattaaaccggtattatttgtgattaataatgacggctatacggtagaacgacttattcacggcatgtatgaaccttataatgaaattcacatgtgggattataaagctttaccagctgtatttggtggtaaaaatgttgaaattcatgacgttgaatcatcaaaagatttacaagacacgtttaatgcaattaatggtcatcccgatgtgatgcattttgtcgaagtcaaaatggctgtcgaagacgcaccgaagaaactcatcgatatcgctaaagctttttcacaacaaaataaataatttcatcgtatacagggtataagtttaagcgaatactttattaaacgaataggactctgatataagatgattaattttaataaaaccgctttagtgttaatcgacctgcaagaaggtattcttaaaatggattatgccccatatacagctgaaaatgtcgttcaaaacgctaataaattaatagatgtttttagaaaaaacaatggctttatcgcttttgttcgcgtgaatttctatgatggtaaagatgtattgcaaccaaatgtaatgatctcattaccaccaaaagaaggcgacgcactacagtcgtttccatcatttattagacaagagagatgacgattttgtcatagacaaacgacattttagtgcatttgtaggaacagatttggacttacaattgcgacgtcgaggaattgatacgattgttcttggtggtgtcgcaacgcatattggcgtagatacgacagcgcgagatgcctatcaattaaactacaatcagttttttgttacagatatgatgagtgcacaaaacgaaacgctacatcaatttccaatagataatgtattcccattgatgggacaaacaataactacaaacgactttctaaatatattgaactaaacatatacttccccccttcgatcatgttgagggggatctttatttcacaaagtattaatacgtcgggttgtctaaccttctatatttaacatattctatatctgttaaatcgttcttaacttacgcccctactacataaaaaacagtatttattccggaattttcaaaaaatttagtatttattgcaaaattatgtatcactttatgtttaatttttgatattatcttaattaagtagatttttataagttctaaaaaggagaacaaatacatatatgaagaagaaactaacatttaaagaaaacatgtttataggttctatgttatttggtttattctttggtgccggcaatcttatcttcccaatacacttgggtcaagctgctggttctaacgtttttatcgctaacttaggatttttaattacagcaattggcttaccatttctaggtatcattgctattggcatttcaaagacatctggtttatttgaaattgcatcgcgtgttaataaaacatatgcttacattttcacgattgccttatatctagttatcggaccatttttcgccttacctagactggcaacgacatcatttgaaattgcattttcgccatttttatcaccaaagcaaatcactttatatttatttatttttagcttcgtcttctttgtgattgcatggttttttgcgagaaagccatcaagaattttagaatatatcggtaaatttttaaatccggtattcttagtattattagcaattattttattatttgcttttatccatccattaggtggcatatctgatgcacctattagtaaacaatatcaatcacatgccttatttaacggctttttagatggatacaataccttagatgcgctagcgtcattggcatttggtattatcattgttgcaacgattaaaaagttaggtatcgaaaatccaactgatatcgctaaagaaacaattaagtctggtactatcagtatcattatgatggggatcatttataccctactagcaatcatgggtacattaagtattggtcatttcaaacttagtgaaaatggtggtattgccttagcgcaaattactcaatactacttaggtaactacggtatcgtcctgttgtcacttatcgttatggttgcttgtttaaaaacagccatcggtttgattacggcattttcagaaacattcgaacaccttttccctaaaatgaattacctagcgattgcaacagttgtaagctttatttcgttcttattcgcgaatgttggtttaactaagattattatgtactcagtcccagtgttaatgttcttatatccattagcaattgccttgattgtactaacattatttagtagcaaattccatcattcaaaacttatttatcaatgtaccattttctttacaatgattgctgcattagtagatggattaaaagctagtccagagttcatttcaagcacatcattctcacaaactttgattaatttcagccaaaaatatttaccattatcagacattggtatgggctgggttgttctcagtttgattggtttcattatcggcttcattatttataaaattaagcatcgtaaaattccacaagcataatactatgccacagtcatatgttaaacatatgcttgtggcattttttattcatactacattaaactgcaatcgtatacatacatatcaatgattatccacaaaaaatattagtactttcattttacaaatcacattaatacaaacacaaccttatctttatattattaaatttatatttgacacttatattgaacaactgtaatatattaatattaattctttaaaatgtataaatataaaggagggagaccgatgaattcaatcattgaattaactgattattatagctctaataattatgcaccacttaagcttgtcatttctaaaggtaaaggtgtcaaagtttgggatactgatggcaaacaatatatagattgcatttcgggtttttcagttgcaaaccaaggccattgtcatccaacaattgttaaagcgatgacagaacaagcttcaaagttgtctatcatttcacgtgtcctttatagtgacaatctcgggaaatgggaagaaaaaatttgtcatcttgctaagaaagacaaagtactcccccttaactctggtactgaagctgttgaagcagccattaaaattgctagaaaatggggctctgaagttaaaggcattactgacggacaagttgaaatcatcgctatgaataacaattttcacggtcgtacacttggctcattatcactatctaaccacgacgcatataaagcaggatttcaccccctacttcaaggcactacaacagtagattttggagacattgaacaattaacacaagctatttcaccgaatacagcagcaattattttggaaccaattcaaggtgaaggtggcgttaatataccaccgaaaggatatattcaagctgtgcgtcaactatgtgataaacatcaaatattattgattgcagatgaaattcaagttggtcttggtagaactgggaaatggtttgctatggaatgggagcaagtcgttccagacatttatattttaggtaaggcattgggtggcggcttataccctgtatctgctgtacttgcaaataatgatgtcatgcgtgttctaacaccaggtacacatggttcaacatttggtggtaaccctttagccattgcaatatcgacggcagcgcttgatgtacttaaagatgaacaactggttgaacgatcagaacgcttaggttcatttttattaaaagcgttgctacaacttaaacatcctagtattaaagaaattagaggtcgtggtttatttataggcatagagcttaacacagatgctgcaccttttgtggatcaactgattcaacgtggaatcttatgcaaagacacgcatcgtactatcattcgattgtctccacctctagtcattgataaagaggaaatccatcaaattgttgcagcttttcaagacgtttttaaaaattaacaattaatcatttatatatgacataggagggattcatgatgattaaagtaggtatcgttggcggtagcggttatggcgcaattgaattaattcgattgttacaaacacatcctcatgtaacgattgcacacatctactcacattcaaaagtagatgaaccgttgaaattaacatttccacatttacaacatattatgcaacatttcgaagcacttacagtggataataatgactgtgatgtaattttctttgcgacaccagcacccgtaagtaaaacatgtatccctcccttagtagaaaaaggtattcatgttatcgatttatctggcgcatttagaattaagaatcgtgaaatatatgaagcatattacaaagaaactgctgcagcacaagatgatttgaatcatgctatttacagcatttcagaatggcaatcgtttgataacaatggaacgaagctcatttctaatcctggctgtttccctacagcaacattattagcattacatccacttattagcgaaaaaatagtagatttgtcatctattattattgatgctaagaccggcgtgtcaggtgctggtcgttcattatcacaacggttcatttttcagaaatgaatgaaaatctaagcgcttatgcaatcggaaaccataaacacaaaccggaaatcgagcaatatttatctatcattgcgggtcaagatgtatcagtcatatttacaccacatctcgtaccaatgacacgaggtattttatcaacaatatatgtcaaattatcatctgaatatacgactgaatcattacataaattaatgacctcttattatgctaatcagccatttgtcagaattagagatattgggacttttccaaccacaaaagaagtactcggtagtaactactgcgatatcggcatctatgtagatgaaacaacgcaaacagcaattttagtatcagtgattgataaccttgtcaaaggcgcaagtgggcaagccattcaaaatttaaatatattatatgattttgaagtgacgactggcctaaatcaatcaccagtttatccataaggggtgttagaatgaaacatcaagaaacgacatcacaacaatataacttttcaattattaaacatggcgatatcagtacacctcaaggcttcacggctggtggtatgcacatcggtttacgcgctaacaaaaaagactttgggtggatttactcatcgtctttggcaagtgcagctgccgtatatactttaaatcagtttaaagctgcaccacttattgtcactgaagacactttacaaaagtctaaaggaaaattacaagcacttgttgttaattcagctaatgcaaattcttgtaccggtcaacaaggcatagatgatgcacgacaaacacaaacatgggttgctcaacaacttcaaataccatctgagcatgttgctgttgcttcaactggggtcattggtgaatatttgcctatggataaaattaagactgggaccgaacatattaaggatgctaattttgcaacgccaggtgcgtttaacgaggcaattttaacaactgatacctgtacaaaacatatcgctgtatcactaaaaatcgatggtaaaaccgttacaattggtggtagcaccaaaggttcaggtatgattcacccaaatatggctaccatgcttgcttttataacaaccgatgcatcgattgaatcgaatacacttcatcaattattaaaatcttcgactgaccatacatttaatatgattactgttgatggcgatacaagtacaaatgacatggtattagtcatggcaaatcaccaagttgaacaccaaatacttagtcaagaccatccacaatgggaaacatttgttgatgcattcaattttgtctgtacatttttagctaaagctatagccagagatggcgaaggcgcaacaaagttaatcagcgtcaatgtgtcaggcgctaaatcaatatcagatgcaagaaaaatcggtaaaactatcgtaagttcaaatctagtaaaatcagctatttttggcgaagatgccaattttggtcgaatcattacagctattggctacagcggatgtgaaattgatcctaactgcacatatgttcaactgaaccaaatacctgtcgttgataaaggtatggctgtactatttgatgagcaagctatgtcgaatacattaactcatgaaaatgtcacaattgacgttcagcttggtttaggtaacgctgcagcgactgcatacggttgtgatttatcctatgattatgtgcgtatcaacgcatcatatcgaacataaggtggtgttggttagatgaaatttattgtcattaaaattggtggcagtacacttagtgacatgcatccatcaattattaacaacattaagcatttacgatcaaacaacatctaccccattatcgttcatggcggtggcccatttattaatgaagcattatcaaaccagcaaatcgagccacactttgttaatggcctaagagtgactgataaagcaaccatgaccattactaaacacacgctcattgcagacgttaacactgcattagtagctcaatttaaccagcaccaatgttctgcaataggcttatgtggtttggatgcacagctgtttgaaattacatcttttgatcaacaatatggatatgtcggtgttccgaccgctttaaataaggatgctttacagtatttatgtactaaatttgtacctatcatcaattcgattggtttcaataaccatgatggagaattttacaatattaatgctgacacgcttgcctattttattgcatcatcattaaaagcgcctatttatgtattaagtaatattgcaggtgtactcatcaatgatgttgttatacctcaattgccattagtcgatattcatcaatatattgaacatggtgatatttatggaggtatgattcccaaagtgctagatgccaaaaatgcgattgaaaatggctgtcctaaagttatcattgcatcaggaaacaagccaaatatcattgaatctatttacaataatgattttgttggcacaacaatccttaattcataactatgaaattaaggcctaacaagttttgacacgcgagatgattccagttcgattatccattgcgctaaaacatttatttaccgttcatctcgttaacaattttgaatacagtacgatacaatatgagatgtaaaaaactaataaccttttacaaatttgtttatcaaaatattttaagttttgcaaagctttttattgtgattattttcacaaaatactataatgaggatagtaaatagagaggagtccttaagttgacgaaacgacaaatgggtatattcatttatgctggaattatcggtggcttgttatctggaattgtaaaattaggttgggaggtcatgtttccacctcgcacaccagaacgtaatgcaacgaacccacctcaagagttattgcaacaattaggatttagtagtgagtttacgcatcaaacatatacattttcaaatatggaattgccttgggtaagctttattgtccactttagtttttctatcgtcattgcaattatttactgcatattagttaaaaaatacgcttacttagcaatgggacaaggtgctgtttttggtattgctatttgggtattattccaccttatcattatgccaatcatgcatactgtacctgctgtgtgggatcaaccattccaagagcatctgtcagaattctttggccatatcgtctggatgatgacaattgaattagtgcgacaacattttgtctatcgctataaattaaattaatacactgactaacattaacgtgagttttaaatcatcgtttgagtatgatgattgatgctcacgttattttattaactgacatgatatgattccagccaacttacgtgagcattaaagtctcaaatgcgtcgtaacaaactattattttcggtaatttcaatattgctcagtatatttttaccttatcacttactttaatctcgtcatgattttgaatgatgccatcgtgtattcacctttcatttttccaataaaaaaacatctaacagtaaacatttaggcagtatagtttaaaatcactgcgcaatgatactgtcagacgtcatattaactactcaataactgaaatacagacacttttttataaccccagggtgcctgtcctaagaaacatacctgtaccataaactgatcaaaaataaattgtttgaacttcacttcacgtgattgataaaagtgtgattgtgtcatatcataaatgtccaatcctttgattaaaccttcaccaatcaattttgtaaaactttctttttgtgtccatatttgataaaaatcatttaaactacatatttgatgtgcttcgtttgtagagaaacacgtcactaacgtacgccagtctaaacgttgtgatatcttttcgatatcaataccaactggttctttatcgacaacacacacgatataaggataactatatgataagctcacatagatgggctgtccatcacgattgtgttgaacaatatctgccttacctcgtggcgaaatgtgataatgccattcatgtggtaataaacctgtgtcatgttgaattccatattgcactaaaatatctcccaatctgtgcatgagtttatcttgattgtatctatagttgactgtacgcggttttttatatgaccaacgactttgtgatattaattcttcaatacttttcaagttactctgtaattgcattacaaatactgtcataactttccctacttacttattgaatattgttttgatatattgtgcccaatgatacagccaattgttagttatcgttggccatttttcactgatgtgattcattatttttaatgttaatgttgtatctatcattgctagttgttgttcacggtcaacactagttaatccaatcgtttcgtacatgtcttgtttctgtaaaatttcattaaatgattcatcgctgacgagttcaatttctttgcgcttaacgcattctaacaaagatttcaccggcattttattaggtgatagcacatggtaaatgatttgtggtgtgttgacctgtgctaatgcgacaatttgtcttgcagtcgtatccacaaaagaaaaatctacaggcatttcagccatgctaaccccgatacaatccagttgtaacaaatcattcattaccattgaaaaacggttagtctttatatttctcatatgccatcttccattgtaaggattcgtcaaattaccaacacgtacaatccgaccatctaagccattatttacagcttctaatacttttaattcactataaaatttgctccgtgtatatggtgatgttagtagttgccctttatagacatccgcttstgaaaatgtcacatcttctgtgtctatatcaaaataagttcccacacttatcgtagacacatatattaaccttgcatgatgttgttgtgccaaacgtatgacatcaacagtaccttgaacatttactttttcaaattcatcatcatcaccaaagtgatctgtacgagcacctgcatgaataatcgtatccatgttttctggtaaaacaacatcatccatacactcgaaatcaccaacaatgacttcaatgtttgataacattatttcaaccgtctcttctgaaaaataatcatttaaattcgtcatcaacttataccatgctatttcctcattatcagcacgtatgaaacaataaatgcgatgactgtatccttgtagtacttcaatcagataagcacctaaaaaacctgtcgcgccagtcaatagtgtatttcctagaggtcgatgacttagactatcctctaaaatacccaagttataacgagacataacaatcttttgtaattccgaaagattatccggtaatgcaactaatgattgttgattttggtacatataattaacaatctgtcgcacggttttatattggtataatgtctgcattgaaatatgatggccaaatcgttttaaatgcgagacaactaacatcgcctctaatgagttaccaccaagttcaaagaaatcatcgtcaacaccgacatcattttgtttcaatacctctccaaatacatcaacaaatgtctgctcaatttcattagagggttcgctatacactttattagactgttgtataggtgatggatttggcaaacgcgtagtatccaccttgtcattcgtggttaatggcatacaatcgatatgcgttatagtcttaggaatcatatacttaggcagctgatcatttaaatattgcttcaaatcctgttccacttgttgctctccgacataataagcattcaatatatcatgcgtatcaaagtgacttactgttacaacacaatcagatataccacgaatagctaatattgcattttcaatttcatcaagttcaatacggtacccgttaactttcacttgtttatctattcttcctaaaaattcaatttgaccatcagatgtataacgtgctaaatcaccactatgatacaactttcctttaccaaatggattattttgccatttatcagccattaattctggacgattaatatatcctatcgctaaactatcacctgcaatacacaactcgcctggcataccaataccgcataacaaaccatctgacataatatacacttggatgttagataagggtttgccaattggaatcgtctcaggtatcaaatcaccacaatgatgtgaccaatacgatgtgatgactgttgactcagatggtccataggcattgaaatacgtgccacaatgcttctcaatatatttaacaaaggatgccgtactagttgccccgcctgtaatcaacttttcaatataaaagtcttccataacactacacatctgtaacggaatcgacgcaaccgtcacacgatgcttattaatgagttgttgtaactgttctggattaacacgttcctctctatctggaatcacaagcgtatgaccatttaacaaacaacaataaatctccataactgatgcatcaaaaacaatatttgcatgttgcaaaaatacttcattgtcgcctaattgcaattcagttgaccatgcatgcactaaattcaacaaatttcgttgtcgtatggcaacccctttaggcatcccggtcgtaccagatgtgtaaatagcatacatctcattatctaacatcgctgtgttttcaagttgattgccatgtaaatcatcatattgttcattttcctttgattcaacaaagcctttagcattttccaattgaatgactggtaatgtcgtttcaatttcaacgccgtaagacatgactgcagttactttagcatcctccaaaattgcaccttgtcgtttattcggaaaatcaatatcgataggtatataagatgcacctactttaactgtcgccaacatcgccgcaatcatttcaaaactacgttctgtaaacaaggcaacccgttgaccattgcccacaccatttgataggagcatgtgcgcaatggcatccacatagttgcgtaatgtttcatacgtcattgtcaaatcattcatgactagcgcaacatgattaccttgtcgtgagacaacttcattaaagtaacttatgatagatttatttcccgggacattaagcattcgatcgttaacatgcgtattgacccaatttagaagttcctccgtgccgtttggtatatcacaaatttgtagtgtatcttgatgcttcaaaatataatcaatcataatcatacattgattacccatgtgacgaactgtttctgagtgatataaatcggtattatactcgatattgattgtatagtcatcgcgatcttcttcaatgatgaaagataaatcaaatttcgccgtcactgatttgggttgaatgtgtgttaatttactatgcccaaaatgagcatgattcgtttcattgttttgtagtactaacatgacatcaaataatggattccgtgaggcatcatgtgattgatctaagtcatttactaaacattcgaatgggtattcttgatgctcgtatgcctccaaactcatttccttaacctcttgtaaaaactgtgtccacattttatcaggtgacggttgccctctatataccaacgtattagcaaacatgcctagcatttgctccgtgcctttatgcatacgcgcactcatcacactaccgacaacaacatcatcttttcgagcatatctacttaacaacgtcatgaccacactcataaagaacataaaatcagtaatttgatgcttttctacatacttttgaagtagctgtctcatttgttgattcattgtaaatgacatcattgctccatttgtcgttttaatatttggtctaacatagtctgtcggtaagcttaaaataggtacttcatctttgaattgagataaccaatattgtctatgtttcgtcatatcacgatgcgacatccactcactatagtctttatattgcaatttaagtggtaacaataatttatgttgataaagtgcgttaagatcattcattaattgtatattactcataccgtcattaatgatatgatgcgtatctataaagaggtatgcatgtaagggacttctaatgtatctcactctaatttgacttggcttttccaaattaaaaggtgctacaaattggcgcatgatttcttgttcatccgtaaaatgcgtgttaacttcttcaaagtcaactgcaacatctgccacaatacgttgtcgaacctcatcatctacaacaatatattgtgttcgtaaaatctcatgtcgcgctatcaaacgctgcactgcttgtcgcaattgagctacattaagttctgatgataaccgccataaaaaaggtacgttatacaccgtatctttatggtttgatttccataataaatacatacgcttttgtgcagagctcagcacataatcatctttaactatagtttctggaatcacttcatagttttgttcttgaaccttagcaatcgcttgtgctagttcaaatacagttggcttttgtaataaatcaccaatttgtaatcgtttcccagtagatgcctctatccgattcaccactaacgttgcttttaatgaatggccacctaattcaaagaaattatcatgaatacctacttgattcacatgtaaaatatctgcaaaaatttggcatagcaagtgttcggtatctgtactcggtgctacataggcatccgtatcgacatagtccatgataggcaatgccttcttatctaatttcccattaatagtaataggaatttgctcaatatgcatgaaattaactggtatcatgtactccggtaaggtcatacgtaattgtgatttaatcttattatgtgataatgtatgcatcgcttcataataagcaacgatatactgatcttgatcatgattttgaacaataacaactgctttattaataccttgtatacgctcgagcgcatgctcaacctctgacaactcaatcctaaaccctcgaatcttaacttgtttgtcctttcgatataaataatctatgttgccatcgggtaacaaacgaacgatatcaccacttctatacatcagctgatttatatttgaatctttgataaatttatctgctgtcaattctggctgatttaaataacctgcagctaacccaaagccacttgtacataattctccaggaataccaacgccacaccgacgctcgccttgcatgatataaacatgagtacccagaatcggtttaccaataggaatacgatttggaactttgttaggtatattatacgtcgttgtaaatgttgtattttcagttggtccataaccattaataatttgaggatgcttcggtttttgattaagcaaatccacccacttagcattcaatacttctccaccaattaataaatactttaacggtaccaatacttctattcgttcactagcaatctgattaaataatgaggaggttaaccacatagtattaacgtcattttcattgattaattgttctaccgctattggatttaataattgttcttttttagcaacaatcagctttccaccattgagcaatgcaccatatatttcaaatgttgcagcatcaaaggctatagttcctgataacaaaatcgtcgtctcttcatttaatggtacataatgattttgatggaccaagcgaacaatacctcggtgcggaattagtgtccctttagggttaccagttgtccccgacgtgtaaataacataagcatgatcttctaacgtgttacatttagaaagattatcaatatttttccacgctatcttattcaaatcaatgtgattaatattttgtttaccattttcatataaagcttggtacgttattacaactttaggcgttacatcttttaaaatgtactcctgacgatcacttggatagttcggatcaattggcacgtaagccccaccagctttcaacacacctatcatcgctattatcatctcaatacttttttcagctatgacagcgacacgatcattaggttcaacaccatactggtttctcaaacggtgtgctaaatcattcgcgcgtgcattcaatgtttgatatgttataaacactccgtcaaattgcacagcgacatgattcggcgttgcttcaacttgttgctcaaataaggtaacaactgtttgcgcatcatctatctcaggcaaacttaaattgatatcgtcatataattgaatatcacgttctgtcatcaaattaagttcatctacagttgttcgtttatttccattttcttcagtaatttgcaaataaatatttcgaactaagtcactcagcgtctcgattgagagcaaatcatatgctgcactgttatatataattttgaacccgtgttgatgtggaaaaatttcaatatccgctaaagatgtatgtgcatcatgtatttgatgtacatcctcaataacatcattacaacaagacatcatatgatgataacaatgaaaaatagtctctagtgaaagcgaagacttcgcgcactgtaattgcgacatattttgcaacacacatttattaaaatctgttgtaaaacgttgacatacatcttttgcatcgattgttaacgttaacggcacaatatttccgtgtaaatcatttggtaaatgtgatggtacatgtatacctaatgtgacatcatgttgttgactcattatatgattagctaaatacacactaacagccaacgatgccatatctattgatgtcatatcatcaatcaaatacgtttgatataaagcttgttcaaatggatgcttaattggaaaataactatcaatatggatgtcagagttattctctaaccgaaaatagtttgagtctaatgctatatgcgatgcatcttgattgtctttatcatcatttctatttatatgtgcatgctgtcgagtattgttaataacagtattgccacgatatgcattgcataaatcatcaagaanaatatcaatttgactatcatcgaaaatggacacatgaaaatctaatagtatatatgcagcatcagcgaactgmaacaatttaactttgaataaaggtgaatcattaaaatggtaagtacttaattcttgcttaaaaaaagcttctaaatcatagtttgcggaagaagatggaacttgttttatctcaataaaaggcagaaattcatgaagtatcattgttaaattgtcatcggtagtaacatcaaaaaaatgtcttatagatgcatgttgtgcacaattgtcgataatgcatacatcattttagtagcttcaacatttttagcgagtttaacccaatacgcattacggtgtgtcgttgattctgtattatttttgtatatacgaaaatattcctgttgaaatctcaaattacccataatcataaaaagtccttctttcatatcataatactcattacttactgaaattgcatgatgatatgataaccgacgaaatgttaattaactcgttatgtaatgattaatataaaacaccattcgcaacatatgagcgatatattctaccctaaaatacatcttgtatcatcgttacaattggtatatttttcaatgtaaattacatacatcttcgataaatagcacactacaaatcgttaatcactttctgttgttcacatctcattgcaaactcaatattgttgttacaaaatatccatgaagcaagtttatattaaacaaacaactcgcataaaacaattgttatccttaaattttaacaaattcttaataaatttatctctattttaattacgaccaaattaataggttttccatataaaaagatgcataaaataaatatttaaataaattcaatttgtattcacttgtttttgtcccccaaatacaccagcaacaagcatgctagcaccaattgttaaaacgataaacatatacagtcccatttgtaatgacgttaagaaaacacccaacacaatccctaacctagctagtgtttctgaaaaatgaatacctaatgcattaactgcactatatgttcctcttttagctttaggaataattttaaagcgttgttctgaaactataggcgaataaataatttcacctacagtcgcaattatcataaaaacaactaataagccaaactgattaagataggttagaccactatagccaacaatataaatcagcaaaccagtgattaaagcttttttaaaatctattttcaatacaactttcgagattgaatacgtgagtaaaatgacgacgaccgtattaatcattagcaagattgctaacatcttagcacctgtaatatcatatgaacctatacttattgtttcaaactgatcctttagtctaatagcaatatatgaggagattgaaaattcacccatcatgatgatactgaaccccgaaatcaataacatataattacggtctttcaaaactaatttataactgcgaaatatattcattatttgtaatttttgataacgacttgcatgcctcttgtcatcactttgctttacttgatttcggtcttgaggtaaccaaatatataaaataaagagtacaattaaaaatatacaagctgctattaagaaaagtagtaacatactgtagccatacatcaagccacctaacaatgccccaatagctaccgataagtttgtcatccaatagctaatcttgtaaatataatgttccacgtcttcggtaattgcatccataattaatgtgtccataactggaaattgtaatccccaaacgattgtaaatatggcatatgcaacacaaaaaccaataatttgccacaattgatgtgacccaaatacgcccatgaacacaagcattatcaccatcgtcgcttgataaataagtactagcaactttttcggaaatatctcaataaggtaaccagatataatggacaatggaaatttnagaaccactaaaccaacaagatatataccgacaattgattgacttaacatatctgttaaatatagtgctataaacggtataaatgctgtcgtaataattagctgtaaaanattgctaatcaatcgtactttcaa

SEQ ID NO: 207 - DNA, 1539 bp; double-stranded, linear
aaaaaaaaaaaaaaanggtgaatctttaattaaacactaatattgtaaaagatgttaagtaaacgcttaatgacacttattttttgaaaataatagtaatatcattttgttaaatgaaagaataaagctataatmattatagaataactatttaaaggagattataaacatgccaattattacagatgtttacgctcgcgaagtcttagactctcgtggtaacccaactgttgaagtagaagtattaactgaaagtggcgcatttggtcgtgcattagtaccatcaggtgcttcaactggtgaacacgaagctgttgaattacgtgatggagacaaatcacgttatttaggtaaaggtgttactaaagcagttgaaaacgttaatgaaatcatcgcaccagaaattattgaaggtgaattttcagtattagatcaagtatctattgataaaatgatgatcgcattagacggtactccaaacaaaggtaaattaggtgcaaatgctattttaggtgtatctatcgcagtagcacgtgcagcagctgacttattaggtcaaccactttacaaatatttaggtggatttaatggtaagcagttaccagtaccaatgatgaacatcgttaatggtggttctcactcagatgctccaattgcattccaagaattcatgattttacctgtaggtgctacaacgttcaaagaatcattacgttggggtactgaaattttccacaacttaaaatcaattttaagcaaacgtggtttagaaactgcagtaggtgacgaaggtggtttcgctcctaaatttgaaggtactgaagatgctgttgaaacaattatccaagcaatcgaagcagctggttacaaaccaggtgaagaagtattcttaggatttgactgtgcatcatcagaattctatgaaaatggtgtatatgactacagtaagttcgaaggcgaacacggtgcaaaacgtacagctgcagaacaagttgactacttagaacaattagtagacaaatatcctatcattacaattgaagacggtatggacgaaaacgactgggatggttggaaacaacttacagaacgtatcggtgaccgtgtacaattagtaggtgacgatttattcgtaacaaacactgaaattttagcaaaaggtattgaaaacggaattggtaactcaatcttaattaaagttaaccaaatcggtacattaactgaaacatttgatgcaatcgaaatggctcaaaaagctggttacacagcagtagtttctcaccgttcaggaaacagaagatacaacaattgctgatattgctgttgctacaaacgctggtcaaattaaaactggttcattatcacgtactgaccgtattgctaaatacaatcaattattacgtatcgagatgaattatttgaaactgctaaatatgacggtatcaaatcattctataacttagataaataattttctntataatcaaatgctgacataattttagttgaggattattatgacggtataaataaataaag

SEQ ID NO: 208 - DNA, 846 bp; double-stranded, linear
caatttctatctatcaatgatgtgcatacttccanttaaattaatcgaaatgaatcaaggtatatcattcctgcctctttatataacaacaaatagtgattacaatatttcggttattaacacgaaaattttacaagcacctatttcatttacatatatatacagcaaaaaagaaagcccagaaatattggtgtttattaaatcatttaaaaagtatattgccaatgaacaattataataaatttcaaatctaaaaaaccaagaatgcgattaatcatcacattcttggttcaattttattcatgaattttttcaacattaaacgttaagttattgtctgaatttaaattaactttaatcgttgtaccttctgggaatccctctttaatcatcatacgtgctaatggtgtttcaatttggcgttgtacaaaacgttttaatggtcttgcaccgtattgaggttcataagcttcttgacctagccaagctttagcatcatcagaaacttcaattgagattcgttgttctaataatcttatatttaattgcgttaagattttatctacaatcatactcatgtcatcaatagataatggtttaaataatacgatatcatccatacgattcaaaatttctggtttgaaatatgcatttaaacttgtcataacagctttttctgttgattctgtaatttcaccagtctcttttacgttttctaataaaacttgagatccaatattacttgtcataataataatagtatttttaaaatcaacgctacgtcctttagaatcagttaaacggcttcatctaaaatttgcaataatacattaaagacgtcagtat

SEQ ID NO: 209 - DNA, 1674 bp; double-stranded, linear
ntgggaacagtaagccagtatttttagaaagttgccatacatgagcgtcgatttttccaatatggctatgacactagaacaatgggaatttggaggaaaagtaaatgattaaacctaaaatagcattaaccattgcaggtactgatccaacaggtggtgccggcgtaatggctgatttaaaatcatttcattcatgtggtgtatatggtatgggcgtcgttacaagtmttgttgctcaaaatacattgggcgtacaacatattcataatttaaatcatcaatgggtagatgaacaacttgatagtgtcttcaatgataccttacctcatgctattaaaacggggatgattgctacagcagatactatggaaacgattcgtcattatttaatgcaacatgaatctattccatatgtaattgatcctgttatgttggcgaaarcggtgattcataatggwtaatgacacaagcaaaacttgcagcatacgttattgccattagctgacgtagtaacaccgaatttaccagaagctgaagaaataacgggactaaccattgatagtgaagaaaaaattatgcaggctggccgcatctttattaatgagattggtagtaaaggtgtcatcattaaaggcggtcattcaaatgatactgatatagcaaaagattatttatttactaacgaaggtgttcaaacatttgaaaatgaacgatttaaaacaanacatacgcatggaacagggtgtacattttcagcagttataacggcagaacttgcaaaaggtagaccattatttgaggctgtacacaaggctaaaaagtttatttcaatgagtatacaatatacgcctgaaatcggccgtggtagaggtccagtgaatcattttgcatatttaaagaaagagggattagacgatgaattatctaaataaaatacgtattgaaaacccattaacaatttgttatacaaacgatgtagttaaaaattttacagcgaatggtttattaagtattggtgctagccctgcaatgagtgaagctcccgaagaagctgaagaattttacaaagttgcacaagcgctattaatcaatatcggtactttaacagcagaaaatgaacaagatattattgcgattgctcaaacggcaaatgaggcaggcttacctattgtatttgaccctgtagctgttggtgcttctacatatcgaaagcaattttgtaaattattattgaaatcagcgaaagtatcagtaattaaaggcaatgcatctgaaatattagcgttgattgatgatacagcaactatgaaaggtacagatagtgatgctaatcttgatgcggttgcaatagcgaaaaaggttacgcaacatataaaactgcaatagtaatcacaggtaaagaggacgttattgttcmagataataaagccttcgtattagctaatggatctccattattagcacgagtaactggagctggttgtttattaggaggcgttattgctggatttttatttagagaaacagaaccagacatagaagcgttaattgaagcggtaagcgkatttaatattgctgctgaggtagctgctgaaaatgaaaattgtggtggtcctggtacgttttcaccattgttgcttgatacgttatatcatttaaatgaaacaacctatc

SEQ ID NO: 210 - DNA, 2232 bp; double-stranded, linear
atgagttgccgatgaatttagcaccaccaacgattgcntttgatactgtgtcccaaccagcttgtttagcatatttaataccttcacgtaaaggatcgttatcatatgcagcaataccaaatacgttatggtatttcgtgtttgagttagttacaactttgtnttgcactacatctgcacctttcgctaattgagaagtaccgttacctgtttctaatagggcatgtgagataagataaacttcattaatgccatacatttgagcagctttgttaaatgcagcaccttggttttctaatacacctttaccttttaagaattgattaattttatcaatagaaatattttgtggttggtctaagcgtaagaattgatattttaatgctggatcttgagctaaacgcttcgtatccattgcatgcttaacatcattaaatttagcatctgtccacttacctggtacacgttgtacttgtggtttatattgtaaaccagcttgtatttgagcaacttggtttaatgtcatacctgtttgattatacttaattaattctttagctaaatcagttgatttaatccatgctaatttaccgttagataatttaccatagtaccaagtttgtccattaatgacttgttctttaacaactgcgaatggttgttcattaaatgcttttaatgagtatttagctgtatcagaatttggtgttacatagtaataaccattaccatttttaattacataagtgtagttataatctttggcagctgatgtagttggtttcacagcagttggtgcagttaaatcttttgcatttacccaaccagtgcggttattaatagtaccgtataaataaacatctttgcctacagatacttgtttcgttgcattaaatgtaccttgagcaatgttattgcctgttaaaatgacttggtttttagtaccccaaggaaccattgataagccgttatttgatttattaacagtatatttttgagtcgttttaacttctttgcctaagttttgaacatttaagtcttttacattgaaccaacctaatgggatgttatggcttgtattgtttaataatacatacgtttcattaccatgagcacgctcttttgttacatagaacgtacggtctgcatatttcgcaccgtttttcgctgttttttcataaacagaagcacgaataccagtgttgtttggtttaacttgagcaatcttgctaactgtttgagtcgtttgtggtttagtaacagtataagcttttacagctgtttttggttgtgctactgcttttttaggtgcagcaggtacagctaaatatgctttacttacccaaccagatttaccatttacagttccaaataaatagatagatttatcaatttgttgttgcttagtcgctttaaaagtttggttacctgtaccagaaactgcaccagcttcttgtttataagtgccccaaggtactgaatataatttagtgcctgggtttactgtatatgtttgcattacatttacaggtgattttgcattgttataaatacgtcaccttgtttaacccaaccaattaaagttggactattgtaatctttaactaagtagaatttgtttccacctaaacttgcttcttttgttacagcaaatgttttttgaacttctttcgttggcttaccagttttgtcataaactgtagtgaataagccattgtttttagcattaatttgagcaacaccgtttaatgatgaaactgttaatttattatttgttgtaggtgttgatggcttaggtgttggtgtaggcgtaggtttagcagtatcaactaaatatgctttacttacccaaccagatttaccattcacagagccatataaataaattgatttatcaatttgttgttgctttgaagccttaaatgtttggtttccagagccagacacactaccagcaacttgtttagatgtaccccaaggtactgtataaagtttcgtaccaggtttgattgaatatgattgatttacatttacaggtgatttagctgtgttgtaaaccacatcgccttctttaacccaaccaaatttattaccagaattgtaatcttgaacaagatagaatttttgattacctaatgtagctgttttagatacagcaaatgttttttgaacttcattagttgctttaccagttttgtcgtatacagtagtatataaaccactatttgttgg

SEQ ID NO: 211 - DNA, 2082 bp; double-stranded, linear
gatttaaataaaattaatggatatcgtgatcgtacgatgttagaacttctgtacgcaacgggaatgcgtgtatctgaattgatacatttagagttagaaaacgtgaacttaataatgggatttgtacgcgtatttggtaaaggcgataaagaaagaattgtaccattaggcgacgcagtcattgagtacttaactacttatattgaaacgattagaccgcaacttttaaaaaagactgttactgaagtcttatttttaaatatgcatggtaaacctttatcacgacaagcaatatggaaaatgattaaacaaaatggtgtaaaggcaaacattaaaaagacgttaacgccacatacgttacgccactcttttgcgacacatttattggaaaatggcgcagatttaagagcagtgcaagagatgttaggtcactctgacmtatctactacccmactctatacmcatgtttcgraatctcaaattagaaaaatgtataaccaatttcatcctagagcataaagtgaacaataactcaaaagtcacaatacacatgactaaaaatgtctgtgctattgtggcttttttaaattggttgattaattacgtctatgttttcttaattgaatcgcttcttcttttgctgcaatcacttctgaacgatcacggcgcatgtgatggtctacaataaaaggatctgttgctgtttcctgattataatcatagtctggatagttggccttgatgatgcgttcaaagactggagttattggtaatataacagatgaaaaaggctttgctgcattcaattttgcaatctgttgctcaattaacaactgataatcatttaaattaaggtataacgcatctctatctttagcattttgtattatttctttagatttattaaaagacttataggcgccttttaaattattgcggcgataatggtaacaagcagttgcaaacaagattaaactaacaactgcatcttgcttactgtagttattttcagctttccatgcatcttctaaaatgtcatgacataggaaataatgttgcttagtatgaaattgataatagaaatttatcagtgcctgttgcattttgttatcaccccaatttaaaagtaagttattttcatgctataatattttagagaattatgcacatatgacgcaatacgaggtagatattatgtatgaagttaaattagatgctttcaatggaccattagatttattgctgcatcttatccaaaaatttgaaatagatatttatgatattcctatgcaagcattaacagagcagtatatgcagtacgttcatgcaatgaaacagcttgaaattaatattgcaagtgaatacctagtattagcgtcagaactcttaatgattaaaagtaagatgctattaccacaatcaacatcagatatggatgttgatgatgacccacgggaagatttagttgggcgtttaatagratatcaaaattataragaatatactgctattttaaatgacatgaaagaagaaagagatttttattttaccaaaaagaccgacagatttatctcatttggaaacagatgaatcytgggatccaaatcatacgattgatttaactgaattaattgtagcttatcaaagagttaaaaatagagttgagttaaatacacctaaatctgttgaaatccgaaaagagacatttaccattcaacaagctacagaacaagtgacatcgagattgaaagataaagatcattttaacttctttagtctgtttacgttttctgagccaattgaacaagtagtcactcactttttagctattttagagatgtcaaaagcaggaataattaatattgagcaacaacgtaattttgaagatattaacattattagaggagtgaactaccattttggataatcatggtatattagagtcgcttttatttacagctggcgatgaaggtttagatgaaaaacaactattagaaatattagatatgtcgaaagaccaactcgttgaattaattgaaaattattcatcacatggattaatgatacaacgatttggaatga

SEQ ID NO: 212 - DNA, 4219 bp; double-stranded, linear
tctattctcgttcttccaagaccctgaattagaagttaagaaaatcgaagaagatgagaaagaatctattaaaaaagctcaaaaaggtatttataaagaccctagagacatcaatgatgacgaacaagatgatgatacaaaagatactgttgataaaaaggaatgattgtaattgcctaacaaaaacactcaagaatattgggaagaacgcggacgcaaagcaatcgagaatgagttgaagcgtgataaaactaaagctgaagaaatagaacgtatattgaatatgatgattaagcgcattgaaaaagagatcaatgcgtttattgtcaagtacggagattttgcaggcgttacattacaagaagcacaaaagattattgatgagttcgatgtaaaagcgtttcaagaagaagcaaaaagattggtcgaaaacaaggagtttagcgatagagcaaatgaagaattaaagaagtataacacgaaaatgtatgtatctagagaacagatgttaaagattcaaatagaattcttaattgcttatgcaacagctcaaacagaattatcgatgagggaatatttcgaatcaacagcttatcgtgtgttcagtgatcaagcgggtattttaggtgaaggtgtacaagtagctaaagaagttatagatacaatcgttgatacacaatttcatggtgtcgtttggtcagagcgattatggactaataccgaagcaatgaaacaagaagtagaagaaataattgctaatgtagttattagaggtcgacatcctaatgaatatgttaaagatatgcgcaacacttaaataaattcgaaggcacagcacgacaaaagaccgcagcaattaaatcattgctttatacggaatcggcacgtgttcacgcacaatcaagcattgacagcatgaaagaaatttcaccggaaggatattatatgtatattgcaaaaatcgataatagaacaactaaagtatgcaaagggcttaatggagaaatattcaaagttaaagacgctaaaattggtgttaatttctatcctatgcatatcaattgtcgttcagattgcgctttactacctaaatctatgtggccgaaaaaaccaagcaagaaacgaaaaacaaaatacttcggagggaaagtgaaaagcggtgattgatttaaaagtgaagttttttaaaggcaagttagttttgtatgacagtaaattaaatgtttggaggatactaatatgagtaatactgacaaataccttagagacatagcaagagaattaaaaggtatacgtaaagagttacaaaagcgaaacgaaacagttattattgatgcaaacttagacagtttaaggtcggcagtattagccgataaagaaaaatcgaaatataatgaacctctcttttaatagctagcacttaattgtgttggctattttttatgtccaaaacgtgctgatgacataaaaagcacgcatggaaaaacagtcgacagactataaatggaggtatatctcatggaagaaaataaacttaagtttaatttgcaattttttgcagaccaatcagatgatccggacgaaccaggcggagatggtaaaaaaggaaatcctgataagaaagaaaatgacgaaggtactgaaataactttcacgccagagcaacaaaagaaagttgatgaaatacttgaacgtcgtgtagcccacgaaaagaaaaaagctgatgagtatgcaaaagaaaaagcagcagaagctgctaaagaagctgctaaattagcgaaaatgaacaaggatcaaaaagatgaatatgaacgcgaacaaatggaaaaagaactggaacaattacgttcagaaaaacaattaaacgaaatgcgttcagaagcacgaaaaatgttgagtgaagcggaagttgattcatcagatgrggttgtcaatttagttgtaacagatactgctgaacaaactaaattgaatgttgaagctttttctaatgcagtaaaaaaagcggttaatgaagcggttaaggttaacgctagacaatcgccattgactggtggagattcatttaatcactcgactaaaaataaaccgcaaaacttagctgaaatagctagacaaaaaagaattattaaaaattaacggaggcatttaaatggaacaaacacaaaaattaaaattaaatttgcaacattttgcaagtaacaatgttaaaccacaagtatttaaccctgacaatgtaatgatgcatgaaaagaaagatggcacgttgttaaacgactttacaacacctatcttacaagaggttatggaaaactctaaaatcatgcaattaggtaagtacgaaccaatggaaggtactgagaagaagtttactttttgggctgataaaccaggtgcttactgggtaggtgaaggtcaaaaaatcgaaacgtctaaggctacttgggttaatgctacaatgagagcgtttaaattaggggttatcttaccagtaacaaaagaattcttgaattacacttattcacaattctttgaagaaatgaaacctatgattgctgaagctttctataaaaagtttgacgaggcaggtattttgaatcaaggtaacaatccgttcggtaaatcaattgcacaatcaattgaaaaaactaataaggttattaaaggtgacttcacacaagataacattattgatttagaggcattgcttgaagatgacgaattagaagcaaatgcatttatctcaaaaacacaaaacagaagcttgttacgtaaaattgtagatcctgaaacgaaagaacgtatttatgaccgtaacagtgattcgttagacggtctacctgtggttaaccttaaatcaagcaacttaaaacgtggtgaattaatcactggtgacttcgacaaattgatttatggtatccctcaattaatcgaatacaaaatcgatgaaactgcacaattatctacagttaaaaacgaagatggcacacctgtaaacttgtttgaacaagacatggtggcattacgtgcaactatgcatgtagcattgcatattgctgatgataaagcgtttgctaagttagttcctgctgacaaaagaacagattcagttccaggagaagtttaataaataattaggagtggtaacatgcccgaaatcattggaattgttaaagtagattttacagatttagaagataacagacatgtctatatgaaagggcatgtctaccctcgtaaaggttataatcctacagatgaacgtatcaaagctttagctagtgttgaaaataaacgcaacaaacaaatgatttacattgtaaatgacaaattaaccaaaaaagaacttgtcgaaatagcaagtgttgctggcttacaagttgatgaaaaacaaacaaaagctgaaattatcaatgcttttgagtcactagagtaggtggttatatgactacgctagctgatgtaaaaaaacgtattggtcttaaagatgaaaagcaagatgaacaattagaagaaatcataaaaagttgtgaaagccagttgttatcaatgttacctattgaagttgaacaaataccggaaaggtttagttacatgattaaagaagttgcagttaaacgctacaacaggattggtgctgaagtatgacatcagaagcggttgacggacgtagcaatgcgtatgaattgaacgatttcaaggagtatgaagctattattgataattactttaatgctagaacgagaactaaaaaaggaagggctgtgttcttttgagatatgaagatagagttatttttcaattagaacaagtagcaacttacaatcctaaaactagcaaaaaagaaaacacactaatcacttatgatgcgataccatgcaatattaaccccatttctagagcaagaaagcaacttgaatttggtgatgtaaaaaacgatgtaagtgttctgaggataaaagaatcaatatcttaccctgttagccacgtgttggttaatggcattcgctacaagatagttgatacaaggatatacagacacgaaacgtcatattatatcgaagaggtcaattgatgaatatagatggattagacgcactgttaaaccaatttcacgatatgaaaaccaacattgatgatgatgtagatgatattttacaggaaaacgccaaagaatatgtagtacgagctaaattgaaagctagagaagtaatgaata

SEQ ID NO: 213 - DNA, 1999 bp; double-stranded, linear
gcttacaagtatattcataattacatattcaaggtccttgcatgtggtattttgctatggyctttaactacaacggggtctaagactgcgtttatcatattaatcgtcttagccatttattyctttatkaaaaagttatttagtagaaatgcggtaagtgttgtgagtatgtcagtgattatgctgatattactttgttttaccttttataatatcaactactatttattccaattaagcgaccttgatgccttaccgtcattagatcgaatggcgtctatttttgaagagggctttgcatcattaaatgatagtgggtctgagcgaagtgttgtatggataaatgccatttcagtaattaaatatacactaggttttggtgtcggattagtggattatgtacatattggctcgcaaattaatggtattttacttgttgcccataatacatatttgcagatctttgcggaatggggcattttattcggtgcattatttatcatatttatgctttatttactgtttgaattatttagatttaacatttctgggaaaaatgtaacagcaattgttgtaatgttgacgatgctgatttactttttaacagtatcatttaataactcaagatatgtcgcttttattttaggaattatcgtctttattgttcaatatgaaaagatggaaagggatcgtaatgaagagtgattcactaaaagaaaatattatttatcaagggctataccaattgattagaacgatgacaccactgattacaatacccattatttcacgtgcatttggtcccagtggtgtgggtattgtttcattttctttcaatatcgtgcaatactttttgatgattgcaagtgttggcgttcagttatattttaatagagttatcgcgaagtccgttaacgacaaacggcaattgtcacagcagttttgggatatctttgtcagtaaattatttttagcgttaacagtttttgcgatgtatatggtcgtaattactatatttattgatgattactatcttattttcctactacaaggaatctatattataggtgcagcactcgatatttcatggttttatgctggaactgaaaagtttaaaattcctagcctcagtaatattgttgcgtctggtattgtattaagtgtagttgttatttttgtcaaagatcaatcagatttatcattgtatgtatttactattgctattgtgacggtattaaaccaattacctttgtttatctatttaaaacgatacattagctttgtttcggttaattggatacacgtctggcaattgtttcgttcgtcatttagcatacttattaccaaatggacagctcaacttatatactagtatttcttgcgttgttcttggtttagtaggtacataccaacaagttggtatcttttctaacgcatttaatattttaacggtcgcaatcataatgattaatacatttgatcttgtaatgattccgcgtattaccaaaatgtctatccagcaatcacatagtttaactaaaacgttagctaataatatgaatattcaattgatattaacaatacctatggtctttggtttaattgcaattatgccatcattttatttatggttctttggtgaggaattcgcatcaactgtcccattgatgaccattttagcgatacttgtattaatcattcctttaaatatgttgataagcaggcaatatttattaatagtgaataaaataagattatataatgcgtcaattactattggtgcagtgataaacctagtattatgtaytattttgatatatttttatggaatttacggtgctgctattgcgcgtttaattacagagtttttcttgctcatttggcgatttattgatattactaaaatcaatgtgaagttgaatattgtaagtacgattcaatgtgtcattgctgctgttatgatgtttattgtgcttggtgtggtcaatcattatttgcc

SEQ ID NO: 214 - DNA, 7769 bp; double-stranded, linear
tcattattaagactattatatataatgaattttaactggtttattaaacgagaacgtcgggaattaagtaactacaataaaaataagatatgacaataaggagactacacgcgtgatcattgccataattatattgatatttatttcgtttttcttttcaggaagcgagacggcattaacggctgccaataaaacaaaatttaaaactgaagctgacaaaggtgataaaaaagcaaaaggcattgtaaagttacttgaaaaaccaagtgagtttattacaacgattctaattgggaataatgtcgcgaatattttattaccaacacttgttacaattatggctttacgttgggggattagcgttggtattgcatcagctgttttaacagttgttatcattttgatctccgaagtgattcccaagtctgtcgctgcaacatttccagataaaataacaaggcttgtatatccaattattaatatttgtgtcattgtgttccgtcctatcacattacttttaaataagttgacggacagtattaatcgaagtttatctaagggccaacctcaagaacatcaattttcaaaagaagaatttaaaacaatgttagcaattgctggacatgaaggtgctttaaatgaaattgagacgagtaggttggaaggtgtcattaattttgaaaatttaaaagtaaaagatgtagatacaacacctagaattaatgtgacggcatttgcttcaaatgcgacatacgaagaagtttatgaaacggttatgaataagccatacactagatatccagtgtacgagggagatattgataacattattggggtgtttcattctaaatatctgttggcttggagtaataaaaaagaaaatcaaattacaaactattcagctaagccattatttgtgaatgaacacaataaagctgaatgggtattacgtaagatgactatttctagaaaacatttagcaattgtgttggacgaatttggtggtactgaagcgatagtgtcacatgaagacttaattgaagaattattaggtatggaaattgaagatgagatggataaaaaggaaaaagaaaaactttctcaacagcaaattcaatttcaacaacggaaaaatcgcaacgtatctatataaggagcgaacagctatgtggaataagaatcgacttactcaaatgttaagtattgaatatccaattatacaagcaggtatggcaggaagtacgacaccgaaattagttgcatcagtaagtaacagtggtgggttaggcacaataggcgcaggttactttaatacgcagcaattggaagatgaaatagattatgtacgccaattaacgtcaaattcttttggcgtaaatgtctttgtaccaagtcaacaatcatataccagtagtcaaattgaaaatatgaatgcatggttaaaaccttatcgacgcgcattacatttagaagagccggttgtaaaaattaccgaagaacaacaatttaagtgtcatattgatacgataattaaaaagcaagtgcctgtatgttgttttacttttggaattccaagcgaacagattataagcaggttgaaagcagcgaatgtcaaacttataggtacagcaacaagtgttgatgaagctattgcgaatgaaaaagcgggtatggatgctatcgttgctcaaggtagtgaagcaggtggacatcgtggttcatttttaaaacctaaaaatcaattacctatggttggaacaatatctttagtgccacaaattgtagatgtcgtttcaattccggtcattgccgctggtggaattatggatggtagaggagttttggcaagtattgtcttaggtgcagaaggggtacaaatgggcaccgcatttttaacatcacaagacagtaatgcatcagaactactgcgagatgcaattataaatagtaaagaaacagatacagtcattacaaaagcgtttagtggaaagcttgcacgcggtatcaacaataggtttatcgaagaaatgtcccaatacgaaggcgatatcccagattatccaatacaaaatgagctaacaagtagcataagaaaagccgcagcaaacatcggcgacaaagagttaatacatatgtggagtggacaaagcccgcgactagcaacaacgcatcccgccaacaccatcatgtccaatataatcaatcaaattaatcaaatcatgcaatataaataatcgaccgcaatccacaaaagcacaagcacccccaaacattattttagtgcttgccatttttgtggattgcgtttctattttaccaatttaatcaaacgaaaacatcaagctgaagatcgccgaaagattttaatcaagcaaaaacatcaaactaaagttcgctgaaatgattatgataaaagttatatggtatgatgacattggtgatatatatgataaacatcggattaacaggttggggtgatcactattcattatatgaagatttagaacgccaaaccgataaacttaaaacatatgctggacattttccggttgtcgaattagatgcgacatactatgcgatacaaccggaaagaaatatattgaaatggataaaagaaacgcctgatacatttgaatttgtggtcaaaattcatcaagcactcacattgcatgcagactacaaaacatttgcagatacaaggcaagaactatttgatcaatttaagaatatgttagagcccttacatacacagaaaaaattagcaatggtattggttcaatttccgccatggtttgactgcaatgcacaaaatatcaaatatattttgtatgtaagacagcaattacaagcatttccaatgtgtgtagaatttaggcatcaatcatggtttagtgatgcatttaaagaacaaacattggcatttttaacagaacatcaaatcattcatgcagtagttgatgaaccacaagtgaaagatggcagtgtacctttagtcaatcgaatcacaaatgaaattgcgtttgtacgttatcatggacgtaatcattacggttggactaagaaagatatgtcagatcaagaatggcgcgatgtacgctatttatatgattataatgagcaagaattaatagacttggcacaaaaggcacaaatattagcacaaaaagctaagaaagtttacgtcatatttaacaataattctggtggtcatgcagcaaataatgccaaaacatatcagcgattattgaatatagaatatgaagggttagcaccacaacaattaaaattattttaagaggcgacgactatgttattaacaattacattattagttttaatcggaggtttgtcagcgattatagggtctatcgtaggcattggaggcggtattattatcgttccaacaatggtttacctcggtgttgaacatggattactacataatattacaacacaagtagcgatagggacgtcttcagtcattctaattgtgacaggactttcttcatcacttggatatttaaaaacaaaacaagttgatattaaaaatggttccatctttttatttggactattaccaggttcattgcttgggtccttcattagtagatatttaacatttgagtcatttaatttatattttggtatctttttaattttcgtagccattttattaatggtaagaaataagattaaaccgtttaaaattttcgataaacccaagtatgaaaagacttatgtagacgctaaaggtaaaacatatcattatagtgttccaccattgtttgcttttattacaacgtttttaattggtatattgacaggtttatttggtattggaggtggcgcactaatgacgccactaatgcttattgtatttagatttccacctcatgtagctgttggaacaagtatgatgatgattttcttttcaagtgtcatgagttctatagggcacattgctcaaggtcacgtagcttggggttatgcaatcatnttaattatttctagttattttggtgcgaaaatcggtgtcaaagtgaatcaatcaattaagtcagatacggtagtaacattattgagaacagtaatgttgttaatgggtatatatttaattattcgtgcgttgatttaatacaactttaaaaggaggacgtcaatttgaggcttacaatttatcatacgaacgatattcatagtcatttacatgaatacgaacgcattaaagcatatatggcagaacatcggccacgacttaatcatccttctttatatgttgatctaggtgatcatgtagatttatccgcacctataactgaagcaactttaggtaaaaagaatgtggcattactaaatgaagcaaaatgtgatgttgcaacaatcggtaataatgaagggatgaccatttcatacgaagctttaaatcacctttacgacgaagcaaaatttatagtgacatgtagcaatgttatagatgaatcaggtcatttaccaaataatatcgtttcttcttatattaaggacatagacggtgtgaaaatactattcgttgcagcgacagcaccttttaccccattttatcgtgcactaaattggattgttaccgatccacttgaatctataaaagaagaaattgaacttcaacgaggtaaatttgatgtattaatcgtgctaagtcattgtggcattttcttcgatgaaacattatgccaagaattgcctgaaattgatgtcatttttggtagtcatacgcatcattattttgaacatggtgaaatcaataatggtgtactgatggcggcagctggaaagtatggtaattatcttggagaggttaatttaacttttgaggcacataaagtagtacataaaactgcaaagattattcctttagaaacattacctgaagttgaaacttcatttgaagaagaaggaaaaacgttaatgtccaattcagtaattcaacatccagtagtgcttaagcgtagtatgaatcacataactgaagctgcatacttattagctcaaagtgtttgtgagtatacacatgcacaatgtgccatcatcaatgctggcttactcgttaaagatattgtaaaagatgaagtgacagaatatgacattcatcaaatgttaccgcatccgattaatatggtaagggttagactttttggtgtgaaattaaaagagattatagctaaaagtaataaacaagaatatatgtatgaacatgcacaaggtttgggtttcagagggaatatatttggaggatatattctttataatttagggtacattcattctacagggcgttactatctgaatggagaagaaatcgaagacgacaaagaatatgtactaggtacgatagatatgtatacgttcggtcgttatttcccaacattgaaagaattaccaaaagagtatttaatgccagagtttttaagagatatatttaaagaaaaattattggaatattaaaaagtaagattattggattttcatttgtcatgaatttcgatataatgtttaaagatacacttaacaggagggtatgtgttgttatggcgacaaaaaacgaggaaatattacgtaaaccggattggttgaaaataaaattaaataccaacgaaaactatacaggacttaagaagatgatgagggaaaaaaatcttaatactgtatgtgaagaagctaaatgtcctaatatacatgaatgttggggtgcacgtcgtacagcgacatttatgattttaggtgccgtatgtacaagagcttgtcgtttttgtgcggttaagacaggtttacctaatgaacttgatttaaatgagcctgaacgtgtagctgaatcagttgaattaatgaatttgaaacacgttgttatcactgctgttgcgcgtgatgatttaagagatgctggttcaaatgtttatgctgagacagtacgtaaagttagagaaagaaatccatttacaacgattgaaattttaccatcagatatgggcggggactatgatgcgttagaaacattaatggcgtcaagacctgacattttaaaccataatattgaaactgttcgtcgcttaacaccgagagttcgtgcgcgtgcgacttacgacagaacattagagtttttacgtcgttcaaaagaattacaaccggatatcccaactaaatcaagtattatggttggattaggtgaaactatagaagaaatttatgaaacgatggatgatttacgtgcgaatgatgtagatattttaacgattggtcaatatttacaaccttcacgtaaacatttaaaggttcaaaaatattacacgcctttagagtttggtaaattaagaaaagtggcaatggataaagggtttaaacattgccaagctggacctttagtacgtagttcttatcatgcggatgagcaagtaaatgaagctgctaaagaaaagcaacgccaaggtgaggcacagttaaatagttaatatttaaccattaataaggcataaaggcttagtttgtacaaaacgaacgtgtcatagaagtaatcattatttttatgaaacactaaaagtataaactgagcctttcattgtcatagataggtgaagaatttgataaaagtagatcaacattactttgaattaatagaaaattatcgcgaatgttttaatgaagaacaatttattgctaggtattcagatattttagataaatatgattacatagttggtgactatggttacgatcaattacgattaaaaggtttttacaaagattctaataaaaaagcagagatgagtaaacgtttttcaaatattcaagattacatatttgaatattgtaactttggttgtccttactttgtattaagacatttgtctaaacaagaggttaaaaagttaatcgaagaagttcatccgtctgatgtgatagatgacgacaataaacttcaagatgtgaagattaagccaaccattcaagatactgaacattaataaaacccttagctagattgaaaatgggaatcatgcaattcaagcatggacctgtaatctagttaggggtttttatctttaatgaatgacttcatttaaatactcagtaatttcatcgccttcttcagcatttacacctaaaatatgagcgatatagccttcttcttttaaatcatcagtaccgataataccgaatttatttgtttgcatattaagtacgagtgtcttaccataatgtctatttgtatggactaacatcaaatcatatcgactatgctcgccaacaaaaccaacaaactgaacttgactctcttcgttgtcatcatataaatacatatcaatcattttgtagcgactccttttaaaagtagtaaagttagtataacgacaaatgaagtatactgcaaaattatgataatatataagtgagaggtgacaaggaatgtattttgtagacaaagataaactaactcagaaattagcctatttacaagcattaactgatgattatcatgagagcaagcacaatcattatgcatttgaacgcattgctcaaatgttgatagaatcatcggtagatatagggaatatgattatcgatgcatttattttaagggatcctggtaattataaagatgtgattgatatattagaactagaaaatgttattactaaagaaacacagcaggcgattaataaaactgtcggtattcgtaaacaatttacatatgattacacagccttagatgttgagattatcatgccaatgtttga

SEQ ID NO: 215 - DNA, 644 bp; double-stranded, linear
accgccacccattaatgattgcttaaaatcaatagtcgtaccatttaatacgggtgcatcttttttgtctactaatacttttaatccaaagtattctaagacttcatcattttcaccaggcgcttcttctgcacccataccgtatgttaaaccagtgcacccgccaccattcactttaatttttaaatagccatctggcatttcatttgctttaagcatatcttttacttcgtaagcagctgcttctgttaatataactgttggcatgataactcctccttaaaaaatccaagtttcttttatatgtgcatatatattttgtaataattcttccggcgaatcaccttcaacaatatcaccatttactaaagcatacaacccggctgaacatataccacaatgtgtcaggcaaccatactctaacacatcgacatctgggtcattttccagttgattaaaaacataatctccaccttttgccatgttagagagacaaaattctacgatcggattcatacttcaccttcttatttcatttgttacaatattatagcattttaaaactggtattttaacatgatgtgctcaattagcaacaactgatgtttcttatcccagttatgtaatagtgccttagttagtac

SEQ ID NO: 216 - DNA, 1578 bp; double-stranded, linear
gaatgatgaaaggaatagaaaagaaaagataaataatgtaatagatttatccgagaaaattgaaagaacaaaagatatgccaatcaagaatactataactactcaattaggaaataaacttattggcacaaaaaaagctcgttttgatgataagaaagtagtgtcgtttggagcatttgaagatgaataaaataaatgatagagatttaacagaattgagtagctatagggtttatcaagacatcaataaagataatgactttacagttaacgaaaaacgatttaagcaggcagatgtatttgaagatttatatagagagaaactaaaagacacaaataaattaagagagtataattatttacaaaatgaaacttttaaaagcgcataaataggtgatgagatatgcttaaaaaagcaaaatttatcttaatggcaacgatactactatcaggatgttcaactaccaataacgaatccaacaaagaaacaaaatctgtaccagaagaaatggatgcttcaaaatatgtaggacaaggattccaaccacctgcagaaaaagatgcgattgaatttgcaaagaagcataaagataaaattgctaagcgaggcgaacaattttttatggataacttcggtctaaaagttaaagctacaaatgttataggtagtggcgatggtgtagaagtattcgtgcattgtgatgaccacgayatcgtatttaatgcgagtattccatttgataaatcaatwattgasagtgatagctcattaagaagtraggayaaaggygatgatatgagtactttagttggtgcagtactcagtgggtttgaatatcgagcacaaaaagaaaaatatgataaattatataaatttttcaaagataatgaagagaaatatcaatatacaggatttacaaaagaagcaattaataagacgcaaaatagtggttatgaaaatgaatatttttatatttcggccataccttataatttagctgagtatagagactattttgaaccattgttaaacaaaagtgacagtgaattttcaaaagaattgtcaaatgttaagaagcaattaaaagataagtctaaagtttcggtaactactactctatttagtaaaaaaaagaactatactaaaaaaagtaacagtgaaaatgtaataaaaatggcagaagaaataaaaaaagataaagagataccaaacggtatagagcttagtataaaattttcggacaataaaataaatacggttaaaccaaattttaacggtgaaagcacttcagaatatggtgtgtttgatcaagaataaaattaatgatgaaaatttaacggagaatagtgtatattgagtagatcmagaataaaaagataattctactattgttgtgaaggcaaataagtagaagattttaagtgtaatttctggtgatttaaataataatatanatggnagtactgatataanactttttaacctactagattcttataatttgctttccattttatgacgatttttactccaattgagtgatagaatccaaaaaagccatctccaaaaattaatcc

SEQ ID NO: 217 - DNA, 5137 bp; double-stranded, linear
tgttttccttgggttaaaacatgcttgctatgcgtttgtaaatatgacttgctgttttnacctgnatacccgtcacaccatggaagtaaaaatgtttcttgctcttggcttacaattttagctttaatcgcttcatatgctttatattggtcttctgttaattgctgttttgattcttgttcgaaaacacgatctttaaatgggtctctttcaacaaccgcgtcatatttttcaacataaccttttttgataagtccatctaaactggattttgaaaagcccatatcctcaatatcagttaaaaatattgttttatgttgttcttcagacaagtaagcatacaaatcgtattgtttaataactttctccaacttagctaatacttcatcaggatgatacccttcaatgacacgaacagcacgcttggtttttttagttatattttgtgtgagaatcgttttttcttcaacgatatcatcttttaacaacttcataagcaattgaatatcattatttttttgcgcatctttataataatagtaaccatgcttatcaaatttttgtaataaagctgaaggtagctctatgtcatctttcatcttaaatgcttttttatacttcgctttaatagcactcggaagcatcacttctagcatagaaatacgtttaatgacatgagttgaacccatccactcacttaaagctattaattctgatgttaattctggttgtatatctttcacttctatgattttttttaacttcgaaacgtcaagttgtgcatcaggttctgctgttacttccattacataaccttgaatcgttcttggtccaaaaggtacaattacacgcacaccaggttggatgacagattcgagttgttcgggaattatataatcaaatttatagtcaacgctcttcgacgcgacatcgactatgactttcgctatcattattgccacctagtttctagttcatctaaaatttgtgcagctaatactactttttttcctttcttgatatttactttttcattatttttaaaatgcattgtcaattcattatcatcagaactaaatccgatagacatatccccaacattatttgaaataatcacatctgcatttttcttgcgtaatttttgttgtgcataattttcaatatcttcagtctctgctgcaaagcctattaaatactgtgatgttttatgttcacctaaatatttaagaatgtctttagtacgtttaaaagatactgacaaatcaccatcctgctttttcatcttatgttctaatacatcaaccggtgtatagtcagatacggctgctgcttttacaacaatatcttgttcgtcaaatcggcttgtcacttgttcaaacatttcttcagcactttgaacatgaataacttcaatatcttttggatcctctagtgttgtaggaccagcaactaacgtcacgatagctcctcgatttcgcaatgcttcagctattgcatagcccatttttccagaagaacgattggatacaaatctgactggatcgataacttcaatagttggtcctgctgtaaccaatgcgcgtttatcttgaaatgaactattagctaaacgattactattttgaaaatgagcatcaattacagaaacgatttgaagcggttcttccatacgtcctttagcaacataaccacatgctagaaatccgcttcctggttcgataaaatgatacccatcttcttttaaaatattaatattttgctgcgtacgtttattttcatacatatgcacattcatagcaggcgcaataaatttcggtgtctctgttgctagcaacgttgatgtcaccaaatcatcagcaatacctacactcaattttgcaattgtatttgccgttgcaggtgcaacaatgattgcatctgcccaatcacctaatgcaatatgctgtatttctgaaggattttcttctataaaagtatctgtataaacagcatttcgacttattgcttgaaatgctaatggtgtcacaaatttttgtgcgtgattcgttaacataacgcgaacttcatacccagattgtgttaacttacttgtcaaatcaattgctttatatgccgcaatgccacctgtaacggctaataatattttcttcatattcaatctcccttaaatatcactatgacatttacgctttacatcatcatatgcgcacaaatgctcattacttttttatagatacaaatttagtattattataacatcaatcattggataaactaaaaaaacacacctacataggtgcgtttgatttggatatgccttgacgtatttgatgtacgtctagcttcacatatttttaatggtcgaaactattctttaccataataatcacttgaaataacagggcgaattttaccgtcagcaatttcttctaacgctctaccaactggtttaaatgaatgatattcacttaataattcagtttcaggttgttcatcaatttcacgcgctcttttcgctgcagttgttgcaattaaatactttgatttaatttgtgacgttaattggtttaaaggtggatttaacattattttttagcctccaaaatcatttttctatacttagcttctacgcgctctctttttargtgctcagcttctacaatacattgaattctattcytcgcaagttctacttcatcattaactacaacgtaaycgtataaattcatcatttcracttctktacgcgcytcgttaatacgactttgtattttctcatcagattctgttcctctacctactaatcgctctctcaagtgttctaaacttggaggtgctaagaaaataaatagcgcatctggaaatttctttctaacttgctttgcaccttctacttcaatttctaaaaatacatcatgaccttcgtccattgtatctttaacatattgaactggtgtaccataatagttgcctacatattcagcatattctataaattggtcatctttgattaaagcttcaaacgcatccctagttttaaaaaagtaatctacgccatcaacttcaccttcacgcatttgacgtgttgtcattgaaatagaatacttatatgatgtacttggatcttcaaatatncgtnttctaacagtacctttacctactccagatggtcctgataaaacgattaacaatcctttttcattatccatgccttacgacctctctaagctaatcttctattatttaaatatgatatcacattgttctttatattgtatagcatatttgaaattgcatgccataatttctattaagtctaacaatatcgttatattgcacgattaattttaattaaataaattgaattgcaaacttttagataatgtaaaatgtatggcataatgtatggttcaataactatactgaaaagttacaatcatgttaaaatgaaacgaatgatatgaagaaggtggaagataaattatggcttatgatggcttatttacaaagaaaatggttgagtctctacaatttttaacaacaggacgtgttcacaaaatcaatcaacctgataatgacacgatactaatggttgtacgtcaaaatagacaaaaccatcaattgttattgtcaatccatccaaacttttcaagattacaattgactactaaaaaatatgataatccatttaatccacccatgtttgcgcgtgtttttagaaaacacttagaaggtggtattatcgaatcgattaagcaaattggtaatgatcgtcgcattgaaatcgatataaagagtaaagatgaaattggcgatactatttaccgcactgtcatccttgagattatgggtaaacatagtaacttaattttagtagatgaaaatcgcaaaataattgaaggatttaaacacttaacaccaaatacgaatcactatcgtacagtaatgccaggatttaattatgaagcaccacctactcagcacaaaataaatccgtatgatattacaggtgcagaggtgttgaaatatatcgattttaacgcaggtaatattgctaaacaattattgaatcagtttgaaggatttagccctttaattacgaatgaaatcgttagtcgtcgtcaatttatgacttcatcaacattaccagaagcatttgacgaagtaatggcagaaaccaagttaccacctactcctatttttcataaaaatcatgaaacaggtaaagaggatttctattttataaagttaaatcaatttaatgatgatacagttacatacgattcattaaatgatttgcttgatcgtttttatgatgcgcgtggcgaacgtgaacgcgttaaacaacgtgcgaatgatttagttcgatttgttcaacagcagttgcacaaatatcaaaataaattagcgagttgattgaagaatatgagcagtctaaaaataaagatactgaacagttatatggtgaattgatcactgctaatatatatcgaattaagcaaggcgataaagaagtgacggcattgaattattatacgaatgaagaagttgtcattcctttaaatcctacaaaatccccatcagcaaatgctcaatattattataaacaatataaycgtatgaaaacgagagamcgtgaattacaacatcaaattcaattgacgaaagacaatatagattatttttcaacaatcgaacaacaattacatcatatttctgtccatgacattgatgaaattagagatgaattagcagaacaaggctttatgaaacagcgtaaaaatcaaactaagaaaaagaaagcgcagattcaattacaacattatgtatcaactgatggcgacgatatatatgttggtaagaataacaagcaaaatgattatttaacaaataaaaaagctaaaaaaactcacacatggttacacacaaaagatattcctggttcacatgtcgttatatttaatgatgcaccaagtgatacgacaatcaaggaagcggctatgttagcaggatacttttcaaaagctggtaattctggacaaatacctgttgattatacattaattaaaaatgtgcataaaccatcaggtgcaaagcctgggtttgtaacatatgacaatcaaaaaactttgtatgc

SEQ ID NO: 218 - DNA, 2267 bp; double-stranded, linear
gttttatcgcagcagtaaagctatcaatcggcggttcaattgatgatgcattagcagaaatcanacaatcattttagttaaaatttactaataatgaaaaatgtaaacctttttcaaatgaaactttataaaaaatatgatagtatatatgtaaatgtttaataaaatctggagaaataggaggacattgccatgcaacaccttataaaaaaacatgtattgaatggcgagtttgatttagtacgacaattgatgtccgaaacagattttatggaatttgaagaagcatatatttcaagtgcgcatgaagtagaaagtatgatgttttatacatgtattttagatatgattaagtacgaagaatcatctgaaatgcatgacttagcatttttattgcttgtgtatccactaagtgaatatgaaggtgctttggattctgcttattatcatgcagacgcttccataaaacttactgacggcaaagaagttaaaagtttgttacaaatgttattattgcatgcgataccaacacctgttatttcagataagaaggcttttgatatcgccaagcaaattttaaaattagatcctaataataatgttgctcgtaacgtcttaaaagacactgccaaacgtatgcgacaacgttgttgttgatataaatgaattacaccaacgtaatgcacgttaattacatttcaattatattagcttaataatagttttaacatttggttgggttgggcatatgttccagccttttttaatacttaaaaactaacgaagtatacttgtgtgcacaaatggtttttatacaacattttataaatttatacattttaataaagaacatacgatagatggtttaaaccttgttaactgagaaattttgatatgtattcttcgaaatttaactaaatatacgaaattcaagaagcacaataattaatcatttttcctatacaaaagttcgtatgactgcattataaaagcataaatttataatttttttaaatgtcattgaacgtgataatgtgaatggattgagcaattttgaaaaagtgaaaaataacctatgcgacttgcaattaattttcagtacgttataatgcacactgtgcaaaattaaggaggtctattattcacatgatgatgaataaagaagcaacaaaaattggatttgcctacgtcggcattgtagtgggcgcaggattttcaactggacaagaagttatgcaatttttcactaaatatggcttgtgggcttatttaggtgttattatatctggttttattttagcttttattgggcgccaagtagcaaaaattggtactgcctttgaagcgacaaatcatgaatcaacattacaatacgtattcggtgaaaagtttagtaaagtctttgattatattttaatcttcttcttatttggtatagctgtaaccatgctagctggtgcaggcgcaacatttgaagaaagttataacatacctacatggctaggtgctttaattatgacattagcgatttatattacgttgckattagactttaataaaatagtacgtgcactaggtatcgttacaccatttttaattgttttagttgtattaatcgctggcgtttatttatttaaaggtcatgtttcattagcagaagttaaccaagtagtgcctgaagcaagtatttggaagggaatctggtttggtacaatatatggtggattagctttttctgtaggttttagtaccatcgtagcaatcngtggggatactgaaaagcgtacagtgtcaggtgcaggcgcgatgtatggtggtattatctatactgtattactagcattgatcaactttgcattgcaagtgaatatccaactattaaaaatgcctcaattcctacattgacgttagcaaataatatccatcctttaatagcaacagtgktatctgttattatgctggcggktatgtataatactattctaggactaatgtattcatttgcagcacgttttacagaaccatacagtaaaaattatcatatctttattattataatgatggtagcaggttatttattaagttncgtaggatttgctgaattaattaataagttatatacnatttatgggatatgtaggcttattntattgtagtagctgtaattatnaaatatttccaaacgtaaaaatggcggataaaaaacatattgctttaatatcatatggaggggatatccgaaactttacaatttgaatcactttggt

SEQ ID NO: 219 - DNA, 6336 bp; double-stranded, linear
gtcaatgtaacctaatagtttatgtctatcttgtgtaccaactactacatcgacaccaggaatttccataatttcagctgatgaagtttgcgcataacaacctgttacacagattacagcatcaggattttgtcttattgcacgtctaattatttgacgactttttttatcacccgtattcgttactgtacaagtattaataacaaatacatcagcattcgcttcaaagtcaacgcgctcatagtttgcttctttaaataattgccagattgcttcagtttcataatggtttactttacaacctaatgtgtgaacgcaactgttgacataaatattcaccccattaattctttttcataacttattgcacttaacgcatacaatggcgcagtttctgcccgtaaaattctcggcccaagaccaacaactgtactagtattactaaataatgaaatttcattttctgacaaaccaccctcaggaccaaaaatcatcaacactttatcctgagcattgaattgttgtaaagtttgcttgaaattgcttaactcaccatcttttgcttcctcttcatatgcaataagaatatagtcataattatcaatagtatcacaaattaattttaaattcgactcgaattgaatagatggaatcactaaacgatagctttgttcagcagcttctttaattattttttgccaacgctctatctttttggcaacttttgcctcgtttaatttaacaattgaacgttccatgctcacagctataaatgatgaagcacccaattcagtagctttttgtagcaaccactcatatttgtcagctttgattagtccactgcaaatcgtaacatcaactggcaattctgtattaatattttgtttttcttttaaatcaacttcaattttatcacttgttatgtcagcaatttcacataaataaactgtttgatcattaaaagttaaaataattttactaccaacatcatatctcattacatttgttatatgatgaatatcttctttttttgtaataaaaaaacgctgacttacatcagcgttttggntctatgaaataacgttgcacattattcactcactttctggccaacaagacaaacccaaccgttgtcatgttgttctgaaataattttaaaacctacacgctccatatgtgactgtataccttcatacttctcttttataataccagaagtaataaaataaccgccttcatttagagtattataagcatcttcaatcatttcatcaataatatgcgctaaaatatttgctattacaatatcaaatttttctgtttcgtctttcaataagttacctggaacagcttcaattaacgtttcacaatgatttcttctgaagttttctttagctacactcactgccatttcatcaatatccaacgctttaatacgttttacaccgattagatgacttgcaatacttaatatacctgagccagtaccaacatcaattactgaatgctgtggcaatacatatgtttctattgccttcaaacacatacttgtagtcggatgatcacctgttccaaaagccatacctgggtcgagctcaatgcaaagctcttcatccgcttctttagcatatgtttcccaactaggaactattgtgaacttcttcgacgctcggaatggatggaaatagtttttccattcattttcccaatccgtctctgcaataatttgctcactgaattgaacgttatgttgatcaagttcatctaaatttaataactcatctttaatttgctgtcgcaacttatcatcataagtcatttcattaaaataggctttcaatcttactcccttatctggataatcctcttttttcaaagcgtaaatttcaccgtatttatcttctggttggttaattaaatcatctgaatcttctatcacgacaccatttgatccatgattttcaagtatattggtagccaattctactgcttcatgattaataataattgaaagctctgtccagttcatactttattctcccttaaagaatctttttgctctatctttaaaattcgaaggttgttcattaatttcttcaccatttaattgggcaaattctttcattagttctttttgtctatctgttaatttagtaggcgttactactttaatatcaacatataaatctccgtatccatagccatgaacattttttatacccttttcttttaagcggaattgcttacctgtttgtgtaccagcagggattgttaacataacttcattatttaatgttggtatttttatttcatcgcctaaagctgcttgtgggaagctaacatttaatttgtaataaatatcatcaccatcacgtttaaatgtttcagatggtttaactctaaatactacgtataaatcaccagcaggtcctccattcacgcctggagagccttcaccagctaatctaatttgttgttcattgtcgacaccttcaggtactttcacttctaatttaactgttttattttcagtaccttttccgtgacatgttggacaagcttcttcaaattcttgaccacttccattacatttaggacaaacttgttcagtacgaactctacctaaaattgtgttttgttctacagctacatgaccagcgccattacagtaactacaagtctttttacttgttccaggctttgcaccatcaccatgacatgtttcgcatgttacatctttacggattgaaatttcttttgttgtaccaaataccgcttcttcaaatgttaatgtcattgtatactgaagatcatcacctttttgcggtgcatttggatctctttgtctgccgccaccgaagaaagagctaaagatatcttcaaaaccgccgccaccgaagccactaaaaccgccaaagtcagagccattgaatccttgtccaccaaaaccttgtggaccatcatgtccaaattgatcatagcttgcgcgtttattatcatcacttaaaacttcataggcttcagaaatttctttaaacttttcatctgcaccttcttctttgttaatatctggatgatattttttcgaaagctttcgatacgcttttttgatttcatcttttgaagcatccttactaatgcctaaaacttcataataatctcttttggccacagctatctctccttttcttaattaactcatatagtttaacgtaatatgtcatactatccaaataaaaagccaaagccaatgttctattgactttgacttttcagatcatgacaacattctaattgtattgtttaattattttttgtcgtcgtcttttacttctttaaattcagcatcttctacagtactatcattgttttgaccagcattagcaccttgtgcttgttgttgctgttgagccgcttgctcatatacttttgctgataattcttgaatcactttttcaagttcttcttttttagatttaatatcttctatatcttgaccttctaaagcagttttaagagcgtcttttttctcttcagcagattttttatcttcttcaccgatattttcgcctaaatcagttaaagttttttcaacttggaatactagactgtcagcttcgtttcttaagtctacttcttcacgacgttttttatctgcttcagcgttaacttcagcatcttttaccatacggtcgatttcttcgtctgataatgaagaacttgattgaattgtaattctttgttctttatttgtacctaagtcttttgcagttacatttacaataccgtttttatcgatatcaaacgttacttcaatttgaggtttaccacgttcagctggtggaatatcagtcaattggaatctaccaagtgttttattatccgcagccattggacgttcaccttgtaatacgtgtacatctactgatggttgattatctactgctgttgaatagatttgagatttagatgtaggaatcgtagtgttacgttcaattaacgtattcatacgtccacctaaaatttcaatacctaaagatagtggtgttacgtctaataatactacgtctttaacgtcacctgtgataacgccaccttggattgcagctcccattgccactacttcgtccgggtttactcctttgttaggctctttaccgatttcttttttgacagcttcttgtactgctggaatacgagttgatccaccaactaagataacttcatcgatatctgagtttgttaagccagcgtctttcattgcttggcgtgtaggttccattgttcttctaattaatgaatctgataattcttcaaatttagaacgagttaagtttacttctaagtgtaatggaccgttttcaccagctgagataaatggtaatgagatttgagtttgtgatacacctgataagtcttttttagctttttcagcagcatctttcaaacgttgtaatgccattttatcttgagataagtctacgccattttcttttttgaattctgcaactaggtagtcaataattacttggtcaaaatcatcaccgccaagtttgttgtcaccggctgttgatagtacttcgaatacaccgtcacctaattctaggatagatacgtcaaatgtaccgccacctaagtcaaaaacaagaactttttcatctttatcagttttgtctaaaccatatgctaatgctgcagctgttggttcattaatgatacgctcaacttctaaaccagcaattttaccagcatctttagttgcttgacgttcagcatcgttaaagtatgcaggtactgtaattacagctttgtcaactttctcacctaaaatagtttcagctgtattttttaagttttgtaaaatcatagctgagatttcttgtggtgtgtatgatttaccttcaatatctactttataatcagtacccatatgacgtttaatagattgaacagtgtttgggtttgtaatagcttgacgttttgctacttcaccaacttgagtttctccatttttgaaagctacaacagatggtgttgtacgtgaaccttcagggttttgaattacttttggctcatcgccttctaatactgtnacacatgaatttgttgtacctaagtctataccaataattttactcataataaaattcctccatttaatcattaaattaatttaattttaaacaatgtcttttcgccaaatttaagttattggtttactttgaccattgatggtcttaatactctatctttaagcttgtatcctttttgtagttcttgagtgatttcgccagattcaaaatcagggttatcatcttgaactacagcttggtgaatatttggatcaaatgcttcaccttcagttttaataacttcaagaccattatcttttagtgcgttaatcaaactttcatgcaccatttgtacacctttttgaagagatttaaaagtctcatcatcaccttcaatttgaagtgcacgttctatattgtctattgctggtaaaatatctgttaacacacgttgtgcttgatatgttttgtttatttcattttctttttgaattctacgcttataattttcaaactcagcgtagagccttaaatatttctcttcgttttcatctgctaattgttgaagttcattaattttttgatcttttggatctatttcttcaataacattctcgtcagacgtttcttctattgcttcatcttgtaaatgacctttactttcttcagcttgttcaactgaatcatcaatattttgtttgacgtttgtttcttcaactgttgattcagtgtttttttcaactgattcgtctttatttgtcattttctgtcctccaatactttctaatccatcattaccaaattctatttaataattgaatgacattttgataatgcatagctgtaggtccaatcacagcgatttgaccttttaacgtttcatcaaaatgatattgacttgttacaattgaaatatcacttaagctgtcatcaatttcattaccaatttttacattaatatttggtgaagatatatcttgtaataattctgcaattctatttgattctatatattgtagaatgggctgaattgaagatacattactttcattcaatgcatcaataagtttaacctttccacccatataaatgctattactttgattagaaatatgattattcatcgtatttaacaatttattgataaaaatttcttcctgctctgattgaacaaaagagacaatatcatcttgtaaattctgattaaactcagttagtttgtttgtaacaaaatttgatattgtatttagtttgtcattattaa

SEQ ID NO: 220 - DNA, 13059 bp; double-stranded, linear
ttcatgattattatctgttgtagacactgctggatcttccgatgtatctttcgatgcatctttcgatttgtgtatttgctgattcaaatggtctaggtcttctaacgccttatttaccattgcttcatcatttttatcatctttttctccatgttttgttgtagccgtttgtgacatatcatttttcattgcattaagatcgtcctcgccactttgttgacccctatcaacatttgaagaaacctcatttaaatctttaagcaattgatctaatttactgtctatatcactttgaccgttcatttcagtgtgagaacttttattgtctttgctatccaactcattagctcgttttatgatttcatctatttgcgatgctgttttcgcttcatttagttgtgctttataatgttctttagatgaagccgataactgttttaattgctcaatttgacgaattgccttgtcaactttgtctaataaatcttgcttagataatatctcttttgtaatttcagtatccttttcagatgcagcttgggcatcgtacggcaagatattcgttaaaatgatacttgtcgccatcattgtcgaacacgataactttacatataattgaaacggtttccctcgatatttagccatcaacatactccttcctcacttacttccttcaaagaattacatactattatatacctgtttacaagaaatttacacttatctatctagttattgttgttagtaattatctacttattacttagcttatatttaagtaaacaaaacaagcatgacgtaatatcatattgtccatgtcgctaacatcatattacgtcaaatcttttatattaaatgatgttttattttagactgctttttccttttagctttcgagcgcctgtttaaaaacttgctcgaattgttcacgcgagatttcgtgtgcatgtgctttttgtgctaataaagcatctcgaaactgttgttgatctttcaaactttctaacatttgtattaattggtctttactttccattgttatctcatcattatgctcaaataagtgctctgataatgttactttagcatggtgtgcggtttgacgataacctaaaatcaacaactcatagtcaaacgcttgttccaccgcatttaaaatttcattaccctcattgatatcaagataaatatcacataactggtatagttcatttaccctgtcaatattaatagatgggtataaatgcacattagcatattgatcaagttgcattagcttatcagacatctctgtaatagcagcgatgtgnaacttaaaatctggtaaagttycaaccaataccttgatgttacgaattgatccgagttagttaatattacaatttctttagtatatctattacgactacgatagttatatagatatccgccttgtaaaatacgagattgaacctttgcgtctgctatattgagcatcgtttcatattcgtttttatctggaataataatattacaatgtcgtttcatatcacctttacacatcaattgcatatttcccgggacattaccattacagtgttcttgccataccaaaacatcactaccttttgatggcaaattatataacactgaaaatggtagggctagtgagttaataacgaaatgatgttccgtaatttcaagttgcttgataaaaaataatgcgaatgcgagctttgaagggaaaaagtaagacttcccttgccaatccaatatgacatcagatgttacaaaattttcataaatcacttctttaccttctgctgtcatatatttcttcaagatcgctttacgatttaaatcgtaaacagtttgtgcaaatttaataccattcttagaataataatcgacaaatcggacacgttgttggtcatcaaaccattcgacacgactaacaattctagggcgctctccactttgayaaaatattttacctcgyagacgtcccatatcattaattgtagccgaattgttgttacctttaatttcccaaaaagctggtacagtaacctgattaaaaaatcgtggtttcatattttctgtattatgattatctgcaaaaaattgatacggtgatataacatcgtccggtaaaaagccattgtcattgagtacaattgttaaatcttcttccaacttactggctttaaaagactcatataactttcgtgaatgatcgttaaagtaatcaaataatttaatcatgtagcacctcttgaactaatgtttcccattttaaaataatatcttgagtcataaattgctgtgccacttcataagagatgtcatgtggtgtctggggaccattgttaaaatacattacaatggcatgagctagttttgcgataacatcatccacactatcttcgtcggtatcaaaaggtaccaagtagccattttccccatctcgaataaaggttgggttaccataattcacatttaatccaatcatacctagtcctgagcctaccgcttccattagtgttaacccaaaaccttcgctagttgatgcagaaagaaataactcataatcattataaatttcatcaagtttaacatgccctagtaaacgaatataatcttgtgcgcggtgtgtatcaataattttacgcagtcgcgtcttctcgctaccttctccataaatatcaaatgttaattctggcacttgtcgtttagccacgataaccgctttgacaagccaatcaatatgtttctcattcgctaaacgagatgcactaatcatcgcatatggctttcttgataatgttggatatgataatgcatcaatgcttcccacaggaatagtataaacacgtgggcgataaccttgatattgctcaaattgtcgacaaaccatatgattttgaatatctgttgctgtaataaagaaatcaatgtatttagcttttgaaaattgatattcataataattgttccatagtatatgctgctcactcatcatattattactataatgatcagcatgaatcacaacaccaactttactatcacctttatgctgcaaaacagcctgaccaatatcagaagcgcggtctaatatgacaatatcgtctcgggttaaattcaatcgttgtaaaaagtatgcaataaattccgttttgttatacaacaccgcatcttcaaacacatatatagagctgtctccatcaatatattcgttataagcgatggaaccatcttgattataaaattgtcgcatatataatttcgctttattatcagctggtgcataatactcagaaaatatgcgcgtataactataaaaatctttacgtactaacatactattaattacaaattctgcacgatccacaatatctttttgttcattttgcagataacatgttacaaatgatgatttcccattaaaatataggcggactatcttaccatttctttctctaaaactaatgtcatgaccaagctcacgttcaatgtcatctaacgtgtacgttgttggtgctaaagaaatatcactaaaatactgatacaaccaaataacttcttgatctttaaacccaatgttttgcgttaatgtctgtatgttctctgactgtataaaatctaaaaacacaaatttagtgtcttgatttgtacgtctcaataatttagcacggtaagcttgtgcatattcaacaccgctactcgcccagcctataccaaagtttatattatatattgtcatgcgctaccccttttcatttatggaaaatgtataactggcataccctctttatcaaatgtaatcatgctttgacaaatatttttcaccattctttttttgatatttcgtgtcataacttcaaatgaatctaaggcaactctatggtattcaaaaatagcgttacgttgcccattttgtcgttgattaacgcttgcttttaattgttgtaaatagtcgacttgttctaaccaacatgaatcaattgctttcaaaaagactttttgaacgaaaatattataataatatgcactttgcatgtttttacgattcaaagctaattgcttttcaaattgctctaataaaaatgtcactactgcttgcttatctttaaaattaacacaagccacatctttattaaattggaaacttaaattttgataaatatactcgacaacacgcgattttgttagcaccttttcctcatttacaaacatttcaaatacatctttagctaacgctttaaaatcttgattctcagcatcatctatttctaaaactcgattgcgttcctcgtatacaagatctcgctgtatactaatgcttttttcaaattcattagccatttcacgagctttaaccccttgttcttccgagatacgctgcgctttaactacaatttgcttaactttgcgattaaacaaattactttgcgataatcgttgtgcatctaatgaatataattgattattttccgctaaattactatcgctccatcgcttaactaaataatcatctagtgaaatatatatacaagatgatcccggatccccttgtctaccagaacgaccacgtaattgcctgtctacacggctattttccatatgttcatgaataataacagctaatccacctaatgcttcgacaccttcaccaagtttaatatctgtgcctcgacctgccatactagtcgcaacagtcatggaaccaatttgccctgcttcagctatcatctgcgcttcttttgcaacattttgcgcaatgagtaaattattaggaatatccatttggaataatactttcgaaaagtattcagccgcttcagcagttctcgttatgagtaaaaccggtcgccccgtttcatgaagttcaactatatcatgaatcatcgcgatgtttttctcatcaactgaacgaaacactttatctggttcatcgatacgttgaatcgctttatcagttggtacttgtacgactatttttgaatacaaatcaaagaactctgattcgcctaattttcctgtagctgtcatacctgaaaatgattcaaaaagtttaaataaattctggaaggtaattgttgccataacacttttatctgttgaaacctccataccttctttcgcttcaatagcttggtgaagtccagcttgcaacttagttcccggtaacatacgacctgtaatacggtcaattaaaacaatatcaccattatatacaaagtaatcgacattagattcaaacaaatattgtgcgcgcagtgctaaattaatattacgcactaggaccatcgcttgttcgctatataaatcttcaacattaaagtatgattgtgccgcttcaataccttgatttaacagccatatttcttttttggtcttcttcattttaaaatgcacgtcttcaatcaatgtatctacaaactctttcacaatatgaaatagatttgattgtaatcttggtgcacccgaaataactaatggtgtttgagcagcatctaaaatgattgaatccacttcatcaataataccgtaatttaattgtggtaaaaatttcccttccgcactatcagccaaattatcaattaaataatcaaaaccgagacgtccattagttgtatatataatatcatgttcatatatattacgtttttcccctttttgatactcataatccacaatatcaacaaaacctaatgaagcagttaaacctaaccattcatataatggttgcatctcttcaaaatnccgntcgctaaataatcattcgttgtaattaaatatgttccttttcccgaaagagcatttaaatataaaggcatcgttgccgttaatgttttaccttcgcctgtttgcatctccgcaatgttaccttcatgcaatacaatcgctccgattaactgaacttctttaggatacatacctaatactctccagctcgcttcacgtgccactgcataagcttcaggtaacaatgtatctagtgtatcaactcctgatgctaaacgttctttaaattctattgtcttttgttttaacgcatcatcagaatatgatttaacttcatcgctccatgtattgatgsgttcactatttttctaatcgactttagtcttaattcgtttatcgtaacatctagtttatgtttcatttacttccccaccattcagtttcgatacatctaagtaatctaaaaatcgtactggattcattaaacgtgacatataatttagatgtttgtcttgctcttctttaaaataaacctcgacatttgtatcttttagttcatgatttcctgggacatgttctgtaagccatccttttaaatcatcatcttcatggcttgtacgatacactttgcaacccaaatgctgagcgacataagttgcaaaaacatttgactttgacccataactaatcaaattaatagcctttagggtatcttgactttgcaaatcattctttagttgcttaatatttccctcgatattgtcgtccatccaacgttcaacgagccaaacatgaccaaacagtttcaaaaaatcattcgaaatagttggataggtgtcagatggttctgcaataatgacattgatcatatcatttccatattggtcatcgcctatcttcgtcacccgcatgcttttatactctaaatcatattgatgcgtcatctctgtgattgttaaacatctaaatataagactcgtcgatgctgcattcatcatttttattttataagcataggcktcatcaggatattgaatcgtaatactatttgactttacaatctcagtacttagttttgtgccatttttattataaaaaatgatgataaaatacactgaaccagcaggcgttgcatcaaaatcaaaatgcaatttataatgctgtcctctacgcaaaattggkaaacttggcgcacttttatattttgaaaattgctttaacatcaaccactcatgaatcggtaatccagagggcatcaaaggatttataaaagtcacttcaccatttgaaaatgatactttagagccatacataaatgtagtttgtgaaatataattccaagtaactttaaatgttttgtttttcagcatgttgaactctcccaaacttgtcttccaaaataatgttgtaaaaattaacaaaccaacttgcaatggtaggtgaatcatcattatgtcgcccaggaatactgcgattcatcactcttgcttggtgtgctgtcaatacaggtaatagctcttgaaatgcatgtggatcataatcatcatgttgcatatatgctatggcaaaaacagtttgtgacaatgattycttttgaaatgtttgccaaaatttttgatttaatgcctgtatcgacgcttgagatgtatcaccttcattagacaccaggacgtctaatgctgtaccgaactcttctggtctaagtaatcgcatatgttcagcaatcgttccaatattaacaagtggtttaccaacaataattgcctgaggatttaactgagcaccataatacaaggcaccaaatgaacccatagataaaccagataatattaattcatgtgatttaaaattcagcttttctaatgtctcgtcaataacattgataataccttgttcatattcagatgaaccgatataaaaactaccaccttcaacacgaggatcgccgataagtaaaaacggtgcattcatacgtttcatcatataatatccttcgaaaccttccgctgttcgataaccactaaaatatacgtttagtggcggtttcatatcaccagggtggaaataataaataaattcctgtcgttgactatctacgaaacgactaccaccaagtaaaaattgacccatgtctaatctagaccatcgtttgtgtataggtcctaaatgtaccgtcccgttcccacgcgccttaacagttacacttatataagcatcaaatggtttcgcaggtatctctaaaggactgtctaacatatcatcagtcaatacgatttgttcaattaatgcaccatcagcgccagtctgaatcaatctaaatgtatattgcaactcgaccgcaccatcaatatcaaattctggccatatttgaatgactttatctttatcgtaaacgagattattttgccaagatgcgataggtttaaattctttcccaaattctccactcaatgtgagctctgaattaccttggtaaacgacatctcctttaaaattcggatgcacaagtgctaacttaggagaaaccttatctccatactgtcctgagaagctaactgcctctaatttattattacgttcttcaatattccggtaatgtaatggttgaacaacgtatttttggacattttcgtcttgttcatattcaactgaccaaaatgattcatcaacatacgtattgtatggttcgcttatcatttgtaataaattcgttaatgtctccgagtatggtgcttgaatatagataaaatcaaagcgcccttctgcttcaacaatcgcttcaatagcctctacataaccactatcaaattcaaacaatccaatatcgaagtaatcccaactcacaccttttttgtgttgaaaaataggttctaaatcgtctcctccaatttgcaaaactctaaatttacgtggcatcattttcaccttctattaactcatcgagctgattaataatattcttagaagcatatgcatctattaattttaaagaataggcgtacgcataattccaatttttcaaataaaataaataataatttaacgcatcatctaattcatcaactgtatttataatacggccattgtcataatcagagacgtaatctgtttgttgaccattaatttgtggaatcccagcgctaattgcactaatttgtaaatacaagtcaggttcttttgacatatctatcacaagtcgcaacgtccgcaatgcttctacaacatcatgttcagcatgtatcgtcttaacagcaatgatgtcatcttgatcttcaggtgtcattaatgctgaaacattaacatccgcattctgtttagcttggtattcctcatttaccgacgtaatacattcacgaagccacatcggtatgtcattttgatggcgcgataataaaattaaacggtaataatcttcctgtgcgatataatccacaagtcgttgcatcatttgttgcaaatcagcgtcactcataccatctatccatacacctataaatgtttccatcaattgactacttatattaggtgattgtctcgtttcaaatggtgtgattcgaatcattgtattctcccgctgatacttctcttgatgactaattaaatcacgttctagttgcacactatcaacaattaaatgggcattctttacgatagattgatattcctcatctgacacagtttcatttctatttttaaaaaatgaataacttaatgatttcgctggaatatgattggctatttgtcgattgtgcctagcatctgaagccacaatcacatgatcatcttcatgtatttgttgtgcaatcattgcttgaaatttttcttcaattagttgagccatattgttatattctgtttgttgatagtgatgttgatatctttttgaaacagtgactctgccatttttcaaatcttcatgaagtacacaatctccattaatcgttaaatattcttggtaagaagcctctccctgatcatcaaaataacgtatcgctgataaataacctctgtcatcaaaaatataacgccgttgtaactgatctctttcaaattcttcaaaccaaattgaatacccttcttgactaaaataaatatttgtataggtctgttcactcgtcacacattttaataaatacggtgtgtacacaaactcaacatcatccggccattttaagtgatgataattaatcgcttgtggcgcatggtgactgaatccttgaatttcatcaaacacagacgaatactttgtctcatataagtcatatcgatgtaaaaatgttcttaaatttggtgcatgattgagaacaatcagttgataatctaagtcattttcaaggtgcattcccattaaactaatcatatcgtcaaattccgtcttattttgtagttgataatacggcacagtcgtgtcttgccaccatcgttggtcatcgtaccaagctggaataaagtatttcataattacctccttaccaatactggtttaaaaatggcttatatttatcaaaatataaatatgtacgaattgtttctgcaatattaatactgatgtaaactaatacaatcagttgtactgagaaataaatttcagtagataaatgcggtacaaacaatgtgaaataaagcggtataccaataatgactgtaactaatgccaatccaaaccaacatacgcgtcgtgcttgataatttaaataacgttctgtatccttaccaggtttaactcctgaaaaataattgccactctttaagaaatctttggatttttgtttagtattgattaaaaatctcgataaaaaataacccaataacatttgaatcactaaatatactgaaatacctactggactatcaaatgtcagcattggcatgtcatctgatatgcttttattaaacatagataaaataaaatgaatgccactttttaagaaaacaaaagctgaaatactcatcattaaagtaatactgcctgcagggttaactttccaagataaataagatttcatatttgttgcggaaacgttcattaaatcgatatatggtattctcacttctactaattcaataaataataagataaacaatgtgattatcacaaggatgattaacaacgcaatcacaatatgacttgcatctatatattccattttttgatgcatcattgatttaataatactaaccattacaatcggcattggtcctgcgatgccgtagcgactatttttgtcagctaaccaaactaataacatcgttccagtaaccaaaatcaatattgttaagtaaatattgtcttgatgaacacgttctttcgaaacatattcatgaatcacaaaataactttgaataacacttaaaattaatgttaagatgcgctctttataatgcttctcaagacttgtttgtttcatgtatttatccatattccgataagaaatcagcatcaagataatcattgatgttaaccacggacctaatcctaaagtgaaaatgtttaaagtattaacgtctccacccatattagaaatagctattttaaaaaatgactcatgttttacttgcatatcgttataggaaacgatggaaatgtttgtgcctaatatataaataaacaagataaaacatgtgtatagcatacgtttatatataattttatattcgtattgttgtaaaagttttaacatgttgcacctcttttatatcaaaaacattaaaaagactaagggttcatcactaattattaaaatcctatatcgatttttctagtgattggtgcctcagtctttttaattttagccagctataaattcaatttatgcttgagaatcatcttgatcattttcatctttctttttctttctcttcattaaacctaaaccaactaataatgtcataacgccacctagtaatccattttgttttattgagtcacctgtatctggcaatcttttttcactttgtgctggtgtgccattatgtttagtcacttcagatgttgcacttaatgtagactgagattcactcgtgctcgttgttgcttcacttgataagcgagatgtgctcgtgctgtgagtatgatgcatactcattgagtctgacggatgcattgagttagattcagatgtacttgttgagccggacatacttgttgatgttgagtcagaaatgctttgtgaaccagacatagatgtactcagtgattcggatgtgcttgtcgaatcggatgtgctcaatgacgttgatgtgcttgttgacactgattctgagtcactaattgatgttgagtcggatttgtcttgtgacattgaaacactcgatgaattagattcactcattgatgttgagtcagatacgctcgttgaacctgaaccagacgtacttaatgattcagatatgcttgttgaagttgaaccacttgttgagtccgatgtacttgtcgatgtcgagtctgaatctgatgtactcaatgattctgagtcactgatagaagttgaatcacttgtagattctgattctactgtactttgtgaaccactgatacttattgaagtagaatcactgatactgtctgatgttgataatgatgtcgacaccgatgtgctttgtgatgacgatgtactagcactcattgacattgatgttgatatcgatgtacttaaggaaccagatgcacttgtacttgttgactggctttgtgacattgaatcacttaatgatgtagatgtgcttgttgagctcgagtcacttacacttgttgaacctgatattgagtcacttaaacttgtcgatgttgaaactgatwcgcttccgctcattgagtcagatgttgaaagtgatgtactcgttgaatttgatccactgatgctagacgaatcacttgtagacattgagtcgctttctgatgcactgatgctcatagagtcaaattgactattacttgttgagcttgactgcgaatcgctcacacttgttgacgttgattctgatccactcatactttgcgagctactcaatgattttgaatcacttaatgaatccgaagtgctaagacttgtggaaccacttaaagatattgatccacttaatgagtcggagtcacttgtactagtagaatcactcattgatattgaatcacttagcgaggtagactygcttacgctttctgaaccacttaatgatgttgaggtactcaatgaaccagatgtacttgttgaagtcgaaccacttgttgattttgaatcacttaatgaatcagattcactcacgctttctgaacttcttagtgacgtcgatacacttaatgatgacgaatcgcttgtgcttactgaatcg

SEQ ID NO: 221 - DNA, 10758 bp; double-stranded, linear
agggatggccttacctaaaaaaccgggnaaaccctccaaaacccattaaaaggntggntaccctttaaaatggtagcatttaaccgccacccgccaaggtgggtggtttattcttccgttatttaaattagtacaccatgcagattctgtagttgagggatattttaacgaaagcttattagcaactgataaaaaaatacgtcctaaggcatatattgcttcatggaaggacatcgagccggctaagaaaatagaatttaaaattaaaaaaggtattaaatggcatgatggtaatgaattgaaaattgatgattggatttattcaattgaagtcttagctaacaaggactacgaaggtgcttattatccaagtgtagaaaatatccaaggtgcgaaagattatcatgaaggaaaaactgatcatattagcggattgaagaaaatagatgactacactatgcaggttacatttgataaaaaacaagaaaattacttaacaggatttattactggacctttattaagtaaaaaatatttatcagatgtaccaattaaagatttagcgaaatcagataaaatccgaaaatatcctattggtattggaccgtataaagttaagaaaatcgttccaggtgaggctgttcaactcgttaaatttgatgattattggcaaggtaagcctgcactagacaaaatcaatttaaaagttattgatcaagcgcaaattattaaggcaatggaaaaaggcgatattgatgttgcgaatgatgctaccggtgcaatggcaaaagatgctaagtcatctaatgctggtctcaaggtattatctgcgccaagcttagactacggtttaataggttcgtatctcatgattacgataaaaaagctaataaaactggtaaagtgagaccaaaatatgaagacaaagaattacgtaaagcaatgctttatgcaattgatagagaaaaatggatcaaagcgtttttcaatggttacgctagtgaaatcaatagttttgtaccatctatgcattggatagcagccaatcctaaggacctaaatgattacaaatatgatcctgaaaaagctaaaaaaatcttagataagttaggttataaagatagagatggtgacggatttagagaagatcctaaaggtaataaatttgagattaactttaaacataattcaggttctaatcctacttttgaaccaagaactgctgcgataaaagatttctgggaaaaagttggcttgaaaacaaatgtgaagttagtagaattcggtaaatataatgaagacttagcaaaacatgcatctaatacgattcctgtttatatgccatatatcacatcttatttcatgacgcgtgctatcggcgacagacctttagtcgtcccgcatcaatctcagaacttagcatttattggtaactttgcagaaacagagcgagacactgtatttacaacagaatattcggttcgtactgccatggaagctgtttatcaattactaaatatagatcgtggtattccagaagtcatcaatagtccatttgatcttcgcgtcttaatggatgccatatacgaactgaatgaccaccaagatttgcgtgagattactaaagattcgaaaatgcaaaaactcgcattagcaggattccttaaaaagataaaaggtacgtacattgagtcattattaaaagaacacaaattgttataacgaaaaccattaatagatttttatttggtgatttcaaatcatgagactgggacagaaatgatgttttcataaaaattatttcgttgttccactctcatgatttttttgatgaaacataattacatgattgattgcatcattttgttaaacaagtgattgcaaacctgccatttcacactgaaaatttacataataagtgacgatattttacaagtcatatacaaataacatatattgttaaataattttacctaatcttaacattaaatttacaattataagcgataatctaaatataaagcttatttgaggtgaaataatggaaatgtcggttacagaagtcattttctcctttttaggtggtttaggtattttcctttacggcttaaaaatcatgggagacgggcttcaagcatcagcaggagacaggctacgagatattttaaacaaatttacatcaaatccagtattaggtgttattgcaggtatcgttgtaactattttaatacaaagtagttcaggtacgacagttatcacaatcggactggtaacagctggatttatgacattgaaacaagccattggagtgataatgggtgctaatatcggaacaacggtaactgcatttattatcggtatagatttaggcgaatatgcaatgccaattttagcattaggtgcattcttaatctttttctttaaacgctctaaaatcaataacattggccgcatactattcggtttcggttcactattcttcggtctagaatttatgggtgatgccgttaaacctttagcatcattagatggatttaagcaattaatgcttgatatgtctacaaatccaatactcgctgtcattgtcggcgcagggttaacagcactagttcaaagttcaagtgcgacgattggtattttacaagaattttatcaacaagatttaattagcttaaacgcagcaatccctgtgttactaggcgataacattggtaccacgattacagctatcttagctagtttagccggctcaatcgctgcaaaacgtgcggcgcttgtacacgtcatctttaacttaatcggggtaattatcttcacaattttcttgccagttgtgattcatttgattagtttgttacaagatttatggcacttaaaaccagcgatgacgattgcagtatcacatggtatcttcaacataacaaatactttgattcaattaccatttgtagcaggtttagcatggattgttacaaagcttgtcccaggtaaagatattgctgatgactataaacctcagcacttaaacaaagatcttgtttatcacgcacctggtgttgcattacaagaaactcaaaaagaattacaaaatgtgggtcagattgtcttatcaatgtttgaagacattcgcgaaattacaaaagacgataaaaaattgatcaaaaagcttgaacaaaagcatcaagctgttgaaacaatcaatgatagcattcgaaattatttagttagaatttctacaaaagccattacgaaggcagacgttgagcgtttagcagttatgtttgatgtcaatcgctctattttaaaagtagcagagctaacagaagagtatgtcgctcaattaaaacgccaacatgatgaagatattcgcattacagaagatgcacaacgcggtatggataaattattcaaccatgttgctgagtcatttgataaagccatcgacatgttagatgtttatgacaaaacgaaaaaagatgaaattgtagaacgtagtagagaatcatttaatattgaacataaactacgcaaaggtcatattaaacgccttaatcgtggtgaatgtacaacaaaaggcggattactatatatcgatatgattggtgttcttgaacgtatcggttatcattcacgaaatgtttctgaagcacttgttggccttaacgatgatgtacctacagatgaagaaattgcaacaactgaaatttaatttttactgtcttatttatattcatatttttttaaaattagagattcagatgcatgtaaaaagccaatccaacattcatgggttggcttttttgtttagcaaaatttattatcttaaatcggctataaacactgatataataatgcttcattagtatgcggtaagcatgacggacactgttctcggagtctgaccccgaaacgtttaatatacacttttacacgtcgccttcattgaagcgaattgccataaccttcacattatatatagttctttccatataaatgtccaaatttttagaacaacgcaataaataaccatccacctaacttatcaaaaatttaagtggatggtttttcattttcatttatatttatattagtgttaatccaatcatagatttatctatatgcactgctctatacatttcctcatttaatttgctttactttcatttatatcattatcaaaacacttggcgtgtcatcgttattatttcgcatctttgacacgtttatcatcattaggaatcgcgaataaaattgcgataaatgccatgattcccattaatacgttaacccaaagtgcaatcatcgcacctgtatgaatgctcgttgcagcaactgcaccagcatatacagcaccactaattgcgacaccgaatgcgccaccaagtgatgaagccattttataaatacctgaagcaacgccaactttatctaacggtgcattcgaaatagctgtatctgtagaaggtgttgcataaatacctaagcctagtccgaaacataaatatcctacgacacaactgataacataaaatatgcctggtaagaatactaatgaaataagtgcaataccaatgaccacaatgaatgtacctaataacattggtcgcttagaacccattttttgtaataatttttcaccaactcgaatcatcaataacaccatgattaaataagtaattgataagtatcctgcctgcaatgctgtataacctaaaccttgttgcacgaatgtattcgctacaattaatgtacctgcaaaaccgtttaataagaagttcgaaatcgttgcacctgtatatggtttattttcaaataatttaaaatcaataagtggattatctacttttttctcaacatttaagaaaataaagaatgctacaattacgattgcaatcaaaccaaagaaccataatgatgtgtaaccaagtgctgcacctttagtaatgacaacgtttaaacttagcaacataactactagaacaattagccctgcaacgtcaaatttatgtgtattggtaatttctgatttcgtttcaggcgtccctttgatgagtaacattgaaagtacggcaacgataattgagaagatgaaaatccatctccaacccatagttgtcgcaactgcaccaccgaagagtgaacagataccactgccaccccaagaaccgatagaccaataacttaaggcacgctgacgttcagcaccctgataataagttttcataatggccaatgtagaaggcataatacacgctgctgatacaccttgtataacacgacctaaaattaataatgccggtaaattcgtaataataattaatgctgaaccaataatacttaataataaaccgatattcgtcattttcacgcgcccaattttatctgccagaccacctgctccaacaacaaacatgcctgaaaatagtgcagttagactgaccgcaatactaattgtccccatgtctgtaccaaaactttgttgtaaattcggtacaacatttacaagtgattgtgcaaacaaccaaaatgtaataacacctaatacaatacctaagattaacttgttgcccccgcgatacgtttcattcatgttagttatctcctttaaggtaatctaaaacaactgtccctactgcttctgcagaaataagtaatgatttttctgaaatgttaaatttaggatgatgatgtgggtaaatttcaccattttccaccgctgcacctgtataaataaaggcacttgggcgttctttagcataatatgcaaagtcttctgaaggtggttgtggttcacacatttcaacaccaaaatcaaggtttgcttctttcaacgtcttagccacgtactcagtaaactctggatcattatataatgctggataatcatcgttatattctaaggtgcaagttacaccatacatatcctctaatccttttgataaacgtttaatttctttttcaattgttgcttttgtagcatctgttaatccacgtacatcaccttcaatttcaacaacatctttaatgacattgaattgacctttaccgtcaaatgaaccgattgtgacaacaccggtttcaaatggacttagtcgtctagatacaactgtttgtaacgctgtgacgaagtagctacctgcaacaatggcatcattggccatatgtggtgatgaaccatgaccacctttaccttgaactttcaatttgaagaatgcgcgtcctgtttgaacataaccaggtctgtaatacactttacctgttttcattgtgctcatgacgtgtacacctaatacatgatcaacaccgtctaatacaccattttcaatcattgttttagcaccacctggtggtacttcttcagctggttgatgtatcacaacgacttttcctgtaaaactatctttcatttcagcaagcgtctctgctaatacaagcatgtatgctgtatgtgcatcgtgaccacatgcgtgcataacacctttattttgtgatgcaaaagataatcctgtatcttcagtaatgggtaatgcgtcaaagtctgcacggattgctaatgttttaccaggtttccctgaatcaatcgttactttaattccacgtggtccgacattcgtttctacttccacatctttacctttgtaaaattcagcgatgtatttcgccgtttcatcttcatgaaaagataattctggatgctgatgtaaataacgtctgatctcaatcattttgccttctttagattttaaagtttcaattaattgttgattcatatccttcatctccttagttacatcataaatgattaatcattatttatattgccaacaacagagatgttaaccattaattttttgcaattttagctttgaatataaaaaatcacaaattatgtatatcaaaatttgtgatttgtgatcattttatgaacttgggtaacgttttacttcaattaagtgaatcccattcgtaatcattttaatgtttaatgccagtgtgtccgtgatatctatatcatatacttctaatttcggaaaactcattcgattaacgtaatctatagagtccttgtccatgccatgtatcgtatgatgtttgcgccaaagattaaataacgcaccattttctttatctaaggtaaaatgtttaatcttatacataccttcttccagggcattaatgttcaaatgaatcatttccgtcgcacgcatattcatttgattgtccaacgctaagtacggattaaaatgctttgcatcatataacaatatttgaaaatttgaatcagtccccgtgacaatacatgtatcatcagaatacaaaatattgcttgttaatttattaaatagcaatgccgtgaaatagaccggacgttttccattatattgatgaaatagttcaatagaattcatataatcccgttcatttttacaatgactgacgtgcaaatcataattcaaccaatacccgataccctctactttagaacttaattttaataattgctcaatgatgataccacctctaaaatattcgccgtttgtaataaatgtatcacccgtcaatgtattccaattgagtaaaatgagtggacgctttaggcgatgacgatgcattaagtcgataaggtaattcgttttattaataatcatttgactcgcggttttaaattcatcatcattcattttattaaaatcaacagcgtcatttgaattggcatcaaatacaaaatggtcgatgtgtggctcaagtcgtttcaataatggtagatgtctttccgtagcttgatctaagtgaatgtacaagccaccattagggaataatgctttaaaataatcaatcatttcaatcaaagacgtgtgcaatgtcgtcacatacaagttgaacttcaaatcttttctatgactgacatgcagggcaacgtgatggataaaaattttaaatgcatcgatataatcacgtgagtcatactgatccaaatgcatggtcaaactaaagttatgatctaataaaaagtctaaacacaaatcaatatcataaaatatattcgaaatttctgcatcatacgtgaatggcgcattgagctttttcatgatatatggaatcacatcatatgctaatacttcattgacttgaaaatcatgatgacatgtaagcaactgtgattgatactgtgtattgagcaaattcctcaaatagcccacttgaataatatgattaaattgatttagttggtgattggttggttgaaaggcaatctctttatagttcatcttttcaatatcttcaataaaatgattcatttcttcaatgtagtcatttaaaagtaatatcaattcacggtcgtgataatcatgttgtgccgattgctggttttcagtgattgctggacgatcacctcgatattgtttaggtgtttgatgcgtaaagtgtttaaatgttctcgcaaagctcgctgcacttgaaaagccattttgcaatgcaatatcagtaatggtttcatctgtgtatgtcaaatcgagtttcgcatgctcaattcgcgtcgtatttaagaaatgatggaatcctacacctagcgattctgtaaactttttagacagatggctctctgaccacccaacgtattcgcttaattctgaaaggcttaaatcttcatgaaaatgtaactcgatatagtcgcatacttgattcactttatcatcatttaagatactttggttcgaatgatatgtacgcgggacataatgaatcatatgcataagcaactgaatcacaagttgttgctcagtcaatttagacaactcattatgtcggatatgtgttgaaaccagtcttgccattatatttctcagttgatgtatattctttgttgtggtcgcatctgttaagtgaaaatatagacaatgcacatcatcaaacttgtctgctaaatatttcatttggaattggatataacatatgatgccatcttgttgaagttgaaatcgatacaagtcgcggtggttaatgatgaaaatgtcgccactgttgcattgcgtcatattattttcatcataaatgtgtgcctcncctttaataacaaaaccaatcattaaactattgagccttttgaaatctgacatactctcagtttctactcgaattaaataatcacgttgcatactatccctcaattcagtaatatgaatacgtttattttacattattttacagcaacatatttgaatttcatattgaatcgtgtgtgtggatgattatttatcctcactcggttcaagatgtagactatcagtaaaaaaagtattttcaccttttttctccacaaaagtaaattcaatgtctttatatccaactgrtgaaccttttaagtctcccgaacctttcaacaataactttggtgctttattcgttggtattttatatctttttcgtaattgttttacattatagtcatcattagttaattgatattttgctgaataactcggtacctctggattatatgatatatcgccgtctttgtacttcgacaaatctttaaagctgccatattgcgcgaagaacttaaaattctcgatttctttttttatattttcgtctttgatacctttagttggaatgattttattgtctaccattttaacgggatattctttatctttactcttaggtctaccatcttcatcatgaagtgtttcactcactatatacttcccggttgtagtcttagtgtttctattcatatatagaaccataccttttgatttcatacgttcccctttaggttgaacaaccatttcagaaccaataatccatgtacctttatcatttttatcaaattcgtcatcacgataaccttctttatcgtataaatcctctagatttttaatcggatacatactcaatgttttttcaaagcttttcttaacttccgcttctttacctatgccacaaccagcagtgaaactaatgactaatatcaaaaaactaatatacaataccaatttgtttaatcgtttcataatttcacaatcctattcttcttattatctttcctggattgatttcatattttgatcgagtcatgattatttatcctcacttggtttaaaaattaacccatcactaaagtaaatgttctcttcttttttctctacaaacgtaaattcaatgtctttatatccaactgatgaaccttttaaattccctgtaccyttcaacaacarcttcggygctttatttgttggtatgtcatatcttttacgtaattgttttacattataatcatcattagttaattgatattgagctgaataactcggcacctctggattatatgatatatctccatctttataattcattaaatctttaaaattgctatattgcgcaaaaaacttaaagttttcgatttctttttttatgttttcttctttaacttcctcagtagaaatgaatttattattaatcattttaactggatattttttttgattatcctgagctacttcgtatttctccgtctttatttcattagtatagtaaaatccttttgcacttcttgtatttctatctatcttcaaaagcatgccttttatttttagagcttctcctttattttgaattgccatttgagaatttacaatccatgttcccttatcatttttatcaaattgatcatcacgatatccttctttatcgtataaatcctctagatttttaatcggatacatactcaatgttttttcaaaacttttcttt

SEQ ID NO: 222 - DNA, 1109 bp; double-stranded, linear
ntatcaactttggaatttaaagtcaataacttttttaaaaactttttgtgttcacaacccgcttctttttcaacgcgtttattgcttaacacaagaacttattttaccagcattccaaaacaaatcaacataaaaacgtacaaaataaaagtaattttgtacgtttagcatatattatacctatttatttgtagcagctataactttttgtgcaatcgagctataaattttacctagacgatcatctgattgatatattgacggtgcaaaatcttttggattccaagatggttgctctaaaggtaattccccaagtaattgagtattaagttcatcagctaacttagtaccgccacctttgccaaagacatattctttattacccgtctctttactttcaaaataactcatgttttcaattacgccaagaatagaatgatccgtatgttttgccatcgcacctgcgcgagctgcaacaaatgctgctgtaggatgaggtgtcgttacaataatttccttacttgaaggtaacatcgtatgaacatctaaagctacatctcctgttccaggtggaagatcgagtattaaatattcaatgtctccccatttaacttctgtaaagaaattcgtcaacattttacctaacattggccctctccatataactggcgcattttcttccacaaaaaaggccattgatataactttaacgccatgacgttcaactggaattacttccttccctttaattccaggcttttcatcaatacccatcatatctggtacactaaatccatatatatcggcatctactaatccgacttttttcccttcacgagctaaggcaacggctaaatttactgcaacagtagatttaccgacaccacctttaccggaggctattgcaataaattcgactggattattttgagataataggccttctatcgttttaggtttattttcttcttttggtttaaattgatttactttttcttccggcaatgtttcaaatcgtataccgaccgttttcgcaccgttttcttttaatgcattaacaacagccatctgtaaatctaaattgcgtgcaccacctaattgtgccattg

SEQ ID NO: 223 - DNA, 3997 bp; double-stranded, linear
tctttatttaaaaaaatgattgtctagtttgtatctctctgaagatttggcaataaataaaagccgataaccgtataatgattatcgacttaaagtttatgtggcattttttacttttgtaatttcaggtgagttagatgattattatcagatagattattgcttataatcatatgatgtttgaatgatatctttgatttcactgattagtgcttctttaggattagcagttgtacattgatcttcaaatgcgagctctgccattctatcaattgactcatttaattcttcttcagacacaccttgtgatttcaaattcatttcaattccgactgattgacctaattcgtagacagctttagctaatgattctacgagtgcttctgtcgtattaccttttaatcctaagaatttggcaatatctgcataatctgtatctgctctgaagaactcatatttagggaataatgcatgtttttgcgggtctttggcattataacggataatatgcggtagtaatatcgcattcgctctaccatgcggaataccatattcgccaccaattttatgcgcaattgagtgtgcaatgcctaagaatgcatttgcaaatgccataccagccaaagttgatgcgttatgcattttctctcttgaaactttatcacccttttcaacagatgattttaaatattcgaacgtcaatttaatcgcttgtagactcaaacctcttgtgtagtctgaagccattacagatacatatgattccattgcatgcgttagtacatccattcctgtatctgctgtaacgctttttggcacactcatcacaaattgagggtcaataattgcaacgtcaggtgttaaagcaaaatcagccaacggatattttacatttgtttcactatctgtgataactgcaaatggtgttacttctgaacctgtacctgatgtcgtagggatacaaatgaacgtcgcattttcaggcatgcctattttataagtacgtttaccgatgtctaggaacttttgtttagcaccgaagaatgatgtctcagggtgttcaaagaacatccacattgcttttgcagcatccatcgctgaaccaccaccaagtgcaatgattgtatccggttggaaatcaaccatcatttccagacctttatatactgtattagttgatgggttcggttcgacttcgctaaatatttttatttgaggctgttccgttttttgtcttaatacattctcaactgtttttgtataaccgaattctaccataccagggtcacagacaatcatcactttttcaatcttgtccattgttgttagactcatgattgcattttcttcaaaataaatttgagcaggcaccttgaaaatttgagtattattacgtcgtttagcaatcgttttaatgtttaataaatctgtcgcactaacattatgtgaaattgagtttctaccgtagaaccacaacctaatgttaaagacggaatcaattcgttatacatatcaccaatacctccaaccgctgatggtgtatttacaagtacacgacaagctttcattcttagtccaaaatctttttgtaatgtttcatcttctgtatggataacggctgtgtgtcctaatccaccaaaatgtagtgtgtcttcacaaatttgaaatgcttgttttgtagattgggcttttactaaggctaatactggagataatttttcacgagataacggatagtctgaacctacaccgctaatttcggctatgataagttttgtattttcggggacaggtatacctgctaattcagctatttcaactgcagatttaccgacaatatcaggcttaatacctgttttttgttcattcataattgcattttctaagcgttgtaattcatcttttttaacaaagtatgcttgatgtgctttaaattcattagtaacatctttataaatttctttatcaatgactacaacttgttcagaagcacaaatcataccattatcaaatgtttttgaaccaatgatatcatttactgcacgtttaatgtgtgctgttttttcaatgtaagacggcacgttacctggtcccacacctaatgccggtttgccagttgaatatgcagacttaaccatgcccgaaccacctgttgctagaactaatgcaatacctttgtgattcattaattgttttgttgcttcgatagaaggcacttcaatccactgaataatatctttaggtgcacctgccttcattgccgcttctaatacaacttctgctgcacgcttcgacgattcttgtgcacttggatggaatgcaaaaatgattggatttcctgtcttaattgcaatcatcgctttaaaaatagttgtcgacgtaggatttgttgttggcgtaacaccacaaataacaccaattggttccgctacatacgttaatcctttttctttatcttcaccaataatccctactgtcttattgtcttttattgaattccatatatattcagaagcgtataaatttttaatcgctttatcttcgtatatacctcttccagtttcttcatgtgctaattttgctagcaccatatgttgatcaacagctgctaagctcatttgatgaacaatatgatcaatttcttcttgtgactttttagataatgcttctaatgcttttttccctttgtcagctagagcatcaatcataattgccacttcttgttctttcgatccacgattttctttttcaggtatagttaacatatacaaccactcctttatactttgtgaattatttcacaaacattatagtacatgtctctcaggatataaagaaaattctatacaaaaaagtttaatttcgaatattatttgaacaaatatcaaattttaaaataaatgttttcatgaaatcattgttatttcggtgtttttagaatgattttataatcataattttttcaatgacataatttattcataattatatatttaattctgaatattctttaatagcctaaaaagcttgttatatcgcacaaaacacaacattaaaaggtccttgtcgatacctatcaacagatgttacaaataaaaaccacccgtgtgaacgggtggtttgttctgcggctataagccttccttactggccagccctaaaagggcactgacaagtcagccaactgcactactattccagcaatcctaaaggtttactcttttttctttctttttttatttttctctccagtgaaaggatctaaatattcttccattgaaatttcatctgcaacgatatcctcttgtaattgattacgaatataattttcaatcacttttttatttctacctactgtatccacataaaatcctttacaccaaaactttctatttccatatctatactttaagttagcatgtctatcaaatatcattaaattacttttccttttaaatagccaacaaatgatgataccccaagtttgggtggtatacttactaacatatggatatgatctttacatacctctgcttcaattatctctacaccttttctttcatataattgacgtaatataatccctatatctttttttatttttccatatatcgcttgtcttctgtatttaggtgcaaagacaatatgttacttacaattccatttcgtatgtgctaaactgtttgtgtcagatgacattaaatagcatctcctcgtgttgattattttggttggctgaccaatatttactctaacatgtagagatgcatttttttgacaatggtagaaccttttctggggagtgggacagaaatgatattttcgcaaaatttatttcgccgtcccaccccaacttgcattgtctgtagaaattgggaatccaatttctctttgttggggccccgccccaactcgcattgcctgtagaatttcttttcgaaattctctgtgttggggcccctgactagaattgaaaaaagcttattacaagcgcatt

SEQ ID NO: 224 - DNA, 1391 bp; double-stranded, linear
gngcgagacaaacacacttattggtgccattatmcctagaatgaattcatatgcagtagatgaaacaatcaaaggattggcaaaacaatgccaaaaatatgaatcacaattaattttaaattacacaggtttaaatatcgaagcagaaatacaagcgcttgaaacattagcacgcagtaaagtagatggtattgttttaatggctacagacataacagagagacatattgaagtcattaataaaatgaatgtaccaatcgttattgttggtcaacaacatgaacaacttcatagtattgtgcatgatgattataaagcaggtcaaattataggcgaatggattggtcaacagggatatcaacaagttgaagtgtttagtgtaagtgaaaaagatattgcagttggtatacatagaaaacgtggtttacttgaccagttagctaaataccaaattaaacctaatatacatgaaacaaattttacttatgtggaagcacaaaaagatgttgcaaatgttttggaaaatgtggagcaagtagatgcggttgttggagcaactgatacgattgcattagctgcctataaatattattctgataaaaaagatgttatgaaaccacatcaaatatatggttttggtggtgacccaatgacacaattagtgtctccatcgataaaaacaattcattataattattttgaagctggccaatgcgcgatggaagagatacaacagatgcttaaaaagcaagatatgccatatagcgtcacagtagatgttaatatttagacgctgtattttttaaaataaatgtggaaccgataccatataactataaatggataggttaaaagttaaagaacgtaggtaaaatttgctataatagaatataaattgttaacagcataaattataaaaggaggactgggtaaatattatgaccgaatggactagagaagaacgttatcaacgaatcgaggacgttgatactgagtattttaaaacattaaaacaacaagttgatcaatcaaaatttcgtcaacaatttcatatacaaccagaaacaggcttattaaatgaccccaacggacttattttttataaagggaagtattatgtttcacatcaatggttcccattaggcgcagtacatggcttaaagtattggtataactacacgagtgatgacttaataaactttaaagctgaagggccaattttaaatccagatactaaatatgacagccatggtgtatatagcggtagcgcttttgaatataacgggcatttatattatatgtacacaggaaatcatcgagataatcattggcaacgacatgcgagtacagatgatcgcacgattgaaagaagacggttncagttggnaaaa

SEQ ID NO: 225 - DNA, 930 bp; double-stranded, linear
atttattttaatgtttatattttctaacacttttttatgatcatagtagtaattgacatttttcaattcaaagactggtgtcatcgtatctcacctcgcattcaactatacaactcctagtaacatatgtaaacagtaatgtttacgactcaaaattagacaaaataaagagatatgcccccttcaagttttatttatcgcatttcttgaagagagcattatcattttattgttgcataaccttattttttaattctgggtcaaattgctgttgttttaacatttcaatttcaagtttatatggcggttttttatttttcttatcttcaccaacataaggtgtttctaagattttcggaatatctttaaaactatcatgatgcacaatgtaatttaatgcatcaaaaccaatgtaaccgaagccaatattttcatgtcggtctttttgagcgccacggtcatttttagaatcattgacatgaacaactttgattctgtcgactccaatgattttatcaaattcatttaatacgccatcaaagtcctctttaacattatatccagcatcatgcgtatgacatgtatcaaaacatactgataaacgttcgttattatgaactccatcaataatacgtgctaactcttcaaatgagcgaccaatctctgtacctttacctgccatcgtttcaagcgcaatacgtacattattgtcattcgttaaaacttcatttaatccttcaataatcttattaattccggcatcaacaccagctccaacatgcgcacctggatgtaatacaatatctttagcccctatagcttgcgttctktcaatttcttgttgcaagaaatctacaccaagattaaacgtttctggtttggttgtattgcaatattaatgatgtatggtggcatgaacaacaatattag

SEQ ID NO: 226 - DNA, 1984 bp; double-stranded, linear
tgacgcaccaatttataacgcaattgacaaaacaattagatatacctgtgaaatttgtacctggaaaccatgatttatgggaagttgaaagtatgactacgcaagacatttggaataattataagagtatgtcacagtgcttggtaggaaaaccatttatagtaaatgaagaatgggcaatcataggacatactggctggtatgattatagctttgcagcacaacgattttcattagatgagttacaaaaaggaaaacattatggtgcgacttggcaagataaagaacgaatatcttggggcatatcagatcaaaatttatctaaaatagcggctgaacaagtgaagaaagatatattagaagtaggaaatagacgagtgattttagtcacacatgttgtgacgcaccctgatttcattgttcctatgccgcatcgtatattcgatttttataatgcatttattgggacaagtgatttcaatcctttgtatgcgatgttcgatataccatatagtattatgggccatgttcattttcgtaaaagtgtgatagatgatggcagatgttatctctgtccgtgtctaggctatccaagacaatggcgttcagaagatatttaccaggaaataaatgagacgatacaaataatagaaatttaaaatgcgcaaacctgacccagtttgcgcattttatgttttacacacgcgagtaatgtgtttacttacgtgtgtttattttgttgctgattttcaattgtatatgaatgtggttgcacataaatgcactttcttcctggtgaattaaagctgtattccattttctctttacgaattttaataatttgtttgcgatttggaatgatggcaggtaaaactaggccacgacgaatatgactccaaagtggatcgatataatagtaatagtaatcatcgtacccaatgagtaacgttacgtgaatatttgaaacttgtttcgctggcttgttatcaaagcggaaaacacgtagtaatggtttagaaccaagattagtatggtatattaacacaggttgaccttgatcgataatacctttaagatcttctaacgatttaccagtgccgtctacgatattaggattgtatttttgtaaaaatggtacatatgcttctggaaatatcgtttgatgataattgccaagcttaatgaataagtgatgtccaacataacctttatgtggattgttcggatgtgtcggccaatgtctcataatttctgtagcagggatatgttggttgttgtattgcaacatcatggctgcggaaacaccttcacaccccatgaccatagggataggaaatagctgactgataggtttaactggtaatatttttcggttcataatatagtcctcgcattgattcaataaatatttaatataattatatagcgtcaatgcaaaatgtcctaaacatatgttttacatgagtgaataaaattaatggagtgataaaatggaatatcaattacaacaacttgcgtcgttaacgttagtaggtattaaagaaacgtatgaaaatggacgacaggctcagcaacatatagcagggttttggcaaagatgttatcaagagggagtaattgcggatttacagttaaaaaataatggtgatttagccgggatacttggcttatgtatacctgaattagacggtaagatgtcatatatgattgcagttaccggagataatagtgctgatattgaaaaatatgatgtcataacattagcaagttcaaagtatatggtatttgaagcacagggcgcagtacctaaagcagttcaacaaaaaatggaagaggttcatcactacatacatcaatatcaagcagatacggtaaaatcagcaccattttttgagttgtatcaggatggtgatactacaagtggaaaattaatattaccagaaatttgggatncctgttaaaggggtgattgaaatangaantg

SEQ ID NO: 227 - DNA, 6373 bp; double-stranded, linear
gattccacgtgtgttaaaagaagttacaccttcaatgatggtatttactaatttctttagagatcaaatggatcgcttcggtgaaattgatattatggttaataacattgcagagacaattagtaataaaggcatcaaattattgctaaatgctgatgatccatttgtgagtcgtttgaaaatcgcaagtgatacgattgtgtactatggtatgaaagcacatgcccatgaatttgaacaaagtacgatgaatgaaagtagatattgtccaaactgtggtcgcttattgcaatacgattatattcattataatcaaattggtcattatcactgtcagtgtggtttcaaacgagagcaagcaaaatatgaaatatcaagttttgatgtggcaccgtttttatatttaaatatcaatgatgaaaaatatgatatgaaaattgcaggtgactttaacgcttataacgcgttacagcatatactgttttaagagagctagggttaaatgaacaaacaattaaaaatggctttgaaacgtatacatcagacaatggtcgtatgcagtactttaaaaaagaacgaaaagaagcgatgatcaatttagctaaaaatcctgcaggaatgaatgcaagtttatcagttggtgaacaattagaaggcgaaaaagtgtatgttatttcgctaaatgataacgctgcagatggtcgagatacttcatggatttatgatgcagattttgaaaaattatctaagcaacaaattgaagctatcatcgtgacaggtacacgagcagaagaacttcaattgcgattgaagttagcagaggttgaagtaccaattatagttgagcgtgatatttataaagcaacggcaaagactatggattataaaggtttcacagttgcaataccaaactatacatcattagcgcctatgcttgaacaattaaaccgttcgtttgaaggaggtcaatcataatatgcatgaattgactatttatcattttatgtcagataaattgaatttatacagtgatataggaaatattattgctttaagacaacgtgctaaaaaacgaaatattaaagttaatgtcgtagaaatcaatgaaacagaaggtattacctttgatgaatgtgatattttctttatcggtggtggaagtgatagagaacaagcattagcaacaaaagaattaagtaaaattaagacaccacttaaagaagcgattgaagatggtatgccgggattaacgatttgtggaggctatcaatttttagggaaaaaatatatcacgcctgatggtacagaattagaagggttaggtattttagatttttatactgaatcaaagacaaaccgattaacaggagatattgttatcgaaagtgatacttttggaactattgtaggttttgaaaatcacggtggtagaacatatcatgatttcggtacacttggtcatgttacttttggttatggtaataatgatgaagataaaaaagaaggcattcattataaaaatttattaggtacttatttacatggaccaattttacctaaaaattacgaaatcactgattatctgttagaaaaagcttgtgaacgtaagggtattccgtttgagcctaaagaaatagataatgaagcggaaatacaagcgaaacaagtattaatagacagagcaaatagacagaagaaatctcgttaactctgaacatcgcatcaatggatttaatattgataaacgatgaagtttagtaattaatcatatatgtataaacacacacattattttggatggaaacaaccaaattgatgtgtgtttttttgttctagtgaataattattatacaatgagtatctatcctagaattatcaatagtaatggtgattatgcaacatgaaaaaatgaatgatgaaaggaatttgacgatgaagcctactaaagtgatattaaaagatgcatcttatttacatagcaaaacatcgataacatttattttaaaagatgtagttatcgaagaagataataaaatttattatttcgacactagtgcactttcgaagatcaagaagttaaatttgaatttgcactctttgatagtgacatggacaatttgaaacatatggattgcgacaatcctgttactgaaatatattttatagaacctgatttacattttacaattattgattttaatcaagaactgctttgtatttatattgattttgattctggtttaaggcattcaaacatggcaacagaatctggtatttcattaaggataaatgttgctaaatcagattttactaaatttattaatgaattagcctctttacattaatgatttaaatctgatatgtaattacaatcaaaaaagacagccacatccctccgtagtttaggcgtgtggctatatttgagtctgaatatttatgcttgtaattttaaaaagggacatgctatatacgataaaaagaggcggggacataaatcaatgttctatgctctacgaagttatattggcagtagttgactgaacgaaaatgcgcttgtaacaagcttttttcaattctagtcaggggccccaacaaagagaaattggattcccaatttctacagacaatgcaagttggggtgtgggccccaacacagagaatttcgaaaagaaattctacaggcaaagcgagttggggtgggacgacgaaataaattttatgaaaatatcatttctgtcccactcccatggtgccaattagcataaggtacttaaattaagcatatctgctgtctagcagtcgataaatcattagaacttcgtatagtatatgacttttaatttgattttcaccactaatttcaagtgcttttatagtcgaacgtaaagtttctacagaatcatcttctctcttaaaagaaccatcataaaatatatctttgatgctactactaatttttagcaatgccattttttcgtcacctgaaaagttaacacgagtatttttaggcaagtaaatgatatttgataaatgagtgataaacaaacgattcgtatatgcacgtttagttaattgattgagtaatttccaatcacattcttttttcttatgatagcttaattcatcacgttgataacttattaacgtttcaacttgattatttaaattgaaaatatttttatatgctttttcgcttttatcagattgcagtcttgataagataagttcttggcagcgattgtaaaataatttatacatcaaggcatctgtcttacttaatttttcttcgacctgaccataatacttaggtggaaacaccatgaagttaattaaacctgatgtcacgagtccaataattgctgtcaatgttcgagacaaaaagttgaatatgtaggcatcatgaatacctggaatcatagctaatgatgttagtacagcgacattcgtaccaacttgcaatttgagttttgtacagaataaaatcgtgaacgttgcactcaatgcatatgtaaaaggtgattgatcgccgaataaatatgtaaataatactgcaaagcctgcaccaattaccgtagcaggtaatctacgataacctttaataagtgatgccttggcagttggttcaattgtgactacagctgttaaaatggcatagatgggtgttaaatctagtgccatacaaaagacagctgttaaaaaaatggcaataccagttttaattgttctggcaccaattaaatgtttataccattgatcgttcattttttaacctctaatcatcgtaaaatcttagcgagcgctttataataatagtatcgtacattggaaaagttcatgtatgtaaaatatttgaaataatcatacataagcattactttgattttcatatacattaatcaaagttctgggctccacaatgttatattgttagtagttgactgaaataaaatgcacttgtaacaagcatttttcaattatagtccggggccccaacatagagaatttcaaaaaagaaattctacaggcaatgcaggttggcggggccccaacacagaagctgacgaaaagtcagcttacgataatgtgcaggttggcggggccccaacatagagaaattggatctacaatttctacaggcaatgcaagttggggtacaacgataaagaaatattttttctttatcacactatgtctcactcactttccaaaatactaaagtaacatctttagtatatcaaagaatttttgctataataagttataattatataaaaaaggaacgggataaaatgattgtaaaaacagaagaagaattacaagcgttaaaagaaattggatacatatgcgctaaagtgcgcaatacaatgcaagctgcaaccaaaccaggtatcactacgaaagagcttgataatattgcgaaagagttatttgaagaatacggtgctatttctgcgccaattcatgatgaaaattttcctggtcaaacgtgtattagtgtcaatgaagaggtggcacatgggattccaagtaagcgtgtcattcgtgaaggagatttagtaaatattgatgtatcggctttgaagaatggctattatgcagatacaggcatttcatttgtcgttggagaatcagatgatccaatgaaacaaaaagtatgtgacgtagcaacgatggcatttgagaatgcaattgcaaaagtaaaaccgggtactaagttaagtaacattggtaaagcggtgcataatacagctagacaaaatgatttgaaagtcattaaaaacttaacaggtcatggtgttggtttatcattacatgaagcaccagcacatgtacttaattactttgatccaaaagacaaaacattattaactgaaggtatggtattagctattgaaccgtttatctcatcaaatgcatcatttgttacagaaggtaaaaatgaatgggcttttgaaacgagcgataaaagttttgttgctcaaattgagcatacggttatcgtgactaaggatggtccgattttaacgacaaagattgaagaagaatagttcaacatatactaagactaaagtatgaacatcatttagttccggagcctattcatattggtttcggaactgttttataataattaagaacacaatcaatgcgtcatttcaaaaatatgttgtaacaaagtagtttttaagcaaacatatcatcgacatcaacgaagatacatagcgcatttggtattttaaaacttattataaaaggtgatagttatgaactatgttgaacgttatattgaacagtttttgagagcaacagtaagaaataatatcaagcactaccttttaatgctagatgaaaaaatgaaaaatttagatgattatatgcgttatttaattactaaaaaagaacaacttagcaagttaattgacagtctaatgctaacattagaaaataaatatattgatattgctgaagcatttcaaattcaatgtgcaagagaaatcaataatcaagaaattgaaaatattaaatcagagttgaataaagttgaagcatattatgcacaaattgaaactcaaattcaacaaacttcaactgaaaaaatagcaacagaaaaaacatcgtatctaataaattatatgaacgctgtggcatagaaaggcggcgaaacatgacacacaaatatatatcaacgcaaatgttgatcatttttactgcattaatgattattgccaatttttactacatattttttgaaaaaattggctttttactcgttctattattgggatgtgtattagtttatgtaggatatctttattttcataaaatacgtggccttttggcgttttggataggcgcgctattaattgcattcacattattgtctaataagtatacaatcatcatcttgttcgtctttttattattacttattgtgcgttatttaatacacaagtttaaaccaaaaaaagtagttgcgacggatgaggttatgacttcaccatcttttattaaacaaaagtggtttggtgagcaacgtacaccagtttatgtatataagtgggaagatgtacaaattcaacatggaattggcgacctacatattgacttaacaaaagctgcaaatattaaggaaaataataccattgttgttagacacattttaggtaaagtgcaggttatattgccggttaattacaatattaatttacatgtagctgctttttatggaagtacttacgtgaatgaaaaatcatataaagttgaaaataacaatattcatattgaagaaatgatgaaaccggataactatacagttaatatctacgtatcaacgtttatcggagacgtagaggtgattyatcgatgaaycact

SEQ ID NO: 228 - DNA, 4488 bp; double-stranded, linear
atagngaaagcgttttacacttaataactccctcttaaatgcatccaggttctatgtagtaaatcatgaanataacatataaatntagaggagatttacctttgaatacagagaacaacaagaatcaaaaccaatctgttaaaaattctgaaagacgcggcatgttaaaaggatgcggcggttgccttatttcttttattttattaataatcttattatcagcctgttcaatgatgtttagtaataatgacaattccactaataatcaatcatcaaaaacgcaattaactcaaaaagatgaaaataaaaatgaagataagcctgaggaaaaatcagaaacagcaacagatgaggatttacaatcaaccgaagaagtacctgcaaatgaaaatactgaaaataatcaacatgaaattgatgaaataacaacaaaagatcaatcagacgatgatattaacacaccaaacgttgcagaagataaatcacaagacgacttgaaagatgatttaaaagaaaagcaacaatcaagtaaccatcatcaatccacgcaacctaagacctcaccatcaactgaaacaaacacgcaacaatcatttgctaattgtaagcaacttagacaagtatatccgaatggtgtcactgccgatcatccagcatatcgaccacatttagatagagataaagataaacgtgcatgtgaacctgataaatattaaacaacaagcgaattgaattcaaattgtatttagctttatgcactaatcacatagtaaataatgagggagattttttaggcatgagcaatcaattcaaaagcgaagaagagcgaagacaatgggaacaattccaagctttccaaaatcaacaaaaccaacagaaccagcaatacggacaaaagaaatctaaaaaaggatggttctggggctgtggtggttgtctagtattatttattttaattatcatcggtatttcagcttgtacagctggtattacaggtaaccttggcggaaatagttctaaagaaacgaacaaaacccataaaatcggtgaaactgttaaaaatggcgaccttgaagtcactgtaaattcagtggaaactatgaaatctgtaggaccatctcttgcaccaacaaacgctaaaggtatatttgtcgttgctgatgtgacgattaaaaacaaaggtaaagaagcgttaacaattgatagttcaatgtttaagctaaaatccggtgataaaacatttgaagcagataatacaggttcaatgtctgctaatcaaagtgacaatggtagtatagaaaattcatttttcttacagcgtataaatccagatagcactgctcaaggtaaaattgtttcgatgtgtcagaaaacatagccaacgcaaaagataaaaaattagaagttatttctagtttatttagcgtcaagaagattacatttgatttatccgatgctaaaaaaacatcaaaagctaaaaaagacaagcaagatacagaagtagctgttgcgagttcaaatagcgataatgtaagttatgaagcttcggctactacacctgctacaacttctagtgcggatactgattctgaagatagcgaaaagtctagtaaagatgaggataagcagaatgcgtctaaaagtgataaatctagtgtagaaaaaagtgaatctaatgaggaaactgctcctgtagagcccatgccccatagcaaacctaccactagtgaagcaccacctagccaaaatattcacaatgaagatagcmtgtacgacgcttcaacagaataaaattnycagtagctcggctacccttcttttacggaaaaattaattatacataatcaaatcaaggagataaaaaaatgaaattcaaagctatcgttgcaatcacattatcattgtcactattaactgcctgtggtgctaatcaacataaagaaaatagtagtaaatcaaatgacactaataaaaagacgcaacaaactgacaacactacacagtcaaatacagaaaagcaaatgacaccacaagaagccgaagatatagttcgaaacgattacaaagcaagaggcgttaatgaatatcaaacattaaattataaaacaaatcttgaacgaagcaatgaacatgaatattatgttgaacatctagtccgcgatgcagttggcacaccattaaaacgttgtgctattgttaatcgacacaatggcacaattattaatatttttgatgatatgtcagaaaaagacaaagaagaatttgaagcatttaaaaagagaagccctaaatacaatccaggtatgaacaatcatgatgaaacagatggtgagtcagaagacattcaacatcatgacattgataataacaaagcaattcaaaatgacataccagatcaaaaagtcgacgataaaaatgataaaaatgctgttaataaagaagaaaaacatgataatggggcaaataattctgaagaaactaaagttaaataatggcatactttgattaatcgtaatttttaggagaaacgctatgataacatttgagaatatacaacaacttgagaaatacaccttaatgactatgcatggtctttttaatcaacttaaactcggcattatttcaatcgaaaacgcagagcatacgctttttacaccttatatgttggaaacgctctcttccctaggcgtgaaagacagcattgtcgatttaattcataaagggactgaattagaagactttgcggcatttaatttatcaattgaagacacagttacagtctgtttacaaagaactgaagaactattaaaacaatacaaaaatgtggaattcaatgacaaaatattaatcaattggcgtattatacaagagaaatagacatataaaagtcgaatgtaactacgtgagtattgattttattctttgtaaattacaagcatttcatattataaagtttgaaaagaggtatattgaaatggagaaaaatgaatatatagctaaatataatgaatatagtcaattattagacgctacatactcgcaagctgtagcatmccttttaagtaaatatggcgctgtaaccgatgattattataaagaaaaatcatacacgcgatttttaaatggagnaatcaaaagtatttcaaaaggaaaatacactagagctagcgaaggattatattgccatcatataagcgaggacaaattccaaaatctatctgatctaagattcatttccaaatttaagtactcatacgacgttcaaaagaaagaaaacttagtgtactgtgatctaatcgagcatttaattttacatgcaattattacaaaagaatcccatggccaatttggtgtagctggattatgtcaaatgatcaaaccaacagtcattgattggtacattggcgaatataatccaaaaccagcatggatgcaagccaccaaagcacgtgcctatttgcctggaatattagtagagaaattactcattaaaattgacgatatgttaaaaggaatagaaatataagatttccttgagtctagataaatgattaatgtagatttattttttgctgttgagattttgttatagatgtttaaacctgtaattaaatatattttataaaatagaccacgcatacctatctataaacggrcaatgtttataaatgagtttgcatggtcttgaattgtattaaatttcttttggttttaataaatcgactagattttcacaatatttatcaaatatgtattcctaaattatacagccttaatccagcagctactttcgaaacttccaacttagttgatataaggttcaatagtttgtttcgttctttttcagataaaccagaacttaaattgatattattgacttcataaaaattatagactaatgcctctatttgctttttaggcataagtaagtcgactgaaaactgatttacgtcgctttcataaatcatttcatgtaaattctttagactattatcgttactatctctcattaagtctgtatttttaaataaataacggcccaattcacgagctattgaaaatcttgtattattaatcgagtgattattattaatatagattgttcttccacttaaataacccgaagtattaccctccattttaatatatctaacatttaaattaagttgaaataatagcttgtctatgtcaatagcaaagtgttcagaagtaataaaaagttgatccattttgtcctttataaatgcctgaaataatcgaactatttttgattctaaaatatcttcataatgaactttctcaataactttcaattgattccccaccctaactaaaaaaatcgaacctacatcatttaataaatttataactataggtgtaaacattattaaaataaaacccctctactactatatgtaacgaagggacatgatttcaaaataaaataccttttttataaatntattataatatcccccactatacnac

SEQ ID NO: 229 - DNA, 846 bp; double-stranded, linear
tatggcgccatattagttgtaactggtttaagaggtccaagaaatatcaaataaagttgttcctgggcttggtactgttatctcaatattgmwtgcatttggtggtctagcttttaatattggtaatattgctggtgccggtttaggtttaaatgcaatttttggattagatgtaaaatggggcgcagctattactgcaatctttgcaatattaatctttgtaagtaaaagtggccaaaaaattatggacgttgtttcaatgattcttggtattgtgatgattttagttgtggcatatgtgatgtttgtttctaatccaccttatggtgatgcttttgtgcatacatttgcgccagaacatccaatgaaattagtcttgcccatcattacgttagttggtggaactgtargtggttatattacctttgcaggtgcacatcgtatattagactctggcattaaaggtaagcaatatttaccatttgtaaatcaatcagcaattgctggtattttaactacaggtattatgagaacgttactattcctagcggtattaggagttgttgtaacaggtgtgacactaagttctgaaaatccaccagcgtcagtttttgaacacgcaattggaccaattggaaagaatatttttggtattgtgttatttgctgcagctatgtcatcagtaattggctcagcatacacaagcgcaacatttttaaaaacacttcataaatcacttaacgaaagaagtaatttaattgtgattgtgtttatcgttatttcaacaatgattttcttatttattggaaaaccaatcagccttttaattatagcaggcgcgataaa

SEQ ID NO: 230 - DNA, 2072 bp; double-stranded, linear
gaatcgcactcattgtctgtttgtcatcattataaataggcatatgttgtacctcaaatttctttttaaaaggtactaatatttctttagtgaaaattgaatcacggtcgtttattggtgccttgagtatattattatagacggaatctgatctaataatattgattttatacatgataaacctccttatgttgtcagcataaaggataacgtaacgtgattttcaagcagtaattgtaactaattgamaaaaattaagaaaagtatgtgagtgttcctaawtaatatgattaaaatgatggcgaataagtgtctaaaagcatcttaaagggacattgtatagggtaaatcacttcataaataagggaaaatccttatgttcactttttcacaatcatnataaaatatatatgtagtcaatactttgtctatattgaatgttttcatataaatgaaagcatttttaaataacattgacctctaatatataggcagagtattgatatctattaaaaaataaatgattttgatgaaggtgaaacgtatgtacaaaacaaaaggtggctttcaacttacattacaaacattaagtttagtggttgggtttatggcttggagtataattgcgccattaatgccctttattaaacaagatgtcaatgttactgaaggtcaaatatcaatcattttagcgataccagttattttgggatcggtgctccgtgtgccatttggttatttaacaaacattgttggcgctaaatgggtattctttactagttttatcgtattgttattcccgatatttttcttaagccaagcacaaacaccgggtatgttaatggcttcaggatttttccttggtgtaggtggtgcaattttctcagttggtgttacatcagttcctaaatatttccctaaagaaaaagtaggtctagcaaatggtatttatggtatgggaaatatcggtacagcagtttcttcatttttagcaccaccgatagcgggtattattggttggcaaacaacagttagaagttacttaattattatcgctttatttgcattaattatgttcatttttggtgacacacaagaacgtaaaattaaagtaccattaatggctcaaatgaaamcattatctaaaaactacaaattatattacttaagttattggtattttattacttttggtgcttttgtagcatttggtattttcttacctaactacttagtaaatcattttggaattgacaaagtagatgctggtattcgatcaggtgtattcattgcgctggcaacattcttaagaccaataggtggcattttaggtgataaatttaatgcagttaaagtattgatgattgattttgttgttatgattatcggtgccattattttaggtatttcagaccatatcgcattattcactgtaggctgtttaacaataagtatttgtgcaggtattggtaacggcttaatcttcaaattagtaccatcatacttcttaaatgaagcgggatccgcaaatggtatcgtatcaatgatgggtggtttaggaggattcttcccaccactagtaatcacgtacgtagctaatttaacaggatcaagtcatttagcatttattttcttagcggtattnggangtattgcattatttaccatgcgtcatttataccaaaaagaatatggctcattgaaaaacggttgatatgtaatacatgccattcatttagttaaatacaaagccttaatatcatgcgcaatattcgtagcatgacattaaggctttagtagtgtattcattttaaatttaactatgaaattggaatagatgttgatgaagtagtttcattgcttggtttgattttaggcaaggtaatggttaataacccattttcaaaactagcagtaatatgttgcttatcaacagcttcaaaatcaaattgacgcattaatgattcgaagttacgctcatctaaaatgagttgttcagatttgtattttgcgcttctagtagcttgaatagtgagcgwattattattgaaatcgatactaatatctccctg

SEQ ID NO: 231 - DNA, 3159 bp; double-stranded, linear
cgtcttctcttggttattctctgtgttttgtctttgttcaaattcgattttttgttgttcgaatgaatgtaatactttatttttttttggcacataatccaagtnatttttaggaattaatatacggtctttaaatgcttcttgtattttgctcacaatcaattggtatagttgctcttcttttgataaacgcacttctagttttgttggatgaacatttacgtctactaagattggatccatttcaatattaatataacaaatcgggaacctacctattgttaagagtgtatgatagccttctaaaatcgctttatttagcataaagtttttaatgtatcgtccattaataaaaatagaaatatagtgcttattacttctagaatgttcaggctttgcaacaaaaccttcaatgtgataatcacttgtatctccagatatatgtactaaatctcgtgcaactttcatcccataaatctctgccatcacttcattagttcgtcctgaaccatttgtacttaacattgttttgccatctgaaatgagtgctattcgaatgtccggatggctcattgccattctgttgacaatatctgttattttacctagttcagtgtataaacttttaatatattttaaacgtgctggtgtattataaaataatgattctacaagtatatctgttccttttttcgcttttgcaggcttatgatttaatatttcaccattttctacatatatttcatttccattagcattatccgtgcaagtcttcaatgttactttagcaactgatgaaatactggctagtgcttcaccacggaatcctaatgtcctaatatgaaataaatcttcatcttgatctaatttactagtcgcatgtctatgaaatactaatcctaagtcttccgcttcaattccgcttccattatcgactacgcgaatagattggacgccagattcctctacttcaatgcttatttctgtagcgcctgcatctatagcattttccaacagttctttcacaacagaactcggtctttcaactacttcacctgctgcgattttatttgctaatgaggtttggagttctttaattttccccattttgcaacacctctattttaattgattttgtaattcacttaacttcaccaatgcctcaattggtgtcatattagataaattcaaatttttaatttgtagttcaatctcgcttttttgatcattttcaaacaaatcaaatgatgcytgttcaaagtctttttgagataaagtatcagttgtttcttcaacacttaagtttaaattttcttgattaatttccaggttcattttcgaccatttttaaatttgatatcgatgatttttcaccagcagacgcttcaaactcgcttagaatcacttgtgctctgctaataactttttcaggtaaatcagctaatttcgcaacttgaataccataatatcgtcaactgcaccatctttgactttatgcaagaatataagttcacctttatattcattagcagcgacgtgaacattttttagacttggtaatgcttgatctaatgttgtcaattcatgataatgtgttgaaaataacgttttagcatgtgatgtttcagctacatactctatcattgcctgcgctaaagctaaaccgtcatacgttgaagtaccacgtccaatttcatcgaaaataatcaaactatcctctgttgcataagttaatgccttttgtgcttctagcatttctaccataaacgtactcttacctgaaaccaaatcatctgccgcacctattctagtgaatatttgatcaaatataggtaacactgcctctttacaagggacataagctcccatttgggccattatactaattatggcaacttgtctcatatatgtcgatttaccagacatattcggacctgtaattaaatatataaatgtttcattatctaatcgacaattattaggcacatagtcattataatccattactctttccactactgggtgcctagattccactaattctaatgttttattttcactaaatgaaggcctagtgtaattatatttttgagcaatttctgcaaagctctgtaaacaatctagctctgaaataattttagcttgttgttgtaaacgttcagtatattttttaacttcttcacgtagctgaacaaataattgatattctaattcgatggctttgtcttccgcacctaaaatgatatcttctttttctttaagttcatcagttataaaacgttcagcattcgataacgtttgcttcctcatataaccaaattcacttggttcaaaattttgcaagttggcacgtgttatttctataaaataaccaaacactttattaaagcttattttcaatgattttattcctgtacgttgtctttctttggcttgtaattctgctaaccatgtttttccgttttttgaagcttcaagatattcatctaattgcgtattaaaaccaactttgaatagtccgccatctttaactgaaattggtggttcttctactaaactctgttctaatatatcaagtaaatcatcaaggggttctagttgattaacttgtacaagagtattctgattcatagaatttagtaatgctttaatattcggtatttcagaaatggaatgtttaagttgaattaaatctctcgcattaacatttccgtaactaacacgcccaacaagacgttcaatatcatacacttgattaagatatgttcttaaggtgtctctttctatgaaatgagcactaaattcatcaacgatatctaatcgtgcttcaatttgttctttacttattagtggtctatctatccattgttttaagcggcgtgctcccattggtgttttcgtttcgtccattagccaaagtagcgttcctttttttgattttaatcgaatgctttccgttaactcaaggtttctcttagcataaaaatccattttcatataatctatagctgcatattgaacaacatcctcgatatgcgataaatcacgtttttgtgtatgatgaatataatctagcaataattgtgtcgcttgatacattaatttatgttcagtttgattcacactatagatttctgatgataacgtttccctgactgt

SEQ ID NO: 232 - DNA, 1238 bp; double-stranded, linear
taagcgagaagcaattggtgttatgtatgctagtgataaaccaacaggtgaaagtacaaggtcatttgctgtttatttctctcctgaaattaagaaatttattgcagataatttagataaataaatcatccatccatacattgataaatgattttyagaaattaacaacaaaatcaacaattttaaacatctctgtgattctatttattcgaaatgatttaaaaaataaaacttcaaaaacctaaccttatatttatacgaatacttagaggagcacaaaaatgaataaaaatataatcatcaaaagtattgcagcattgacgattttaacatcagtgactggcgtcggcacaacagtggttgagggtattcaacaaacggctaaagctgaacataatgtgaaactaatcaaaaatactaatgtagcaccatacaatggtgtcgtttcgataggatctggaacaggtttcattgtcggtaaaaatacaattgttaccaacaagcatgtcgttgcaggtatggaaattggtgcacatattatagcgcatcccaatggtgaatataataatggcggattttataaagttaaaaaaattgtccgttattcaggtcaagaagatattgccattctacatgtggaagataaagctgttcatccaaaaaacaggaattttaaagattacacaggcattttaaaaatagcatcagaagctaaagaaaatgaacgcatttcaattgttggctatccagaaccatatataaataaatttcaaatgtatgagtcaacaggaaaagtgctgtcagttaaaggcaacatgattattactgatgctttcgtagaaccaggcaactcaggttcagctgtatttaacagtaaatacgaagttgtaggtgttcactttggtggaaacggccctggaaataaaagtacaaaaggatatggtgtttatttctctcctgaaattaagaaattcattgcagataacacagataaataaatccttacatagataaatgattttaaaaattaacaacaaactcaacaattcaaatcatctctgtgattccatttattcgaaatgattaaaaaaaataaaacttcaaaaagctaacattataattatacaaatacttagaggagcagaaaaatgaataaaaatataatcatcaaaagtattgcagcattggacgatttttaacatccaataactgggtgtcggcacaaccatgggttgaag

SEQ ID NO: 233 - DNA, 6444 bp; double-stranded, linear
tgataagtcatttaaattgtcacctattgacatgacttctttcatttcaatccctaatctttcggcaattgtttctagcgcaatacctttttgtgcatctgaatgcgttatttctatatttcctctcgaagatgatgatatagctaaattcggagaktcagctaaaattttactagctttgtcaattttttctaaatttccatcaaatgctaatattttcataattaattcaccaggtatgttttcaatagcatcataattatcaacaactytcaacgtaccattatctatgcgtctttgaataccatttttaatacgctcaacgtttgcatgttgacctgcacgctcagcaatatctatgtaaatgtctaaatctctttgtggatcttcagtataaatcgcacgactcgtgtatacttgataataaatacctgcatcttttaaaacatttgtaattttgtgtactaacgatttattaaggtgtgaagtgctcattacattgaaagtttcatcacgtacttcagcaccattcaaacaaatatatggtactgttaaatctgtgtcagcaactggtgcttgkgcttcataaaatgctcgacctgtcgcgataacaaccgttatcccttgttcttgagcgtatttaatcgcatcaatattaggttgagaaatttcatgtgctgcattaagtagcgtgccatccatatcagtggctattagttttatcattatgtnacctcgtttcgtaaatntaaaatcttgttcttaaataagratatatactcagcgcacatacttttctattamcatttatatkgtcattaatttatcatataatgtaattctaacaaatnttaattagtatgtactatcgtctaattggtggatttcttattggctcttaagtttttaaaaaatgttgttaataatgtgctacatgcttctttaagtacacctttatcaacaattgcacgatgattaaaattagattgttgcaataaattcattaaactgccactacaaccacctttaggatcatctgcgccatagacgactcttggaatgcgactcattacaattgttcctgcgcacatgacacatggttctaaggttacatataatgtgcaaccttctaaacgccaactacctaacactttggctgcacgttcaattgcaatatgttcagcatgcgccgttggttgttgtagtgtttctcttaaattatgtgctctagcgataacttcatcatctttagtgatgatagcacctataggtacttcgcctagttgagctgcttttttagcttcttcaatcgctaatgtcataaaatatatatcatttgtcatttatgtccagatacctcacttatggtacaatactcaatgtctattttaacatttggagatgtgaatatgaacaaaccttttatagcaattgaaggtcctattggcgtaggtaaatcttcacttgcacacaaattaagtcaaactttagatttttatgaagaaaaagaaatcatcacagaaaatccatttttatcagacttttatgaagatatctctaaatggagttttcaaactgaaatgttctttttatgcaatagatataagcaatttcaagatgtaacacaactaaatcaaggtgtagttagtgattatcatatacataaaaataagatatttgctaaaaatactttgagttctgttgaatttcagaaattcagtaaaatttatgatattttaactgaagatatgattatgccgaatatgattatctttttagatgcagaccttgatgtgttaaaatctagaattgctaaacgtaaccgtagttttgagcatcaaatagaagtgatactgtaagttaaaaaaagattatcgtgagtattatgagtccttacaaagtaatggttcaaatgtagttttaatcgatacnacttctattgattttcttaaaaatgaacaagattacgaagatatattacatattatattacctatgataggagatattaccaatgaataattacggtattccacaaaatgccattataaccattgcaggtacagttggtgttggaaaatcaacactaasgcaagcacttgcagataaattaaactttaaaacgtcttttgaaaatgtcgaacataatccatatttagataaattttacagcgattttgaacgatggagtttccatttgcaaatttacttcttagctgaacgttttaaagaacaaaagcgtatgtttgaatatggtggtggctttgtccaagatcgatcaatttatgaagatgttgatatttttgcaaaaatgcatgaagaagaaggcacaatgagtaaagaagatttcaaaacatattcagacttatttaatgccatggtcatgacaccttattttcctaaacctgatgtaatgatttatttagaatgtaactatgatgaggtcattgatcgtattattgaacgtggtcgcgaaatggaaattaatacagaccctgaatactggaaaaagctatttaaacgctatgacgattggattaatagctttaatgcatgtccagttgtacgtatcaatattaatgaatatgatatccataaggaccccgaatctttaaatcctatgataaacaaaattgctcgaattattcaaacatatcgacaagtagatacacgataaaagactaaagacatagcgtatatgtttatattcaatgtatattccatagatattatcgattattttatcaattctatcgaatacattaattcacatatacactatgtctttctttttaatttaaagcttctaaaatatctgccgcactatttaaaataatatcagcttcatgtaattcttcttttgttgcaatacctgttaatacacctattgccatacctaaatttgcattacttgctgtcttcatatcattagcagtgtctcctactatagctactttctgaggatctacattatattgctcaaataaaggcgataatactttaggatttggcttctcataggcatccgcttcggtagaaatgatcaaatcgaacaacgaggtagcattggtatgtgctaaaaattgttctacaccttttttagtatcactcgtaacaataccaagttgatagccttttgctttcaaatcgataagtgcttctttaacaccttctacccaattaatttcaggaatacgttcatctaccagcttttgacttgttgacttggaccagtcggttgtatcttgtcccgtcacatcattaaatgcctggataatttgttgtaaagatcctgaacccatcactgattttggatcaatagattctttaatgacaccgagttgtcttaaagcagcttctttattatgtactgggaaagtctcaagcaatgattgtacaaatcgtacccctattttttcccaacttctatcaaattcaattaacgtaccatctttatcaaataatatccattccattgatatcaatactcctatttatttatttcgtattatgctgattctatgatattcgttatcccctgaaaatgaactcgtagtattgttctatttaaatattgaattaaatataataataagtgaaatccccttcaatacttaacaataaacattgtaaacttaatttattaccatgcttcgcttcattgaaagggattttagtcatgattaacttttgcatattgttttcatgattatattcaatttttattaatattttggtacaacgactctccaaccatttttatcttctaaagtaccattttgaataccagtatagacgtcgtataatttttgagtaatttcaccagtctcattattattaataacgatttcacgatcttcgtatctcaatgtacccacaggtgaaataactgctgcagtaccactaccaaatacttctgttaactcacctttatcatatgattcgaataattcatcgattgaaacgcggcgctcttcgacttcatatcctaagtttttagctaattcgataatagatttacgtgtaataccaggtaaaatactgccattcaactctggtgtaattactttgccattttcaacgaagaaaatgttcatgctaccaacttcttcgatatatttctgttcaacaccatcaagccataatacttggtcataacctaatttatttgcattagtttgtgctaataaacttgccgcatagttacctgcaacttttgcaaagcctacaccgccacgaacagcacgcacatattcatcttctacatagattttagttggttttaaagtttcaccaccataatatgcacctgaaggagataaaataattaataatttatactgatgtgatgcaccaacgccaagtgccccttctgttgcaaaaacaaatggacgaatatataatgattgaccttccccttcaggaatccaatctctttcaatatcaactaattgttttagcccctctaacaattctgcttcgtctacttgaggcatttctaatcgtgctaacgagttattaagacgcttaaaattttcttcaggacggaaaagtgcaacttccccatctcttttatatgcttttaatccttcgaataccgattgaccataatgaacaccttgtgcagcaggtgaaatttcaataggaccataaggtactatcttcaaatcatgccatcctttatctgcatcataatcataactcaacatataatcagtaaaatatttaccaaaacctagttgagatgtatttggtttttgttttaatgtttctcgtcgttcaactttaactgcttgtgacatggtgattgcctcctaataatattgtataagaatttgtttaacttaaattataacaatccatattttgctgttcaacaaattttctaaaaattcaaaattaattaacagatttctagaaagactatatcttttagtataaacgtattaatttcacagagacaagtaatctgtgttttactaatatactttacatacaaaaaactctttactttaaaatgaactaagctcgcgaattcaataagtataatgaataatattagaattcatgcactagtttattaaaataaagagtaatttaaaatatcattccgtgtattaaagtgaatggaaatgattagttattatttttaacagtatctttttgttcaatagcttctaacattaatttagtcatgctcgctaaatcatatttaggatcaaatccccattcgccacgtgaacagcttgtatcaatagaatccggccaactattagcgataccttgtctaataggatcaacatcgtaatctaatgtaaaattgggatagtattcttgaattgcttcttttaccatctctggatcaaaactcattgcgctcaaattataaccatttctagtttctaatttagcgtcgtctgcttccataagtttaataattgcttcaattgcatcatccatatacatcatatccatatacgtgcctttatctatgaagcttgtataatgaccctctcttactgctttgaagtatatttcaacagcatagtctgtagtaccgccacctggctctttaacatgcgagattaaacctgggaatctaacacttcttgtatctacaccaaaacgtttgaaatagtattgacacaataattctccagctactttatttacaccatacattgtcgtaggttgctgaatcgttacttgtggcgtattaactttaggagttgagtctccaaatgcaccaattgaacttggtgtgaaaaagtgcaaattataagttcttgcagcttctaatgcattcattaatccacccatatttaaatcccaagctagaattggatttttctcagcagttgctgataataatgctgccatatgcattagactatccgcttcaaagtccctaactaactcaaacatacggtcacgatctgttacgtctaagatttcaaatggtccattttgtacaggtgagtctgcttcaggttccctaatatctgtagcaagaacattatctgtcccataaatttctctgcacttaacaactaattctgtaccaatttgtcctaatgcaccagtaatcataatttttttcatagaaatatctcctttgtctcttctatatagctatagtccatcacaagcggacataatattcattttcataataattataatataaaagcgctttcttgtatatatgacatgtacatgttgctgatatktctgtaaatggaaattctagttgtattaattgattttagtaatttatagcgtttattattgctaattactgtcaaattaaattttttatccctcaactcttaaactctggatatctttcattatattagcttttttataaccatggatatcatgtaaagccttataagcnttaaataatgtttcatacctttgtacttnttccgcttctggatt

SEQ ID NO: 234 - DNA, 4721 bp; double-stranded, linear
gcccatgagacaattttacttgcttttcccattggttatcacgttcttattacatagatttaaaccgagaaatattattcaaacgctatttattgtatcgttgatttctttaggacttatgatagtgattcatttcatcactggagataattcacgtgtgtattttgggacagatacacgactgcaaactttattgcttggttgtatattagcatttatttggcctccgtttgctttgaaaaaagatatttctaaaaagattgtcgtatcattagatattatagggatatctggttttgcggttctaatgactttgttctttatagttggagaccaagatcaatggatctataatggaggattttacattatatcatttgcaactttattcattattgcaattgcggtacatccttctagtttatttgctaaatttttaagtatgaaacctttactaattataggtaaacgatcatatagcttatacttatggcattatcctatcattgtttttgtgaacagttattacgtacaaggacaaataccggtatacgtttatattatagaaattttgttaacagcgttaatggctgaaatttcgtatcgctttattgaaacacctatacgtaaaaaaggatttaaagcttttgcatttttacctaaaaagaaggggcaatttgctagaacagtgttagttatcctattattggttccgtctatcgttgtgctcagtggacagtttgatgcacttggcaaacaacatgaagccgagaagaaagagaagaagacggaatttaaaacaacgaagaaaaaagtcgttaaaaaagataagcaagaggataagcagacagcgaatagcaaagaggatattaaaaagtcatcaccactattaattggtgactcggtcatggtggatattggtaatgtctttactaagaaaataccaaatgcacaaattgatggtaaagttggacggcaactcgttgatgctacaccaattgtgaaatcgcaatataaagactatgctaaaaaaggtcaaaaagttgtagtagagcttggtacaaatggggcatttacgaaagatcaattaaatgaactattggatagttttggaaaagcagacatatatttagtttctattagagtacctagagattatgaaggtagaataaataaattaatttatgaggcagctgaaaagcgctctaatgtacatctagtcgattggtataaagcttctgcaggtcatccggaatactttgcatatgacggtattcacttagaatatgcaggtagtaaagcgctgactgatttgattgtaaaaacgatggaaacacatgctacaaataagaaataatttgatgcactaaacttttgaaatattacattacttctgatatttattatcaaaaatgatgtatttcattaaaagtttagtgcttttttattttcaaatcccatagtaacggtgcagaaaaagtgttgtaaacattctaattggtatattacattcaatgaagctttattaggaacagattacattatgataacaaagcccgcaagacacctaatctctgttatagtttgttttgtcgcaaaactataaaagttataattgtttgcatactaaaaaaataaaaaatataaaatttaaaataattgagtcgctaatgactatatgtatagagtgttttgattattgggaggatatttaattatgaaaaaaatcgttacagctacaatcgctacagcaggacttgccactatcgcatttgcaggacatgatgcacaagccgcagaacaaaataacaatggatataattctaatgacgctcaatcatacagctatacgtatacaattgatgcacaaggtaattatcattacacttggacaggaaattggaatccaagtcaattaacgcaaaacaacacatactactacaacaactacaatacttatagttataacaatgcatcttacaataactactataatcattcatatcaatacaataactatacaaacaatagtcaaacagcaacaaataactattatactggtggttcaggtgcaagttatagcacaacaagtaataatgttcatgtgactacaactgcagcgccatcttcaaatggtcgttcaatttctaatggttatgcatcaggaagtaacttatatacttcaggacaatgtacttattatgtatttgatcgtgttggtgggaaaattggttcaacatggggtaacgcaagtaattgggctaacgcagctgcatcatctggctatacagtgaacaatacaccaaaagttggtgctatcatgcaaacaacacaaggctattacggtcatgttgcttacgttgaaggcgttaacagcaacggttctgttcgtgtttcagaaatgaactatggacatggtgctggtgtggttacgtctcgtacaatttcagcaaaccaagcaggttcatataatttcattcattaatcaaatgtaaatcaaatgacgtcaatattctctaacatgagagtattggcgtttttgttttatataaatataaatgagagcggtttattcactgatctttagggaactaagtaataaagtgataatttatactatgtcagtatgattgagagtgattcaatttagatgaaaaccatgaaaaaatatattaaaacagcatttttttgtagtatgtattggttaattgttcaactaaatatagcaaatttaggtacaagaattcctgataagtattttcgtcagaagtacataatatttaaatcatttaactttgagaagcatggaaaattttggaacaaatggttttacgtaagaaaatggaaacataagattttagatggtcatcagcttaatcaaaatatatatgatcagcgtcatttaatgacaatcaatactgatgaaattgaaaaaatgattatagagacaaagagggcagagttgattcattggatatcgatacttccagtcatcatattcaataaaggccctcgtttagtaaagtatataaatattttctatgcaatgatagctaatgttccaatcattattgtgcaacgctataatcgaccgagattaacgcagttactacgcatattaaaacgaagaggtgaacgtcatgactaaacatatcatcgttattggtggtggcttaggtgggatttctgcagcaattcgaatggcacaaagtggctattcggtctcattatatgaacaaaataatcatataggaggcaaagtgaatcgtcatgaatcagatggctttggctttgatttaggtccatctattttaacgatgccttatatttttgaaaaattattcgaatatagcaagaagcaaatgtcagactacgttacaatcaagcgattgccacatcaatggcgtagcttttttccagatggaacgactatcgatttgtatgaaggtattaaagaaacaggtcagcataatgcgatattgtcgaaacaggatatagaggaactgcaaaattatttgaattatacaagacgaatcgatcgtattactgaaaaagggtatttcaactatggtttagatacactatctcaaattattaaatttcatgggccattaaatgctcttattaattatgattatgtacatactatgcaacaggccatagacaagcgtatctcgaatccatacttgcgacaaatgttaggctattttatcaaatatgtaggttcttcatcatacgatgcgccagctgtattatctatgttattccatatgcaacaagagcaaggcctttggtatgtagaaggtggaatccatcatttagccaatgccttggaaaagctagcgcgtgaagaaggtgtcacaattcatacaggtgcacgtgtggacaatattaaaacatatcaaagacgtgtgacgggtgtcagattagatacaggtgagtttgtaaaggcagattatattatttcaaatatggaagtcatacctacttataaatatttaattcaccttgatactcaacgattaaacaaattagagagggaatttgagccggcaagctcaggatatgtgatgcatttaggtgttgcttgccaatacccgcaattagcacatcataatttcttttttacggaaaatgcttatctcaattatcaacaagtttttcatgaaaaggtattgccagatgatccgaccatttatctagtaaatacgaataaaactgatcacacacaagcgccagtaggttatgaaaatatcaaagtcttaccacatattccatatattcaagatcagccttttaccactgaagattatgcgaagtttagggataaaattttggataaattagaaaaaatgggacttactgatttaagaaaacacattatttatgaagatgtttggacaccggaggatattgaaaaaaattatcgttctaatcgtggtgcaatatatggtgttgtagcagataaaaagaaaaacaaaggatttaaatttcctaaagaaagtcagtattttgaaaacttgtactttgtaggtggatcagtaaatcctggtggtggcatgccaatggttacattaagtgggcaacaagtcgcagcaagataaacgcgcgagaagcgaagaataggaagtgatatctatgaaatggttatcacgaatattaacagtaatagtgaccatgtctatggcgtgtggtgcattgatatttaatcgtagacatca

SEQ ID NO: 235 - DNA, 3516 bp; double-stranded, linear
tattcgtgcgcaatgggctaaattaggtctaggtttagattatagtagagaacgttttactttagatgaaggtttaagtaaagcagttaaaaaagtttttgttgatttatacaataaaggaattatttatcgtggcgaacgtattataaattgggatccnaaagcacgtacagctttatctgatattgaagtaatacatgaagatgttcaaggtgcgttttatcattttaaatatccttacgctgatggtgaaggttttattgaaattgcaacaacaagaccagaaacgatgttaggtgatacagcgattgttgttaaccctaatgacgaacgatacaaagatgtaatcggtaaaactgttatattaccaatcgtaggacgcgaactgcctattttagcagatgagtatgttgatatagacttcggttctggtgctatgaaagtgacaccagcacatgaccctaatgattttgaaattggtcaaagacatcaattagaaaatattatcgttatggatgaaaatggtaaaatgaacgacaaagcgggtaaatatgaaggtatggaccgttttgattgtcgtaaacagctagttaaagatttaaaagaacaagatttagttatcaagattgaagatcatgttcattctgtaggtcattcagaacgatctggcgctgttgttgaaccatatttatcaacacaatggtttgtgcgcatggaagacttagcgaaacgttcattagataaccaaaaaacagatgatcgtattgatttttatccgcaacgtttcgaacatacatttaaccaatggatggaaaatattagagattggacgatttcaagacaattatggtggggtcatcaaattccggcttggtatcataaagaaacaggcgaaatatatgttggagaagaagcgccaactgatattgaaaattggcaacaagatgaagatgtattagatacgtggttctcaagtgctttatggcctttctcyacgttaggttggcctgatttagaaagtgaagactttaaacgatactacccaacaaatgccttagttacaggttacgatattatctttttctgggtagcacgcatgatattccaaggcttagaatttacagatcgtcgtccatttaatgatgtattattacacggtttagttcgtgctgaagacgggcgtaagatgagtaaatcattaggtaatggtgtggatccaatggatgttattgacgaatacggtgctgatagcttgcgttacttcttagcaacaggttcatctccaggacatgatttaagatactcaactgaaaaagttgagtcagtgtggaactttatcaataaaatctggaatggggcacgtttcagtttaatgaatatcggtgaagactttaaagttgaagatatcgatttaagtggtaacttatcattagcagataaatggattctaacacgtttaaatgaaacgattgcaacagttactgatttaagtgacaaatatgaattcggcgaagttggacgtgcattatataatttcatttgggatgatttctgtgattggtacattgaaatgagtaaaattccaatgaatagtaatgatgaagaacaaaaacaagttacacgttcagtattgagttatactttagacaatattatgagaatgctacatccattcatgccatttgtaacagagaaaatatggcaaagtttaccacatgaaggtgacacaattgttaaagcttcatggccagaagtgcgtgaatcattgatttttgaagaaagtaaacaaacaatgcaacaacttgttgaaatcattaaatctgtaagacaatcacgtgtagaagtaaatacgccattgtctaaagaaatacctattttaattcaagctaaagataaagaaattgaaacaactttatcacaaaacaaagattatttaatcaaattctgtaatcctagtaccttaaatattagctgacgtggaaawtcctgagaaagcaatgacatcagttgtaattgcaggtaaagtggtattaccattagaagggctaattgatatggataaggaaatcagccgtttggaaaaagaattagctaaacttcaaagcgaattagatagagtagataaaaagctctctaatgaaaactttgtaagtaaagcacctgaaaaggttataaatgaagaaaaacgtaaaaaacaagattatcaagaaaaatatgatggtgtgaaggcaagaattgaacaattaaaagcataggagttagtaacaatgaattacctagagagcttgtattggatacacgaaagaactaaatttggcatcaaaccaggtgttaaacgtatggaatggatgctagcacaatttaataatcctcaaaataacattaagggtattcatgtaggtggcacaaatggtaaaggctctacagttgcttaccttagaacagctttagttgaaaatggttatgaagtaggtacatttacgtcgccgtttattgaaacatttaatgaacgaattagtctaaatggtgtgccaatatcaaatgacgctattgtagaattagtatcacgtattaaaccagtaagtgaaatgatggaacgtgaaacagatttaggtgttgcaactgaattcgaaataatcacagcgatgatgtttttatattttggtgaaatacatcctgttgattttgtcattgttgaggctggattgggtataaagaacgattcgacaaatgtctttacaccggttttatcaatcttaactagtatcggtctagaccatacagatattttaggtggtacttatctagatattgctagggataaaggcgcgattataaagcctaacgttccagtgatatatgctgttaaaaatgaagatgcattaaaatatgttcgtgaacgcgcaattgaacaacatgcaaagccaattgaattagatagagaaattgttgttgtatcgcaaaatgatgaatttacttaccgttataaagattatgaattagaaacaatcattttaagcatgttaggtgaacatcagaaacaaaatgctgcattagccataacagctcttattgaattaaatgaacaaggattaattgaattagatttcaataagatgatagacggtattgaatcagttcgttggactggacgtattgagcaggtgcatgacaaacctttaatcattttggatggcgcacataattcagagagtatagatgctctaattgatacaattaaacagtaccatgataaagaaaaagtagatattttgttctcagcaataaacggaaaaccgattaacgagatggtcaaacatttaagtttaattgcgcatacgttttatgcaactgaatttgattttccgaaagcgttacgcaaagaagaaattgtaggtagtattgaaaatgatgaaatacaattagtagatgactacgttgaatttataaaaaattatcaaggtgatacattagtaattaccggtagtctgtatttcataagtgaagttaaatcaa

SEQ ID NO: 236 - DNA, 7481 bp; double-stranded, linear
tgagtgatagaatcaaaaaagccatctcaaaaattaatcaagcaaacaacattccaaacaatgstcgcaaatcaccaatgtatcactctccaattacgtaactatgatttaatttaagcatagttattgaggttttgtgatatatagtataaaattaatgagaattaaatttaataatgtaaaattcatmttcggggtcgggtgtaattcccaaccggcagtaaataaagcctgcgacctgctagtatgtatcatattagtggctgatctagtgagattctagagccgacagtatagtctggatgggagaagatggaggttttttgttgtgcaataatcctcctattcttacgagatgaatggaaggagaaaattgaatatgcaacaaaataaacgtcttatcacaataagtatgttgagcgcgattgcgtttgtgttaacttttatcaagtttcctataccatttttgccaccatacttaactttagattttagtgatgtaccgtcactactagctacatttacgtttggaccagttgccggtatcgtagttgcactggttaaaaatttattgaactacttatttagtatgggcgatccagttggaccatttgctaactttttagcaggcgcaagtttcttattaactgcttacgccatctataaaaataaacgttcaacaaaatctttgattactggattaatcattgcaacaatcgttatgactatcgtgttgagtattttgaactatttcgttctattacctttgtacggtatgatatttaacttagctgatatcgcaaataatcttaaagtaatcattgtttcaggaattataccattcaatattattaaaggtatcgttatttctattgtatttattttactatatagaaggcttgcgaatttcttgaaaagaatttaatcaaattaaagcaaaataatatacacataataataaaaagcaggtgactatcaataaacgatagcttgcctgctttttctatagaacatttgtctaaaaaatcaattattcaaattttaaagcgtccccatcaaatgattcgtctgcaattttaatagaatctgtagggcatccatcaattgcatcttccatatcttcatataattcctcaggtacttctgcagtaccttggttatcgtcaaggattacgaaagcaataccttcgtcgtcgtaatcatatatatctggcgctgctgcaccgcatgcaccacatgcaatacaagtatccatatcaacgattgtatattttgccaatgtcttcgcctcctttgataaaaatgctaaaatagtaatgtgactaaaattttagacagcatcatttttattttcaaattatccgttttacagagtgagggttaaatttgcaacacattataaaaacagcattacaacaaacatttaactataaaacaaataaaagtatttacaatatcttagttggtaagaaatctcaccaaaccttttttgacgcttgtagtcaacaacagttgtcattatatcacagtttaccactattaaaatatccgtcttttgagctatttttagaaaaaatcaatgaatttaatgctgaaatggaaatcatgttgcatcctagatatacatttgaaagcatggggcaaacatttcaagcaattcaactattagtgcaaaccatgtctaataccaaacaacatgtttttcattttgtaccaatctctcaaaataataagatacamgaaactgtaaagattgtctataactacattaaagaaaaccaattacaaattgattttgaaaatgaactacataacttgtttaaagcaataactttaaaagggccatgttacttacattattatttgcaaggctatgatgaaccaatgtatacgagacagcaagttagtttaatagaaaagctatctcaacagcaattgtttgaatacgaaatgaataatttagtgacaatgatgtttgaattagaaagtggagaatatactattttatcaaaaataataatgaaacctacattattaaatcaaacttatattacttatacaaaattgcttgaacaattcacgatggaagatatagcggctcaacaacaagttaaaatcaatactatcgaagatcatgtacttgaaatcttaatcaaaggttacatgtctaattacgatgattatgttgaactagaagatcaactccagtttttgaatttttatcaacagcatcgtggcgaacgattaaaattttacaaagaacaatttgacacgttatcatattttcaattaaaagtattaatcgttggatttgaaagaggtgatctgaatgttgcatgatattttacgaaacaaatttggattcgagagttttaaaccgggacaacaggaaattatagaaagtataatgtctcaacaacacactctaggtatacttccaactggaagtggaaagagtttgtgttatcaaatacctacgtatttatcaggtaagccgacattaattatctcaccgttaatatctttaatggatgaccaagttatgcagttgaaaataaatggagaaaaacgtgtaacatgtattcactctggtatggatgaaattgagaaaaagcataatattaaatgtttacgacatagccgcttcatctttctaagtccagaatttctcctgcaaccgtcaaattttaaattaatatctatgatagactttggcatgattgttctagatgaagcacattgcctatctgaatggggatatgatttcagaccacattatgctctaataggaaaagtaacaaagcattttaaagaagcggttgtcttagcattgacagcaactgcaccaccgcatttacaagatgatttgacggaaatgttagcgattcaattcaatgttattaaaactacaatgaatcgcccaaatataagctttaagcatcttaattttcatgatgatgaagataaaattgaatggttgctgccgtttctacaacagtcgggaccaacgattatttatgtctcatcgaaaaagatgtgtctgaatttagcgcaacttatttatgattcaggttttcttacaggtatttatcatggtgatatgaattatcaagagcgacacacagttcaacaacaatttttaaataatgatattccgattatagtcgcaacgagtgcttttggtatgggaattaataaaaaagatattcgcacaatcattcactttcatctttcaacaagtccttctaactacattcaagaaattggccgtgcgggtcgcgatggtgaactaagtcaggcaattagtttattccaaccggacgataaatatattttagaaacgttattatttgcagatatgataacagaagaagatgtacaaaatttcgaaataggagaatttttagctcccgataaacaagccgttttgacaacgttgcaatcattctatagtatcggcgccttgaaacagatatttaagcaatcatttaaacgaaagcaattaggattctttcgcatgattggctattgcaaattggatcaatgtagacggaagtatttattagaatttttcggtgaatatccaccggcacaagatcgatgttgtgacaatgattctaatataactgatatcgcaattttaaataagaagaaggtaattagaagtattggatttgatgaaaagttgcaaaatttatttctcagatagtattactttactaaaagaaaattgacaagctataattagtgtatacacaattgaaaaatgattgaaataattttgaaaaatatacataaacatatgtcatgtgggtatattttatgtaaaatcattgtaatagaatagaaaggaagatggctatgtctaataattttaaagatgactttgaaaaaaatcgtcaatcgatagacacaaattcacatcaagaccatacggaagatgttgaaaaagaccaatcagaattagaacatcaggatacaatagagaatacggagcaacagtttccgccaagaaatgcccaaagaagaaaaagacgccgtgatttagcaacgaatcataataaacaagttcacaatgaatcacaaacatctgaagacaatgttcaaaatgaggctggcacaatagatgatcgtcaagtcgaatcatcacacagtactgaaagtcaagaacctagccatcaagacagtacacctcaacatgaagaggaatattataataagaatgcttttgcaatggataaatcacatccagaaccaatcgaagacaatgataaacacgatactattaaaaatgcagaaaataacactgagcattcaacagtttctgataagagtgaagctgaacaatctcagcaacctaaaccatattttacaacaggtgctaaccaatcagaaacatcaaaaaatgaacatgataatgattctgtaaaacaagatcaagatgaacctaaagaacatcataatggtaaaaaagcagcagctattggtgctggaacagcaggtgttgcaggtgcagctggtgcaatggctgcttctaaagctaagaaacattcaaatgacgctcaaaacaaaagtaattctggcaaggcgaataactcgactgaggataaagcgtctcaagataagtctaaagatcatcataatggcaaaaaaggtgcagcgatcggtgctggaacagcaggtttggctggaggcgcagcaagtaaaagtgcttctgccgcttcaaaaccacatgcctctaataatgcaagccaaaaccatgatgaacatgacaatcatgacagagataaagaacgtaaaaaaggtggcatggccaaagtattgttaccattaattgcagctgtactaattatcggtgcattagcgatatttggaggcatggcattaaacaatcataataatggtacaaaagaaaataaaatcgcgaatacaaataaaaataatgctgatgaaagtaaagacaaagacacatctaaagacgcttctaaagataaatcaaaatctacagacagtgataaatcaaaagaggatcaagacaaagcgactaaagatgaatctgataatgatcaaaacaacgctaatcaagcgaacaatcaagcacaaaataatcaaaatcaacaacaagctaatcaaaatcaacaacagcaacaacaacgtcaaggtggtggccaaagacatacagtgaatggtcaagaaaacttataccgtatcgcaattcaatactacggttcaggttcaccggaaaatgttgaaaaaattagacgtgccaatggtttaagtggtaacaatattagaaacggtcaacaaatcgttattccataatataactatataaattgtaactgaactgctatatacaaacgtgcatattataagtatctctaaatattttggagaacttaaattgcgcttataagtatgtagcggttttttcatttttcaaagtttgttatttaacaaggtcttgtctcgaatattggcatatcaatttaactttttaaatagtcatcaaaaagataaaacaccacaatcaacaaatttaacgaggaagaataaaaaataaatcaacatattaaattgtagtgttattcaactccgtagctaacaattctctattcacattaaacaaattgtcaaaaatatatcataaatcttcaagcacagacttagcgcatcaatcactgaactgttataatagtttgggattaaaggaggccgaaacaatgcaaaaagttgaaagtatcataattggtggagggccatgcggattaagtgcggctattgaacaaaaaagaaaaggtattgataccttaattattgaaaagggtaatgtcgttgaatcaatctacaattatcctactcaccaaacatttttctcatcaagtgataaattaagtattgggcgagtaccgtttatcgttgaagaaagtaaaccaagacgtaatcaagcgctagtttattaccgagaagttgtaaaacatcatcaattaaaagtaaatgcatttgaagaagtattaactgttaaaaaaatgaataataaatttactattactacgacgaaagatgtttatgaatgtcgatttttaacaatcgcgacaggctattatggtcagcataatacattagaagttgaaggtgcggatttacctaaagtgttccattattttaaagaggcacatccgtattttgatcaagatgttgtaattatcggtggtaagaattcggctatcgatgctgctttggagttggaaaaagctggtgctaacgtgacggttctatatcgtggtggagattattcgccttcaattaaaccgtggatacttccaaatttcacagcattagtaaatcatgaaaaaattgacatggaatttaatgctaatgttacccaaataactgaagatactgtgacttatgaagtaaatggtgaaagtaaaacgatacacaatgattatgtatttgcgatgattggttatcatcccgattatgaatttttaaaatctgtaggcattcaaattaatacaaatgaatttggaacagcgcctatgtataataaagaaacatacgaaacaaatatcgaaaattgctatattgcaggtgtaattgctgcagggaacgatgcgaataccatttttattgaaaatggtaaattccacgggggcattattgctcaaagcatgctagctaagaaacaaacgcccttagaatcataaaaataaaggtctatgtactaaataacttagttttacaacgactgacattcatgatatgtcaaatgaggttgatgactattgattgtacatagacctttttatgttacgtattcattataattcaaaatatgatttgatttcagctttatctaaattgttgcttaacgcgactaataattttaatcttgcttttggaccattcaagccgttagaaaaaataaaaccttgttgtgcgagttggtaaccaccaccatcgtatgcgtaagttggactcacaataccattaaaggaacgtgaaactagcacaataggtatatttaaagatactaattgttgaatgccttctaatgcgcttggaggtatgttgccttgtcctaacgcttcaataaccataccatcgataccttctcgactataaaaactaaaaatgtcacctggcatacccatatatgcttttactaatggtacatttagtttgtcattgacattttccaatgcttgttggcgatatggcatatgatggaattgcacacgatcctttgtcaatacacctagcggaccatgatttggactttgaaatgtgtttgtattagacgtatgtgttttggtaacattacgcgccgtatgaatttcatcattaaatacaaccatcacgcctttatgacgggccttttcatcagaggcaacgcgaatagcggaaatataattatataatccgtcagaaccaatttcattagacgagcgcattggccaagaantaacaacaggttg

SEQ ID NO: 237 - DNA, 6346 bp; double-stranded, linear
atgaattataccttccactagaagtgtcggtatttatgtgcctggtggtaaagcaagttatccttcaacggtattaatgacagcgacgttagcacaagtagcaggtgtggaaaatattgtcgttgtgacaccacctcaacctaatggtgtgtctcaagaagtattagcagcatgctatattacgcaagttgatcaagtatttcaagttggtggtgctcaaagtattgctgcgttaacttatggcacagaaacgatacctaaagttgataagattgtaggtccaggcaatcaatttgttgcatatgccaagaaatatttatttggacaagtaggtattgaccaaatagctggaccaacagaaatagcacttattattgatgaaacagcagatttagatgccatcgtatatgatgtttttgcacaagcagaacatgatgaattagcacgtacatatgccattagtgaagatgcgcaagtccttaaagatttagaatcacgtattgctaaagcattgcctaatgtggacagatacgacattgtttctaaaagtatcgctaatcaacactaccttatccatgctagtaattttgatgaagcatgccatgtcatgaatacaatcgcgcctgaacatgcgtcgattcaaacagtaaatcctcaaccatatattgaaaaagtgaaatatgtgggtgcattgtttattggacattattcgccagaggtcataggagattacgttgcaggtccaagtcatgtattacctacaaatagaacagctagatttaccaatgggttatcggtcaatgatttcttaacacggaacacggtcatccatttatcaaaagatacgtttgaacaaattgctgattcagcacaacatattgctcatgttgaagcattatacaatcaccagcagtctattttaatacgtcagtcttaggggagtgtaattgaaatgatttatattgataaaaatgaaagtccagttacgccgttggatgaaaaaacaatgacgtctattattagtgcaacgcnatataatttatatcctgatgcagcatatgaacaattcaaggaagcttatgctaagttttacggattatcgcctgaacaaattattgcaggaaatggatctgatgaattgattcaaaagttaatgctgatcatgccagaaggtccggcattaacgctaaatcctgatttttttatgtatcaagcatatgcggcacaagtaaatcgtgaaattgcatttgtagatgcaggatcagatttaacgtttgatttggaaaccattttaacgaaaatcgatgaagtacaaccatcattttttattatgagtaatccacataacccttcaggcaagcaatttgatacggcatttttaacagctattgcagataagatgaaagcattaaacggatactttgtcattgatgaagcatatttagattatggtacggcatatgacgtggaactggcaccacacatcttaagaatgcgtacattatcaaaggcgtttggaattgccggcttaagattaggtgtcttaattagtactgctggaacgataaagcatattcaaaaaatagaacatccatatccattaaatgtatttacgctaaatattgcgacttatatttttagacatagagaagagacaagacaatttttaacgatgcaacgacagttagctgagcagttaaaacaaatatttgatacacatgttgcagataaaatgtcagtgttcccatcaaatgctaattttgtacttactaaaggctcagcagcgcaacaattaggacaatacgtatatgaacaaggatttaaacctcgcttttatgatgagccggtgatgaagggctatgtaagatactcaattgcaacagcatcacagttaaagcaattagaagaaattgttaaagaatggagtgcaaaatatgatttatcaaaaacaacgaaacacagctgaaacgcaactaaatatttcaatatctgatgatcagtcaccatcgcatattaatacaggtgtgggctttttaaatcatatgttaaccttgtttacatttcatagcggtctgtcattaaacattgaggcacaaggtgatattgacgtagatgatcaccacgtaactgaagatatcggcattgtcattggccaattgttacttgaaatgattaaagataaaaagcatttcgttcgttatggaacgatgtacattccaatggatgaaacattagcacgtgtcgttgtggatataagtgggcgcccatacctatcattcaatgcatcattaagtaaagaaaaagttggtacgtttgatacggagttagtagaagaattttttagagcggtcgtaatcaatgcaagattaacaacgcatattgatttaattcgtggaggtaatacacaccatgaaattgaagctatattcaaagcgttttcccgtgcattaggcatagcgctaactgcaactgatgatcagcgtgtgccgtcatcgaaaggtgtgattgaatgattgtcatcgttgattatggattagggaatattagtaatgtaaaacgcgctattgaacatttagggtatgaggtggttgtctcaaatacctcaaaaataatcgatcaagcagaaacaatcatattgcccggtgtcggccattttaaagatgcgatgtcagagataaaacgattaaatctcaatgcaatattggctaagaatactgataagaagatgattggtatttgtttaggcatgcaattaatgtatgagcatagtgatgaaggcgatgcatctggattagggtttatcccaggaaatatttcgcgtatccaaacagaatacccagtgccacacttaggctggaataatttagtgagtaagcaccctatgttaaatcaagatgtttatttcgtacattcttatcaagcgccgatgtcagaaaatgtaattgcatatgcgcagtatggggctgatattccggcaattgttcaatttaacaattatattggtattcaattccatcctgaaaaaagcggtacatatgggttacaaattttgcgtcaggcaatacaagggggatttataaatgattgaattatggccagcgattgatttgattgggtcaacaagtgtgaggttaacagagggtaaatatgatagtgaagaaaaaatgtcacgctcggctgaagaaagtattgcttactatagtcaatttgaatgtgtgaatcgtattcatatcgtcgacttgataggtgctaaggcacagcatgcccgagagtttgattatattaagtcattgaggagattaacaaccaaagatattgaagtaggtggtggcattcgtacgaagtcacaaatcatggactactttgccgcagggattaattattgcatagttggaacgaaaggtattcaagatactgattggcttaaagagatggcacatacatttccaggtcgcatttatttatctgttgatgcctatggagaagatattaaagtgaacggatgggaagaggacacagagttaaatttatttagttttgtgagacggttatcggatatacctcttggcggcattatatatactgatattgctaaagatggcaaaatgtccggacctaactttgaattaactggtcaattagtaaaggcaacgacgattcctgtcattgcttccggtggtattagacatcagcaagatattcaacgattagcgtcgctaaatgttcacgctgctattataggaaaggctgcacatcaagcatctttttgggaggggctaaaatgattaaaaaacgtatcattccatgtttagatgtcaaagatggtcgtgtcgttaaagggattcaatttaaaggattaagggatattgggaatcctgttgatttagcaatgtattacaatgaagcgggtgctgatgaattagtatttttagacatctctaagacggaagagggtcatagcttaatgctagaagtgattgaacagacagcgtcacgcttgtttatccctcttactgtagggggtgggattcaaagtctcgatgatattacccaattgctaaatcatggtgcagataaagtatcattaaattcaagtgctttaaaaaatccacagctcattaaacaagcgagtgataaattcggtagacaatgcatctgcatagcaattgatagctattatgatcctgaaagaaaagcacattattgttgtacgactggtggtaaaaaaatgacaaatattaaagtatatgactgggtacagcaagtagaacagttaggtgcaggtgagctcctcgttacaagtatgggacatgatggtatgaaacaaggctttgatattgaacacctagcaaatattaagtctcttgtaaatattccaatcattgcttctggtggtggtggcaatgcacaacactttgtagaattatttgatcagacggatgtttctgcaggtttagctgcaagtatattacatgatcgagaaacgacggttcaatctattaaagaagtgatacggcaagggggtatagcagtaagatgaccaaatataaaattgattttagcaaaggtttagtgccagcaattttacaagataatcaaacaaaacaagtattgatgttgggttatatgaaccaagaagcttttgataaaacgatagaagatggtgtggtatgtttctattcgcggtcgaaacaacggctatggacaaaaggtgaaacatctggtcatacgcaacgtgttaaagatattcatgtagattgcgacaatgacactattttaattgatgtcataccaaatggaccaacatgtcatacaggcagtcaaagttgtttcaacacagaagttccattttcagtgcaaacattagcgcagacagttcaagatagtgcccaatccaataatgaaaagtcatatacaaaatatttattaacagaaggtatagaaaagattacaaaaaaatacggtgaagaagcttttgaagtcgtaattgaagcaattaaaggtgacaaaaaagcatttgtaagtgaagtagcagatgaactttatcatttatttgtcttgatgcatgcgcttggcgtcgatttttcagaaattgaggcggaattagcgcgtagacatcataagcgcaataactttaaaggtgaacgacaaaatatcgaacagtggtaaagcaagtatggactaagatataaggaaaaggatcatggcttatacacttacaaatattgtggaaaacgtgacattttcaagtttaaaatacgacaccaacatattttaactatgaatgctgtgatggtactaaagttgcgaactcgttatagataagtagtggataatcacaatacgaaatcaaaaataattataaaaagtaaattgagcaactcaggaatagatgtcactgttaaagatgtcgaaaagtatatgaatcgatataatgaagttatgaagggaaaaaatggcgaaaaagctaaagagttatgtttgtcgttactacctattaatatcatagttgtctttacattctttgtatttatactataaatacaaatatatctagcctgaaatagaaatgtcatagcctatttaaaagacaatctccattagaactaagatatgcatcccgaaagttagactaaaaaactaactttatgggatgtatttttatgctaatcatcataaattcgagattaagttaaaggtagttcaagagtaattaaacaataaatwaaaaatagtaggatacttactttgagggaagaaaattaactgtatatatttagtttaggaacaagtattacggtttatcctgatacaattattgtggatgggatgatatttttaggtttaaaatacgacaccagcaaacataataactgtaatagctcataaatctccccatatagctaatctaaaaaaataatacatcattggaattaagccccaagcatgtaaatattaaaaatcaaaamagatatmtgtaaaaaagttacaatttgcataattaaattgtgtctaattattgactaattaaattttgccaaatataatattaattaataatttgaaatgattagcgtatacactttaaattctctttggagaatatattttttaaatacaaatgtaaacgctttctcgtcaaattaaacaatagaaaggatggtcattatgagtgcttggttaagtaaattatttgagtttattcctcgaataattatcaatttgtttatctaaaataaaaaaatagaggtgctgacaatgatgaaaagtcaaaataagtatagtattcgtaaatttagtgtaggtgcatcttccattttaatagctacattactatttttaagtg

SEQ ID NO: 238 - DNA, 3775 bp; double-stranded, linear
tgataatgattctcattgtcatacatcacgaaggaggctaattagtcaatgaataaagtaattaaaatgcttgttgttacgcttgctttcctacttgttttagcaggatgtagtgggaattcaaataaacaatcatctgataacaaagataaggaaacaacttcaattaaacatgcaatgggtacaactgaaattaaagggaaaccaaagcgtgttgttacgctatatcaaggtgccactgacgtcgctgtatctttaggtgttaaacctgtaggtgctgtagaatcatggacacaaaaaccgaaattcgaatacataaaaaatgatttaaaagatactaagattgtaggtcaagaacctgcacctaacttagaggaaatctctaaattaaaaccggacttaattgtcgcgtcaaaagttagaaatgaaaaagtttacgatcaattatctaaaatcgcaccaacagtttctactgatacagttttcaaattcaaagatacaactaagttaatggggaaagctttagggaaagaaaaagaagctgaagatttacttaaaaagtacgatgataaagtagctgcattccaaaaagatgcaaaagcaaagtataaagatgcatggccattgaaagcttcagttgttaacttccgtgctgatcatacaagaatttatgctggtggatatgctggtgaaatcttaaatgatttaggattcaaacgtaataaagacttacaaaaacaagttgataatggtaaagatattatccaacttacatctaaagaaagcattccattaatgaacgctgatcatatttttgtagtaaaatcagatccaaatgcgaaagatgctgcattagttaaaaagactgaaagcgaatggacttcaagtaaagagtggaaaaatttagacgcagttaaaaacaaccaagtatctgatgatttagatgaaatcacttggaacttagctggcggatataaatcttcattaaaacttattgacgatttatatgaaaagttaaatattgaaaaacaatcaaaataattaaggagttttacgatgctacttaaaccaaaataccaaatcgttattgctggtttatgtcttgcaatagtagctatcttaagtttaatgattggaaatacgcttgtgtcaccaggtacggtgatacaggcgttattcaactttgatagtgaaaacgatttacatgatgttgtcactggtgcacgggcgtcgagaacaatcattgcgttattgactggtgctgcccttgctgtctcaggtttgttgatgcaagcacttacacgaaacccaatagcctcaccagggcttttcggtgtcaatgcaggcgcagtattttttgtcatttttagtattacatttatccaaattcaatcttttaaaatgattgtagttattgcatttttgggggctattgttgttactgtattagttgttgcactaggtatgtttagacaaacactattctcacctcaccgtgtcattttggcaggtgctgcgattgcgatgctatttacagcctttactcaaggcatacttattatgaacgaaacagacttacaaggcctattattttggttaagtggctccgtttcattacgtaatatttgggatatcccatggattattccgcttgtattgatacttattttaattgcatttagcatggctgcacacatcaacatcttgatgacaagtgacgacattgcaaccggcctcggtcaaaacataaaattaatcaaatggatgattattatgctcatcagtatgttagccggtatttcggtagccgtagctggatcaatcgtctttgtgggtcttatcgtaccgaatattagcaaacgattattaccaccaaactataagtatttaattccttttactgcattagctggagcaatcctaatgatcatttcagacattgttgctcgtataataattaagccactagagttgcctatcggtgtcgttaccgctgtcattggcgctattgtcttaatctatattatgaagaaaggacgtcaacgcttatgaccgaaaagattaataaaaaagacaattaccatctcatcttcgcgttaatctttttagccatcgtttcagtggtaagtatgatgattggttcaagctttataccattacaacgcgtactgatgtactttataaatccaaatgacagtatggatcaattcactttagaagtattacgcttacctcgcattacacttgcgattttagcaggtgccgcactaggaatgagtggtttaatgttgcaaaatgtattaaaaaatccaattgcctcacctgatattatcggtatcacaggtggtgctagcttaagtgctgttgtctttattgcatttttcagccatttaacaatacatttacttccactatttgcagtattaggtggcgcagttgcaatgatgatactattagtgtttcaaacgaaaggacaaatacgcccgacaacactcataatcatcggtatttcgatgcaaacgttgtttattgcgcttgtccaaggattactcattacaacgaagcaattatctgctgccaaagcttatacatggctagtcggaagtctttacggtgctacgtttaaagatacaatcattttgggtatggttattttagctgttgtgccgttgttatttcttgttataccaaaaatgaaaatatctatacttgatgaccctgtagcgattggcttaggcttacatgtacaacgtatgaaactaatccaattaatcacttctactatactcgtatctatggcaatcagtttagtaggtaacattgggtttgtcggtttaatcgcaccacatatcgcgaaaacaatcgttcgcggaagttatgctaaaaagttactaatgtcagcaatgattggtgccatatcaattgttattgcagacttaattgggcgtaccttattcttgcctaaagaagtgccagcaggtgtatttattgctgcttttggtgccccattcttcatatacttattattaaccgtgaaaaagttataacgatattattaaaacaaaatgacctcacaacgaagttagctaaatgattcagttaactaaccgttgcgaggtttttttatacatatagttgttgttattgttaacaagcgtcgactttcttaattacatattaatactttatatacaaataacaccgactcatattctataatatcaatcaatattcttcgatttttcaaatatcgataactatttcttatttaaatatagtgtttgataatgtcatttattcaaaaacacaaattttaataaaaatatcatattatttttaattgtaaattatggattatttttcttattatattgtgttatattaaaataaagtgcatatacaaggagataaaacaatgaaatataataaccatgacaaaattagagattttataatcattgaagcatatatgtntcgttttaagaaaaaagtcaagcctgaagtcgatatgactataaaagaatttatattactgacttatttatttcatcagcaagaaaacacacttccatttaagaagattgtttcagatttatgttataaacaatcggatttagtacagcatataaaagtacttgtgaaacattcatatattagtaaagttcgaagtaaaattgatgagcgtaatacttacatttcaatatctgaagaacaacnaganaaaattgcagaacntgttacattgtttgatcaaatcattaaacaatttaacctt

SEQ ID NO: 239 - DNA, 1361 bp; double-stranded, linear
agaaaaattagcctacctatgcaagttgttattgcattagtgttaggtgttgtcgtaggacttttattatatggacaagaaaacgtagcaaattacattaaaccatttggtgacgtatttttaaatttaattaaaatgatcgttataccagttgtattttgctcactagcgctttctatttcgaacgttggggaatcgaaaactgtagggcgttatggctggaaaacaattttatactttgaaattattacaacaatcgcaataggtttagggattatcttcggtaacctatttaaaccaggtgctggattagacccaacaaaattacctaaaggtgatatttctaaatatcaatcaactgcacatgcagcagaacaatctacatatggaaatcattttattgataccattgtacatattattccgacaaacttttttgaagctttaaataagggtgaattattacctattatcttcttcgcagtattctttggattaggattagctgctgtaggtaaaaaagcagaaccagttaaagaatttttaagcggatcgcttgaagctgtgttctggatgattaataaaattttaaaattagcaccacttggagtgtttgcattcatttgtactacaattattacatttggtgcatccgcattattaccactattaaaattagtattagttgttgtctttgcaatggtgttctttgtattcgctatactaggactagttgcatggatgtgtggtattaatatcatgaatattattagaatcttgaaaagtgaattgcttttagcattttctacatcaagttcggaagctgtacttcctgtaatgatgaagaaaatggaaaacttcggttctccaaaagaaattacttcttttgttataccaattggttatacgtttaacttagatggatcagcactttatcaatctattgcagcattattcgttgcacagatgtatggaatgcacttaacattatcagagcaaattgtgttgatgttaacattaatgattacgtctaaaggtatggcggcagtaccaggaacttcaatcgttgttttattaacaacattaggtgccatgggcttaccggcacaaggtttagcattaattattggtgttgaccgtatcttagatatggtacgtacatgtgtaaacgttattggtaatgcattatcaacaatcgttatagctaaatgggaaaacgtatatgacaaagcaaaaggtcaagaatatttaaaatcaatttaaaaaatactatctgacatttaargncccttacaacctttggttgtnagggctnttttatgtcatgcgtcttaaagccaggccgtatancggtaagcgta

SEQ ID NO: 240 - DNA, 1489 bp; double-stranded, linear
tcaatatgtaaatcggcgattgtccctatcttcatacccttaccttctttactcaaattaaaatgttatttattatgccatagcttatctaatatatatagttaactgcttcatttagatgattattttatatttttgcataaaaacttatatcttttcaaaaaaatcgataagttttagttatcatacccttacctatcaaatgttttttcttatatttaaaaaaataattgctttattaaatggatttctttagtatttataattaagaaaacgcttacacacaacttttttatttgctttatcctgaggaggaaaattatggcaagaaaattgcatagagagttgaataacagacacatccaattaatagcaattgggggcgcaattggaactgggttattcctaggatcaggtcaaacaatatctttaactggtccatcactgttattcacatacatgattattggggttgtactattcgcttttatgcgcgcattaggcgaattgttgttgagcaatacaagatttaattcatttgttgatattgcaaatgaatatttaggcccttttggtggctttgtcattggctggacttactggttatgttggattgtatcaagtatgtcagacctaactgcgatgggacaatactttgcattttggtatccacaagtcccaaattggattaccgtgctatttattgttttaatcttgattagcttcaacttattaggtgccagattatttggtgaactggagttttggttctcgattattaaagttgtcacaattattgcgatggttatcgttggtcttgtattaatctttttctcatttaaaacacattatggacatgcatcattcacaaacttaatcagtcacggtggcatgttccctggtggaacatttggtttcttaatgtcattccaaattgctgtatattcattcattggtattgaacttataggtgtaactgctggtgaaacgaaagatcctgaaaaaaccttaccgaaagcaattaataatgtacctatccgtattttattattctatatcggtggtctattagtaattatgtcagtcataccttggaatgatatcgatccaaatagtagccctttcgttaaactctttacattaatcggcgtaccatttgcagcaggtgtcgttaactttgtcgtgctaactgccgcggcctctgctacaaatagtggtatctattcgaatagtcgtatcttattcggactgtcacaacaagggttaggtcctaaagttttaaataaaacgaatagtcatggcgtgccttatttatcaatgttagtttcatcaattgcattacttatagcagccttgttaaactacattttccctaatgcaattcaactattcatatacgttacaacgttatcaactgtgttgtttttagttgtttgggcaatgatnattgtcgcttatcnaatgtatttggaaaaagcatcctgaggca

SEQ ID NO: 241 - DNA, 5000 bp; double-stranded, linear
ttttccatcatratcaccatttaagacaatagctgtatgaccatatcctccaccaaatcttccactaaaaaccactaagtccccaggttcagctttgaaagttggtgtgttgtgataaattttagcttcactattaaaattatttgcatatggtatatctttagctccatatccttttaatccakgaccataaagakgattccaatatacattaactaaatcgaaacattgccatccataactaccgtcgaaatcccatcctctattctctaatgttttcaaataatttaatgtactgctattactattacttttattatttgaagacactgtttttggttttggttctactaatggtgtcattggcacttttaatttttgaccaataaatattaaattaggatttgctatattatttgtattttgaatatttgaaactgtagttttgtattttaatgctatagcactaagtgtgtctcctttttttacagtatagatttgtgtttttggagcttctctaaaactgtagtaaccaaagtaattattagtaactttattcgttttcttctgattagaattttgagcttccaagtttgcaattttaatttctttagtaagttcattgttattaataactagattgttaccttggcttgagtttttcggagtatttgaaatctttatatcttgattaatttcatttccgtttgaaattgctgatttgttgtctaactttaaacttgtgtccgatgttttaacagcaccttcattttttattttgtcttttgtcgtatttttattagcatttaactctgatttcgcgaatacattttgctcataccctcttgtaaaatctttagatttatcaatttcatctgcatatgctttgttcgacatacccaatgccaaaaacatacctattgaaattgacaaaattccaatactaacttttctaattgaatagcgtactttactttgttgtttattcatgatgaaacactccttacaataatatacaaacattataacatagtgcgctatatattttaattaaaattttctttgttttataaagctattgtaggaggtaaaataattaacttgtctttccaaaatatgaaaagtgtactaaaattcatcgcacgacaaatagcccatttccgatacttttataaagtatggaatgggctatagccatttatatcatcttttaactttatttattaacagttaataatgattcataaatacctgcttctttagcagcttcaattaatgttgaaccaatttctgaaggtgttgccgctgttttcacaccacaactatttaatgttttaattttctcttcagcagtacctttaccacctgaaatgattgcaccagcatgtcccatacgttttccaggaggtgctgtttgtccaccgataaagcctacaactggttttgtcatattcgctttaatccattcagctgcttcttcttcagccgtaccaccgatttcaccaatcataacaactgctttcgtttcgtcatcttcattgaatgcttttaaaacatcaataaagtttgttccgttgactgggtctccaccaataccaacagctgtagtttgaccaataccttcttcagtcaattggtgcactgcttcatatgttaatgtacctgaacgagatactacaccaacatgaccttttttgtgaatatagccaggcataataccaattttacattcatctgctgtaatcacacctggacagttcggaccaactaaacgtgtttttctaccttgtaagtagcgtttaactttaaccatgtctaatacaggaatatgttcagtgatacaaataaccatatctaagtctgcatcagctgcttctaaaattgagtctgcagcaaatggtgctggaacgtaaatgactgaaaccgttgccccagtttcatttttagcttcttcaacagtgttgaaaacaggaacgccttcaacaacttgaccacctttaccaggcgtcacacctgctactattttcgtaccataatcaagcatttgttttgtatggaaaagggcagtagaccctgtaataccttgtaccattactttagtattcttatctataaatacactcatcttagtgctcccatcctttccttatgcttctttgactagtttaacaattttttgtgcaccttcagccattgttgctgctggttcaattgctaatcctgagtcttttaagatttttttacctaactcaacatttgtaccttctaggcgtacaactagtggtaaagttaaatctacttcttttacagcttcaacgataccttctgcgataacatcacatttcataatgccaccgaaaatgtttacaaaaatacctttaacattttcatcacctaaaatgattttaaatgcttcagttactttttctctagtagcgcttccgcctgcatctaagaaattggctgggtttccaccgaaatgattaatcgtatccattgttgccatggctaaacctgcaccattaaccatacatccgatgtcaccatctaatgcaatgtatgataaatcatgtttagacgcttcaatctctttcggatcttcttcttctaaatcacgtaattctacaacatctttatgtctgaataatgcattatcatcaaaattaattttagcatctaatgccaatacatcaccatcagctgttgtaactaatgggttgatttctacgattgaacaatctttttcaatgaatacattataaagtgctaataagaatttagcagctttgttaacagattctttaggaatattaatattaaacgcaattcgtcttgcttggaatggtgaaagtccgattactggatcgatagtttctttgaagatcttttcaggagtcttcgcagcaacttcttcaatctcagtgcccccttcttcagacgccatcaatgttacttggtcagtcgcacgatcaataacgaatccaacgtaatattctttttgaatagcacaaccttcttcgatatataaacgcttaatttctttaccttctggaccagtttgatgtgtcaccaaagttttccctaataattcttttgcatatgtttctacctcagataaagatttagcaatttttactccgcctgctttacctctacctccagcatgaatttgtgcttttacaacataaacatcagaatttaattcttttgctttctccaccgcttcttcagcagtaaatgctactcgtccttctggaactgcaacgcccattgaacgaaatatttctttaccttgatactcgtggatattcatcttccatcctcctgttacttaggttaagttcccttacaattataaaaaatgtaagcgctattgtaaacttaaatgctacttttttatcatttaattgaattttacgatttacagtaacgattttataggttcaaagctttttctatgctctttcataatgccaatatcatcgattgctagtaaatgttgtttggtaccgtaacccgcgtttttttcaaaaccatattcaggataatctttagataactgtgtcatataatcatcacgaaaaacctttgccatgatacttgcagctgcaatggacacacttcttgcatcacccttgattaaagatacttgaggcagtgcattatcaagcgtcatcgcgtctatcaataaatgcgttggttgtactgataatccatcaatagctcgctgcatggcgatttgagtagctttataaatattaaattcatctatttcttncagtgtcgcgatcccatatgcaaaagcagtaacttcattttttagtgcttcatttaattctagacgtttcgtaacaggtacttttttcgagtcatcaaggcccaaataattgtgatttgaatttaaaattgttgcgcatgcaacgactggacctgctaaaggtcctcttccaacttcatcaatcccacaaataatagcattaggatgctcttttaatatttcattttcaaagtaagtcatttcaacatacttttcttttaaagcttgttctttttctaacgcttttctgcgcctagctatggcattttgaacaccttttcgctcatctaaaaagcattcatgattttctaattcttctattgtattaaccgcattaatcaactgcgtaacttctttaattgttagcgtcatttgctaattcctcagtcatatctttaaaaatatcaaaacaataatttcctattttagcatttcgaatatcataaataatcagttcaatgactgcttcgtaatcaatttcattaccacgtcgaattaagcccacgttttttccctatcgcatcaaaccacgctatgatttctgcatcttcaggaacttcaatattataatgtgactttaatcgcgctaaatcattttgaattaaaaagtttaatccatagatggcaacttcatctaagtgcacaatactatcttttatcgcaccagttaaactcaacttcttaccgacttcttcatcttcaaatttaggccaaagtatccctggtgtgtctaatagttgtaatgcattaccaactttaatccattgttgttgtttggtcacacctggtttattaccagtctgcgcaatactacgctttgccagtttatttattaatgtggatttaccaacatttggaattccaacgatcattgctcttatcgctctaggtttaagtcctttcgctttttcgcgttcaaatttttcagcagtcgccttaattgctgcagcttccactttctttaaatttttaccgtgcttagcatccactgatacaggatagtatcctttatcaataaaaaattgttcccattttgacatctcatttaaattagacatatcttttttatttaatataacaacacgtggtttttggttaataacttcatctatcatagggtttcttgaactatatggaattcttgcatctactagttcaaacactacatctactttttttaatt

SEQ ID NO: 242 - DNA, 1700 bp; double-stranded, linear
aacccgnagacgaaactncatagttgcctgttatgttgattagtgcgtttgtagctatttnaaatcaaacattattaaatacagcgttacctagtataatgagagaattaaatatcaatgaaagtacatcgcaatggctagttactgggtttatgcttgttaatggcgtcatgatacctctgacggcatatctaatggatagaattaaaactagacctttatacttagcggcgatggggacatttttattaggttctattgttgcagccttagctccgaattttggagttttaatgttagctcgtgtaattcaagcgatgggtgcaggcgtacttatgcccttaatgcaatttacgttatttacattgttcagtaaagaacatcgaggtyttgcaatgggactagcaggtttagtaattcaatttgcaccagcaataggacctacagttacaggattaattattgatcaagcgagttggcgagttccatttattataattgtaggaattgctatacttgcctttgttttcggtttggtttcaatctcgagttacaatgaagtgaaatatacgaaattagataagcgttcagtaatgtattcaactattgggttcgggttaatgctatacgcatttagtagtgcaggagatttaggatttacaagtccaatagtaataggtgcgttgatattaagtatggttattatctatttatttatacgtagacaatttaatattactaatgcacttttaaatttaagggtttttaaaaatagaacatttgcattatgtacgattagttcaatgattataatgatgtcaatggttggacctgcgctgcttataccgctatatgttcaaaacagtttatctttatctgccttgttatcaggacttgttatcatgcctggtgcaataataaatggtattatgtcagtttttacaggtaaattttatgataagtatggtcctagaccattgatttatactggttttacaattttaacaattactacaattatgttgtgtttcttgcatacagacacatcttatacgtatttaatagtcgtatatgcaattagaatgttttcagtttctttactcatgatgccgataaatactacaggaattaattctttgagaaatgaagaaatctcacatggcacggctattatgaactttggtcgtgtaatggctggttcactaggcacagctttaatggttacattaatgagttttggtgcaaaaatatttttatctacatcgccatcgcatttaactgcaactgaaattaaacagcaatccattgctataggggtggatatctcatttgcttttgtagctgtgcttgttatggcagcttatgtgatagcactttttataagagaacctaaagaaatagaaagtaatagaaggaaattttaaaataattatagtagttggtctatttaaaataataggctaactgctttttttatttaataaaaagttttatacttttagtgatagactaagcaaaaattgttatttgctatgatgtagatgtcttaaaatgattaagggggatttgctttgttaacggtagatcaagtgaaagaattggtaggagaaattaaagatcctattatagatgtgcctttaaaagaaacagaaggtattgttgangtttctattaagggagaanaagaacatgtgagtgtt

SEQ ID NO: 243 - DNA, 10146 bp; double-stranded, linear
tgcatcaactttcaaacaataaatcatcacaataaccacacctaattcaacacttttcaaacataagtattgacacattgagcaaaatgatttttaattgtaactaatacagttacaattatgaggtgagaaacattgaatttagaatttaacattgccgtgcatgtattagcttttttaactaagcatcattcagaaaaattcaatagtagttcattagcagaattaacttgtttaaatcctgttcaattacgacgcgtgacgactcaacttgtcgatttaaaaatgattgacacaatacgaggtaaagatggcggttatttagcaaatgatcaaagtgctgatgtctctctagcaacattatataaacattttgtcttagagaaagaacaccacacacgtctatttactggcgacgaaggcagtcactgtcaaattgctcgtaatattgcaactaccatgtcacattatcagcaagacgaacagaatatcattattaatttttataatggaaaaacaatcaaagatgtcattgaagacattcaaaaggaggatttatgtcatgaaaacatatgatttaattgtaataggatttgggaaagctggtaaaactttagcgaaatacgctgcatcaacaggtcaacacgtcgcagttatcgaacaatctccgaaaatgtatggaggcacttgtataaacataggatgtataccttcgaagacacttgtacatgatggattagaaggcaaatcttttgaagcaagttataaccgtaaaaacgatgttgtcaatgcgctaaacaataaaaattaccacttattagcagacgataacaacattgatgtactggattttaaagcgcagtttaaatctaatactgaagtgaatttattagatcaacatgacgatatcgtcgatagtattactgcacctcatatcattattaataccggtgctacctctgtcattcctaacattaaaggccttgatcaagctaaacacgtcttcgattcgacaggtttattaaacattagctatcaacctaagcacctcgttattgtaggtggcggttatatcgccttagaatttgcttcaatgtttgcgaatttaggtagtaaggtaacagtattagaacgtggcgaatcatttatgccacgcgaagatcaagatgtcgttgcatatggtattactgacttagaaaataaaggcattgcattgcatacaaatgttgaaacgactgaattgtcatctgacaatcatcatacaacagtccataccaacgttggtaactttgaggctgatgcagtacttttggctatcgggcgcaaaccgaatacggatttagctttagaaaatactgatatcgaattaggcgacagaggcgaaattaaagtcaatgctcatcttcaaacaactgtgccgcatatttatgctgcaggtgatgttaaaggcggacttcaatttacgtatatatctttagatgattatcgaattatcaaatcagcgttatatggtaatcagtcacgtacgactgacaatagaggcagcgtgccttatacagtatttatagatccaccattatcacgtgttggattaactagtaaagaagctgccgctcaacattatgattacactgaacatcaacttttagtaagtgctatacctcgtcataaaattaacaatgatccaagaggtttatttaaagtagtcattaataatgaaaataatatgattttaggtgctacattatatggtaagcaatctgaagaattaattaatataattaaacttgcgattgatcaaaacattccatataccgtattacgagataatatttatacgcatcctacgatggccgaatcatttaatgatttatttaatttctagacaaaacataaaaacctggtggcacgcattgaatgatgctgccatcaggctttattgttgtgcttttcgcttttctaatttttctttaagctttctatcttgttcttctttacgacgtttacgttcttcatgtcgttttcttaaacgctcttcttcttcaggatcacgtggtttctttaattgttgagaaactttttcgattaattcttcttcagtaagcgcagccagtgggcggttattaacaaaagtgaatgtttttcggcgtccaggtccacaataagattgacaacctatcacgatttcagcatcgggatctaatttttccaacttcttttgtaacgttcttatattgactgcctgacattcatcacaaataaggaatgtatttttcatattgctacccacctttctttatcatatctatatcgtcgatttcattaattttttcgttaactctatctattttactctttttaatatttttttcaagatacgtaacacggctgacaataaaaaatggagcatttatcttctaattaaattagatgattgctcccctatcaaatcatttattgcccatgataaatattaaattttaatggtttaataccatgttttgtccattcatcataaattttttctttatctacatctttattgataattgtaataccacagtctccaccaccagcgcctgatgttttagatgcgccgtgatacttttcagcaatatcacacaaatattttagcttttcagtttctatatcaactgtagcttctttatccatacgttgaataattgtacgattctgacgcaccatcttttgcacacctttaatgttatttgttttaaaagcatgaataagtttttcaacacaacgatgtgaatcttctaagaagtcaccgtaaaatgaaggatctgatttcaaacgtttcacttcgctaacaaagtgtggtgatgacgccggtgagccagtccaaccgataagtacttccatattttcaggtgcttgtaatggttcgatgtgcaatccaggccagtttttgattaaaacttcttcaaccgtagtatcttcaatttgatgcttaacccattcatgatcaaaagtactatacgctagccatccactatatacactcacagcaatatctccgcatgaacttaaactttgtaacttcatatttgcaatcactgctagtttataaatgtataaattagataacttcatatcataaaattcatttaatacttttataactgacacaagtactgctgcacttgaacctaatccatatttatgaccatttgaatcatctaaattactatcaatagtcagatgaaaatgcttcatcgctatatcgcaacttttcgcgtattgttcaaatatttcaatagctgtgaccacataatttaattgttttgctgcatgtggatctgaaatgacaatactatcttcatctctactaaatgtaactgggttatgatgtaatgcttttgaatgaatggtacctttatattggtctgcttcttcaatagtagcagttacaaaacgatctaacgcaataagtacagatttatatcctggttctgttacagcatattctccagcaatataaagttttccgggtgctttgacctgaatcattttatctcttccttactcaattatttcaattcctgtggcaataatgtcactatcaataatttggttattatcaaactgtgttaataatttatctataatctgttgcttgtttttcttttctacaagtattttcacattaggtcccgcatccattgtaaaataacacggataccccgcttctcggcattcgtgaacaagcgccatgacatcataactttcttgcacaagatatgtgaacggcggtgttgatcctagattcgtggcatgcatacgcaaaccattttcttcaattacttcaccaaggcgtttaaaatctttgtcttgaatcgctgcttttgcttcagctaaatcttcatcaatatgatctaaccaatattgataaaaccttgatgtgtttcgtgtcaatgacataccatatcgactaggtacctttttagaatgttgattaatcacaacaaatatcatggcaaggtcatcttcaaaatgattcgattcaagtggaacggcatatgacgtctcatcactataccctttttcccattctgcaaatccaccataaatactacgcgacgcagaacccgaaccaattcgcgccaatctcgataaatccttatctgacagctgcatgtctagcgcttgattacaagctgctgctaaagctgcatatgcgcttgccgatgaagccaaccctgctgctgttggtacaaaattgtcgctttcaatttctgcataccaatcgatgccagctctatttctgacaatatccatatattttgaaattttctctaattctttgccactaaccttttcaccattcaaccaaaattgatcctgtgttaactggtcgttaaaagtgactttcgtttcagtgtaaaatttttctaatgtaacagatatgctattattcattggaatgattagtgcttcatcttttttaccccaatattttataagtgcaatattcgtatgtgcacgtgctttgccacttttaatcaacgcattaacctcctaaattctcaatccaagtatgtgctgcaccagctttttctacagcttttacaatatttttcgctgttggtaaatctttggcaagcaataacatacttccaccacgaccagcgccagtaagttttccagcaatcgcaccattttctttaccaattttcattaattgttctattttatcatgactaactgtcaacgcctttaaatccgcatgacattcattaaaaatatccgctaaggcttcaaagttatgatgttcaatcacatcactcgcacgtaaaactaacttaccgatatgttttacatgtgacatgtactgagggtcctcacaaagtttatgaacatcttctactgcttgtcttgttgaacctttcacaccagtatctataacaaccatatagccgtctaaacttaacgttttcaacgtttcagcatgacctttttggaaccaaactggtttgcctgatacaatcgtttgcgtatcaataccacttggtttaccatgtgcaatttgctctgcccaattagccttttcaatgagttcttctttcgttaatgatttccctaaaaaatcataacttgcacgaacaaaagcaaccgcgacagctgcactcgatcctaatccacgtgatggtggtaaattcgtttggatcgttactgctagcggctctgtaatattatttaattctacaaaacggttcaccaaagacttaagatggtcaggcgcatcatataacataccatcgtaaacatcgcttttaatagacgaatagttcccgctctctaaggcttctattaaaactttgattttacctgcgttaaacggtactgcaatagcaggctctccaaatgtaacagcatgttctcctattaaaataatcttacctgtcgattccccatatccttttcttgtcatgtcaatatcaccttttatatttatcctatacttgattcattatttttatttattagtaaaagacatcatattctaagttgcatngcattcgcgttaaatttcattgcagtctttatctcacattattcatattatgtataatctttattttgaatttatatttgacttaacttgattagtataaaactaactttcgtttacttcaaagtttaaatcttatcgagtgatatttcagattctttatctttttataaaatagccctacaatttataattttccaccctaactataatactacaaataataattggaatatatagatttactactaaagtattagaacatttcaatagaaggtcgtttctttcatagtcatacgcattatatataccctattctcaatctatttaatacgtaaaacatgaaattttcttattaaatttattatttccatcatatcattacttttaatttaatgatgttcaatttaaatattaggtcaataacatatttatgctttttatggatactttcaaaaataacagccccaaacgataacttgaaaggggctgttaaatatttaactattgcatttgatctatcattttcttgtttctttcaatcattttatcaaaatacgtatcgtatctttgccattcttcttgagtaattggcgtcatatttaatacaccgccaagatctttgattgcatataatagtaaaaacattacatcttgaacagtaatcgttttgttaagcaatgtctctaatgaggccatacaagatggttcaatttcaggatatttaaatttagtcacttcaccttttaaagcatgttcataaaatgtttgcatcatcaatgcacgttctgaaccagagccttcaacacaaagataaatttgtacagcaataccgcctctaactcttcgttgcgatatgcctgcaaatttcttaccatcgatacttaagtcaaattttcctgggcaataagaatgttcaatttccatcgtatcaatatcaacattctcattttcgaacattttgctaattaagaggtacatcacagtaaacgcttcatcaatcgttgtttctgtttgtcctttgaacatcagcgatatatttaatacaccttgatctagaacgacacctaagccaccagaatttctaacaatggcattataaccaatctcattcgttaaataatcaatgccatcttttaaaaacggcaatcttgaatcatgaataccaagaataacagtatgttgatgaatccaagtacgcacaacattatctgatatatctttgcccacactttcgcaaaatgtatcatcgaatgcgaaagattgcataggttctaatccagaagaatgatcgatatatcgccagttgacgccattaaaatatttactcgctaaatccatcgttattgtaaggcttgcgctgctgtaataattgaaagattgtatacatcttcaattgagcagccacgtgataagtcatttactggagaatttaaaccttgtaatactggaccaactgcatcatatccacctaaacgttgtgcaattttgtaaccaatattaccagcttctaaacttgggaatacaaagacatttgcatcaccttgtaatttagcacctggcgcttttttctcagcaacacctggtacaatcgcagcatcaaattggaattcgccatcaatgattgcttctaatttttcttcttcagctttttgttgtgctaatttgacagcttcttgaacttttgtcacgtcgtctgatttagcagacccttttgttgaaaagcttaacattgcaacttttggatccatgccaaagcttaatgctgattttgcactttctactgcaatttctgcaagtccttgtgaatcaagttctggattgattgcacaatcaccaaagatgtattgttcatcacctttaatcataaagaagatacctgatgttcttgatacacctggtttcgttttgatgatttgtaaagctggacgcacagtgtcgcctgttgaatgtgctgcaccactaactaaaccatctgctttaccagcataaacaagcattgtaccgaagtagttcacattgtttaataattcttgtgcttgttcttcagtcgctttacctttacgtcgttcaacaaatgattgaactaattcagctttcaattcacttgtcgcaggattaattaattcaatattagaaatatcaagatcaagtttttgcgctaaagattgaaccttagtctcatcacctaacacgattggtgtaacataatctgttgcttgtaattgtgttgcagctgttagaacacgttcgtcctctccttcaggtaatacgattttaacgtttttaccagaaagtttgtcttttaatacatttaataaatcagccataatgtcctcctgtaatataaatcttattaatcattcacggtataattatacgccattttatttcataatgccacgtcaccaatttgtaatcataattttatcgttacccctttgctttatgataaaatttataaagaactgatgatttttgaaaaggagcgataaacatgagtcaagcagccgaaacattagatggttggtatagtctacatttattttatgcagttgattgggcatcattacgtatagttccaaaggacgaacgcgatgcacttgtcactgaatttcaatcatttttagaaaatacagcaactgtaagatcatcaaaatctggtgatcaagctatttataatataactggtcaaaaagcagatttgttattatggttcttacgtcctgaaatgaagtctttaaatcatattgaaaatgaatttaacaaattgcgcattgctgacttcctaatccctacatattcatatgtatcagtcattgaattgagcaattatttagctggtaaatctgatgaagatccttatgagaaccctcatatcaaagcaagattatacccagaattaccacattctgattatatttgtttctatccaatgaacaaacgtcgtaatgaaacttataactggtacatgttaactatggaagaacgccaaaaattaatgtatgaccatggtatgattggtagaaaatatgctggcaaaatcaaacaatttattactggttctgtagggtttgatgatttcgaatggggcgtaacattgttctcagatgacgtattacaattcaaaaaaattgtatacgaaatgcgctttgatgaaacaacagcacgatacggtgaattcggtagtttctttgtaggacatattattaacacaaacgaattcgatcaattctttgcgatttcttaatacattggtacgtttataaattaataaaaaaattccaagcttatcggtttaagcttggaatttttcgtttatcttcagtatattcccgtatacataagacgtgatttggtaaatagttgaaatctgtatgtttaaacttatatatatgtgctaatgtattatcaataacaaagtacactttgctcatagcaagtsacccgagtagtcttccttgggagaactttaactactatcactacatataaacgttaacctcaatagaaattatacagtcgctactctatacaatttttgtaatggttaactaatattattttaacctatttgaaatatttgaaacatatttttgtcgaatttttttcaataatttttcctttttatacttcaagagaattttaactactaaaaattccgatgattattattacaatagtatcaaatattagttttttaaaatcaataacaacttatcaaaaagctcatgtggttattttatagtgtataaactataatgagtattaaattcttataaacaatggtgatgaaatggacataaattcagaagaatacaaacaagaggtacttatcaaagacgttgtcatgcttgctgctcgcatactattagaatctggtgcagaaggtacgcgtgtagaagataccatgacacgtattgcaaaaaaacttggttacagtgaaagtaacagctttgttacaaacactgtcatccagtttacgttacattcggaatcgtttcctagaatatttagaattacctctcgagatacaaacttaataaaaatttctcaagctaataaaatttcgcgtcaaattacaaacaatgaaatttctttagccgaagcaaaaacgcaacttgaaaaaatatatgttgctaagcgtgacagcagtcttccctttaaaggttttgctgcagcaatgattgcaatgagtttcttatatttacaaggtggtagattgattgatgttttaactgcgatattagcaggtagtctaggatacctagtcactgagattttagatcgtaagtwacacgcacagtttatcccagaattcattggttcattagttattgggattatcgccgttattggacatacacttattccaacaggtgacttggcaactattatcattgcggcagtcatgcctattgttcctggtgtattaataacaaacgcaatacaagatttatttggtggacacatgttgatgttcacaacgaaatcattagaagcattggtttngcgtttggcatcggtgctggcgttggtagcgtattaattttagtataggagtatcagactatgttttggatcttaaactttatctttagctttttagcttc

SEQ ID NO: 244 - DNA, 2022 bp; double-stranded, linear
atttaattggttggtggcgtattctcntttccaagatttgccacgattggatgttcagtcgacaaatatgtaaccagtcccgataaattacgttcctcaatcattgatagtatgtctggtgtttgtaacgatttatcgagtaaggcatcaagcaattgataatgtcccaatacaacaaaatgcacgttgtctctcaactgctgttgaataaactgaataaagagctttaagctctgttgcacattcgctaatgatggtgcatagttttccaaaccaacttgtacagccgcttcattattccgaatgattaaacctgtgtatgccacttttgttgctgcagttggatacattgagtaataacgcaataattgatctgtaaaatcatttcgaagtgcataaatttgatgctcatgttgccaaaaatttcgctcacccatctgctgcaaatcctcatggttcaattgtttccagtccaacttttcaaccacactaaaatcaactaactcataatccgctttattaaaatattttaaaaatgctgtttccgattcttttaacgcaattaattgttctgnattattcactcgaccaccctttactttcaatactgtatttaaaatcacttggtattttcgttgtttgctttacttctctaccacgctaaagtgtaatatgattaataacttatcatttttagcaatacattacaacctttttcagaaaattcggtgtattgattttaaaattttttaaaatanaaaaggcaagacatttgtgcctataaaaatgcttaaccaagatttttatattgaagttgtacttcttgcacatattgtccttgccttattatgtaaagttattttctttctatctttttattaaatttaactattcttcataatcccgattccctttaaagtaacgtctatcttgtttactatatacattttcaggattaaaaaacggtttgagtttatatttaaattcaaataagtttagaccatcaatcgcaaccctatcttggtaaacgttcgttgctgatatatctgtaaaattgtttggaccgacacctgcaataaacttaaactctgcttcatctaccaaataatcatacgcttgtgtatgtctatcctgtgcgccatgtggaaatacaaacatatctgttttacctacaattggttcaacttcatctttccatcttttagtatcacgtttaataccttctaaagatgttttttcaaaattaatgtgaccatatgaatgactcgcaaatgaccatccatcccgtttcattgcgcgaacaacttcctcagctgcctttttattctttgtataatctttactcgttaattcattcgtgcgataacctaatacgccctcataaccggttaaagcaacaacacctttttcaccatttaaagaaaaatctggatgctcttttacaaatttatttaaaattggcacgatatcattgtcatcagaataagtagcatggccttttttgtctgtagtttcagaaacaacatgtttatttttatcgagtactaaacggtcagcataaccatggtgtctcatgtaactatagtaattcatatcatcaattgagatgattagtggctttttacctttcggcaattttatttttttggcttttacatgatgagatgataagtcgtatacatcatgtggattaacgatgatgtaattatttttatataattcgttcaatgattttttaaattcacttacagtaatcatccaatcattgttgcccttagcttggtgtgtatctcctgtaaacgcaacttttgggtctgtaattaatgggtgataaaacacatgataaacttggccgtgatatgtttcccaatgttcatccattttcgatttatgctttgcatactcatttggattaacagatttattktgagctttctcattttgcttggaacagctatatmacaatgcaactgataataacagaaaaaatagcaataaatattttttatgcattaaacattc

SEQ ID NO: 245 - DNA, 1340 bp; double-stranded, linear
atagagtgataaaggatggttgtcatatgataaatgcagtagtaatagcagtaattttaatgattgtgctatgtttatgtcgattaaacgtnttattaagcttatttatcagtgcgctagttggtggcttaatttcaggcatgagcattgaaaaagttataaatgtatttgggaaaaatatagtcgatggtgctgaggtagcattaagctatgctttattaggtggatttgcagcattaatttcatacagtggtatcacagactatttagtaggaaaaattataaatgcaattcacgctgaaaatagtcgatggtcaagagttaaagtcaaagtgacaataatcattgcattattagctatgagtatcatgagtcaaaacttaattcctgtacatattgcattcattccaattgtcatcccaccattgttaagtctgtttaatgacttaaaaatagatagacgtttaatcggtttgattatcggttttggtttatgtttcccgtatgtgttattaccatatggattcggtcaaattttccagcaaattattcaaagtggctttgcaaaggcaaatcacccaattgagtttaatatgatttggaaagcaatgcttattccttcaatggggtatattgttggcttacttatcggtttatatgtatatcgtaaaccacgtgaatatgaaacacgtaaaatttcagatagtgacaatgttacagagttaaaaccatatatcttaatagtaacaattgtagcaatactagctacatttttagtacaaacatttacagattcaatgatttttggtgcactggcaggggtactcgtattctttatttcacgtgcatataattggtatgaattagatgctaagtttgttgaaggtattaaaattatggcttatattggtgtagttattttaacagcaaatggatttgctggtgtaatgaatgctactggtgatatagatgaattagttaaaactttaacaagtattactggtgataataaattatttagcattatcatgatgtatgtgataggtttaattgtcactttaggtattggatcatcatttgcaacaattcctattatcgcatcattattcattccttttggagcgtcaattggactagatacaatggcattaatcgcattgattggaacagcgagtgcattaggtgactcaggttcgcctgcaagtgattcaacattaggaccaactgcgggattaaatgttgatggccamcatgatcatatacgtgatacatgtgtaccaaacttcttgttttataatattcctttaaatgattttcggtactattgctgctatggtact

SEQ ID NO: 246 - DNA, 3365 bp; double-stranded, linear
caaaatctaagagaataanatttgttaatttnaaatagcaagcaattcaaagttatatgtgtaatagataaaatagatatccctatagtgatgcgttactagctaaacataataacacattagaagataatgaagttaaggagttactggattgtttcgactatgtaattaagtataaaaatatccaacgacaaaacgtaattataaaatggtaaaagctatggtacagtttcaaattgctaatgacatgcgtatcggtgagctacttgcaataaagagagtaaatataaactatgaagataaaacgctagatatcgacggtaaagttaattggataactgaaaaaagacgggagcattcggagtaaaggagacaactgaaagaagtaatagctataaggccacagggctcactacccaaagcatcgacttactaagaacacttatgcttggaatgataagtttattgatagagagtacatattcacaaatacgtctggtagccctatcgactcgaacaaaattagccacattattaaaggggggcgctgatattagttctattaagaaacctataacgacgcatacattacatcattcgcatatatctacacttgctcaattaggaattaacttaaaagcaatgcaagagcatgtaggtcattcagattataaaaraaatctagagatatacacacatgttactaatcagatggcgaaagatatgatgaataaatttgaacgattggggagttaaaattggaaaaagatgatacactagcagaaattaagcctatgctcaattttgatgagcaaatagcaaaattaaaacagatgaatatattttttaatattattgacaccgaaaaagcaaatgaaattcttagaaaaaataattacttcttcaaactwgcttatttccgaaaaaatttcgraaaaaagaatggcggctatttcatagaatttgcttatttatcagatttagcaactatagatatgaaattaagatacacaatgttgcatttaactttagatattgaacatagtttaaagtatctagtcttaaaactaataacagaaaataaccaagaagatggttataaaataatagatgagttcttatgtattgataaatcatatagcaattcaaattttgacacaaattcaagaacaccagaagaagttatggaaaccaaaatcaaaaataaaaacgaaatattcaagcatatgaataaacgaggacaactacccgagaagttgaataaatactatcmaaatccacccgcnnggktttgcattgrattcatgcaactaggtcaattcgtttcgtttctcaacttctattacaagaagtacaatgacgaagaattgagagttgctaatattttaatgcctttagttaaaaatataagaaacaaatcagctcataaccaacccatcatagcaaatctaaattatgacagtagattacctcaatatttatttgaaaaagggaataatataggcatatctagaaacatgttcggaataaaaaatttcatagatactktckstacgctagaattacataatcaagtttgtagtaatgcaattatccaagcaagatatcacgatttggaccaacttcaaaagcgatataaaagraacgraagctattataataatgcattagctatcaaaagattttttatagctttagataaaattattgacttcaacagaccaaaagtataaactatctagtgaggaaagagacttataggtctcgcgagttattttaattcgtatgcaagaaaaagaagagctatgcattttatttaaaatgcgtagttctttttttatgcatctaaattcatattatttttgcaatataaacatatctttgtgcaaattccgaacacaaaacattcacatcatccttttttgccctttttctataccccaaaacacaaaaagccccgtaagcctatgcctacggggtttgacaataaattatatattattgttcttctttaacatatggtaataatgccatatgacgagaacgtttgatagctgtagtcaacatacgttgatatttagctgaagtaccagttacacgacgtggtaaaattttaccgcgttctgagataaaacgttttaataattcagtgtctttgtagtcgatatgtgtaataccatttgctgtgaaatagcatacttttttacgacgacgtccgcctcttcttggtccacctgccatgattgtgtgcctcctttgataattttttcgctttaatttcgttaatttttattagaatggtaagtcatcatcacttatatcaatcggtccgtttgcatttgcaaatggattatcagattgtttcgtgtttgatgaattattgtacgaattgttttgtcctgattgttgaccaccgaatccttgaccgtaatcttggaattcattttgttgacgttggccaccattttgttgcgcatttttaggttcaaggaattgaacgctatcacacacaacttcagtaacaaacacacgacgaccttcttgattttcataattacgggattgtaagcgaccatctacaccagctaaactacctttagataaatagttatttacattatctgcttgtcttctaaaaacaacacagttaataaaatctgcttcgcgctccccttgagcattcgtgaacgtacgatttactgcaagagtgaatgtcgctacactcacacctgagggagtggttctgtattccggatctttcgttaaacgacctactaatacaactctatttagcatttaaacgccccctctaattattacttgtcttcgtcttcacgaataaccatgtaacgaatgatatcgtcactgattttagctagacgttggaattcgtcagtagctttgttgttatcagatttaacacgtacgatgttgtagaagccatctttgaaatcattgatttcataagctaggcgacgtttaccccagtcttttgcttctaaaacttctgcaccttcagtagctaagataccgttgaaacgttcaactaacgcttttttagcatcttcctcaatgtttgggcgtacgatgtacataacttcatatgttctcattttatatttgcacctccttgtggtctatacggcttatcaatcttaaaacagataagcaaggaataattttcattactcacaataaagaattatatcatgcgccattactttttacaataataattcaaactactcttcatatcatttttgatattaattcatttgaaactttcnatgatattttnaaaaatacacttcacaaaagcgaacatatgtnctataanagttgtgaggtggtaaggaatgaattta

SEQ ID NO: 247 - DNA, 1032 bp; double-stranded, linear
gttaaaagtaattggtggtattgatgatgattttacagccaatgttatgcatccaaatcaatatcgaattcgatattcgtctcagaaacaggaccttaatgaagatatgacagtttttgatgcagtattaagttctgatacaacaactttacgcatcatcaagcaatatgagcaggcagtacaagcttatgcggatgaccaaagtgataaattgttcaagcgaatgatggatgcgcaagatgctatggatcaacatgatgcttgggactataacgctgaaattaaaacaatcctctcaaaactaggtatacatgatactactaaatacattaaagaattatccggcggacaacaaaaacgtgttgtacttgctaaaacattaatagaacaaccagatttattgttattagatgaacctacgaaccatttagacttcgaatcaatcagctggttgatcaattatgtgaagcaatatcctcatactgttttattcgtaacccatgatcgatattttttaaatgaagtttccactagaattattgaactaaacagaggtaagttagcgtcatatcctggtaactatgaatcttatattgaaatgcgcgctgaaagagaagtaacacttcaaaagcaacaacaaaagcaacgagctttatataaggaagaacttgcttggatgagggctgggagctaaggctcgtactacaaagcaacaagctagaattaatcgatttaatgacctagamaatgaagttaaccagcaatataaagacgataaaggtgaattgaatcttgcttattcaagattaggtaagcaagtgttcgaattagaagacttatcaaaggctattaatgataaagtattatttgaacatctgacggaaattattcaaaamggtgagcgtattggtgttgttgggccaaatggagctggtaaaacaacactcttaaatattttgagtggagaagaccaacaattcgaaggtaaattgaagactgggcagacggttaaagtagcttattttaagcaaa

SEQ ID NO: 248 - DNA, 852 bp; double-stranded, linear
tgtgattaacgaagcttattttcgtacaccttcaacaactgattacaacggcgtttatcaaggttattatattgattttgaagcaaaggaaactaaaaacaagacgtcctttcctttaaataatattcatgaccatcaagtcgaacatatgaaaaatgcatatcaacaaaaaggtattgtgtttttaatgattcgttttaaaacgctagatgaagtttatcttttaccctattcaaaattcgaagtattttggaagagatataaagataatattaaaaagtctataacagttgatgaaatacgaaaaaatggttaccatattccttatcagtatcaaccaagattagactatctaaaagcagttgataagttgatattagatgaaagtgaggaccgcgtatgacggaaaacaaaggatcttctcagcctaagaaaaacggtaataatggtgggaaatccaactcaaaaaagaatagaaatgtgaagagaacgattattaagattattggcttcatgattattgcatttttcgttgttcttttactaggtatcttattgtttgcttattatgcttggaaagcacctgcttttaccgaagctaaattacaagatccgattcctgcaaagatatatgacaagaacggagaacttgttaaaacattagataatggccaaagacatgagcatgtaaatttaaaagacgtgccgaaatcaatgaaagacgcagtacttgcaactgaagacaatcgtttctacgaacatggcgcacttgattataaacgtttattcggtgcaattggtaagaacttgactggtggatttggktctgaaggtgcctcaacattaacacaa

SEQ ID NO: 249 - DNA, 5804 bp; double-stranded, linear
cacttttttcattaaaaatctcatatttatacactgaacgtaatctcgaatatttttcaacccaagttttaactttaactttttctggataaaaaatagactttttataattgacattgaggtcagtcacaggtgaaatgattccttgtttttccatatcagcataactaaaacctaacttcgatatataatccaaccgcgcaacttcaaaccaagttgcataattcccgtgataaattacacccatcttatcagtttcagcataacgcgcttctatttctgtaatactatatatcattttaagccttctttcagtttaactttatatctcattctaacataaaatacaagaagaggccggccaagaacacaaaggktttgaaccgacctattatatcataaagtttatagaagtatttttgagcactatcaaagtgcctcaaataccgattaaaattttactgtgatatctattttttattgcgctaatttatttcttaaaaccatttgtaaaattccaccgtgacgatagtaatccatttcaacaagtgagtcaaaacgaaccatagcgtcaaattctaccaaatcaccatcttgcttcttagcagtaactttgacgtagtcatgtggttgaacattttcatcaatattaacagraatttcttctgtaccatctagaccaagagaatcagctgattcaccttttttaaactctaatggtaatacacccatcataactaaatttgaacgatggatacgttcataactttgtgcaataactgttttaacacctaataagtttgtaccttttgctgcccagtcacgagatgaacccataccataatcgttaccagctaatacaactaaacctgtaccatcttctttatatttcattgcagcatcaaagataggcattacttcatttgttggccaataagttgtaaaaccaccttcagtacctggcgctaattggtttttaatacgtatattagcaaacgtacctcgaaccattacttcgtgattaccacgtcttgaaccatatgaattaaattcacgaataggcacttgatgatcttgtaaatatttaccagctggcgtatctttaccaattgcacctgctggagagatgtggtcagttgtcacagaatcaccgaatttacccataacacgtaaaccatttaatggaacaatcgtacccggttctttagataatccttggaagaatgatggattttgaatgtatgttgaattaggatcaaagtcatatagaggttgatcagttacatcaatctcattccataattcgttgttattgtatacgttattatattcttcaataaataattcaggtgttacaacactatcaacggtatctgaaacttctttaattgatggccaaatatctttcaaatatacatcttcaccgtcattacctttaccaataggttcattttgtaaatcaatatcaaccgttccagctaatgcataagcaacaactaactgtggtgaagctaggtaattggctttaacaagaggatggatacgaccttcaaagttacggttaccagataatacagatgtcactaataggtcctcatcagcaatcgctttttcaatttctggtaataaaggacctgaattaccgatacaagttgtacatccataaccaaccaagttgaagcctaaatcatctaaataaggttgtaagccagcatctcttaaatatccggtaacaacttttgatcctggtgctagagaagttttaacgtattcaggaactttcaagcctttttcaactgcttttttagcaactaaacctgcacctaacattacataagggttagatgtatttgtacatgatgtaattgctgctattgcaatatcacctgttttcattgtagcttttgatccatctttaaagttaatttcagctttcttatcaaattcacttttatctaaaccgtgtccttggttgcctgctggagctgttacagaattttcaaatgatgatttcatatcacttaagaaaattaaatcttgaggacgttttggtcctgaaagcgatgcttcaactgttgataaatccaattcgataacatctgtataattaggatcttctttctcaacatcaaagaacatatggttttgtttcaaatattcttttactagcgcgatatgttcgtctgatctaccagttaacttcatatatttaagagattcatcatcaactgggaagaatccgcaagttgctccatactctggtgccatgtttgcaattgtagcacggtctgctagtggtaaatgttgtacacctggaccaaagaactccacaaatttaccaacaacaccttttttacgtagctcttgagttactcttaacgctaaatcagttgctgttgcgccttgtggtaatgaatttactagtcgtacaccaataacctctggaattgggaaataagaaggttgtccaagcattccagcttcagcttcaataccaccaacaccccatcctagtacgccaataccatttatcattgttgtatgtgaatcagtaccaactaatgtatctggaaatgcagttttttcaccatctacatcacgaacatgtacaacacttgctaaatattctaagttaacttggtgaactattccagttgcaggaggaactgcattgtaattatcaaatgctttcgttgcccaatttaaaaactgataacgttcatagttacgttcaaattctaatttcatattacgttcaagagcttctggatttgcatagctatccacttgaactgagtggtcaataactaaatccaccggtacttctggattaattttagtaatatctcccccaacgtcatccattgctttacgtaaagaagctaaatcaactacggctggtacacctgtgaaatcttgtaaaataacacgagaaggtttaaatggtacctcgccttcatttccatcttttccaaactgacttaaagctttaatatgatcgtctgtaattacaaaatcatcttcttgacgaagtaaagattctaacaaaacacgaattgaataaggtaaattggaaactttagtaataccttgctcttctacagcttttaaatcatagtaagtataactttggccattcaagtcaaaatgtttttttgattgctctttaaaatttgcagccatttaatgatcccccttgatacatttttatatttatatgccttgattaaattgtattattatatttattgataaacaactcatcatgcttagaaaacgcttaatttaggttttgactttttaatcagagtatataagcaaaacttatcatacaggtaaggtgtaataagtattttttattaattgagaataattatcaatttcgcgaatgattcaattcaatttttaaacgtattatttcattgagcagaaagaaaattatggcaccaaactttaatatttttttcaatgtcattcttttgatgggagtgggacagaaatgatattttcgcaaaatttatttcgtcgtcccaccccaacttgcattgtctgtagaaattgggaatccaatttctctttgttggggcccatccccaacttgcacattattgtaagctgacttttcgtcagcttctgtgttggggccctcaccccaactcgcattgcctgtagaatttcttttcgaaattctctgtgttggggcccctgactagaattgaaaaaagcttgttacaagcgcattttcgttcagtcaactactgccaatataacttcgtagagcatagaatattgatttatgtcccagcctgagttaattttctataaaagtatatttaatttgcgtttataccgtcaaacttcactttagctttgtcaaacccctttctattaagttttcagaaataaacctatcttaaaatataaaaaaatcgagaattcgtagtttaataacgaaattctcgttcttatccttttgaatatactcaattttccacaaaaacaaacaagtagtatatctgttctagctactagaatgacatactacttgttattaaaatacttaactaaactttattagttatcttttttctctatatttctacgtgactgacgcttttcaagaatgtcagattcataatcttcttgttgactcttgatatattcttgtaagcgatgtttattcggagtcaatgttaaacctaggaatttacgttcctggttcgcatccttgtagaaacttaccatcatgagtatgacgacaaaggagaatgggaatgcacttataattgcagcactttgaatcgcatttaaagcttcagcgccgttaccgccaccagctaataaaagtacaaatgctattaaggcctgtgaaattccccaaacaacttttaccatactagatggatttaatgaaccaaatgttgtttgcattcctaatacaaatgttgctgagtcagcagatgtaataaagaatgatgcaattaataataatgcaatcaacgataaaacaatgccaaatggcacatgattaaacactccaaatagctgtgtttcaggagtcatatcaaaaatttctttgtgtttcttacctgtctcgatgcctaatacaccaaagacactaaaccaaacaaaactaacaattgctggaactagcaagacaccagaaatgaactctctaattgaacgtccttttgaaactcgtgcaataaacactccaacgaatggactccaacttaaccaccaaccccagtaataaagtgtccatgaagacatccattcacgtttttgaggatttaaagctgctgtatcaaaactattaaacaagaatgtgtttagtaaactacccgtagagctagttaacatatttaaaataagaacagttggtccaacaattaaagcagctaccattaaaatagtacctaaaccaatgttcaagttacttaagtattgaatacctttacttaatccagaccatgcacttgctataaataagatagtaacaacaatgatgataatcgcttgtacaaacgtattgtttggaacattgaacaagtaatgtaaaccaccattaatttgtagagcacccatacctaacgaaacggctaccccaacgattgtcgcaaatacagataaaacgtcaataaaaatcccaataggaccttctactttatcacctaaaagaggacgtaaagttctagataataaacctggttcacctttacggaattgcgaatatgccaacgtaacgcaacaacaccataaacagcccaagcatggaatccccaatggaaaaatgttgaacgtagagcttcagtataagcttcagtagttttgggatctgctgtaggtggcgtagcaaagtgcgccatcggttcagctgcaccataaaacaccaaacctatccccataccagcactaaacaacatagcaaaccatgaaattgtattaaactcaggtttgtcatttggtttacctagtttaagttttccaataggactaaaaataaggaatatacagaagaacacgataatcgtagtaagaataagataataccaacctaacttttctgtaatccacattttaatattattggtaacatagttgaattgttcaggtaaaaatgcaccaagtaatacgactatagcaacaacaattgcactatagatgaagactggtgaatacttctttccatttggattctctggtgaagaagaattcataattaattactcccttcaattctatatttaattttatgtagtagaataaaaatattatctaaacattttattcaataactcacg

SEQ ID NO: 250 - DNA, 400 bp; double-stranded, linear
acccgcgaatatggtccatcctatcgatttatttttaactggtttgacaatatttaatttttcataatcattcttagtgattttgacatatgttttcggtatgagccagttaataaatggaaagaagaagacaatccaattacttgccaaatcaatcattaaatattcactatcgtatttgattattcgatatttagggtttttattaataactttagattcgcaaagcaatgtctccacatccctttaattttatgtgtaatacatttttcgatacttcaaaagacattcaaatactatcaagttactgtcatcaaaggttttattaactgatattttcatatttttaatctgaatttagtactttcacttaatttttaagtatgacatgratggtttt

SEQ ID NO: 251 - DNA, 964 bp; double-stranded, linear
ccagggtgcggaaagctttaaaatttggactaataaagatgctgatattaattctatgaaaacagcagttttacaacaattaaaaggagaataacatatgcttactggcaaacaaaaaagatacttaagaagtttagcacacaatattgatccgatttttcaaattggaaaaggcggtatcaacgaaaatatgattaaacaaatagatgatacgttagaaaacagagaattgattaaagtacatgtactacaaaataactttgatgataaaaaagaattagctgaaacattaagcgaagctactcatagtgaattagtgcaagtgattggatctatgatagtgatttatagagaatctaaagataataaagaaattgaattgccataataatgaaaaagataryactttacggcggtcagtttaaccctatccatactgcacatatgatagtagctagcgaagtatttcatgaattacagccagatgaattttattttttacctagttttatgtctccattgaaaaagcaccatgattttatagacgttcagcacagattaacaatgatacagatgattatcgacgagcttggttttggagatatttgtgacgatgaaattaaacgtggtggtcaaagttatacctatgacacgatcaaggcattcaaggagcaacacaaagacagtgagttgtactttgttattgggacggatcagtataaccaactagagaaatggtatcaaattgaatacttaaaagaaatggttacttttgtagttgtaaatcgagacaaaaatagtcaaaatgttgaaaatgctatgattgcaattcagatacctagggtagatataagttcgacaatgattcgacaaagagttagtgaagggaaatctatccaagttcttgttcctaaatccgttgaaaactatattaagggggaaggattatatgaacattgaaaaa

SEQ ID NO: 252 - DNA, 1193 bp; double-stranded, linear
cccattttttaatttatttggttgaatgantggggttatgaaaaaggaagttttaatcttttgtcatgaaataaatgggatgaatatcacgactagaagtaatgttacgaacaggagcgtataaactagagacgctaaattcgacatagtatgtngctcaattatggctgatgatgaatttaaagtatgtgcgttggaactgtcggatttttgttcataatgttttgcatattgcgccatgatgaatagtgtaaaaataaataaaacaataagagatataatgcccataatcaaaagtatttgtttagagcctttcattatttcacatcctttctaaaatatatttgtaactaaatttaaaatagttatttttgtaattctaaacctttttcatcgcgaaaacaattaaataggtcgcggtattaattattatattattaccgcttaatatgaaaaatacatgaaaattaattttctaatatacttttgaaaaattattacaaattagccccttcaaaacgcgaaaacataaggattctagtttcaaaagggctgataagcataaaatgaaatgtaatatttcgatgtataaaatttttaattagctaaaaatcatcgcattaattttttgagctacatcatcaaaattcggacattttaacgacacatataatttaattttaggttcagtaccagaaggacgtaaagcgataaatccttcgtcaaataagacacgaataacatttgatttaggagaattaatctgcgacgttgtatctttatccaaatgataaacctcgctagttaaataatcttcaattgctttcactttgagtccttgaatctcttgcggtggatttgaacggaatttggtcattattgcattaattttctttttcccttcaaatccttctagcgtatgcggaataatgtatcctcatgtctaccaacagtttgataaatctgttctaattcatctttcaatgttttgccatataattttaactcagaagcgtattttataatgagtggcacaatttgtacggcatctttatcacgtacaaaaggctctgatagaaaaccgtaactctcttcaaatgcgaaaatcatatttgatgatcatccagttgtcttatttcctgagcaataaatttaagcccgtcagcacctctttggtattcaacattattata

SEQ ID NO: 253 - DNA, 1098 bp; double-stranded, linear
tatcaggatgattatgncggggttttattaagtctgagcgtatatnccttttattctcctaaatggtttggaattcaaggagaagacgatgaaatggtatccaaaaaccaangaatatatngcattaagtctgaggatgatagtgcggtggcaattcgttcattaattttgcataaagatgaacctatgtatttaaaaaaacgtacatgtgtacctactttgttaattaatggggaacatgatcctttgattaaagataagaatcattttaaattggaagcgcattttttaaatgttacgaaaaaaatcttcgaacattcaggacatgcaccgcatattgaagaaccagaagcatttatgaattattatttaaaatttttaaaaagcgtatcataatatgtgatatataaacctagggcataaagtccttaggcaatgtgaaaaagctgattactattcattatttgatagaaatcagctttttttgaaatgtatttgatatatactgctcgttatgcggctatcttccttatattaagtgccattagtgcaaaacctcttaacaattaggtaaaaagagcataaaaaaaggaagtttaatagaatgtatcatctatcaaacttcaccaaattgcgctaaacaaaattatagttcaatttcgttgtttgcttcagtgattcgtttatttactcgactcaataatgattcgatttttttacgttgttgtgcattaacaagaattaatacagttctttcatcatgctcattacgttttttatcgaagtaatcttcttgagataaaattttaactgctttaacaacttgtggttgtttgtagtttaaatgattaataatatctttaagatagtattctttctctttgttttcgctgatgtatgtcaatacagcgaattcttcaaagctaattganaattcctttttaattaaactttttaatttgtcagcataagtgaccattgataacaactcaaagcaatcattgatttttgtaattgccatgtttaaaacctccctatttgatgcatcttgctcgatacatttgccccgataatatantgtatctaatctttatgnat

SEQ ID NO: 254 - DNA, 2881 bp; double-stranded, linear
ccaggtaaaattgtgcaatcatttgacgcattaatggacgccttggacaatgaagattatgaaggagaaaaagtcattccattcttagataaacattttaaatatcaagatggccgatcaagtgagcgtttagtcagaaatttatttggtagctaagtttatatagtagtcaaagtgggagaggtataatgatgaaattttcagtaatagttccaacatrcaattcagaaaagtatataacagaattacttaatagccttgcgaaacaagattttccgaaaactgaatttgaagtggttgtagttgatgactgttcaacagatcaaacgttacaaatagttgaaaagtatcgcaataaattgaacttgaaagtaagtcaactcgaaacaaattctggtggtccaggtaaacctagaaatgkggcgttaaaacaagcagaaggtgaatttgtattatttgtggactccgatgactatataaacaaagagactttaaaggatgcagcagcatttattgatgaacatcactcagatgtcttattgattaaaatgaaaggtgttaatggtcgtggtgtaccacaatctatgtttaaagaaacagcacctgaagttactttgttaaattcaagaattatctatactttaagcccgactaaaatctatagaacagcattactaaaagataatgacatttattttccagaagaattaaagagtgcagaagatcaattatttacaatgaaagcatatttaaatgcaaatcgaatcagtgtgttaagtgataaagcgtattattatgctacaaagcgtgaaggtgaacatatgagtagtgcgtatgtttcacctgaagacttttatgaagtcatgagattgattgctgtagaaatattaaatgcagatttagaagaagcccataaaaatcaaatcttagcagaatttttaaatcgtcattttagtttttctcgtacgaatggcttctcacttaaagttaaactagaagatcaaccacaatggattaatgctctaggagactttatacaagcagttccagaacgtgtagatgcattggtgatgagtaaattacgaccattgttgcactacgcgagagcgaaagatatagacaactatagaactgtggaagaaagttaccgtcaaggtcaatactaccgttttgatattgtagatggtaaattaaacattcaattcaatgaaggcgaaccatactttaaaggcattgatatcgctaagccaaaagtgaaaatgacagcatttaaatttgataatcataaaattgttacagagctaacgttaaatgaatttatgattggcgaaggacattatgatgtcagacttaaattacattcacgaaacaagaagcacacaatgtatgtacctttaagtgtcaatgcgaataaacaatatcgttttaacattatgttagaagatattaaagcgtatttacctaaagaaaaaatttgggatgttttcttagaagtccaaataggtacggaagtatttgaagtgcgtgttggtaatcaacgtaataaatatgcatatactgcagaaacaagtgcattaattcatttgaataatgatttttatagattaacaccgtatttcacaaaagactttaataacatttcgttatactttacagctattacattaacggattcaatctcattgaagttaaaaggtaaaaacaaaatcattttaactggtctggatcgtggttatgtatttgaagaaggtatggctagtgtcgtactaaaagacgacatggtgatgggaatgttaagccaaacatcagaaaacgaagtgcnaaatcttacttagcaaagatattaaaaagcgagacttcaaaaatattgttaagttaaacactgcacatatcacttatccactaaataaataataaatgccctcaaatcattgtgagccaacatgatttgagggctttattttgctgtttatgacatgattatgacatttccctgattttcattttcatatacattaaattgtatacactggaaatgaggaggttatctataatgataaataaaaatgacatagtagcagatgtagtaactgattatccgaaagcagcggatatttttagaagtgtgggaatagatttttgttgtggcggacaagtaagtatagaagcagcagccttagaaaagaaaaatgtagatttgaacgaattattacagcgtctcaacgacgttgaacaaacgaatacaccaggttcgttaaatcctaaatttttaaatgtttcatcacttattcaatatattcaatcagcatatcatgaacctctaagagaagaatttaaaaatttaacaccttatgtgacgaagttatcgaaagtacatggacctaatcatccatatttagttgagttaaaagaaacatacgatacatttaaaaatggcatgttagagcatatgcaaaaagaagacgatgtcgattttccaaaactcattaaatatgagcaaggtgaggtagtagacgatattaatactgtgatagatgatttagtttcagaccacattgcaacgggagaattgttagtaaaaatgagcgaattaacatctagttatgaacctccgatagaagcgtgtggtacttggcgacttgtttatcagagattaaaagcacttgaagtgttaacacatgaacacgtacatttagagaatcacgtattatttaaaaaagtatcataaataacgcgattagaaactgttggcaaaaataagtccagcagtttttcgctatgtataaaagtcataatagtgacataaacagcattatttgaaaagaanaatggtcaacttagcataaaaattgatatgaanatttaatggtatagataatta

SEQ ID NO: 255 - DNA, 1056 bp; double-stranded, linear
accgtcgaatatcgcttgtgatttacaatttgtgtattaagatgctcaactaatttgggtacatattccgaatttagatttgcaagtacaacaattccataattttgttttggatttagtaaaataaatgatgaaaagttatctagcgttcctgaatgaaacactaaatgttcatcattattggtaaaccagccggaagcatatgcattggcattaggttcaccaattgttgaagataaatttttatgtgattgttgaactaatgatttgtatttatcaggtggattaagttggaattttatccaatgttccaaatcttcagttgatgtcatcatatatgctgatggtgtatcccaaaggttaaattcaggtttagagacgacaggtgtcgaaccttgtaattcatagccaatagcatcatgttttgatttgtaattggtttgtttgaatgatgtatgtgtcatatgcaaaggcttgagccatgaatttgtaatatattttgtataggattgcttcgtaacgttttggataattaaacctaataaatcatagttcatatttgagtattcaaattcttctccgggcttatgatgtaattcatcacccataattgcatgggttacatcatttaaacgattatttttgcttgtcacagaatcttcgcttgtaatatcactaggtataccacttgtttgagccaaaagttgcttaatcgtaatagtttcattttgaccattatagttcattttaaaatgaggcacatgtttggatacggcatcatttaagtttaatcgaccttcttgagctaattttaaaattgcaagacctgtgaaagctttcgtattagaagcaatttcatactttgttgtgggagaagctttgacttttttatcaacatcttgataaccataacctttatttaaaaaaactttgccattttttactaytaaaattgatgctccaggaatgtgtcccttttgtaaatcatgctcgataattgtatctatttgttgttgcgaatcattggttaaccgtgtcttcgtattgctatttaat

SEQ ID NO: 256 - DNA, 1277 bp; double-stranded, linear
atgccacacttattggtggcaggatcgacgggtagtggtaaatctgtttgtataaatggtattattacaagtattttattaaatgctaagccgcatgaagttaaacttatgttaatcgatccgaaaatggttgaactaaatgtttataacggaattccacacttattaattccggttgttacaaatcctcataaagctgctcaagctttagaaaaaattgtagctgagatggaaagacgttatgatttattccaacattcatcaactagaaacattaaaggttataacgaattaatccgtaagcaaaatcaagaattagatgagaagcaaccagaattaccttatatcgttgttattgtagatgagcttgcagatttaatgatggtagctggtaaagaagttgaaaatgcgattcaacgtattacacaaatggcacgtgcagcaggtatacatttaattgtagcgacacaaagaccttctgtggatgtaattacaggtatcattaaaaataatattccatctagaatagcttttgctgtgagttctcaaacagattcaagaactattattggtactggcggcgcagaaaagtkacttggtaaaggtgacatgttatacgttggaaatggtgactcatcacaaacacgtattcaaggggcgtttttaagtgaccaagaggtgcaagatgttgtaaattatgtagtagaacaacaacaggcaaattatgtaaaagaaatggaaccagatgcaccagtggataaatcggaaatgaaaagtgaagatgctttatatgatgaagcgtatttgtttgttgttgaacaacaaaaggcaagtacatcattgttacaacgccaatttagaattggttataatagagcatctaggttgatggatgatttagaacgcaatcaggtaatcggtccacaaaaaggaagcaagcctagacaagttttaatagatcttaataatgacgaggtgtaaaaaaatgtcagaaatgaatgcggtatataacgttaaacaatacattttaaatttgattaagcaaaataaattggaatatggtgaccaacttccaagtaatttatcaattgccagagaattaaatgtaaaaaccgacgatgtttatgaagcaattcagcattgattactgaacaagtcattaaagatattttgaagagggcacaagtgttaagtcactgccccctttcttttatccattgaatgaacttataagtattgggcaaatgattaaaaatgcaggrtttgaatgcggaact

SEQ ID NO: 257 - DNA, 3557 bp; double-stranded, linear
taccgtcgttttatgygtcaaattttacagtaaattttgcttcatcaaaagaaataacctttaacaagtatagtaattttacattttacaatgttacaaaatataattttttataattagttaaaatcactaaaacgcttttatacactatcaaatcagcatttataaaaatatgaaccgatatcctaaaatgttaataatattacaagataataacaraccacacaaagctacttatttttgataatatggaaatcgtaatataaaacnaaaacttaatttactatataaattgtcttaataatttttaaaagtagtaaaacataattttaaggaggagtccctttgaaaaaattagcatttgcaataacagcaacatctggtgcagctgcatttttaacgcatcatgatgcacaagcttctacacaacatacagtacaatctggtgaatcattatggagtattgctcaaaaatacaacacttcagtagagagtattaaacaaaataaccaattagataacaacttggtattccctggtcaagttatctcagtaggtggaagtgatgcacaaaatacgtcaaacacttctccacaagctggttcagcatcatctcatactgtacaagctggtgaatcattaaatatcattgctagcagatatggtgtttcagttgatcaattaatggcagccaataacttacgtggttatttaattatgcctaaccaaacattacaaattcctaatggtggatcaggtggtacaacaccaacagctacaacaggtagcaatggcaatgcatcatcttttaatcaccaaaatttatacactgctggtcaatgtacatggtacgtatttgaccgtcgtgctcaagctggtagtccaattagcacatattggtcagacgctaagtattgggctggtaacgcagctaatgatggttaccaagtaaacaacacaccatcagttggttcaattatgcaaagcacacctggtccatatggtcatgttgcttatgttgaacgtgtcaatggtgatggtagtatcttgatttctgaaatgaattacacatatggtccatacaatatgaactaccgtacaattccagcttcagaagtttctagctatgcattcatccattaattaaataaattgtactgatatatactagcaattcacatcatgtgagattgctagttttttatttttgaaaaaaattttcattttggtacaaaaaattatctcacccttccctatcatacatatttatattttgtatgaatggtagttaggtaaaaattaacaacctacctatttgattaaattaaatgcataatatattaaaaatcaaaataatgcaactaagttgactatataatgatttaatttgttataccagtattttacgctttttcgtctacatatacaaatttatattaaataaagcccaatacaatttaggttaattaaacaagttgataactatttaattattccttcattgaagaatataaactattaaatcattattttgctcttacatatattttaatgacctaactgattatgttccatggaatacatttataatatagcctcctaattaaratgcyttgtcttggtcattctacgtaaattctataaaatatgttatctacttacataararnctgracttcaataccaccatatgtttgtgatactgaagttcagtttagttttattttcaattagaaaaataagttaagtatatagaatagtaaacctgctaacaatgctgaaataggtaatgtaatcacccatgtaatgatcattcgttgcgcagtgctccattttacacctttagctcggttagaagcaccaacacctaagattgatgatgacacaacgtgagttgttgataatgggaaatgtagcgatgatgcaacaaaaattgttaatgcagatgataaatcggccgcagcaccatttgctggacgtattttcataatattaccacctacagttttgataattttccagccaccaattgcagtaccaagccccattgctgtcgcacaggcaaattttacccataactgtggttcaacactgccatcattctgtacattagcgacaatcaatgccaacgtaataatacccattgatttttgcgcatcattcgtaccgtgagagaatgattgtaacgctgctgtgaaaatttggaaaaatctaaagttacgattcgctcttgttaaatttgcatttttaaagataactttaaaaattgaatacatcaagaaaccaacacaaaatgcgataatcggtgaaacgattaatacaataataatttttgtgaaaccttggtaatgtaacactccaaatgagccttcagatgcgattgctgcacccgcaattgaacctataagtgcatgtgaagacgaacttggaattccgtaaaaccaagtagctaaattccaaataatagccgcaagtattgcagctaacacaacaactaatccattttccaatttaaatggatcgacaatgtctttagtaatggtgcctgcaacgcccgtaaatgttaaagcacctataaagttcatcactgctgccattaaaattgccgttttagggttaacgctctagtagatacagcagtagctactgcattggctgtatcatggaatcccattgataaagtcaaatatcagcgagaaaataactacagctatagtgacgatgattatatatgacataaatatatactccccttagctatttttcataataatagtttcaaaattatttgctacgatttgacatttatcagcgatttcttccatgctttcataaatatcttttattttaattaaagtgattggatctgtttcgctattgaaaatatgtttaattgactgtcttaaaataccatcacagtttgtttcaaattctttaatattaattgaatgaatacgcatatgtgataattttttatcgactaataagccgacagcaagtttcatttctgcaactgctttttgaatgttatcaacaaactcagccatatattcatctgtgtattcgattgaatacatttcaaacatrgctgccgtttcttcaattgcatctaaaacatcatcaattgcatcacataatgataaaatatcttcacgttcaattggtgtgataaatgtttgatttaaatcagtaattacttgatgtactaattcgcaccatgtgactcataagttttaatgttgtctgagtatgcttttaaatctaaatgtgtattgaaatccattttaccgaattcaatagcagcacgatccagattgaaaaccatctcttctaattgaaccataaacttatcttttttcttactaaacatttaaaatcctccatttaagcgattgtcaccaatcacattcagttataatttgtttcaaattaagacaagtgaatttacaaactaatgatacaaatttgttattatcaatcgtcagtataattttagtgtactgatattaatttcaaaaatgcctcacagtaaacaatttactgtatttgcccttata

SEQ ID NO: 258 - DNA, 1631 bp; double-stranded, linear
aactatacatttcgaaaaattcttctagtgaacctgcgccaccaggagccatgacaaatgcatctgcaagttctgccattttattttnacgttcatgcatagaatcaactaaaattaattcagttaaacgttggcttgtgatttcatgttcatctaacattttaggcatgacgccaatagctttgccgccatgatctaatacaccatcttgaatggcacccataatgccaattgaccctgcaccaaatactaattcataaccttgttcagcaaaatatttacctaaatcgtatgctttttgtacatatgaagggtcatgacctttgcttgcaccacaataaactgcgattcgtttcatgttaatccagctccttaattcgatgaatgacttttaatagtgattgttcaaacactttttgatcttgctttgtaaaaggtgggggacctttgtggcgaccaccttgttttctaatttgtgcattcatatatcgtttatctaatagttgttgaatatttttggaattgtatatcttcccattatgatgcatgacaattaagactttgtcgactaataaacttgcgagtccataatcttgagtgactacgatatcatccttcgttgataattgaacaattttgtaatcaactgcatctggtccatcatcaacatataatgttgatacatgtggaggatataattggttcgaaaaatggctgaagctccgaataattgtcacaaaaatgcctgtctcagttgttaaatctataatagaatcaacaacaggacaagcatctccatcaataataatatgtgtcacaattatgcctctgtattgttttctttattttgttgagaggcgcttttggcaacataatctttatattttttaaatgacttgatgcgtgctttatcagcttcttgttggcgtttttgttcttctttgtgtcgtttttcaatatttttttgtaactttttattcattttagcgatttctttgcgatttttttcagctagtttatcgccttttttctcagttttctcatctaatttattaggtgttaagcctgctttttcttcgtatttttgtgattttttcatatctttaatacgttgtatttcattcttttcgcgggctttttgctcttctttatgacgcttttcgatatttttttgaagtattttattcattttatcagcgtctttacgattttgtttagctaatttttcgccttttttctcaatataggcaggatcatgttctctagcaaactttttaagttcacgtttattttcaaaatcttgttttttatcgccgacatattctttaacatcactcgctgtgttactgattgctgcagatgtttttgaagcaactttacttgtagcatctgtaactttttgtacgtccggatgttgtttgatacgtttacgttcaacaattaacggtaccaatacaattggtaatacattaatcataaatttgatgacttttttcttatccatagatcttgcctccataattactttattaattttacataccctatgatacatcaatataaacgatgatagtagtgaatcactattaagtatttcagatgttttttaaaagaagacccaattanaaaaa

SEQ ID NO: 259 - DNA, 6645 bp; double-stranded, linear
cgaaatcatgatttaatgctttttcatataagcttttccaattaatctttcgtccatgatattcttcaactgttgctagatattgtgcaattttagttactttaaaggagtgtgctgcaacattgtgktcmaaatatttaaattttccaggtaatcttataagtctttccatatctgataatcttttaaaatattgatgtacacccatttcaattacctcctccattaattaatcataaattatactttctttttacatatcaatcaattaaatatcatttaaatatcttctttatataactctgattaaatgataccaaaaaatcctctcaacctgttacttaaacaggctaagaggatagtcttgtcttgatatattacttagtggatgtaattatattttcctggatttaaaattgttcttgaagatttaacattaaatccagcatagttcatttcagaaacagtaattgttccattagggtttacagattcaacaacaccaacatgtccatatggaccagcagctgtttggaaaatagcgccaacttctggtgttttatctactttaaatcctgcaacttttgctgcgtaattccagttatttgcattgccccataaacttcctatacttctacctaattgtgcacgacgatcgaaagcataatatgtgcagtttccataagcatataagtttcctctgttagcaactgatttattgtagttatgtgcaacaggtacagttggtactgatttttgtacttgagcaggtttgtatgctacattaactgtcttagttactgcttgcttaggtgcttgcttaactactacttttttagatgcttgttgtacaggttgttttactacctttttagcttggcttgcttttcttactggtgatttaaccgctttagtttgtttcactttattttgaggcacaagtgaaatcacgtcaccaggaaaaattaaaggtgttacaccaggattgtatgaatataattgattcaacgttaagtgatgctctaaagcaatcttatataatgaatcgccagcaactactgtataagttgtcggtgattgcgtttgtgcttgaacatttgatacataattatgttgaacaggtgtttttacttgtgtgccatgttgttgtgcatgtgctgcattatttaaagctaaaaaagctaacactgacgaaaccgtcactgtaagagattttttcatcttgctgtcattcctttgctgttagtattttaagtatgcaaatactatagcacaatacattttgtcaaaagctattgttataacgatgtaatcaaatggttaacaatataaaaagaatacaaccttttatcatagtgtaaaatgtattcataccatgtaattgagaacgttttcaataattaattcaataccttgaaaatcgccataggtaatattactaaatgcacactgcatatgttgttttaacaaacacaacttttaaaaaatatattctaactctatctaccgaattgtacttaaatattcataaacaaatcatattccaaaatctaatttacaatttatttagctacctttaaaaaaaccaaaaaccgacgcccttttagagcctcggttttaaaatatatattaatcgtgcgacattgtctgtcttaaatatgattcgataaatggtccaatgtctccatccatcactgcatcaaccttacctgtttcttcgttcgtacgatgatctttcaccattgagtatggatggaaaacatatgatctaatttggcttccccagccgatttctttttgttcgccacgaatttcagccatttcacgtgcctgctcttccaattttaattgatataatttagactttaacattttcatagctgcttcacggtttttaatttgagaacgttcattttggttattaacaactatacctgaggggtggtgggtaattcgtattgccgattcagttttgttaatatgctgaccacctgcaccagaagctctgaatgtatcaactgtaatatcatccggattgatttcaatctctatttcatcattattaaaatctggaataacgtcgcatgatgcaaatgatgtatgacgacgtcctgatgaatcaaatggagaaattcgtactagtcggtgtacacctttttcagcttttaaataaccataagcattatgccctttgatgagcaatgttacacttttaatccccgcttcatccccaggtagataatcaacagtttcaactttaaagcctttcttctcacaataacgttgatacattctaaatagcatattagcccaatcttgagactccgtgccacctgcaccaggatgtaactctagaattgcgttattggcatcgtgaggcccatctaataataattgcaattcgtattcatccactttagccttaaaattaatgacctcttgctctaagtcttctttcatttcttcatcaaattcttcttgtaataaatcccaagtagcatccatgtcatctacttctgcttgtagtgttttataaccattaactattgcttttaacgcattatttttatctataatatcttgcgctttcgtttggttatcccaaaaattaggttctgccatcatttcttcatattcttgaatattagtttctttgttctctaagtcaaagagaccccctaatttgtgttaaatcttgattatacttatctatatttcgtttgatttctgataattccatagcattcgctcctatttatatttcaattcaagtcattgatttgcatcttttataatgctaaattttaacataattttgttaaataacaatgttaagaaatataagcacactgacaattagtttatgcatttattgttaaaaatcagtacatttatcatcgacatatgcctaaaccgattttttaaaactaagtacataacaacgtttaacaacttcttcacattttttaaagtatttaacgcttgtaaaataaaaagactcctcccataacacaaactataggtgtttaattggaaggagttattttatatcatttattttccatggcaatttttgaattttttaccactaccacatggacaatcatcgttacgaccaacttgatcgcctttaacgattggtttcggtttcactttttctttaccatcttcagctgaaacgtgcttcgcttcaccaaactctgttgttttttcacgttcaatattatcttcaacttgtactacagattttaaaatgaatttacaagtatcttcttcaatattttgcatcatgatatcaaataattcatgaccttcattttgatagtcacgtaatggattttgttgtgcataagaacgtaagtgaataccttgacgtaattgatccattgtgtcgatatgatcagtccaatggctatcaatagaacgaagtaaaatcatacgctcaaactcattcatttgttcttctaagatatctttttgactttgatatgctgcttcaatcttagcccaaacgacttcgaaaatatcttcagcatctttacctttgatatcatcctctgtaatgtcaccttcttgtaagaagatgtcattaatgtagtcgatgaatggttgatattcaggctcgtcatctgctgtattaatatagtaattgatactacgttgtaacgttgaacgtagcattgcatctacaacttgagagctgtcttcttcatcaataatactatttctttcgttatagataatttcacgttgtttacgtaatacttcatcgtattctaagatacgtttacgcgcgtcgaagttattaccttctacacgtttttgtgctgattctacagctcttgataccatttttgattcaattggtgtagagtcatctaaacctagtcggctcatcattttctgtaaacgttcagaaccaaaacgaatcattaattcatcttgtaatgataaatagaagcgactatcccctttatcaccttgacgtccagaacgaccacgtaactggtcatcaatacgacgagattcatgtcgctctgtacctattactgctaaaccgcctaattcctctacgccttcacctaatttgatatctgtaccacgaccagccatgttagtggcaatagtaacggcacctttttgtccagcgcctgcaacaatttcagcttcacgttcatgatttttcgcatttaacacatcatgacggataccacgttttttaagtaaatttgaaatatattcagaagtctcaactgcaacagtacctaatagcactggttgccctgccttgtgtttttcaacaacatcttctactactgcatcaaatttacctttttggctaatgtaaattaaatcagacttatcgttacgttgcacaggtttatttgtcggaatttgagttactgtcatgttataaatatttctaaattcttcttcttcagttttagctgtacctgtcatacccgcaagtttattgtacattctgaaatagttttggaatgtaatagacgccatagttttagattcattttgaatttgaacgccttccttcgcttcaatagcttggtgtaaaccttccgagaaacgacggcctggcattgtacgtcctgtaaattgatcgacaattaatacttcgccatcaacaaccatatagtctacgtcacgttgtaatgtaacgtgcgcacgtaaagctgtgttgatatgactaataacatcaacattttgtacatcatataagttttcaactttgaacatacgttcagctttatccgcaccttgttctgttaaatgtacagctttcgttttttcatcgtatttataatcttcgtcctgttttaacattttcgcaaaaacatttgcttgtgtataaagtgacgttgacttttcagcttcaccagaaataattaatggcgtacgtgcctcgtcgattaaaattgagtcaacctcatcaatgattgcaaaatgtaatggacgcattactctatcttcagaataattcaccatgttatctcgtaagtaatcaaaacctagctcattattagtactgtaagtaatgtcttgtgcgtatgcttcacgtttttcttctgtcgtcttactgtttaagtttaatccgacagtcaaacctaagaagttatataactcagccatttcttcactttgaacacttgataagtattcattgactgtaataacgtgaacacctctaccagctaatgcatttaagtatgttggcattgtcgctgttaatgttttaccttcacctgttctcatctcagcgatatcacctttatgaattgcaataccacccataatttgaactttatatggtgtcatattgaatacacgtttagagccttctctaacaagtgcatatgcttctggtaaaattttatctaaataatcattttgctttttgacattatcaatgtcagctaattctgtttggaattgtttcgttttattacgaatttcttcatcagttaaaattgccgttttttcttctaaagcgattactttatcagcaagtttacctaactgtttaatttctttattattgccatcaagaatttttgataaaaatcccatttcgttcgctcctttagctaaaaaactgtttggcctacaacaatatatcttatcatttatagttagaaaattatacttatttactcatttgtagaatcaatataaatatatttatgacatacttcattcacattctgttgtcaacaagtttatcactaataaatatattctcaatacgcaattatacttcctaataaattatattataaatattttacgattttcgactcggactatacaatagactgacatactattattaacttaacattcaaatatatacatccattaacattagcatagtcactatgtttcattcaacaaattacattatcgaactatgaaatagtcataatttgcttttggagtataaaaaagcacttgtgcaaaaacacaagtgctttaaacttaatttattgttcactagtttgaatcaagccatatttaccgtctttacggcggtaaacgatacttgttccatcagtttctctgtctgtgaatacaaagaagtcatgacctaatagattcatttgtaataccgcttcttctgaatccattggttttaagctgaattcttttgaacgaataatttctatctcgttatcatcgtaagcgtcattatcaacttgtgtttcttgcatttcttgtaattcggcaacaaacacttcttgatctcctcgatcacggctcttacgattaatacgtgttttatattttcgaacttgtctttcaagtttattattaattaaatcaatacctgcgtataaatcatcgtttcgctcttcagctcttaacgtaacatttttcaatggaattgttacttcaattttagtagctgaatttgaataagttttaactttaacatgcgccactgcatttggtacgtcattaaaataacgttccaacttaccaattttttcckcaatatagttgcgaatagcatctgtgatagtgaggttatctccatgaatttcaaatctaatcatagtaaatctctccttaaacctctttatnggnaactcnttattatatttaacatttttacgccaatcgtgcaaa

SEQ ID NO: 260 - DNA, 7430 bp; double-stranded, linear
cagttccagcacatctattggggatcaacaaactagggaaaatgctaattatcaacgtgaaaacggtgttgacgaacagcaacatactgaaaatttaactaagaacttgcataatgataaaacaatatcagaagaaaatcatcgtaaaacagatgatttgaataaagatcaactaaaggatgataaaaaatcatcgcttaataataaaaatattcaacgtgatacaacaaaaaataacaatgctaatcctagcgatgtaaatcaagggttagaacaggctattaatgatggtaaacaaagtaaagtggcgtcacagcaacagtcaaaagaggcagataatagtcaagattcaaacgctaataacaatctaccttcacaaagtcgaataaaggaagcaccatcattaaataagttagatcaaacaagtcaacgagaaattgttaatgagacagaaatagagaaagtacaaccacaacaaaataatcaagcgaatgataaaattactaactacaattttaacaatgaacaagaagtgaaacctcaaaaagacgaaaaaacactatcagtttcagatttaaaaaacaatcaaaaatcaccagtagaaccaacaaaggacaatgacaagaaaaatggattaaatttattaaaaagtagtgcagtagcaacgttaccaaacaaagggacaaaggaacttactgcaaaagcgaaagatgatcaaacgaataaagttgccaaacaagggcagtataaaaatcaggatcctatcgttttagtgcatggtttcaatgggtttacagatgatattaatccttcagtgttagctcattattggggcggtaataaaatgaacattcgccaagatttagaagaaaatggttacaaagcttatgaagcaagtataagtgcttttggaagtaactatgaccgcgcagttgaactttattattatatcaaaggcggtcgtgtagattatggtgcagcacatgcagcaaaatatggacatgaacgttatggaaaaacatacgaaggaatttacaaagactggaaaccaggacagaaggtacacctagttggacatagtatgggcggtcaaacgatacgtcaactagaagaattactgcgtaatggtaatcgtgaagaaatagagtatcaaaagaaacatggtggcgaaatttctccactattcaaaggtaatcatgacaatatgatttcatcaattactactttaggaacaccacataatggtacacacgcatcagatttagctggtaatgaagctttagtgagacaaatcgtatttgatatcggtaaaatgtttggtaataaaaattcaagagtagacttcgggttggctcaatggggtctaaaacagaagccaaatgaatcatatattgattatgtcaaacgcgttaaacaatctaatttatggaaatcaaaagataatggattttacgatctgacgcgtgagggtgcancagatttaaatcgtaaaacgtcgttgaaccctaacattgtgtataaaacatacactggtgaagcaacgcacaaagcattaaatagcgatagacaaaaagcagacttaaatatgtttttcccatttgtgattactggtaacttaatcggtaaagctactgaaaaagaatggcgagaaaacgatggtttagtatccgttatttcttctcaacatccatttaatcaagcttatacaaaagcgacagataaaattcaaaaaggcatttggcaagtgacgcctacaaaacatgattgggatcatgttgactttgtaggacaagacagttctgatacagtgcgcacaagagaagaattacaagatttttggcatcatttagcagacgatttagtgaaaactgaaaagctgactgatactaagcaagcataatttataaagtaaagggaggaattaataatgactgcagacttctttcaattaatcggatcattatttagaattctaaaagaattattcaagtaaaacattggcgaggccccaacataaagaatttcgaaaagaaattctacaaacaatgcaagttggcggggccccaacaaagaagctggcggaaagtcagcttacaataatgtgcaagttggcggggccccaacatagaagctggcggaaagtcaggttacaataatgtgcaagttggggtgggacgacgaaataaattttgcgaaaatatcatttctgtcccactcccattggcatttacgaagtttaaatgtgcaattagaatatatgtataacaatattaaacacgcggtaaaacgaagtcagtcaattcaaactgatttcgcccaccgcgtgtttttaacatagcttaataattaataagcattaatgttcaatttatatggttgttttccaataataaacctaaagatatagaattcacgcaatatcatgccgacacctatacataatcctaaaatgaatagtagtgatatcgctagaaagaccattgtattatcctcaaatatatttgtatatgcaaacaatgagtctagaatgattggatgtaataaataaataaagaatgagaaagcactaatcatttgaatcgtattaaataacattgttttaaaatgcgtgcaaatacccaagataacaataaacataatactattatatggtgttaatgaatatgaaaagctggtaacgttccaatagtctccatttgtaacgcaataaacacaaaataagtagctacagctaatacaatcataataactaaataacgttctaagaaatttaatacacgttcgtagttataacccatatatgcacctaagaagaaataaaaaatccatccgaatattatagtattttcacttaatggataatagtgtagcacggtatcgtgaaacgctgtgttgttcgtaaagtaatataaaaatgattgctgtaaaataaaagataacaataataatattttactgttgaataggttatagttaattttaaaaatgatataactcaaaataaagaattgcatgataacaacgataaaatagccataccattgacctaataggacattttcaatgaattgtttattgaaacttgaatctgttaataatgattcactataactgtaaaacaatcccattaatatgtaaggaataagtatatattttacgcgtgtagttaagtatctataggtgactttttggtaattcaaggttgtcagtaactgtgacaagataataaagcaaggtgtaccaaaaatcacaatattacgaatgtaaaattgtaacactaaggatccaccctccatattttcatgttttaaagtaatttgtgtaagtaaatgtgtgataataataattgcacatataatagcacgtaaatatacgagttcaagtctaatctttttcatggaatccgtcccatctcttaattaaatgctcaaaagcatcatcactaattaatattctagggatgtaataatcattggagttcggagtgactgctttttcctctaatgaaaaaccgtattttaacccagcttttttgattaccggtaatttatcgtcattcatcaagccataaggataggctatagttttctgcgactttttaaagtttttagttagatatttttcacttttgtttaaatcttttatgattgtagcttcagaagctttcattaattttgacttattatttttagataagttatgcaaatcgtgggtatgtgtttcaaattcccataacccagttttatacatttcttttagttcttttttactaatcatatcgaggttgtgaaagttttcttccccaacatgacctgtgataataaacccagttgccggtattttatatttttttaagattggataagcattttcataaatagtttcatccatatcatcaaagttaatccatacacttcgttttggaaacttaccttttttcttgtaatataaaaattctttcaaggttaaaaatttagcatcatgtgattttagccattttatttgagattcaaattgtgattgactaacactataatttttaatttctttactactagaaaagaagtaaataaaattattcagaaaattcgcttttcttacacggtgataatttaatgccagagcactattttctttatatttcagttttttaggtgaatcgtcatctgcatttgcaatatgatgaccatccagtgtgcttacaggcaatatgatcaagatactcaacactaaaattataaattttctatacttcacgattctcttcctctctgccatttttgaatcaatatgctaattgtaaaaaatacaaaaatgataatcgcgaaaatgcccatagtttcaaatatatctaaaatttcagtattttcaatgtttaaagcaacacgtattgtattgatactttcgtcatgaatttcaaatatagtaccaatataaacgagtagaacaactaaacaatatatccaaaagacacaagatatagcgataagtgctgtttctcttacaatatttagcgatgattttagcgttgggtattccctctgtctgggcttgaccatgttgcgtaaccacctttcttacgttttaatgcttttggaaatgcgacaagaactactgctgcgttaataatccagtatactgtcggataccaacttacaaatatgagtccagccatattctttttctcgtagcgactatcaataaagagtgcgactgtaaattgaataacgtttataaaagtcatagtaaatgatgatagtagaaatattgaaaaactatatgtcataaatgtatagtctaagaagtttgctgttatgaacaaatagcctaaatatagaagcactatatatacccataaaatcgagatgatttgctcaaacatcaaaatatataaaggaaaccttttcgttttcattgtgctaaaaaagtctcgtagtaatacttcgtgtcccccttgagcccatctcacgcgttgcttccaaagacctcccaatgtttctggaaccaacatccaacacatggcaagcggttcatacttaatacgatatccacgtaaatgcaatttccaagaaactgcaatatcttcggtaatcatatcagtatcccagtagccaacgtcgacaactgcactttttttaaatagagtgaagacacccgaaatagtattgactgcgccagcaagtgtctgacttcgcttaatacagccaattaaacttgcatattctatcgtttgaattttacctaaaatagaactcttatttcgaattctaggattacctgtaactgcaccaagttttggatcatgtttgaaattctcaatcatataatatggtgcatcttgatcaacgatagtatctgcatccaagcacattacataatcatatgaagcctgtttaatgccttgattgagtgcgttggctttacctctgttttcttgtaaatcgacgaaaataaagtcattattttctttgattttatagatgagttctgctgtattatctgaacttccatcattaatgataataatttctttcttctcgtatttgagtgcaagaacattagacaacgtatcttcaaycgtttcactttcgttataacaggcaagtaaaaatgtaatgccttctaattcatccacatttatgtcaggcttcttgttcaatgaatatctaatttctctggtaaaatagaaataaattgaaccgacaatccagtaaatagacataaatacaggataaaaaagcaaaaagttaaaaaattgcaatttctttacctacctttcgttagttaggttgtaagccatatggtaattgatagtattttaatttgcaatagattgttgttataattaaacggaaatatttgtaattgcaacttaattttcctgtaacatagtgtgattaattttcagtagggggttataaaaattgaaggataagattattgataacgcaataaccttattttcagagaaggggtatgacggtacaacacttgatgatatagctaaaagtgtaaatataaagaaagcgagtttatattaccattttgactcgaaaaaaagtatttacgaacaaagtgttaaatgttgttttgattaccttaataatattattatgatgaatcaaaataaatcgaactattcaattgatgctttatatcaattcttatttgagtttattttcgacatcgaagaaaggtatattagaatgtacgttcaattatctaatacgcctgaggaattttctggaaatatttacggacaaatacaagatttaaatcaatcattaagtaaagagatagcaaaattctatgatgaatcaaagataaagatgacaaaagaagactttcagaatttaatattgctgtttcttgaaagttggtatttgaaagcatccttttcgcaaaaatttggagcagtggaagaaagtaaaagtcaattcaaagatgaagtgtattcgctactaaatatatttttgaagaaataatttttgttactagtttgtaataattaacttacttttgtaaaaaaagacatgagattatttttttaaatctatataaagttgacaatacaaatcgatattgagaatattaagatgtatatgaattttataaattaaatgcaatacattaatataaatatcaattgttgcaaaatacgatttgttcaatgatttgataatattattctttatatttgtgaatggttaagtttgtctttgaacatattataaaagtgtaatgttcccctgaaaagaataagttgtcatctaattacaggaaatccgcataaattagatgaaatggaaagtaataagtaataatttattgataagcgcctatgtgatggtaaatcatgacataggcgcttttttttataagttaaaaatgtaaataaaaattatataaattacccacatctttttaaaaggtgtgggctttattatcattaacccaactcacagtgacgggttacgcaaggtattgaattaccgagtacgggcacgctcggtgttgtaaagagcaaataatcaagtaatgatgatgcttctactcgattataagaaagccatgatagagtacgatggtatctagttttattattaataggtttggatatttaaagttggacaatattatatcttgtgcaaaaatataaataagttatacataatggtagagaatcatgatataattttaaacgataaaatatttatataaataattagagaaaatgtagttgtgtatgtyttgtggtcgttaaactagatataattgtccgatttataaaacatacataatgaatacaatgattgattatgtggaggaaaccatgamagamaagtttgatttagtaaaactattaaatattctaaagaagaatattaaattattgcttattttaccggcaatatgtcttgtagtaagtg

SEQ ID NO: 261 - DNA, 4082 bp; double-stranded, linear
attgttactcattattttttcatattcacacaaatgatcttgtttatatttagctaattgatttttatctagcattttatcctcctgctgagtttgtaacctttaataatttattttctataaaaacttagtattccagttgcttattatatcattgatgaaaggctgaaataaaacataaactgttccgaccattaacgctgtagctaaagataagtctacaagtccacctgttttaaattgaatcggtgtcttcacattaaacggtaaggaknaaaataatttcacgccttttggtgttatcatatctagtataacatgtgacactaatccaattataattgctgccatataataattaggcgtctgaataatttgcaataaaaatgctatgattgcgataaataatattgaatgcgtaaaggttcgatgtccaaagatcaatctcacaaaaaaactaattaccttaaaccttctgccaatcttactttgagtgtgacatatatcgggtaataagctagctagagttgctagaatgataaccgtaaccgacgaaaaaatatccgtttgaaaatattgtgttgttagcgctccaacgagcatgccgcatgaagcatgtgttttacctgtcatatttgttctcctttaatactcacattttaccacatccctaacaaaaacacgaacatattttcgggttaaaattcattagtatgacacaatttaaaaaagtatcacataactcttgaaaacgattacaaaatcgtttatgatgtatttacaaaatatttaaaggatgtgtttgaataatggcaatgacagtaaaaaaggataataatgaagtgcgtattcaatggagagttgctgatatcaaaattcctacaagtgaaattaaaaatattacacaagaccaagatattcatgcagttcctaaattagacagcaaagatgtatctagaatcggctcaacgtttggtaaaacgaatcgcgttattatcgatactgaagaccacgaatacattatttatactcaaaatgatcaaaaggtttacaatgaattaactaaataaattgtataaaaaaatcattcatggtgagggcttcatgaatgatttttttaattgattcaacacccagcataaacaaatacaaaaggacaactgttcccataattttaacagttgtcctttttcacatatatttataacaaaagatgtgccatcaaagaaataattggtagtgtaatgattgttctaatcaagaaaatcataaacaatttgccgatgcttacaggaatcttcgaaccaagtatgacgccacctacttcagacaagtatattaactgcgatatactaagtgccccaataacaaaacgagttatatcattttgtacaccttcaattaatatagaaggtaaaaacatatcggcaaaaccgataataatcgtttgagaagcctgtgccgcttcaggtatttgcattaactctaaaaatggaacaaaaggtttacccaatatgacaaaaaagggcgtgtagttcgcaataatggtagcaatagtaccaatactcattactacaggcaaaataacaaaccacatatcaatgactgtttttaatcctgacttaaaaaagtcaataacgcccggtgctttaatacctacttctgttgcagtatcaaagccatgtctcaatgccgtctttccttctggcaatgcctcagtacgcgcactttcaggtacctccttagcatactcatcaggaattttatttaaaggccaaattcttggcataatgactgctgcaacgaggcaggatactatcactgataaatagaaagcaaaaaattgattttgcatgtgcactgtttcagcaactacaattgcaaaggtgatagaaactacactaaatgtcgttgaaataactgttgcctcacgacgagaataatatccttcaccatattgtctacttgtaattaagacaccaacagttccgtctccaataaatgatgctaaattatctaccgtcgaacgtcctggcaatgtaaataaaggtctcataaccggtctaaaaataggacccaacatctctaacaaaccgtattccattaatagcggtaaaaatagagctgcaaataagaatactgccactaatgttggcaataaacttgagaacaataatccacccgtttcatctgagtaaataacctttgaaccaattcgtaaaaatgtcatccatgcaaaaacaactgctaatattcgtaaaattaaccaaccaattctaacgttaaaagcattgttcattagcccgtcaggtttcaatttatcttttaaaatagttgaacaaatcagagttatgatacccgataaagtaattatcgtcacaattaaaaatggcattacgccacctaatacatctttaagcacgcctgctaaaaatgccacgggcaacgttgtttgcttctgtccatcttgttcgactggaattggtactaaaaataataagataccaattaaagacatcgtaataaacttaagtctcccaataactatctctttccttgaaaagctatccataaaatcaatccatttctctatgtattcgttttaagtatatacagaattctattcagttaacaaacatattccttatcattctatctttcaaaatgtttatgtatgcaaaataatgaataattacagttattaaatatacgctatttcttgtaatttttcaagatgaattcaaaaaaggttaagtacaattactgatttcgtacttaaccttttttaaactctaatcatatgttagttatttcattcttcgtaataatattaagaagtatggtgcaccgataattgcaatgataaccccaacaggaatatccagtggcggatgaatgccacgggctaaaccatctccaaatgttaacaatatagcaccaattaaccccgacatgataataacgtgtaatgttttatttcctattaattgtctcgcaatatgaggtgcaattaatcctaaaaagctaataccaccgacaactgaaattgcggatcctgctaatattactgctaaaattaacaatagcattttaatagttttaacttttaaaccgagtgcggttgcaacagcatcacctagattcaatacatctaattgataactcaataaaatgatgattggtatcgttattaaaaaccaaggtaatatagtataaatattcgacatatcatgtccatatagactacctgtcaaccaaacaagcgctttgtttgcttccagtggatttctgattaataagaactgcacaatcgccgtacatattgcgcctattgctaaaccaattaaggcaagctttgaacctttaacatcatattttgaaattaaaaatgataaaaataaacttactgcaaaggcacctaagaatgaacctataggtaatacaaacaatggtgctgttggaaaggtcataataataatcacagcagctaaactggcacctttagaaatacctataacatcaggtgaggctaacgggtttcttattacagcttgtataattgcacctgaaatagccaagctactaccgataataataccaagtaatgttctaggtatacgatactcatttaaaataaaatcatcttgtgtaaagattcccttaatagcatcaatcggatgaatcatgacagaccctacacataaacttatgaatatactcacaattaaaaggattgtgattaaactataacgacgtataattttcgttgtcatcatattcttttcacccctttaatcgttataaataagaagtaaagtgcacctacgaatgatgtaacaatccctactggtgattcataaggatatgtaattaaacgacttaatacatctgatagtagtaacaaatctgcacctataataaatgttaatggaatcatgactaaataattcttactcacatagcgtttgactatatgcggtacgattaagccaacaaatccaattggtcctgccactgacaccgacatacctgtaagaataatgactaatagtccaatgataattctaactttatttatattt

SEQ ID NO: 262 - DNA, 1145 bp; double-stranded, linear
tattagaaggtcgttcggatgaacaattaaaaaatttagttagcgaagtaactgacgccgtagaaaaaacaacgggggcaaatagacaagcaattcacgttgttatagaagaaatgaaaccaaaccattatggtgtggctggcgtaagaaagtcagatcaataattcttcataagatgcatgccaattaattctttgaaaacgaacaaggcgacttctatctgagtatgatagaaatcgccttgtttatttttaatcttcatctaaaaagtctttaatagcttgtttatttgtgtttttattaatctgtaatgcactaccatcagtatttgtattgacatcytcgtatgagttcttgattggcacagtcaatgacttaacatctttttcacctcggataccaaaactcaaacctgtttggaaaatccctgaatcaggaatgtttgtattcacatagcctcttaaaatacctgcaacttttggtaatttaacaactgttctaaaattaaccatttcttttttcaatgtttgcatcacttgttgctgacgtcgcacgcgtccgaagtcaccttcagggtcgtgacggaatcttgcataaccaagtaattctttaccattcaacctatggttaccctttttcaaagatacaccaatatttttcgacatatctttttcgacattaattggtacaccttcaggcattaattcatcaatcattttctcaaatccagtaaaatcaactactgcataatattcaggattaattcctaaatttttatcaagtgtttttctaagtagctctggaccacctaaagcgtatgctgaattaattttgtgttttccatatcctggaatatctgcataaatatcacgcatgacagacatcattttcatctttttattgataaagtcatattgaacaaccatgatagaatctgttcttgattgtccaccttgtgctttatctgcaccgagtacaagaatagaaattntaccatcattttttactggtccattaaattgatgtactttaacatctttcgcatgtttcttggcatattctacaccgctattgtaactatgtacaatatatacaactaatgccgataagtaaaattacaacaatcagaagaatgataggtaatt

SEQ ID NO: 263 - DNA, 7075 bp; double-stranded, linear
tatggctcatcattaatgcacgtatcgggtagcgtttaccattgataagtgcttcatgtttagcacgagttcttaaaattccatcgccataaccgatatcaactacagctaattttgtattgtttttagtcacttcaaaggcaaagctataaccgcaataatcaccagcttgtacttcgcgcacttgaataacatgtgcttttaaagttaatgactgaactatatcatgttgattcagtgaactatatggtcttgaaccgtataacgcaatacctacacgcgcatgtgtatggtggggtagtaatayyygtccttcccgataaaaactcgcactattttgagcatggattaggtcgaactgataaccttcagataaaagtgcttcaacaatttccatccattgtgaacgttcaacattataatctgacacatcgaattcatcagcatatccaaaatgggkccataaaccactaataatcatttttgcattttgattatgatggtgatctttcaatacttctttaatttcgtttaaatctttaaatccagaccgatgtaataaattttcaaattctaagtgaacatgaataccagctaaatcatttttatggttatagtaatatgtcaacgacggcaaagtcatgtgtatttgatgttcacggactaaatcaaactcgtaaactgcattcattaaaaagattgttgcatctggagcaagttgtctaatttgaattgcttctcgtagtgatgttgtgctaaatgtatctatacctgcatggataaactgagttacagcaaattctaggtcatagtgatatgcattatttttaacaactgccattaatggctgattgtttttgactgtgattgcattttgtaaaaatattttcttatttacagaccatgttgctgtcaatgtattacacctctttgtaattatttaataaattttcgtaaaaattaaccacgtttattaacactttttcatcaaaatttaaatgtgatgtgtgcaaaccagttacaaaacctttatcttcatttcgtgttcctataaaaacaaagtaagctggagctagttgttgaccataaaaactaaaatcttccccaaataagaatggcgttggtttgtcatagacatttaaatcagcttttattaaggcgtcctctatttgagtacgtaatttcggactattgattgtagggggataaccttctgcaaatttaacttcacaatctacattaaacagaagcttgacactttctgctatcttgtgcatttgatttttaacgattgttaaatcatcaatatcatatgtacgaatagtaccttctaaatagccattacttggtacagtgttaatcgcttcaccagctttaaaatgaccaatatgaacaatatttcgtttcaaaccgttaaggtgaaattgttgaatttgtgatatttgagttaatacatgttgtaatgcttcaccacaagaatgaccttgttctttatcagcaacatgacttgacaggcctgttaagaaaaagcgatactctgttgcgctggccgtaatttcttcatctcttatcactgcaatgccttcatcagcaaatgggttaacatgaataccaaataccgcttcaattggatacttatcaaaggcaccggcttttattaatcgatttgcaccgccaccagtttcttctgcaggttggaaaatgaaaacgacattttgcggtaattgacctgcatcttgcatgtctttgcaacgttgtacaaaaagcattaatgcagttgtatgaccatcatgtccacaagcatgcatcacatgatcagattgactgcgataaggcacatcattttcctctaaaataggtaacgcatcaatatcagctctatacgctatcgtatgtgagccattaccttctaagtatgcaatgacgccagtttccaatgggcaatcgtatttaatatttaaactatctaaaaacgctttaatataagcagttgtttcaaattcatgtaagcttaattcaggatgttgatgtaaatgacggcgatgtttcgtaacaaattctaattcattcataattatcaatcctttgtgttaaattactatataaatagtgtaacgtatttcgaaatttgtgatcataagtttattcaatgctaaacaataaggttgagacataatcgtatctcaaccttgaaattattatacgttgacgtcactagtcattcagttttcttaatgctgctacaatctcttttttagtatcttgtacttcagaagcttgcttaatcacttttgcaggtgtaccagcaacaactgcaccagctggtacatcttgtgtcacaatcgcgccagctgcaacaatagcacctttaccaacacgtacaccttctaaaataactgcatttgcaccgattaatacatcatcctcgattataaccggtgaagcactagggggttcaatcacacctgctaatactgcgccagcccctacatgtacatttttaccagttgtagcacgaccaccgagagtagcattcatatcaatcattgtaccttcgccaacgactgcgccaatattaattgttgcgcccatcataacgacagcaccatcttcaataatggcttgttctctaataaacgcacctggttcaattcgtgcattcgtatttgttaagtcttttaatggaatagcagaattgcgacgatccatttcaatttctatatcttcgaattgactaccatatgcttcgtaaaaaggtttccaatcatccgcttcacaaaagattactttagattgttctgaaccaaatactttaaaactttctggatatgtgatgccttcaaaattaccatttaaatatacttttattggtgtagactttttagcatcacttatatattgaataatttcttcagctgttaaatgttgtaccataaaataatcgatctcctttaatatgtttataagttgtcaaacgtataaaagccgtttggtttattaactaagcgttctgctgcttgtattgcaccattcgcaaaaatatcttttgattgtgcacgatgcgtgatttgaatcgtttcatcagtgccagcaaatagaacttcatgttcaccgacaatcgtacctccacgaatagaatgtataccaatatcttgtggctggcgtttttcatttaattcatgtctatcatacacaggtgttacattttctttcaaagatacgatcacatcatacaatttttctaacgtaccacttggtgcatctacttttttattatgatgtgcctcagtcaattcgatgtcgaaatcatcaagtaggggaacagcagctgctaaaattttagtcaatgcatgaacgccataactcatgttcgcgctgaaaaacacaggcatattttgactcaattcatctaacttattaagtagtttttctttctcgnccagtgttgccacaactaatggcaaatgaaaatcttcatctaataaagggaaaagcagatttggatttgaaaaatctattgcaacatcggcacctttaacatctgcaatatgttgatattgttgatatggcgttgttgctttcggtgtattttcaatgaccccaacgatttcatgtcctttttcttctgctaatctagcaacgcgttgattcattgcgccatagccaattagtaatattttcactcattttcacccgctttaaatgtgtcatatgtttcacgaagcactttagtatctgtatcttctaggctaaccaatggtagacgtaattcataatttccaaatcctaaataacttgttagagctttaataggaattgggttaatatcaactgataaagctgataacagtgtgccgattggtttaaattgatcttgaatatctaatccactttgttgagcatcgtataacgcttgaaattctttaggaatgacattggcaataacagagataaccccttgaccgccacgttgatagtattcgacgacgttgtcatcattgccactatataatgcaaatgaatttgtatcaatgcgctttttcacttcttctaaatactcaaaatcattcgtagcatcttttaaagcaactatataaggatgttgacttaatatttctacagtttctggttcaattgtcatgttcgttcttgaaggaacattgtacagcacgactggtaatttcacagcatctgcaatcgcttcaaagtgtttgactaaaccacgttggttcgttttgttgtagtagggcgtaattaacataattgcatcagcccctaaggctttagcttggattgaagcttggattgacttttcagtatcattagtgccagttcctgctatgacaggaacacgtttatctacaagatcaataactgtttttagaatgcgttctttttcatctgttgttaaagtagggctctcagcagtagttccattaacgatgattgcttgggcattattttctagtaaaaaattaacgtgtgttttcaaagcttcaatattaactttgttatttgtaaaaggggttgtaagtgcaacsccaacaccctcaaataaatgtgtcattttaattcgctccttttaaacgcataacttgttccaatacttgtacagcatttaatgcagcaccttttaataaattgtctgatgtacaccatacatggaaagtattttctaatgaatcatctctacgtatacggccaacaaacacttcatctttattagtagaattgattgccattggatattcattgttctctggattgtctactaaaacaacgcggtcatcttgatcaaataacgctttaatatcttctgctgttgtttctttgtcaagcgttacatcaatttcaacactatgactatcttgaacaggcacacgtgcgcatgttgctgttacttttaagtctggcgcatttaaaatttttctcgtctcatcaatcattttttgttcttcttttgtatatccgttttctaaaaacacatcaatatgcggtaacacattattataaattggatgtggatatgcttctggtgctttaccatttacaccttcagctaaatctttcttacctttcatccctgaacctgatacagcttgatatgttgtatatgccactcgttttaaaccataagcatcttgcaatacttttagaggtacaacagattgaatcgtagagcagtttggattggcaatgatacctcttgtaaatgtaggttcattgacttccggaacgattaaatcaatatcttctgccatacgccattgacttgaattgtctataacgattgcaccagctttttcaaaaagtggggcaaagtgttcgcttgtaccgccaccagcactcattaatacataatcgaaatgttcacttgcacgagcatcagttaattcttgaactgtatatgtttttccttgaaattcaacttcttgccctgcagaacgtgctgatgaaaataatactaattcatcgaaaggaatatttttacgatttaatgtctccaacatttttgtacctactaatcctgttgcacccacaactgctaactttgtcataacttgtcactccattttataataatttccaatttttagaatattttaacaatcattttaccattaaatgttaaatgcgtcatatagtttttctaccgcttgttgcccattaaaatcatcaatgacgtatgaaatacttatttcagatgttgttgtttggtagaaaggtatattattttcaattaatgtcaaaaatgcttttgatgccacacctgacatatcacgcatgcctgagccaattaatgaaattttgacataatgctcattgattttataagctaatgcttcatattgattctttaatgtttcaagaatcatagaaatttgatgaaaatcactatctttaatcgtgaaggatagttgtagcccatccaagttgacgatttgtgaaatcatatcaacatttacagcaccttcttcaagttccgtaaatagttgggtaagtagctgattgtcaggtaggggataactaattgttacatgcatcatatgtttatccaaagccacaccagtaactgcttttttctctaatatttcttcatttgacataatccatgttcctttcacgttcgataaagtttttcctaaatataaagggatattatagtttttagctaattcaacacttcttgtttcaagtacaccagcacctaaagcgctcatttccatcatttcttcatatgagacgatgtctagtcgtttagcctttggtaaaagtcttgggtcagtggcatacacaccatcaacgtcggtataaatttcacaaggtatttgattactaacagcaagtgccacagcggtcgtatcagaaccacctctgcctaaagttgttaattcctgatgttcattgatgccttgaaatccagcaactactaaaatatcgttttcttgaaaggcttgttcaaatgtttgaggattaatttgagcaattttactttttaaatgatggccaatggttttaatacccgcttgatagccagtcattgctttggcattcataccgatatcatttaataccattgataaataagatacagtttgttgctctccggttgtcaataataatgccagttcttgttgttttggtgctttagtcaaggttgatacattcgtcattaattgatctgttgtgttacccatagcacttacaacgacaattaaattgttcatcttgattgactcgctcctttaacatttcagcgatcctttttatttttgtaaaatcactgacggatgatccgccaaatttcaacacacttcttgttaccatataatcctcctaattgttaggaagggcacacaataataaaaaaagaacaagttcggaatgcgaacttgctcttaatctatatacaagtgatgcactccattatttttaaataatgacaaactctcagctcttaaccaaaaagtccaacaaattataactgctattataattgcttcggcatcgcaccctttcaaatttagctgttagcagacagtaatctaaactttactcatgattgatgcgcctc

SEQ ID NO: 264 - DNA, 5171 bp; double-stranded, linear
agacgtactttgtgattmcgaagyrcgtactgmagcacttgtcgacgttgatgtacttgttgaacctgattgactagtactttgtgataatgacttactatcagaatcagatgtactttgtgaatcacttaatgattctgatgtactacctgactgagacgtgctcattgaactacttacggacattgatttactgtctgatgcagataatgacccacttgtactgatagagtcacttactatctctgaagtactcatcgagtctgatgtacttgttgagacactttgtgatgctgctatgcttagtgatccagaaacagaaccacttgtgctcgtcgaatcgctcaatgattctgatgtactcatcgattttgaatcacttgtacttaatgatattgatgtactttgtgaatctgatttgcttgttgacgcactttgagagttggctatgctatttgaaatactgatagagtccgaggtgctagctgactcgctcaatgatgttgatgtactaattgcattcgatgtactgtcacttaatgatgctgatgtactagacgaccctgatatactcgttgataagctttgtgacttagacaagcttcctgatgtactcatacttaatgagtcactgagtgatgttgatgtacgcaatgaatcagatgtacttgttgatagactttcggatttttcagtactgctagagtttgaaatagaatcgcttaatgatgttgatttactagctgaatccgacatgcttgatgatacactttgtgaattcactaaacttgtgcttgttgagcttgatacactattactttcagatgtgcttaatgacttagatgcactcacagaatcagataggcttacacttgtcgatttcgaggtactagctgatgtagataccacaatcgatcctgatgtactcgttgatgcactttgtgagtcagctttacttgttgacacactttgagattgttgtgtacttcctgatgttgatacggaatcactcatgctatttcttgttacttcatatttaaaagttgtcgtcgttttgttaccgctcgcatctgtagaaacgattgatatagtacttgtaccaatgtttgttggtgtaccactaatagtattatttgtactatcaaatgttagtccggatggcaatccagtcactgtattcgtcaccgcatttccactgttatcttgcgtaaatntttaatcggggatattggtgaatacacttctgatgattgatctcctattggtgtcactgttggtgctgtcgtatccacaacatttattgtaaaagttgtcgtcgatttgttatttgcttggtcagtagacacaactgtcactgttgattgaccaatttttgttggtgtcccaatgattgaattcgttgcactatcgtaacttaatccgcttggtaatcctgtaactgtatttgtcacagtcccagtaccattatccgttgtagtcaatacaataggattcattgttttacccacttctatggtttgattgcctacagttacagttggtgcttttacatcagtaaaataatatgtcactgattgtccagcattcgtcatttttacagttttatttgtatcattataagttgacgcatatgaactatcgacggacgtgtagttatatcctttagcagtcaatgcagattgctgattatcgattgtcacgacttgatcaacatttcctgaatatgtttttggtggaataatatctttacctgttgttacatcaacgtatctcacttgtgtancagcagactctgtatattcgaatgttccaaattgtacttgttgtaaatttgtcgcgccacctgttgaggctgtcattgataatgaaaagttggtcgtaccacttttcgcaatccaatctgaaatattacgtgtccatgtttgacctgcatatttgacagtcataacctttgtatcaccattatagttaatatcaaaatcttggaacgtgttatttgtaggttgaacatttaacttcgcagcattatcagctgttgaacttgatgtatacgttgtcgcaacaccataactatctgttgttacaaatgcaccaaacgcacctccaccagctacattagatgggtcagcattcgcctttgcagctgaatttggtttagatgtattgtgatacgtatccaatttgaagccaaatgcgttacttaagccaccaatacctactgcggcaccgtttaaccctgtttcacctaatacacctggtgaaaaggcaaaaccgataccatctccaccatttccatgcccttcatatttgttacctaaatttacttttccagaaaaatgaaaactcttattagagtcaatacgtgttcctaatgtaatagcacctttttggctgtatgcatcctgtgttaacgtcacaataccggtactttgatcataggtagcattacctgacgttgtcatatattgttttaagttatctttattaactgtaattgtattagcagttactgcggttgtcgtcgctgctgacgcaaatgttgacatagctaagcgactgaaagttcgaagttttactggtgcggtgctagttgacgttgtgctagttttgtttaagttgaccgaagatggcgttgtgctttgtgaagtgttatttgatgcagtactttgatttgttgatgtattaattggttgttctgtacttgaagttgaagctacagatttagtatcagaacttgatgtagtattctttgaggatgttgattctgatgtagatgtcaatttctcttgttgattgcttgtactattagttgtcgaagtgaccttttcagacttttcacttgagactgtgtcactatttgatgtttgtaccgaactactatttttcgttacacttgtggaatcggctgttgatgttgatgcttcgattgtcgttgagttttgattacctactgtttcactttgtgtgtttaattcagaagttaatggtgcatcagaagccgcaaaagcttgctggtcatgcaacatatttaccgtgaatgcaccaccaataaccgccgtagttttcagtccgtatcccgtcatttttttactaatgctttgattatcttgactcactaaactatgactaataaatggtagccccataattttgaacatttctatttctttaattccggattttacccaattttttccagatttataaagtcttactcttgttttttcgtttgctaagctgtcatgaaatgctttctgtcttttactcatgtaataactccttgtattatctttacattcattagattataatatatgccactattcaatttaatacaactcttttttgatacaaaaatactcattttgttaaaatttgtaaaaattcatttttattcgtctaaatgtaatcgttttcatatttttaaaattactttttctcgtttatgcgtataatctttttttatataaatttggctaattggctttatgtttaatcattataattgtttcgtttttaaaataattattgtattaatatatctataccatccaccttttatttataaatagttaatttacaactaaacgataaatattatatgcaaaatacatctttaatattaaagtaataccaatattttttcaataaacctagtgtaatatatgtgtaattctaaaagattcttctttaaaaatataaataccacgacatattgctttaacattttcatttataaagcgaaaaaatgcatcgctactaagttgaatgtttagtaaggatgcattgaattcactaaaatgattaaattacttatatcttttcatctgattgattatcgaaatttcttccttctaaacctgctaactcttctttagaagctgcaggtgctttcatttcaaatatctcattcactactgtgtaatcgtaatatcctaatctggcaataggtttaatcgacttaatgtccaatttaccattatcaagaataaccttatcgtcaatatgaacttgggcaactcttcctataacaatatctacggtagatactggatctccagttggaatacgaatcgtttgaacgtactcacattcaaaatgaactggcgattcttttacacgatatcctggagcttctatacatttttcctttgttacacctgcaaaattaaattcatcctcttctggtggcaatgctttcgatgataaattaactgcttctcttaaatcatacgttgccatattccacacaaaccaacctgtctcttcagcatttttcactgtatctttacgttcgtgatcaccaagaacggattgatttgctgcgaacataaccataggcggatcccaagttaagttttgatactgactataaggcgctaaattatctttcccatctttcgatacagtagagatccaccctattggacgtggtactgtactacttttaaatgggtcgtgcggtaaaccatgacttcttacaccttgttttggcgaataattcatactatcttcaccccttataagtaattacatttaaggttacgccctctttacataagcgtctaatataaataaacaatttatttataagtagaaactatatatgacgtggttgcttataatttgcgttcttgattcgaaaaattcagataaggatttatacaattaatatttatgatatcttttgtaaatttaattaattatagttacttcaatcatgattagtttataataataaagtgaaattgaaaaagacagctattatgcgatgagcgaaaaacttcaagtaaaacaagaatttaacggcgttacaaggcaatacttgaatttcagaacagatagtatcgatgatctggataagttcaaaaaagaattcaaacctgttatgcacttaaaaggtgatgcattcaatcaacagttacaatctttgattaacaaatatccacaaatacaaaaaaatatgaaatcagagttcattgcttattatgataaagaaaaaaatagagaaacagtaaaaaactatgcttggaaccttcaaaaatctataaatgacattatgcaatcatatcctagcacaaaatttgtacagttttataaaagatgatgtttccccgtcaatggtagatggaaatggccgtttaaaatcgggatactaatgtatttccatc

SEQ ID NO: 265 - DNA, 3589 bp; double-stranded, linear
ctacacactaaacctatttcagttatgggtggtacagtgattctcttttcatttttaataggtatttggattggtcatcctattgaaacagaaatcaaaccacttattattggtgcgattattatgtacgtacttgggcttgtagatgatatctacgatttgaaaccgtatataaaattggctggtcaaattgccgctgccttagtagttgctttttatggtgtgactattgattttatttcgttgccaatgggtacaacgattcattttggatttcttagtattccaattactgtgatttggattgttgctattacaaatgcaattaacttaattgatggactcgatggtttggcgtcgggtgtttckgcaatcggactcattacaatagggttcattgcaattttacaagctaatattttcataacgatgatttgttgtgttttattaggctctttaattgggtttttattttacaatttccatcctgccaaaatatttttaggtgatagtggggctttaatgattggatttatcatcggattcctttctttactcggattcaaaaatattacaattattgcattgttcttcccaattgttatcttagcagttccattcattgatactttgttcgcaatgattcgacgtgtgaaaaaagggcagcatataatgcaagctgataaatcgcatttgcatcataaactattagctttaggctacacacatagacaaacagtattattaatctattcaatctctattttatttagtctttcgagcattattttgtatgtatcgccaccattaggtgttgtattaatgtttgtattaatcatatttagtattgaattaattgttgaatttacaggattaatagataacaactaccgaccaatattaaatttaattagtcgtaagtcatctcataaagaggaatagggaatgaaagcatagctgtatgggataatttgtattatatggctttactctttacaatttttttgtattaaatttcaaatataaaaagcactgccataaacgtgtacttcaattgtcgtttaataatacgcaattgatatttaccgtcttatgatagtgctttttatttttattcagttggtatatcgaaaggtaactgctttggagtttcttcagtcaaatcgaaatttcctgcagtcatttgatttaaaaagttaataaacgcttcatagtcacttttaacgacatcgatatagtagcttaccttatcagtgtaagtttggtttcttaacataaaatgagttgaagctaattcatattcaaatttaccagtttgatcataattcagtgttactatacatggtactgcttctcgtagttcgacacgcccgatatcataaatgacgtctctaacagcaccgctataggcgcgaattaaaccgccaccacctaatttaataccaccaaaatatcttgttactacgacacacgcattatgaacatcgrgcttttttaatatgtctaacattgggacaccggcagttcctgtcggttcaccatcatcattcgcnttttgaatattcatttcaggtccaatagtatatgcagaacaattatgagtggcatctttatgttctttttttattgcagcaataaatgctttagcttcatcttcattttgaacaggtttgatatgagcaatgaatcttgatttactaatcacattttcaataatgtgttcttttttaacagtaatgatattttgtgtcataataactccttaattcataagcttaagattatttaatcttcattatacactgaaaatgacatgactataaatcgtttgattgccattttctttttaactgaaatattgtatcattgctatgagtatattttaggaggacgactatgaaaattgctgtgatgaccgattctacaagttatctgtcgcaggacttaatcgataaatataatattcaaatagcgccattaagtgtgacttttgaagatggcaagattataccagaagaaaaagttcgtactaaaaagcgtgccattcaaacattagaaaagaaagtattagatattgtaaaagactttgaagaagtaactttatttgtcataaatggagatcatttcgaagatggtcaagcgttatacaaaaagttacaagatgattgtccttcagcttatcaagtagcatactctgagtttggtccagttgttgcagcacatttaggttctggtggattaggtttaggctatgttggcagaaaaataagattaacataattataaaattttaataaaagagtctatattgtaattggaaattatctctcgtatacatggctttaaatgttcatcatttgaaagccaaaatgctaaagatataagaaaatcattataatattaggctcttttttacgttgaaatgaggttttaagcattaaacattacgggaaattaattcatcctcatacttcacttactaatgaaaaaattaaaaaagaagtaacaggtgtcatcaaacaaaattcaaactattattgtgttcaatgtgaaagtacaaatccaaagcatttttatcagtatgattcctcagtacattccaagaaaattgtatattgcagaaattgtatatcactgggtcgaatggataatgtaacaagatataaaataacagagagttcgcaaagttcatcacaagcatattatcatctctcatttgaattgtcggaacagcagtcttatgcctcagaacatattgttcgagccattagaaagagacaaacgattttgttatatgccgtaacaggtgcaggtaagacagaaatgatgtttcaaggcattcaatatgcaagaatacagggagataatatagctattgtgtcaccacgtgtagatgttgttgtagaaattagtaaacgtattaaagacgcatttcttaatgaagatatagacatactacaccagcaatcaagacaacaatttgaagggcattttgttgtatgcacagtgcatcaactttaccgattcaaacagcactttgatactatttttattgatgaagtcgatgcctttcctttatcaatggataaaaatttacaacaagcattgaagtcatcttctaaagttgaacatgcaacaatttatatgacagcaacaccaccgaaacaacttctgtcagagattccccacgaaaatataattaaattgccagctcgctttcataaaaaatcacttccagttcctaaatatcgttatttcaaacttaataataagaagattcagaaaatgttataccgaattttacaagatcaaattaataatcaacgttatacactggtgttttttaacaatatagaaacaatgattaaaacattttcggtttataagcagaaaattactaaattaacatacgtccatagcgaggatgtttttcgctttgaaaaagttgaacaattaaggaatggacatttcgatgtcatttttactacgacaatattagaacgtggatttacaatggcaaatttggatgttgttgttatcgatgcacatcaatatactcaagaggctttaatacaaattgctggacgtg

SEQ ID NO: 266 - DNA, 1017 bp; double-stranded, linear
tttccaagaaggcttgaaaaatgttwcaagtggtgcgamcccagttggtttacgacaaggtatcgacaaagcagttaaagttgctgttgaagcgttacatgaaaattctcaaaaagttgaaaataaaaatgaaattgcgcaagtaggtgcgatttcagcagcagatgaagaaattggacgttatatttctgaagctatggaaaaagtaggtaacgatggtgtcattacaattgaagaatcaaatggactaaacactgaactagaagtggttgaaggtatgcaatttgatcgtggttatcaatcaccgtatatggttactgattcagataaaatggttgctgaattagaacgcccatacattttagtaacagataagaaaatctcgtctttccaagatatcttacctttattagaacaagtggttcaatctaatcgtccaatcttaattgtagctgatgaagttgaaggcgatgcattaacaaatatcgtgctaaaccgtatgcgtggcacatttacagctgttgcagtaaaagcacctggttttggtgatcgtagaaaagcgatgcttgaagatttagctattttaactggtgcgcaagtgattactgatgatttaggcttagatttaaaagatgcatcaattgatatgttaggtactgcaagtaaagtagaagtaactaaagataataccactgttgttgatggtgacggtgacgaaaacagcattgatgcacgtgttagccaattgaaatctcaaattgaagaaactgaatctgactttgatcgtgaaaaattacaagagcgcttagctaaattagcaggtggtgttgcagttatcaaagtaggtgcagcaagtgaaacagagcttaaagaacgtaaattacgtattgaagatgcattaaattctacacgtgcagcagttgaagaaggtattgttgcaggtggtggtactgcattagtaaatgtttaccaaaaagtaagtgaaattgaagctgaaggtgacattgaaacaggtgt

SEQ ID NO: 267 - DNA, 1409 bp; double-stranded, linear
ttaatccagcgttaactgtatttgcatttattatgattatttcgattcttttagcgtatgtatttaaatggcttggattagtggatgatgtgttattaatggtcattatcatttcaactatttccttaggcgtagttgttccaactttaaaagaaatgaatattatgagaacaactatagggcaatttatcctattagtagcagtacttgcggacttagtaactatgattttattaacggtctatggcgcaatcaatggtcaaggcggcagtacaatatggttaataggtatattagttgttttcacagcaatttcatatattttaggtgttcaatttaaaagaatgtcatttttacaaaaattgatggatggtacgacgcaaatcggtattcgtgcggtatttgcattaataatattattagtagccctagcagagggagttggcgcagaaaatatattaggtgcattcttagcaggtgtcgttgtttcattattaaatccagatgaagaaatggttgaaaagttagactcatttggttatgggttctttattcctattttctttataatggntggtgtagatttaaacataccttcattaattaaagaaccgaaattactaattatcataccgattttaatcgtngcatttatcatttcaaaattaattccagtcatgtttattcgacgttggtttgatatgaaaacaacgattgcatcagcatttttattaacatcaacattatcgctcgtgatagctgcagccaaaatttcagaaagattaaatgctatttcagctgaaacgtcaggtatattaattttaagcgcagtcattacatgtgtattcgttccgattattttcaaaaaactgtttccagttccagatgagtttaaccgtaaaattgaagttagtttaattggtaaaaatcaattaacgattcctatagcgcaaaatttaacatctcagttatatgacgtgacattatattatcgcaaagacttgagtgatcgtcgtcaattgtcagatgatatcacgatgatagaaattgctgattatgaacaagatgttttagaacgactaggtctgtttgaccgagacatagttgtttgtgctacgaatgacgatgatattaaccgaaaagttgctaaattagccaaagcacatcaagttgagcgtgtcatttgcagacttgaaagcacaacggacgatacagagttagttgattcaggtattgaaattttcagtagctacttaagtaataaaatcttattaaaaggtttaattgaaacacctaacatgttgaatttattaagtaatgttgaaacgtcactatatgaaattcaaatgttaaattataaatatgaaaatattcaattacgtaatttcccattcggaggagacatcatc

SEQ ID NO: 268 - DNA, 4702 bp; double-stranded, linear
aaagagggttttttactactataatccatcctttaatggaattccatttgtccctttggcccgttcataaccataggaaaatatatgcngnaatcattgatagtaaatacatcaataatacgaataatgtcggtgaaatcacgtccgtattaccattattagctaaaacattttccaagttttcttttgaaccggatactcataaatgcttttaatgcntggttttgtctgtcgccatctttagaatttgtaatacttttttaaattctttagcgaacaactcattatctttatcgtttttagccatttgacgattcaaatcgttagctcttacgcctaatgctcgacctgtcgcatgtagcttattcacattattgtcgacttgatttaattggccactaacagaatctgcaattgattttgattcttgtgtatctgatagcaattgcgtactcttttcagaaattctactaatttctttatctaaatttgaagacatcgtattaaattcatcatttttgcctttatcaatttttggttcttgtggctcttcagcaaaagtctttttaacgttttctaactgatcaatcagcttggaaatatcttcttkattttttgttgtattctttttgttatttaaaatgtcatcaatcagtttgtctgagttttcttccattgaatcaatttgatgtaacacagctactttatcgtctttgaaactttccatgtcattgataacttggtcaaccatcatatcaattaaacgtttgttgtcgaatggtttatcttctctgccttttgtatctgtgtacattttataatgcgcatcaaacctagataatgcactcaattgctggcttaatgcatctttcgataagcgaccatcaaggttatgattcaatgttacatccacaacactcgttgctttcttatcatttggttcatcttgacgatttgcttgtccaaataacaattgtaaatgcattgttttatcttttaagaaatctttctcagcatcctttttcaatttagcaacgccattgacttcaactttatattccttgttagatgtatcgagttgaacactttgatccttaatgtcatattttttaccattaattttaatgtcgccttcaaaattaaaatgaggatctgttgcaacagttaattgattaatatcattacttttaatcgtttcagtacgttgcactttgacaccatcattaatcaaactacttgtgtcttgcgcaacttggttatcgtaatctgttaaattaatgtgttctgctaacggttttttcaaattatattcatttttataacgttttgcttctttgacaattgcttcgtatttattagcttcatcctcatttaaacctgcagctataaagtcttgtttagacatgttatagataaatgttgtatctgtatcaggttctttgacaatatcatcatgaagttgtttctctaagttttcagcgaattgagcattgttcattttaatgctatttagcgcatcttgtaagtctttgttatttgcaagctcatcttgcagtgattctgttaattgcttacgatantcttcaatcataccttttgaaaatggtgactcttgtgattgaatgatttctcttaatttatctaagttttctttaacagtttgtttatattcttctttacctgtatcttgcatacttgattgttgatcaatttggctgtccatctgttttaatgcattgatatagttatcaagttccacgctatctttttgcgatttataatcttgtaacattttatccatcgctgtattgtgctcgtcaaataatgaattttgtttttcaattaaagtcgaaacattataatctgtgttcactctgaacgtatctgaattcgcactcaataatgatttattgtatgtttggaaccattttgtaatgtctttgtttgcagaaattgaatttacaagcgtatctgtaaataattccgggaagtcgttaattggatttaataagtaattcgagaatttactattcacaccatgttcacgcgtcataatagcgccaacatttttttgtgcattatgtaaattatcaatgatgcttgttaaataaatttcgactaagtttttgttaaagtcgttaagtacattacttacaactttttctgtgtttttagctacttcttctttttgtcctacagctgttttatactgtagcgatattttcgatggtgttttagcgtctaattgcattgccaattttgaaaagttttctgggataacaatcatgacttggtatccaccatttttcaaaccagactcagcaacgtttcttgttactgtttcaaatttatagtttttctcatttgctaaccttttaataaatgcttgacccagctcaacttttttaccgttatatgtcgttggttgatcctcgttaacaattgcgatatgtattttattatttttattacttacactttgggatcctttttctgattgatctccatattttgtttgaacaaaaaatatcatactaactatggcaattataataattaaagtgacaattaatgcataaatccaatttttctttttcatgcttatttcctttcagttgttttcttaaaaaaatgataagcaaagccacattagaaaatgtgactttgccaatttcagaatgcttattgcaaaccgaaattattagaaagttgttggtcttgttcttgaacggcatcagcagtgctattcaattgttgtttaatttcttctaataattgtgcaaatttttctactttaggactaagttgttggaattgctcttcgaaacggctgaaagcttgaccttcccagttcgctgcaatttcaccttgtgcacgkgttaaatcagataaaatttgacggatttggtctgaaccttgcccgtaagattgcgattttgctctgatttcctctggactcatcttaatcattgccataactagaaacctcctgaatattttaagtttatcaaaactttttagggacactattttttgaaaaagtgctccttactcaaataatatataaattattagtatatgtatatagttttttaagtatttttagcttttttaaaataaatatattgaatataaccatatatttttaattaaccattcatttttgtaatataaatgtgtatactaaaattaaattaaatacataaaggattaaatggttattatgaagaaaacaattttactgacgatgacaactcttactttatttagtatgtcgcctaactcggctcaagcatatacgaatgatagcaaaacattagaagaagcaaagaaagcacacccaaacgcacagttcaaagtgaataaagacaccggcgcgtatacttatacatatgacaaaaacaacacgccaaacaacaatcatcaaaaccagtcacgtacaaacgacaatcatcaacacgcaaatcaacgtgatcttaacaacaatcagtaccattcttcattaagtggtcagtatacgcacattaatgacgcaattgattcacacacaccgcctcaaacgtcaccaagcaatcctttgacaccagcaataccgaatgtcgaagacaatgacgatgaattaaataacgctttttcaaaagataacaaagggcttattacaggcatcgatttagacgaattgtatgacgaattacaaatcgccgaatttaatgacaaagcaaagaccgctgacggtaaacctttagcattaggtaacggtaaaatcattgatcagcctcttatcacaagtaagaacaacttatatactgctggacaatgtacatggtatgtctttgataaacgtgccaaagatggacacacgattagtacattttggggagatgctaaaaactgggcaggccaagcttcaagcaatggcttcaaagtagatagacacccaacacgaggatcaattttacaaacagtaaatggtccatttggtcatgtagcctacgttgraaaagttaatattgatggaagtattctaatttcagaaatgaactggattggtgaatatatcgtttcatcaagaaccatctctgcttcagaagtttcatcatataattacatccattaaattaatcatgacatcaataaaaagcgaccagttcgcagtttacaattcgtaacactgcaaaattggtcgctttattttgtatgttattcgattataaaattacaaagaaatgttctctacattccccattaatcaaaatcgtttacgaaagtataattgtagctataataatccaagtcgtaacaactagtggcactatcgtcttgaataagaatataccgtattttttcttgcgatatatatccagtactagccaaattaaaatgattataacaccaacaaaaataaatacaggattcatcgatatagcatctgcctgtaactcaggttgcattcttaatttagtgataattaacatcactactgaaataatgaaaaagtagatacctcttatctttgatgtctgtaaatctaattcctgctcttcaatgacctctttagattcacccaattcttttgcaatcaaataatttactaccttaggtttcacccataaacacttaattgcaaagtacataaaaatatatgatccagtatccataaacattaaaaagttgcttaaatcatgatcaacaaagcgagcgc

SEQ ID NO: 269 - DNA, 2004 bp; double-stranded, linear
acaaaaaattcaccctcattaatattgaaactaatgttatcgacagcaacatgtttgccataacgcttagttacatttttaaacttaatcactttgccacctctttttttctcatagcataaaaccgagattatatgtatgtattccctatttaaccacgtttattacaattttcaaatttaaatgatttatccttgaacttttttaataaaataatgaataawaggwaatcwccagttaagaaatagtgttattttaccttgaattcaaaaaaacacccagtaaaacaaggaatgcttactaggtgtcttcactatactttggctttataattttgaatcgtttctaaaaatgctggacaataatgttttaatttgtaactacctacgccatcmatattaatcatatcttgtttcgaagcaggcttacgtttagcaaattcctccaacgtgtaatcagaaaatatacttacaggtgctatcgttaatttgtcacttaactttttacgaacttctaccaactgactgaataatactcggtcaaccccttcaaccgtatttataaatactttttcagtcgctttttgcttaaatggtgttgtgaatacttctacttcattactgagtaattttttaattgaagtatcacacattaatatttcgtcattttcatttaagaaccctttgaatcttaattcatctattaagtgacttaattctgatgttgtgtaacctttcattaaaccatgggttgaaatttggtcataacctttatacttaatataatctgktgactctcctcttaacacttgaatgataacactataactctcttgttgtttcatacgagcgatgcaactaataatcatcttagcttcttgtgtcatattatatgatttatcttgttgaacacaattactacattgttcacattcttctaatttttcattcggttcaaaataatggacaattgttgcttctagacatttttttgtttttgtatattgaatcattttagttaacttttcgcccattttatctttatagtcatcatcagcttgagagactgttataaaatactcgtgtaaattgatatcgcgttcgctaaataacaaaatacattcacttttcaacccgtcacgacctgcacgacccgcttcttgataataagattctaaatctccaggcatattataatgaataacaaagcgtacattggatttatcaatacccataccaaaagcatttgtagcaacgactactttaacacgatcaaataagaaatcattctgcgcttcttctctttctttattgctcaaacctgcatgatatataacactttcaattttctgactttctaaggcttcttgaagctcttcaacttgcttacgtgtagaacaataaataatacctgcatcttcatcgtgtgttttaatataatccaatataaatttttgacgttgataagtaggatttactttaaaaattaagtttctacgcttagtactcgttttaatttgatcagtttgagcgatatttaacttttctctaatatcttgctgtacttcaaccgtggcagttgctgtcaacgctattattgtaaaatcttgaggtaacgtaaatacttttgaaataacattttggtaactcggcctgaaatcatgaccccatttagaaatacaatgcgcttcatcaaacgcgactaagtgaatctttatacgctgaagcatatttaaaaaatatcggttttcaaatcgttctggtgcaacatacaaaaattgaatttctccatttgataatgctttttcaatacgttgttgctctttttgagtcaaactactatttaaaaaagcagcttgaattcccatcgcttttaattgatccacttgatctttcattaatgatattagtggacttattacaattgttgtaccacctaacmataaacctggtacttgrtagcmtatagacytacctccaccagttggkaagrcaccaagcacat

SEQ ID NO: 270 - DNA, 2244 bp; double-stranded, linear
aaagattgcttgccttgagggtttatatatctgactcaattgccacatttttatcaagagtagttgataatactcatcataattatagctaatattatatttttttaaaagatagtgtatgattttctggtgtttgttgtatacgtcattaaatttcaagtagtcattctccaagttatacgtataacaaatatttccggataaagttagaataaaatatttagaaaaatcattcatttgcgtaatcgctaaattaagtgttaaatataagacataagtaattaatttaatgtgatatgatgtattattactttgctaaatagtagatagaacaaaatttgtaatcgggaggtaacaatggattacgcacatttaaatttagaacatttttttgcacgaaacgacgatttagatgttataagagatcgcgctgatttcgtgatgataaataacttcactaatgaaatgatgtatcgtgatggtcaaattgaaggcacgattgatttaaatcagtactattataaaaatagatcaaatgcagcaagttttattatgatggattataaaaaagaaactaagtaaacgaacaaaagaattttttgttttttaatacgtgaataataagattattgatataaaggttttcaaaggttatacaaaaagataaaacatttatgattcgtagatcaacgtaaagtaatgttgataaatggtttaaaacgtttcatttacattactgtttatttatgaatatgtaacaatgcatagataaaattgttaaacggttttaataatgttaaactttattatcgtagtcaaactsaatgtataacaacaatgacctaagaggtgtggatatgaataaacacaagaaaggttctatttttggaataataggacttgttgtcatatttgctgttgtcycatttttatttttctcaatgatatccgatcagatatttttcaaacatgttaaatccgacattaagattgaaaagttaaatgttacattaaacgatgcagcaaagaaacaaataaataattatacgagtcaacaggtatcaaataaaaagaatgatgcatggagagatgcatctgcaactgaaattaaaagtgcaatggatagcggtacttttatcgataatgaaaagcaaaaatatcaatttttagatttatcaaagtatcaagggattgataaaaatagaattaaacgtatgttagtagatagaccaacgttattgaaacatacggatgatttcttaaaagctgctaaagataagcacgttaacgaagtttatttaatttcacatgcattattagaaactggcgcagttaaaagtgaattagctaatggagtcgaaattgatggcaaaaagtactacaatttctatggagtaggagcccttgataaagacccaattaaaacaggtgcagaatatgctaaaaagcatggttgggatacacctgaaaaagctatttcaggcggtgctgatttcattcataagcacttcttatcaagcacagatcaaaatacattgtatagtatgagatggaatccaaaaaatccaggagaacatcaatatgctacagatattaagtgggcagaaagtaatgcaacaattatcgctgacttttataagaacatgaagactgaaggaaaatacttcaaatactttgtgtataaagatgacagtaaacatttgaataagtaatttgataagctacgagttgtttttatgactcggacatactaaaaagacgctttctatcttgttttgatagaaagcgtctttttgcattagagaaaacacattgatkgataatcccaccaatgcaagtggggcaggacatcgataaagaattactttttctttagaaattagtatttcttatgcatgagttttactcatgtattcctatttttaagtacacattagttatagctaatgataaagaaccactacataataaatcattagtgtttttttatcatttctgtcccactctcatcgtgatttgaaattttcaattgcgattttaatttcatctcttacacgttggaactctgaccaaggcttgcctgcaggatcatcaaatccccaatgttctttcttaacatttgttggtaaagaagggcaatttacgtctgcatcactacataatgtaacaactaaatttgaatttntaataatattattatcggattaaaatctgatggatgatttgatatatcaatgcctactt

SEQ ID NO: 271 - DNA, 1371 bp; double-stranded, linear
ataagcaatttaattttgagtctacaatggaggaattatcatctttatcagagacttgccaacttgaagtgttgggtcaaattactcaaaacagagatcgtgtagatcgcaaatattatgttggtaaaggtaaaattgaagaaattcaagcatttattgagttcaaagatattgatgtagtcatcacaaatgatgaattaacgactgcacaatccaaatcactaaatgaagctttaggtgtaaaaattattgatagaactcagttgattcttgaaatatttgcattaagagcaagaagtaaagaaggtaaattgcaagtagagctagcacaacttgattatttattacctagattgcaaggccatggtaaaagcctttctcgtttaggtggcggtattggaactagaggccctggtgaaacgaagttagagatggatcgcagacatattcgaactcgtatgaatgaaattaaacatcaattgcggacggtagaagaacatcgcgaaagatatcgaaataaaagaaatcaaaatcaggtgtttcaagtagctttagttggttatacaaatgctggtaaatcatcatggtttaatgttttagcaaatgaagagacgtatgaaaaagatcaattatttgcaacgttagatcctaaaacacgacaaattcaaataaatgatggatttaatttaattatttcagatactgttggttttatacagaaactacctacgacgttaattgcagcttttaaatcaactttagaagaggctaaaggtgcagatttattagtacatgtcgtagatagtagccatcctgaataccgtacgcagtatgacacagttaatgatttaatcaaacaattagatatgagtcatatttctcaaatagttatttttaataaaaaggacttatgtgatcatgcatcaaatcgtccagcaagtgatttgcctaatgtttttgtttcttctaaaaatgatggtgataaattacttgttaagacgttatttattgatgaaatcaaaaggcaattaacttattatgatgagacaattgcgacgaataatgcagatcgattatattttctaaaacaacatacattagtgactgaacttaaatatgatgaaattgaaaatgtttatcgtataaaaggatttaaaaaataataaaaggacgaaattcaaatgaaagatataagtaagatagtagctgacgtcgaatcaacgttagcaccatattttaaagaaattgaagaaacagcatatattaatcaagaaaaagtattaaatgcatttcatcatgtcaaagcaaccgaaagtgatctacaaggatcaacaggatacgggtatgatgactttggacgtgatcatttag

SEQ ID NO: 272 - DNA, 6035 bp; double-stranded, linear
catcatatggtaaccgaattgaaatatttttaataataatcccttaagcatatctgtatgcgtaaacctatgcgttttaatattctgaagttacttagttcatcctcagtttcatccatttgtttaatataaataatacatccagctgctactaaaaatgctaatcctaaaaatgatgtaacaaatattagaataccgttagtagcatcgacctcttttttcatttcatcatacgtgatgactttgtctccaaactgttttgcaattgcttgagctttttccttttgtgatgtttgtttaatatcatatccataaaaagtatgaacgttattttgtgttttcaactgctgatacttttcaggacttacttcgatgacaggtgagttgaagcttagatttaaaggataaaccttacctttgtcttcttgtgtacacggaaagtttcattcttagtaccttttactactaaatctttgtttaaatggatattaataatgttaggcagcgattttgtatttgtaatgatggcattgttgcctgttaacttgttatttgcacttaaaatagaattcgtgcgacctgaatcactaccattttccaaagtaataacctgatcattaacattatctacagtaatagtttcgtaagcatttttagaaaatgtaatttgttgttggcttagtttagtttcaaattgtttagcatcttgagtagcgaccacgttaaattcatttggtgccatagatgtaagggtttgatctgtatttgatttagataatgccgcaaaacacaatacagttactgtaactgcagaaataattgcaatgatagttaaagacatggcatttttcttcattctgtacataatagacgatgtgaatacaacatcggtaatagatacgcgtccattttttgattttttcaatgttttaaaaataagtgacacggaacttctgaagaataaataggcgcctacaaccgttaaaaataaaatgataaacggtgatgtcatagccatagttagtgctttgaacgtaccaaacatttctgtcgccatataatagcctagtgcaatcatagcaatacctaatacgcctgaaataacctctgcagtcgttactttagcagttgtggcatcagttttaattgaatctttcatcattgataagatactacgtctttttagaaataaagcactttgaaataaaatcagtacatacgcaataattagcatgaaaatagttaaaacaagggccataggttcgaaatgtatcgataagttaatcgataacgacatcaatttagatactatggaaagcaataattgtgcacctgcaatgccacataatacaccgacaacacctgtgattaaaaatacgatcatttgttcaagtgctaacatttncaaaatgttttgtcgtgttaaaccaatcaactgaaatagcgcaaattcacgtgtacggcgttttacgrmtaaatgattggcatacattaaaaagatgacaataatgataaataaaaatattgatccgactaaagcacctttcttaatgatggccatcgagtcgtcattatttacacctttagtaaactgtaaggttgtaaaactgaaatataagacgatgctaaaaaataatgaaaataaatacattgcataatgttttaagttttgtcgtaagtttttgaaaacgatatggttaaatgtcatttgagacaccacctaatactgattgaagatgtacaatgtcttcataaaaggcctgtttagaacgtccttcctgataaagttgtgtatgaatttggccatcttttagcatgatgacacgttctgcaaaacttgctgcaaccggatcatgtgtaaccatgacaatagttgtatcaaacgatttattcatttcttccaaacgttgtaataggtcatttgcacttttcgagtcgagtgcgcctgttggctcatctgcaaatatgatttgtggtttgtgaacaaatgctctcgctgctgcagttctttgttgttgaccaccagataattcgctagggtatttatttcctaggtcataaatacctaatgctgtcgtgatcgctttataattttcttccattgttgccttcgacattttttgaacagataaaggtaacataatgttttctttaacggttaatgtcggcagaatactgtaatcttggaagatgaaacctaatgattctttgcggaatttggcaagtgctttttgattaagtttattaagctcttgtccgttagcaatccgctaccgctagaaatttggtcaattgaacttagtacatttaataaggttgtcttacctgatccagaaggccccataatcgcaacgaattcgcctttttgtatgtcaaagttaatatctttaagtgcttgaaatgtgtgctttttaccgtatgtttttgaaacatgtgcactgataatatcgtcatagtctcactccttttgtatttaatttcattttaaataatgtttggagtagtagcctttatctaaacttacaattcaatgaatgaaccttacagagttgaaarctatcgctacttagtagatttttgagtgaggatacagattcatcgtacatattagacaaaagcaatggtgctttctaagtgatgatgtttgtgtaaattgagaaaagggaatttaattattgtataataaattttttgtaaaaattaaaagagggttttatttgaaaggaattgattgttatggaaaaaggaaatcaaggtattaaatggtctagtttaataatgggtgtattattattaatgttggcagtcgttatttttacatttccaattgaaaatttttatgctattacctggttgattggactgtttgtattaattaacggtgtgattcaaatcgtttaccgtagaaaagcaaaagctttagtaggtggtaaccaaaattggattctgtttatggggattgtagatattctatttggtctattagttatttttaatgttggcgcaagttcagcattctttatttatatgtttgctttttggtttatttttagttctatctctggattatttacgttttcgggtagtggtagcttaaaactaatttcagtgatttttaatttattaggtattgttttcggtgtcattttattatttaatccattaatgggtatcgtctttatttcgacgatgattgctattgcatttgtattcgtaggtgtcatttatgttgtagatgcacttgcttaagtaaaatgaagcggttcaaaagaagggtgtgacatgaagtttgtgtcatatcctttttgttgtgtttatgaagcataaaaaaggggcgctacctacaataagtaagatacgcccatatttttatattttactattattgtttttcaatacgattaatagttacatttagtccaaaatatttttctaaaaaatgtttatagttatctttagtgacatcaaatttttctgagctaccattccttgttaaagttaaatgattttcagacattgtagcacggccaaatgattgtggcattgtaattaataaatgctgtacaaatattgaatctggatgcgtttgattatattcgatgttgctattaaaatcttctatttgtttaggtttgaattcagcttcatattttgtatgccaatgatcattttcgaatttttgaacatagaaaatatccttgtcttcgttgttaaaaatagcgcggaatgtaccactgatatcagtaattggttgtgtatgctcagatgaagtaataggaatggcatgtagaggtaagtctccaaagccaacatcagttacatagaatacatcatttatagaaacaacaagtgaagcatgtgaaccgttcagactacgaccgccaccgggwgtgtgaatagtagctgacattaattcaggattaaatcctttttgttgtaaataggctttgaaaaatgtatttaattcataacaaaaaccaccacgtttatcatgaacaattttattaaaaagtgcatcgatatttatagatatcggcttactattttgaacatcaatattttcaaaaggtacagttaacataaaacgtgttgcataataatttaatgcttcaatactcggtcgattataacgagatgaatcaatttgtaaataattctctaacttcgcaatattcataagcatagcgcctcctgtattaaagattataattaaattttaaacagaaatactgaaattttaaattcgaaagcattgaattttggataaatacattttaaatagaaaaatacgctctcaaaatgaagtcatctctaaaagaaacgatttaaagatgactactgagagcgtagcataatggaagaagtgtgcagggtgtctaaaaatgcaacaatacaaaggtagttgcaagacaagttgccttatctagaccatttgtgttctatgcgaccaaacttccaaattaaacttgaaataagccaagtaattaaaaataatgcaactaaaatatagcctaaataatcaaattcgatcgaaccaatgaatgcccaaaacgcaccatgtaaatctaacttatcagcaagaatttgtagcaattcaatcatcccaatcactaatgctgccatgactgatatcgcagtaatcgttatattgtaatagattttgcgaataggattgaagaatgcccaattataggcatacttcattacaacaccatctaatgtatccaataaactcatacctgatgcgaataaaattggtaaagataagattccgataaatgaaatggcttgttgtgatgcgcctgaagaaagagcgagtaacgcaatttcactagctgtatcaaaaccaagtccaaataaaaagccaagtggcaatacgtgccaactacgcgtgattaatttgaaataaggtcctacaaatcgagaaaccaatcctctagattcaagtaatgcatcgacttcagcttcttcaatgtgttcacgacgtaatttagcgaacaagttaattaaagagattaaaataattagattcaacacaccgataagcactaaaaagaaacctgaaactagtgtaccaatcgttccaccaatatcttggaaatgcggtaattcatctttagcccattttacagatacccctaaaaaaacagccattaaaaatacgacagatgaatgtccaattgaaaaatagaaacccacaccagatggatctttgcgttgctgtaataatttgcgaaccgtattatctattgcagcaatgtgatctgcatcaaatgcatgacgcaaacctaatgtatatgcaagaatccccataccaaataagatatgatggtcttttccagcaatccataaaaaactaaacccaataacgtgtaacaaaatgacaatagctatgtatggtaaccagcttaagcgctcatttttaaaaacagtcaaaatatatccttctttcataacatgatatttaatcatactgtatgttcaatgggcactctagtaataagtgttcatataacaaaaatgttatgccaaattatttgttatataaaaatatacatgtaaccacaaaagattttttgcgatatatataatttgataaattaaccaacaacaatgtaagatgtcactttgcttaacttggcatcctttttatgattttcaaattcaaaaaaatgagcaaaatgaatctctttaccagtttttaatatttcaataccatgcatggaacctaagcacccatgtgtgatgctggaatggatattgagactagcaacctgattgtaatgattagatagttcttgaattaatatttgaggtccgtatatgtcaaagcggccagggacagaccaaataaattctgttgtaaccagtgaacgtaataattcaatatctaatgctgctgtaacaactataaaatctatcatttgttgacgtttaggcgcatgattgcatgacacatctcctgttaacttaaaaggtaatgatgactgaacttccgttttaaaatgtagttggtgctgaaataaagcttgttc

SEQ ID NO: 273 - DNA, 1039 bp; double-stranded, linear
ttttgaacagccatatttattcaccctcaacatcattataatggtattagtcgcattaccttcacttgttttagctatatatgattatatgagttttagaatttcttctgctattttacaatttctaggggctatctcttggttctttttatcattgatattatcgctcacacaatttacaccttttacattagcgtcatttataacttcaattattttgttcacaagcacaattatcacattagccattggtggtaagtctgttgaaaagaatgattccccttaaattccaaatgaaaaaaaggttctgaaggccgctataaaacacagtttttcagaacctctatacttctattcaatgatatatggtttgcaattttctacctttaaatccacagcttctgcccttgaaactttgttaaaataaaccatcaaacaacgaatgacaacttgatgtgcaacaatgacaatatcatctttttgtgtatcttcattgacaacatgattcataaaatgttctacgcgttgatatacatcttcataactttctccttcaggcgctttttgtgaaaaactatgacgaaagtctttaaagtttggatcattgaaatatttttcatatttcggattcgcactgatttcatctttatattcaccctcaaatacgccaagtgaacgttctcttaatagaggggtagtcgttgatgcaatgtcatatggaaaaatatgttcaaacgtttgctgtgttcttaataagtctgaaacatatacatgtttaatctgtttctctttaaaataatcacataaatcgtctgcactttttgtgccagtatccgttaacggcacatctaattgtccacaaaaataagatcgaaaatgtttattatcataattcgattttgattcgccatgtctaactaaataaatcgtcataatattactccttaccttatgtatttcatatctaccataacactttgactactaattcgatatcaatcttaatattctattctaaaaaaagaattaattcatatnt

SEQ ID NO: 274 - DNA, 1496 bp; double-stranded, linear
gagagaatntgcaattagttattcaattagttgatttaagacatgatccaacacaagatgatatcttaatgtacaattatttgaaacattttgatattcctactttagttatatgcactaargaagacaaaattccaaaaggtaaggtycaaaagcatattaaaaatattaagacacaattagatatggacccagacgatacaattgtaagttattcatcaattcaaaataatamacaacaacaaatatggaatttaattgaaccgtatatttcatagtttttgtacgtcaaaacttatacaaaaattttaaaaataatgtaagcacgaaacttttaattagtacacaattgataacatttttcaacgttcatcattttgtcaaaaactcaaaagtaaattagaaagattataatttatttaagcatcgtacttaattggattttaaattatgttataatatttgtattgttagtatatatgggggcttttcaaatgcattttattgcaattagtataaatcatcgcacagctgatgtgcactaagagagcaagttacttttagagatgatgccttacgaattgcccatgaagatttatatgaaactaaatctaytttagaaaatggtcatattatcaacatgtaatcgaactgaagtatatgctgttgttgatcaaattcacacaggtcgttactatattcaacgatttctagctcgtgcatttggatttgaagtagatgatattaaagcaatgtcagaagtaaaagtgggggacgaagcagtagaacatttattgcgtgtcacttctggtttagattcaatcgtacttggagaaactcaaattttaggtcaaataagagatgcatttttcttagcgcaaagcacaggtacgacaggracaatttttaatcatctatttaaacaggcaattacttttgcaaaaagagcacataatgaaacagatatagctgataatgctgtaagtgtgtcttatgctgcggtcgagttggcgaaaaaagtatttggcaaattgaaaagtaagcaagctatcattattggtgcaggggaaatgagtgaattatcactattaaatcttcttggttctggaattactgatattacagtagtaaatagaacaattgaaaatgctatgaaattagcagcaaagcatcargtgaaatatgatgaactatcatcattaccaaatttacttgaaagtgcagatattgtgattagttcaacgagtgcacaatcttatatcattacaaatgaaatgatagaaagaattgcagaaaatagaaagcaagattcactagtattgattgatattgcagttcctcgagatattgaacctggtattagtgccatcacaaacatctttaattatgatgttgatgacttaaaaggtttagttgatgcaaacttacgtgagcgacaattagcggctgcaacaatttcggaacaaattcctacagaaatacatgcacacaatgag

SEQ ID NO: 275 - DNA, 4826 bp; double-stranded, linear
cttgattttttccctttagtattttccatttgantgtcgcagcttctaaatcctgctttggttctctagtgaacttcataattaaagcagctacaacgaatgatacaagtgcagcaaggaagacaccgagtaacatgtgcaagaattcacctctaggtgcatttaaacagtaaactataaatgaacctggtgacgcgggacttttaaatccaaatcctgttgcttgataagttgcaacaccagtcattccacctaaaataacagcgataaataataaaggacgcattaatacatatgggaaataaatttcatgaataccacctaagaagtggataattccagcaccatatgacgttgcttttgcagtgccttttccaaaaatcatataagcaagtaagatacctaaacctggtccagggttagattcaattgtgtataaaattgattgaccagcttttgcagcttgatctgcaccaagcggtgtgaatacaccatggttaatcgcattgtttaaaaatacaatttttgcaggctctactaaaatacttacaagtggaagtaggtgtgcatgtactaatgcttcaactgccactgataaaatatgcataataaatttcataagtggtgctaaaattttaaatcctgcaatcgtcatgataaatcctaaaataccagcagaaaagttattaaataacatttcaaaaccttgcggcgttctaggttgaatcaattggtcggtcttcttcattaaccaaccaacaagtggacccataatcattgcaccaagtaacattggtgtatcaggtaatgcaacgatgacccccatagttgctgttgctgcgatgataccaccacgtaaatcataaattaaacgaccaccactaaatgcgatcaataatgggattaaataagtaatcattggtcctgctaaagtagctaaatctttgttaggtaaccatccattatctataaaaatggccgcgataaaaccccaagcgatgaaagcgccaatgtttggcatgatcatactacttaagaatgatccaaatgcttgaacacgacgaccaattccttttttctcttcagtttgtgacatgtttacacctcttttttaatatatgtgactatatatagtgtatagagaggttacttgttactcaatataaacaaaaatcaactttgtcaaaataaatgtgacaaaattaaataaagtgtcatcaatgtgacagtatagatattttgaaaaagtaaaacaaaaaaattgttttaggatttttaaaattttattgtgaaaatatttgcaaaacaaaacaacaccgtgtacaataatgattaatggaaagggggaaagttcggcagtacagttaaagcgcctgtgcaaataaatatttgtatttgaagattaaaggttaatatatgagtggcctttatagagtgcaatatatgtatttgtagacgaggaggatagtgatcgaatagatcggcggatgctatcccggatgtggctcattcgttagcttattaagtaaaacattagggtgacttaatggacaaagttaataagatcgccagaaattgaatataaaaaatattaatatggaaagtacagtgtgagcaatttgtatagttgtaaaaataactatgcttaatttgttatggatgaatgcgatgatagcatgttcctatttatattatgaaagcagattgtcaatctaaattatcggcaataaatcataatttacgcgtactattccaatatggaggaaaatgtcgttatgtgtggaattgttggttatattggctatgataatgccaaagaattattattaaaaggtttagaaaaattagaatacagaggttatgactctgcaggtatcgcagtagtaaatgatgataatacaactgtatttaaagaaaaaggtcgtattgcagaattacgtaaagttgctgatagtagcgattttgatggacctgttggaatcggtcacacacgttgggcaacacacggtgtaccgaatcatgaaaactctcatccacatcaatcatcaaatggccgttttactctagttcataacggtgttattgaaaactatgaagagttaaaaggtgaatacttacaaggtgtatcattcatttcagaaacagatacagaagttatcgttcaattagttgaatacttttcaaatcaaggactttcaactgaagaagcatttacaaaagttgtgtcattattacatggttcatatgcattaggtttattagatgctgaagacaaagacacaatctatgttgctaaaaataaatcaccattattattaggtgttggtgaaggtttcaatgttatcgcatcagacgcacttgcaatgttacaagtgacaagcgaatataaagaaatccatgaccatgaaatcgttattgttaaaaaagatgaagttattattaaagatgcagatggaaacgttgtagaacgtgattcatatattgctgaaattgatgcatcagatgctgaaaaaggtgtttatgcacactacatgttaaaagaaattcatgaacaaccagcagtaatgcgtcgtattattcaagaatatcaagatgcagaaggtaacttgaaaattgatcaagacatcatcaatgatgttaaagaagcagaccgcatttacgttattgcagcaggtacaagctaccatgcaggtttagtaggtaaagaatttttagaaaaatgggctggcgtaccaactgaagtacacgttgcatcagagtttgtctacaacatgccattattatctgaaaaaccattgttcgtttatatttctcaatcaggtgaaactgcagatagccgcgccgtattagttgaaactaataaattaggtcataaatcattaacaatcactaatgttgcaggttcaactttatcacgtgaagcagaccacacattgttattacacgcgggtcctgaaatcgcagttgcatctacaaaagcatatactgcacaaattgcagtattatcaatcttgtctcaaatcgttgcaaaagagcatggtcgtgaagcagatattgatttattgagagaattagcaaaagtaacaacagcaatagaagcaattgttgacgatgcaccaattatggaacaaattgctacagatttcttagaaacaacacgcaatgcattctttatcggacgtactattgactataacgtaagtttagaaggtgcgttaaaacttaaagaaatttcttacattcaagcagaaggttttgctggtggagaacttaaacatggtacaattgccttaatcgaagaaggtacaccagttgtaggtttagcaacacaagagaaagttaatttatcaattcgtggtaacgttaaagaggtagtagcacgtggtgcacatccatgtattatttctatggagggtcttgaaaaagaaggcgacacttatgtcattcctcatgtacatgaattgttaacgccattagtatcagtggttgcattacaattaatttcatactatgcagcattacacagagatttagatgttgataaaccacgtaaccttgctaaatcagttactgtggaataattcacttttttagaatcaatcatgtattaaaattaaagtatatggcacccttttagattaatcgactagaagggtgcttttttaggtcgacttagcttttacttcatcttaatttggcagaaatgcgtaaaaatgaagtgttttatttatttaaatagtctgacaattaagggtgttatgttaatatgattttatgagaagtatggagtagcaataaaggggtgacctcgcatgttaattcaattagatcaaattgggcgaatgaagcaaggaaaaacaattttaaaaaagatttcttggcaaattgctaaaggtgataaatggatattatatgggttgaatggtgctggcaagacaacacttctaaatattttaaatgcgtatgagcctgcaacatctggaactgttaaccttttcggtaaaatgccaggcaaggtagggtattctgcagagactgtacgacaacatataggttttgtatctcatagtttactggaaaagtttcaagagggtgaaagagtaatcgatgtggtgataagcggtgcctttaaatcaattggtgtttatcaagatattgatgatgagatacgtaatgaagcacatcaattacttaaattagttggaatgtctgctaaagcgcaacaatatattggttatttatctaccggtgaaaaacaacgagtgatgattgcacgagctttaatggggcaaccccaggttttaattttagatgagccagcagctggtttagactttattgcacgagaatcgttgttaagtatacttgactcattgtcagattcatatccaacgcttgcgatgatttatgtgacgcactttattgaagaaataactgctaacttttccaaaattttactgctaaaagatggccaaagtattcaacaaggcgctgtagaagacatattaacttctgaaaacatgtcacgatttttccagaaaaatgtagcagttcaaagatggaataatcgattttctatggcaatgttagagtaaatattttgcaaataataagtaataatgacaaaatttaattaagataaaatggacagtggagggcaatatggataacgtaaaagcaatatttttggacatggatggaacaattttacatgaaaataatcaagcatcaacgtatacgaaagatgtcattaatcaattgagagagaaaggatataaagtatttttggcaacaggacgttcgcattctgaaaatacatcaacttg

SEQ ID NO: 276 - DNA, 4846 bp; double-stranded, linear
gaataaaaagtaaaattactcgcctttgttaccttttactttatcaataaaatcagttgctttttcttttgcattttcaacgaattctttcgctttaccagaagctttatcttctttaccttcgttttctaaatttttattatcagtaacattacctactgtttctttaacattaccttttgcttgttcaaatttactttcgtctgccataataaatgcctcctcggaataattaaatgttatatataatacttacccactgaaaaattatctaaacattttacttaaataatttttgatattgatttgacgtcattttataactagcgaaatagattcatcattaacttgagggagtgggactgaaataataaagaatcactaatgatttatgatgtattagtcactagccatgtgaaattaaaaataagaataaatgagtagcacgcatgcatataggattttactttatccgtaatagcatctcattcctaaatatcatataaatacctgtttaaattaaaaagcccagcaacatcacgttactgagccattaatatgatttatttagcaggaataactgcaccattgtatttttcattaatgaagtcttgaatatctttagattgtaatacttcaattaatgctttgattttcttatcatcttgatgtccttctttaacagcaattaagtttgcataaggattatctttcgcactttctacagcaatagaatcttttttaggatttagtttttgttcgattgcaaagttcgaattaatgataacagcatcagcgtcttcattttgataaattttaggtaagaattctgctgattgtttattattaaacttaatatcttttttattctctgtaatatcactaaacttagcatcttcaatttttacgccttttttgattttaattaaacctgcatcaacgaagaattttaagaaacgtccttgttcagctggattattagacacatagactgttgcaccttttggtaattcttttaaacttttatactttttagagtatacagccataggttctaagtgaacatcaccggcacttacgattttgtaacctttatcctttttctctgtgtttaaatatggtgtatgttggaaatagtttgcgtcaatttcacctttgtctagtaatttattaggtgtagtgtaatcgttaattgttttaatatctagttcataaccttttttctctaataatggttttgctttttctaaaatttcagcatgtggtgctggtgaagcactanctgttattttcttgtcgtcactgccacttttgtttccattaccgcaagctgctaatacaactgcaaatgttaatactaaaataagaccaaataattttttcataaaatgaaacccccaatttatcgtttatcaagtttatttgtaagccaatccccaatgaattggattataaatacaataattaaaataaaaactgttgatactaaaatgacatcattttgatttcgagtgaaacctgttaagtatgctaaatttcctaaaccaccggcaccaattacacctgcaactgctgttgaaccaactaaagcgattgctgtaactgtaatgccagacactagcgctggcatagcttcaggtaaaaggactttacgaattactgtccaagtattagcgcccattgaccaagccgcttcgatgacacctttatcaatttctttaaaagcaatttctacgagccttgcataaaacggtgctgcgccaatgatcaaggctggtaacgcacctgtcggaccacttatcgttccaagtatcaaacttgtaaatggaattaataataaaattaaaataataaatggtatcgctctaaataagttaacaatgaaagaaacgatagaataaaataaccttgcaccgatagacttacctttagcagacaagaataataacacacctaaaataagaccaagtataaatgcaaatatagttgagacgactgtcatgtatagtgtttcgactattgcagtccaaacttctggccactgaatattaggcattgtaatcatttcatttataatttcactaaatgatttacccatgtcttaacacctccattttaacttgtcgctcaattaactctttttcgaattttccgaaatctacacttgaaatatatggaatatgcagaactaaaaagccgactgttccattttttgtatttttaatatttgcttctaaaatattaattttaatatcataggcagttgatagactcgatacaataggctcggttgttgttgaaccagcgaaaactaatctaacgatatatgcatctttttctaatggctctaattctgttaaagatgtttcgaaatcatcatttaaatcgtctttcacaaatcgttttgtcacagtgtgttgcggattttcaaaaacctgtgtcaccggtccttgttctatcactttaccactttccataactgcaacttcatcacaaatacgacgaatgacatgcatttcatgcgtaattagtacaattgttaaattttgttgttctctaatttttagtagtagatctaaaatttcatctgttgtttgcggatcaagtgcacttgttgcctcatcacaaagcaagaccgttggatcattagtaacgctcgtgcaatcccaacacgttgcttttgtccacctgataactctgatggataagccttttctctaccttttaaaccgacgagttcgacaagttctaatgctttttgcttagctctccttctagggacacctgcaatttcaagcggaaacataatattttttaacacagtccttgaccataacaaattaaaatgttggaagatcatacttactttttgtctttttgctcttaatccatttttggacaattgacctatatggtctccatctataataacttcacctgatgtaggcgcttctaaatgattaaacattcgaatcaaagtactttttcctgctccagaaaaaccaatgacgccataaatcgatcctgctcgaatcgataaattaacgtgatctacagcaaggacttctttatttttagtccgatattctttaacaacttcttttaattcaatcacgttgattcctccctgtgttgcttaataaaataaaaaatgctttctcaatatcgatagaaaaattgagaaagcaatagtagtattgtttctctcatcttcaaaagttaaaactttatgtgaattggcaccatttctatataagacggttgccgggcttcgtagggcacatccctccaccactctcgataagagtttacgcatcatttaatttgtattaatcctaacaccttagtaaaatttcgtcaataactattttaaattttctaacaaatcagtcaccgatttaaatgcataaattcgttttacttctttatctttattcatcaacaataaaatcggcgtagacatgatttgcatatctttacaaaactgaggataaaagtttaaatctattttcaataatggtaactgcaatatttcattagcaatgtctaacattctttctgaaaccttacaagtaccacacgttggtgtataaccaaagattaaatgtttgtcttcctcataaaatgtagttacatctttgatgtctaatgaattattcatttactaaaactaacctttcattatttatattcggtaaaagaggtgtttctttcttacaagtaaagccatgttttgaaagtacatgcgccaaatattgtttggggcaattcgcaacttgacagtaagttttatcaataaatatatgttcactttcactcaaataacgtttaaaccaatttctaattcgatctccttcgtcatcagaatcggctaatacaaaaacttgtttatcatacagtgattctatcatatcatcaagcttatctatactcattgttccatgagtacaaataatattgactggttctgcaataacctgttgcaccctttttttatcagattttccttcaacaattatcactttatttacaatagccatcatcatcaccctttaaaatcaataaacatctgtcactgtatcatttcacaaaattggtatgaataaaacataaatcacaaaaaatttaaactagcttaatataataattacaaactcaatgtttgactagctggaacatttaacataagcagacaaaggctaagtcaaaaatcaacatcctaaaatctacaatgttatattaacaatagttaaccaaaagaaaatacacctataacaaacttttcaattatagcggggccccaacacagaagctgatggtaagtcagcttacaataatgtgcaagttggcggggccccaacataaagaaatactttttctttagaaattagtatttcttatgcatgagttttactcatgtattcctatttttaaatacacattagctgtggcttatgaaaacaggctgggacataaatcaatgttctatgctctacgaagttatattggcagtagttgactgaacgaaaatgcgcttgtaacaagcttttttcaattctagtcaggggccccaacacagagaatttcgaaaagaaattctacaggcaatgcaagttggggatgggccccaacaaagagaaattggattcccaatttctacagacaatgcaagttggggtgggacgacgaaataaattttgcgaaaatatcatttatgtcccactccctagattgatctatagatactacacttattaaagtaatatatttttatgattctcttagctgcaatcccatgaatacatgtaatcatcaaacttcatagcctcaaggtcagtagatttca

SEQ ID NO: 277 - DNA, 1843 bp; double-stranded, linear
aacaaagacacaatcgaacatgaaccatcagtaaaagctgaagatatatcaaaaaaggaggatacaccaaaagaagtagctgatgttgctgaagttcagccgaaatcgtcagtcactcataacgcagagacacctaaggttagaaaagctcgttctgttgatgaaggctcttttgatattacaagagattctaaaaatgtagttgaatctaccccaattacaattcaaggtaaagaacattttgaaggttacggaagtgttgatatacaaaaaaaaccaacagatttaggggtatcagaggtaaccaggtttaatgttggtaatgaaagtaatggtttgataggagctttacaattaaaaaataaaatagattttagtaaggatttcaattttaaagttagagtggcaaataaccatcaatcaaataccacaggtgctgatggttgggggttcttatttagtaaaggaaatgcagaagaatatttaactaatggtggaatccttggggataaaggtctggtaaattcaggcggatttaaaattgatactggatacatttatacaagttccatggacaaaactgaaaagcaagctggacaaggttatagaggatacggagcttttgtgaaaaatgacagttctggtaattcacaaatggttggagaaaatattgataaatcaaaaactaattttttaaactatgcggacaattcaactaatacatcagatggaaagtttcatgggcaacgtttaaatgatgtcatcttaacttatgttgcttcaactggtaaaatgagagcagaatatgctggtaaaacttgggagacttcaataacagatttaggtttatctaaaaatcaggcatataatttcttaattacatctagtcaaagatggggccttaatcaagggataaatgcaaatggctggatgagaactgacttgaaaggttcagagtttacttttacaccagaagcgccaaaaacaataacagaattagaaaaaaaagttgaagagattccattcaagaaagaacgtaaatttaatccggatttagcaccagggacagaaaaagtaacaagagaaggacaaaaaggtgagaagacaataacgacrccaacactaaaaaatccattaactggagwaattattagtaaaggtgaaycgaaagaagaaatcacaaaagatccgattaatgaattaacagaatacggaccagaaacgataacaccaggtcatcgagacgaatttgatccgaagttaccaacaggagagaaagaggaagttccaggtaaaccaggaattaagaatccagaaacaggagaygtagttagaccaccggtcgatagcgtaacaaaatatggacctgtaaaaggagactcgattgtagaaaaagaagarattccattcragaaagaacgtaaatttaatcctgatttagcaccagggacagaaaaagtaacaagagaaggacaaaaaggtgagaagacaataacgacgccaacactaaaaaatccattaactggagaaattattagtaaaggtgaatcgaaagaagaaatcacaaaagatccgattaatgaattaacagaatacggaccagaaacgataacaccaggtcatcgagacgaatttgatccgaagttaccaacaggagagaaagaggaagttccaggtaaaccaggaattaagaatccagaaacaggagatgtagttagaccaccggtcgatagcgtaacaaaatatgggacctgtaaaaggagactcgattgtaggaaaaagargaattccattcaggaaagacgtaatttatcctgtttagcacccggggcagaaaagttac

SEQ ID NO: 278 - DNA, 8536 bp; double-stranded, linear
taaacagcgcgtgtacttgtgattcccccttcttctattttacccacccgggaaataatacttttcgcgattccttacttgaacaagcaatattttatcagctgtttcttcaactaaacagacacatttaatcatctttgacaccccaactttgtgaaatcaatttttcaaattatactgtacaattatgttatcatatatgagtagttatagcgcaaaacgttagcaattcagcgcacccaacttttcatataaacagaagatactagggggaattattattatggcaaaacgttccaaatcacaacgtttatcaagtttactaaatgtcgcaggtttcatagtcgacggctacaatggctataaatatcatgctaaaaataaaaaattagtatatctttcattaggtttaagcactgtaggaaccgtgttagacttttacatttcaattaagtcaccacgtaagttcaaaaaagcagtggcagttgttactttaataacaaacggtgctagattatttacaagcattcgcaaagtaaaacatgaatactaattcagaaaaggattggtcgaacatagaacatgaagttcattcgaccaatcctttttcatatacaaaaattcctattacaacaatcacgactttgatagccccgccataaaatttaggattcaatccaacttttcagcttgtgaaatgtaataggaattcattatatatttatatacgtaagactttagtgaatatatctataattatttacttggtaagctggtaccgttctgtaagttaaaatacctggtgcagctgaatagttcatttctgaaactaaaatactaccatcgttatttacacgttctacaaacataacatgaccatagtaacctacatctgtttgagcgatagaacctacagtaggtctattgtcgatagtgtaaccatctgctgccgctgcgttatcccagttattagcattccaccaataagtactaatacctttaccaatttcagcacgacgattaaatacatgatatgtacattgaccccatgtatataagttttggtgactgaatactggtgtattgtaacctctatttgtcgttgttgcagatcctgagttcgtagatgcattaccagttactttcaatttttgacccggatatataaagaaattatttaagccatttaagctcataattttttgataagttgtaccatattttgatgcaattaatgacaatgagtcacctgcttgtactgtatagtatgatccgccacctgagttcgttgatggacggctactattgctcgcagcgttacttgagctagcagtacctgatacttttaatttttgacctggataaataaagaaattatttaaaccattaagtcgcataatgttttggtaagttgtaccatattttgatgcgattaatgataatgagtcgcctgcttgtactgtgtagtatgatccgccacctgagttcgttgatggacggctactattactcgtagaattacttgagccagatacttttagtacttggtttgggaaaattagattagatgttaaattgtttaatgactttaatttagcaatcgaaatcccatacttatttgaaattgcccacactgattcacccggttttactgtgtgagttgtagccgcatttgcttgagttgccgcaacagcgctaatcgcgcttgtcccaataatagctgcaattacttttttttgcactttaaaatcctcctcttgcttaactttcctaacattcttttatccgaatttatgaatactacatcattatacgattttattatgtataataggttgatgtttgatgacattatgattacaaaaaaatcatatactgtatcatcaaattttataattatcccttaaaattattacaacttattagattttacaatatctaaattattacaatttcataatatttcactataaaatgattacaatccctttctctattggaaataattttattctccaacaataacgccctacaaacataagcatgaactttgcttgtaggacgcaatataatttattttgctaatgacgtttctattgccttaatctcatctttagataaattaacaggtttctctccatctttgacatcttcctgcaacgctttttgagcttcttttgaatgatacaattctacgattttagcatatgttttgttatccaagtctttgtcattaactgcaacaatattaatatatggctttactgcatctgaatttgatttttctaaaaatatcggatcatttttaggatctttacccgctttagttgctacaccgttattaataactgcaatatcgacatcagataaagcacgtgcagtttgttgtgcatctactgcagtaatttttaaatgttttggatttgacgttatatctttcaccgtgcctgctaatccgaaatcttttttcagttttattaaaccagctgcttctaatagtttaagtgcacgtgcttggtttgacacatcatttggaatgacaactttagcaccatctttaacctttttgacatctttaattttatctgagtaaatgcccaacggtgctaaaactgttgtacttaatgctgaaatctttgttcctttatgcgcctttttatattgatctaaaaatgcaaaatgttggaatgcattcatatcaatatcaccatcatttaatgctttattcggtaaattgtaatctgagaagtgcttaatctccacatcaatatcatcttttttagctaattctttaaccttctcccaagccttagtgtcatttgatgcgacaccaattgttacttttttatcattgttaccaccacacgctgctaataatacaagtgctacgataactaacccaatcaatcttttcattctatcaattcctttcaaaatcttcactatatatcattaatgtctacgtatgaatctagctagaacattccctagcgtttgaatcacttggacaataatgactaatacaataacggtaataataatgaccgtcgtatcaaatctttgataaccatacactaaagctaagtctcctataccaccaccgccaacagctcctgccatcgccgtacttccaataagtccaataatcgcagtggtaattgctaatactaacgaacctaaagcttcaggaattaaaaaatatctaatgatttgtagtggtgaagcgcccatcgntttcgccgcttcaataatcccctcgtctacttccaataatgagttttcaacaagtcttgcaatgtaaggtgccacatatactgttaaaggcacgatggcagcagtcgtaccaattgaagtacctactactaattttgtgaatggcacaatcgcaattaacaaaataataaatggtagtgaccttaaaatattgattaaaggatttaaaacttgatgtatcactatattgggccatatgccttgttttcgagtaattaccaataagacacctaatggaataccaatcactgctcctaaaaataaagcaatagataccatatatagcgtttcgtacaatgcttgtaataactgtgcactgtctaaatcagaaccaaacatatgttaatgcacctcctcaaattgaatatttttctctttgaaatattgatttattgccgtgtcttcaaattgttgatccatattaaatcgaagccacatataacatacggtgttaccttgtatttctgacatagatgaaaataaaattttaacctctctgccacaaatttgaatcaagtcatttataatcggttgtgtcacctgagtttcctcgacgaagattttataatctttaaaatcgccaacttgttcgtcattcaatcgacgaatcaatgatgtacttggctcagtctgtataactgtagacacaaaattttgagcaatcgtcgttttaggatgactaaacacctctttaacagttcctgtttcaaccactttccccttttccattacagcaacacgattacaaatgtctttaataacgcgcatttcatgtgtaatcatcataattgtaatgccaaaggtttgattgacattctttaataacgtcaatatcgaagcagtcgttgctggatccaatgcgcttgttgcttcatcgcataggagtattttcggattagtaacaagcgctcttgcaatagccaccctttgcttctgcccaccagataattcatcaggaaattggtcttttttatcactcaatcctacaaattcaagcatttccgttactcgttgcttaatttctgttttgcttttcttacttaaaatgagtggcattgctacatttttaaatacggtagctgaatttaataaattgaaatgctgaaatatcataccgatatctttcttaatatccctcatcattttatcgctataattcgtaatatcatgtccatctacaatcacttgtccattcgaggcagcttcaagatgattcacgagtcttaccaacgtactttttcctgcaccactatatccaatcacaccaaaaatatcattgcgattgaccgtaaatgatacgtccttcaaagcatctattttttgcttctttttattaaaggtcttacttacctgtcgaaactmaatcatcatcgcccctcctacaaattcttattaatccactaggaataagagcattatatgtaaaattgcatatatcgtcaatacaatttgccgaattttctaaaaaattaaaaaataagtaattcatgtgacaatgacgaattgtgagactactatgacatttatcaaattaaatccataaaaatgtccaccaatcctccacaacgcaattactaaatattaacatcgcacaaaaaagcactagcatattcaagaacaacaaacgttgaactcaaaatatatgccagtgctgctattatttataaagtatctagtgcttgttttaaatcatcgactaaatcttcagtatcttcaatacctacagaaattcttacaagtccgtctgtaataccttctttagctcgaatatctgctggaatggatgcatgtgtcatcaatgcaggtactgaaattaaactttccactgcacctaaactttcagctaatgtgtaatacgatgttgctttaatcaattgtttggcactttctgtatttttcacttcaaatgcaatcacacctgtatggccatccgcttgagccatatggacatcatgatttaaatgactttcaatacttggatggaacacttgttgcacagctggatgtgcttgtaacattttaataatttcaataacgctgcgattaatttgttccatacgtaaacctaatgttttaatacccctcacaagtaaatagctatcttgaggtcctaaaatgccacctgttgaatttgaaataaatgctaaacgttctgcaagcttgtcatccgatgttgcaactaaaccagcaacgacatcactatgtccacctaaatatttcgttgcagaatgtaagacaatatcgatacctaaatctaatggattctgataataaggtgtcataaatgtgttatcaacaactgaaatcaaaccgtgttctttcgcaatttcagcagactttttaatgtcagtaacacgtaataatggattagaaggtgtttcaataaacaacatctttgttgttgggcgtatcgcttgtacaattgaatctgtatgcgttgtatctacaaaatccacttcaatgccaaatcgtgtaaatacttttgtcaatgcgcgataagtaccgccgtatacatctgaatttaaaataatatgatctcctttgtccaacagcataacaactgcactgattgctgcaacacctgaactaaatgcaaagccatgtttgccattttctaatgtcgcaataacgctttctacagaacttcttgttggattcgcagtacgagaatattcatatccttgacgtaaatcaccaatatcatcttgtaaatatgtacttgtttgataaattggtgttgtaacggcacctgtataatcgtctgttgtgtgcccaccatgaattaatttagttttcttgttcattattattctcctcataattaaatatttgcttagacatatatcgatcactaccatctggaaatacgacaacaatcgtaccttcagataattgcgcttttaaattcaatgcaccttgtaatgctgcacctgaagaactgcctactaacaacccttcatttatagccaaacttttgacatttcgaaaggcatcttgatctttaatcgtaaatatcccatctacaagacgtctctctaaaaatatcggccatttctcagaaccgataccttcagtgtcatgtgcatgagctggccctccatttaacacggacccttctggctcaacggcataacattgcacgtgatgttgctttaaataacgtgcggtacctgtaaatgtaccgccagagccaataccagccacaaaataatcaatttgctgtaatgctgaagtcaattcgggtcccaatgtatgaaaatatgtatccggattatgttcggattcaaattgattcatataaacggcaccatatttttcagcataggaacgtgcagctaattgtgccccatgcataccttcagactgactcgtccttgaaacttctgcaccaagcgctatcataatattaatcttttcttctgaaaaaccatacggcgcaaagatcttacatttcaaatgatgtctattcgctgcaatagctaaccctatgcctgtattaccagcagtcgcttcaacaatagtttgacctgcacgcacacgcccttcttgaattgccttctctactaaatatttcccgagtctgtctttaacactgcctccaggattccattgttcaagcttggcataaattttaactttatcatcactataatgttctaacagtactaatggtgtattgccaattaaatcataagtaatcatagatgcaccctcatctgacatgccgatcaaatgaatgaaacctttcttcatgtctcaattttaattcttacttttcagataagaattataaacgacattttgttattttgcaattatctaagtttcgattaattcagaaccagtactaaattttcaattccaaacaaaaaaacacctgagcaacacaaatacttgtgtgtcagatgcttctatatattaactaaataattgcacgataaagactaaaataataacgacaggcatcgcatacttaattaagtaataccaaccactgaataatctaaatcgatctttaccaaaatattgttgtaataattttttatctaataattgtcctacgacaagcgtagtacctaatgcgcctaatggcatcaatacattcgaaacgatgaaatccatattatcaaaaatcgttcccgcaccgaatcttacatcttttaagataccaaaagataaggttgctggaatactaatgataaatactaaaatactaccgatcactgcgacttttttacgttttgtattgtcattcttcgtgaagttagaaacatttaattctaataaagaaatagatgacgttaaagccgcaaataagaacagcactaagaatcccaaatagaataatgtgcctagatgcatttgactaaagaccattggcagtactttaaataataatccaggcccttcttgtggttcatagccaaaactatgtaaagccggaaatatagctagacctgccaatacagatacaaagatattcataacaacgatagaaatagctgatgacttaatcgtcatgtctttagaggcataactcgcataagtaatcatacctgtagttcctaatgataacgtaaagaatgattgacctagcgcaaacaagatgccatcagcagtaatctctgatactcttggttgtaaaataaatttcacaccttctaagacgccatctaatgttaaagacttaatcacaatgacgattaaaaagacaaacagcaatggcatcataactttcgatgccttttctaatcctttttcaacacctaacatgacaataatcatcgtagcgaatatgaatataccttgccctagaacggttaaccaaggatttgatattaccgcttcaaaattcatttcttggagatgattgatgcgttgaaatataactaattgccataatacttgtccgatgtaaatgacaatccaaccaccgataacactatagaagccaaataaaataaacactgccaaattaccgttccagccaatgatattgagccattttttaccagttaatttactatatatttgtgttgtatatgtccgtcccattttcccaacagtgaattccataatgagtaatggcaacccaacaaaaatggtgaatattaagaacatagctagaaaggcaccgccgccataaatccctgccatatatgggaatttccacatggcaccaagaccgattgcagaacccgcactagctaaaataaatccagttgatgacttccattgtgattgttgtcttttcatcattcac

SEQ ID NO: 279 - DNA, 4328 bp; double-stranded, linear
gctttggccattttatgtggcgattgagacaatctgtkgttgtcttatttgatgttgtatttcaactggtaattctagttgcgattgaaataatggcaacttttcccaatcattaacaaataattcaatacctgctatgtctaatactttagcacgtgcatcatcaacaagacggcgttccaattgatttgcttcttctttaatacctggtgacgtactttctaatatcaaattagatatagggatgtgaccattaattgcataatataatgcaacacgcccacccattgaatatccaaacaatgttattgatttatctttatatttatctaaaattcggtctaacaacgtcgtaatataatcaaaattccacgtttcatccattgaagactgatcttcgccatggcctggtaagtctatagtgatgacatgatagttatcagtaaatttttcgatgtgattatgataagtacggctgtcgctaagaaatccatgcagaaatactaaaacttgattggtctcaacgtttgcttcataaaatttataatgtgtcatgaatcatttcactcaatttctggtataaaatttgatgctgtttaaagttatcttcgcgattcgttatcaattcataaatcgtcgaagtttcagataacaatgtggcatttttaaattctgaaacactgttaaaacgtttaaaatcgaattgatataacttagctgtatactcgaaatccaatcccgtcggtgtgccaaacaaccgttcaaaatagtcagttgcactttctttttgtggtaaatatgaaaaaataccgccaccatcgttgttcaataatacaatattcatctgaatattatttaattttgacattaatagtccattcatatcatgataaaatgataaatcacctatcaataatgttattcgtttatgcacagccatacccagtgcagttgaaacgataccatcaataccattcgcaccacgattcgcatagacatctatatttttattcaataacaagttatctacatctctgataggcatactattactaataaataatgcatctttttcagatgttttcttaatcaattcaccaacgaatgcactctcatctgtagcttgttccaaataacatttaatttctttacgcccttttttctctaagcattgccatttttctaaccaacttacgcgattaactgtcgtgtcttccattaatgacctaaagaaatcattcgcagaaatctcatatgaaatatctggcgctatcggaaagacatcaatcttatcattgttttgcactaatatttgaaatgcatcagttttctttaaccattgatttaactttttagaaatcactggtttcccaacacgaattacgaaatccacatttaagtctaagccgcttctaaacagcaaatcatatgtacagataacattcggatgatcaaattttcttaaatgacttaaaggatcagctaaaataggcaaatcatatatcgttgaatacgttagtatttgatcaacttcttggtgctgcatatcccctacaataattaaaccttttttcttatttaaaatgtgtcttaatgccgatgcatctatacttttttgatagtgcggtaaaatcttcatctcagaagttaacaattctgttgcattcaaatcaggtgttaacggatctctaaatggcaagttaaaatgaattggccctttatgtggtccatataaatattgactagcaatttgcatttgatagtaaattgcatcaatggtctctttactatcatccgcaataggcatatcgaactcataacttacataattattaaacatatttacttgattaatcgcttgtggtgcgcctacacttcttaattcatgcggacggtcacttgttaaaacgattaaaggaattctactaatttggctttcagcaattgcaggcgtataattcgctgctgctgtacctgacgtacataatatagcgacaggtctttcactgcctttaattaacccaactgcaaaaaacgctgcacttcgctcatcggggtgtatccatgttttaatatttggatgtgcttcaaatgcaagtgcaagtggcgttgagcgtgatcccggactgataactacttcccttacgccgtacgcatataactcagatgcaaatgtaaaaacttgcttcgttaaagctgctttatgatttcccattcatatcgactcctaatgcattcatcataggtgtgaacttaaggttcgtttctgccaattcactatctggatcagaatctttaacaatgccacacccagcaaataaagttgcttgtgctttcttaataagcatcgaacgaattgcaacaataaattcacaatcatcgtatatatctatatagccaaccggtgcaccatataatcctcgcgtaccaaattctttctgctcaataaaatccattgcaaattcttttggatagccacctaaagcaggtgttggatgtaaattatcaattaaactaatatacgaatcatccttcagtggcgcctttatttcagtgtacaagtgatataaatgatcattttttagaattttaggcgtcttatcataatgtaattcagtgatataaggtttaatatcatgtaaaatactgtcaacaacaaatcgatgttcgattaagtttttattatcttttaaaaatgcttcaacattttttgtatcttcgtcctcatcttgtgaacgtttaattgtacctgctacagctttagtcgatagtattttattattgacctttattaattgttcaggtgtttgtgaaaagaatatagaatcttgtgattctaacaagaatatataactgtttttttctttagaatatgcttgctttagaatatatggaatactgatatctttatcgaactttattaaccgtctacgtgctagtacaattttttcttcattattaatagattctatagcttctactacaagttgacgccagtcatctttataaatatcttcatttctagtaatttccccaatttgctcgtccacatctatgtccgatatattgttgaacaaatccattaaatcgttcaatgcctcaacagtaaaactttcccttttaactgtataagttaaaaatgtcccattattatcagttgaaattaaaacttcaggtaatacaaaatgatttagtccaaactctcgccattcatcatctgatttatgacttgaaaattggaaccctccaacaactcgaagatgatgtttctcagattgcggatgtataaatgtgatgttatgttttaatttttcccagtctttaaaaatagattgtttatttttagaattatttttgaataattgaattgctttgtagccaaaatatgacgttcgattatcattcaaacgcatataaaagcgatctcctgcctcattgtcagtgagatgaaataatgtgctcgggtctagtgactgtgataatttcacttcaactgaaacccattcctttgagctgccatatatctctttgacaatatcgtcctctaatacgcccgtagccatccatttcacttctttcttcgtcttttttcactcattattatattgtatcatttttggataattgtgttacaagaattgcttaaacttatcttgcaatttttcacgtcaattgacctttatgctactttctattaaaatatctttgttataaaaaatatgatttaaagaggttttgtattcaatgagtaatcaatatcagcaatattctacagttaagaaatattggcatttaatgcgtcctcatacattaactgcttccgtagtacccgttttagttggtacagcagcatctaaaatatattttcttggtagcgaagatcatattaaaatcagcctattcattgccatgttactagcatgcttacttattcaagcagcaactaatatgtttaatgaatactatgattataaaaaaggcctcgatgatcatgaatctgtaggcattggtggtgccattgttcgcaacggtatgagcccagagcttgtgctacgattagccattgcattttacatcttagcagcaatattaggtttgtttttagctgctaactcttcattttggttattaccagttggattagtatgtatggctgttggttacctatatacaggtggccctttccctatttcatggacgcctttcggtgaattattctcaggcgtatttatgggtatgtttattatcgttattgcattctttattcaaactggcaatattcaaagttatgtaatttggttaagtgtacctatagtaatcactatcgg

SEQ ID NO: 280 - DNA, 1450 bp; double-stranded, linear
gttcaatacagaaaaaataaatttagatgttgaagcatcctacaattaatacagatccatttcaatatatttaaactaaaatctcgggatttctaaattttgaaatttcgaggttttnatatttttatttaaaatagcacatttatactttataatagtaaagatgaacatataaggaggccaaatcatggcaaaacatccattcgaacaatttaatctagaatctagtttaattgacgctgtgaaagaccttaattttgaaaaaccaactgaaattcagaatcgaattattccaagaatactaaagagaacaaatttaattggtcaatctcaaacgggtacagggaaatctcatgcatttttattaccattaatgcagttaattgatagtgaaataaaagaaccacaagcaatcgtagttgcaccaacaagagaacttgcacaacaactatacgatgcagcgaaccatttaagccaatttaaagctggtgtttcagttaaagtttttattggtggtacagatatagagaaagatagacaacgttgtaatgcacaaccacaattgattataggcacccctactagaattaatgacttagctaaaacgggacatttacatgtgcacttagcatcatatttagttattgatgaagcggatcttatgattgacttaggattaattgaagatgtagattacattgctgcaagattggaagataatgcaaatattgcggtgtttagtgctacaatcccacaacagttacaaccatttttaaataaatatttaagtcatccagaatatgtagctgtcgacagtaaaaaacaaaataaaaagaacatcgaattctatttaatacctactaaaggtgcagctaaagttgaaaagactttaaatttaattgatatactaaatccatacttatgtattattttctgtaatagtagagataatgcaaatgatttagcacgttcactaaatgaagctggtattaaagttggtatgattcatggtggcttaacgccacgtgaacgtaaacaacaaatgaracgtatacgtaatttagaattccaatacgttattgccagcgatttagcatctcgtggtattgatattgaaggtgttagtcrtgtcatcaattttgatgtgccaaatgatattgacttctttacgcatagagtcggacgaactggtcgtgggaattatrraggtgtagcaattacgctttatagtcctgatgaagaacacaatatttcattaatagaagatcgcggttttgtattcaatactgttgatattaaagatggtgagttaaaagaagttaaagcgcacaatcagcgtcaagcaagaatgcgcaaagatgaccatttaactaatcaagtgaagaacaaagttcgaagtaaaattaaaaacaaagttaaaccaggttataagaagaaatttaaacaagaa

SEQ ID NO: 281 - DNA, 1139 bp; double-stranded, linear
agtcaggtatatcatgccatyctgaattggtcgatattaatatcagtggtgttaaagaacgaattgtataccaatagacgctttatattgtaaaatagtattaaatgcagaatagagaggagatttaatgcgatatgacaaattataaagttgtcgttttagatatggatgacacattgctaaattcagataatgtgatatcagaagaaactgcaaattatttaacagcaattcaagatgaaggttattatgttgttctagcatctggtagacctactgaaggtatgattccaactgctagagatttaaaattacctgaacatcatagctatattattagttataacggtagtaaaacgattaacatgactaatgaagaagtagaagtaagtaaatcgattggtaagcaagatttcgatgaaattgtagattattgtcgagatagaggctttttcgttcttacatatcatgatggtcaaattatttacgacagcgaacatgagtatatgaatattgaagcagaattaacaggtttaccgatgaaacgtgttgatgatatcaaagcgtatattcaaggcgatgtacccaaggtcatgggtgtagattatgtagcgaatattacagaagctagaattgatttgaatggtgtgttcaatgataatgtagatgctacgacaagtaagccattcttcttagaatttatggccaaagacgtttcaaaaggtaatgcaattaaagcgttatgtcacaaattgggatattcggtggatcaagtcattgcttttggtgatagtatgaatgataaatcaatgtttgaagtcgcaggtctagctattgctatggggaatgcatcagatgaacttaagcaatatgcaaatgaagttacgttggatcataatgaaaatggtattccacatgcgctcaaaaaattgttataaattttaaaataagccttaacacatgatatttgaataagatatcttgtggttaaggctttttatttttgtgaaaatgacttcagttatactatggaggatttgaaatacatattttagattagtaatgatatcaaacgaatagagtaaatgtatattttttgaataaatcaagtattaactagtcacggaaggnagataaat

SEQ ID NO: 282 - DNA, 2931 bp; double-stranded, linear
tctaaaaatgctgtgaaattcttttataaatatctaaaaggaattaatgttgataacattgctgtgataggaagtaagacagcgcaatattgtgaatcacttggcattcgagttgattttatgccaaacgacttttctcaagaaggatttttaaaatcatttaatcaaactaaccaaaaaatacttttgccttcgagtgaattggcgagaccattgttattagcagcgttatctaaagataatgaagttgttaaaatagatttatatacttcagtgcctaacaaacaaaatatacaagatgttaaagaaatgatagaacatcaacaaatcgatgcattaacattttcaagttcgtcggcagtacgttattattttaatgaaggatttgtaccaaaattcaagtcgtattttgctattggagaacaaacagcacggaccattaaatcatatcaacaaccagtaacaattgcagaaattcaaacactcgaatcactaattgaaaagattttagaaagtaggggctaaaaatgaaatttgatagacatagaagattgagatcatcagcgacaatgagagatatggttagagagaatcatgtaagaaaagaagatttaatatatccaatttttgtagttgaaaaagacgatgtgaaaaaagaaattaagtcattgccaggtgtataccaaatcagtttgaatttacttgaaagtgaattaaaagaagcttatgacttaggcatacgtgccattatgtttttcggtgttccaaactcaaaagatgatataggtactggtgcatacattcacgatggtgttattcaacaggcaacacgtattgctaaaaaaatgtatgatgacttattaattgttgcagacacttgtttatgtgaatatactgatcatggtcattgtggcgtgattgatgaccatacacatgacgttgacaatgataaatcattgccactacttgttaaaacagcaatttctcaagtggaagctggtgctgatattattgcgccaagtaatatgatggatggttttgttgctgaaattcgtcgtggattagatgaagccggctattacaatattcctataatgagttatggtgtcaagtatgcatcaagtttctttggaccttttagagatgcagcagattcagcgccatcatttggggatagaaaaacgtatcagatggaccctgctaaccgtttggaagcacttcgtgaattagaaagtgatcttaaagaagggtgcgacatgatgattgttaaacctgctctaagttatttagatatagttcgagatgttaaaaatcatacgaatgttccagttgttgcatataatgtgagtggagaatatagtatgactaaagcagcggcacaaaatggttggatagatgaagaacgtgtcgttatggaacaaatggtttcaatgaaacgtgcaggtgctgatatgattattacgtattttgcaaaggacatttgtcgctatttagataaataaggttttatatttatgattttccataaactgtaggaggaatttactttatgagatatacgaaatcagaagaagcaatgaaggttgctgaaactttaatgcctggtggtgtaaatagtccagtacgcgcatttaaatcagtagatacaccagcaatttttatggatcacggtaaaggttcaaaaatttatgatatcgatggtaacgagtatatcgactatgtactaagttggggaccacttattttaggacatagagaccctcaagttattagtcatttacatgaagcaattgataaaggtacaagttttggtgcatcaacattacttgaaaataaattggcgcagctcgttattgaccgagtaccttcaatagaaaaagtgcgtatggtgtcatctggtacagaagctacattggatactttaagattagcacgtggttatactggcagaaataaaattgtgaaatttgaaggttgctatcatggtcatagtgattcgttattaatcaaagctggttctggggtggcaacattaggattgccggattctcctggtgtgcctgaaggtattgctaaaaatacaattacagttccatacaatgatttagatgcacttaaaatcgctttcgaaaaatttggaaacgatattgctggtgtaatcgtagaacctgttgctggtaatatgggtgtcgtaccgccgattgaaggttttttacagggattaagagatattacgactgaatacggcgcattgctaattttcgatgaagtaatgactggtttcagagtcggttatcattgtgcacaaggttactttggtgtgacaccagatttaacttgcttaggaaaagttatcggtggaggactacctgtaggtgcatttggtggtaaaaaagaaatcatggatcatatagcaccattaggaaatatttatcaagcgggtacgttatcaggaaatcctcttgcaatgacaagtggttatgaaacgttaagccaattaacgccagagacatatgagtattttaatatgttaggcgatatacttgaagacggtttaaaacgtgtatttgctaaacacaatgtaccaataactgtaaatagagcaggttcaatgattggttatttcttaaatgaaggacctgtaactaattttgaacaagcgaataaaagtgatttgaaattatttgcagaaatgtatcgagaaatggcaaaagaaggtgtgtttttaccaccatctcaatttgaaggtacattcttatctacggcacacacgaaagaagatattgaaaaaacgattcaagcatttgatacggctttaagtcgtattgtaaaataaatatacggacaaattgagagcctgaactttgttcaggctcnttttaaatgtatataaggcatgggcggcgacttgatagtgaaagtccactacta

SEQ ID NO: 283 - DNA, 1421 bp; double-stranded, linear
aattatgaatgcattaccagtattattacaaaagaacaattaaaaatgtttgtttatgattatgatacgcatctcattaaaaatgtaatggttgcagcagacgtgttaaaggcaaatgatattcaaggacatgaaccattaatcgttaaccttcaaacgattgatgaaacattacatcgtttacctatgcataatagaaaagacatgatggttaatggcggtgtacttatggcacatttaaatgccaaaagtggtccgtggttaaaagatgtgctaagacaaattgagatagcgattgtaacaggtaaagtaagcaacgaagaaactgaaattttgaaatgggtggataatcatgtcaaaatatagtcaagatgtacttcaattactctataaaaataaaccgaattatatatctggacaaagcattgcggaatcacttaatatttcacgcactgcagtaaaaaaagtgattgaccaattaaagttagagggatgtaaaatagattcagtaaatcataaagggcatttattacaacagctcccagatatttggtatcaaggtataatagaccaatatacaaaaagttctgctttgtttgattttagtgaagtatacgattcaatagattctacacaacttgctgcgaaaaagtcacttgttggaaatcaatcttcattttttatcttgagtgatgaacaaacgaaaggtcgtgggcgatttaatagacattggagttcttcaaaagggcaaggactttggatgtctgtcgtgttaagacctaacgttgcattctcaatgatatctaaatttaatttatttattgcattagggataagagatgcgattcaacattttagtcaagatgaagtcaaagtgaaatggccgaatgatatatttattgataatggtaaagtgtgtggtttcttaactgaaatggttgctaataatgatggtatagaagcaataatatgtggtataggtattaatttgacgcaacaactagaaaactttgatgaaagtattagacatagagcaacaagtatacaattacatgataaaaataaattagatagatatcaatttttagagatattacttcaagaaattgaaaaaagatataatcaatttttaacgttacctttttctgaaattcgtgaagaatatactgcagcttctaatatttggaatagaacgttgctatttacagaaaatgataaacagtttaaaggacaagcaattgatttagattacgatggctatctaattgttagagatgaagcgggtgaatcacaccgtttaattagtgcagatatagatttttaacactaaagcaaggagagatagctatgggtatggcaacctatgccgttgtggatttggnaacaacaggcaaccaattagattttgacgatatcattca

SEQ ID NO: 284 - DNA, 2202 bp; double-stranded, linear
ccaagttgcctaaaatgattaagcaaggtttataccctatgcnaacgattgaacaagaatctggagccatccgactgccaacgatttctagagtgangcgttcattacaatggggtaatgatgcttatacaatgattttagatcgtatgaatattgaaacaaatgaataataaatgaacgataaacaatggttatctatctgcactaataaggtagataatcattgttttttcacgaaaaaatttacagagtaaaagaacttaaatttcatattaagtctttagaactcgacacttaaaaatgctataatcatatgtatgttaaaaaaggagtttcggaaaatgtatgacattaaaaaatggcgccatatttttaaattagacccagctaaacatatttcagatgatgatttagatgcgatttgtatgtctcaaacagatgcaattatgattggtggaactgatgacgttactgaagataatgtcattcatttaatgagcagagtaagaagatacccattgcctttagtacttgaaatatcaaacatcgaaagtgtaatgcctggttttgatttttattttgtacctacagtactgaacagtacagatgttgtatttcacaatggtacattattagaagcgcttaaaacatatggacatagtatagattttgaggaagtaatatttgaagggtatgtcgtgtgcaatgctgatagcaaagtggcaaaacataccaaagcaaatacagatttaacaacagaagatttagaagcatatgcccaaatggtcaatcatatgtatcgattaccggttatgtatatagagtatagtggcatttatggcgacgtatcaaaggttcaagctgtctcagaacatctaacagaaacgcaacttttttatggtggcggtatttcctcagaacaacaagcgacagagatggcagctattgcagatacaattatcgtcggtgatattatttataaagatattaaaaaagctttaaaaacagtaaaaataaaggagtctagtaaatgaatgcgttattaaatcatatgaatacagagcaaagtgaagctgtaaagacaacagaaggaccattgttaattatggcaggtgctggttcagggaagacacgtgttttaacacatagaattgcttatttattagacgaaaaagatgtctcaccatacaatgttttggctattacttttacaaataaagctgcaagagaaatgaaagaacgtgttcaaaaattagtaggtgatcaagcagaagttatttggatgtcaacattccactcaatgtgtgttcgtattttacgtcgtgatgcagatcgaattggtatagaacgcaattttacgataattgatcctacagaccaaaaatctgttattaaagacgtcttaaaaaatgaaaatattgatagtaaaaagtttgaacctcgtatgtttatcggtgcgatcagtaatttgaaaaatgaacttaaaacacctgcagatgctcaaaaagaagccacagattatcactcgcaawtggtagcaacggtttatagtggatatcaacgccaattgtcacgtaatgaagcgttagattttgatgaccttattatgacaacgattaacttatttgagcgtgtaccagaagttctagaatattatcagaacaaattccaatatattcatgtagatgagtatcaagatactaataaagcacaatacacattagttaaattattagcaagtaagtttaaaaacttatgtgttgtaggtgactcagatcagtcaatttatggttggcgtggtgctgatattcaaaatatcttatcatttgaaaaagactatccagaagcgaatacaatctttttagagcaaaattatcgttcgacgaaaacgattttaaatgcggctaacgaagtgrttaaaaataattctgaacgtaagccaaaaggactgtggactgcaaatacgaatggtgagaaaattcattactatgaagcaatgacggaactgatgaagcggaatttgtaatacgagaaattatgaagcatcaacgtaatggtaagaaatatcaagatatggcaattttatatagaacgaatgcacaatcacgtgtacttgaggaaacattcatgaaatctaatatgccatacacaatggttggtggccaaaagttctatgaccgtaaagnaatccaaagatttatt

SEQ ID NO: 285 - DNA, 785 bp; double-stranded, linear
agtggtgcaaagataggcattgataataccgctaagccagcaagatgatggcacgataaaacctaaacagaagaamataaatagtaatacgatgataaataatggtccactcatatgttgaactaaagatgatgaaaagtgtaagattgtatctgaaatcataccttcattcaacactaaattaatacctcgagctaaaccaataattaaagatacacctactaaacttgatgcaccattgacaaatgcatctacagttcctttttctcccaatccagatttacctgtcccagcaataaacattattataattgtaaatattaaaaatgctgaagccataactgggaaccaccaaccttgcgtcataactccccataccataattggaaatggtagtacaaataatgtaaggattatcttcttacgcaaagtaaaatgggcactatcgtcatcttttaatacagaccattgctgttcaaaagcatctttgtcttcataagaatatgacgctttaggatcgtttttaatttttttacagtaccaatataaataactaataacaaaaatcgcaccgacaatacaagcacctattctccaatacaagccatccgtaaaagttgtaccagcggcattagaggcaattacaaccgagaacgggttaatagttgaaaatgtactaccgacagagctggcaaggaatatggcaccaactggaaacgatagaatcgtatcctaacgctaataaatatagggactaaaatcggataaaatgctacagcttcttc

SEQ ID NO: 286 - DNA, 812 bp; double-stranded, linear
ctaacgngataaggttgcaantttatctgaacatctgatgactgtaattttgttaatgataaaatatttgtcactaatagatataaatactgactttcttgaaaactatgtacaagtaattgttccttttctatgatagacatatctttactatgtgatactaaaatatctaaatktcccataattgttgttaacggtgtacgtatgtcatgcgaaattgatcttaaaaaatttgaatgtgtcagttgacgttcagcctgtaacatggattctctcgtttgtttaagtaacgtcacattttcaacggcgagagaaagttcatttaacattgattctaatattgatgcatcatatggattaatcacttgagaactttggtaatcaatggctagaatgcctttaatcggagatgtgccaattggtatcaaccatttattaatgcctggaaatgtatctgttgttgcaccagcttgtctttcatttttaattacccagcttaatgcttgttcatgctgttgagtcgtattatcgatatggttttgcaatggtattgttttaattactttcgattgattgataacgtatatagtaattgattgttgcaataattgattaatttggtatccagcatttattagtaagttttcaactgtataagtttgtttaatcgaatcattaaattgaaataataaatctgtacgataaagttgctttttagtaatggagtawtggaatttaatttgtnttaataaagcactcgttaaaatacttgtnaaaatgctaacgataaatgtaataggatagtcaaagcg

SEQ ID NO: 287 - DNA, 1732 bp; double-stranded, linear
atnnattattattactgctattttaaattttaaaaaatgcttttgattatattcaacantttgtataaaattaaatttgcttttgattaaagcatgaaaattgtaatcaaaccataaattgtcgtatgatgtagttagaattttaaaatgcaggaggtcaagtatatgactgaaataacattcaaaggtggaccaatccacttaaaaggtcaacaaattaatgaaggtgattttgcacctgattttacagtgttagataatgacttaaatcaagtaacattagcagattatgctggtaaaaagaaattaattagtgtggtaccatcaattgatacaggtgtttgtgatcagcagactcgcaaattcaactctgatgcttctaaagaagaggggattgtgcttacaatttcagcagacttaccattcgcacaaaaaagatggtgcgcttcagcaggtttagacaatgtcattacattaagtgaccaccgtgacttatcatttggtgaaaactatggcgttgttatggaagaacttcgcttattagctcgtgcagtatttgtattagatgcagataataaagttgtttataaagaaatcgttagtgaaggtactgatttcccagattttgatgctgctttagctgcatacaaaaatatttaatcattaaagagataaatcttaaaatgtatacatcgtgtccatcgttgtcaacagcattaaaatagaattgttttctatgattgctaagacctatgggcactttttattggagagggacgaatatggcagaacaacaaacaattatggaacgcttgtttcatacattagatgaaaaagctaaaacattaaataatgaaaatggccaaagttttattgaaaatcttgggctagcaatggaacaagtatataccaatgaaagaggattgttagaacaatcgacgttacaagatcgacgtaaagcattccaatttgcatatttaagtttaatgcaggaagaaaagatacaagcaaatcatcaaattacaccagattcaattggattgatactaggatttttagttgagcgttttatgaacaaccaagaagaattacatattgttgatattgcaagtggtgccggtcatttaagtgctactgtaaaagaagtgttacctgraattgcggttatgcatcatttaattgaagttgatccagttttatcacgtgttagtgtacatttagcaaacttcttagaaattcctttcgatgtgtatcctcaagatgccatcatgccactaccattagaagaagcagatatcgttattggtgattttccagtaggctattatccaattgatgaaagaagtaaggagtttaagctaggttttgaagaaggacatagttattcacattatttattaatagaacaagcaataaatgcattaaaagatgctggatatgcctttctagtggtaccaagtaatatttttacaggtgaacatgtaaaacagcttgaaaaatatattgcaacagagacagagatgcaagcatttttaaatttaccaccaactttatttaaaaatgaaaaagcgcgaaaatctatattaattttacaaaagaaaaaatcgggtgaaacaaagccagttgaagtattattggcaaatattcctgatttccaaaattccttcaccaatttccaaggatttatggacagagttaaaatccagtgggatgggaccaccaaatcgtccta

SEQ ID NO: 288 - DNA, 2779 bp; double-stranded, linear
aaaagaactagctaaacgcaagcaagaagctattagtagaattaaagacttttcaaatgaaaaaataaatagtattcgaaatagtgaaattggcacagctgatgaaaaacaagcagcaatgaatcaaattaacgaaattgtgcttgaaacaattagagatattaataatgcgcatacattacagcaagttgaggctgcattgaacaatggtattgctcgaatttcagcagtacaaattgtaacatctgatcgtgctaaacaatcgtcaagtactggaaatgaatctaatagccatttaacaattggttatggaactgcaaatcatccatttaacagttcgactattggacataaaaagaaacttgatgaagatgatgacattgatccacttcatatgcgtcactttagtaataatttcggtaatgttattaaaaacgctattggtgtggtgggtatctctggtttactagctagtttctggttcttcattgccaaacgtcgtcgtaaagaagatgaagaggaagaattagaaataagagataataataaagattcaataaaagagactttagacgatacaaaacatttaccacttttatttgcgaaacgtcgcagaaaagaagatgaagaagatgttactgttgaagaaaaagattcgctaaataatggcgagtcactcgataaagttaaacatacgccgttcttcttaccaaaacgtcgtcgtaaagaagatgaagaagatgtggaagttacaaatgaaaacacagatgaaaaagtgttgaaagataacgaacattcaccactcttattcgcaaaacgacgcaaagataaagaggaagatgttgaaacaacaactagtattgaatctaaagatgaggacgttcctttattattggctaaaaagaaaaatcaaaaagataaccaatccaaagacaaaaagtcagcatcaaaaaatacttctaaaaaggtagcagctaaaaagaagaaaaagaaagctaagaaaaataaaaaataatttgtttctttgataaatagaggagcaccgattgacatcacatcagtcggtgctccttttatttattctttttaattaatttatacaatgcctgttgagcgtgttgattcgcttctttgttttgttctctcggtatccatttaacaaataataaatcaaaatctttttcaaatatttctatttgatcaaaataaggtttgaaatttgcgtttttcacataaccagcttcaatgctatctgcaattagctttgagtctgtatataatagtgcgttttgaacatttaattcacgtgcatgttctagtgcataaatacatgcagcccattctgcagtgtggttatccatttcgcctaactcatgtgtatatgtataatgctgctcatcttctttgattacaatggcacatgtacttatgcctggatttcctttcgtcgcagcatcaaaatttattttcgccataataaacctactttctattcaatacttagttaaagttactattactgtaatacaaaatatgttgggtaatccattaaaaaacacgcatcacttaaataagtaacacgtgtttaaaatactcgctgattcaaagatgattttctaatacgtatactgtaatatacttcctaaaaaaatcatcttcaggctgggacataaatcaatgttctatgctctacgatgttatattggcagtagttgactgaacgaaaatgcgcttgtaacaagcttttttcaattctagtcaggggccccaacacagagaatttcgaaaagaaattctacaggcaatgcgagttggggtgtgggtcccaacacagaagatgacgaaaagtcagcttacaataatgtgcaagtttgggatgggccccaacaaagagaaattggattcccaatttctacagacaatgcaagttggggtgggacgacgaaataaattttgcgaaaatattatttctgtcccactcccttaaaacttattcttttgtgtagtaagtgcgttaatagccttgatctaacttatcaatcttacctttacgataaaatgatttagcaatatatccaaatggtacattgaaaactgttgaagctaattttaatacgtacgttgtaataaatatttcaaatacaamtgtaccaggtaaacttccgataaatgcgatagctacaaataaagctgtatcaattattgrgcttaaaaatgtactaccatatggcacggatgaaaaacgttttatcmgaactaaatacttttttaattagtgaaaagataaatacatcaatatgttgaccaataatatatgcgacgattgagcctaaagcaatgcgtggcacaacatcaaagattgcgtgtaatgctttttgtgccatatcttctggtgcaggaataaaatgtaatgacaattgcataacaataatcataattaatgttgatgaaaagcctaaccaaactgctctttttgcaactctacgcccataaatatcgtttaatatatctgttgctaaataaatagaagcaaacatgacattacctaaagttgctgaaataccaaagatttctacagttttaatcacttgtatgttggcaatgattgtgccaattgcaacccatgcaattaaaccttgtttaccaaaaaagcgatacataagtaccataagcacgaacgttgcaataaacgtaactagtcctaaaatttcattatacatattaaaatgtcctcctaaattttgatcatgcgggtgtttagaaaccgctcaataaataa

SEQ ID NO: 289 - DNA, 1999 bp; double-stranded, linear
actgatgtgcgttcatcaaaaacaatataatcaaattcattttcatcaaattgcttaaaattatcatctctagataatgtttgaatggttgcaaataaatatttggcatcgacatctctatgttttcctgtcaacaatccaaaatcactatcattttttataggtaatacttttttaaattcttccttagctctatttaaaatcccctcattatgaacaataaataaaaatttattagggtttacttctctaacatctaatgcacataaaatcgttttacctgtaccagttgcagatattattaacgccttatctttggctttatccctaatagcttttaatgaccttaatgcttctgcttgcattaaattgggtacaatttccactgattttttcaccttatcagctagcagcatttgagtttgttcaacctccgctaatttttctaaggaacggtactcaaatgattctttatatgaattaatccattgctcagtcagtggggtactcttttgccataacaagtcaaattcactttttacactatcaactaaatcgccatttttcatagtagacagtaaaacattatgctcataattaacctttaacgcattagatgttaaattagagcttcctattaccatagaactataatccttatgctcaaaaatatatcctttggcatggaatccagcaatatcagttaatcttacctctacattttttaatttaagtaattctccatacattttaggactattaaaccctaagtaattagatgttaatattttccctttaacacccttattgcttaaatctaatagttgagcctttaagctggctaaaccgctttctgttataaaagccacagaaaaataaaacgtttcacatttttgaagttcatctataattgttgaaagaactttttcatttttattatttactaaaagcttcggtgtataattccctttatgagaaatatgtttgtctataaaccctttatgtaaagattgattgaaatcatttagtaatctactcatattatccctcagtcataattttattaacggctggtatatccgctggggcccaatttaatttatcaagttcgtttattgacaaccattcaatactcttatgttcagttagagttggtaactctttgtttaaagtacatttgtatgttgttaacctaacaattccaaaatcatattcatgttctgtagttataactttgtctccaacaattaaatcacatttcatttcttctctaatttctctaatcaaagcgtctttttcagtttcattcttttcaaccttacngccaggaaattcccacattaaaggcagactcattttttcacttctctgtgcacaaagaattttgttatcagaaaaaataatagctcctactacattgattacttttttcataagactcacccttcaatttaaaatcatcttaattgttattctatcaaaaattacaaaactatatataaatcaatattaaaaattaatattttacattcacatgaacgctctactccatgcattttcatacacatctattatataatacttgtgaaaagtattgtcttggggctgtgtttttttacttttggggcgtatttctttataattcattacataaatgtaagggctttagttttcatgttttattaagtctaactgagattttgaaaggatgtttagcaacaatggataaagaattatggatagaacgagctaatgatagtttagttaaacatttttatgagcagcaatctgacattgaacagcgagaaggttttgaaagtaaattaacatttggtactgcgggtatacgcggaaaattcggtcttggtgaaggtcgacttaataagtttactattgaaaaattggcattaggtttagcgcgttatttaaatgcccaaacaaacagtccaacaatagtcattcattatgatattagacatctttccaactgaattcgccc

SEQ ID NO: 290 - DNA, 1933 bp; double-stranded, linear
gatgacttttccccctcataatcttcatggtccaggcgtccattaatgcgtcaaaggatggcacattttacctggaacaaatgattcatatggttcataaaaatcacgcgtcgtaatataatcttctaaatcaaatgcatagaaaatcattggctttttaaatactgcatattcatatattaaagatgaatagtcactaattaataaatctgttatgaacagtatatcattaacttctctaaagtcagaaacgtcaacaaaatattgtttatgtttgtctgcaatattaagtctatttttcacaaatggatgcattttaaataatacaaccgcgttatttttttcgcaatatcttgctaaacgttcaaaatcaattttgaaaaatgggtaatgtgctgtaccatgaccactacctctaaatgttggtgcgaaaagaatgactttcttacctttaataattggtaattcatcttccatctcttgtttgatctgtgtcgcataagcttcatcaaatagtacatcagtacgtggaacacctgtaggcactacatttttctctttaataccaaatgcttcagcgtagaatggaatatcggtttcagatgatacataagcttttgtatagctacgatgatttaatgaatcaataaatggtccaccctttttaccagtacgactaaagccaactgttttaaaggcaccaacggcatgccatacttgaataacttcttgagaacgtctaaaacgcactgtataaatcaatgggtgaaagtcatcaacaaagatgtagtctgccttcccaagtaaatatggcaatctaaacttgtcgatgatgccacgtctatctgtaatattcgctttaaaaacagtgtgaatatcatactttttatctaaattttgacgtaacatttcgttatagatgtattcaaagtttccagacatcgttggtctagagtctgatgtgaacaacaccgtattcccttttttcaagtggaaaaatttcgtcgtattaaatatcgctttaaaaataaattgtcttgtattaaatgattgtttgcggaaatacttacgtaattctttatatttacgaacgatataaatacttttaacttccggagtcgttacaacaacatcaaggacaaattcattaacatcgctagaaatttcaggtgtaacagtataaaccgttttcttcgaaatgccgccttttctaaattcttttaggtaagtctgcaataagaaattgattttaccattttgtgtttctaattcgttgtattcttcttcttgttctggctttagattttgatatgcatcattaatcacatctgggtttaactgtgcaatataatcaagttcttgctcattcactaataagtacttatcttcaggtaagtaataaccattatctaagatagctacattgaaacgacaaacgaattgattcccatctattttgacatcattcgccttcattgtacgtgtctcagttaaatttcttaatacaaaattactatcttctaaatctaggttttcactatgtccttcaacgaataactgaacacgttcccaatagattttatctatatatatcttacttttaaccaacgttaattcatccttttctatttacataatccattttaatactgttttaccccaagatgtagacaggtctgcttcaaaagcttctgtaagatcattaattgttgcaatttcaaattcttgaccttttaacaacgctaatttanctacaatatctgggtattgaatgtataagtctacaacatcttggaaatcttttgaaccacttcgactactaccaatcaacgttagtcctttttccaatactagacgtgtattaacttctactgggaactcacttacacctaacagtncaatgcttccttctggtgaaatgtaatcgatcatt

SEQ ID NO: 291 - DNA, 2049 bp; double-stranded, linear
ngtncggncagatatattggtggtctttagtaagtgtatcaaattcatcagatgtcaagggcatgttatcacctccttaggttgataacaacattatacacgaaaggagcataaacaaatgaacacaagatcagaaggattgcgtataggcgtcccacaagtttctagcaaagctgatgcttcttcatcctatttaacggaaaaggaacgtaacttaggagcggaaatattagaacttattaaaaaaagtgattacagctacttagaaataaacaaagttttctatgcattagatagagaacttcaatacagggcgaataataacaaactttaacatttatctaaaggagtgatagagatgccaaaaatcataataccaccaacaccagaaaacacatatcgaggcgaagaaaaatttgtgaaaaagttatacgcaacacctacacaaatccatcaattgtttggagtatgtagaagtacagtatacaactggttgaaatattaccgtgaagataatttaggtgtagaaaatttatacattgattattcagcaacgggaacattgattaatatttctaaattagaagagtatttgatcagaaagcataaaaaatggtattaggaggattatcaaatgagcgacacatataaaagctacctattagcagtgttgtgcttcacggtcttagcgattgtactcatgccattgctgtacttcactacagcatggtcaattgcaggattcgcaagtatagtgacattcatattttataaggaatacttttatgaagaataaaaaaactgctacttgttggagcaagtaacagtgcaagatgagcaattgtcttaaataattatataaggagttattaatatgaccttacaacaaaaaatactatcacattttgcaacatatgacaatttcaattctgatgatgttgttgaaacttttgggatatctaaaacacatgcaaaatccacactttcaaaacttaagaaaaaaggaaagattgcaatggaaagttggggtgtctggcgtgttattgaatcgcaattgcatttaagtgtagtcgaacgtaaaaaagaaattttagaagaacaatttgaattgttagcaagattaaatgaacaaagtgatgaccctagagaaatagaagaacgtatcaagttaatgattcgtctagctaaccaattttaaggaggagttaatcaatggcagtattagaaggtatttttgaagaattaaaactattaaataagaacttacgtgtgttaaacactgaactatcaactgtagattcatcaattgtacaagagaaagttaaagaagcaccaatgccaaaagaagaaacagctcaactggaatcaattgaagaagttaaggaaacttctgctgatttgactaaagattatgttttatcagtaggaaaagagttccttaaaaaagcagacacttctgataagaaagaatttagaaataaacttaacgaacttggtgcggataagctatctactatcaaagaagagcattatgaaaaaattgttgattttatgaatgcgagaataaatgcatgaagctagatcactcaaatagagctcatgcaaagcttagtgcaagtggagcaaaacaatggctaaactgtccaccgagtattaaggcaagtgaaggtattgcagataaaagttcagtttttgctgaagaaggtacattcgctcatgagttaagtgagttatatttcagtcttaaatatgaaggcctaacacagtttgagtttaataaagcttttcaaaattataagcgaaatcaatattacagtgaagagttgcgcgaatatgttgaagagtacgtagctaatgtagaagaaaagtataacgaggctttgagtagagatgacgatgtaatagctttatttgaaacaaaattggatytaggtaaatacgtccctgaatcttttggtaytggtgatgtcattatattttcaggtggtgtacttgaaattattgaccttaaatacggtaaaggcattgaagtttcagctatagataatc

SEQ ID NO: 292 - DNA, 942 bp; double-stranded, linear
atgatgtttctatattcgtattaggaaaacctgttggtattacaacaaacgccctaaaattacaataccgctgctcctataccaattgcaacaacagttttaactgaaatatcttgttttttcatcttcattactcctttacataaaaaattcattatattgatggtgctttagataaatgaatcgtccaatcatttccagtaccaatatgatataaatctgaaaatgagtcttgattgactgctacaccaatatttactagcgagttaacatacacaagaggttcacccacattaacatctgcaaacgatcgcgcaaatttaataatattttgatagactttcttatcttgatgataaattgttaccaccaaattattaccatgaacaatttccaaggattttaagaatgccaatggaatatttgtccataatgacccaaatctgatatctaaaatatcaatgcttcctgtaacagaatcctcattttttgtcacttctcttatttctaatgcctcaatactatcaacattaattgcctgaccgagacgttcaaacgctatcttatttgcagctaatctcgcaccattgtatgcataaacatctctaccatgaaaagtatgactttcttccgaatgaggcaatcggcttttcacttcatcaatttcgataacttttttaataccttcgtaatgtttaatatgacttaaagaaccattatcaggtgtaataatgtaatgacctgaatatgttaagcaagcaatgtccgcctatcactacctacacccgggtctaccactgatacaaaractgtgcctttaggccagtattttacagtttgatataaacgatatgacgctacccaaatgtcatacggtggtatatcatgcgttaagttttcaacacgtatatcatcattacagtatatgcaactccatacatt

SEQ ID NO: 293 - DNA, 1268 bp; double-stranded, linear
tgtaataaaattttatgnaacatgctgngatgctaccatgaaccttcttcatttctttatgtgagattgtgaaattaatcaaataataatacggtggatactttcctaatttacgatattccatttcctgacgataaaatgttaaataatcatttttttgaacatccaatattgaataatgatctggattatacgtttgaatgatgacttgacctgccttttcatgacgaccagctctaccagccacttgcgttaatagttgataagtacgttcgctcgcccgaaaatcaggtaaatttaacattgtatctgcattcagcacaccaactaaagtaatatttggataatctaatcctttcgcaatcatctgagtacctagtaaaatgtcaccgttacctttttcgaattcagtcaataacttttcatgtgcacctttctttgaggttgtatctacatccatcctaattatgcgcgcatcttcaaattcttgttgcaatagttcttcaactttctgagtaccagtacctacttgtcgaatgtgttcactctcacaatttggacattgattcggtggcgtctcttggtaaccacaatagtgacattttaataagtctgtcgttttatgatacgttaatgaaatatcacagtttggacattgcggtacatatccacaatcccgacataacataaacgatgcataaccacgtcgatttaaaaataaaacaacttgttcctgtcgatctaatcttaattgtatggcttcacgtaaatcttttgaaaacattgaccgattaccttcactcaattcttcacgcatgtctactatatcaatttcaggtaaagcttgttggttcactctgtttggtaatgatagcaaatgataaacgcctttttcagctcgtgcataactttcaagacatggtgttgcacttcctaaaatgactggacagtgatgatattcacttcgccattgggcaatttctctagcgtgatatctcggataatcttcttgtttatatgtagattcatgttcttcatcaatgatgattaaccctaaatttttgaaaggtgcgaacacacttgaccttgcaccaacacttactctcgcacgaccatccctaattttttgccattcatcataacgttccccattagataagccagaatgtaatacagcaacgtcatcaccaaatcgacgtttgaagcgtaaaaccatttgcggtgttagagcgatttcaggaactaacatcatcgcctgttttccttgg

SEQ ID NO: 294 - DNA, 629 bp; double-stranded, linear
taccaccaaataatatattagctggcattttaataacatttanatttgtcatgatatcatcaataaaatgttgaaacttcgtaatttcaccttcataatcatcaattgctgctaattgcgcactcgatgcttgctgatctaaatttaaaatattcgacatgcgttgactataataaactaaatgttctattaagccatcgtcactcttttcctttggtgctgacatgacagcgatacgtttcaaaggatagtgttgcgccaattttaatgtcattaatccacctaaagacacacccgttgcactgatagattcataaccttcattgactaaaaattggtaagctttctcaacttcttcccaccaatcatctacattatatgtcatgaaatctttcaacaataaaccatgacctggataattcggtgcataacaactaaatccttggtcatttaactcagctgcaagatgcttcacatcccgatttgtacctgtaaatgaatgtaataataatatcgcatgtccatttgtgccttttaaatacgtggactcggtgttttaattctcatttttctatatacctccactatgtctaaagakgttkgctaaacgcgttgtcgtcgatgattaa

SEQ ID NO: 295 - DNA, 2817 bp; double-stranded, linear
tatgaaagtaatgaatggtaatattattaaatttgatggaaaagtagatattgataatgcagataatatcggttttttaattgagcatcctaaattatatgataataaatcaggattgtataacttgaaattatttgcacaagtattaggtaagggttttgataaagcatacacagacaaaattatagatgcatttggtatgagaccttatattaaaaagaaagttaagaaatattcaatggggatgaagcaaaagttagcaattgcagtatctttartgaataaacctaaatttttaatcttggatgagcctacaaatggkatggatccagatggctcaattgatgtgctgactacaattaagtctttagkaaatgaacttgatatgagaattctaatatcaagtcataagttagaagatattgaattaatttgtgatagagctgtatttttaagagacggncattttgttcaagatgtaaacatggaggaaggtgttgcatctgacacaacgatagttactgttgatcataaagactttgatagaactgaaaaatatcttgcagagcatttccaattacaaaatgtcgacaaagcagacggacatttaatgatcaatgcacaaaaaaattatcaagttatactaaaagcattatctgaattagatatttatccgaaatatattgaaacacgtaaaagttcattgcgtgatacgtacttcaatataaatcaaagaggtgataaataatgagaattttaaatttagttaagtatgatttttatagtatatttaaaartcctttaacatatttagcgatactagtcgtatctagtttgattgcaactcaaagtatacttatggcaaattcgatggataacccgaaacatattattgtctatggatctgtatttgctgcagcaaaatggttattgttaataattggattaatgtttgttgttaagacaattacgcgtgatttttcacaaggtacaattcaactatatatgagtaaagttaaaacacgcgttggatacattatttcgaaaacaatttcaattattttaatttcaatattatttgcattaattcattatgtgattttgattgttgtgcaggcatctagtaatggaaaaaatttggcgttttctaaatatgtagataatttatggttcttcctaatctttttactattctttggcttgtttttattcttaatcacacttgcatcacaaaaaacagcaatgatattttcattaggtgtatttttagtactcattgtaccgtttattaaaccttttattacatttatcccaagatacggtgaaaaagttttagatgcttttgattatatcccttttgcttacttaactgataaaatgattagctctaactttgattttagcaattggcaatgggtaatttcattaggttctatagtgatattcttcattttgaatatcttatatgtcgctaaaaaagacatytaataaaaataattttgaggttgggaattttaaattttcccaacctcaaagtttgtcttattgtaaatttatttattttctaatttatttaggatggaattataaactgctttccaaaatgaagcgtcagttttatagcggtttgatataactaagtgtgtttctttttctaaatctgcatagtctggatgatctttgctcggtaatttatcagcacgaacatcagttacaaatttttggacttcatttgctcttggtccccaaactgtttcttgttcgaattgatcattcaagaatacgaagataggaattgcacgtgatttaccatttgttaaatattgatcgatcagttttgtatcatcatctctatggaacacgcgtacttctaaatttaatgcttcactgatgtgttttagaattgggagattcatcattgcatctccacaccagtcttcagtaattactaatactttagaataattcatctcttttatttttttgatgcgtgaatcatcttctggtaactcaaatgattgatagatactgagaacggtatcttgatttgtcttcattccatcaatgtattcatttaagggttggctatttttgaaataagtttctaaatttgtcattgtaaaaacctcctttagcatttacaacattataccaatttatagtaataaaaggtaatgaaataaattaattgcaaattctttgttaatttttgttaaggatgaaacgggaagcaccttatgctatatttaaataagtacaaagaaagggtgacatcagtgcgtattcaaaatcgctgggttgtgtttatattatttttaatctgttcttttggtgtattaattggtttatatcaatatcgtcatacgaaaactgtggatttgtctaatcttgaaataaacgatattaaattaaatgagaagtttgataaaaaaggctatgaagtaaataaaaaaattaagtttgatcgttttaaattttataacagtaaagctcaccctgatcttaccgttaaagtgagagaaaaggataacatcgttaaggggataatattagtaagagatgaaaagatacatactaattttgatgggggaattggttcgccgataaataacgcgattgaaaatcttggattcggatataaaagracaaaagttggcaatgrttkctcatcggtaaagtatattgatagagataaccatttaaaattaaacttactttatcaagatttagaaattaaacgtattgaattttttagtaaatagctttaggtcttaaagttwtaaaaaacgaatgaataattttattgggatgagtgac

SEQ ID NO: 296 - DNA, 1607 bp; double-stranded, linear
tctgttaaaatgatttttcttttanaaaggccgnaaatcaatgttcgattnttatttgcattatggtctcgatattggtagaatatcaaatggttaaatgagaaaaacttggaggtgctcacatgtcatcaatcgtagtagttgggacacaatggggagacgaaggaaaaggaaaaataacggatttcttggcagaacagtcagatgttatcgcgcgtttttcaggtggtaataatgcaggccataccattcaatttggcggagaaacatataaattacatttagtaccatctggtatcttttacaaagacaaattagcggtaatcggtaacggagtcgttgttgatccagttgcactattgaaagaattagacggattaaatgaacgtggcattcctacaagtaatttacgtatatctaatcgtgcgcaagtgattttaccatatcacttagcacaagatgaatatgaagaacgtttacgtggtgacaataagattggtacaactaaaaaaggtatcggtccagcatatgtagacaaagttcaacgtatcggtattcgtatggcagatttacttgaaaaagaaacattcgaaagattattaaaatcaaacattgaatataaacaagcatatttcaaaggtatgtttaacgaaacatgtccatcatttgatgatatctttgaagaatattatgcagcaggtcaacgtctaaaagaatttgtaacagacacatcaaaaatcttagacgatgcatttgtagcagatgaaaaggtacttttcgaaggtgcgcaaggtgtaatgttagatatcgaccatggtacatatccattcgttacatcaagtaatccaattgcaggtaacgttactgttggtacaggtgtaggtcctacattcgtttcaaaggtaattggtgtatgtaaagcttatacatcacgtgttggtgatggtccattccctactgaattattcgatgaagatggacatcatattagagaggttggtcgtgaatacggtacaacaacaggacgtccacgtcgtgtaggttggtttgattcagttgtattacgtcactctcgtcgtgtaagtggtattacagatttatctattaactcaatcgatgttttaacaggcctagacacagtgaaaatctgtacagcttatgaattagacggtaaagaaattactgagtacccagcaaacttagatcaattaaaacgttgtaaaccaatctttgaagagttaccaggttggacagaagacgtaacaaatgtgcgtactttagaagaattacctgaaaatgcacgtaaatatttagagcgtatttcagaattatgtaatgtacaaatttctatcttctcagttggtccagatagagaacaaacaaacctattaaaagaattgtggtagaactttatataagtcatacacaatgattataaatacatgagccttctatctttattggtaggaggcttttgttatgcttgcttctgtatcgattcgattatttagataaaaaatactaacgtaaaggcgatatttgctagtcataatttagaagrttagatgatatttaacgaaaattaagatganatacttgaatggtaa

SEQ ID NO: 297 - DNA, 3055 bp; double-stranded, linear
ttagaagtaagcactttaatatctttacctacccatgtaccaacaccttctttaggctttggattttcagcatggttatttgatttattcacctgttcagatctatttactttattacctttattcgggttctctaatacatcaaattttaatctcggtgaataaaaaagatatattaaaaatccaactaaaaataatacaccgacgactcttataattaactttttcatcaatcaaccacctaaaaagtattaatactattgtaaaaaacaacacattaattagcaaattttcaacactgacataactgtgtcgtttcgataaaacaaaatcatcttcaggcataattttaacgtcataaagattttccctacactctatatcataacctatctttatgttttcaggttgaatttcattattaagattaaaatatgtataaaaaaatggacagttaaggtatcaaatgaataccatcaactgtccgactattcttcatcaaaaaacctgataaaacaaattgccttatcagattagtatcatttgtataagcatattaatgaccaaatgttgctttaatcagtgatgtcgtttctccacctggatataatacatataataataagtaaactgctacacctgtaattgcagtacagaaccatataactgaagcgaatggcccgaatttgcggtgtacattatatttatctttaaatgcagtaataatttgaactaggcctagaataccaccaattgttgctaaattaatgtggaaaaataagaaaatcgtataatatttcttaattgatgctggtccgccaaatgctgtattaccgataaaaatcgttctacttgcatagattaagaaaaaagttaaagcaaaaacagctgcagctaacataacatttttgtgtttatttatttcccttttccaaataagtctccaaccaatggcaattaaaattgcactaatgacaatacatgtcgtactaatcgttggtaaaattggaacgcccatatttttcatcctaacttaattaatctagatcaaagtaagtaatgaaacaatcacagctaacacgaaaaagatcactaaataatttagtgaatatataaacatttgtgttgcccattttgtttgatctgaatttttcttaaatgttgttaaacctaatgcaatccatcctaaatttaataaggtrgctaacactacgaatacgacacctaaatttattagtaataaaggtactggcaataaaataatcaaccagataaacatactgacacgtgtacgtttaaagcccttaactgatggtaacattggaatatttgcaagtgcatattcatctttacgtttaatagctaaggcataaaaatgaattggttgccaacmaaatacaactaaaaacagcgcaatcgctgttaaactaatttgtccttcaattgcaacccatccaattagtggtggtactgctccaggaaaactcccaatcactgtgttccatgttgtatgtcttttagaccatattgagtaataagacacataacctacaatccccataagaccaagtacgcctgatggtatattcaataaaaacaaacaaatttctccaactaacatcataccaaaacttaatagtaataaattttgatctgtaattctattatttacagttggtctattttgtttactaggcataatacgatcaatatcttggtcgtaataattatttaacgcacatgcgccacccataattaaagtagatccaaatagcattaataaaatttgaggtattgatgataagaaggaatgatttgtcattacaactgctagccatgcgcccgcaaaagccggaattaagttaccttgaacaagtcccattttaattatctgttgcaattctttgaagttaactctgctaatattttgtgacmaagtatgctctttgctcataatccccctccttaaatttgttcatataagattatgatatcttagattgcataaaaagactaggtttaataaaattaaattgtgacaaattaacgacaagagaaaatgtcaattttgtgacacaaataacatttaatttattgctataatgtatatgttagaaaattttaataagtagaatcatgcatctaaaagagattaatatttaagcttcaaatttgagtaaacgtggattacataattatcccaataaaaaaatcattacgattaagttctttttatgtcgtccacatacaatacttgtaaaattaaatcatatttcctgcgttggatcccatcttttcatatcctacaatcaggtctatttatagtatcatctcaaatccggctattaattctaattctcagtgatgcgtttttttatgatggggtgtataaattgtttggcaaaaagaatttaaaatggttaggtgtcgtagcaacgttaatgatgacatttgtacaacttggtggagccttagttaccaaaaccggatcagctgatggttgtggttcttcttggccactatgtcatggtgcgttgattccagaattctttcctattgatacgattattgagttaagtcatagagccgtttcagctttgtctttattaatggtcttatggttagttatcactgcatggaaacatataggctatattaaagaaattaaacctttatcaatcattagtgttggattcttattattgcaagcattaatcggagctgctgctgttatttggcaacaaaacgattacgttttagcattgcactttggtatatcattaatcagtttctcatctgtatttttaataacattgattattttctctatagatcaaaaatatgaagctgacgaattatatatcaaaaagccattaagacgtttaacatggttaatggcaatcatcatttattgtggtgtttatactggtgcactagtgagacatgcggatgcaagtttagcatatggtggttggccattgccattaccacgatcttgtaccacattcaggaacaagattgggttcaactcacgcatcgtatcanggtcnnttaa

SEQ ID NO: 298 - DNA, 748 bp; double-stranded, linear
ttcttatttaaagaagtcatttttagaaattgttgagactttaaaaaatgatccgtataaaataacacaatcttttgaaaaattagagcctaaatatttagagcgatattcaagaagaattaaccatcagcacagggtcgtctataccgtagatgatcgaaataaagaagtattaatactatcggcatggtcacattatgattaatgaatattcaatatctgaataactttaatgataagttaattaaagaaactagtatttaagtgtagggaaaatagcgacgttaatgcgttgttatctctacactttttaattttataatagcgcaagactaaacagattgaaattagtaacaataaaagaataacgtattataataaggaattttaaattgtgactttttcggaatattaaattttagaaatatgaggtttttaagcggattcctcacaaaattttaaaaatatttaagcctgaaaatgataaagcggtagggaacgtttttctgaaagttagtgatacaatagttttaagttgaaatacaggaggatgaataacatgaatcagtcagtcaaattacttaaacatttaacagatgtaaacggcattgctggttatgaaatgcaagttaaagaagcaatgcgtaactatatagagcctgtcagtgatcaaattattgaagataacttgggtggcatttttggaaagaaaaatgctgagaatggtcaatactcaattatgganttc

SEQ ID NO: 299 - DNA, 4718 bp; double-stranded, linear
acctccgaataattgattccattaactttttttgtgaaaaatttaaacaggcgaagtcttcaataagtgaagatgtccaaattataaaaaatacattccaaaaagaaaagttaggtacagtaattactacyctggcgcaagtggtggtgttacgtataaaccaatgatgagtaaagaagaggcgactgaagttgttaatgaggtcattactctattagaagagaaagaacgtttgttacctggcggatatttatttttatcagatttggtaggtaatccatcgctactaaacaaagttggtaagttaattgccagtatttacatggaagaaaaattagatgctgttgttaccattgcgacaaaaggtatttcattggcaaatgcggttgctaatattttaaatttaccagtagtagtgattagaaaagacaacaaggtgactgaaggttctacagtttcaattaattacgtttcaggatcttcaagaaaaatagaaacaatggtactttcgaagagaactttagcagaaaattcaaatgttttagttgtcgatgattttatgagggctggtggctctattaatggtgttatgaatttaatgaatgagtttaaagcccatgtaaaaggggtatcagtacttgtagaatcaaaagaagttaaacaaagattgattgaagattatacttccttagtgaaattatctgatgtagatgaatataatcaagagtttaacgtagaacctggcaacagtttatctaagttttcataaaaggagttttagtattatgaaaatcattaacacaacaagattaccggaagcacttggaccatattcgcatgcaacagttgtgaatggtatggtttatacttctggtcagattccattgaatattgatggacatatcgtaagcgctgatgttcaagcacagacaaaacaagttttagaaaatttaaaggttgttttggaagaagcaggatctgatttgaattctgttgcgaaagcgaccattttcattaaagatatgaatgatttccaaaaaataaatgaagtgtatggtcaatattttaatgaacacaagccagcgcgtagttgtgtagaggttgcgcgtttgccaaaagatgtgaaagtagaaattgaattagtaagtaaaattaaggaattataattttcgattaatatgtttaatcaagcttctaaataaaacagagagatatatactataggggggctcactacatgaaagtgacagatgtaagacttagaaaaatacaaacagatggacgaatgaaagcactcgtttccattacattagatgaagctttcgtaattcatgatttacgtgtaattgaaggaaactctggcttgttcgttgcaatgccaagtaaacgtacaccagatggtgaattccgcgacatcgcgcatcctattaattcagatatgagacaagaaattcaagatgcagtgatgaaagtatatgatgaaacagatgaagtagtaccagataaaaacgctacatcagaagattcagaagaagcttaatcaattttatatttagcgatgtaatacatttgcaataagttgatttgatactgtcgataaagcataaagctttgtcggcagtttttttagtttgtattaatgtttttttatttttaatgaaaggctaataaatatatacgttaacagattatgatgatatgaaaattattgattcattgctgataaaaattgcgtttgaatgatgctcgtatttttgaagtaagaaaaaagttgtttttaaaattacaacgaattaaaaacaatgccttttatatgttgaaagagtattgcagattaaattataataatgacgaaggtaaaatttaatgggggttaatgttcatgcgaagacacgcgataattttggcagcaggtaaaggcacaagaatgaaatctaaaaagtataaagtgctacacgaggttgctgggaaacctatggtcgaacatgtattggaaagtgtgaaaggctctggtgtcgatcaagttgtaaccatcgtaggacatggtgctgaaagtgtaaaaggacatttaggcgagcgttctttatacagttttcaagaggaacaactcggtactgcgcatgcatgcaaatggcgaaatcacacttagaagacaaggaaggtacgacaatcgttgtatgtggtgacacaccgctcatcacaaaggaaacattagtaacattgattgcgcatcacgaggatgctaatgctcaagcaactgtattatctgcatcgattcaacaaccatatggatacggaagaatcgttcgaaatgcgtcaggtcgtttagaacgcatagttgaagagaaagatgcaacgcaagctgaaaaggatattaatgaaattagttcaggtatttttgcgtttaataataaaacgttgtttgaaaaattaacacaagtgaaaaatgataatgcgcaaggtgaatattacctccctgatgtattgtcgttaattttaaatgatggcggcatcgtagaagtctatcgtaccaatgatgttgaagaaatcatgggtgtaaatgatcgtgtaatgcttagtcaggctgagaaggcgatgcaacgtcgtacgaatcattatcacatgctaaatggtgtgacaatcatcgatcctgacagcacttatattggtccagacgttacaattggtagtgatacagtcattgaaccaggcgtacgaattaatggtcgtacagaaattggcgaagatgttgttattggtcagtactctgaaattaacaatagtacgattgaaaatggtgcatgtattcaacagtctgttgttaatgatgctagcgtaggagcgaatactaaggtcggaccgtttgcgcaattgagaccaggcgcgcaattaggtgcagatgttaaggttggaaattttgtagaaattaaaaaagcagatcttaaagatggtgccaaggtttcacatttaagttatattggcgatgctgtaattggcgaacgtactaatattggttgcggaacgattacagttaactatgatggtgaaaataaatttaaaactatcgtcggcaaagattcatttgtaggttgcaatgttaatttagtagcacctgtaacaattggtgatgatgtattggtggcagctggttccacaatcacagatgacgtaccaaatgacagtttagctgtggcaagagcaagacaaacaacaaaagaaggatataggaaataatcatttacgtatttaaaatggctaggataaaaggataatcctatgtaatattaatgtaatctttatgatttaatgattcgcatagtaatggagttacatyttatatataatagtaattgcgtaagtaaataattggaggactataaatgttaaataatgaatataagaattcgtcattaaagattttttcattgaaaggaaacgaagcattagcgcaagaagttgctgaccaagtaggaattgaactaggtaaatgttcagttaaacgttttagtgatggagaaattcaaattaatatcgaagagagtattcgtggttgtgacgtatttattattcaaccaacatcatatcctgtgaatctacatttaatggaattattaattatgattgatgcttgtaaacgtgcttctgcagcaacaatcaatattgtagtgccatattatggatatgcaagacaagatagaaaagcccgtagccgtgagccaatcactgctaaattagttgcaaacttaatcgaaacagctggcgcaactcgtatgattgcgttagacttacatgcaccacaaattcaaggattctttgatattccaattgaccacttaatgggtgtgccaattcttgctaaacatttcaaagatgatccgaatattaacccagaagaatgtgtcgttgttcaccagaccatggcggsnttacacgtgcacgtaaattagctgacattttaaaaactccaattgcaattatagataaacgtcgtcctagaccaaatgttgctgaagtgatgaacattgttggtgagattgaaggacgtacggcaattattattgacgatattattgatacagcaggtacaatcactttagctgcacaagcattaaaagataaaggtgctaaagaagtatatgcttgttgtacacaccctgttttatcaggaccggctaaagaacgtatcgaaaattctgctataaaagaattaatcgtaacaaactcaattcatttagatgaagatcgcaaaccatctaacactaaagaattatctgttgctggtttaatcgcacaagctatcattcgtgtatacgaaagagaatcagttagcgtattatttgactaatatttaaaaggcgtttgacgaacatattccaaacgtgtataatagtttcgttcgtgattatacgaataaataaacacttgcaagcaacgatgatgttgatgggtaagtgaggtgctcgttttgagcaaaaatgaaaggtggaaatgagaatggcttcattaaagtcaatcatccgtcaaggtaaacaaacacgttcagatcttaaacaattaagaaaatctggtaaagtaccagcagtagtatacggttacggtactaaaaacgtgtcagttaaagttgatgaagtagaattcatcaaagttatccgtgaagtaggtcgtaacggtgttatcgaattaggcgttggttctaaaactatcaaagttatggttgc

SEQ ID NO: 300 - DNA, 3181 bp; double-stranded, linear
aaaatgcatataaatacatattaaggaggattttatgaattttcttaaacctgcaaagcatattaagcctttgccagaaaatcagatagatgatacctataaacgattacgtctccaagtatttcttggtattttcatcggttacgctgggtactatttattacgtaaaaacttttcgttagcgatgccggcattgcaagagcaaggttttacaaaagcggaactaggttttgcactttctgctgtttccatcgcatatggatttagtaagttctttatgggtactgtaagtgatcggagcaatgctcggatattcttagttcttggattagcactcactgctatcgtcaatttgttaatgggatttgtaccgttctttacatcaggtatcggtattatgtttgtcctattattcttaaatggatggtttcaaggtatgggctggccaccttcaggccgtgttctcgttcactggtttagtgtaagtgaacgcggaagtaagactgccctttggaacgttgcgcataatgttggtggaggtattatggcacctattgctgcttggggtattacaacaactgcatttatcaactttggttatttaaaaggtttcgaaggtgtattcatttaccctgcactcttagcacttatcattgccgcaatttcatacgtattgattagagacacacctcaatctcaaggtttacctccaatcgaaatttataaaaatgactttgctacaagcgataagaaaacattagaaacagaattaactacaaaagaaattttatttaaatatgtactgaacaataaatgggtatgggcaattgcctttgcaaatatatttgtttatttcgtgcgttatggtgtacttgattgggcgccagtctacttaagtgaagaaaaacatttcgacttaaaagcatcaggttgggcatacttcttatacgaatgggctggaattcctggtacattattatgtggttacatttctgataaattattcaaaggtcgtcgtggacctgcaggtttcttctttatgttaggtgtcacagtatttgtattaatttattggttaaatcctccaggcaatgcttggttagacaatgtctcattaattgccattggtttcttaatatatggaccagttatgttaattggtttacaagcattagattatgtacctaaaaaagcagctggcacagcagctggattaacaggattatttggttatctgtttggtgctgtaatggccaacatcgtcttaggtgctgtagttgataaattcggatgggatgtcggttttattttattaacagcaattagtgtgtttgcaatgttgagctttatcctcacttggaataaagtaggacaagaaaccgttcatcattaaatgataaaaaataaagtcatatggttatcttatcgaaagatgatatattcatctcttataagttcaaccatatgactttttattagtattcaaaaaaatatttacattgccacttttgtgtttgccctgctgttttattcaattgattacaccacttaggataaactctaaaagccattttcccttgatacttagatgaagctaagatacctttttctaccaataattccctaggaaatagaaagtagccatttaattcatcatcgataacagcaacaatcaggtaatcagcaaactcttcaattttgtatggccgattataattatcttcgtcttttgtccaacatgtcacgaaatatcccgatttagtcggtgttttcttagctaacctactttgatatgtttcctctttaaagctaaatgttaatgcytcgtaatcttgattatatttttcttcagttaaatctttaacttctgattcttcactaaaaatatttttcaacagtattttagatttacacatatgccaatctcactttattttttcataatcgtatcatatatttatttttttcgaaaaatacacttccgaccgaaatatactcagccagaagtggacgaaatatttaaccttctattaattcagatgtatcaactgtcaaacgatcacgtaataaatagacgattaacattgctgctaaagcacaaagtgactcagcaattaataatgaccaaatgacacctgttagtccaaacaaagcattcataataaataatactggaatgataattgcaccttgtaaaatggccataattgtagcaccacgaccttgcccagtcgcttgaagcataccagtaaacaagaaacctataccatttaataataatgatgccattgttactttcaaaataaatgtcgccatctcaacaatggcttgatcagtagtaaatagtccgaccatatgatgtccaattgtaaatacagcactcatacatacaacaaagataacgccgatagacatgataactgctttgataacgtctttcatacggcctttatttgccataaagttatatgcaattagtggtacaacaccttcacataatcccatgataataagttctggaaattgcacaagtctaaatgagataccataacttgcaatcgcgaagtttccataatgtgctaaaaataaatttaaaactaatcctgtgaatcccattaagatactcattaaaaatgcaggaataccgattttaaagatttcagaaagcatttctttattaggtttcgcaagtttaatattaactgacacaacgtcactatttttcataaaataaatgataaagaacagagcagcagcaacattactgattgcagtacccaaagctgcaccaacaacgtttaaatcaaaaccaaaaattaaaattggatctaaaataatatttaagcctacactagctaacataccaatcatagaaaccattggtgccccaattgcacgtgcaaattgttctaatatgaagaacaaaattacaaaaggtgcacttaaaaacattactttcaaataattacttgttaaagctaacgtttcacctctcgcccctaaaattgctgcgatttgatcactgaatggtaaagtaactaaaatcacgataagtcctagtgcaataccaccataaatagagaaactacttacaaatttactcttamtatagtctttcgcacctaataaacgtgaaatataagttcctgcaccaacgccaaataaattacctaaccccatt

SEQ ID NO: 301 - DNA, 4029 bp; double-stranded, linear
tcatcaccttcaaataaataggcatgcgataatttatttgaatgatatgcattcgtcaattgttgctgttcatccattcattacaaactcccttttgcttttatataaaaaggttgccaaagagcaactaattactgcaacaatagcgaccatgatttgtgattatttttagaaccacaaaaatcaaatctattggcatctgaactagtcgcagtcaagcaacccaaaattgttaataacttattaatacactattttaagtatctctaattgatgattgtattatagaattaaaattgatggaatgcatcaactggcataacaaatacagtagcaccgccaacttcaacttcaactggatatggaatgtacgaatccgcactgcctcccataggtgtaataggtgaaaccaactgttctctattaccacacgtttgattaatcacagacaatatttcatctacacggtcatcattgacaccacataagaatgttgtattacccgctcttaaaaacccacctgttgttgccaattttgttgctctaaagttatttttaacaagttgatctgcaagttcctgactatcttgatcttgtacgatcgctataatcattttcattttataacacctcttctaacaattatatcatatcttttctaaatatttgatgatagtttgatacgtgtcttcaacaacattttcaagaggttgatctgcattaacgcttttgaaccgttgtgattcattatgaatgatttcttggtaaccttcaattactttttcgtgaactttaaatcttcttgatctaatctattttgatctcttgaatttttaataatacgttcgcgacctacttcagcactaacatttaaataaatcgtcaagtctggatataatccatttattgcaaattcgtttaatgctcttacttcttcaacgccaatccctctagcataaccttgataagctaatgaactatcgatatagcgatcacacaacacaaccttaccttcttttaaagctggtatgacctttaatacaagatgttctcttctagatgcagcaaataacattgcttcagttctaatgtccatatcattgcccttctaatacaattttacgtatttcttcaccagtaggaacaccacctggttctctagtcataatgacatcataatcttttactaatctatggtaaacttcattaattacagttgtttttccagagccttctgggccctcaaaagttataaaagctgacattttattcatcctcaactaaaattttattatttttaattccttcaactatcattccagtttccagatattcatttaccaattctatcatattttcagttattgtttctcctttgaaaataataggaatccctggcggatacgggacaatatgtcgcgccagaactttacctttgccttttcaaatcacaccaagtaacatattcaaagcgttttggtttatagttaccttcagtygttaaaagttgtgtttgtttaactttagaaactgattttttcggtaaaatcatatcttcaattttacgtaaaagcgaatcaaataaatacgtatcatcatgatgccataacggcaatatcgctaatgcttgatagtcgtccgctaattctaaatagatatgtgcattcataaaccaattttgaatatcatgacctgtaaaaccttcatattttatcagcaacttcaacggatcatcaacttgaagcatttcaaaacccttcttctccaaacattcgattaattgcgctctcttatcaaaaaacacggtactatcatatgttttatagaactcggcagctgactctaaactagccataatcaaatacgaaggactagatgtttggaagtagcttagatattctataatagtttctctataaggtgcatttttatgaatataaagtaccgagcccatcgttaaagctggtaacgttttatgaaaagattgaacaacatagtcagcttgataatttaatgtagaatctggaaatccttgcaatccaaagtgcgcgccgtgtgcttcgtcaatgagtacaggaatatttaattggtgcaaagatttgataacctcttctacattaaatgtttcaccgtaatagttaggataagtcaacacagcaagtttgtgaccgtcattattcaaacggcttaaattaactttattataatgattcgttaacggactttgatgcgtttcaataaaatgcccttcttgttggctaatatcgagcgcatgtaacacagatttatgtacatttcttgccattaagatatcgccttttttctgtgaaaaagactggatgacagataatattcctgaagtggtgccattcactaagaaataagcatcataatctgaatgtttctccacctgcttcatactttccaaaatgacttcttcaggatgatgtaaatcanctnaatccaggtatttcagttttatccattgtcattgataattgagataaatgaccgatagtcatatttttatgacccggaacatgcaaagaaatcgcttcttcttgatttaaactttctaatttatttaaaataggttgcttcatgatatacgcttcctttatttacactgttttggaattagttactttcaaaagtattaattatatagtaacacttctttgacaaaagttagtgttacttatgcaatagcttgtctattgtataataattaatttcctttttgtacttcgatttaaaagatattagacataaaatctaaaaacagcagtaagatgatttatgattaaaaactatcttactgctgttcactttttataatacttctgaatgtcttcacttatacttctagtcacagatttaaataatcaaaagtgcacattattaaaatatcaatttcacactcaatgcggctcatcgcattcatttcttgtctagcaacgttctactctagcggaacgtaagttagctaccatcctcgctaagaacctttcttgacttgtgacaatcgcttgcttctttcctctccttcggctctcgcttactcatttagctctactaaactcgttgcgctcttttctcgtttcgtcagattcaaacgttttcacttcgccaagccatttttctttgtgtttactttttattttgacgttttagacataaaaaaagagacctcacggtctcaacttgcctggcaacgttctactctagcggaacgtaagttggctaccatcgtcgctaaagacctttcttgacttgtgacaatcgcttgcttctttcctctccttcggctctcgcttactcatttagctctactaaactcgttgcgctcttttctcgtttcgtcagattcaaacgttttcacttcgccaagccatttttctttgtgtttactttttattttgacgttttagrcataaaaaaaagagaccttgcggtctcaatgcggctcatcgcatccattttttgcctggcaacgttctactctagcggaacgtaagttggctaccatcgwcgctaagaacctttcttgacttgtgacaatcgcttgcttctttcctctycttcggctctcgcttactcatttagctctactaaactcgttgcgctcttttctcgtttcgtcagattcaaacgttttcacttcgccaagccatttttctttgtgtttgctttttattttgacgttttagacataaaaaaaagagaccttgcggtctcaatgcggctcatcgcatccattttttgcctggcaacgttctactctagcggaacgtaagttcgactaccatcgacgctaaggagcttaacttctgtgttcggcatgggaacaggtgtgacctccttgctatagtcaccagacatatgaatgtaatttatacattcaaaactagatagtaagtgaaaagtggattttgcttcgcaaaacatttattttggattaagtcttcgatcgattagtgattcgtgcagctccacatgtgcaccatgcttgccacctcggaacctatt

SEQ ID NO: 302 - DNA, 7159 bp; double-stranded, linear
gatgcaatagttgagtagttataagtagctacatacaaccgctcaaatataggttcaagaacatttttaatgaagaaagcgattttcccmcagagtgcaaacgcttgactcaataacgaaatgtcacctatgtatggcgtgacttattatacaggaggtgcaaagtatgtttgctattattgaaacaggtggaaaacaaatcaaagtagaagaaggtcaagaaatcttcgttgaaaaattagacgtaaacgaaggagatacttttacatttgataaagtattatttgtaggtggagattcagttaaagttggagcgccaacagttgaaggtgcaacagttactgctactgttaataaacaaggtcgcggtaaaaaaatcactgtattcacatacaaacgtcgtaaaaattcaaaacgtaaaaaaggccatcgtcaaccatacactaaattaacaatcgataaaatcaacgcgtaattattatgattactgttgatattacagttaatgatgaaggcaaagtaacagacgttattatggatggccatgctgaccatggtgaatatggtcatgatatcgtttgtgctggagcttcagctgtattgtttggtagtgttaatgcgattataggattgacatctgagagaccagatatcaattatgacgacaatggtggtcattttcatataagaagcgttgatacaaacaacgatgaagcgcaactaattcttcaaacaatgcttgtgtctttacaaactattgaagaagaatataatgagaatattagattaaattataagtgaggtgcattccgatgttaaaattaaacttacaattcttcgcatctaaaaaaggggtaagttctacaaaaaacggacgtgactctgaatcaaaacgcttaggtgctaaacgtgctgacggtcaattcgtaacaggtggttcaattttatatcgccaacgtggtactaaaatttaccctggtgaaaatgtaggtcgtggtggcgatgatacattattcgctaaaatcgacggcgttgttaaattcgaacgtaaaggtcgcgacaaaaaacaagtttctgtatatgcagtagctgaataattttgtctagttaacaccagaagtgaatcttctggtgttttttactttttataaaatgtttttcattattattttcattatgttattaaaaaatgggaattttagacgttatactaaatgtgcactgtataagagcccctaatcactaaactataagggggacaaaggaatacagttgcagcgtttaaagaataaactgtaccacaattggtgctgagaaatataagtattttaaagcaaagatttataaaagtaactgcataagagcccctaattatttacaatatataaggggctctaatatgctataattattgggaaaatgaaaattatatgtaaaagaggtgagatatatgtttgtcgatcaagtcaaaatatctcttaaagccggtgatggtggtaatggtattaccgcatacagaagagaaaaatatgtaccatttggtggaccagctggcggtgacggtggtaaaggtgcttcagtcgtatttgaagtggatgaaggtttaagaacgttattagattttagatatcaacgtcattttaaagcaagcaaaggtgaaaatggccaaagtagtaatatgcatggtaaaaatgcggaagatttagtattaaaagttccacctggtacaattattaaaaatgttgaaacagacgaagtgttagcagatcttgttgaagatggtcaaagagctgtagtagcgaagggcggtcgaggtggccgaggtaattcacgttttgcaacacctagaaaccctgcacctgacttcagtgaaaaaggtgaaccaggtgaggaattagatgtatctttagaattgaaattattagctgatgtaggattagtaggtttccctagtgtgggtaaatcgactttattatctatcgtttcaaaagctaagcctaaaattggggcatatcattttacaacgattaaaccaaatctaggtgttgtttcaacgcctgatcaacgtagttttgttatggcagatttaccaggtttaattgaaggtgcatctgatggcgttggattaggacatcaatttttaagacatgtagagagaacaaaagttattgttcacatgattgatatgagcggttctgaaggtagagaacctattgaagattataaagtcattaatcaagaattagctgcgtacgagcaacgtttagaagatagacctcaaatcgtagtagctaacaagatggatttacctgaatcacaagataatttaaacttgtttaaagaagaaattggcgaagatgtgccagttattccagtttcaacaataacgcgtgataatattgatcaattattatatgcaatagcagataaattagaagaatataaagatgttgacttcacagttgaagaagaggagtcagttggcattaaccgagtattatataaacatacaccgtcacaagataaatttacaatttcaagagatgatgatggtgcttatgtggtaagtggtaatgctattgaaagaatgtttaaaatgactgactttaacagtgatccagcagtacgtcgatttgctcgtcaaatgcgttcgatgggtattgatgatgcgcttagagaacgtggttgtaaaaatggtgatatcgttagaattcttggcggagaatttgaattcgttgaataggagcgaaacatgatggacaataaagattataaaaagttttatttaattagagaagatgtcttgcctgaatccgtggttaaaacattgaagattaaagatgccttaaaaagtgatccgacattgtccatttatgatgccgttaaacagtttgatctatctagaagtgctttttataaatatagagaaacgatatttccagtagacgataaaatgcttgaccatcgagaatttacattaattttatatgtaactgatattgttggtatgttggcacgtgtactagatgttatatcaaagttagaactatctgtattaacgattcatcaaagtattccaatggaagaaaaagcaacaataacattatcactgaatgctaaatctaaagaaacttcagtagaagatgttattggcgctttgagaaatttagattatgtatcaaaagtagaattaattagtatgagtatgtaaggatgtgcctataatgtacgcgtatgtcaaaggtaagttaacacatttatatcctacacacgtagttgttgaaactgctggtgttggttatgaaattcaaacaccaaattcttatcgttttcaaaagcatctagatcatgaagttttaattcatacatctttaattgttcgtgaagatgcacaattattgtatggatttagtagtgaagaagagaaagatatgttcttgagtttaattaaagttactggtattggtccgaaatcagctttagctattttagcgacaagtacgcctaatgaagtaaaacgtgccattgaaaatgaaaatgatacgtatttaactaaattcccaggaattggtaagaaaacggcaagacagattgtcttagatttaaaaggtaaagtgaaaattactgaagaagatagcgattcattattacaagtagacgctacttcgacggtgcaagatcaattcgtgcaagaagcaatgttagcgttagaagcattaggttattctaaacgagagcttgcaaaagttgagaaaacgttaaataaaaataaatatgactcagttgatgaagctgttaaggcaggtcttcaattagttgtatcttaattttaaatagattaataggggaagtgttgtcatgaatgagcgtatggttgatcaatcaatgcatagtgaagaaactgatttcgaattgtcgcttagacctacgagattacgacaatatattggtcaaaattcaataaaaagtaatttagaagtatttattaaagcggctaaacttcgtcatgaaccattagatcatgtattgctttttggcccccctggattaggtaagacaacattatctaatatcattgccaatgaaatggaagttaatatacgtacagtatcagggccttcattagaaagacctggtgatttggctgcaattttatcaggacttcaacctggagatgttttgtttattgatgaaatacacagactgagtagtgttgttgaagaagtgttataccctgcaatggaagatttctttttagatattatcattggtaaaggcgatgaggctagaagtatccgtatcgacttacctccattcactttggtaggtgcaacaacgcgagctggcagcttaacaggtccactaagggatcgatttggtgtgcacttaagattagaatattataacgaatcagatttaaaagaaatcattattagaacagctgaggttttaggcacaggtattgatgaagaaagtgccattgaacttgctaaacgttctagagggactccaagagtagcaaatcgactattgaagcgggtaagagacttccagcaagtgaatgaagatgaacaaatatacattgaaacaacgaagcacgcattaggtttacttcaagttgatcaacacggactagattacattgatcataaaatgatgaactgtattattaagcagtataatggcggacctgttggtttagatacgattgccgtaacaattggtgaagaacgtattacaattgaggacgtttatgagccatttcttattcagaaaggctttttagaacgtacgccacgtggcagaaaagcaacaccattagcttatgaacattttgcaaagtcgaatgaggagagagaataacgtgaatattgaagaatttgactatgacttaccagaatcattaattgctcaaacgcctttaaaagatcgtgatcatagtcgtttattagtcatggatagagaaactggtgaaatgaaacatttacatttcaaagatatcattgagtattttagacctggtgatacattagtgcttaacgatacgcgagtaatgccagctagactttttggtttaaaagaagaaactggtgcaaaagttgaaatgttaatgttaactcaaattgaaggtaatgattgggaagtcttactgaaaccagctaagcgtattaaagttggtaataaattgaattttggtaatggcaaaattatagctgaatgcataaaagaaatggatcaaggtggacgcatcatgcgtttacattatgaaggtattttacaagaaagattagatgaattaggggaaatgccactgccaccatacatcaaagaacgtttagatgatccagatcgttatcaaacagtttacgctaaagaaagtggttcagcggcagcaccaacagcaggattacattttactgatgagttattaattgaaattaaaaataaaggtgttaatatcgcatttgttacattacatgttgggttaggtacgtttagaccggtgagcgtagacgatgtgaatgaccacgaaatgcatagtgaatattatcaaatgacmcaagaaacagctgatttattaaatgatactaagccaaaggacatcgcattatatcagttggtacaacttcaacacgtacacttgaaacaattcgacgcgatcatgataaatttgttgaaacgagtggctggactaatatatttatttatccaggatttgattttaaagcaattgatggccagattactaattttcatttaccaaaatcaacattagttatgctagtatcagcgtttagtagtcgtgaaaatgttctgaatgcttataaaacggcagtaaatttagaatatagattctttagttttggcgatgcaatgttaattatataaaaagaatgtgaggattttgaatatgcctgcagtaacatacgaacacattaaaacttgtaaacaatcaggtgcgcgtttaggtatcgtgcacacaccacacggttcatttgaaacacctatgtttatgccagttggtactaaagcaaccgttaaaacaatgagtccagaagagttaagacaaattgaagcaaaaatcattttgggcaacacatatcatttgtggttacaacccggaaatgatattatcaaacacgctgggggattacataaattcatgaattgggatggtccgattcttacagattcaggcggtttccaagtgtttagtttaagtaatttacgtaaaattacagaagaaggcgtggaatttagacatcatactaatgggtctaaattatttttgagtcctgagaaatcaatgcaaattcaaaatgatttaggatctgatattatgatggcatttgatgaatgtccaccgatgcctgctgaatatgattatgtaaaaaaatctattgaacgtacaacacgttgggcgaaaagatgtctagatgcacaccaaagacctgaagatcaagcattgttcggcattatacaaggtggcgaatatgaagatttaagagaacaaagtgcaaaggatttagtagaattagattttcctggttatgcaatcggcggtttgtcagttggtgaacctaaaccggttatgtataaaatggttgaacatacagagcagtttatgcctaaagataaaccaagatatttaatgggtgtaggatctccagatgcgttaatcgaatgtagtattcgcggcatggatatgtttgattgtgtcttaccgacacgtattgccagaaatggtacttgtatgacatcgcaaggtcgtttagttattaaaaatgcaaaatttgcagatgatttaagaccgttagatgagaattgtgactgttatacatgtcaaaactattcaagagcgtatatacgtcatttaatcaaggcagaggaaacttttggtattcgtcttactactattcataatttacattttctgctaaaattaatggaagatataagacaagccattcgagaagatcgtcttttagatttcaaagaagaattcttcgagcaatatggattaaatgttgagaacccaaaaaacttttaagcaagaggagcgtataaaatgcaattttcattactaatatatatagtcgtaatttttgcggttatgtatttcttgatgatcagaccacaacaaaaactgtgcgaaaca

SEQ ID NO: 303 - DNA, 3159 bp; double-stranded, linear
tccatttatagaaatttctaaagcaganaataagatagaagatatcggccaaggtgcagaaatcatcaaaagaacacaagacattactagcaaacgattagctataactcaaaacattcaatttgattttgtaaaagataaaaaatataacaaagatgccctagttgttaagatgcaaggcttcattagctctagaacaacatattcagacttaaaaaaatatccatatattaaaagaatgatatggccatttcaatataatatcagtttgaraacgaaagactctaatgttgatttaattaattatcttcctaaaaataraattgattcagcagatgttagtcagaaattaggctataatatcggcggaaacttccaatcagcgccatcaatcggaggcagtggctcattcaactactctaaaacaattagttataatcaaaaaaactatgttactgaagtagaaagtcagaactctaaaggtgttaaatggggagtgaaagcaaattcattcgttacaccgaatggtcaagtatctgcatatgatcaatacttatttgcacaagacccaactggtccagcagcacgagactatttcgtcccagataatcaactacctcctttaattcaaagtggctttaatccatcatttattacaacattgtcacacgaaagaggtaaaggtgataaaagcgagtttgaaatcacttacggcagaaacatggatgctacatatgcttacgtgacaagacatcgtttagccgttgatagaaaacatgatgcttttaaaaaccgaaacgttacagttaaatatgaagtgaactggaaaacacatgaagtaaaaattaaaagcatcacacctaagtaaacagttcaatcatcttaaaaaatcctgggacacttcatacttgtctcaggattttttmacaaattgaatcagcctcataacattaaattattttatcgtacattaaatttaataataacaactgatttttataagaataaagtatcgamccatagtagatacacaaataatacaaatgaaacaatttaacttgaaagcttaaataaatattatcaagttaataaacaattaatttttagatggattcatcaaaaatcgtaaaaaagcacaatttgtattttacaaacattaattaaaaaagaaagcaagacattcgtgcaatcggttaccttaaattgtttacaactgtcaacaataccaaggttttattaactatatttctcacaaaattagcttttagcattccaaacaaaaaaggttaaatcgaacggaattatggcatttttaacttaattgtaaaaaaagttgataatggtcaattgttaatgaacagttaattataataacgcccaaaatatattattatttaattaagttaaataaaattatagaaagaaagtgaaacttatgcttaaaaataaaatattaactacaactttatctgtgagcttacttgcccctcttgccaatccgttattagaaaatgctaaagctgctaacgatactgaagacatcggtaaaggaagcgatatagaaattatcaaaaggacagaagataaaacaagtaataaatggggcgtgactcaaaatattcaatttgattttgtaaaggataaaaaatataacaaagatgctttgatattaaagatgcaaggattcattagctctagaacaacatattacaactataaaaaaactaatcatgttaaagctatgcgatggccattccaatataatattggtttaaaaacaaatgataaatatgtttctttaattaattatttacctaaaaataaaattgaatctacaaacgtgagtcagacattaggatacaatatcggtggtaatttccaatcagccccatcactcggtggtaatggatcatttaactattctaaatcgattagctatacacaacaaaattatgtaagtgaagtagaacaacaaaactcaaaaagtgttttatggggcgtcaaagcgaattcattcgccactgaatcaggtcaaaaatcagcctttgatagcgatttatttgtaggctacaaacctcatagtaaagatcctagagattatttcgttccagacagtgagttaccacctcttgtacaaagtggatttaacccttcatttatcgccacagtatctcatgaaaaaggttcaagcgatacaagcgaatttgaaattacttacggaagaaacatggatgtcactcatgccattaaaagatcaacgcattatggcaacagttatttagacggacatagagtccataatgcatttgtaaatagaaactatactgtgaaatacgaggtcaattggaagactcatgaaatcaaggtgaaaggacagaattgatatgaaaatgaataaattagtcaaatcatccgttgctacatctatggcattattattactttctggtactgctaatgctgaaggtaaaataacaccagtcagcgtaaaaaaagtcgatgacaaagttactttatacaaaacaacagccacagcagattctgataaatttaaaatttcacagattttaacatttaatttcatcaaagataaaagttatgataaagatactttagtacttaaagctactgggaatattaactcaggctttgtgnaacctaatcctaatgactatgacttttcaaaattatattggggagctaaatacaatgtatctataagctcacaatctaatgattcagtaaacgtcgttgattatgcaccaaaaaatcaaaatgaagagtttcaagttcaaaatactttaggctatacatttggtggtgacattagtatctctaatggtttatctggtggacttaatggaaatacagctttttctgaaacaattaattataaacaagaaagttacagaacaacattaagtcgcaacacaaattataaaaatgttggctggggagttgaagcacataaaattatgaataatggttggggaccttatggaagagatagcttccacccaacatatggtaatgaactcttcttagctggcagacaaagcagtgcatacgctggccaaaacttcatagcgcaacaccaaatgccattattatctagaagtaacttcaatccagaatttttaagcgtactatcacacagac

SEQ ID NO: 304 - DNA, 3821 bp; double-stranded, linear
gcaaaaacttttctccaactatgtcagactataatggcatgaacaaaattgatatgatgaatcaaattaaagttgatacgatgttgcatggttatcacgctggatttttatttgcattattgattacagttgttagtttcttttgttcatttatgttacaaggtaagaaaaaagaagttgattctcgtcaataaatataagttgctagctatataaagctttttagcaaaagttcaacatattgacttatccggcatttcagattaaaatatttttattccgattagaataataagaataaggagatatattctatgaaaagacttttatttgtgatgatagctttcgttttcatattggctgcatgcggaaacaattcgtcgaaagacaaggaagctagtaaagatagcaagacaattaatgttgggactgaggggacttatgcaccatttagtttccacgataaagatggtaaattaactggttacgatattgatgttattaaagcagtggctaaagaagaaggtttaaaacttaaatttaatgaaacttcttgggattctatgtttgcaggtttagacgcagggcgttttgatgtaatcgcgaaccaagtaggtattaatcctgatagagaaaagaaatataaattttctaagccttacacattctcaagtgctgttttagttattcgtgaaaatgaaaaagatattaaagattttgatgatgttaaaggtaagaagttagcacaaacattcacatctaattatggtaaattagctaaggataaaggtgctgatattacaaaagttgatggctttaaccaatcaatggatttattattgtctaagcgtgttgatggtacatttaatgatagtctgtcatacttggattataaaaaacaaaaacctaatgctaagatcaaagcaatcaaaggtaatgctgaacaaagtagatctgcatttgcattttctaaaaaagcagatgatgaaacagttcaaaaattcaatgatggcttgaaaaaaatcgaggaaaacggtgaattagctaaaataggtaagaaatggtttggtcaagatgtttctaaatctaaatagcgaacaacaacatgcgctagatgctgcaaaacaagctttcggacctatgctagaaggtttggtcaaatattcaattcctattacattagttacatttgttttaggattgattattgcattatttacagcattaatgcgaatttcaacgagtaaaattttaagaagtatttcacgtgtctatgtatctattattcgaggaacaccaatgatagtacaactatttatcatattttatggtattccagaattaggtagattattaacaaatgacgctgacaaccaatggacattggcacctgtagtggctgctattattggtttatcattaaatgtaggtgcgtatgcttcggaaattattcgtggcggtattatttctataccgaaaggacaaacagaagctgcatattccatcggtatgacgtatggtcaaacgatacaacgtatcattttaccgcaggcaattcgagtgtcgattcctgcactaggtaatacatttttaagtttaatcaaagatacatcattattaggatttattttagtggctgaaatgtttagaaaagctcaagaagttgcgtctacaacatatgaatatttaacaatttatgtgttagttgcgctaatgtactgggtggtatgctttattatttcaattatccaaggtatctatgaatcttatattgaaagagggtatcgctcatgattcaattgaacaatatccataaatcatttaatgatgttgaagtcatcaaaggtattgatttatctgttgaacaaggtgaggttgtaaccttaatcggtcgatctggttcaggtaaaacaacattgttacgtatgattaatgcattagaaattccaactgaaggtacagtttatgttaacggcaaaacatatacatctaaagataaaaaatcacaaatagaagttcgtaaacagtctggtatggtatttcaaagttataacctttttccgcataagacggcattagaaaatgtaatggaaggtcttatcacagttaaaaagttgaaaaaggatgaggcacgtgggaaatcacttgagttacttgagaaagttggtttaacacatgtcaaagatcaacgtccacatgcattatcaggtggtcaacaacaacgtgttgctattgtcaagagcactagcaatgaaccctaaagtgatgttgtttgatgaaccaacatctgcacttgatcctgaacttgtgaatgatgttttaaaggttattaaagatttggctaatgaaggcatgacaatggtcattgtgacacatgaaatgcgttttgctaaagaagtatctaataacattgtatttattcmtgaaggcatgatcggagaacaaggggctccagaagagatgttcaatcgtccgaaaacagaagaattaagacgtttcttaaatgttataaatgaagaataatcaaatagaaccacgtatcatgttttagtatggcgatgaagccatatacatgatgcgtggttctttgttatgttgtcataatcttggagcgatattttaacgacgtttatgatttaagtacgtttgtaccttatatagtaatggtttgataggcttaataaagtcaccgatatactcttctacatgtgcgttaaaaccttttttgaattgttggacgccatagtcttctgatgactctgaaaagtcaccggtaataccataaaaattatagcgatcaatatgatgcgctttagcaaacttaatcatttcccactgcaaatggtaggcacccatataagcattatatttagggtttgaaccactagataagtaataaacttcatgctcattgtagataaataaagcagaagctaagtttaagactgcaccatcttgttcaatttgttctattgtattgtcgattttacgcttattgctatttagctgttgttctagctgtgtgcgtttcgttttatttttctttgaattaggactttcttccaatgcttcttcaacacctgagagttcagctgttaattgttgttgctttaattgtaacgtttttaaatactcgtttaaatcaatatacgccaactttaacatggcgtggtcatcgtataacttttgcatttcttcaaagtatggtaactcacggaatttgaaaccgtgcttttcctcagccatatggaataagtcgaaaaaagtttgcgtttcatcaatcgttaacgttttagttttgacaccaatatcatatgtttttttaatattacgtctcgtttgataatccatttcttttaaaagttggtcttcagtcttatcttttaaatctaacactgacagccaacggatttggctcattgaatcataacctacagggaaaccttggtgtttataacctaatttatccattgttctaacaaatgctcggttatcataagatttaacaatttcaccgtctgcattgcgtaaattttcaattaaatatggatctacaaggacatataaacaattgtgtttctttaaatatgacgttaatgctttaaagaaaaatgctactaatgattgatttgtataatccatcactggcccgcgatgtgtataaaaatatttgaaaaatttaagtgtgcgtgcttctgtcaataagcatcctgcaatcacttgaccattgtcatctttaacccctacragatgcacatcgccttttaaatcaactctatgattgtaatgaatagctgattgtgtgtaatgtgaaaaatgct

SEQ ID NO: 305 - DNA, 1422 bp; double-stranded, linear
gcgacaccattgtttgcagcaactgttaatttaccagttgatggtttcgacggtgttgttggttttgatggtgtagtaggggtagttgtagattgcgtaccccatggcgccactttacccatttttattaaatatttttcattaattaagtcatataattgatcataactataattatgacttcttaaatatccatgtggatcggcatggtcagtaccacctaaatatttacttacagcgtagtgagtccatactgtaccatttccatcatactcagcactgtctggttttaaaccataatattgtaattgtgtagctgcatagtcagcatagttattcattgaacgtgcaaatgaagcatagtcgtgtgtgtgtacgatttcaacattgatgaatctagggttaccgactgcaccgacaccccaagataagtaatccgttggtgctgtttcgattatacgatccccatcaacaaatgcatgtacgaatgcgttttgatagttatttttcatataactaatttcaccatttatcgtcgaacgatcattagctgtatcatgaactacgataccttcaggacgacctacgccgttacggtatgcgtatttagggaagtaagatgtataatcttcttcaattttaggtgcttttaagttatttttacaaatgtaatcgttaattgaagagtttacttgtggtttatattttggcaaactcgtttttggtgttgcagcaactgatcttggttgtgctgaagcgctaaaagtagttactttaggtgtcgcttcagttttagctttaggtgctgatgtagttgcagctttaggtgctgcggttttatattgcgtytcaagagctgcaggtttagcagctgatttaattaattctggattaatttgattttctgaattatcatcttcatcatcaactaaactataaccagcatttgtaacattagtgttagttttaggtgctgtagtgcttgttgactttgcaacaggctgcgtattatttgtagtcgctgattgattagcacgagtgtcaccatttacttgtgcagtatcaactttttgacttacttgagcattgcctgttttgttatttgctgtttttggttggacaatagcagggtcttgatatacttgagtgccagaaatgttttgcgttggattttttacctcagcttttgcttgttcagtagttgctttaactttattactatctaaaacgtttttattagtagtttgatcttgtgtcgtctcagctgcttgaacttgatgtgcagtgactgctgaacctacaagcgttaatgcaaccattgaggtagtttgtaattgaattttttcgccattctatttattactccyaacatttattaattattactaacattatagtacctgtnttatatacctgtgcgta

SEQ ID NO: 306 - DNA, 6076 bp; double-stranded, linear
acgcgttggttatttcaatcataatattactctgcaaatacacagccctgtaaccgagtaaatggatagagatttgaacaaatgaaaacaatcaactaatggaaaggataaaatattatgcacaacaataatgaattcaacaaaaaactgaaagattttataggtagcgataaacggatggctttagtaaagggttatgttaacgagtataaattaacaactgttttaagagctttaaataattccgattacacaaaagggacgatacacactcgttcaataggcaacctaaaacaaatagtagataatcgaattattcctaaaaatataactcaaaacacaatcttcaaattgagtaatttaaccttagaggttaacctctatgaaagaaacacaatttatcacggagactttgctatttactatcctgtagaatctgctctaataatagaaacagatactcctaggctaattaatcatataaataacaacccagtccaaaaaatatttataataacaacaaatgactggagctttaatacacttgaattagaaaaaatagtagacgaaactataatttatgatttaaaacaagaagatcctaaacaatatgaaattttatataaaaataaacacggaaaattgccttattgatgaattaaaacgcaaacttagaacaccttaccccttttccgtccttattgtaattttccaactactcaaattaaaaaccacccgtgcaaacaggtggttttattatatataattattcccactcaattgtgcttggtggttttgatgtaatgtcatagactacgcggttgacgtgatctacttcgtttacgatacgactagaaatcttttgtaagacttcccaatcgatgcgtgcgaagtcacttgtcataccgtcgatagatgttactgcacgaatacctactgtgtgatcatacgtacggtagtctcccataacacctactgattgaatgtttggtaacactgtgaagtattgccaaatttctctttcaagaccttcttctctaatcacttggcgtaaaatcgcgtctgattctctaacgatttctagtttatcttcagtaatttctccaagtacacgaataccaagaccaggtcctgggaatggttgtctccatactaaatgttctggaatacctaactcaatacctaatttacgtacttcatctttaaacaatgtattgattggttcgattaattcgaattccatgtcttctggtaatccaccaacattgtggtgtgatttgattgtttgtgctgttttagtacctgattcgatgacgtctgtatatagtgttccttgcgcaaggaagtctacacctttcagttttgatgcttcatcatcaaatacgtatacaaattcattaccaatgattttacgtttttgttcaggatctgaaacaccttttaatttattcataaagcgatctttcgcattaacacgaataatattcatgttgaaaccttcaccgaattgctccataaccatgtcgccttcacctttacgaagtaagccatggtctacaaagatacatgttagttgatcacctattgctttatgcaatagtacagctacaacagatgaatctacgccgccactcatcgcacataatacacgacggtctcctacgcgttgacgaatcttttcaatttcgatttcgataaagttttccattgtccattgacctctacaatcacaaacacgacggacaaaattatttaataaatcattaccatattctgtatgacgtacttctggatggaattgaacaccataaatgcgacgtttcttatcttcgattgctgcatagtctgtgcttgggctatcagcgataacttcaaagccttctggaatttcaataactttatcagaatgactcatccaaacagtttgttctgctggtaagccagcgaataactcatctgacttcgcattaatgattgctttaccgtattcacgttcattggcacgttcaactttaccacctaataatttagtagttaattgcatgccgtaacaaataccaagtactggaattcctaaattatatatttccggatcaattgtaaatgaaccttcttcataaactgaatttggaccacctgataagataataccttttggattcattttcttaatttcttcaattgaaatttcatgatcgtgtaattcactataaacgcccatttcacgaattcggcgtgtaattaattggttgtattggctaccaaagtctaagacaaggattaactcttgttcttttgccatttccatatttgtcgttctcctttatcttaattagaatgagtagttcggtgattctttcgtaatttgaatattatgtggatggctttctgctaaaccagcaggacccatacgtgtaaattgtgcttcttcgcgtaattctcttaaatcgtgtgaaccagtataacccataccagcacgcacaccgcccattaattggtaaattgtatcttgtaacgcacctttataagccgtacgtccttcgataccttcaggaacaaatttcttaggcgctttgtcctcttggaagtaacggtcgtttgaacctttttccatcgcacctaaagagcccataccacggtatactttatattgtctaccttggaaaatttctgttgcgcctgggctttcttcagtacctgctaataagctacctaacataaccgcatgtccaccagcagctaatgctttaatgatatctcctgagaatttaataccaccatcagcaatgatagctttaccatgtttgcgtgcttcagttgcacaatcataaattgctgtaatttgtggtacaccaacacctgctacaacacgcgtcgtacaaattgaacctgggccaataccaactttaacaatatctgcacccgcttcaaataaatcttttgttgcttctgcagttgctacgttacctgctactaatgtgatttctgggtaagtcttcttaatatgtttcacttgatcgataacacctttagagtgaccatgtgctgtatcgataactaagacatccacacctgcttcgactaatttttgagcacgaatatcagtatcttttgaaataccaattgctgcggctacaagtagacgaccatgttcatcttttgctgcattagggaattcgataactttttcaatatctttaatagtaataagaccttctagacgtccgtctttaactaatggtaacttttcaatcttatgtttttggagaattttttctgcttcttcaagtgttgtattcactggagctgtaattaaattttcttgcgtcattacatctacaattttaatcgagaagtcttcaataaaacgtaagtcacggtttgttaaaatacctactaagttgcgatcttctttattatcaacaattggtacacctgaaatacggtatttacccattaatgcttctgcttcataaacgctttcttctggcgttaagaaaaatgggtttgaaatgacaccattttctgagcgttttactttttgaacttcgtccgcttgttcttcaacgcccatatttttatgaataacacctaaaccaccttgacgagccatagcaatcgccattttagattcagttacagtatccataccagcagaaataactggaatatttaatttaactttgtctgataattgtacgcttaaatcaacgtctttcggtaaaatatcagattgtgctggaattaataacacatcatcaaacgttaatgattcttttgcaaatttactttcccacattaaaaacagcctccatttttcaaattaattagttatattatttcacattttcttccgtttgtttatactttattccattaaaaaagaaattaagaataattgcagagattgcgcctaaaacaattccgttttgagtcaaccatgcaaattgttcacctaaacctttaaatgcttgtggtacagcgcttataccagtacctaatcctactgatacagcgataattaataaattgttttgatttttaaaatcgatatgtcctaatatactaacaccatatgccattaccatgccaaacatagctatcatcgcaccgcctaacacaggtagcggtatgatatttgctaatgcgccaagcttaggtatacaaccacatataagtaataacacgaccatgccgtatataacattgtttttcttagcgccggataaagaaacaagtcctacattttgcgaataggctgtatacggaaatgaattgaatatagaacctaacactatcgctagaccttccgcagtataacctttacgaaaatcttttctttctaacttcttaccggtaatttcacttaacgcatgatagacacctgtcgactcaattaaactaacgatagctacaataaagaacactaacgtcgatgtcacatcaaagctaaatccagagaatctaaacggcactgggatgcctaaccaaccggcatgattgacttgattaatatcgaccatcccaagtaagccagcacctatcgttcctaaaacgagtccaattaatatggcaatactcttaataaatccagttgtgaatctttgtaaaagaagaataatgattaatgtcattaaacctaacaaaatgttcttaacatctccatagtcctttgcaccttgacctccagctaagtaattcattgctactggcattaaattgataccaatgatagtaacaacactacccgttactactggtgggaagaattttacaagatgtgaaaagaaaggcgcgatgataataactaatatccctgataaaaatagcgaaccataaagtacatctattcctttcgtttgaccaattaaaatcatgggcgcaacagccgtgaatgtacatccaagaacgattggtaatcctgttcctgttactttattggcttgtaaaaatgtggcaaccccacacataaatatatctactgtaactaagtaagcgatttgttcaggtgtaaacttcaaacttgtaccaacaatgattggaactaagatagcacctgcgtacatagctaaaagatgttgaacacttaggattaaatttttcattattcttctcccaccaatgtcactttgtttccttctagtgaagcaaccttgcagagagaagaaactgttaaacctgcttcttctaaacgttgatgcccattttggaaactcttttcaacaacaataccaataccagctgtcttagcattcgcttgctgtgcgatatcgtataatcctaatgaagcatcaccatttgctaaaaagtcatcgatgataagtacagtatcttcttctgataaaaactcttttgaaacaatgaccgtacttgttttatttttagtaaatgaatgaatagatgtttcataataaccatccgtcaaagtgctaggttttgcttttttcgcaaataaacatggcacatcaaaatgcagtgcagccatgattgcaggtgcgataccggaagcttcaatggttaagattttagtaatccctttatctttaaattgctcgtaaaaagtgcgaccaacttcattcattaactttgcatcaatttgatgatttaaaaatccatcgacttttaaaatcttctcatcaatgacaacgccgtcttcctttactttttgtcctagtaactccactcttaaaacctcctcagatttgtgtgaaacattttgctcttaaattggtgctagatacaaaaaaatccccaaactaaataatagtttcagggtttatgagtgaacgaacatgcataacgaatttgtcatgcaatcaatgtaaaagaagtttcatcaaataaactgtgaccatcatataaaatgatataaatcacccaccatggttacaatttaatggctgaagctactcctagtattgtgttgttactcatagtcatgtcgttcaaggcaacatggtagaaacttctaaagccatattctttagattatatgagtttatgtaaattatttaacgataatagcaaattttcggcattttttcaataactgcttaggtaatcttttaatagtttt

SEQ ID NO: 307 - DNA, 6136 bp; double-stranded, linear
accgccgattgatagctttactgctgcgataaaactgccttcaacaattggtgcatcaacttttaacacacgatgattaccatcatacatttcaattgccatatctacattcatttctgaagatccaatatcgtaaaaacacaatgcatcatcctctaatttagtcaaaacttcttggatgatatcaaatgaagttccaattgaaccatctggtaatcccccgattggtataatatcaacgtcacctgccatttgctttaacaaagattttgtaccacttgcaatttctttactgtggctaacaagtataattttaggcattatcttcatctccaatcaaagcgtttaaaatataaaccatactttgagcacctggatcaatataaccttttgattcttctccaaaatatgcagctctacctttcgttgctaccatatcttttgtattatctgctaattgctgtaaatcattgaatgttaaagtttcaccatttttaagcttctctgctgctcgcgctactacatcatacattgtcttttcatttaaagtaactttaccacgtgattcaaccgcttcggcaaatgcctgaattagtgtaatgaaatcttgattatccatatcatctttggtgactgcagacattttaacaaagctaaagccatacagtggtcctgatgcacccccaacatttgacatcaatgccataccagttgatttgaacaatgattgcattgagctatcatcaagtttgtctttaagactactaaacccacgaaccatgttaaccccgtggtcaccatcaccaattgctcgatctaattcagttaattcagattcatgttttttaaacgtttcttctaaatttaataaacgtgctttcatatcattcactttcatttgtgccacctcataaatgtatatttattcatattcacttcttatttaaagtattgacttgttgttggtgctaaaaatgcttccaaatattctggtttattaggcacgatagttatagaaaaaccttgcatgtctaaagatgtcatataatcaccaacaaaccatttagcaacattaaccgttcttgcagctaaattttgttgaatatatttagttacgatatttaattcagataacggcgtaccacccataccatttaccattaatatgacatcattggcagtaacttctttatacaattcgtctaacaatgttccaacaatatgatcaatatcctttacttcttccctatgaatacctttttcaccatgtataccaataccgatttccattttgtcgtcttcaatatcaaagccatattttccagtagttggaacaagcggtggctcaattgccataccaatacttttaatttcaggtaacaacgcttctacacgcgattttatctctgttaatgaataacctttttcagcaagataaccggcaagcttatgaacaaacactgttcctgcaacaccacgacgttgtacttcgtttgtcacagcaatgtcgtcacgaacaataacagtttgaacatttataccttccatttctgcaagctcttgtgccatttcgaaattcatcacgtcacctgcatagttttttacaactagtaatacaccatcaccagtatctactgctttaatagcttctaatattttatcaggtgtaggtgatgtaaatacttcgccacaaaccgctgcatctagcataccttctgcaacaaaaccggcatgcgcaggttcatgtccgcttccacctccagagactattgctacaccatgttctttcttagctttttttacaataactgtattagcaatcagatctaactctgggtgcgcaattaacaatccttcaagcatatcagttaaaaatgtttcttttttattgattaactttttcatcatgttgtacctccttggtattatcagtcatagtataaaacagaataaatgaatgcgctatcataaagaattaacctgataccgttatcaaatatatttttgataagatcctcttgataacttaatggttcattattgaaaaaataaatagtcttgagtggctcattaaataaaaaatgctatgaaaagccttataataaagtgcctttcatagcaataagttgtgtccattgacactatacatttttcgttttgtacattaaatataagaaatacggtgcaccaataattgctacgacaatacctgctggaaccccacctggttgtaatacaattttgccaattgtatcagctataacaagtaaacatgcccctactaaaatggcaattggtaaaaacaactggtgacgtggtccaacgatacgtttggcaatatgcggacccattaatccgataaacgaaattgaacctgctactgctacagcagcagatgataacatcactgcgataaagaataatattaaacgttctctgcttaaccttacacctagacctcgtgcaatattatcacccgtatgaataatatttagtgtattcgatttaaatagtaagtaaggaataataatcaacacccacggtaaaaatgcaatgacaaatggccattcgtcaccccaaatattacctgcaaaccaagcagcgatgaaatcagattgcttatcatcaaattttgacataattgtaattgagccaccatataatgctgtttgtaaacctacacctattaataccatactcgcaggtgtaacaccttcatttttattaaaactgaaaataaaaataatcaatgcagtggtgataccacctagtatacttattaacggcagtacataaacaaagttgtcagcattaattttaccaattgcaataaataatgcgattgcaaatccgccactgcgttaatacctaatatacctggttcagctattggattttttgtgacactttgcactattgcaccactaatactaagctgcgccagccaaaatagtaatcatcatccgaggtaacctgaaatctaataagattaactcatcaatggcatcaccttgtccaattaaagttttgaaaaatctttcaacaggtatgttgtattcacctgaggtaatactccaagtacaacctagaaatagtagaatgctaaaaacagccagtgctatcaattgtctgcgtttattatttgaactaatcatattgagcgtcctccttttttaactaaatataaaaagtaaggaacaccgataaatgaaatgattgcaccaacaggcgcttctcctaaatatcgtgctatcacatcggcaacaagcacgagtatcccacctaacaaggctgttaatggtagaattttagcataatcagttccaattaaaaatcttgctatatgaggtaccatcaaacctacaaatgcaacttgtccagcgatagcaactgcaatacctgctagaatcatagcaataattaaacatatgcctctgatcattgttacattttgacctaaacctttagctaatgattcaccaagatttaaaatggtaagttgtttactaattgttaatataatgaataacgcaataccaattaatggaattgcccacttaaggtgtgaccatgttgtgcctgaaacgcctccagcagtccaaaatgttactgtttgatttagtctaaaagctaatgcaataccttgacttagcgctgttaacatagcacttactgctgcacccgctaaaataatacgcatcggattaaatccatcacgtctagatcggcctatcattaatacaatagcacctcctagaatagcacctaaaaatccagcaaacatcaatattaaaaatgaagtgtttggtaaaactgcatatgttaatgctaaagcaaatgaagcacctgaatttaaacctatgagcgccggatcagcaagaccattacgagtaacaccttgtataatcgcaccagaaactgcaagcgccatacctacaattactgctgctatatttctgggaatcctaatctcattgatgatgttttgctgttgattgctaggattataattaaaaatagcctctataattgtagaggcttgaattttggcgtcacctattaatgtagaaataaatagtgtgattagtagtatcatacttaaacctataatataggataaaaacttcaatggcgttgggttctctctatttgtcatgttaattgtcctttttatcatattaacttacttaattaagaataagctctgcgacataagtcataagttaccagtaaaggttttccagttttaggatctttacttaaaacaacatcaatattaaaaactttttctaatatttcctgtgttaatacgtcttctgttgaacctgtagcgatgatatccccttctttcatcgcaataagatgatctgagaaacgaatcgcttggttgatatcatgaagaaccatgacaattgtacaaccttgttcctgatttagcttctgaactaattctagtatttctaattgatgacagatatctaaatatgttgttggttcgtctaaaaagataatatcagttctttgtgctaatgccattgcaatccaaacacgttgtctttgaccaccacttaaatcattgattgaacggtgtcggaatgtatcagttcctgtaacttccattgcccaatcaatttctttcttatcctcagcagttaatctaccaaatcctttttgatgtggaaaacgaccatatgaaactaattccccaacagttaagccatctgctacttcaggtgattgaggtaaaatggctatttttttgcaatcycyttcgtagattgtgtatgaatattttcaccatctaaaaatacttcgccttctttaactgccaataaacgtgacaatgcctttagcaaagtagatttcccgcagccgttaggaccaatgattgacgtcactttgccatctggtatttcaacatctaatttatttataatcgtgttatccccgtaaccaattttaacttgttgtccatgcaaacgattcataatttccctactttcaataaaattctttctgtttataaaaaataatttctatttttaaattatcaattttcaaagacatcccaattgataatgattatcatgaacatcattataacatttttcaatcttattgactaacattactttttaaattggatagctcgatttgtcatgtcttgtatattacttttataaaataaaaaacgcccacagataagtcttcatagttcaaaaacttgtccgtggacttctatttaagtatgtgtgctcataccatttatttattcatctgcaagaaagccattaccatagacatctcttacatcatgaattacgaggaatgcatctttatcgatttgtttaattaatcgctttgcttttgaaacttgtgttttagaaataacaacgtataagacatctttttcttcacgcgtataatagccatgtccgtttaaaatggttaaacctcttccaatttgctcgtctattgctttggcaagtttgtcgggattagttgaaataatcgtcatagcttttttagtgtttaaaccttctatgacatattccatcacttttgttcctatataaagtgatattactgttactaatactttatcaagtggaataactgtaagtgaaattgcaacaacgatcatatcgaagaaaagcaaagcatatggcgtgcttacatcgaggtatttcgttgcaattctcgccaaaattgttgtacctgctgttgtaccgcctgcaaggataattactccgattcctagtccaacgcttacaccaccaaaaatggcattcacaatgctgtttccagtttctacttgccatgattctgttaaactcaaaaatattgaaataagaattgttacaagaatagttaagtacatacttctcttactcaaaaatttataacctatggcaatcaatactgcgttgaccaagaagttagtgatggctggtgaaatatgaaacgcataatataaaataattgctaaacctgtaaccccgccttcacctaagttaccagaaataataaatgcatttacacctgcagcaaagataaatgaacctaagacaactagtattaaatctttaaccgttttattcacgaaaccatcccctttatatatttattagactat

SEQ ID NO: 308 - DNA, 2576 bp; double-stranded, linear
gatatcgtasctactgaaaagtcatcaccaccatggaatgatttctttaaacgttttagcttctatgcaattgcaattcaatactttgttgtacaatttatcattacattattcttaatttggttaccgacgtatttaacagaagtattccacgttaactttaaagaaatgagcattagttcattaccttggttattaatgttcttcttaatcttatcagcaggtgcaatttctgaccgtgtattaggattaggtcgttcaaaattcgtagctagaggtgtaattgcaattgcaggatttattgtgtttgcagtttcaattatctttgctgtacgcacaggaaatttatatgtaagtattttctggttatcactaggtcttggtggtatcggtatttcaatgggtatgagttgggctgcagcaactgacttaggacgtaacttctctggtacagtatcagggtggatgaacttatggggtaatataggtgcattaatcagtccgctattagcaggtctattcgtagaacatttgggttggacaatgacattccaattgttaatcgttccagcagtaatcgctgtgattatgtggttctatgtgaaaccagatcaacctttaattgttagtgatgataaagcaatagaaaaataatttaaacaagcagtaagctttcacatagttggggcttattgctttttttgcgttgaaattgaaactttttaaaacagatatggtttaagatgaaaatgaagttattgaaatgatatatgtaaagaaataaggttttaaaacattagtcaggtaacgcttgtaaaagtacatataaattttaactagcgcaaaggtgggcgaccaaagttcaacgatgttaaataacattagraattaattttaattggactttaaaagtttttaaatttagataattgagcataaggtgttataatgacatatgttgcgtaattaaaatttatagcaacaaattcattttaactatgctaataaaaagattatggaaatattttgacaaggaaaggagaagtcgaaatgacatctttttgacatcactcataaaaatcaatcgacttaacttagacttttataaaggtgtaagacagggactgttaatgattattcctgcaataatcggttacttatgtggtaatttccaatttggattattagttgcaaccggaacactagcccatatttatgtttttaaaggtccgtcgcgatctaagctgcgaactgtaataatttgtaatttagcgtttgcaatatgtatgatgcttggtacgctaacagccaaaacgccactcgtttttggaatgacattattaattgttacggttataccattttatatatttactgccttaaaaatagctggaccgtcatcgacattcttcattgtgacattcagtctacccattaacttacctatagctcccgaagaagcattatatagaggctttgcgattttagtaggcggtatacttgccactatgatggtgttaatcacgatcgtattttctaaaaacaaagctgaagaacaagcaattcaaaatgattttaaactcatatctaagttgttacacacttataatgataaatctgcttttttacaagtagcaaaaacagcggtggatagttttaaagcatctgataaattattaatcacttctacttcaagtaacgataaattaagtagacgtttccaaaaattattattattacacacatctgcccaagggatttattctgaactgttagagttgaacgctaaacaaattcgaccattgccagatgagttaattgaaatgatggatcatatcattgcacaactagataatagtgaggaaaatgtaagatattggcgaaaagaagtgacagtaacagaggaatttcaaaatttattcaaccatatattgaaaattgatgaaatggtgcatgcaaatgaagcgcgtattgcgtatgaagcagacatgcgaaaacctttatatagtaaacgcatttatcaaaatttaacattagactctatkgtttttagaaatacattgagatatacagcgattatgatgatagcgatatttattgcgttaatgtttgattttgaaaaagcatactggataccgttatctgcacatacaatattactaggaacatcaactatacatgcaatcgagagaggtatggcacgaggtttaggtactattttaggtgtgttagtactttcagtcatattgttgttttcaataccaacacctgttgcagtaattttaatgggcattgcagcattgtttactgaagcattggtgggagcaaattatgcgattgcagtagtttttattacaatacaagttattttaatgaacggattagcatcacagaatttaacaattaacattgcgtttccaagagttattgacgttgcaatgggtattgtgattgcaatcataggtttatttgtccttggacaacgtaccgcatccgcattgcttcctaatgtaatggctgaagttgttcgtaaagaagcaacgctctttcattatttattttctgaaaatcaatat

SEQ ID NO: 309 - DNA, 668 bp; double-stranded, linear
caagcacattacgatggtctaatactttgctaataatttcttcttgtcctggtcgaaacgtttcatacccaaagtaatgcgataatgtttgttgcatcataaattgaccccttattgttgttctttaatttcttctaactcactccatcttgtgatgtctaaatcatattgaatttcaagttgttctttttcttcgtttaattctttaattttcccataatctgcacttgcctcaatcatgagcacatcaatttcttccattcttacttccgcttgttctatgcgtttcatcaattgttcatattctaatttttctttatatgataaaccatttttcttacgtacagttgtagaagatttagattgttgcttcaatgtggatttatttttatctaatgattttttataactttcataatcttcaaaagttccgataatcttttccatctgaccatcatgaataaaccaatatgactgtgcaactttatttaagaagtagcgatcatggcttacggtaatcactgtaccaccgaaagtatgaatataatcttcaagtattgttaaagtctcagtatctaaatcatttgtcggttcatctaacaacagaacatttggctggtgtacgagtagacgtaataaatacaaacgcttttgctctccaccagata

SEQ ID NO: 310 - DNA, 12173 bp; double-stranded, linear
catcagtttattttgaaaggcaatgcgatcatttcatgtatttatgttgtttgaaacatcgttagataacaatagtgatattgcacattttaagctgaagatggaaaaatattcgataatcaaataaacaatgaattttagaaggtacaatgacgttcactaatttaaatatagctgaatgtgttggtgagtgatgttcactatagatttatattaatatacaaagacaaaggttgttaatttttattaagcgttaggttgaatgtatgagaattttagatttataatagaagatagaaacgaaaatttttcttaaaagcagtaatgttgactcaaaataagctataataatgacacttatttaattgattaacatttgctaataaatatcaatatagaatataactttccaataatgactgagaaaatcgaaatgtcagtctcgaatcatataattagaaaattgattattttctgtcaatttagggttgaactatacatatgatattgttagaatattttttaacattatattttattgctttaaagtggaatatacttgaaataattagtagaggtgagtaaggatgagtaataaattagaatcatacagaagtgagattgtatcactgaatcatcaaattttagacttattatctaaacgtggtgaactagcacaaaaaattggggaagaaaaattaaaacaaggtacacgtatttatgatccacaacgtgaaaaagaaatgcttaacgacttaatcgatagtaacaaaggaccattcaacgataatactattaagcaattatttaaagaaattttcaaagcctctacagatttacaaaaatctgaaaatgaaaaacatttatatgtatcacgtaagttgaaacctgaagatacgattgtaacatttgataatgggggcattataggagacggcaataaatcatttgtatttgggccatgttcagttgaatcatttgaacaagttgaagctgttgctaaaaacttacatgctaaaggtgaaaaatttattcgtggcggtgcatttaaaccacgtacatcaccatatgatttccaaggcctaggtgttgaaggacttaaaatacttaaacagattaaagataaatatgatttaaatgttgtcagcgaaatcgtaaatccaaatgattttgaagtggctgatgagtatttagacgtattccaaattggtgcacgtaatatgcaaaacttcgagttattaaaagaagctggccgtacgaaaaagcctattctattaaaacgtggtttatctgctacaatcgaagagtttgtttatgcagctgaatacattgcttcacaaggtaatcaaaacattattttatgtgaacgtggaatccgaacttatgaaaaggcgacacgtaacactttagatatttcagcagtaccaattttaaaacaaggtacacacttaccagtcatggtagatgttacgcatagtacaggtcgtaaagatatcatgttaccaactgcgaarsagcattagcagttggtgctgatggagttatggctgaggtgcatccagatccatctgttgcacttagtgatgcgggtcaacaaatggatttagatgaattccaagcattttatgatgaattaaagcctttagctgatttatataacgctaaaaagttaaaataatattccaaggaaactatagactacttaactaatatgtcatgttgaagtagaatattatctttgaatcgacaattttaaacttacagccattctaagagtatattacttttagagtggctattattttttgtatagaaataaaggtatactgcacttaacgattgttataatacttcgacacttgttcaatttcacaattattaaagattatgactgatagcagtaattaaaattataactatgaattatctgtaaaatataatagattcacacatttgttgctgaaatgtgaacatttttcaacaaatgcaattgatatttgaaaaggctttctcaaaacattacaattaaaaatgaaaaaagtttatataaaattaaaatatatcgttcgttatcatttagcgtttgtttttatttcaagcttttcgctaaatttttccaaacaaaaatatgttactgtaaattaaaatatggtaaactatgaaaatgaaatgaaaacatgttattataatgaataaaacgtttacaaggaggaaattatgacagttactatatatgatgtagcaagagaagcgcgtgtctctatggccacagtgtcgcgtgttgttaatgggaaccaaaatgttaaagcagaaactaaaaataaagttaacgaagtcattaagcgtttgaattatcgtccaaatgctgttgctagaggtttagctagtaaaaagacaacaacagtaggtgtgatcattccagatatatctaatatctattattcacaacttgctcgtggacttgaagatattgcaacaatgtataaatatcactcaattatttcaaattcagataacgatcctgaaaaggaaaaagaaatttttaataacttattaagtaaacaggttgatggtattattttccttggtggtacaattactgaagaaatgaaagaattgataaatcaatcatctgtacctgtagtagtatcaggaacaaatggtaaggatgcacatatagcatcagttaatattgattttactgaagctgcgaaagaaattacgggagaattaattgaaaaaggcgctaaatcatttgctttagtaggtggagaacattctaaaaaagctcaagaagatgttttagaaggtttaactgaagtgttaaataaaaatggccttcaattaggtgatacattgaattgttctggtgctgaaagttataaagaaggcgtaaaagcttttgccaaaatgaaaggcaatttgccagatgccattttatgtatcagcgacgaagaagcaattggtattatgcatagtgcaatggatgctggtattaaagttccagaggaattacaaattattagtttcaataatacacgattagttgagatggttagaccacaactttctagtgttattcaaccattatatgatatcggtgcagtagggatgcgcttattaacaaaatatatgaacgatgaaaagatagaagaaccaaatgtagttttacctcacagaattgaataccgaggaactacaaaataaattcacaaaattaggcattcatctaacgacccaaattatatgggtgttggaagaatgccttttatttatcttttaaaatcgttgcagattaggttacttattgacgagtagattcgtaccaactcgctatatgtaaagctaattttttatttttttcactaatttcttttgtgcgggggacataggtataatcatttaaacgatcttcccatcttttaggtaataattcagatgaataatgtttccatttattaatccattctaacggtaaataaccactttgaattggttgatcaattaaacttaagaatacatgactccatgcacgtggtacgactctccaaatattgtagcctccgccaccaaacataattacctttccattcgtataagaatcagctaaatattttacaaaatatggaatttcatataatgaatgtaacgtacaatttagatgagttagtggatcacgataatgtatatcgacaccatttacgcttagaataatatcaggtttaaaactctttacgacaggctcaactgttaatttaaaacactccaaaaatgatgcatcttctgtatacggttcaagtgggacatttacagtgtgtccatagccgatatcttcaccgcgctcagtatagtgaccagagcctgggaaaagaaattttccggtttcatggatagaataagtagtaacatggttatcggcatagaaactccattgtgtaccatctccatgatgtgcatcggtatctatgattaaaacgcgttgattgtattctttagctaagtattgtgcggtaattgcaatatcattgtatatacaaaaaccacttgctcgaccaggttgagcgtgatgcaaaccaccacctaagtgacaaccatttaatactttgcctgacataataagatctgctaaagttaaagcgcctccaacaattgtggcactatggcggtgcatatgcttaaattgaccattctcttcatcatttaatccatatttcttagcctcatcttcactgataatgccatgtgaagcatgcttaatagcttcgacgtaatcatatttatgaattaacattaattcgtcatctgttgcaattctaggttgtactatttgttctggagacaataaatttgcattcaaaagtagctctgttgttaattttaaacgcatttgattgaagggatgttggtcatgaaatcgatattgtaataacttatctgaataaacatatgcagtttttgatgaatgttgttgcatataatccctccgatattccaaaaattaaaagaaaaaccgattcatataacgaatatcatcaaacgcttgttgctgttctaatgtaatgtttttgccaattcttgccattaaacaattagctggatgacttgttatttctggatcatctgtagcgaatatttcaagtccaccagttgccattaaccgctgcattaattttttatagtcaaatacatctaactttgaattttttaaatcccaatgccagtaatattctgtagttataacgatataattctcgaattctggtgtagaaaggctaagttgtatcagcttttctgcaagttgtaattgcctaaaattgatgctgacttcaattgcccccaattcgattaaatatggaagcttacctgtagaccagcgctcaatttcatcaggatagtggaaagtgacataacccacaatgagttgatcttggcgagcaacataaattctaccttctggtaatgttgtaatttctaacaaagctttatactgatcttcagcatctctaaatgcggttaaatgcgcatcgaaagtaagcgctttcaaatcttcgtgtgttaaaggaccttcaataacaaattgcttgtcatgaatgtaataatcttcggattgatacgtctttaaatgattcatattttcaactcctcaatcgacgtcgtgattgtattaaattcattatatagaaaatttacaataattaatactagaaaaaggataaaagtaaaaattttgaataattagaaatgttatgtataatattgagaaagaaagcgttttcacataacaaagggggagtttcaaatgaaagtcgaagtttataaaggagcgcaaggtaaacataaccttaaagattatgaagaaacatataatacttttgattggaaagacgtagaacaagcattttcttggagtgaaactggaaaaatgaacatggcatatgaatgcatagatcgccatgtagatcaaggattaggggataaaatagcgttaaattacaaagatgagcacagaaaagaatcgtatacttataaagatatgcaacggttatctaataaagcagcgaatgttttgtctgaacatgcagaagttgacaaaggtgacagagtatttatatttatgtcgcgtacacctgaactatattttgcgttgttaggtgttttaaaaattggtgcaattgttgggccgttatttgaagcatttatggaaaaggcagttgcggatagattagagaacagtgaagctaaagtgttaattactaataaggcattgttacctcgagtacctgtagataaattaccaaacttgaaaaaaattgttgtcgtagatgaggatgtagaagacaattacatagacttcattagtttgatggaaactgctagcgatgaatttgacattgaatggttaaagtcggatgatggtttgattttacattatacatcaggttctactgggcaacctaaaggtgtattgcatgttcaacaagcaatgttagtgcactatatttctggaaaatatgtattagatttacaagaagatgatgtttattggtgtacagcagatccaggttgggttacaggaacatcttatggtatttttgcaccatggttaaatggcgctacaaattgtatagctggtggtcgcttttcgccagaacagtggtatagtatgattgaagattttaaagtgacgatttggtatacggcaccaacagctttaagaatgttaatgagtgctggtgacgatattgttgagaaatatgacttgtcatcgttacgttcgattctatcagtaggtgagcctttaaatcctgaagttataaaatgggcgaaaaaagtatacggtttaacggtgttagatacttggtggatgacagaaacaggtggacatatgattgttaactatccaacgatggacgtcaagcttggctcaatgggcaaaccattacctggtattcaagctgcaattatcgatgatgcagggaatgaattaccaccaaatcgaatgggcaaccttgctataaaaaaaggctggccatcaatgatgtatcgtatctggaagaatccagaaaaatataaatcatattttattggagactggtatgtatctggtgattcggcatataaagatgaagatggttacttctggttccaaggacgtgttgatgatgtaattatgacagctggtgaacgagttggaccatttgaggttgagtctaaattggttgaacacgaagcagttgccgaagcaggaattattggtaaacctgatccggttcgcggtgaaataattaaggcgtttgttgcactgagaaaaggatatgaaccaacagacgaattaaaagaagaaattcgtatatttgttaaagaaggtttgtcggcacatgcagcaccacgtgaaatcgaatttaaagataaattacctaaaacacggtcaggtaaaattatgagacgtgtattaaaagcttgggaattaaatttagatgctggggatttaagtacaatggaataatgacatgaatgttattgaagatttttttcgaagaataaagggtgacaacatatttcatgtcaatgtttaaataatcgtttactttacgataagcaatataaagaactgttaacttgtgtcatatcatttcgtagaaagcatttgaaaatgatgacataacaataatggcatatctttatattgctttttatttttaatatgatctttggaagatgattattttaaataatagaaaaatatagttatcaatagtatcaagcgctaaaagttgtataatacaaaactttaataagtgaatttattgcaaaaatgaaagcgctaacccgatttagtcgacaagtttttaacagttcgttattatatgaatgtaagtaaaaatttcttagctacaacttacatattataaatgcataaattaaacaaaaaggggcgaaaaaagttgactcatttatcagatttagatattgcgaatcaatcaacactacaaccaattaaggatattgctgcatcagtaggtatttcagaggatgcattagaaccttatggtcattacaaagctaaaatcgacattaataaaattacgccaagagaaaacaaagggaaagttgttttagtaactgcgatgagcccaacaccagctggtgaaggtaaatcaacggttacagttggtttagctgatgcattccatgagttaaataaaaacgttatggttgcattaagagagcctgctttaggaccaacatttggtatcaaaggtggtgcgactggtggtggttatgcgcaagtcttacctatggaagatatcaacttacatttcaacggagatttccatgcgattacaactgcaaataatgcattgtctgcgtttatcgataatcatattcaccaaggtaacgaattaggaatcgatcaaagacgtattgagtggaaacgtgtattagatatgaatgatcgtgcacttagacatgtaaacgttgggttaggtggacctacaaatggtgtaccacgtgaagatggctttaatattacagtagcgtctgaaattatggcgattttatgtttaagtagaagtattaaagacttaaaagataaaattagtcgtattactattggttacactagagatcgcaagccagttacagttgcagatttaaaagtggaaggtgcacttgcaatgattttaaaagatgcaataaaaccaaacttagtacaatcaattgaagggacacctgcattagttcatggtggaccatttgcgaatatcgcacacggttgtaactcaattttagcaactgaaacagcacgtgatttagctgatatcgttgtaacggaagctggatttggttcagacttaggcgctgaaaaattcatggacattaaagcgcgtgaagcaggatttgatccggcagctgtcgttgttgttgcgacaattcgtgcgttaaaaatgcatggtggtgtagcgaaagataatttaaaagaagaaaatgtagaagcagtaaaagcaggaattgttaatttagagcgtcatgttaataatattaaaaaattcggtgtagaaccggttgttgcaattaatgcatttatacatgataccgatgcagaagtagaatatgtaaaatcttgggctaaagaaaataacgtacgaattgccttaactgaagtttgggaaaaaggtggtaaaggtggcgttgacttagcaaatgaagtattagaagtcattgatcaacctaattcatttaaacctttatatgaattagaattaccattagagcaaaagattgaaaagattgtgactgaaatctatggcggttcaaaagtaacgtttagcagtaaagcgcaaaaacaattaaaacaatttaaagaaaatggttgggataattacccagtatgtatggcgaaaacacaatattcattctcagatgatcaaacgttgttaggtgcaccatcaggatttgaaattacaattcgtgaattagaagcgaaaacaggtgcaggatttatcgtagcgttgacaggtgcaatcatgactatgcctggtttacctaaaaaaccagcagcattaaacatggatgttactgatgatggtcatgcaattgggttattctaataaatcatgtcaattgtttaataaagataagtaaatagtttaatagaccggactgttggagatgcattatttcagcagttcggttttttgctgtgctaaaaatagattcaatttggcgaatctaacgacaatgtttgaaggtggttaattaatgtatatgaagataaaaagtgggcttgaagaataggaaagcgatgcaatgaatattccatattaaaaaaaattaataaaataggttgcaatatttaattgggatgcgctacaattaacactaataattgatattgataattattatcaattaaatataatcttataggagttgttaacaacatgaacaaacatcacccaaaattaaggtctttctattctattagaaaatcaactctaggcgttgcatcggtcattgtcagtacactatttttaattacttctcaacatcaagcacaagcagcagaaaatacaaatacttcagataaaatctcggaaaatcaaaataataatgcaactacaactcagccacctaaggatacaaatcaaacacaacctgctacgcaaccagcaaacactgcgaaaaactatcctgcagcggatgaatcacttaaagatgcaattaaagatcctgcattagaaaataaagaacatgatataggtccaagagaacaagtcaatttccagttattagataaaaacaatgaaacgcagtactatcactttttcagcatcaaagatccagcagatgtgtattacactaaaaagaaagcagaagttgaattagacatcaatactgcttcaacatggaagaagtttgaagtctatgaaaacaatcaaaaattgccagtgagacttgtatcatatagtcctgtaccagaagaccatgcctatattcgattcccagtttcagatggcacacaagaattgaaaattgtttcttcgactcaaattgatgatggagaagaaacaaattatgattatactaaattagtatttgctaaacctatttataacgatccttcacttgtaaaatcagatacaaatgatgcagtagtaacgaatgatcaatcaagttcagtcgcaagtaatcaaacaaacacgaatacatctaatcaaaatatatcaacgatcaacaatgctaataatcaaccgcaggcaacgaccaatatgagtcaacctgcacaaccaaaatcgtcaacgaatgcagatcaagcgtcaagccaaccagctcatgaaacaaattctaatggtaatactaacgataaaacgaatgagtcaagtaatcagtcggatgttaatcaacagtatccaccagcagatgaatcactacaagatgcaattaaaaacccggctatcatcgataaagaacatacagctgataattggcgaccaattgattttcaaatgaaaaatgataaaggtgaaagacagttctatcattatgctagtactgttgaaccagcaactgtcatttttacaaaaacaggaccaataattgaattaggtttaaagacagcttcaacatggaagaaatttgaagtttatgaaggtgacaaaaagttaccagtcgaattagtatcatatgattctgataaagattatgcctatattcgtttcccagtatctaatggtacgagagaagttaaaattgtgtcatctattgaatatggtgagaacatccatgaagactatgattatacgctaatggtctttgcacagcctattactaataacccagacgactatgtggatgaagaaacatacaatttacaaaaattattagctccgtatcacaaagctaaaacgttagaaagacaagtttatgaattagaaaaattacaagagaaattgccagaaaaatataaggcggaatataaaaagaaattagatcaaactagagtagagttagctgatcaagttaaatcagcagtgacggaatttgaaaatgttacacctacaaatgatcaattaacagatttacaagaagcgcattttgttgtttttgaaagtgaagaaaatagtgagtcagttatggacggctttgttgaacatccattctatacagcaactttaaatggtcaaaaatatgtagtgatgaaaacaaaggatgacagttactggaaagatttaattgtagaaggtaaacgtgtcactactgtttctaaagatcctaaaaataattctagaacgctgattttcccatatatacctgacaaagcagtttacaatgcgattgttaaagtcgttgtggcaaacattggttatgaaggtcaatatcatgtcagaattataaatcaggatatcaatacaaaagatgatgatacatcacaaaataacacgagtgaaccgctaaatgtacaaacaggacaagaaggtaaggttgctgatacagatgtagctgaaaatagcagcactgcaacaaatcctaaagatgcgtctgataaagcagatgtgatagaaccagagtctgacgtggttaaagatgctgataataatattgataaagatgtgcaacatgatgttgatcatttatccgatatgtcggataataatcacttcgataaatatgatttaaaagaaatggatactcaaattgccaaagatactgatagaaatgtggataaagatgccgataatagcgttggtatgtcatctaatgtcgatactgataaagactctaataaaaataaagacaaagtcatacagctgaatcatattgccgataaaaataatcatactggaaaagcagcaaagcttgacgtagtgaaacaaaattataataatacagacaaagttactgacaaaaaaacaactgaacatctgccgagtgatattcataaaactgtagataaaacagtgaaaacaaaagaaaaagccggcacaccatcgaaagaaaacaaacttagtcmatctaaaatgctaccaaaaactggagaaacaacttcaagccaatcatggtggggcttatatgcgttattaggtatgttagctttattcattcctaaattcagaaaagaatctaaataattanctaaatatagcatatgtatgattaactttgtagac

SEQ ID NO: 311 - DNA, 1316 bp; double-stranded, linear
caacattaatattgatattaaatcttcctggataacgtgcttgttcgagtgataagtatgcacgcacttgacttaactctttatctaaagtaatcgtatgttgcttagagccttgtaaattcgctctgaaaaaataactcaattctaatagtaactctcgtgccttttcgctatttattctaactaaagctgagatcgtgttaattgaattgaagaaaaaatgtggactcacttgtgcctgtaatgacttaatctcagcatctttcaataacttactttgcgtttcggcttcaccaagttcaatttggctactaaaaatatttgccaatccttctgcaagttgacgttccacaaaagttaaatcattagggtttgtaaaatacatcttcaatgtaccgacgatagaaccatgcatctcaagtggtatcacgatagctgctctaagcgggcaattcggatgactacaaccaatctcttctttagtatgaacttctttcaactttcctgatttcaatacatctttagacagacttgttaatatttcatttgttggtatgtgatgatcactacctgcacctacatgcgataagatttcatttttgcttgtaattgctacggcagatactttcattaaatttttaataatcatcgcaatttgctgtgccgattctctattcaatccttctttaaaatacggcaatgtctggttcatcaattgcagtacatcatgtgtttgaacagccttcatttgctcctcttgctttaatgttgaaatgataatagacataaaaatcgccgtaccaacgctattaacaataatcattggtagtgcaattaatgatatgaggtcaaccgcatatgctttgtcgtgggaaaatgttaaaatgctcaacatttgaatcatttccataacaattccaatcatggcacttttcgcaatactcgggtaacgcttgcgtctttgagcttgtaagccaaaataaccagcaattataccaataaatatagatgagataagataaacttgtgcatccgccccacccatatacactctgaaaatacctgaaataacgccaacaaatagacctacaaaagggccaccaactaatcctgcgacacctatcgttaatacacgtgtgttagctaaagatacatcatcatctaaacggaagtacacacttcctgacaaactatgttgatgatcgatgacgataccagttaaattagacattaaggcaaacaaactgaaaataatacataattgccaacgtgctttccatgtacgtcgacgattcmttacgtttttacaatatggc

SEQ ID NO: 312 - DNA, 7972 bp; double-stranded, linear
tataaatattattttattatcgtttatcgctatttgtgttacataatcaaaaccataaattcttactcattcagatttacccaatatttttacttttataatgtaatgcgttttatccaagttattttttaaaaataaatattgaattnggggctgntttcatgtcattaagagatgaagcattggaaatgcacaaacgtaatcaaggtaaattagaagttaaaccaaatgtaaaagttactaataaagaggaattaagtttagcatactcacctggcgttgctgaaccgtgtaaagatatttatgaagataaaagaaaagtatatgattacacaattaaaggaaatacagttgcagttattactgatggaacagcggtattaggtttaggtaacattggacctgaagcaagtattcctgtaatggaaggtaaagcagtattattcaaaagcttcgctggtatcaatggggtgcctattgcgttaaatacaactgataccgaagaaatcattaaaacagttaagttgttagaacctaattatggtggtattaatttagaggatatttcggcaccacgttgttttgaaattgaagaacgattgaaaaaagaaactaatattccggtattccatgacgatcaacatggtacagcaattgtaacattggcaggtttggtaaatgcattgagagttgttaacaaagatattgctaaaataaaagttgtactaaatggtgctggtgcagcaggaatagccattgttaaattactatacgcgtatggtgtaagaaatatggttatgtgtgactcaagaggcgcaatttttgaaggacgttcatatggtatgaatcctacgaaagatgttgtagcaaaatggacaaataaagataagattgaagggtctttagaagaagtcgtaaaagacgcagatgtatttatcggggtttctgtagctaatgcgctgtcacaagatatggttaagagtatggcagataatccaattatatttgcaatggctaatccaaatcctgaaataatacctgatgatgccaaagcggcaggtgcacgagttgttggtacaggacgttcagactatcctaaccaaattaataatgtattagctttccctggtatttttagaggtgcattagaggttgaagctacacatataaatgaagaaatgaaaaaggcagctgtagaagcgattgctgatttaatcgatagttctgaattaaatgaagactactgtatcccaggaccgtttgataaacgtgtagcgccatcagttgctcgtaatgttgctaaagcggcaatggaatctggagtagctaggattgaagttgatccgcaagatgtgtatgataaaacaatgaaacttacagatttacaataaaaataattaacgtttaattaaattgcttaaaagttagcaataaagagtcattaaaatgatgaaaatgaaagtttatgataaacattcaacagtcaaacgaatataaatcaaataaatttaaacccgtttttaactggtcaagttcagtttaaggctctaaatggttagaacagaggttatttggaggttttcctatgtttaaagatttttttaatcgaacaaagaaaaagaaatatcttacagtacaagactctaaaaataatgatgtgcctgcaggtattatgactaagtgtccaaagtgtaagaaaattatgtacacaaaagaattagctgaaaatttaaatgtgtgctttaattgtgatcatcatattgctttaactgcgtataaacgtatagaagcaatttctgatgaaggatcatttacagaattcgataagggaatgacctctgcgaatccattagattttccaagttatttagaaaaaattgaaaaggaccaacaaaagacaggtcttaaagaagcagttgtgactggtacagcacaactagatggtatgaaatttggcgttgctgtcatggattcacgttttagaatgggaagtatgggatcggttatcggtgaaaagatatgtcgcatcattgattactgcactgagaaccgtttaccatttattcttttctctgcaagtggtggtgcacgtatgcaagaaggtattatttccttgatgcaaatgggtaaaaccagtgtatctttaaaacgtcattctgacgctggactattatatatatcatatttaacacatccaactactggtggtgtatctgcaagttttgcatcagttggtgatataaatttaagtgagccaaaagcgttgataggttttgcaggtcgtcgagttattgaacagacaataaacgaaaaattgccagatgatttccaaactgcagaatttttattagagcatggacaattggataaagttgtacatcgtaatgatatgcgtcaaacattgtctgaaattctaaaaatccatcaagaggtgactaaataatgttagattttgaaaaaccactttttgaaattcgaaataaaattgaatctttaaaagaatctcaagataaaaatgatgtggatttacaagaagaaattgacatgcttgaagcgtcattggaacgagaaactaaaaaaatatatacaaatctaaaaccatgggatcgtgtgcaaattgcgcgtttgcaagaaagacctacgaccctagattatattccatatatctttgattcgtttatggaactacatggtgatcgtaattttagagatgatccagcaatgattggtggtattggctttttaaatggtcgtgctgttacagttattggacaacaacgtggaaaagatacaaaagataatatttatcgaaattttggtatggcgcatccagaaggttatcgaaaagcattacgtttaatgaaacaagctgaaaaattcaatcgtcctatctttacatttatagatacaaaaggtgcatatcctggtaaagctgctgaagaacgtggacaaagtgaatctatcgcaacaaatttgattgagatggcttcattaaaagtaccagttattgcgattgtcattggtgaaggtggcagtggaggtgctctaggtattggtattgccaataaagtattgatgttagagaatagtacttactctgttatatctcctgaaggtgcagcggcattattatggaaagacagtaatttggctaaaattgcagctgaaacaatgaaaattactgcccatgatattaagcaattaggtattatagatgatgtcatttctgaaccacttggcggtgcacataaagatattgaacagcaagctttagctattaaatcagcgtttgttgcacagttagattcacttgagtcattatcacgtgatgaaattgctaatgatcgctttgaaaaattcagaaatatcggttcttatatagaataatcaacttgagcatttttatgttaaatcgatactgggttttaccataaattgaagtacattaaaacaataatttaatatttagatactgaattttaactaagattagtagtcaaaattgtggctactaatctttttttaattaagttaaaataaaattcaatatttaaaacgtttacatcaattcaatacattagttttgatggaatgacatatcaatttgtggtaatttagagttaaagataaatcagttatagaaaggtatgtcgtcatgaagaaaattgcagttttaactagtggtggagattcacctggaatgaatgctgccgtaagagcagttgttcgtacagcaatttacaatgaaattgaagtttatggtgtgtatcatggttaccaaggattgttaaatgatgatattcataaacttgaattaggatcagttggggatacgattcagcgtggaggtacattcttgtattcagcaagatgtccagagtttaaggagcaagaagtacgtaaagttgcaatcgaaaacttacgtaaaagagggattgagggccttgtagttattggtggtgacggtagttatcgcggtgcacaacgcatcagtgaggaatgtaaagaaattcaaactatcggtattcctggtacgattgacaatgatatcaatggtactgattttacaattggatttgacacagcattaaatacgattattggcttagtcgacaaaattagagatactgcgtcaagtcacgcacgaacatttatcattgaagcaatgggccgtgattgtggagatctagcattatgggctggattatcagttggtgctgagacaattgtagttccagaagtgaaaacagatattaaagaaatagctgataaaattgaacaaggtattaaacgtggtaagaaacactcaatcgttcttgtagcagaaggttgtatgactgcgcaagattgtcaaaaagaattatcacaatacatcaatgttgataatagagtgtctgtgttaggtcacgttcaacgtggtggtagcccaacaggtgcggatagagttttagcatcacgtttaggtggatatgcggtagacttattaatgcaaggtgaaacagctaagggtgttggaattaagaacaataaaattgtagcaacatcttttgatgaaatttttgatggtaaagatcataaatttgattatagtctatatgaacttgctaacaagttatctatataagatttcaggaggaattataaaatgagaaaaactaaaattgtatgtacaattggaccagcttcagaatcagaagaaatgattgagaaattaatcaatgctggtatgaacgttgcacgattaaacttttcacatggtagtcatgaagagcataaaggtagaattgatacaattcgtaaagtagctaaaagattagacaaaattgtagcaattttattagatacaaaaggtccagaaattcgtacgcataatatgaaagacggtatcattgaacttgaacgtggcaacgaagttattgttagcatgaatgaagttgaaggaacacctgaaaagttctcagtaacatatgaaaacttaattaacgatgttcaagtaggttcatacattttacttgatgatggcttaattgaattacaagttaaagatattgaccatgctaaaaaagaagttaaatgtgatattttaaactctggtgagcttaaaaacaaaaaaggtgttaacttacctggcgtaagagtaagtttacctggtattacagaaaaagatgctgaagatatccgtttcggtattaaagaaaatgttgacttcattgcagcaagtttcgtacgtcgtcctagtgatgttttagaaattcgtgaaattttagaagaacaaaaagctaacatttcagtattccctaaaattgaaaaccaagaaggtattgataatattgcggaaattcttgaagtgtctgatggtttaatggttgcacgtggtgacatgggtgttgaaattccacctgaaaaagtaccaatggttcaaaaagatttaatcagacaatgtaacaaattaggtaaaccagttattacagctacacaaatgttagattctatgcaacgtaacccacgtgctacacgtgcagaagctagtgacgttgccaacgcaatctatgatggtacagatgcagtaatgttatctggtgaaactgctgctggtttatatcctgaagaagctgttaaaacaatgagaaatattgctgtatcagctgaagcagcccaagattacaaaaagttattgtcagatcgtactaaattagttgaaacttcattagtgaatgctatcggtatttcggttgcacatacagctttaaacttaaatgttaaagcaattgtagctgctactgaaagtggttcaacggcacgtactatctccaaatatcgtccacattcagacattattgcggtgactccaagtgaagaaactgcacgtcaatgttcaattgtttggggagttcaacctgtagttaaaaaaggacgtaagagtacagatgcattgttaaacaatgcagttgcaacagctgttgaaactggtagagtatctaatggtgatttaatcattattactgctggtgtaccaactggtgaaactggaactactaatatgatgaaaatccacctagttggtgacgaaattgctaatggtcaaggtattggacgtggatcagttgttggtactacgttagttgctgaaactgttaaagatttagaaggtaaagatttatctgacaaagttatcgttactaactcaatcgatgaaacgtttgtaccttatgtagaaaaagctttaggcttaattacagaagaaaatggtattacatcaccaagtgcaattgttggtttagaaaaaggtattccaacagttgtaggtgtagaaaaagctgttaaaaacataagcaataacatgttagttacgattgatgctgctcaaggtaaaatctttgaaggatatgcaaacgtactataatttataaaaaaacgtctttccatttatcaacaatggaaaggcgttttttggttcatctggtattttatgacgtaattaataggttatttgataatgatagtgtatgaatggcaatctatataaatgtttatatcttttatacatgtacattatcaccttcaaactttcactcatattactttggaaatttattataaaatagaagtatggatgtatttctgaaatgatacattattaaatagatgagaaagtaaaagttttgagccaagtacgcaatttaatattataagttgcatataaaacaggatgggacataaatccctaaaaaaacagcagtaagataattttcaattagaaaatatcttactgctgttctctatttatacaatacttcgtattgaatggttcgctttcctagggtgccgtctcagcctcggtcttcgactggcactgctccctcaggagtctcgccattaatactacgtattaacatgtaattttacttttacatactttaaaaaaataaaacactttgcccaacttgcacataaatgtaaaattcaataaaatgaattttctgtgttgggtcccttcgtataatttaataaataccactaaactaaattaacgaggtgccttatgtataaaatttataacatgacccaacttacactaccaatagaaacctctgttagaattcctcaaaatgatatttcgcgatatgttaatgaaattgttgaaacgatacctgatagcgaattcgatgaattcagacatcatcgtggcgcaacatcctatcatccaaaaatgatgttaaaaatcatcttatatgcatatactcaatctgtattttctggtcgtagaatagaraaattacttcatgacagtattcgaatgatgtggttagctcaagatcaaacaccttcttataaaactattaatcgttttagagtgaatcctaatactgatgcgttaattgaatctttatttattcagttccatagtcaatgtttaaagcaaaatcttattgataataattcaatttttattgatggtacaaaagtagaagctaatgccaatagatatacatttgtgtggaagaaaagtattcaaaatcacgaatcgaaattgaacgaaaattcaaaaacattatatcgtgacttagttgaagaaaaaataataccagagataaaagaagatggagatagcgatttaacaatagaagaaatagatttaattggtagtcatttagataaagaaatcgaagatttaaatcattctattgagaacgaagattgtgctcaaattagaaaacagacccgtaaaaaaataactgagattaagaagttcaaaaagaaatttgatgattattccgaaagaaaaaataaatatgaagaacaaaaatcgattcttaaagatagaaatagtttttctaaaactgatctgatcatgatgcaacttttatgagaatgaaggaagaccatatgaaaaatggccaacttaagccaggatacaatttacaaatagcgacaaattctcaaaaatgttttatcctatgacctatttcaa

SEQ ID NO: 313 - DNA, 3175 bp; double-stranded, linear
attttttagttaattgtctttcttaaaataattttagctttcattaaattaaacaattttacaagcttggaacaccaatcaaaatcctaagttctaaaatgcaatattagtagtcgttgactgaatgaacatatgcttataatatttttttgcaatgctagtcaagttgatttatgctcacaaggatatgcgatttatattttcttacaacaatgaaaatgcctgatacaatgcgatcctttatactttcaagagttaaattagaaatgtatatcaagacacaagttgtatcaggcaaataattaaattattgttgttttaaccattgtactatcgtcggaatcataaatcctgttggcccttttggaccattatatgaagctttattagtcgttgctggacctgcaatatcgaaatgaatgtgaggtgtttgaccactaaaatgtgttacaaaacttgccgcaaatagcgctttaccttgtccattcgtatggttaactaaatcagcgatatcactgtgtttaatacttgcacgttcggttgcagtaatcggtaattcaaataccatttcatcgacttcagaacttatttgtaatatatcgtttaatatcactttactattcgattcaaatgcagcagctttatcatcgcctagtgcaacaattgctgcacccgttaatgtagcaaagtccataatcacactaggctgatattgatttgcataaaacacagcatctgcaaggactaatctaccttcagcgtctgtattcattacttctacagtttcaccacttaatgctgtaaatacatcatctggcttcattgatgcttcatttatcatattttcagcacacgcaagcactccgacaatatttacaggcagttgtaaacgactagccgcttcaatgataccaacgacattcgcagcgccacacatgtcaaacttcattgtagccatgccattcttcgttttaatactataaccaccagaatcatacgttatacctttaccaactaaggcaattggtgcttcatctttgtctttgccattatatgtgatggttactaatctcggtttatgcttactacctttacctactgcttgtaaaagtccgaatccttcagaaactaaagtgtcataatctttaacatctactttgacctttgtatttttaaaatgattaacaatatcttctgcaaatgtttgtggtgttaatacattcggtggcatattactaaagtctcytgccaaattaatggattggccaatactgataccctcatgaataaaatctaattcaattaatgattcactaataaggkttaaattcgtcttaaacggtgccttctkacttgrtttataatgatcgaatycatatgktgcacgctcactttggaataccgcatgccattaatacatctggataactggatccatattttgganataaatgaatccataagtaaatacgtatcttcaatgtgttctgactttatgtattggaaaagatgtccccatattttcaacatatcttgataatacgtgtctttaagtttcctaaaccaactgtaattaaacgatatgtttgatcttgtacatcaaatgcagttgtataaatcttcccaactttactaccaataatatgttgatgttttagtctttcaagtgattctgtaatatcgatatgattaaaactaatgcgctctaactgatttaaatgttctggtataccaataatcaatgtatttatttcgttgcttagtgtgttatttaatttaaaattcataatgtacctccttagatttgatatgttactcacttcaaattgtacaacaataaagccctcagtgacactgaaggactttataaatgaataatttaattttatgtgtttagctgaaactttatttaaagcctagaatttaccttttttgaatgctaaaccgataccaccgattttgaataccgcacgtgtatcaatcacttttttcatgaatgctgcttttttaccagcgataggtttaccaaataccatacctacaccgtcatgtgaacctaaagaacaaacagttccacgatcaacgtattcgaattcttcagttgattcaccgtttaagatgcgtttaatgtttttagcaacactttcaccttgttgcattgcaatttgtgctgtagttggtaatggacgttcttctccagctgggataaacgctgaacagtcaccaataacaaaaatgttgtcgtaaccattgattgttaaatcttgctttgtaacgatacgtccacgtttaacgccttcaaatgattcttccattaatttactaccacgtacaccagctgcccatactgaagtacctgcatttaattgttgtttttcaccatctacttcaactacaaaacctttttcgttacaagcaacgattggtgtagcaattttaaattcaacaccgcggtcttctaagtagctaactgcgtggttaactaattcttctgagaacattggtaacattttaggtgctgcttcaacacaagtgattttaactttattttgatccacaccatatttgctacataattcaggaattctgtctgttaattcacctaagaattcaacaccagtgaatccagcaccaccaactaagatagataaatcgttatcatctttttcttttgatgctgcatagttagcaaatttgtcttcgatatgacgtgataattcacgtgctgtgataacattttcaatttggaaagcatgatctttcataccttcgatgccgaatgtttcactaacgaaacctaatgctactactaaaatatcaaagtcataaataccttgatttgtttctacctttttagcatcacggtcaatttttgttacttctgcttgaacaaagttcactttgtctttcttcaagacactttccacaggatataatacatcttcatagtttagtgtacctgctgatgcttcatgtaaccatgttgcttcatagtgatattcatttttattaataagcgtaatttctgcttcttctgttgatatcgctttttgcaatttagttacagtttgtaaacctgcataaccagcaccaagtacaagtacttttttacgatcttgagccatttaattncacctaagcnttcatatttttttaaccaaatgctgataattac

SEQ ID NO: 314 - DNA, 702 bp; double-stranded, linear
catcattattaaagattttcaatcaatacagaatcacaatacgtacgcattgtgcacgataaaaatacagatgtgtatattaactatgaactacaagagcaactaacgaacaaagcttacattggtgatcatatttatgttgaagggatatggctcgaagtacaagctgatggtttaaatgtattgagtcagaatacagtggcatcgtcattaattcgcttaacacaagagatgccacatgcacaggcagatgattacaatacgtaccatcgttcgccaaggattattcaccgtgaaccgacggatgatattaagattgaaagaccgccacagccaatacagaagaacaatacagtgatatggcgttccattataccgccattagtaatgattgctttaactgttgtcatctttttagtgagaccaattggtatttatattttaatgatgattggtatgagtacagtaacgatagtatttggtattacaacgtatttctctgaaaagaaaaagtataacaaagatgttgaaaaacgagagaaagattacaaagcttatttggataataaatctaaagaaattaataaagcgattaaagcacaacgttttagtttgaattaccattatccaacggttgctgaaattaaagatatcgttgaaacgaaagcaccaagaatatatganaaaaccatcggcatcatc

SEQ ID NO: 315 - DNA, 4121 bp; double-stranded, linear
tatgttccgacaacgaaacaaagtgtaattacaagagcaaagataactttgaatgtttgtaaacgtccatctttaccttcagttaaatgcatgaacattaataattgargtcctgcttggacgaatgcaaagccaaagataattgtcaacttcgcgtggaatgttaatgacgtgtatagtgttacgtaaactgctaaaagcgttaatacgatagatgcgataaatcctacagtatgtttcattattgtactcatccgctatacaccatccctatcatatatacggcagtaaagatgaaaacccaaacaacatctaagaagtgccagtataaacttactataaataattttggcgcattatatttgtctaatccgcgtcgttggatttggattaataaacaaatggcccaaacgatacctagcgatacgtgacaaccatgcgttcctaataggataaagaaactagaccagtaagaaccaattgttgggttaacgccttctgatgcatagtgtgcgaattcataaatttcgaatccaacaaagactaaacctaaaagtaacgtaatgatcatccaaaacatcattaacttttgtttttcttggcgcatgtagtaaatagcaataccacatgtgtaagaactgaataataatgcaaacgtcattattaaaacaagaggcaattcaaataactcagtagtcattttacctgcataatcgccaccatgttgcaaagttaatagtgtcgcaaatagggtaccgaataacgcaaattcggctgtaatgaaaatccaaaagccaagcttatttaattcgccttcatgtgtgcgtgaatcaatagtgtttgtatcatgactcatgacttacagcctccctttctttaatacgcgcttctcttaatctagcttcagtttctgcaacttcagcagcagggatatgatatccgtgatcgatttggaaactgcgataaatcatagtaccaaaaataccgaataaacaaattaatgctggaattacagtttcgaaaattaagaagaaaccgccgatagtcataaagataccaatccagaatccaacaggagtattgtttggcatatgaatgtctttgtaattatggttgtctaagtaatgacgaccatgttctttcatatcaacaaatgtgtcgtagtcattccaatctggtgtaatggcaaagttgtatttaggtggaattgctgatgcagtagtccactctagagtacgaccaaggccatcccagttatctccagttgcttcacgtggagatttgaagtgactgtatacgatactaacaacaaggaataagaatccgattgccattaataatgcaccgatagttgaaattaagtttaataagaaccaaccatctgatggcatataagtgtataaacgacgtggcataccatctaatccaagaatgaattgtggtaagaaacaaacgttaaatccgatcatgaagaaccagaagcaccatttgtttaatgtttcgtttaatttgtaacccatcatctttggataccagaagattaaaccagctaagcaggcaaatacaacaccagtaaccaatgtatagtggaagtgagctactaagaagtacgtattgtgatattgatagtcagctgatgccattgctaacattacacccgtaacaccacctaaaaggaagttagggataaatgctaatgagaatagcattggtgactcaaatgtaatacgtcctttatataatgttaataaccagttaaacaatttcacaccagttggaataccaatcagcattgttgaaattgagaagaatgagttgattaacgcaccattacccattgtgaagaaatggtgaacccaaactaagaaactaaggaacgcgataccggcagttgcccataccatactttgatgtccgaataaacgcttacgagcgaatgtcgggataatttctgagtaaataccaaatgctggaaggataacgatataaacttcagggtgcccccatacccagaagaagttagcccaaagcattggcataccgccatgtgcaactgtgaagaatgctgtgtcaaatattctatcagttgtcattaatgctaacgctactgttaaaggagggaaagcaagaataacaattaatgtagtaataaatgttgttactgtaaacattggcatttgcataaacttcatagttggtgttttacatcttaaaattgttacaaagaagttgatacctgtagctaaggtaccaagccctgaaatttgtatagctattaagtaatagttaacacccggaccaggactgaattcacctgctagtggcgcatagtttgtccaaccagctgctggtgaaccaccaataataaatgacaggttgaataaaatcatacctgcaaagaatagccagaaacttacgttgtttaatactgggaatgcaacatcacgtgctccaatttgtaatggaacaacgatattccataaaccaaagataaatggcattgccatgaagataatcatgattacaccatgtgtactaaaaatttcgttatagtggttagattctaaaaatttgttatcaggtactgttaattgcgcacgaataagtaacgcatcaataccaccacggacgaacattaatacggcacagattaaatacataataccgattttcttatggtctacagatgtgaaccattctttgtaaagatatttccataatttaaagtaagtaattactgcgattaaaccaataactaagaatggggcaccaatttgtgccattgtaatcatccagttacctttaactagtaattgatcccatggaaaattcattaatgtccacctccatgatcatcattgtcttgatcttgcgcatcttttgaaattttcttcatttctttcgcatttttcgattcatctttcttgaactcattgttatatggttcgtcatttccaagaatcatcaacttcataccatgtcgtttatagttcgcatttgtaatttgagctttacgagcaggtattaatggtttgtctgatacatctttaaacatattttcttcactagtgaagtttggatctttcaattcgaaattgaaacgtttatatgcatagaagatgtattctggatcggctgctggatcaacaaacgccatatgtgtaccattaaattctaaagctttattaggtgtgcttggtaataattgtttatcaaatgtatcttgatctaacgttttcttacctttaacttctttcacccatttgtcgtagtctttttgactaacggcatttactttaaatgtttgacgtgagaatccttcaccattgaagttagagttacgacctctgaacgtaccagtttgagatgcttctaacgtccaattcattgtcatgccagtcatggcatatttttgaccacctaattgtggaatccagaaacttgtcattgtatccatagcttgaagcttaaatacaacaggacgatctttagggattgttaatgtattaacagtctctatatgttcatctggataagcaaagaaccatttgtatcctgcacttactgcatatacaaccattggatctttctcactcttcggtggtttttcgtaatcgtataaagttttaactgtaggaatagctaaagcagcaacgattatgataggtattacaaaccatattgtttcaatgatggcattatggtgcatcttaccagattcggcattcttattataactatacttgtaaataaaaatggcgaacatgccaagtacaacgaaacaaataacaagcatgaagacgattgaataaagaatcaagaacttctgactacttgctactggcccttttgcgttgaaaatttctatatttgaacaaccactaagtaaaattagtgtgccaaataatagaagcaaagacttaaattttgacacttttttgacctcctaatactacaaatgtagggcttaacattaattttaagttattacacaatatttacaagggcttatgggaaaaaaattaataaaattgtatcaaaaatgttgataaatcaaggtgtgacgtgggttcacacatttgttaaaattatgtgtacattttgtgactaatagcgttttt

SEQ ID NO: 316 - DNA, 9310 bp; double-stranded, linear
cgagtgagtacamacatatttttatttgcaaggggtaaatggcatataactatcttttttatgtaagctggtataaaatttatactaataggagggatagtatgaatatagtagggcatcatcacatatccatgtatacaaaagatgcaaaacgtaataaggatttttacacaaatgtccttggattacgattagttgaaaagtcggttaatcaagacaatccttcaatgtatcatttgttttatggggacgaagtaggtacagccggaacaattttaagcttttttgaaattcccaatgcgggtcataagcagccaggtactgaaacgatttatcgattttcattattagtaccaaatcaagcggcacttcattattttgaaaaacgtcttgagaataatggtattaagtctgaacgtttgtactatcttggacaagaaggtgttgtctttaaagatgaagacgacttagaaatcatattgcttgttaatgatagttttgaagtaccacatcaatggcaacataacgcttatagtgaaatacctcaagcatatcaaattttaggaatagggccagtcgaattaagagttagaaatgcagcgcgtacggtagaatttttggaaaatgtcttaggttatcgcaaaagagataataaatcattcgatgtgctgacattagcaccacaaggtttatattcggattttgtagttattgagcaacagggacaacgtgaaagacctggacgaggttatatccatcatattgcagttaatacaccacaaatgagtgacttagatgcaatttacaagaaattacaacaacaaccacaaagtaattcaggtataattgatcgctatttctttaaatcattatactatcgccataattcaattatgtatgaatttgcgactgaagcgcctggatttactattgatacacctgttgaacaattaggaagtcaattgaacttgcctgactttttagaagcagaacgtgaacaaattgaaagtaagttacacgaaatataaaggagaatgtttaatggccaaattagaaatgaataaaaatacgcctcttgagtttggtttgtattccttaggtgatcatttattgaatccattgaaaggtgaaaaagttagttatgagcaacgtattaatgaaattattgaagcaagtaaattagcagatgaagcaggtattgatgtttttgcagttggtgaaagtcatcaggagcattttacaacacaggcacatacggttgtgttaggtgcaattgcccaagcgacaaagcatattaaagtttcaagttcttcaacgattattagtgcacagatcctgtaagagtatttgaagacttcgcgacattagatttgatttctcatggtagagccgaaattgtagctggcagagcatcaagaacaggtatttttgacttgtttggctatgatttaaaagactatgatgaattgtttgaagaaaaattaggtttacttttagagttaaataaaactgagcgtattacttggtctggaaaatatcgtccagaacttagaaatatgaaaatattcccaagaccaatcgataatatattgccaatatggcgtgctgttggtggtccacctgcaagtgctattaaagcgggaaaacaaggtgtgccaatgatgattacaacccttggtggcccagcaatgaactttaaaggttctatagatgcttatcgtcaagcggcaactgaagcaggtttcgatgcttcgcctaagtctttaccagtaagtacagcgagtctgttttatacagctgaaacaactcaggatgctatgagagaattttatccacatttgaatacagggatgtcatttattcgtggtgttggttatccgaaacagcaatttgctaattcgtcagattatcgagaagcgctaatggttggaagcccgcaacaaattattgaaaagatattgtatcaacacgagttgtatggtcatcaacgttttatggcacagcttgattttggcggtgtgccatttgaaaatgttatgaagaatattgagttaattggcaacgacattataccggcgattaaaaagcatttatcaaaataggaggggcgtcatcatgaatattgtattattgtcaggttccacagtaggttctaaaacgagaattgctatggatgatttaaaaaatgaactagaagtcatcaatgagggacatcaaatagagttgatggatttacgagaacttgaattagaatttagcgttggaaagaattatctagatactacaggagatgtatataaattaacgacgtcgttaatgcaggctgatgtgatttttattggttttccaatttttcaagcttccatccctggtgctttgaaaaatgtgtttgatctacttccagtcaatgcgtttcgtgacaaggtaataggacttgtagcgacagcaggttctagtaaacattatttaattcctgaaatgcatttaaaaccaatattgagttacatgaaagcacatacgatgcaaacgtatgtatttattgaagagaaagatttttcaaatcaacaaattgtcaatgatgatgttgtatttcggttaaaagcgttggcacaatccacaatgcgaactgccaaagtacaacaacaagtgtttgaagaagaaaacaaccaatacgacttttaaagtataaaaataagacgctcggcacactaaatttgtaagtgtttgagcgtcttttcatattaactatatagccaatgaacgacgataaaggcaagtgatgacaagcatattgaggtaataatgattgtcataagcggtttaagtgcgcgatttttaagatctttaaatgcaacatttaaccctaaagcaaccatggccattaataagcaaattgttgatacagtatttaaaatatttagcaatgctgacggaatagttacatatgtattcactaaggccataatgacaaatccaattaaaaagtatggaatgcttattcgacccttgctagatgattctgatgaacggaaacgcataattaaaataagtacgatggttaatggaatcagtaagaatactctaccaagtttaccaagaagtgcaattttaagtgcatcactaccaccaaagccaccagctaagacaacgtgtgcaatttcatgaagactaacaccagaccaagcgccataaacatttgtcgtcattgaaaagatagcgtagatagctgtatatataagtgaaaatatcgtaccaatcaatgcgatgataccgatactaatagctgtatccttttcacgtgatttgaatattggagcgactgcggcaatagcagcagcaccacaaacgcctgtgccgacacctagtaataatgcgatgtttttgtcaccatgcaacagtttgttgacaaagagcatcattacaatactgaaaataacgacacctacatcgatggctaatagtttactaccttgaccgataatatcgaatatattgagtttaagtccatataggatgattgcaaatcttaataaatatttagatgaaaacgtaatacctgagctatattgttcaggatatcctctaaagtgacgatatagaatagcgattaatatcgcgatagttaatgcgccaaccttatctaggattggcaatttagctgctaaaaagctaaataatgcgactataaatgttagtgatagcccaatcataaaatgcttatttttcaatgatgccatgagcagtgcctcctttaatagcattttagcactgttttgtcgtatttttaaatataaatttggaatgaataataaagtagtgattaaattaagttgtgtgataggaaacttggacatcaatcaaagtaataggcactacaacgcttattggcggggccccaacaaagaagctgacgaaaagtcagcttgcaataatgtgcaagttggggatgggccccaacatagagaaattgggtccgtaatttctacagacaatgcaagttggcggggccccaacatagagaatttcgaaaagaaattctacaagcaatgcaagttggggaaggacaacaaatttaagatacaatgcgtaacattaatatgttattataatgataatttacagaattatatgaaaaatgaatgaggatgtgatggtatgtttggaatgaaagtgaatgaacaaataacattaaaaattttagaagctcatgacacagaagcgcttttcaatttagtcaatcgttcaagaaattcacttagggaatggttaccttgggtagatgcaactgagcaaccatcagatacgcgtgcatttattaaaagaggacttttgcaatttgctgatggtaatggatttcagtgtggcatttggtatgaaggaacgctagttggtgtcatcggtttacatgaaattaatcacatgcacagaaaaacttcattagggtactatttagataaagaatttgagggtcatgggattatgacacaagcagttgaggcattgataaagtattgtttcgaagagcttgacttaaaccgaattgagattagtgccgcagttaataatgaaaaaagccgggctattcctgaaaggctgggatttactagagaaggtatgttacgtgacaatgaattactaaatggtatttattcatcgagttacatctatagtttattaaaatcagaatacgaccaaaaatgacaaattagacttacaaaagagtgatgacatttaaaatggcagcgctcttttatttaatttttgaaaataaaaggttgttgacagtattattttataacaatataatgattttgataattattatcaactagatgatgtttatgggaggatgctttaaaacagccgttttaagtgtaatgtattattttagcgtgtagggaatgcgaaaataatatttataagaacacatctatggggataatagaatttctataatgaggtgtcaaaatgaaaaagttaacaacgctattattagcatcaacgttattaattgctgcatgtgggaacgacgatagtaagaaggatgattcaaagacatcgaaaaaagatgatggtgttaaagcagaattaaaacaagcaacaaaagcatatgataaatatactgatgaacagttaaatgaatttttaaaaggtacagaaaaatttgttaaagcgattgaaaataatgatatggcccaagcaaaagcgttatatccaaaagttcgtatgtattatgaacgctctgaaccagttgcagaagcatttggagatttagatcctaaaattgatgcacgtcttgcagatatgaaagaagagaaaaaggaaaaagaatggtcaggatatcataagattgaaaaagcattatacgaagataagaaaattgatgatgtgactaaaaaagatgcacaacaattattgaaagatgcaaaagaattgcatgccaaagctgatacattagatatcacaccaaaattaatgttacaaggttctgttgacctattaaatgaagttgcaacttctaaaatcacaggtgaagaagaaatttattcacatacagatttatatgattttaaagcgaacgttgaaggcgcacaaaaaatttatgacttatttaaacctattttagagaaaaaagataaaaaattaagtgatgatatccaaatgaacttcgataaagtgaatcaattattggataaatataaagataacaacggcggttatgagtcatttgaaaaagtatcgaagaaagaccgtaaagcatttgcggatgctgttaatgcattaggagagccactaagtaaaatggctgtgattactgaatgacaaattatgaacaagttaacgatagtacgcaattttcaagacgtacatttttgaaaatgttaggtattggcggtgccggtgttgcaattggcgcaagtggtgttggtagcatgtggtctttcaaatcaatgttcaatacaccagaagatccggaaaaagatgcgtatgaattttatggtaaagtgcaaccaggcattaccacacccacgcaaaaaacatgcaatttcgttgcgttagatttgaagtcaaaagatagagatgcaattaaggcaatgtttaaaaagtggacggttatggctgatcgtatgatggatggtgatacagttggcaagccgagtaacaatcctttaatgccaccagtagataccggtgaatcgataggattaggtgcaagcaagttaacgattacctttgggattagtaagtctttgatgaagaaaattgggttatctagtaaaattcccgatgcctttaaagatttaccgcattttccgaatgatcagttaatagacgattacagcgatggtgatattatgattcaagcatgctcaaatgattcgcaagtatcctttcatgcggttcataatttagttcgtccatttcgagatattgttaaggtacgttgggcgcaatctggttttatctctgctaaaggtaaggaaacacctagaaatttaatggcatttaaagatggaacaattaatcctaggaagaataatcaacttaaagattatgtgtttattgatgacggatgggcgaaacatggaacttattgcgttgtcagacgtattcaaatacacattgaaacgtgggatcgtactgcgctggaagaacaagaggctacatttggtcggaaacgacatagtggtgcaccgttaacaggtgggaaagagtttgatgaaattgacttaaaagcgaaagatagtcatggcgagtatattattgataaagatgcccatacgaggctagcgaaagaagcaaatacgtcaattttacgtagagcctttaattatgtggatggtacggatgaccgcacaggtaacttcgaaacaggcttactttttattgcttttcaaaaagcgacaaaacaatttatcgatatacaaaataatttaggtagtaatgataaattaaatgaatatattacacatagaggttctgcttcatttttagtattaccaggtgttagtaagggaggataccttggtgaaacattatttgactaaatttgtagcaatgctaataactgctgctatggtgtgtagctttgggttactgaaaagtcaggcagcagaacaacaaagtattagtgatgtatatagtgtgataacggatgcgaaatctgcactttctaataattcgatatcgaatgacaataagcagaaagcaattgagcaagtggtaagtgcagttaagaaattatcgcttgaagataatagtgaaagtaatgctgtcaaatcagatgtgagaaagcttgaagatgcaaaagcgaatgataatcaaaaagatacactttcgcaattaacgaagtcattaattgcttatgaagagaaattggctagtaaagatgcgggttctaaaattaaactattgcaacagcaagtcgatgctaaagatgctgcgatgacaaaagcgattaaagataaaaataaagcggaattagaatctttgaacaatagtttgaatcagatttggacaagtaatgaaacagtgattcgcaattatgacgcaaatcaatatggacaaattgaagtcgcattattacaacttagaattgcaattcataagtcaccattagatacggcaaaagtgtcacatgcttggacaacttttaaatcaaatattgatcatgtcgataaaaaaagtaatacgtctgcaaatgatcaataccatgtatcacaattaaatgatgcgttagagaaggcgattaaagctatcgacgacaatcaattgtcggatgctgcatgtgcgcttacacattttatagaaacttggccgtatgttgaaggtcaaattcaaactaaagacggtgctttgtatacgaaaattgaagataaaataccatattatcaaagtgtattagacgaacataataaagcacatgtgaaagatggtttagtagatttaaataaccaaattaaagaggttgttggccatagttatagcttcgtcgatgtgatgattatctttttacgtgaagggctagaagtgttgttaattgtaatgacattgactaccatgacgcgtaatgtaaaagataagaaagggactgcaagtgtgattggtggtgcaattgccggacttgtactgagtattatcttagcaattacgtttgtagaaactttagggaatagtggcattcttcgtgaaagtatggaagcgggattaggtatcgttgcggtcatattaatgtttatcgttggtgtttggatgcacaaacgttcaaatgcaaaacgttggaatgacatgattaaaaatatgtatgctaatgcgattagtaatggtaatttggtattgttagcgacgattggtttaatatctgtgttgcgtgaaggtgtcgaggttatcattttctatatggggatgataggtgagctagcgaccaaagattttattattggtattgctttagctatcgttattttaatcatctttgcattattatttagatttatagttaaattaatacctattttctatatatttagagtgttgtcgatctttatttttattatgggattcaaaatgcttggcgtaagtattcaaaagttacaattattaggtgcgatgccaagacatgttattgaaggattcccaacgattaactggttgggcttttatccaagttatgaaccattgatagcacaaggtgcttatattatggtagttgctatcttaatctttaaatttaaaaaataaaaaacaggccgagtgcctgttttttttgttgctatattggaaatattcggtattgcagtataacgataatcacagcattgattcgtataaggttaatgtgttggcggtttgcctcggcatgtgaacttaacgatgaacatactgaactcaaagagcaatatgagtggcaatgtgagtaatatatttaatgttaaatcgggtggtgcaatgatacttgctaatacaaagcaagcgaaataaatatatttacgrtaatgtttcaatgatgtggtatctataagaccgaattttgcaagacccataaataatattggtaattgaaatagaagaccaaatgtgaataaccaacgtatgagttcaatcaaatatgctttaaagccaatgacaggcgaaatgtttaaagttaatgataattttaacgcgaattgaatgatcattggaaagccaacataaaatgcaaaagcgacgccagcacagaataataacacgctgaaaaaactatatttataaataaattgacgttcattattatgtaatccaggtgcaatgaatgcccacaattgataaa

SEQ ID NO: 317 - DNA, 3458 bp; double-stranded, linear
attagtattacacactaatgtaaatagattggttggagaagagatatttgctaataagtgccttgctaataatgatgttcaaattatgaattcaataaaaaaattaattgaagctgagttattaacaacgactaatgattttgaagttagtatatataaaaagacaagacctgaattacaaagtattttaaaaagttttggtataaaaacaacaggtaataaacctgacttaattaaacgtattgacgacaattttcatattattaataacttagatttaccatatgtatatataccaattaagaaaggagaagaaattttaaagaaaacagagtacttaacctcttttatacaaagttatggtgaaatttctcttgagcgtgcttattatttggttgaaaactatatagatgaaaattgcgatgataaagttgcagaaatatacaagtttgaatttcaaagaaaatatgacaatggcgagtttgattttaatcatggatataatttcgaattgaatatgttgatagatcactataaaagagatgtaaaagactacgataatgccagaaagtattcaaatatttatctttactttggtttgagagatttcttaaaaaaattaatgagtaattattcatattacgatagtaaagggaatatagatttgaacgaaatacaaaacgatctgaatagatttatcaactctagcgcttctggtatgtacgagcgattaatatataatgaaaatttatccaataatattatgtttgaattatttaaaaaggacacacaagattatagtgatttggaagaacaattgattgaaaagttcataaactatgtagtgtctaatgtaaaaaaagaaagtaggagtaatactcttatagagttatcaaaaattttagagaacggatatacaattgataaagaagaatttaaaaaagaagatgattatctttctaagtacatatttactgacatagattatttgaaaaagttagaatcaaaaataaacgttgctattgatattcgaagtggagaaattcatttggtattagatgatgatagccttgatatattaatacaaaatcaaaaatacggcaatgagttttgagtcataactaaatataatatgttgaagagaggttttatttaaatggctaaaattggttatgatcgtgtatcaacgaaagattaatatcgatacacttaaagaatttgggtgtgggtgtgtatatagtgaaagaataagtggtgtcaaacgtacagagcttgttaagtgtttagattatttacgagagagcgacacattagttgtctatcaacttgatcggttaggtagaacgacaaaactattaattgaattatcacaatgattcgatgataacggaattgacttacaaattagtaacatgaacatttcaacgaaagacacaatgggcaaaatgttttttacgatgatgagtgcatttttcaggattagaagttaatttactatgtgagtgtataaaatagacttagcagcaacaagagcgagaggccgaaaaagcgggcgcccctctttaccagagaataaaaaatgagaaattaaatttttatatgatgaacaaacgataacaggggaagaaatagctagttagacaagggtatgtcactcaactgtttatcgagttgattaagaaatgaaaaaacttatactatgaattactgtttaaaagtgtgcatgttataatatttattgagcaagttggatagatggtggctaatctcttaataaaggggtgatgcctatggttatagttgttactcctagnaaaggactagcatgtctgattttgaaatgcttatggttgtattaacaatcattggtttagtattgattagtactcaagaccataaaaaataaccttctattcgctttgaccggcatttttgaaggctatttttaaataaaatataaggtcaccgtctttttaacgggctcattagggtaacatgtttccgagtgttgccctttttgtgtttcaagagttaatgattttcatcttttgcttctacttgctacaaatatattttaacacatttttcttatgaattgtagttctgaacataatcagaattaataaaaccaactttccatacagcagaaaatacaattaaaagtatagaatgtaatcacgaattatataaaaagtattggagacctcttcatatatagataattcacttagttattttagaaagaagcccctaacaactaaagttgaaaaatagaggaacacagttggattacgcatcaactgcataaggcccctaamaactaaagttgtaaggggcyctaaaatttattttggttgattgtcttctggtttatctgaagtcattgtttttgttgtattatcatttaatgaatcttgtgctttttctgtttttgtttcaacagatgttgtcactttatcattttctacttttgtattttttggttcagtgacaacttttttattcttgtcagctgtttttactttatctttagtaattttttgaccacgttttaagtaatattgaacgatacccattaaaatgattgcatgaataacaacgaataaaataattgtcattactgtataaactcttatgatattttctgcaacactttgagagagtgattgcgtattaaatgaaatcaagtaaccaacaggtgttttaaataaaataataattaagtttaataatagtattccaatgaaaaatttgaaaaatgttttttgaccatttttcattgctttaaatccattagctaagtgtgtttttactttatcgttagttgattcaacgaaactagtcataaagttgaaaataggtattaacaataaccaagtaataattgctttaatcaataaaacaacaatgattatgatgctttgagttgtaatagcaataccaatcaggtgtgtactatctgcatatgatgattgtactgaattcataatcatttctgatactggagaaaataatttgtatagtaatgatgtcagaagtgaaagaacgataatcattgctatagatacaagaccgatcagaacgctctttaaataattaccttttttaaatgcaataaataaatcggtaaattttactttttcatgactcattgctcgtttcataacatttgtaattccgataaaaatttgaactaaaacaaacagtgaaactacagctgctataagtaatacagcgataacttttaaatatgcatctactggtggtttttgcccaaattgtgaataaattgcaatagtttgtgcatacttagcaagctggaaattagcaagtaaatatacaactgcaattacagcaaatgctataagtgcatatatcaatgttattaataattgtggtttagcatttttaaatgctgatttaaagtaagtaaacaaagtggtgcctccttttcttca

SEQ ID NO: 318 - DNA, 695 bp; double-stranded, linear
gcttgcaagatgctttcattaaagacaaagtcatcgatattatgaatatgttccaaaatcacactgatatcacttatacgttgaataagtctcatgcacatattatatgtacgccagaaatatttgctaaattgttacatacgattgcaactagaaatatcgacattctatctgccaattatagatcgtcatctatgagcaaagctcgtatatcataataaaagacacatctatacgatgatcatttacaatgattgcgtatagtgatgtgtctttttttgtattatttatcttcggacgattgatcctcaaccatttgttcaaatgcttcacgaacttgtggtactgtcatacctactacaacttggatactcttaccactctttactaatccgtgtgccatttgttgatgcgtgaaatattccgtatctgcaactttactttcatcataaacagttaagcgtaatcttgttgtacagttagtaacatctttgatattttctttgccgcctaaaccgtcgaggtaatatgcagctttgtcttcgtattcattaccagatgaagcacgtttagaatctacgctatcaccttttttatttttgtaatcttgcttagaaaataatttaacttcctcttctgtttycttacgtccaggtaatggaatatcaaattycaaaattaagaatctgaataag

SEQ ID NO: 319 - DNA, 875 bp; double-stranded, linear
aatattgatattatatatagtcgaatcaatgatgacccacatcgacctaatgcaaataataagacaatcaagcagttaaatgacttgtattgctcgcggaatttaagatataatgaaatcgcattcaagaaatttgatagtcatttgctatcaatttcagaaatatattatgaattgctaaatttaataaaagcgagtgatcagtattagagagaatagagcgttaagactctatcgccgaagtgcaagtaatttattacgaaactctcaggcaaaaggrtaatactgtaacgcgttcctgaattggtgatttataaacagggtagcgattgctatcctgtttttataattttaagggggtatttcaatgtcaagtgatttaaaacaaacacctttatatcaaaattatgttgatagaggtgcaaaaattgtggaattcggaggatgggcgatgcctgttcaattttcaagtattaaagaggagcataatgctgttcgatacgaaattggcctgtttgatgttagtcatatgggtgaaattgaagtaacaggtaaagatgctagtcagtttgtgcaatatttattatcaaatgatactgataatttaactacttcaaaagcattatatactgctttatgtaatgaagaaggcggtattattgatgatttagtaatatataaattagctgacgacaattatttattagttgttaatgctgctaatactgaaaaagattttaattggattttaaaacacaaagagaaatttgatgttgaagtacaaaatgtatcaaaccaatatggtcaattagcaatacaaggaccaaaagctagagatttaattaatcaattagttgatgaagakgtaactgaaa

SEQ ID NO: 320 - DNA, 5897 bp; double-stranded, linear
tctttttacgaaggctaccgtttaggatctgataacttaactgtaggagaaattgtatttaatacagcgatgacaggttatcaagaaactatttcagatccatcatatacaggtcagatcattacttttacgtatccattaatcggtaattatggtatcaatagagacgattttgaatcattagtacctacattaaacggtattgtagtgaaagaagcgagtgcgcatccaagtaattttagacagcaaaagacacttcatgacgttttagaattgcatcaaattccagggattgcaggtgttgatacaagaagtattacgcgtaaaattcgacaacacggtgtgttaaaagctggttttactgatcgaaaagaagatattgatcaacttgtcaaacatttacaacaagtagaattacctaaaaacgaagtagaaatcgtttcgactaaaacaccgtatgtttcgacaggtaaggatctaagtgtcgtacttgtagactttggtaagaagcaaaatattgttcgagaattaaacgtcagaggttgtaacgtcacagttgtaccatatacaactactgccgaagaaattttagcaatggctccagatggcgttatgctatcaaacggaccaggtaatcctgaagttgtagaatgtgcgattccaatgattcaaggaattttagggaaaattccgttctttggtatctgtctaggacatcaactttttgcattatctcaaggagcaagctcatttaaaatgaagtttggtcatcgtggtgcgaaccatccagttaaaaatttagagactggaaaagttgatattacgagtcaaaaccatggatatgcaatagatatagattcgttaaaaagtactgatttagaagttactcatcttgcattaaatgatggtactgtagaaggtttaaaacataaaacattaccagcattttctgttcaataccatcctgaagcaaatccaggaccgtcagattcaaactatctatttgatgattttgtagcaatgatgactaattttaaggaaaaggagcgtcatatcaatgcctaaacgtaatgatatcaaaacaattttagtaatagggtctgggccaattatcataggtcaagcagctgaatttgattatgctggaacacaagcatgtctagctttaaaagaagagggatatcgagttattcttgtaaattcaaatccagcgacaatcatgactgataaggaaattgcggataaagtatatatcgaaccgttaactcatgattttatagcgcgaattatacgtaaagagcaacctgacgctttacttccaactttaggtggtcaaacaggtttaaacatggcgattcaactacacgaaagtggtgtgcttcaagataataacgtccaattattaggaactgagctaacatcaattcaacaagcagaagaccgtgaaatgtttagaacattaatgaatgatttaaacgttcctgtaccagagagtgacattgtaaatacagtagagcaagcctttaaattcaaagagcaagtgggatacccgctaattgttagaccggcatttacgatgggtggtaccggaggcggtatttgtcataatgatgaagaattacatgaaatcgtctcaaatggtcttcattatagtccagcaacgcaatgtttattagaaaaatctatcgcaggttttaaagaaatcgaatacgagtaatgcgtgataaaaacgataatgccatcgttgtatgtaacatggaaaatattgatccagttggtattcatacaggcgattcaattgttgtggctcctagtcaaacattatcagatgttgagtatcaaatgttacgtgatgtttcattaaaagttattcgagctttaggtatcgaaggtggttgtaatgttcaattagcattagatccccattcattcgattattatattatagaagtaaatccgcgtgtatcacgttcatcagcgttagcttcaaaagcaacaggatatcctattgcaaaattagctgctaaaatcgcggttggtctaacattagatgaaatgttaaatccaattacaggaacatcttatgcagcgtttgaaccaactttagactatgtgatttcaaaaataccaagatttccttttgataaatttgaaaaaggagaacgagagcttggcacacaaatgaaagcaacaggtgaagttatggccattggtcgaacttacgaagaatcattgttaaaagcaattcgatcacttgagtatggtgtgcatcacttaggattaccaaatggtgaaagcttcgatcttgattatattaaagaacgtatttcacaccaagatgatgaacgattatttttcatcggcgaacaattagaagaggcacaacattagaagaaattcataatatgactcagattgattacttcttcttacacaagttccaaaacattattgatattgagcatcaattaaaagagcatcaaggtgatttagaatatcttaaatatgcaaaagattatggatttagtgataaaacaatagcgcatcgctttaatatgacggaagaagaagtatatcaattgcgtatggaaaatgatattaaacctgtttacaagatggttgatacttgcgcagctgaatttgaatcttcaacaccatattattatggtacatacgaaactgaaaatgaatccatagttactgacaaagaaaaaatcttagtattaggctctggaccaattcgaatcggccaaggtgtagaatttgactatgcgacagttcacgccgtttgggcaattcaaaaagcagggtacgaagcgataattgtgaataacaatccagaaacagtttcaacagacttctcaatttctgacaaattatactttgaacctttaactgaagaagatgtgatgaatatcattaatttagaaaaacctaaaggtgtcgttgtacaatttggaggacaaacagcgattaatttagcagacaaattggctaaacatggtgttaaaatacttggtacttcactagaaaatctaaatcgtgctgaagatagaaaagaatttgaagcactattaagaaaaattaacgtgccacagccacaagggaaaacagctacatcacctgaggaagcattagcgaatgctgcagaaatcggatatccggttgtagtaagaccttcttatgtattaggtggtcgcgcaatggaaattgtagacaatgacaaagagttagaaaactatatgacccaggctgtaaaagcgagtccggaacatccggtactagtcgatagatatttaactggtaaagaaattgaagttgatgcgatttgtgatggagaaacggtcattattccaggaatcatggaacatattgaacgtgctggtgtgcatagtggtgactcaatcgctgtatatccaccacaaactttgacagaagacgagttagcaacacttgaggactatactataaaattagctaaaggtttaaacatcattggcttaatcaacattcaattcgttatagctcacgatggtgtgtatgttttagaagtaaatccacgttctagtagaacggtaccattcttaagtaaaattactgatattccaatggcacaattagctatgcgagcaatcattggggaaaaactaacagatatgggttatcaagaaggggttcaaccatatgctgagggtgtctttgtgaaagcaccagtatttagttttaataaattgaaaaatgttgatattactttaggacctgaaatgaagtcaacaggtgaagtgatggggaaagatactacattagaaaaggcgttattcaaagggttaacaggtagtggcgttgaagttaaagatcacggtacagtattaatgaccgtcagtgacaaagataaagaggaagttgttaaattggcacaacgcttaaatgaagttggctataaaattttagcaacgtctggaacagctaataaattagctgagtatgacatacctgcagaagtagtaggcaaaattggtggcgaaaatgatttattaacacgtattcaaaatggtgatgttcaaatcgttataaatacaatgactaaaggtaaagaagtagaaagggatggcttccaaattagacgtactacagttgaaaatggtattccatgtttgacatctttagatacagctaatgccttaacgaatgtaattgaaagtatgacatttacaatgcgtcaaatgtaaatcaatcaaactgtatcggtggggctgtaattaaccatttacttaaagaagtttatattacagcctcattattttaatgaatttcttaatataaagggagacatatatgatgaaagatttaccaattattgcattagattttgaatcaaaagaaaaagtaaatcaatttttagatttatttgatgaatcattattcgtaaaagtaggtatggaacttttttatcaagaaggtcctcaattaattaatgagataaaagaaagaggccatgatgtatttttagatttaaaactgcatgatattcctaatacagttggtaaggcgatggaaggactagctaaattgaatgttgatctggtaaatgttcatgctgctggtggcgtaaaaatgatgtctgaggccattaaaggattaagaaaacataatcaagatacaaaaattattgcagtaacacagcttacgtcaacaacagaagacatgttacgacacgaacaaaatatacaaacatcgattgaagaggccgttttaaattatgccaagttagcaaatgcagctggtttagatggcgttgtttgttcacctcttgaaagtcgtatgttgactgaaaagttaggtacatcatttttaaaagtaacaccaggtattagacctaaaggtgcatctcaaaatgaccaacaccgtattacgacaccggaagaagcaagacagcttggttcgacgcatattgtagtcggtagaccgattacacaaagtgacaatccagtcgaaagttatcataaaattaaagaaagttggttagtataatggctaaagaaattgcaaaatcattattagatattgaagctgtaacattatcaccaaatgatttatatacatggagttcaggtattaaatcaccgatttactgtgataaccgtgttacgttaggttatcctttagttcgaggcgcaatccgcgatggtttaattaacttaattaaagaacactttcctgaagtagaagttatttctggtactgcaacagctgntattccacatgcagcttttattgctgaaaaattaaaattaccaatgaattatgttcgttcatcaaataagagtcatggtaagcaaaatcaaatcgaaggtgctaaaagtgaaggtaaaaaagtagttgtgatagaagatttaatttcgacagggggatcttcagtcacagcagttgaagccttaaaactagcaggtgcagaagtattaggtgttgtagctatctttacttacggtttgaaaaaagcagatgatacatttagcaatattcaactacctttttacactttaagtgattacaatgaattaattgaagtagctgamamtgaaggtaaaatttctagtgaagatatccaaacattagttgaatggagagacaacttagcataatatagacactagaaggaggaattcaacaaatgaatgacaaaacatctaatgatttatatgggaagataaaacattgtaacgaatttatcaatcattcaaatgattccaatctatctagtagtcacgatgtcgacgaaagttcaacgaagcaaaaacatataaaaaataaaacaactatagatcataatgatgatttatttaaacatgtaaaggatatattacgtaaacaaggacaaatttaaaaacaaaaaagct

SEQ ID NO: 321 - DNA, 7965 bp; double-stranded, linear
tcattctaaatcaacttattttccattgcataaattgctgcttgtgtacgatcgctaacttgtaatttactaaatatatgactgacatgtgttttaattgttttttcagatacaaataaagtttctgcaatctctttatttgttttacctttaaccatttcacgtaacacttcaatttctctctttgacaacttattcgtgtagtgtggtttttggctaactgtttcgaatacatcttgtgccttaggatgtatcattttttcaccgttcataactcgtctaatagtttcaattaattgctgaggctcaacgtctttcatttcataaccatcagcacctttattgattgctgaaattacatgttcatcatcaacataacttgttaataccaaaactttaatatccggataatgtgccttaatatattccgtaatttcaataccattcatgccaggcatcactaaatctaatagcacaatatcagggtgctcatgctcttttaaatattctaaaaatgtttctccatctgcaaagtcttgtaaaacttctatgttttcaatcgtggataataaaaatcgcaatccttgtcgcacaatataakggwcatctactaatatnactttgttcatgggttatctccttaaatcaagctattttataggaattgtgaattgtatttgtgtaccctttgttggctgagaatgaaaggtcactttacctcttaataatttaactctttgttttatgttattaataccgtgtgatgaagctatctgaacattatcgatctcaaatccttgaccataatcaatcacgtcaatatatagtatatcgttcatttgttttaatgtaagatccattttattcgtatcagcatgtttcttaacattattaatacactcttgtaatgctctgtatatgttttcttcgatttcattagataaatcgattaaaccttctacatttacatttaattgtatatgcattaatttactatatgctgtcaaagcatgaattaaaccttgctcaagtccaactggcttaagtngccaaatcaatgcacgcatttcattaacggcattttgactcgtttcctcaatcgtcttgaatgcttgtttagcgatggattcgtttgacatgccatacgcagcatgtgctgttagttttacagaaaataacatttgatttactgaatcatgtaaatctctagctaaacgattacgttcattaatttttgccgcttctttttcacggtctgttaaataaatacgtttgatggctgaccctaattgaaatgcgacagactctagcaactctaaatcttcatcgctatatatttcagtatttggagacgctacatttaaaatgccgaattgttcttgacccgatttaagtggtaccgttgcatgatgtgtaatattgtcattttggctaggaaatgctttagaggctaagttaatacgagaacaattgacgatattcgacgctttcattagcctacgttgattaaatgctttcacacaccaacaagacccatctttaatatagtgacagtggtctgctgtcaaagattgtggtagagccacatgtgatacaagttcatgttcacctacgctattgatgaaaaatatccagcctgtcgtgaaattactgccctcaattaaatattttaacgcaccttgggtcatgctatacatttcrgtttcttcgtttaaaaattcggcaatctcttttaataaagctagtcgcgtcctttgttccatcaaatcgctccaattcatttttacgtgtattaactattatacattgagttattatatttttaaatcttagacgtaaacatgataaaatggccttgattactcaatagttatatttcggagaactgatttgtgatatgatattaaagactataggaggattttatgaaatttaaaataccagaaaactttaatgacttaagtttacgagatattttccaacaacttaaggtacctaaaaaagatttacatcatttaaatatgtctaaagatattactattaatgataaacctgcgcgattaatggataaagtgcatactggcgacgatgtatttgttccaaccatcgatgaaaaaagtaattatgttccaagttatcgttatgcacaaattaaatacgaagacgatgatatggcaatcgtaatgaaacctaaaggtgttaagactcaccctaatgatttaaaagaaagcaatactttaatgaatcatgtgatttacactattgatagtgactatgtcgaaccaattcatcgactggaccaggaaacagtaggattattaattgttgctaaaaatcctttaatgaaaaaaattcttgatcgcatgttagaagacaatgatattacgcggatatacaaagcaaatgttaaggcacttttacctttaaaaccacaaacgattgatatgccaattggtaaagataaattccattcgaataaacgacgtgtgtctcctactggacagcgtgcaattacacacattttaacttcaaaaatgataaaagaagctgtgtgccmacttgaaatcaagttggatactggacgtactcatcaaatwcgtgtgcatttagctgaaattggtcaccctgttattggtgatcctttatatggtgattcaacgttaagacaattagaacttgaaagttacaaaatagagtttgtgcatcccttgactaaggaagtcatttccgtttctttggatgactaatttgattagttttgcatgatatttaaacatgcaataccgcattgtaactaaatcaagtatcaacttaaacggatagatggaaaattattaattttttcagatgttcggtttttttgttttttacgatgcttaggattttatattttgatattttagtaattattcattttataacatccttggataatgacttgtagtctttttcaactgcgttacgtgtatctatggacaatacatgacatcataagatttttatcacaggttgtttggccaatacatgtacaacaattcatcatataaaaaataggttctataataaaacggactccatgaaaagtttttccttttcatggctctatatcaaatcagacttataagttcaatttgacatagacaaaaaataaagcttgaacactacatctacctgtaatgcccaaactttattttatattaatatttaattaatgaggatctaccatatcttctggtttaatccatgcttcaaattgttcttctgtaacatatccagtttgaattgcagattcttttaaagttaaaccttctttatgggctttcttagcaatttgagctgctttttcataaccaatatgtggatttaatgcagtaactaacattaatgattgatttaaataattatcaatattctcttcgattggttcaatgcccactgcacaattgttattaaatgtttccataccatcagctaaaagataaattgattgtagtgtattatgcataataactggtttataaacattcaattcaaagttaccttgtgaacttgcgaaccaacaactgtatcattacccattacttggactgcnaccattgttaacatttcacattgtgtaggattaactttaccaggcataattgatgaacctggttcattttcagggatagaaatttctgccaaaccagctcgtggccctgaagccaaccatctcacatcattagcaattttcattaagtctcctgctaatgccttcaatgttccatgcaattgaacaacttcatcatgcgctgtaagtgcgtggaatttattttcagaagatacaaatggataacccgtattttctgaaatataatgtgccactttatcaccaaattcaggatgcgcattaataccagtaccaacagccgtaccaccgatggcaagatttaaaatgtgcttcttagattcagataacattgtttcacaacggtcaagcatataacgccagccactaatctcttgtcctagtttgatcggcgttgcatcttgtaaatgtgtacgaccaattttaataattgaatcaaatttatcttctktttctttcaaagtatttcttaaaagttttaatgcaggttctaattttgtttcaacctcttgatataatgcaacgtgcatagcagttgggaatgtatcattcgaactttgagattyatttacatcatcattkgggtggatactttcatcactttgatgatcttttaaatacatattagcaacataacttactacttcgttcacattcatattactttgtgtaccgcttcctgtttgccatacaactagtgggaagtgttcatctaattcacctgataaaatttgatcacatgcgtatacaatggcatctttctttgcctcgcttaattttcctaaatcaaaattagctattgctgctgcacgctttagttgtgcaaaaccataaactacttcgattggcatacgctctttaccaactgggaaattacgtttacttctttctgtttgagcaccccaatatttatctgcaggtacttctatttctccaaaagtatcatgttcaattcttactgacattcaatttctccccttatcactgtttatttaactgtagtatatcattaaataatttaattgagcaatttatgattaaaacgttttcataatttgaaataaaaatacactaatcgcacgtgttcaccctttattacagtgatacggtcatacgattagtgtgttatctatcattatttagttattattgaactaagtttaattacgatactttgttttagtagcttcaaccgtagcaatagctgtaagtatatataatacagcactaacaattgtcgtatatggatttagagcaacaagcgtacctaaaactcctgttaaactcgcataaaacccatcaagtgtataatacaatattgctgttattaataaacaacaaattacactgattacaatacctgattgattacttttaatgaatgtttgcgcattaacatcatcaattaatccttttgataaattgagttgtaattttattactttgaaaataacaggtaaatataatgccccaattgccaatggaaaagctttaattgatattaaacttataataactgttgctatcaataattgaatccagtattttcctaacataaatatataaatctcctctaatttcattcttcaatagcatatcataatcttggcatattaagaaacgcggtttaatgatttcattaaaaatattactgatagatgacttctttcaattatgtctggagtaattaattatcaattccgtttaaatggtgttttaatatttaaaattgaacttttgatatattactatgtctggtacacaaatcaatgttttatgctttacaaagttatattggcagtagttgactgcagtccacaacatagaggcttcggaatgtcagcttctatttcatgcaagttggtggagctccaacatagtggaattggattcccaatttctacagacattgcaaattggggaaacgggccacaaactcagaaactggtggaaagtcagcttaaaataacatgcaagttggcgaggccccaaaatagtgagatcggatttctaatttctacagacattgcaaattagggaaacgggccacaaactcagaagttggtggaaagtcagcttaaaataacatgcaagttggcggggccacaacatagaaaaattggatcctcaatttctacaaacaatgtaagttggggaaacagccccaacactgaaactagcagaaagtcagcttctatgaatataataaaaaagctaggtaacaaaatgctacctaacttcatattcaagataatcaatcctatttgatatatgttctatactatacattatttacatgataaataactgaatattacacaattataatactttactgactgtcttcttcagaattcttttcttgatcattttgatcagagatttgttccatttctttacctaattcttttaaatcttcaaaatccgttaccatactgttttcttcttcatgataatttaattttggatctttgtctttagacataatcaatacctcacagatttttaattaagcaaagcgtgacgtaaagtaagctttaacatcttcaggtaaacctgcagccgcttctttatcaagaataacatttaccattctatgtgcttttaaatcggctggttcgaagcttgttttaccattttcttgatataatttttcaactacatctcgtttattagcacctgtcactactaagaaaatttctcttgcttccattagtccttgacgaatactaacatttaacttaccttgctcatcgatagaaacaacttgtaatgttaatttccctttattttctttagttttaatcttatcagcgattaattcgattgcatctttttcataagcaattggataaacttgacctgctggtacacctaacgcttcgaaatatgattttttatcgtcataatctaaaatatttatttggctaaaatcaacagcatgtttttcaacatttttctttaattcatctagaactggcgcttgatctgtatctaaatgaaaacctgcaattgtagtaggattattgttaaattgctttctaataatatcagcagcatattctgctacaagttgactattgtcaaagactttaaagttcattgccatgatttctacactcctcttagtttgcattttacataaaaacggcgatattaataattattataccctaactttcaatatatcaaaccatttaactttaacatgcttatactctaaatatagcacttaagcatcatttttataatgaaaatgagtaaattttaattcaatcccggraaatcttgttgacgtaacgcttcataaattaacaacgcagcagtatttgataaatttaatgaacgaatatgttcactcataggaattcttaacgctgtgtcttgatatttctctttcacccagtctggtaatcctgtcgtttcttttccaaaaatgaagtaaaaatctttgtcatgatttgaaaaatcaaaatcactataagtctttttaccaaattttgttaataagtaatactcgccatttgtgacttcaaaaaatgcttcaatactatcatgatacgtaatattcacaaattcccaataatctaaaccggctctttttaacattttatcatcagttctaaatccaagaggtttaattaaatgtaaatgtgtgtttgtacctgcacacgtacggcaatgttaccagtattagctgggatttctggttgatataaaacgatatgatttgtcatattactattctctccttgtgtctaatccttttatcatttcattctgaacttctgcatcctcttgatcataattagcattgataaaatctcttgcttcttccccaagaatttgaccaatggcccaataagcagttgctcgaatcaacggtctttcatctgttgttgcaacttttttcaattctggaattgcatccacttcattaaaatgcgccaatgctaaaatagcatttcgttgtatcggctttttaccacgccaagcacctgcaaggtgaccatatgtttgtttgaattctttattagacatacgtagtaaaggtactaatcttggctttaaaatttctggttccaaaatgatgtcatcttgttcggtattaatacctctatttttcggacaaacttgttgacacgtatcgcaaccatataatctattcccaattttataacgatattggtcaggcatatagccttttgtttgcgttaaaaaactaatgcatttctgactatttaattggccatttccaactaatgcacttgttggacaacgatcaacacaaattgtacaatgcaccacagctatctaataatggatcatcaggttcc

SEQ ID NO: 322 - DNA, 1302 bp; double-stranded, linear
gccctgttggagaaatcacctttatacgatggttgaaaaagcatcattaggtacaatcgtggcaattatagttattttgctgtttttaagaaacattcgtacgacggcaatttctattatatcgattccgttatcacttcttatggcgcttattgctctgaaattgagtgatgtttcattgaatatactaacgttaggtgcattaacagtagcgattggacgtgtgatagacgattcgattgtagttgttgaaaatatttatcgacgcttaacagattcagaagaacaactaaaaggtgaaaatttaattatcagtgcgacaactgaagtatttaaaccaataatgtcatcgacactagttactattatcgtcttcttaccacttgtgtttgtatcaggttcagtaggcgaaatgtttagaccttttgcattggctattgcatttagtttattagcatcgttattagtgtcaattacactcgttccagcgttggcagctacactatttaaaaaaggcgttaaacgtcgtaataaacaacatcaagaaggattaggtgttgttagtacaacttataaaaaagtattacattggtcattaaatcataagtggattgtaattatattaagtacattaattttggttgcaactattgtatttggaggaccgagactaggcactagctttatttcagcaggtgacgataaatttttagctattacttatacaccgaagcctggtgaaacggagcaagcagtgttgaatcatgcgaaagatgttgaaaaatatttaaaacagaaaaagcatgtaaaaacaattcaatactcagttggcggtagtagtccagtagatccaacgggtagtacaaatagtatggcaatcatggttgaatatgataatgacacgcctaattttgatgtagaagcggataaggttattaaacatgcagatggctttaaacatcctggagagtggaaaaatcaagatttaggaacaggtgcaggtaataaatctgtagaggttactgtaaaaggtccatcaatggatgccataaaatcaactgtaaaagatattgaacagaaaatgaaacaggttaaaggactagccaatgtcaaatctgatttatcgcaaacatatgatcagtatgaaattaaagtcgatcaaaataaagcggcagaaaatggtatttctgcaagtcaacttgcaatgcacttgaatgaaaacttaccagaaaaaacagttacgactgttaaagaaaatggtaaaactgttgatgttaaagtcaaacaaaataagcaaacagc

SEQ ID NO: 323 - DNA, 1003 bp; double-stranded, linear
atatatattaatttaaacgtgtttcacatgtaccagtgttaatgacagataatgctgcgtttaaaccaccttcaacaaggttttgtactgcttcatcagagaagaaagcaatatgtggtgttactaaaattctttcatgttcgattaactctaataatgttttatcgtcaatgtctttattagtccagtcatttgtgaagtatgctgcttcattttcataagtatcaatcgcagcacctaacaaagtaccatcgttcactgcagcgattaaatcaggtgtattgatgactgcaccacgtgctgcgttaactaagattgcaccttttttcacatgatcaaacattgctttatcgaataaatgatagctttctttgttcgctggaacatgtaaagaaataatatcggcatctttaatagcttctttaacactatctttataagttaaaaagtctaaatctttattaggataggcgtcataagctgtaattgtagcaccaaatcctgcatatattttagctgtagcagcaccgatacgacccgtaccaataattgcaacagtcatatttttaactggtttagacatgatttctgcttgccaagtaaaatcatgtgcttgtacacggcgttcaatatctgggaagcgacgcactaattgtagggcgatagaracagaatactctgcaattgtttcaggtgaataactaggaacgttagatatcacaatattgtgttttttagctaaatctaaatcatacatatcaaatccagcagtacgttgtgcaatttgtttaataccgtaagattctaatttaggataaacgtcattttctaacttaccaaattgcattgtagttacgccatcgtaatcttttaattgatcgactgtagcacttgataatagctctttagaagtagttacttcgacattattctttttcccccaatttaatgccatctctttctcataatcacgcgtaccaaagaacataattctcgtcattat

SEQ ID NO: 324 - DNA, 5030 bp; double-stranded, linear
ggcttttatagtgtttacgattattatgattacttatattcacgctgttaaaaattatccaaataaccgtactgttcattatggttatacagctgcatttatacttgttatattacaagttatcacaggtgcattatctattatgacaaatgttaacctgataatcgcacttttccatgcattatttatcacttatttatttggtatgacaacatactttatcatgctaatgttacgatcagtaagaagtgacargcaataacaaaaaagcmaaccgtaattttaatggcacgcccattaaaattacggtnttttatatcaatatttaaaattaaacctaagccatgtaaaaacgagattacacgtcaattgttgtgtaatctcgttttatnttaatcattttagtcagttgctttttcaatttcgattaataaatcgcctgtcgctattgtgtcaccattatttacagttacttgtttaatcacaccgtcaaatggtgcttgaattgttgtttccattttcatagcttcagtaattagcaacggctgattagctttcacagtttcacctacactaaccttgacttcagttactgaacctggcatttgagcaccgatatgacttggattactcttatctgcttttggcttaacgttcgcatttgtatgcacattttcatctttaatgtaaatacgtctcgcttgaccattcatcgcatagtaaatcgttctattaccattttcatctggttcactaatcgtttctagtttaataattaatcgtttacctttatcgatttcgatttctactgtttcaccattacgcattccaaagaagaatgtaggcgtatcaagtaacgataagtttccgtattgatttctagtttgaatatattgttcatatacttttggatatagtacataactaataatatcttgctccgtaacaggaccttgttgctcttcttcaagcaactcacggactttttcaaaatcaactggctctagatattcacctggacgagctgttagtgcttcttggccttttaaaataaccgcttgtaaatctttattaaaaccatttacaggttgtcctatttcacctttgaagaacgacactactgattctgggaaatctaatttatagccatctgtaatcacggattgttcatcaagatcattttgtaccatataaagtgccatatcaccaactactttagacgatggtgttacttttacgatatcaccaaataagaaattcactctgcgatacatatctttgacttcatcaaatctttcgcctaaacctaaacttttagcttgttgacttaaattcgaatactgtccaccaggcatttcatgttgataaatttcagtattcggtgatttgatatcactttcaaagtctgaataataagtacgtacagttgaccaataatgactaagtgactccataccttcaatatcagttctaaggtggcgtgggaagccatttaatgcataatataacgaattggcgcttggctgacttgttaaaccactcattgaagcaacagcagtatcaatgatatcgacaccagcatctattgcttgtttgtatgttaataaaccattaccacttgtatcatgagtgtgaagatgaattggtaaatctacagctgattttaactcaccaatcaattcgtaagcggctttaggttttaataagcctgccatatctttaatcgctaaaatatggaaaccttcacgttctaactctttagctagtttgacataatactctaaagtataaatgtttgatcgctcaggatttaaaatgtcacctgtataacaaatagtaccttctgagattttgcccgcttcttgtactgcttcattggcaactttcatttgatctacccagtttaatgaatcgaaaattctaaagacatctatgcctgctttagcactttcttgtacgaatttatgaataacattatcaggatagtttttataaccaactgcgtttgaagcacgtaacaacatttggaataatacatttggaatagctttacgtagacgttcaagtcgttcccatgggttttccttcaagaaattatatgccacatcaaatgtagcaccgccccacatttctagtgagaaaccatctttaaatacgtccgctgttttggatgcgatattaatcatatccttagttctaactcgtgtagctaataatgattggtgtgcatctctaaaggttgtatctgttagtaagacatcatcctgctttttaacccattcagctacaccttttggacctacttcatcaagcaattgtttcgtaccactaaatgaagcgattttacttgaagatacagttggaattgatgctaattcatagtctggtttcggacgtttctcaacatttgggaaaccattaattgttacattacctatatattctaatgttttagtacctctatctagagacggctgaatgtcgaaaagttctggtgtttcttcaataaatttagttgtgtaatcaccacttgtgaactttttattcttcattacattaattaagaatggaatattagttttaacaccacgaatacgcatttctcgtaatgagcgtaccattttttcttctgcttgtttaaatgatatcgcgtgtgtagataattttacgagtaatgaatcataataaggtgatatctcagcaccttggaaaccatctccagcatcaagacgtacaccaaagcccccgcttgaacgataagcaatgattgttccagtatccggcatgaaatcatttaacggatcttctgttgtaatacgacattggatggcatagcctaatgttgtaatatctttttgttgcggcatattaatctcttcaccaaataaatcggcacctgctgcaactaaaatttgtgtcttaacaatatcaattcctgttaccatctctgtaattgtatgctctacttgtacacgagggttaacttctataaagaagaattcgtcaccagatactagaaattcaacagtacctgcattgacatatttaatattttccatcaattgaattgcagcatcacaaatacgttgacgtaatgttgatgataatccaactgatggtgcaacttctacaactttttgatgacgacgttgtactgaacaatcacgttcaaataagtgtacgatatttccatgttcgtcacctatgacttgtacttcaatatgctttggattatcaatgtatctttctatgtaaacttcactattaccaaatgatttttcagcttctgattttgctctatggaaagcatcttctaattcactttcttcacgaacgattctcatacctttaccgccgccaccacttgtggctttaatcattagcgggaaaccagcttcttctgcaaattcttttgctaattcatatgatttaattggaccgtctgtaccaggaataactggtaaatctgccttgatagccgttgtacgagctttaactttatctccaaacatatctaaatgttctaaatgaggaccaataaatttaattccttcttctgcacaacgacgcgcaaattgttcattttcacttaaaaatccatagccaggatgaatcgcatccacattcgcttgttttgctacatcaatgatacgctcaatatttaaataactttcagcaggacctaaatcacttccaactaaataggattcatctgctttatatctatgtaatgaacttttgtcttcattcgaataaattgcaactgtgctgatgtctaattctgccgccgctctgaatatacgaattgcaatttctccacggttagcaacaagtaacttttttatttgtttcaatagcgatacactcctcaaactattagaattttctaactaattagataataaaattttatcttaaagcgctctgttttgctatagttmtgtttcmaattttcaaaatttaacatycttgagacaattaaaaccyccgcttcmgaaataataatttcaaaaatgactatgcaacaacaggtagttccacgtttttgttgtgaaacattttcgatttctacaactctaaaaaattaaaaataaaattgcaaaacatcaacatttattatcaatagcgataactttatcttatcatcatgattctaatttcgccaccacatttagtaatttttagtcataaaatttagttataattatacgttgttttgtttataaaatttgataatcakgagtaatctcgtaatatcaaaacaaaaaggaagttaagcgttgtttggttgcctaacttccgttattgaactcatccagtccaatttgacaaagagtatataaatagccaatgtttagcattgcttaatgacagaagtcatctcgtactaaatattggctagtatttttttaattaaattgtcttcttatatcaactttttgttgttgtttctttcgttgctggtctactttgatttgtttacctacaatcagaagtaaacccatagcaatacttaaactaatcattgatgatccaccaaagctgataaatggcaatggcacaccagttaatggaattgttgccgaaataccgccaatgtttacaaacgtttgacttccaaagtatgtggcaatcccaacacacacaagtttataaaaatatgatgatgttttatttgcaaactggaaggcacgatatacaataaagaactctaaagtaataactagcaatcctccgattaaacctaattcttcgcaaataattgcaaaaataaaatctgtatgtggttctggtaaatagcccaatttcattgcactatttcctaatccttttccaaatacgccaccgttacctatcgcaagcaatgaattggaaatatggtatccagttcctgattcgaattggaatggatctgttagcgtactaaatctggcagttaaataacttggtaaccaaccagccattaatgcaatgacaaatactactaagaatcctagcactgctggtataccaaatcttaggactttgtt

SEQ ID NO: 325 - DNA, 1389 bp; double-stranded, linear
cttgttaatccgaaaattattagtcaatcaaatgaaacaataacagacttngaaggttcaattacattgccagatgtttacggcgaagtgacaagaagtaaaatgatagttgtcgaaagttatgacgtcaatgggaacaaagttgaactaactgcacatgaagatgtagcaagaatgattttgcatattatagatcaaatgaacggtatcccttttacagaacgtgcggaccgtattttaacagataaagaagtggaggcatattttataaatgactaaaataatatttatgggtacaccagacttttcaacaactgttttagaaatgcttattgcagaacatgatgtcattgcagtcgtaacgcaaccagatcgacctgttggacgtaaacgtgttatgacaccaccaccagttaaaaaagttgcaatgaaatatgatttacctgtatatcaacctgaaaaattaagtggatcagaagaattagaacaattgcttcaattagatgtagatttaattgtaactgctgcttttggacaattattacctgaatcattgttggcattaccaaatcttggggcaattaatgtacatgcatcattgttaccgaagtatagaggtggtgcaccaattcatcaggcaattatcgatggtgaacaagaaaccggcataacaattatgtatatggttaaaaaattagatgcgggtaatattatttcgcaacaagcaattaaaatagaagaaaatgataatgtcggtacgatgcatgataaattaagtgtattaggggcagatttattaaaagaaactttaccatctattatagagggcacaaatgaaagcgtacctcaagatgatacgcaagcaacatttgcttccaatattcgacgcgaagatgagcgaattagctggaataaaccaggaagacaagtgtttaatcaaattcgtggattatcaccatggccagttgcttatacaactatggatgacactaacttgaaaatatacgatgctgaactcgttgagactaataagataaacgagcctggaaccattatagaaacgactaaaaaagccattattgttgctacaaatgataatgaagctgttgcaattaaagatatgcaattagctgggaaaaagagaatgttagctgccaattatttaagtggtgcgcaaaacacactagtagggaagaaacttatatgatagaaaacgtgagaagtcttgcttttgacacgattcaagatatattaaatgaaggtgcgtatagtaacttgcgtatcaatgaagtgttgtcagaaaatgaattaaatgcaatggataaggctttatttacagaaattgtctacggaaccgttaaaagaaaatatacgttagatttttattta

SEQ ID NO: 326 - DNA, 2746 bp; double-stranded, linear
tttgctaataacaataaagccaaagccgattcacactctaaacagctagaaattaatgttaagagtgacaaagtacctcaaaaagtaaaagatctagcacaacaacaatttgctggttatgctaaagcattagataaacaaagtaatgcaaaaactggtaaatatgaacttggcgaacttttaaaatttataaatttaatggtgaagaagataatagttactattatccagttataaaagacggtaaaattgtttatactttaacacttagtcctaaaaataaagatgatttaaacaaatcaaaagaagacatgaattacagtgttaaaatttcaaacttcatcgctaaagatttagaccaaattaaagataaanattcaaatatcactgttcttactgatgraaaagggktttattttgaagaagatggcmaagttagattagtaaaagctacgcctctacctggtaatgtaaaaganaaagaaagtgctaaaacagtttcagcaaaattgaaacaagagttaaaaaatacagtaacacctactaaagttgaagaaaacgaagcgatrcaagaagatcaagttcaatatgaaaatacattaaaaaacttcaaaattwgagaacaacaattcgataactcatggtgtgcaggattcagtatggcagcattattaaatgcaactaaaaatacagacacttataatgcacatgatattatgcgtacattataccctgaagtaagtgagcaagaccttcctaattgtgcaacattccctaatcaaatgattgaatacggtaaatcacaaggcagagatattcattatcaagaaggcgtaccatcatatgaacaagttgatcaacttacaaaagataatgtaggaattatgatccttgcacmaagtgtatctcaaaaccctaatgacccacatttaggacatgcgctagcagttgttggtaatgctaaaattaatgaccaagaaaaacttatttactggaatccttgggatacagaattatcaatccaagatgcagattcaagcctattacatttatcattcaatcgtgattataactggtatggttcaatgataggttackaaaaagtaatatagatattgattaaaggcaggtaaaactatgtatcaactacaatttataaatttagtttacgacacaaccaaactcacacatctagaacaaaccaatatcaatttattcattggtaattggagtaatcatcaattacaaaaatcaatttgtatacgtcatggcgatgatacaagtcacaatcaatatcatattctttttatagatacggcacatcaacgcattaaattttcatctattgataatgaagaaatcatttatattcttgattatgatgatacacagcatatcctcatgcaaacgtcatccaaacaaggtattggcacttcgcgaccaatcgtttatgagcgcttagtataactaatttaaatgatttcacttcataaagcgggttggcgagaattcaatttctcaccagctcgttttttcattgtaataataatctttaacatttattctttctctattaatttttctcaaactatcttatctttatgataattaattaaaatgcccttttaaattcttataaaataaaaaagccacctatcgtcgctaataaacgacgcaagtgacttaatatcatattcaaaataacttatgggaatttagggaattgatcgaagtcaggatcacgtttttctttaaacgcatcacggccttctttcgcttcatcagttgtgtaataaagcaatgttgcatccccagccatttgttgtaaaccagctaaaccatctgtgtcagcattcatagctgctttaaggaatcgtaacgctgttggtgagtgtttcataatctctttacaccattgcacagtttcatcttcaactttctctaaaggtaccactgtatttactagacccatatctaaagcttcttgtgcattgtattgacgacataagtaccaaatttcacgtgctttcttatgtccaacgatacgtgctaaatatcctgaaccataacccgcatcaaatgaacctactttaggaccagtttgtccaaaaatagcattatcagcagcaatcgttaagtcacaaacaacatttagtacattaccgccacctacagcataaccttttaccatcgcgataaccggttttggaataatacgaattaaacgctgtaaatctaatacatttaagcgagggatttggtcttcacctacataaccaccatgtccacgtttcttctggtcaccaccagaacagaatgctaaatcaccttcaccagttaatacgataactgaaacgttttgatcatcacgtgcacgtgaaaatgcgtcaatcatttcagcaactgttttaggtgtaaacgcattgcgtacttcagggcgatttattgttaccttagcaatcccttcgtaaaattcatatttgatttcatcatattctctaagtgtttcccattgtctgttagtcattttgctcctcctttaaaaatcctaatatcattgtatcaaattcatcactatcytccacatgaattgtatgacctgtagcagaaattaatttacatttactattaggaattaaatttgccatttttttcgcaatctgtacaaatttttcatcatattctccagctaatattaatgttggtactttaatttctntcagcgcggccataagtttggcatttg

SEQ ID NO: 327 - DNA, 900 bp; double-stranded, linear
taatgtttagtttattaacagtaagttcgtatatcaatgtttagtgctccccaaaattgaagtttgaattttaaaagcatcttgtagaatttagttgtatttttttcaaagaaattcattttgattatttttgataatgagcattttaatagtaatacatgtttatagtgtgtagtatatgtctatactagtagtaactatatagagaaagtaggaataaactatgtcacaagatgtaaatgaattaagtaagcaaccaacgccagataaagcagaagataacgcatttttcccatcaccatattcccttagtcaatatacagcacctaaaacagattttgatggtgttgaacacaaaggtgcctataaagatggtaaatggaaagtattgatgattgctgctgaagagcgatatgtattattggaaaatggaaaaatgttctctacgggtaatcatcctgttgaaatgttattacctttacatcatttaatggaagcaggttttgacgttgatgttgcgacattatctggttatccagttaaattagaattatgggctatgccaactgaagacgaggcagttataagtacttataataaattgaaagaaaaattaaaacagccaaaaaaattagcagatgtgattaaaaatgaattaggacctgattcagactatttatctgtctttatcccaggcggacatgctgcagttgttggtatttctgaaagtgaggacgttcaacaaacattagattgggcattagacaatgaccgctttatagttacattatgtcatggaccagcagcactactttcagcagggcttaacagagaaaaatctccattagaaggatactctgtttgtgtcttccctgactcattagatgaaggtgcaaatat

SEQ ID NO: 328 - DNA, 3642 bp; double-stranded, linear
atctgantngagatagtgataatgtgtcacccaattttaaacctttatttttaagcgtttcatcagctaacacttcattatctttagtcgctttatgcccttctattaaactcggaactaaaaatgatgacttttcaacaccgaacactaaaacattgtctttttgatggccattagacacaatttcccctgtttgcttcaaagtagcttgcttcttgtatttattttcaatatctttcttgttaaaaacagattgttgcacagtttgattggcatctttatttagaacaatggcatctgcttgccacttatcaatgccttctttattcatattgataagaccattcgccaatccagataataaaaatagcaagtaactaatcatcgttaacacaccaataattagtccaaacttcaatttgttgcgccgtatttcattccaagctaaaaacatgcatttctctccctactactatgatttaaacattgtttatattcttagatgcacgtacgtcgtgttgcgctctgtaatgttatacatacacttatccttcattatacccgaactttttatattaaaagcaaatttatggaaaatgcaattaattgtctattatttttgtacggtacatttaaaattaaggatcaatttaaaaacgcctacatatacctttaagtacatgtagacgtccaattcatatattatttaacttcgcctgttttaggatcgaattgcttaatagcatttttacgtaatttatcttttgctttrtcacttgctttatagttattgttgtaaatcgtagcttcccaactaccatacattgggttagggaaaatgatatatttcttaccgaaatcgtctttatgtttttcaattaatgcttcacgagattcagctgtagcttcttttggatctgtaaagtctaataaattatctccaaatagcatgacaagtttatgatccttttgaaccatttgtctgcgtgattctttactcttatcatctttaccttttagtaaaatatgactcttcttagcttgagggataccttgttgttttaagttcttttgtgttgcctttaaatctttttctttatctctatcagaaatatagtagatatcgacaccttttttgtcagcatatttcaagaattcttttgcgccatagacaggtttagctttagcagcttgtacccattcatgccaaccttctgggaaaggtttattatgtattgatgcatagccttgatatggagaattatctaaaactgtttcatctaaatccaaagcaatagctaacttatgtttacctttattctttttaatctctttatctaactgtgtctttgcactgttataaccttgtaaatataatgcttttgcttcagctgaattttgataccaagccactgccataatattttgattaccaagattcgccttttgtgatgctggtatagaagcttgttgcgtttgttgaacttcagcagaacttttggcaaacgctgtagaatttgtcgtttgtggtgctgaaactgtaaccgctaccgataatgatgctattgcaatatactttgaaattttattcatcttatcacctcatgattaatatttaaaatacagttaaaattataaatgcatttatttaatattgctatactatgaaaagatatttaatattatttcttggaaaagctaacaaatatgtgaacatttcatataagcatgatttaatgggagacctatcacatgagagagatttgtgatttatcacgtaataaacttaaattcatttgagtgactaggccttcctatcagacatattcactcatccacgtatcattatgtgtacagtgtgctatctcttatttacctattggaacaaccataaactcatccatagtttaccttttataaatagcagtcctcactcatacaatttctcataaaaatcacaacgctccaacgtatttccaacttactttcacctattttaattcataaaaacgacactttaattgtcattatccaataatagcaagacgttattattgcaatcttttttataaaataatagaatcatagtattgtcatttaaagataaagtaagaacgtttttatttttcagattttttaaattattatgaatatctagttttaggaaggaaattacattgaaaaaacaagttattatttcgggcctcatgttattttcactattttttggagccggaaatttaatattcccgcccatgcttggccatacagcgggtcaaaatatgtggattggtatgctaggctttgcccttacaggcatatnactcccctttattactgttattgttgttgcattttatgatgaaggtgttgaaagtgtaggcaatcgtatacatccatggttcgggtttatttttgctgtcgtgatttacatgtctatcggagcattttacggtattccacgtgctgcaaatgtcgcgtacgaaattggtacaagacacattttacctgtgcataaccaatggactttaattatattcgcagcaatcttttttgccatcgtttactggattagtttaaatccatcgaaaatcgttgataatttaggtaaattattaacaccgttattactattaatggtcgctctattaagtattgctgtcattttcaaccctgaatctgcactaagtgcacctaaggataaatatataacacatcctttcatttcaggaagtttggaaggctattttacaatggatcttgttgctgcgttagctttttccgtagtcattgtcaatggctataagtttaaaggcctcacagatcgcatgaaaattttaaaatatgtctgcttttcaggtcttattgcagccatattacttggaatgatttactttgcacttgcatacgttggggcatcaacagctccaggaaactttaaagatggtacagatatattgacgtacaactcattacgattatttggttcgttcggtaacctcgtatttggaatgacggttatccttgcatgcctaacaacatgtataggactcgtcaatgttgcgccacatttactaagaaacacgtacctaagttttcttataaaatattcgcacttattttctctatcatagggttcttatttacaacacttggtttagaaatgattttaaaaattgctgtcccattattgactttaatatatcccgtgtcgattgcacttgtactcatatcatttgctaacatgtttagcacattcagattcagttgggcctatcgactcgcaactgttattacattgattatttcaattttacaaatactaaatagtttcaacttattacacggtgttattttgaaatcgtttatgatgttacctttagcagatatcgatttagcttggcttgtaccattcatgctctttgctattatcggtttcataatcgatgtatttatacgccgtccgaaacaagcgacaacttaataaatgctcactgcctagtaatgattgacccatcgttactaggcttttttatatganattcatgacttttcagtgataccgtctgtctattgattatnttaaaataaatgatttgttaaaaaatcctagctgttattcaaaaatattagtttttaaaa

SEQ ID NO: 329 - DNA, 2187 bp; double-stranded, linear
ttattgatattgaaaattcaaaaactgcaacacatcttatcactaaaaaccaacactatcatcaaactgacactcattttgaacagtataagaaatttattttagattcaggtatatcatcaacacaatttgtatataataacctgtctgtaagcggatttaaatatactaatgatggtaagaatccaattcaattatctgacatagtgtatcacttaatcgcattattacgatatggcggtggcattagctatcaattattagatgaccattcaaattatatttccttgtacaacaaatatggtagccccctaccattaatgcatttatataaaatgtttagaccttttgttaatgaagatattgaaattacaaataattatgtattgagtcgtaaagataataactaccatttcttattattcaataaaattaatgatcgatatatgtcagacgtaaaacaagatttcattttccataatgaattacctcaagactctttgatgattattaaaacattgaatcatgaacatggttcaattcaacatttgcttccaataagcgatcaacttgtttatatagaaaaagaaattttagatgaattagacaaaacgaattaccctaaaacggagcttgcagttcaagaagaaactggtcgtacatttgaactcaagttaaatcacgacgaggttaaatatatttgctttaaaccaagctaaatactaacagtcctcttgtgtttagtttcttacgttaaaggctatttatatcataaggagatgatttgtaatgagtaactcacaagcaattcaagcaattgaaaacgtgttagtaacgtcaaaagttggtgtattatcaactgcatataataataancctaatagtagatatatggtcttttataatgatggtcttactttatatactaaaacgaatatccattctgctaaggtcaaagaaattaaagataatccagcagcatatgttttgttaggctataacgacacaactaatcgtagtttcgttgagatggaagcgacaatcgaaatcgttacagaacaagaagtgattgattggctatgggaaacacaagacaaaagctttttcagttcaaaagaagacccagagttatgtgttttaagagtagttccgcaatccattaagctaatgaatgataaatcattagatacacctatcaaaatcgatttataacacaaagtgtatataggaaataacttttatgaattctagatataacaatgttaaatacttaaaataactcgctataattaaagtgtttaatatgtttacaattcaatttgcaatgtattgttttttagacacactttattcacatttaacgtgattagggtgtgtctttttaaattaattttatgtaatataaatactgcatttgcaaactgttgcacttttaggtataacagaattaactacatttaaggagattgatgaaccatgaaaaagaaaaaaggttttggtcttggtattagtttaatcgccatcatgttaattgtatgtattgtattagtaatcatgatgatgactggcggaaagaaagatacatactatggaattatgaaagataatactactattgaaaaaatgattagtgaaaaagatgaaagtattgaaaaaaatgttaaattaccttcagattcagatgttaaagttaaaaaaggtgattttgtaattgtttataaattagcagattcagataaaattgttaaagttaaaaaagttgaccatgacgatgtaccacatggtttaatgatgaaaattcatgacatgggcaaaatgcacatgaaacactaattgtaatttaaattacaaattttagttgccatcaaggtatatacgagtaaaagcagcggtaagttgatttccaatttggaatcattttactgctgctttttatatttgaaatactttcatattgaatagctccacttgccgttcgcctgcgctttgcgcatgcataaaagcccctaacaacctgaggtcactgcgctccggttcgcctgcgctttagcgcatgcataaaagcccctaacaacctgaggtcactacgcttcggttcgcctgcgctttagcgcatgcataaaagtccctaacaacctgaggtcactacgcttccgttcgcctgcgctttancatggccataaaagc

SEQ ID NO: 330 - DNA, 1788 bp; double-stranded, linear
ccncctttttaaacctggngaaatgtmcagttttgatggtattgggttctttagtattatgcttaagatagagtgtaatacgctcctgttgttctttatagtatattgctttttgtttttctttttcgtcatatttcacttttaaataaatgactgatgcaactatacatatacataaaatgacaccaataattataaaaacatgttttttgttcattaaagtaactcctaaaatgtggtggaaaatgaaaaaatttttataatctataattatgaacattacagattataaaccataacactaacatcgtcgccttcattaacttgattgttaaaatcagcaattactgagaattgtacaaggaataattgcctattatgccctcatgtaattattgccttactaacattaacaaaatcgatagctattacattaaatgcctataccccagacctcaaacacctttttatacaggacgcactgtaatttcatyyacgttaacgtgctttggttgtgttaatgcatataatactgcttctgcaatatcttgtggttcaagttttttacgatctgttggattgtatgcggcagttatggctgtatctaccattcctggagaaatgcttgttactttaacgcctgtctttgccaactctttttctaatccttgagtaatagtgtgaactgctgctttcgtcgcactataaatcgtactacttttcgttacttcaaagccagaaatagatgcaatgttaataagatggccacttgattgttctaacatagttggtaatgcagcctgtgccgtatataaagtgcctttgatattcacatcaatcatactatcccactcatctacttgataatcagtaatcttagacgacaacatttgccccgcactattgataacaatatccaaaccaccgaatgtttgttgtgcaatttttatcaattcatcgacttcttctttattcgttacatctgttggcactaccttcacactatcttgtgacaattgattcgctacgttttgtaatttttctttatttctacctgctaagacaacttttgccccttcttcatgtagtaatgttgcaattgcttctccaataccactacctgcacctgtaactactgctactttatctgttaatactgtcataatgatcgactcctttgattctttttattttttcagggtaaatcataaatacatattacttttaaaaagcgtatcacaattcatataacggtcataataactcgcttcattttcatagataaattacattacaagccattcgaaacatacaattaatcgttgcttatattttttatttttaaaaatgttgaaaaatcgtcacttctttattgtaaaaacattatattagtaataaagttaatactgtgnatttatcattcgattgaatgattagagggaggaataaaacgtgacatatcatgagcgtgttttagcattaagagcagaaagtaaaagaaccgcatttgattttcgattcgaagatttatttagcaaagaagaatggctaagtatgtctcttgcagaaagacaaaaagctgaaaaagcatttcgacacgagttaaaaatatggacgatgtaagaatgcccttctcaagtgtccatgacgcccaagtaaaattatataatgttgtatattcttataacggcattaaacgtaattttaaacaagttgaaaatggaaggattctaatatcatttcgtttatatatngcagaccatggatagaattttntatggtnaatcc

SEQ ID NO: 331 - DNA, 1341 bp; double-stranded, linear
taagccaaatccattgttaccagaagaagttcgcttcatcttaaaacaaatgggtcttaaagaaaagactatcgatgttgaactcgaagttggcgagcaagttcgtattaaatcaggtccatttgcgaatcaagttggtgaagttcaagaaattgaaacagataagtttaagctaacagtattagtagatatgtttggccgagaaacaccagtagaagttgaattcgatcaaatagaaaagctttaattaacaattaaagttattaaactaaccaaaagataaaaaagagtattgattttttaattagaaaagtgttaaaattatgtggtcgcgcttttagagcgcccatttcgtcacgaaatgttaagagtgggagggcaaaactgagccctgtgaccacatcacgatatcaaggaggtgcacatcgtggctaaaaaagtagataaagttgttaaattacaaattcctgcaggtaaagcgaatccagcaccaccagttggtccagcattaggtcaagcaggtgtgaacatcatgggattctgtaaagagttcaatgcacgtactcaagatcaagcaggtttaattattccggtagaaatcagtgtttatgaagatcgttcatttacatttattacaaaaactccaccggctccagtattacttaaaaaagcagctggtattgaaaaaggttcaggcgaaccaaacaaaactaaagttgctacagtaactaaagatcaagtacgcgaaattgctaacagcaaaatgcaagacttaaacgctgctgacgaagaagcagctatgcgtattatcgaaggtactgcacgtagtatgggtatcgttgtagaataattttacgaatattaaatttgattacatgatttaaacgatgaagcagataacagagataataatgatgaattataaatataatctgaatgactagattaatgattgatttattcataagattaattcttctgttgtctgcycttaacttgcatatagcaagtaatgtgggaggaaattccgctaaaaccactaaaggaggaactataaatggctaaaaaaggtaaaaagtatcaagaagcagctagtaaagttgaccgtactcagcactacagtgttgaagaagcaattaaattagctaaagaaacaagcattgctaactttgacgcttctgttgaagttgcattccgtttaggaattgatacacgtaaaaatgaccaacaaatccgtggtgcagttgtattaccaaacggaactggtaaatcacaaagtgtattagtattcgctaaaggtgacaaaattgctgaagctgaagcagcaggtgctgactatgt

SEQ ID NO: 332 - DNA, 5136 bp; double-stranded, linear
ctctaaatcttcaataggtaacttcattttaataattcccatttgaacaattgcttcttcatcattgacaatttctaaaacttcacccttttgaccgtaagakaatactttkacttcatcaccagcaacaattttatcgtatttttgcttttgtacattttgctttatagatttcgcttcataatgatcatctaatcgtttcttcttatcaatcaattcatgttctttaacatctgcacctttttgttcacgcaattgtcttaagtctttaataatatcgtcagcttcttttgttgcagccttaatcttctgatttgctttktctttcgcttcctctattagagacttttcataattttggaattgttgatactgcttagataaatcatcatgcacttgtccgcktsktttacaagacggtccagktctaacctctgtgtctctacacgtttgtaattacgctctaatgattcaatcatttcatttatttctttttcatcagtaccaatcatcgtcttagccttattaataatattcaaactaagacctaactttttagaaatgtcaaaagcatttgaacgacccggcacacccattaataacttatacgttggactcaaagtatctacatcaaattctacactcgcattcataacgccttctcgattataactatatgctttaagttcaggatagtgcgtcgttgccattactagagaaccaatttttctaacatgatctaaaatgctcattgctaatgcagcaccttcactcggatctgtacctgcacctaattcatcaaataaaactaaactatgtttgtctgcatgctttaaaatttcaactatattcgtcatatgagatgaaaaagttgataatgattgttctattgattgttcatctccgatatcgcaatatacatttttaaatacacttaactgactaccatcaagtgtgggaatcaacaatcctgattgagccataacaataattaaacctaatgtttttaatgttacagttttaccacctgtattcggtcctgtaataattaccgtttcaatatcttccataaattcgatggtattagctacaacagtctcacgatttaataatggatggtatgctttaggtaaatatacagtacggtcctctttaaatatcggctttgttcctttaatacttctactatatctcgcttttgcgattaaaaaatctaactgacccatgacttgttctgccacaagtagtgcatctttgtccgcagccacataaccagttagttgcgttaaaatgcgttctttttcaattgcttcgtcatgacgtaatcgactaatttgattattcatttcaacaactgatgatggctcaatatacaatgtttgtcctgaagcagattgatcatgtacaatcccattaaaatcttgtcgatattcagctttgacaggtataacgtttctttcattcctaactgttacaatagcatctgataattttttctgatttgcttggcttttaacaatacggtccaaattttgtctaatacgttgattcgtgctagaaattttacttctaatcccttgcaattcataactcgcattatcatataaatcatacgtatcgcatgtttcatttatttgttgaaaaagatcagttaacacaggtaattgattcatcttgtcatctaatattgggtatttaacaccttcatcttcttcaaccaattgattataaaatgtcttgaattgattttgtacttgaattaatctttttatcaagttaagctctgatacatttaaaacgccgccaatatcagcgcgatgaatgaatgctgatactttagataagccactcaagcttggtaaacgatgcttattatagatttgagcaatctcatccgtttcttccatttgaaaaacaaccgtttcaaaattagtagctggcatcatttgattgaccttttccaagcctaagtcactaatagtttcattggcaacgagtgattttattttttcaaattctaagacgtctaatgttttttgtctcataaaatccctctatttcttaagttttgtattattttcaataaagtctttaaaagcttcacgcgataatgcgttaatcactctatcttttgttacaaatcctttttgcgcagttgtacgccataattcataaaatctaaatgatttgtatgatgcgcatcagtgttaatagttaatttcacatttggatatttacgaacgatatcagcgctcagatccagtcgatgtggattggcattaatttctaatactgtattcgtttcttcagctaatgccattaattgttcaatattcggtttataaccatctcttctacctataatacgccctgttggatgcgctatatgtcgcacgtatggattgcgacatgcattagctaatcgttccataatttgttcttctgattggttaaagctttgatgaatagctccaattacataatcaagttgtgctaaaatttcatcatcataatccagcgagccatcaggtaatatatccatttctgtacctgaataaatatcaatttcactatattctttatctaaagccttaatttcttcgttttgtcttaaaagtctttctacttgtaagccattagcaacacgtaaactttgtgaatgatcagtaattaccatgaatttataaccttttgcgatatttgcttctaccatgtctcgaatagaaaacgcaccatcactatacgttgtatgcatatgaatatcaccattaatatcatctattgtaatgatattacttagatctttatcaaattcgctaccatcttctcgcatagcaggtggtataaaattcacattaaaatgttcatatatcttggcttcactatcatattgaattaatgtaccatcagcttgttcaattccatattcacttactttttcatcacgtgctttagcaagttgtcgaattcttatattatgttcttttgacccagtaaaatgctgcaatgtatgataaaaagcacttggttcaattaatcgaaaatcgacaccaatcgtttcatcatcatacgctaattctaatgaaacttttgtgttccccactgcaacttcttttactttattgggaatatttaataattgctgctgcactgcttttgggttatcggtacttattatgaaatctaaatctttgctcatttctttaaaacgacggaagcttcctgcagatgaatattgatcgatataatttaatgtatctatataatcaatgatttcttgattaagtcttctcatttgatcaattggatatctatctttcttagcaccaagttgtttcacagcttctaatatgttttgttccgttttcttagcaaatccgcttaattcactaacttttccattttcacaagcaacttgaagtgacgctttatcaacaatattcaactctttatatagcttagcaattttcttgcttccaagtccttgaattttcaaaagtggaataagaccttccggaacttcttcctgtaattgctgtaaatactgagattcaccggtctcacggtaatcattgattacttctgcaacacctttaccaatgccttttaactccgttacatcagatatttcatctaatggtcgttcatctaattcaagactttgagctgcttttcgatacgctgatattttaaaagtattttccccttttaattccatataagtagcaatttgttctaatagtttgataacatctttttttgtcataataacactccataaaaagaagaccaggacgtatcattaatatatacctttgtcctgacctcttatgataatttataaattaatggtgaaagccgataaatatgggatgtgaaaaatcaatgaatgactcacaatagatattttaagctgatgttgtaatgcttcgttaggatataatgccaatagatataacgtaaagtgtaagacaattatcgtcataaacacaccaactatcattcccattgcacgactgaaaatatgaatgttttgatacgctattattttatcaaaagttacgataattagatataaaatgaacttacaaaacaatgtaatcattaaaaaagctacaatcgcttcaaatcgattttgtagatgattaaaatgaaacgcaaaagttgtattaaatgctgttgttttaggatatggaataaatacaattaatctttctacaatagatttgtaaaattgactggcaatccacaatgatacaancgttgcactcaaatgtatcatagataaccaaaaacctcgtctgaatccaacgatgacaaaatacacaaagaaaatgattatgataaaatcaatgaccatttattgctcacgctgctgcaatttgtgaatttgttgtttcaaacgtcgattttttttcttctagtagtactttttcatgcataatattcacagcagttagtattgcttttcttgaagtatctaaacctgctgctttataccctaattcttttattttatcatcaactaaatgtgctacatatcgtatgtgctctgggttatcttccccaacaattgtaaaaagctgatcattaattgatacatttaccttgtttttaaactgtgtcatttataatttctcctgatcctttttttaaaatctaaattcacgttataaaatatgactggatagtttgtctgaatttgatactaatattgttatattgcaattatgataaaacaacaacacaatctctatagatgacttaatgttctttttataatgaaataatgtaaagaattttctattcaatactttatcatgtttaaattgtgtcactataacattttcataaacattatacatgaccactatgtattttgtaagtatccgcaattaattctttacaacatacataaatgtttctgacgttattatcatttatgatatgattatttttgctaaagacaatgaaattttatgaaaggatttacacaaatggcgaatatcgtttttaaattgtcggataaagacataacgacattaatgtcacgcatttcttttgatactgagaatttacctcaaggnatganagcacgtgcaaagtatccaaaatacaactgtaaatatttaccat

SEQ ID NO: 333 - DNA, 4239 bp; double-stranded, linear
ggccaaaattgcacctccactttcctttgaacaaatctattttaaacgcacattcccattatgacaaattaaatgtgagtnacatttgtttgtattttaacatgactactaacgcaaactgttttaccagatttattttttatgaatattataaaataaacttacatcatgttgatagtcggtatctttcaaagataaaatcttaataatttcttagtaaactcttttctctagatttatcacaatattatatagacctattttattttgacgtaagttgctagtatcttcaaacaaaaaacctttataaaaattcatacctttatgctatcgctgtaggctcattaacttgttacatataattcttaactatcctttgatgattgttttattagattgtttcgttgatggatactttcacgaatttctatagttcaatgctactaaaaaaacagcccaaaactttaatttgttttggactgttttataattatgcttgcgatggtgttttagtttctgaagtttgttcagcaatgtcatatttaaactctttaccatcatgatctactgtaactttcttaccttcaatttgattaccatctaatattaattcacttaaattatcttcgatagttttttgtatcgctctaattaatggtcttgcaccatattctggatcatatccttcttctgcgattttgtctttcgctttatcagttacaataatatttatgttttgttcagataatcgatttgttaatttattaaccatcattgttacaatttcttttaattcttcttttgttagtttatggaatacaatgatatcatctacacggtttaaaaattctggacggaatgaattttttaattcttttaacatcgtttttcgaattgtttcataatcttgtccatcacttgaaccaccgaatccagcaaatcgttgatcttgtaattcttgtgccccaacgtttgatgtcattatgataattgtatttctgaaatcaactgtacgtccttttgtatctgtcaaatgtccatcatctaaaacttgtaatagaatattaaatacatctggatgagctttttcaatttcatcaaataaaattacagaatatggtttacgtctaactttttcagttaattgtccaccatcatcatgaccaacatatcctggaggagcaccaactaatcggctcactgcgtgtttttccataaattcactcatgtctacacggatcatcgcatcatcatcgccaaacattgattcagctaaagctctagctaattcagttttaccaacaccagttggtccaaggaagataaagctaccaattggtcgtttaggatcttttaaccctgcacgggcacgtctaaccgctttactgattgaattaacagcatctttttgcccaataactctctcatgtaatgtatcttctagactaagaagtttttcagattctgtttcattgattttagttaatgggatacctgtccatcctgcaataacttcagcaatatcttcttctgacaatgaagttgacatgccattttgtgcattcttccattcatttttagcttcttcatattgcttttcaagttttgtttgtttatcacgcaggttagcagcattttcaaactcttgagcatgtactgcggcatctttttcatttttaactttttcaatttcttgttcaatttcttttaaattattaggtgtcgtatgactcttaagtcttactttagaacttgcttcatcaattaaatcaattgctttatctggtaagaaacgatctgaaacgtatctgttacttaatttaacagctgcttcaatagcttcgtctgaaatattaatacgatggtgtgcttcgtaacgatctcttaatccttttaaaatagcaactgtatctactactgaaggttcatcaacttgtacaggttggaaacgacgttctaaagccgcgtctttttcaatatttttgcgatattcatctaatgtagtagcaccaatacattgtaattcaccacgtgctaatgccggcttcaaaatattcgaagcatcgatagcaccttcagcaccaccagcaccaactaaagtatgcaactcatcaataaataggatgacattacctgcttgttggatttcttccataacctttttcagacgctcttcaaattcaccacgatatttagtacctgcaactactgttcccatatctaaagacataacacgcttatcttttaatgtctctggtacctcattattcactatggcttgcgctaaaccttcagcaatagcagttttaccaacacctggctctccaataagcacaggattgtttttcgtacgtctacttaatacttcaattacacgtgtaatttctttatcacgtcctataacaggatctaatgtaccgtctttggcaatgactgttaagtcacgagctaaactatctaaagttggagtattatttgacttactagcttgtgcatttttattactcatttcagggtttcctaaagctttcacaacttgtgcacgtgctttagtaatatttaaatctagatttgcaaaaactcttgctgcaacaccttcattttcacgaatcaagcctaataaaatatgttccgttccaacaaaattgtgatgtaattttctagcttcatccatcgataattcaatgacttttttagctctaggtgtataatgcaatgtaccaacatgatcttgaccatgtccgattaatttttcaacttcttcaattactttatcttcagtgatattaaaactttctaatacttttgcagcaattccttcaggttctttcattaaccccaataataggtgttctgttcctatatttgaatgatttaaacgaattgcttcttcttgggcatgtgctaatacgcgctgtgcacgctcagttaatctaccaaataacataaataatgacctcctactttatatgttctcttagtatatctgctcgtttttcttttacagatttgtcatcttcttcatctaataaaaatggtgactgtatagctaccatcaattcattaaatttaaagttttgtaattcaatgtaatttaaatctataccaagtttaactcgcttaatctataagaagcctcttccatagttatcattctacagttttgtaaaatacctagcgagcgaaaaacacggtcttgtgtttctaattgattataagtgtctaacttttgtcgtatttgtttttcttcatgaatgatttgattaacaacttctgttaatgtttctatgatttctaactcagatttaccaagtgtaagttggttggatacttgataagtatgtccataaacttgcgaaccttcaccgtaaatacctctgattgtatatccaaaacgattaatggtttgagcaatccgtgtcattcttttcataatagatagacctggcaaatgtagcatcacgcttgctctcataccagtacctatattggtaggacatgtagttaaataaccaagttgttcatcataacttatatcaaggcttcgatctaattcatcatcaattgatgaagcttgattatataaagcctgtaatgtcgtgtcagttcccatagcttgaatacgaatatggtcctcttcatttatcatgacacttaaagattcatcgtcattcactaatactgcggctgctggttgttttattagttcaggactaatcaaatgcttngcaaccatttycattttacttkgtkgatccattkgatcaagacgcattaattcaaagtttggcaaggcatcttgtacctcatttataactctaaatcccatcattttcagtagcatacattagtggatgcacatgattttctaaattacgcgctaaccgaattctagaagacataacaattggtgtttcttcattacttttcatccattggctgatattatcatgaatattatgcgtcatcatgttgcacctcactctcagcttttagtgctttaatttcatctctaacaatggctgcttcctcaaaatcttggatttcaataagttttttcaaatattcattcttttcttcgatttttcgctttaaagctatctttttatgtgaagaatgtggtgtctttccaacgtgctcaaattgtccaccttgaactctgcggacgatatcaatgatgtcatctttaaatgttgcataacaattagcacacccaaatttaccaacatgtgcaatatc

SEQ ID NO: 334 - DNA, 1245 bp; double-stranded, linear
caaaactttgattatgtcgtgtcagttattaatgcatacagtaatgcatcgttgttattttttatttatttactatttattatgtaccaaatcagcctttcagtaaaataggtcaaattactgattttctaaatataaaatgcctcctaataacatactattagtacatcattaagaggctcttgtgttatttgcatactaagcgctcaaatttaaatttaagatgaagattcttgcaataatatttctatatttgtcgatatatccaatggatcttccattggcaagaatcgatttacaacatttccttgtcgatcgattataaattttgtgaaattccattttattggggacccaaagattcctggttgttcattctttaaatgcgtaaataacggatgttcatcgttcccgttcacagatattttagctaacactggaaatgttacaccaaatttctcacgactaattttcaagatttcttcattagaacctggttgtcgattgtcaaaattattattcggaaaactcaacactacaaacccacgatccttatatttttgaaataaagtctctagttttttcaattgttcgctatatatacattctgttgcagtattaacaactaaaatcactttacctctaaatgcttctaatttataagttaagcctttataatcacttacttcgatatcatacacatttctattattcataagacacccctacacagccttttttatattgaatatgttctttttagaatgttctgataaaataagtgcgcgtttacaccgtgaacacacattatatagcgtgatacatttttcgagcacacgataaataatgttcgagtttatgttgttgctcaacctatccgatttaccgtcttttttcacctgtcttactttattaaaataatcacattgtatagctgtattagtccagctacaatatcttccgttataacccctcattataatcatccttattttctatttttaaaaagacaattagaccgctctttaaactatagattaatacttaagktaaactcatacatactgataccatacgttagatctaacaatttaaaattcgttataactatggattaaagagctgcccaactcatataatccttaaaaacttcacatgtgattgtktattaagccctcctttatcntattaaatatccttataacccttttaaaattaaactgacacactcatacattgttacac

SEQ ID NO: 335 - DNA, 1399 bp; double-stranded, linear
cttgtaaaggtagttgttcatttaaattaaaacagtatgctaagttngtgcttatattttgcaacttcaattcgacaggctcatcttgatacatgaatgcctcaatttcatcatgtgataactttttcaaaatatcaattaaatgratactaaaaacgataaataacatatcccaatttgaattcagccctagcgattttaatttgtttaaaatcttatctttttgaaaaattcgattcctaatgtcttgtatatcgttatcagtcaaagtttcccaatctatatgtgaatgaagacctaaataacacttatccattaataattcatataccgttaatgcagagacatcgaaacaacgttcttcacttaraaaaacgccatcaacatcaaataaaattttcttcacaatccccactccatttctgaaaattcagatataaatcattctactatttgactaaaaaaagcgcaaaccctattgaagtagatttgcgctttagctgttnaaattttataaatgtntttcaatttcatcagcaacctgctgtacgtgtgtaccgacaataacttgagttgaatgtttgccattaacagtaacaccaactgcaccggcgtttttaatcttctgtttatcaataatagatgtgtcttttaactctagacgcaaccttgttgcacaattggttaaattaacaatattctcttgaccgcctaaaccttctaatatttgtatagcatgttgatgatatttactttgtttaatatcattttcaccaggagcaatattatcttttacaactgttgggtcaactaattcattttcacctctaccaatcgtattcaagttaaatacttggattactacacggaaaatcacatagtataagatgaaaaatacaacaccttgaacaagcaacatcaatggatgatttgatactggattaattagtgataacacataatctatcaaacctgcactaaatgaaaatccagctgtccaatggaatgtagctgcgataaataaagataatcctgttaataacgcatgaacaacatataagattggcacaacaaacataaatgcaaactcaatcggctctgtaacaccaacgaaaaatgctgcaactgaactcgctaggaaccaaccgtaaacttgttttttctgagtagttttagctgtatgatacattgctaacgcagccgctggaataccgaacatcatgattgggaagaatcccgcttgatagcgtcctgtaataccttttatagcatctttgccactttggaatttaccaatatcattaataccaatcgtatcaaaccagaacacactattcagtgcatgatgtaatcctgtaggaattaataatctattggcaacaccatatatgaaagctcc

SEQ ID NO: 336 - DNA, 1329 bp; double-stranded, linear
tatagttntattatttagcgaagcattaatactaccaccggttataacaaatgtattttgcgtattaaattgaatggtaggaccaatcaaagtatattcaatcgctggaccatcattgttaattaatgactgcgcaaccttaaaactaaattgatccatggcacctgcgcctgaaaatccaatatgttcataacctattcttcctagatcttgtaccgttgaaaagagacctggttgtaaaatcttaattgacattttcaatcaccacccagtcatcaacattaaagttgccatctgatatatctctttcgatttgtataaatttctgttcatctattgcataaaattgtatccattctcctgcttcgtacattgacattggttcacgctcgctgctaaatacttttaacggtgtgcgtccaataatttgccatccgccaggagaatctgatggatatagtcctgtttgattattcgcaatacctacagaacctgcatgaatttttaaccttggctgattacgtctaggtgtatgtagttgttcatcaagtccgcctaagtatggaaatcctggcataaatcctagcatatatattaaataaggtttacttgtatgtttttcaataacttgctcaacagttattcgattatgctttgctacttcttcaatatctggtccatatgtaccaccatattgaacaggtattttaataatacgattggtttgattcacagcatgaacatttttttcattaaatttgttaagttctaaattttcaattaatttagaagatgttatagcttgttcatcaaaatatattagaactgctcgatacgaagggacaatatcttgaatttctaatatttctttttctcgtatccaccgtaccattgctgtgacattacgatatgtctcttcggatattttattttcaaaataaatcataattgtctgctcgttaataaatcttacatccactttaaatccccctttgtattgcaataaaccagtattgaataccttttcattgtatcattgagaagcacaagttgtttaataagtaattcaaatcgcatataataacaaatgataatcaatttgttttctcggaaatattttgcttttttaaaatggagtagttaatattgtaactcttacactaatttaggttctgctatcattcggtctgatggaaaatttttacttttcatctgtccgattttttgattttgaatataaaaaagcacgaccgaagtatcattaacacacttcaatcgcgcaattaaataatctatttgatcatttattggatattaacaatttttacg

SEQ ID NO: 337 - DNA, 3421 bp; double-stranded, linear
gaatagtgccatttggaaagacataaagaatccagaagcacctttagcgaatatgccgtgttcatatagatttgtgaaactggcatgcccgaattgagttttaaatgcaaatagaatcatgacgaaaccaactactattaaaccaataattgtcgctattttaatgatagagaaccaaaattctaattctccgaaaagtcttgcgctaagtaggttgaatgacattaataacagtacacaaaatagtgcacttatccagtttggaatttctgggaaccaaaagctaacatattttgccacagccgttacttcagccatacctgtaataatccaacagaaccagtatgtccatccggtaacaaatcctgcaaaaggcccaatatatgtattggttacatctgcgaaagatttaaattcagtattctgtataatgatttctcctaaacctcgcataaacataaataacataaatcctataatgatgtatgttaatagaattgaagggccggttaatgcaatcgtttgaccagcacctaagaataagcctgtaccaattgcaccgccaattgcaattaattgtatgtggcgattgctcagttccctttgtaatttttcagccataatacatctcccttaaatatagatatgtttattatgcacttatattgagatatatacaattattttcggtaaaaatgtgtaaaattccatgttaatatactttggtttttataatcatatataataaccaattgaaaatttaattctattgtaaaattcatggattattcacatcttgaaaaagctttaatggtgctatttgtggctattctgtgacatttacatagatttacaaaaaaattgttgcacatataatgccagtttttatatttcacaaacgaaatgcgtttactataatattagttgaaagccatttcataaagaaacagtaaaggggaaatttatcatagcmgaattacaaagaggtttagaaggggttatcgcmgcggagactaaaataagttcaattattgaaagtcaattgacttatgccggctatgatattgatgatctagctgaaaatgcgcaatttgaagaagttattttcctattatggaactatagattgccaaacgaagaagagcttgctcatctaaaagggaaattaaatcaatacatgacattaaatcctcgtgtgtatacacattttgaggagtatgttacagatcacgtgcatccaatgacagcattacgtacgtcattatcatatattgcacatttcgatcctgatgctgaaaatgaatcagatgaaaatcgttatgaaagagcaatgcgtatacaggctaaagtagcatcattagttacagcgtttgctcgagtaagacaagataaagaaccacttaagcctaatcctgacttaagttatgcggcaaacttcctatatatgttacgtggggaattaccaacagatatagaagtagaagccttcaataaagcacttattttacacgctgatcatgagttgaacgcatctgcatttacggcacgttgtgcggtatcatcattgtcagatatgtactcaggtattgtagcagccgtagttctctgaaagggccattacatggtggtgcaaacgaacaagttatgacgatgttatctgagattgggtcaattgaaaatgttgatgcttacttagatgaaaaatttgctaataaagrtaaagtaatgggcttcggtcatcgtgtatataaagatggtgmtcctagagcgaaatatttaagagaaatgagccgtcaaattmcgaaagacgctggtcgtgaagaattatttgaaatgtcagtgaaaatggaaaamcgtatggcagaagaaaaaggattaattcctaatgttgatttttatagtgcgagtgtttatcactgtatggaaatacctcatgacttattcacgccaatctttgctgtaagtcgttctgcaggatggattgctcatattttagaacaatataaagataatagaattatgcgtcctagagcgaaatatattggcgaaacgaatcgtaagtatatcccgcttgragaaagaaamtaatcaatacaaattaaaaatgaagatgtaaaatttggaggtaaaataactatgactgcagaaaaaattactcaaggaactgaaggattaaacgtacctaatgaaccaattatcccatttattatcggtgatggaattggaccggatatttggaaggcagcaagccgagttatagatgctgctgttgagaaascctataatggcgaaaaacgcattgaatggaaagaagtgctagctggccaaaaagcatttgatacaactggtgaatggttacctcaagaaacacttgatacaattaaagaatatttaattgctgttaaaggacctttaacaacaccaattggtggtggtattagatcattaaatgtggctttacgccaagaattagatttatttacttgcttaagaccggtacgttggtttaaaggagtaccatcacctgttaaacgtccacaagatgttgatatggttattttccgtgaaaatactgaagacatttatgctggtattgaatttaaagaaggtacaacagaagttaaaaaggtaattgacttcttacaaaacgaaatgggtgcgacaaacattcgattcccagaaacttcaggtattggtattaaaccagtttctaaagaaggaactgagcgattagttagagcagctatacaatatgctatcgataataaccgtaaatcagttactttagttcataaaggtaatattatgaaatttacagaaggctcatttaagcagtggggttacgatttagcattatctgaatttggtgatcaagtattcacttggcaacaatatgacgaaattgttgaaaatgaaggcagagatgctgctaatgctgctcaagaaaaagctgaaaaagaaggcaagattatcattaaagattctattgctgacattttcttacaacaaattttaactcgtccagctgagcatgatgttgtagcaactatgaacttgaatggtgactatatttcagatgctttagctgcacaagttggtggtattggtattgcgccaggtgcaaacattaattatgaaacaggtcatgctatttttgaagcaacacatggtacagctccaaaatatgcaggtttaaataaagtgaatccatcttcagtaattttaagttctgtattaatgttagaacatttaggatggcaagaagcggcagataagattacagattcaattgaagatacaattgcttcaaaagttgttacttatgactttgcccgtttaatggatggtgctgaagaagtttctacatcagcatttgcagatgaattgattgnaaatttaaaataagcagaatagaattagg

SEQ ID NO: 338 - DNA, 3173 bp; double-stranded, linear
ccctngatacccaaactgccctaataccactggctaaacctaatggatagtaccatttattttccaataaataanccaactgcaatngctataactctaaatataatagagataatcmcattaattggattaatacgccaaatactagtaataataggctagataataatccacctaaaaagtactttttaattccaaagaaagctaatatcaataatgctgccggtgcagataattgaaaatctaatcctggtataatggacggtattttcaaaactgccaaaatggttaaaatcgcagcaatgacactaatttgagtaatatcttttgatgtcatactaaaacccctataccgtttcataaacaacttgcttcggtgtgctttctaaaaatgatatgtaatgatttaaatcaatacaatcgtccacaaatattattctgcctccatatctcgtattaactggtttaatatcaaataatcgatggtaaccaattttagcagcggcaaaataacctgtcgtatacgttaagtcatcggacacgcaaagttctcctttgacatacggatgcgcattgatacaactagcaattgctaaggcatcagtcactctttcattaagatcacctttattatttatatcttcaaacgaaaaatgtgttgccctaatccccctttgtccaaatgaatctaaacgtttaccagatatagcagatagaataatagctcctgtataaaccgtttcatttttaatatatgtcatcccttgatttagcgcttgttcagtgacaccacattcttgtgttaaatgttggagatttgctttatcatcctcaataatttgtaatgcttttatttgttgaatcggttccatgattttttgtatttttatattgagaaaatccggttgcccattttcatgaaaaaaacctttattataaaacctttgtaccgtctgttctattttgtcaaactcacaaatcgtttcagcaccactaatatgaacatcttgattgctagaacgcatttttatactatacatgacgatcacctcaatcttcttgatgcaaaatttcaaacaacctatctatatcttgttcagtatgaaaatacgacaatgatattcttaacattggcttagtcacagttggataccttaaataacttgtaaacacatgatgctttaataatgtttgatgaatgttctcagccgcttctatgtcatcaaactcaataaacttaatcggcgagtttgaactattataatkaacattgagtgcttttaacttttggttaaaatatttactcaaactatttaatttagtgcgtctatcatcagcatttattaacttttcaatgtttctttttataaaatacaaattataaattggcaaactacttgagtagatgagtggtctaccgtgattaattaacatatccttcacatcatttgaactkaaaatcacacccccgtatgcaccacatgctttagataaactagaagtgagtatatctacaccttgataattcgagtaattctctattccaaaactatgtgaaacatcgagtatcagtgttgcgttanatttatgctttaatgagactaattgaccaatatccacaacgtcgccattcgttgaaaatacactatcagatatgattatttttggtatattttgattagggtatttctctaaccttttttctaaatcagcaatatctaaatgcttatatatcactttttctaaaccacttaacttaataccgtcaataatactcgcatgattttcttgatctgaaaacacgacacaatttgtatttttgaaaatattaaataacgccaaattagcatcataaccactatttaagatagtacatgcactatatccgagccaacctgctaacattgtttcaatttcttcataagctgtcgaacttccactaattaatcttgaacttgataagtgataactatacttccgcataaatctttcgaaatcatccttatcaaacgctatttgacctaatcctaaataatcattagatgtatagttcgtacatctcttattttctacttcaatatactgtctatctatataccctaccgatttaagcgaccgatataaccctttctgttgtaataaatcaatttgctcttgaaacttcattcttgttttccttattttcacaagtgtcataatcaatttcaaagcctaaatcattaatcatatcgtagtctaattggttcggttgcccaccagtaattagataatncaccgacaaatattgaattcgccgcttttaatgctaatggctgtaacgaacgtaagttgacctctcttcctccagcaatacgaatttctttcgtaggattgattaatcggaataatgctacgattcttaaacatttcattggtgttaaatcatccatgcttccaaactttgtgcctttgattggatgcaaaaaattaatcggaatactgtcggcatccatttcttttaaagcaaatgccatatcaacaatatcttgattagattctcccataccacaaatcacgccagaacatggtgatatattattcgctttcattagttctatcgtatctgttctatctttataactatgcgttgtcacgacgttatcatggtaattttcacttgtattaatattgtggttatatctgtctacaccagctgacttaagtttcttagcttgttcgtcattcgttaatcctaaacatgcacagatttttagttgcgggtgttgagatttaatcgttcttacagtattactaatatgatcaacttctttatcgctcggtcctctaccactcataacaatacaatatgttccaatatgattatcatgtgccacctttgctccatcgataatttgttcctctggaattaaagcatatcgctgtttttgtttaatatctcgtgattgtccacagtacccacaattttcaggacatataccacttttagcatttaaaatcatgtttaattttacttttttaccaaaataatgttttcttaaaatgtacgcctcatttaataaatctaaggtatcaatattagtatcctcataaattttcaatacagtctcttttgttaattgttccccttgtaatatgcgtttagccaaattcatattaacacttcctatctaaaa

SEQ ID NO: 339 - DNA, 1694 bp; double-stranded, linear
cgattatccattaatacaaccctaagtaaatgtataaaaattatcttccacaaacttcaacaaaagcctaaataaattacagcaatttatcaaatattgcttactttgattttatgaaatnacttaattctaacacatactaaatcatcatatactaattcgaaatcaaatgcatttagagataatcaaaatgcggaaacatctccaataatcaataatctattcccaataaatatgaatgttctcaacaatacattatttatatctctttacactgtcatcgacaaaaactaaatctttcactttcaatttcgaacgtggttctacgacatttgctgctatatcatttaatgggattaaaacaaatgcacgttcattcattctcggatgtggcaccgacagttttggtaaatctatcatttcttctccatacaacaaaatatccacatctaaagttctaggaccccatcgttcctttctaatacggtgtaaacattcttctgtcktcaaacaacattccaacagttgtaatactgtgagtgttgtttsaatttcaacacacaaatttaaaaagttaggttgctcagtatacccaactggtgctgtttcataaatcggagaaatattagatacgttaataccatcatattcattcaaaatcttyatagcatcgtttaactggctttctctatcaccaatattactacctaaycctaagtatgcttgaatcatytattctccctcactatttcgatacctactccatcataatgacccggaatcggtgggttttctttagtgattctcactttcgtttccattacacgattatattgtgaatttatacgatttgcaatacgttcagctagatgctcaagtaaattaacggccttaccttccataattgatttaacctcttcgaacacttcaccataatgaactgtatcaataacattatcagtacgcccagcttcagctaagtctactttcaaagttacatccactttgaaaatttgccctatttcattttcagctgataaagcaccatgatatccataaaagcgcatacctttaagaaagattgtgtcttgcattttcattctcctttaaaaaatctatacctttagctaatttagcattcaactcgacattatgaacgcgtactgctctaacgcctttcataataccatatgcagtcgtagctgcagttacttcatctctttcaaccggtgttgtatcataacccatcatctctttagtgaaacgtttccggcttgtcgctaataaaactggatattctgttgcaacaagttcatccagtcttgccataacttcggcttcttcatttctagttttagcgaaacctatacctggatctagccaaattttatttgaaggtataccagctattttagcttgatgtgcttgtgctaacaaagatgttaacatttcttcgacaaccggttcatcacgattaccatttccattatgcattaaaataatttccgcgtcatatttagctacaatttggaacatacgatgatcatacagaccgcccattgatcattaatcatatcaacggctaattttaaacatgcttcagcaacctcacttcgaaatgtatcgactgaaattttttacatcanaaccgacaatagcttcancaacagtaatactctgttccatctcttctg

SEQ ID NO: 340 - DNA, 1358 bp; double-stranded, linear
agcatttcttttctataaacatttaattgaacattattaagtacactattactatagtcactatattgaacacatacctcatttaattctaatagcggttcagatttgtacttattatcattatttgcagatgtttcatctatccattttttcactttaaatttaacatgttcactcatacaaacgtcacgtaaattcgctaagttatcaatggattcgacatctacttctgcatatttaagcgctgtacagtataatggttcacgtatgcctgcttctttaagcttagatgattttagcaaatcactaggcgttgtattagcgatgatttttccatctttaaaaagaagaactctatcaaacgtatcatctaatgattcttctaatcgatgttcgacaataatcatcgttgactttgtttcttcatgaatattgtttaacaatctcagcgtttcatgtcctgtcgcaggatctaaattggccagtggctcatccaatattaaaataggcgtacgatggattaatataccacctaatgaaacgcgttgtttttgacctccagataaatcttgcggtcggtgatttaaatgttctatcatgccaactttttcagcccaataacttacatttttcttcatatcatcttgttcaacacaattattttctaataaaaaggccatatcttcagctgctgttaagcctatgaactgtccatctgtatcttgtaaaactgtaccaacaacattagatctatcatgtaaacaactaacggttgcatcttgattatttatatatagttccccagttatgttacctttagttttaaatggaattaatccgtttatgcaatttgcaaaagtcgatttaccactacccgaagcaccaactactaatactttttctcctggataaatatcaacatttatattctgtaatgtaggtgttgcttgactatgatattgaaaactaaagtctttgaacgagataattggttcagtcatgatatatcattacctttctatattcatttacatatctgattcaacaaaataactattccttacgtaaactaccttttttaatttgagatgaagcatatgcttttaataatattgtcccaataatgccaactgaaataatatttaatactgcagagataacaccttgtgtataaaccttgttagctggttcgttataaatcaaaatatctaatgttggtgcaataagtgcccagcaaataatattcgcaataatttgaccgatattaaaataaaccatcgatttcctagaaaatcggcctgaagaaagatttaattttagtccaatccagccatataaacagcctataattcccgagc

SEQ ID NO: 341 - DNA, 4557 bp; double-stranded, linear
tagaagaattggagaaaatgctaattcaattgtcaacattccatagttatcatgatttagagtttctatttgtgacacgtgaagatgaagttgaaacattgaaatgggcacgttggttgccacatatgacattgaganggcaaaacattagaggatttgtttacaatcaacgaacgcgtgaccaaattttaacgtcaatttatagcatgattaaagaacgtatccaagctgtgctgaacgcagcagaagtaatgagcaaattattttcacaccgcaattagtgtttgtcattacagatatgtcattaattattgatcatgtcattttagaatatgtaaaccaagatttatcagaatatggtatttcattaatctttgttgaagatgtgattgaaagtttgccagagcatgtagataccattattgatatcaagtctcgtactgaaggcgaactgattacgaaagaaaaagaattagttcaattgaaatttacacctgaaaatattgrtaacgtcgataaagaatatatcgcgcgacgtttggcgaatttgatacacgtcgaacatttgaaaaatgcaattcctgatagtattacatttttagagatgtataacgtgaaagaagtagatcagcttgatgtggttaatcgatggagacaaaacgaaacatacaaaacgatggcagtacctttaggtgtaagaggtaaagatgatattttatcattgaacttacatgaaaaagcacacgggccacatggtttagttgctggtaccactggttcagggaaatctgagattatccaatcatacattttatctttagctattaattttcaccctcatgaagttgcattcctattgattgactataaaggtgggggtatggcgaacttatttaaagatttagtccatttagttggtacgattacaaacttagatggcgatgaagcgatgcgtgccttaacatcaatcaaagccgaattgagaaaacgtcaacgtttattcggagagcatgatgttaaccatattaatcaataccataagttatttaaagaaggtattgcgacagaaccaatgccacatttattcattatttccgatgagtttgccgaattaaaatcagaacaacctgattttatgaaagaacttgtatcaacggcacgtattggacgttcgttaggtattcatttaatacttgcgacacaaaaaccatcgggtgttgttgatgaccaaatttggtctaactctaaatttaagttggcattaaaagtacaagatagacaagacagtaatgaaattttaaaaacaccagatgcagcagacattacmttaccaggtcgtgcgtatttacaagttggtaataatgamatttatgaattattccaatctgcatggagtggtgcaacatatgacatcgaaggcgataaattagaagttgaagataagacgatttacatgattaatgactatggtcaacttcaagcaatcaacaaagacttgagtggacttgaagatgaagaaacgaaagaaaatcaaactgagttagaagcggtcatagatcatatcgaatctattacaacacgattagaaatcgaagaagttaagcgtccatggctaccaccattgccagaaaatgtatatcargaagatttagtagaaacagatttcagaaaattatggtcagatgatgcaaaagaagtggaattaacattaggacttaaagacgtaccagaagaacaatatcaaggaccgatggtattgcaattgaaaaaagctgggcacatcgcgttaatcggaagtccaggatatggtagaacaacgttcttacacaacattattttcgatgttgcaagacaccatcgtcctgatcaagcacacatgtacttgttcgatttcggtaccaatggtttgatgccagttacagacataccacatgtcgctgattactttacagtagatcaagaagacaagattgctaaggcgatacgtatatttaatgatgaaattgatcgtcgtaagaagattttaagtcagtatcgtgtcactagtatttctgaatatcgaaaattaactggtgaaacaattccgcatgtctttattcttattgataactttgacgcagtaaaagattcacctttccaagaagtttttgaaaatatgatgattaaaatgacgcgtgaagggctagcattagacatgcaagtaaccttaactgcttcaagagctaacgctatgaaaacaccaatgtacattaatatgaaaacgcgtatcgcaatgtttttatatgataaatcagaggtgtcgaacgtagtaggacagcaaaaatttgcggttaaagatgttgtgggtcgagcattgttaagtagtgatgacaacgtatcattccatattggccaaccatttaaacatgatgagaccaaatcatataatgatcaaattaatgatgaagtatcggcgatgacagaattttataaaggtgaacaccaaatgatattcctatgatgccagatgaaattaaatatgaagattacagagaatcattaaacttaccagatatagttgcaaatggtgctttaccaattggattagattatgaaggtgttacactacaaaaaattaaattaactgaaccagcaatgatttcatcagaaaatccgagagaaattgcgcatattgctgaaattatgatgaaagaaattgacatattaaatgaaaaatatgcgatttgtatcgcagactcaagtggagagtttaaagcttataggcatcaagtggctaactttgccgaagaaagagaagacattaaagcgattcatcaactaatgattgaagacttaaagcaaagagaaatggacggcccatttgaaaaagattcactttatattatcaatgattttaaaacatttattgattgcacgtatattccggaagatgatgttaaaaagcttattacaaaaggaccagaacttggcttgaacattttatttgtcggcattcataaagaattaatagatgcttatgataaacagattgatgttgcacgtaaaatgattaaccaatttagtataggtattcgtatttcagaccaacaattctttaaatttagatttattcaacgagaacctgttattaaagaaaatgaagcatatatggtcgcaaaccaagcttatcaaaagattagatggtttaaatagcaatgaattaaataggagggaggtatgttatgaattttaatgatattgaaacaatggttaagtcgaaatttaaagatattaaaaagcatgctgaagagattgcgcatgaaattgaagttcgttctggatatttaagaaaagctgaacaatataagcgattagaatttaatttgagttttgcactagatgatattgaaagcacagcaaaggacgtacaaactgcaaaatctagtgctaataaggacagtgtaactgttaagggaaaggcgcccaatacgttatatattgaaaaaagaaatttgatgaaacaaaagcttgaaatgttgggtgaagatatcgataaaaataaagaatccctccaaaaagctaaggaaattgctggcgaaaaggcaagtgaatattttaataaagcaatgaattaatattgaggtgaagatatgggtggatataaaggtattaaagcagatggtggcaaggttgatcaagcgaaacaattagcggcaaaaacagctaaagatattgaagcatgtcaaaagcaaacgcaacagctcgctgagtatatcgaaggtagtgattgggaaggacagttcgccaataaggtgaaagatgtgttactcattatggcaaagtttcaagaagaattagtacaaccgatggctgaccatcaaaaagcaattgataacttaagtcaaaatctagcgaaatacgatacattatcaattaagcaagggcttgatagggtgaacccatgatgaaagatgttaagcgaatagattatttttcttacgaagaattaacaattttaggtggtagtaaattgcctctcgtaaattttgaattgtttgatccatcaaattttgaagaagctaaagctgctttaattgaaaaggaattagtaacagagaatgacaagttaactgatgcaggttttaaagtggctacattagtcagagagtatattagcgccattgtaaatattcgaattaatgatatgtattttgcaccatttagctatgaaaaagatgaatatattttgttaagccggtttaaaaataatgggtttcaaatacgaattatcaataaagacattgcatggtggtcgattgtacaatcatatcctttattgatgagacaagaaaagtccaatgattgggactttaaacaaattgacgatgaaacattggagaacttaaataatgaaagtatcgatacgattgggcgtgttttagaaattgaaatatacaatcatcaaggtgaccctcaacaaagtttatataacatttatgaacaaaatgatttgttattcattcgatacccattaaaagataaagtgctgaatgttcatattggtgtcattaatacatt

SEQ ID NO: 342 - DNA, 3931 bp; double-stranded, linear
ttgagtgactttattgaagcgcgtgtagaagaaatattcttcgaagtatttgatgttttacaagatttaggattaacaaaagtaaatggtgggtttattgtaactggtggatctgcaaacttacttggcgtaaaagaattattatcagatatggtaagtgaaaaagttagaattcacacgccatcacaaatgggaattagaaaacctgaattttcttcagcaatttctacaatttctagtagtatcgcttttgatgagttattagattatgttacaattaattatcatgataatgaagaaactgaagaagatgttattgatgtgaaagacaaagataacgaatctaaattaggcggatttgattggtttaaacgtaaaacaaacaaaaaagatactcatgaaaatgaagtagagtcaacagatgaagaaatttatcaatcagaagataatcatcaggaacataaacagaatcatgaacatgttcaagacaaagataaagataaagaagaaagtaaattcaaaaaactaatgaaatctctatttgaatgattattggccaataaaactaggaggaaatttaaatgttagaatttgaacaaggatttaatcatttagcgactttaaaggtcattggtgtaggtggtggcggtaacaacgccgtaaaccgaatgattgaccacggaatgaataatgttgaatttatcgctatcaacacagacggtcaagctttaaacttatctaaagctgaatctaaaatccaaatcggtgaaaaattaacacgtggtttaggagcaggagctaatcctgaaatcggtaaaaaagctgcagaggaatctcgtgaacaaattgaagatgcaatccaaggtgcagacatggtatttgttacttctggtatgggtggcggaactggtactggtgcagcaccagtcgttgctaaaattgcaaaagaaatgggcgcattaactgttggtgttgtaactcgtccatttagttttgaaggacgtaaacgtcaaactcaagctgctgctggagtagaagctatgaaagctgcagtagatacattaatcgttataccaaatgaccgtttattagatatcgttgacaaatctacgccaatgatggaagcatttaaagaagctgacaacgtgttacgccaaggtgtacaaggtatctcagacttaatcgctgtttctggtgaagtaaacttagactttgcagacgttaagacaattatgtctaaccaaggttctgcattaatgggtattggtgtttcttctggtgaaaatagagcggtagaagctgctaaaaaagcaatctcttctccattacttgaaacatctatcgttggtgcacaaggtgtgcttatgaatattactggtggcgagtcattgtcattatttgaagcacaagaggctgctgatattgtccaagatgctgcagatgaagacgttaatatgattttcggtacagttattaatcctgaattacaagatgagattgttgtaacagttattgcaactggttttgatgacaaaccaacatcacatggtcgtaaatctggtagcactggattcggaacaagcgtaaatacttctagcaatgcaacttctaaagatgaatcattcacttcaaattcatcaaatgcacaagcaactgatagtgtaagtgaaagaacacatacaactaaagaagatgatattcctagcttcattagaaatagagaagaaagacgttcaagaagaacaagacgttaatcggttaatatatatacacaaataattcaacacaaatcatcagataacatatctgatgatttttttactaatttttagaacatgtagaaggacatttaagtttttcaaagttattaaaagtgtttaagtatcgtgtgaaaattaagtcaaaaattatttgcgcaacattttaactttaaacataaatgttatattatataattattaactttgtacagttagacgaagataatttaaatgaaatgatggtgacgatcgagtgaatgataattttaaaaagcaaccgcatcatttaatatatgaagagttattacaacaaggtattactctaggtattacaactagaggagatggtttaagtgactatcctaaaaatgcttttaatatggcgagatatattgatgatcgcccatataatattactcaacatcaattgcaattagctgaagaaattgcgtttgatagaaaaaattgggtgtttcccattcaaacacatgaaaataaagtcgcttgtattacaaaggatgatataggcacaaatatagacactttaactgatgcgcttcatggtattgatgcgatgtacacatatgatagtaatgtcttattaacgatgtgttatgcagactgtgtaccagtatatttttatagtacaaaacatcattttattgcattggcgcatgcaggttggcgtggtacctatactgaaattgtaaaagaagtgctaaaacatgtgaactttgatttgaaagacttacatgtcgttattggaccatctacatcatcaagttatgaaattaatgatgatattaaaaataaatttgaaacattgccaattgatagtgccaactatattgaaactagaggacgagatcgtcatggtattgatttgaaaaaagccaatgctgcattattaatttattatggtgttcctaaagaaaatatttatacgacagcgtatgctacatctgaacatttagaattatttttctcttatcgattagaaaaaggtcaaacaggacgcatgttagcattcattggtcaacagtaaacaaggaggagatatgtttgcgtgtgaaagataatttacaacaaatctcaacacaaattaatgacaaaagtgaaaaaaataatttttcaacaaaaccaaacgtgattgcagttacaaaatatgttacaatagagcgagctaaagaagcgtatgaggctggaataagacattttggtgagaatagattggaaggcttttttcaaaagaaagaagcattaccatcagatgcggtgatccattttataggatcattacaatctcgaaaagttaaggacgttataaacgacgtagattatttccatgctttagatcgattgagcttagccaaagaaattaacaaacgtgcagaacataaaattaaatgtttcttgcaagtgaacgtttcgggagaagcttctaaacatggtattgctttagaagatgttgatcagtttatagatgatcttaaaaaatatgacaaaatcgaaattgtaggtttaatgacgatggcaccattgacagatgatgaagcatatattagatcgttatttaaacagttacgtttgaaaaaagaagaaatacaacgactcaatttagaatatgcgccttgtgatgaattatcaatgggaatgagtaatgactatcttattgcagttgaagaaggtgcgacgtttgttagaattgggactaaacttgtaggagaagaggagtgagccacttggctttaaaagatttatttagtggattttttgtaatagatgatgaagaggaagtagaagtacctgacaaacaacaacaggtaaatgaagcgccagcaaaagagcagtcacaacaaacaacaaaacaaaacgcaatcaaatcagtccctcaaaaatctgcatcaagatatacaacaacgtcagaagaaaggaataaccgtatgtctaattattcaaaaaataattcacgtaatgttgtaactatgaacaatgctacaccaaacaatgcatcacaagaaagttcaaaaatgtgtttattcgaaccacgtgttttttcagatacacaagatattgctgatgagcttaaaaaccgccgtgcgacacttgtcaatttacaacgtattgataaagtatcagcgaaaagaattattgattttttaagcggtact

SEQ ID NO: 343 - DNA, 3150 bp; double-stranded, linear
aattgtcgggggactcttaggttttgtcatgcaaagaacaagattttgtttaacaggtggctttcgagatatgtatgtgcaaaagaataataagatgttctatgcattattaatcgctattactattcaaagtataggattattgattttgacggcaacagatattttacaaattcctgcacatagttttccaatattgggaacaattataggttcttttatttttggaattggaatagtattggctggaggatgtgcaacaggtacttggtatcgcgctggtgaagggctaattggtagttggattgcattagtattatatgctgttactgcagcaatcactaaaacagggattttaaagccagtaatggataaaattaatcaaccaacgaatgtaaatagtgatatgtctcaaacaactggcattccgttttggggattagtcgttatattaactataatcaccatttttctagttgtaagaacactcaataataagaaagttcgagttgctgttccaaaactaaagcaacgttatacaggtattagatattaccttttcgaaaaacgataccatccatttattgcagcaattgtaattggacttatcgcactcttagcttggccaatgagtgcatcaactggaagaaatgacggtttaggtataacaacgccttcagcaaatttagtacactttttgattacaggtgaaactaaatttattgattggggtgtctttttagttctaggaattttcattggttcatatattgcagctagaggatcaagagaatttaaatggcgattgccagacaagattacaatacgaaacagtgccattggtggcatatgtatgggatttggtgcgtcagttgctggtggttgttctatcggtaacggtttggttgaaacggcaacgatgacttggcaaggatggattgcgctagcatgcgatgatagttggtgtatggacaatgagtcattttatctttgttcgtccaatgaaaaaagtacaccaacaatctgcaaaggttaaacagcaaacgcaaatagtatagaagattattatgcaaatgatgttgatcaaataaaagtgattggaaaaggagaaataattatgatacacgaattaggtacagtaggaatggtatgtccatttccgttaattgaagcgcaaaagaaaatggcaacattgcaatctggagatgaattaaaaattgattttgattgcacgcaagcgacggaagccattccaaattgggctgcagaaaatggttatcctgtaacaaactatgaacaaattgataatgcttcatggacaattacaattcaaaaagtttaacgttatcattttaacaataaaatagatattagattctatggctacttccgctaatttaaaagtgagtaagtagtctttttttttttagttcatgaaatcatttttatatagtgtggcacattttattccaaaagatgtaataaaacttaacgcatttttgctttttataaattgtcagattattatgaaaaaaagggagtggtaagtatgaatcttaacgatacgatatttatgtttttgtgtacattattagtttggttaatgacaccaggattaagtttattttatggtgggttagttcaatctaaaaatgcgcttaatactgtcatgcaaagtatggcagcaattgtgcttgttacatttgtatggataacagttggttttacaattagttttgggaatgggaatttatggttcggaaattgggaatatacttttcttaatcatgtaggttttgcgactcaagaagatattagcccacatattcctttcgctttgtttatgttatttcaaatgatgttttgtacgattgcaatttctattttatctggttcaatcgctgagaaaatgaagtttattccttatttattattcgtagtaatatggactgctcttgtatacagtccagtagcacattgggtttggggcggcggttggattaacaaactcggtgtattagatttcgctggaggtacggttgttcatattacatcaggtgtttctggtttagtattagctattatgattggaaaaggaaacaaacattctgaatcaacaccacataatcttatcattacgttgattggcggtatattcgtgtggattggttggtatggatttaatgtaggtagtgcttttacatttgataatattgcgatgcttgcatttacaaatactgtcatttcagccagtgcaggtgctataggttggttaattttagaatatatttttaaaaagacgacaagtttacttggacttttactcggtgcattagcaggattagttgtcattactcctgcagcaggatatgtaacatatcttagtgcaacaataatggctttaataggaggtatctgttgttatattgtcattaattacatcaaggtaaaactaaaatatcatgatgcattagatgcatttggtattcatggtgttggtggtattattggtgctgttttaacagcagttttccaaagtaaaaaagccaatcctgacattgagaatggctttatttatactggtgacatacatattatacttgtacaaatattatgtgtaacagcagttgtaatttttagtatagtcatgacgtttattattgcgaaagtaattaaattaattacaccattatctgttacggaacaagaaacgaatataggattagacaagattgttcacggtgaacatgcttactttgaaggtgagctaaatagattcaataaacatattcgatattagaatatatttacatagaatattcattgtcctgacatttaactaaaggttgatgttgggacattttgttatacaaaagttttattttgaaatctttttatgaaagaagcagaaatattatttaaagcggttacacatatgctaaaataaggctaagtgtcacaaataatgataggtgaataagtatgaaaaatatatctgatattgccaaattggcaggcgtttcaaaaagtacagtatctagatttttaaataatggatctgtcagtaaaaaaacaagtgaaaaattaacaagaattatagcagaacatgactatcaaccgaatcaatttgctcaaagtttaagagcgaga

SEQ ID NO: 344 - DNA, 3719 bp; double-stranded, linear
gttatagtgaaattgactcatcacatttcacagaccgtgacaaacgcgttattagacgtgatcatgttaaagaagcacaaagcttagtagagaactataaagatacacaaagtgctgatgctaggatgaaagccaaacaaaaagttaacacattaagcaaaccgcatcaaaactatttcaataaacaaattgataaggtttataatggattacaacgctaatccaaagtaaattataagttatacatctcgtttttaaatgacaatttatccccgtaaatattataaataatcttttcaaattccacatagatatagagacactaataaacctctttgtctcgatatgatagtctgcaacgattcatgttgtaggctttttaattttacaaataaggctaaatatataagttctggcacctaaaatatagaaaatacataaaagtaagtatagttattttattataattattaaatttttattaattaattgtaaaaatgtataattataattaattaacgtttaatattaaaattaactaaaaagaaagaggtgttagttatgacagaatacttattaagtgctggcatatgtatggcaatcgtttcaatattacttatagggatggctatcagtaatgtttcgaaagggcaatacgcaaagaggtttttctatttcgctactagttgtttagtgttaactttagttgtagtttcaagtctaagtagctcagcaaatgcatcacaaacagataatggcgtaaatagaagtggttctgaagatccaacagtatatagtgcacttncaactaaaaaattacataaagaacctgcgacattaattaaagcgattgatggtgatacggttaaattaatgtacaaaggtcaaccaatgacattcagactattattggttgatacacctgaaacaaagcatcctaaaaaaggtgtagagaaatatggtcctgaagcaagtgcatttacgaaaaaaatggtagaaaatgcaaagaaaattgaagtcgagtttgacaaaggtcaaagaactgataaatatggacgtggcttagcgtatatttatgctgatggaaaaatggtaaacgaagctttagttcgtcaaggcttggctaaagttgcttatgtttataaacctaacaatacacatgaacaacttttaagaaaaagtgaagcacaagcaaaaaaagagaaattaaatatttggagcgaagacaacgctgattcaggtcaataatgctcattgtaaaagtgtcactgctgctagtggcacttttataatttttagatcacgatatgatttattatcaattcagaattaaaaaagtaaatagtatcaaaagtaagtgtatttaatattagaaaataaaaattttaaatttagtattaaaatggaatgttactatatagttcaatgtgtattatcacagaaaataaaataatgctttacttctatatttaaaagtgtataatgaaagttaagtaataaagagcgtgaagaaaaatgtgagttatttatatagaatattctccttttcatttatgaatttgttacaaaatatttagtgcaaaagcacgacggaggtattcaatatgaataacggtacagttaaatggtttaatgcagaaaaaggttttggtttcatcgaaagagaagatggtagcgacgtattcgtacacttctcagcaatcgctgaagatggatacaaatcattagaagaaggccaaaaagttgaattcgacatcgttgaaggcgaccgtggcgagcaagctgcaaacgtagttaaaatgtaattttaacttattcaaacagtccttactatagggctgtttttttatgctttaaatcgataacagttggtgtggtaaaagcactagccgttatttttttgtccaataaatttagttggagatttaacaatatataatggttctaaaataaatcgaactgatggaaaagttttttacttttcatctgtccgacttttgattttgaatataaaaaagcgccaatacagaactttaataatgacgagaattaaagtctgtatatggcgataacaagaagtaatgttaaacactcaaaatgtttaacaataataggataccacatcgcataatatcttactacttaattaataatttaactaatcaactttttgttaattttttattaagactgattaattattgagaatatttattgtttttaaaatctcataataattcagtaatcttgttttcatttaaaaggcgaaacattaaaataattaaataaaaatattgcgtttaatttacagcgtcaaatatacttatttctaatgctttggggtctactgaaacaagtaaagaatgatcgatgttactaatattgccattctccaaatttatttctgtgagtatttggaagctaccattaggcaacggtttaacaatagacaattgcttttccgcttgttgtattaaaaaaggttttgtagattgattattaatatgccattcactcatgtatgtttttcactcctgctttaaaatagggttagaaagtttatagttgagacattcatgttcaaccaaaattttgttcgaattcaataaatgtcttgtttaaaatagaaatattgtaaatgttatcgtccaaaacttcaccagttaagtatttgttttgaattaaaatttggcagttagttaagaagtcttgataatcacgatcgcaaaaatagttttcacgtgcatctttagcatcgccaaaaaagttagcgactgtttctgtttctcctttattcgaacgttcaatatataatttgtaaaatttagctattgtatacttttgttctttagttagttcattcaaaatattgggcctcctgaaatatcatttgtaatctatacccaatttattgcaaaacaaaaactaatttaactatttgatgaaactgtgttaataagctttaacaagccttagtttgtatggatctataaaattatctttaattgcatagggtgaaataatatgtagtccataacttttaactgatttttcacttacaccaaatttataagcttggtagataattttagtacaatacgtaaattttttgctgttcaaatttaatgtaactagataacgatgatttgtattctcatagtttttcttaacccattcagccgcttttttacctgcaccaggatagctgcaacgataaactttcatccaatcatttttgccacttgcataattatatttaaaagattcgaaggattgtgtagttggtttgtcgccaggcccctcaatttgtaaaatcgttttatcatcaatcgcgatactacaatgaccaaaaaatcsccacatgacagggccttttgtaacaataatatcaccaggttgtaattggaatttgtcatcttgaatttctgaatacttattatctgcaattgtttttggtgagtttattggggatacgacaacgaataatataagtaaaattatcgttcgtttaatatagttcacttaaaagctccttgttgaagaaatatatgtaaatagtcttaaattagaattgtaatctttaataagcttgtaagactaaaacatatcttaaatattaaagtatgagagtgtgaaatgtctattaagaatnaaaaacagtctgaaacatcattgagacgttccagactggatataaaatgaatttcatttatagcaca

SEQ ID NO: 345 - DNA, 1676 bp; double-stranded, linear
ttgcgttgccgcaccaagatattgaatgcctagcgattccgagtatgcaaactgaacgcaataattcgctttttcttcaatcttctgttcgataataagcgaattcgtttcagcagttgcctctttaatacgcgttatcgctttttgtaaatctgcatcatgataacaaatcataacgccatagccacctgctgtcggaagatcatctcccggcttaattactaacgggaattcccaattcttaatctcgttttcgaattgctcaatttttacaacttttctttttggtaaaaacttcccatttgtccattcaggtattcttgctttattatttaaagcaacaaataacgttttatctaatgcataatattgctgattcaagattgtttcatcatgaatatattgaaaataaatctttttattttccttatgtgccaattgtttgatcaagttttcgtaagattgctgattgttaaatgtataaattgagttcggtacttccttaccaataacttgaaatagctgatgcaatttgtctgtcgcactagcttcgtgaacaataacaggtaattgatttgctattaataactccctaccagttaaaaaattagattgatgttcgtccggtttcaaccatggattcgatatatacgaaggtcttgacgtatagacaacatctttgtcatataaatcacttaacgttaagttcggctcattaccattatttgtcattacttcccattccctttcaaatgcgcatgctcttcaataatgtcttgataaacgtcttgatttgtaattaactctaaccccatcaacgccattattttagcgcctttaattaatgcttcatcaccatgtacactcgcagccgcttctctaaatctatgcgtatgtcctactaaattacgtgatcctattttaatatgaggatgtattgttggcacaacatgacttacgttccctgtatccgtagagccataaccaaaatcatcatcaataactgcttcaccaacttcttcagcatatttagcaaataaatcatctaatttcggcgttttaatgaattcattcacaccgttttgaattcgaccaaattcataatcacaaccagtctgtatcgcagctccacgtgcgatttgatttactttttctgttaatatatccaattctttacgcgtcattgctctagtataaaaacgagcatgtgtatagtctggaataatattagctgctttcccgccatctaaaatcacaccatgcacacgttgatcttttttaatatgttgtcgtagttgtgctacaccattaaaataactaatcatagcgtctaatgcatttaacgcttcatctgcattttcagaggcatgagcactttttccgtaaaatttaacatctaaaacatccactgccaaagtatcaatcgttttataagtttcatttcccggatgaatcattaaggcaatgtctatttgatcaatcacaccagccttgacataagaagctttagcgctaccattttccccaccttcttcagctggacatccaagaacgactactttaccaccaatttggtcaatcacttgcttcaaaccaattgcaccaagaacacttgcagttccaatgatattatgaccacaagcatgacccaatcctggcaaagcatcgtattctgc

SEQ ID NO: 346 - DNA, 1294 bp; double-stranded, linear
tacagtaggaatcataaaacctaatacaacaaatacaaaaccatttaaggcataactaaatgtgttccaaatttgatggtaattcatttgtagttccgtttgtgctctaattaaacggtcgcgttctaaaccatggattagacctgcgattacaactgcaatgatacctgaagcatgaacttcttctgctaaaaagtatacgacaaaaggagttaataattgaataaaagttaaggtattgttatcttttaaacctttattagcggttaagtctatacgtattctaacgacaacgaatccaataattgcaccaataagtacacctagtattgttgaaatgataaattgttcaacagcttggaataatgaaaaggtaccagttactaatgcagtaacagcaattttaaatgaaatgatacctgctgcatcattgagtaaagattcaccttctaaaatcgtcatagaacctttaggtaataattttccgcgtgtaatagcagatactgctactgcatcagtaggacataaaattgctgctattgcaaaagcggctggcattggtaaggcaggccaaatccaatgtataaaatagccaacaccgactacagttgcaaacactagtgccattgacattaatagtataggtttacgatattctaataattttgttcgagagacgtgggtaccttccacaaaaagtagtggcgcgataacggcaaacataaatacttcagaattgaattggaaatcaacttgtattggaataatgaaaataacgacacctaatgcaatttgaataaaggcagtaggaatttgtgggaatcgattattgataaccgaactaataatcacagcaaaaataaaaattaaaaatgcttctaatagtgccatacaatactcctcaaaattttaatagttaatattttatcacttttaaggcataatgacatagatatattgataaaatgaagttattttcaaaaaaactctagtatcggttgaactgatactagagcgagatgtttaaattattgattgtcatatctgaaatgaccgctgtcattttgtcgttgttcatacgcgagcttttcagcattcgttttgtattttttataaaagaaaaataaaaatatnaaccagaatggcgaaatataaatagctgctcttgtttcgtcactaaagaataataaaatgaatacaaagaagaagaacgctagaataatgtaagcaataggcttaccaccaatcaacttaaatttactgtttttatgtgcctcaggatgctttttcaaat

SEQ ID NO: 347 - DNA, 1935 bp; double-stranded, linear
acatgataatgatgacgctattaaaacacgttttttatttttcattgttataaccttctttcgtatgattgatatttgttgatatgtatcgacatgtgaataatatcacaaaaacagagaatatatatttaactatttattaaatgattttgttaatattattaaatactttatcctctttaaaaataatgtgtgtacaaagtcattaatttagcaaatatttttatttagtagttaataaccatcgatttgaaatttatatataattattagctaaataatatcctgcatctttctcatacaatttactataaattagcatatccgatatcagcgttaataagatcgttgatactagmcagttaatttcatagaacgaaatcaaataacacactactttctgcattttaaattatgtttaagaatcanaattatgtttanataaatatatatactactttgaaaggtgtgagcttaatgacaacttttagtgaaaaagaaaaaattcaattactagcagatattgttgaactacaaactgaaaataataatgaaatagacgtttgtaattatttaacagatttattcgacaagtacgatattaaatctgaaattttgaaagttaatgaacaccgcgccaatatcgttgcagaaatcggtaacggctcacctatactcgcattgagtggtcatatggatgttgttgatgcaggaaatcaagataattggtcatatcccccttttcaactgacagaaaaagatggcaaattatatggccgaggcactacagatatgaaaggcggtttaatggctttggtcgtatctctaatcgaattaaaagaacaaaatgaattgcctcatggaacgattagattactggctactgctggcgaagagaaagaacaagaaggtgccaaattattagctgataaaggctatttagacgatgtcgatggcttaattattgctgaaccaactggatctggaatttattatgcacataaggggtctatgtcatgtaaagtaactgcaactggtaaagctgtccatagctcagttccatttattggtgacaatgcaattgatacactgcttgaattttataatctatttaaagaaaaatattcagagcttaaacaacaagatactaaacatgaattagatgttgcgcctatgttcaaatcattgattggaaaagaaatttctgaagaggatgcaaattatgcatctggtcttacagctgtatgttcgattataaatggcggcaaacaatttaactctgtaccagatgaagcttcacttgaatttaacgtaagaccagttcctgagtatgataacgactttatagaatcgtttttccaaaatatcattaatgatgtggatagcaataagctttcactcgatattccaagcaatcaccgacctgtaacaagcgataaaaatagcaaattaattactacgattaaagatgtagcttctagttatgtagaacaagacgaaatatttgtttcagcgcttgtaggcgcaacagatgcctctagtttcttaggagataataaggacaatgttgatttagccatttttggaccaggtaatccattaatggcacatcaaatcgatgaatatattgaaaaagatatgtatctgaaatatattgatatttttaaagaggcttccattcaatatttaaaagaaaaataagaacgatgctgtcagctgccctattcgcgtgctggcagttttttattgcgaattttaagttgatagaaatagcgatgaatattgtttgaatgtaaatattcaaatatcaacaagcacattttcattgattaagtgatgtaaaactgaaattattgtgctgatttgtcatacatatattgactaatgggcatataaaaagatagcctctaatagtnacataaactcgtaaaancc

SEQ ID NO: 348 - DNA, 1351 bp; double-stranded, linear
cctttncctaaacaatttttagatttagacaacaaaccgattttaatccatacattagaaanatttattttaattaatgattttgaaaaaattattatcgcgacgccacnacaatggatgacgcatacgaaagatacacttagaaaattcaaaatttctgatgaaagaattgaagtcattcaaggtggtagcgatcgtaacgatacaattatgaatatcgttaaacatattgaatcaacaaatggtattaacgatgacgatgtcattgtgacacatgatgcagttagaccatttttaacgcatcgtattattaaagaaaatattcaagctgctttagagtacggtgcagtagatacagtgattgatgctatagatacgattgttacatctaaagataatcaaacgattgatgcaattccagtgcgtaatgaaatgtaccaaggtcaaacacctcaatcgtttaatattaatttattaaaagaaagctatgcacagttgagtgatgagcaaaagagtattttatctgatgcttgtaagattattgtagaaacaaacaaaccggttcgacttgtaaaaggtgagttatataacattaaagtaacaacaccttacgatttaaaagtagcgaatgctattattcgaggtggtattgccgatgattaatcaagtatatcaattagttgcacctagacaatttgaagttacgtataacaacgtagatatttacagtgactatgtcattgtacgtcctttatatatgtcaatttgtgctgccgatcaaagatattatactggtagccgtgatgagaatgtcttatctcagaaattgccaatgtctttaattcatgaaggtgttggtgaggtcgtatttgacagtaaaggtgtgtttaataaaggtacaaaagtagttatggtaccgaatacgccgacagaaaaagacgatgtcattgctgaaaactatttaaaatcgagctacttcagatcaagtggacatgatgggtttatgcaagattttgtgttgctaaatcatgatagagctgtaccactacctgatgatattgatttaagtattatttcatatacagagcttgtaacagtaagtttgcatgctattcgtcgttttgaaaagaaatctatttcaaataaaaatacatttggtatttggggtgatggtaacttaggttacattacagccattttattacgtaaattatatccagagtctaaaatatatgtctttggtaaaacagattataaattgagtcacttctcatttgttgatgatgtcttctttattaataaaatacctgaaggcttaacatttgatcatgcatttgagtgtgtgggtggt

SEQ ID NO: 349 - DNA, 411 bp; double-stranded, linear
tcatcaagtctacgataaattaagtccatatctaaaggctcggggtcgacagtttgtaaagtataaccaactgcacagtggctacaacgcatattacaaagatttgtagttgtaaattcgatgttacttaaagttaattggccatgttctttaacatcgttatatgcttcccatgggtcgttttgaatacttattttaggcttgttattacgcattttataaactccttaattgttatttgataccaatttgataccgtttaatcaaatatgctcatagcttgatgttttttatcagtatataaatgagagtacgtttgaattgtttctgtaatgttagaatgcctcattaattccattaataaatacatatctacaccattattaattaaatagctagcgtacgagtgtg

SEQ ID NO: 350 - DNA, 1639 bp; double-stranded, linear
tcattttcataggttattacgcagatcagcataataatccattccatatgagtccttattttggttatgcagcacgtctattggcaacaagtggcattgactatacgtatgtaagaatggcaatgtacatggatccacttaaaccatatttaccagaattgatgnatatgcataaactgatttatccngctggcgatggtcgtattaattatattactagaaatgatattgctagaggtgtcattgctattattaaaaatccagatacttggggcaaacgctacttattatcaggctacagttatgatatgaaagaacttgctgcaattttatctgaggcatcaggcacagaaattaaatatgagcccgtttcattagagacatttgcagaaatgtatgatgaacctaaaggctttggtgcattattggcatcaatgtacgacgcaggagcaagaggactattagaccaagaatccaatkatttccaacaattagtcaatgatcwaccacagacactgcaatcatttttcaagwaaatatttaataataaaggagcgttatagtgaatatcatctcaacaattttaatcatatttgtggcattagagtttttctatattatgtaccttgaaacgattgctacaacttccaaaaagactagcgagacatttaatataagcgtcgataaattgaaagacaaaaatattaacctacttttgaagaaccaaggcgtatataacggtttaatcggagttttgctaatatacggtttgtttatcagcagtaatccaaaagaaatatgcgcagctattttagtgtatatcattggcgttgctatttatggtggcctttcaagcaatattagtatctttttcaaacaaggcacattgccagtattggcactcatatcaatgctttggtaagtattggtgtttgggggggtggagatgtagtcggaggtttggaggatttgagcgaattgtgtgtggactttagactcagagtatttcatcctaattatttcaagcagaggtgacagtagcgttgcctctgtttccttataaaaaaattatttaatgaagaaaacccatatctgatttaattttcagctgataaatactccatatattagaatggctactttatctattgcatcaatcctttaaaacaaaaaacccatgatttcgaaattcccgtatgatggggttcctactctcatggatcagttaaataaatattatcactatcagtttattatttcaatattattaacaatatatgtagtcgtaaaaggaaagaggacatgagaacttcggtgttgattggcattacataacgcttccaaacatattatttggtaacaataagaaactatttacacaatatattttgtatagtaaaattattttataatatttaaatccaattgcacaaggagtgattatcatggtaccagaagaaaaaggttctattactttgtcaaaagaagcagctatcatatttgcaatcgcaaaattcaaaccatttaagaacagaattaaaaataacccacaaaaaacaaatccatttcttaaattacatgaaaacaaaaaatcttaatcacttttatttatagcatttctaatctcagaaatgctata

SEQ ID NO: 351 - DNA, 1816 bp; double-stranded, linear
aaaatcgcatatagtaatatgaataaccagattgtatctacaaaaaagtatattgaaaaaccaagcgcacccattaataatgcgagaataataataatttttctattaaagtgatgcgtatccgaaaatctagcaataattgaatttactgtaaactggctaatcgctgcagatgctagaagtaatccatactgatttgttgtcatacctaaatctttagttgcaaaaagaacaagatatgggaccgtaaccgcaatacccatacctagtagaaacatattagcaacaaagagtttataattctytatttgtaataacgctgcaaacatatccataaccccgcttcttagagccccttttaattnatnaattaggggctcttatgcagttggtgcattagcaaccaactgtattcctttgtccccttttaatttattaattaggggctcttttgctgttggtgcattagcaaccaactacgttcaatttaaccgaatagtttaaaattaaatacaaaccttaaattagtctaaaactacgcctttggttgttcaacaaagctcgccatgagatttacaaaagaatcaacttgtggcaattgcaacatgctcggatcataactcataaatgtcgaacgaatcagcggttcattatcaatttctactttttcaaactcaaattgttctttgctgatatttttcatcataatttctggcaagattgtaacacctacaccactaatcaacatttctttgcaagttgctacttgatccactgtaatagttgcatggtaatcttgttctaaattatcgttataccattcttttatttgatttatataaatcggatcagcttgaaactctataaatggtaactttgtaacatcatctcgtctattttttggaaaaataaaataatgatcatcattaaataaatgtgtgttagctaaattcattaccttatttccacgagttatcataacatgataatctctatgatttgctttaatttgttcagttgaaccaacttgcacttgtatttcaacattaggaaattgggcattatataggctcaaaacttcaggaagtaaggtttgtccaatcaaagaagaacacccgattgatattgttccattcacttcaccaatatgtgcctgcattttgtcaaaaaataatcgctctcttttcaacatgtcacgagcatgctcaataatcattgttccttcagttgttgtaatcaattgtttttttgttctgataaaaatatctactccaaaagcattttcaatagcttttagtctttgtgtaacagcaggttgagatatatataaaatttcagccgctttacgtaacgttttcgtttcgtctaatgttattagtaaacgatagtcttcaatcttcataatttccccccataaattattcaattattgaactttcatggctacaagcattcatgagttcattactaacgaataatttcaccaattttattggtatggctgcagcttgaattacttagtttttcttttgttgttggtgatttttagtttgattatattgcttaggctttatttgtttgcttttttcaatattagttttattttgtggcttttgatgatttttttgagcctttgcattaattttattaaagcagtacatgattttcttttggaatcctttaaaatcattttctaactctgccataatttgatgtgcaatcatatatgcttcatgaaattgcttttttgtaatttgctcactttctaatgcaaacattaaatcatcttcatctaccaactcatatcaccacttgg

SEQ ID NO: 352 - DNA, 9956 bp; double-stranded, linear
gcgttgtcgtcgatgattaataaagtatgggtataccattaagaataacgctacccaaatgaktgctagtgacgtgccgccaatgacatctgaaaagtaatgtgcatgaaaataaaggcgacaaaataatatgctaagccataatattcccataaccaacgcactcaacacttttgttattgtcttagcagcaagtgaaataataatgatcattaaggcgaaatataataatgtgctggcgttggaatgtccactcggaaatgaaaagcctgtatcaacggctaaatgattatatggtcttggacgtaatacagtatctttaattaatttgttcatgatgacacctgaaaccaaatatgtcacaaaccaaaccgctaaatgcctctgtttaataaacagtatgattgtgacgataatggaaatcaacacgacacctttgacatctccaatttccgcactaaacgtcatatagtaattaaacaaattgttaacatactgacgttgtggctcaccgaaataatctgtaaaccatgttaatgatcccatatctatatttttaagccattcttgatttgtcactacactgtaaaacatacctataaatacaatcagcgcgattaaaaataaaggcactgtcattttcggtgatgttaattttttatctatcatcttacaatctcctcgtatcatcattttcattttacaaatgttatccataatatcaatgtgccacaaatttcactttaccgacaatatcaaaattataaagttcatattgttatgtatattgcaaataaaacattgtataattgaaataacaatattttgctattttcaatttagtacgatttatatttattatacagagggggtaaggcgtatcaatagagttatttttgtctatatagcgttaatcattacattagttagattctttacccctattcatccatcattttcaaatttgatttactggatatttgtattatattttattcctattatactatgcgttatcggtttcaaggccgaaaaacttattgcaacaatggtcattatacctaattttttaggaatactttatcgattatatgcctacgtcacacatatactctttatgtaaaaggatagtgggcatgtctcgcaacaaatatgcttgcgtcgacttgtcaccattcgcaaattttatgacatacgcctttcacgggctatattcagacccacgcattcatccacgtaataaacacatcatgtaatagaaaaacagcacacccaaatatatggcgttgcgctgtttaaccaagcatacttctatagctttaataagccagcagaagcatacctaaccttcttaaatatgcttttccaaattatcctcaagtttgaatacgataatacgttcacctgtaactgtacttaaatcactatggaagctcatcactttgatacctgtaattttaaaaatgatatcattcaaatcttgctcaccggattcaactaattcagaacgtgttcgtttaatatttaataatccttcattcgtactacatacacgatattcagctggcgttaagataccttgtaaactaataatcaccatatctcttaaaatgtctgatttaactgacaaggaacctctgccaaggaaatctttttcccattgcgtaatggctttactgatttcagcttcgatttcacctttcgttcttttcatatcactaactccaataatattaaaattgattacttcatctttgtatcgttatcacgacatcaactattacattaagtttatcatttttagtatattttaagaagctagaacattgtagatatgatgatatattagttacttagcatcgcaacatatcatcgttaaatccaacttttaaaacgcccttcctcattaacgctcattaaacgcagccaatgattagacaccttcctagcgaaatgctcattattcgcgagtagtcttgctacaacatagtcgggtgcctgaataacgacaagtaaacgaattggcgaatgatacatcgtccgatcagcagccataacagattgccatgataagccatacatcagatcactcgcattaccttgcatgacaccaacacctgacgtgacggtttgtgtcgctttattcccacttccgtaaaaatgcggcgcaactgtcgacgcataatattgtaaattaatccattgtgccacaagtgccggaccagaaatgatggtatttaataatgtgccatctttatctttacgccaatcataattgtgtaaaaatgtccgcccttctaaatcaatgccttttgttaattggcgtcgtccaattataaatgatgcatttttagccaatccccattctggacgtacctcactccaatcactcgcaaaccgctgcgcttcttccactggatgattcacacgaccaatcgttggcagtttgtccaaacgttcgcgattcgcgtgttcagaaatcatcggcatcgcgtcattcaatgattcatatgcatctaaagcaatagaagataatgtgtctggcacatatacccatgccaacgtatcagtagacgtatgatgttctgctaccgcaaaaacagttgtctctggaatatacacacctgattgttttaatccttgtctgacatttggacgattacatatcatcgctaataacttagcattaaaaccgcttgatgcgccaccacaagccccacattcaagtgatgcatgatgtggattattgtgagaatgactagcatgacctgctaacacaacgaacggcgcaaatgcttcggttaaatccatcaatttcaacgcttgtaacgcgaaatcaatttgctcttgctcagtaaatccaacaggtaagtctgatgttcggtcaaactcacgatcaatcgtcaactttgtttcaggctttttcaaccacttttgttttattttttgtaaagacgcgcgactttttctaggcataatcgaattgacaatggtacttaagcttaaaaatggcccacttaattcaggcaataacagactaggcatgacattatttttcatcaatttaaatgtgtaaaacatcgatgacattgtctgttgctgttgtcgataaacattcatatcgtagcggtctgcaaattctttaatgcgatatgccggcggtaccatgacaggtaatgaatcatgtttgaattgttcgtctacggcatctttttgaataggtaatccaaagaagcctgcaataccaatcgtttcaaagggccctgctgcttcgatatgtctacgaaatggttctgaacgaacatctatacaaaatgcaatttgcgctttcgttgatgtgcccatctgatttagctcgctattattttcatcaactgcttgtgtgtcatttaacaatactgaatgtggctgattagcgttatcattttctgagacatttacttggtttacatctaatgcgcccgccacactttcatgacctgctttaattttttgttttaactgagattcgtatgtcatttcccaggcaattagccataaatttttaaatacatttttattcatagttgctgcaaaatgaataaacgtttgaatttcattgacgtcatgttgtagtaatacatcgctaggcatatcactgtagtaacaccatgatgcaacagtttgcttaaaccaattttccgatctactttcacaatctttagcgactgacttaaactcatcaccaactagcaattgttcgacaactaaccgaattgccaaataatccgttaacaaatgttgttcaaagtgatgctgttgtgaacggtaatacaacatacctgcccaacccggtaacgccaaaagatgtccttcaacataagcttggtagtcttcctgatctattgaaaaatgagttaatactgactctatcgtcatttcaggatcattgggtaagcctttaatcacttggcgctgtgctttagtaaaactatggtcatgttgcgctaaatgcaaccatgcatggtaaaaactttgctcacgcttcggcattgtccaactcgatagaaattgatcgatataaagtttcgtccatttaatcatttgacgattcacttgttcgctaagtggctcaccttgttcatctattattgcatcactcatcggacgtacatcatagtgatgatatgattcagccatatcacgttttgatttttctaatagtagatcagcaacaacatcaacatttgaatgattcatatatgatgcaggtacgtcttttaatgttttaatgttatcaatataaagattgatgtagtgttgcgggatattgtagtgatgttcaagtaacatatcagtaacaagttgattaaagacactttcatctaattcaccacgtgccacagcgctttctattaatgctttatttgggaaaatatccacatctcgaacatcacgtaaccattttgcgacatcttcaaacgtatccgcttctaatccttcccatggatttcgtgctgcaaaaatcgaaattggtgataatggtgtaataacacgtttcgcattttcaatgactgaattgatatttaactgtgttgtcatacctttcacctcctataaatacttcttcaaataattcggatgactttctatcgctttcgagcgtgcttcacctagattaactaaccacacgtacaataccgcaaaagccttagagtatcgatgccgcgccacccaaatacttaataaactgccaaagattaaaataacaacactaatgatgacactcactgtaggcggcgttgtcgcatgtgttgttatattttgtaatacagcgtaaaaataattatgtgtgatgacgtagataaatgtcacgattgcaatcaaaatcataccaacaagacgtgccatgcgtcctttactaaaggctaccatttgattccaagatacaagtaatgaccatcctagaatgagtgcacttaacacttcatatgcacttctgtcactactcatccaaaatagaaatgccacgataatagctaatacacgtcccatgacaatccagccataagcgtctttagcagatgcttgttttggaatattgaatcgcttcacgatagaacctgattgtaaaaataatgttgctttaaaaataccgtgcaatattaaatgaataatcgctgctgaatatacacccaatgcacattgaactaacataaagcccatttgactcatcgtagagcccactaattggcgtttatagtcaacttgaactaagctaatacccgatcctaacaatacagaaatactagaaaggataagtaataatgataacgcaaatccattatcaaatatcggcgcaaaacgagttagaataacaccacctgcattcacaattcctgcatgcataattgccgatactggcgttggtgccgttacagattcaatcaaccatcgatgaaaaggaaattgtgctgccggtatcatgacagctaatacaagtagtacattcgtcaacaatgaccatgtcggatgaactatatgttgtggtacccgccactcgccagtcgcaatataaatagttacaattgctccaacgaatgcaagccaaccacataaaaatgtcatgcttgataatttcgcagactcacgtggcactttccaaaaacgattaacgttcatcagcaatgttaaacataataatgtaataccccagcagagtgccatcagtcttaagtcttcagacatccatgctaaagatgcaaacgacgtaatcgcagtgaacaatggaaagtaatgtctataatgatgatcacctagtaaatatcgcattgaaaacttttgaataataaagccaagcgccattacaaagccagctaataaccaagataaacgatctattttaaatggacctaagacatgttgaccatgaataccgaaaaagccaatgactgcaaataatactggcatgactagtatgtataaatgtaatttaatatatctcattggcataactggtgctaaaaacaacaagccacttatcaatgcaatgataagcgcaataacaaacagtgaaaatagcaattgaaaacttaacactgcataacctccttatttctaatctctcgcataattgcttatgtataaaaataaaaacctacaatagtagattctgtacataatggcagaaaatttactattgcaggtttcagtttaactagacactgcatcacggtacgttgatataccttgttgcagtgttctctttaagcgtgctcccatgcacatatgtatataaaatgttacttctgtctgttcaattcatcttcataaatatgctttgcctagacgagacctaacgtgttattcgttttaaacttataacataaaatataattaaatttctgcttcatgtcaaattcatgagcttaacctctattaaaccaatgattgtaaagattttgtaaatgcacctgtacagttaggcagtatttcccgtccttttaaaataaaaaattcgcagttatgatcataacaattcaagttaggaaaaaaatcaattacgcacaagataactatgtacaatgaagttaactcataagcaaaggaggtaatcttaatgggtatcatcgctggcatcattaaagttatcaaaagcttaatcgaacaattcactggtaaataagatttcataacaaacaaaggaggtctttcacatgggtatcattgcaggaatcattaaattcattaaaggattaattgagaaattcactggtaagtaagttataaaaatctcatagatatgaacatcttatttgaagggggccattcacatggaattcgtagcaaaattattcaaattctttaaagatttacttggtaaatttttaggtaacaactaatctcaaacattaacgatcaacaactcatcactatgttaaatcaacatacaggaggacaaaacgatggctattgtaggtactatcattaaaatcatcaaagcaattatcgacattttcgcaaaataatttaagcgaattgaatacttaaaattctcaggccactataccaatagggatggtggctttgctttgtgttgatttattgatgtgaggtgagtcttgttagtttgttgcaaataaatggtcttggtgttttttgtataggacgttcttagtgggacatacggaatattcgtgatctttgtagtctgacgcgttatatttttgtggcgtgttttatgtttgatactcgagttctgagacattcatgatttggcatgcgaaatcttaatgattttcatgatctagcgcaagatatattggccacgtgcggaattgcgttgcacgtttagactgaaacactcgtgtgaccgtaagtgttaatagtacattgatagctgcatttacttcactcatttttatgactgttaaacaatgattgtaccttcaattaacagttggtacgatggttttgccatttttcatcaacgtaaatataaaaaggactaagacacatacatgtcctagccctatggataaaatgcaaatttctgctttatcaaaactatcacactttagatagattgaaaacaaaaagatcctaagaacaccttaactttttattaattgtcataaattgcaaacaattaagccacaattcaaaaatgattatacttcattcaacttatcgtgctggtctaatttgccattgatatggatcttcaaattgttgccaatctgcatcaatttcttgcgcattgactaagcatgcgtcgagttcttttgttaatttttcttcatctaattctgtaccaataatgacaaattgtgtatgacgatcgccatattctggatcccattcagctgcgacatcttgacgttctgctaatatttgtgtttgttgcgcttcagacatactagccacccaatatgtaactggatgaatattgcaagatgaccctgcttgagataataaacatgctacgtgattgtattgtgctagccatacgataccttttgatcgaacgacattatttggcatgctttctaaccaatcattgaaccttttagcatggaaaggtagacgacgtttatatacaaacgatgatataccatattcttctgtttcaggtgtatgcgatgcatgcccaccagactcaagttctttgatccatcctgctgactcgctcgctttttcaaaatcaaaacgctgcgtattcaagacttcttttaaatctacttcagaatttgttgtcttaataattttagcagtcggttgcaatgcgcttaacattttttctaacttcgctagttcttcttcactaattaaatcaattttattaataatcaatacatcacaaaattcaacttggtcaattaataaatcagcaatcgaacgctcatctgtttcgtcaacgctttgatcacgatccatcaataaatcttctgagttgatgtcatgtacgaagcggttagcatccacaactgtaaccattgtatctaaacggcaaatcgctgtaagatcaatgccaagttcatcatcaatatatgagaaagtttgtgcaacaggtactggctctgaaatccctgttgactcaataacaatttgatcgatgccaccttttttcactaaacgctcaacttcttttaataaatcgtctctaagtgtacaacagatacaaccattagaaagttcgactaatttttcatctgtacgcgatagtcccccaccatctgcgacaagatctttatcgatatttacttcactcatatcatttacaattaccgcgatacgtcgaccttctcgattttgtaaaatatgatttaacaacgttgtcttccccgagcctaaataaccacttaataccgtaactggaattttagccatatatataccctcacttcaatttatttgtaaataggaataattctgttttacattatataggagcgtttcctctttcgcaatcttcgataataaaaaaatagtatacttaattaaattattgagcgctttactttataatggagacaaagatatatctcacgaaagagaatcgaggtgtataaacatgttatttgtcattttagttttatatgttactggtattgcatttattctactcagtgtttttggttcaaagactgaaggattatctacgaaacatactttatataccattggcagtgctattataacgattgctattttcatttcaattggctatgccattcaatacttaactgcagcgctttatggtttgtaaggtgaaggtgatgagtaacgggtagttcgggagaggttaacttgcgttgattttgataaagtgatcatagcttttagtacttgaggatttttattgttgctgttacgaatgtggtcatgtttaatgcgggacagtaatttaagttgtttttttacaattgagagtgtgatatttcgattcggttcgaattactttacatgggaataatataaattaaaaagaagcggcctagtgtcagttgtgaatatactgaacattggtcgctttatttagtagtatgatatgtagtttagctattaatttttttcaggtcatccttaatgctgtctatctcagacatggcacttttaacccaatctccttgagctgcacctttaaaattagctttaaaagcttcgcaatgttgcgccatttgttcaattaatactttttcttcaccttttaatccgttttcaatatctttgtatttatgcttatgttcaggtgcaataactgtgcgaatattttctttttgcgcttccattttagatatgagattaagtgtttctactgtagtacttatatctggcattcttaaggtcatatctggttctattagagtcatttaatctcctccaaattatcagtcacttagcttatctaactgcttttcataagacttttttaagtcttctttatattcttctaatttcccattcttgctttctga

SEQ ID NO: 353 - DNA, 2411 bp; double-stranded, linear
tttcttttaacagatttatcccattaattgttctacaagcccacgatgagcaatatcatttttagcaaccattaataaaccagaagtatccatatctatacggtgaacaatacctggacgaatttctccattaatacctgacaaatttttaatttgatacattaaaccattaactaatgtattggtataatgccctggtgatggatgaactaccatgcctttcggtttatatacaactgcaacatcgtcatcttcataataaatatctaaatttaaattttcaggtagaatatcagcttcaaccacttctttttcagtgacaactatatgatcattaagtttcactttataattagatttaacaactttatcgtttgcaacgactaaacctgctttaatccaatcttgtatctggttacgagaccaatcattatttaattcaggcagcaacttatctacacgcatacctgtttgttctttatctgtaatgttaaattcataagtctccattacttaacctccttctcctttttattggaagtatcctttaataaggcaataataattaatattacaccaattgttaaacttgaatctgcgatattaaatattggaaaatcataaccaaaaatatttgtatcaataaagtcaacaacttctcctgttaaaattctatcaataaagtttccaagtgcacctgcaaaaagtaaactaatagcaacttgcataaacaaattatattgagcatctttaataaagaaatatactaaggctattaatataataatggtaataataaagaaaaatgtcatttttccactcaatattccccatgcagcaccattatttcgatgtgatgttatgtttaaaaagtgcggtatcacttcaaatgaatctccaattttcattgtagtagctataatatatttagtaacttggtcaaatataacgacaaatactgctattaaaatggaagtgccaataaaatattttttgtgcattttcgttcctccaatcaatcgtccatgagacaactctttatattatagcttacacctgctaataaaaaaagtaagcatattacattaaatctaatgttactaactcaatacttgataaactactatgttttgacattaaatatgaacttaattattcatttatcatatttaagatgacattaaaaattaggaaagcaggctggaacataaatccctaaaaagacagtagtaagatattttctaattaaaaattatcttactgctgttctctatttatacaatacttcgtattgaatggcttcgctatgcccatctggcacattactgtaaaattctataaatagaatttttgatgatgggtcccttcctagggtgccgtctcagcctcggtcttcgactggcactgctccctcaggagtctcgccattaatactacgtattaacatgtaattttacttttaaatactttaaaaaaataagacatgaatcgtctacacttaattggacaaattctatgagaatagatattgttaatttaagaaagtaggctattttgagtttcactcgaatgtcagttcgaggaataaataaagttaaacgagagctaggttttgtattaatggcaattaatataaggaaaatagcagctcaacgagctgtacattataaaatacatatcaaaaaagctgatttctatcaaataattaatagaaatcagcttttttacattgcctaagaacttaatgtcccaagccctaaaacttgttgttatttatttgatttagcagcgatacgtttatatcttaagtacataaatgctaaaagtataaaccaaatcggaataaaataaattgcacgtcttgtatcaacattaataaataataacccgaacacaaaaatgaagaatacaaatattaagtagcccatatatttgccacctaatagtttgtacgtagcatttttatgtagatctgggtttttacgactataattgatatatgcaatgataatcagaccccatacaactaaaaataacactgtagagatggtagtcacatacgtaaatacttttgtcgcatctgggaaaatatagtttagtaatgctgccacaagtaataatgctgatgaagcaaagattgcaacatgtggaacgccatatttattcgtcttagaaaagttcggaggtgcttgtygttgacttgataaaccgaaaagcatacggctatttgagaatataccactgttacatgatgaagcagcagcggttaatactacaaaattaatcaagcccgcagcaaacggaattccgatcaatgcgaatrattttncgaatggactgttatcaggatcaacttgctgccaaggggtaatagacatgataaccgctaacgccccaacgttnnatattaa

SEQ ID NO: 354 - DNA, 605 bp; double-stranded, linear
gngaattatttttaataatgaaaggattacttncatgggtttttactaggantacccagaaggtcaaaatatttttgatgcgctaagtcaatatgaagttaagcgacgcggcgatatggaagaggatccatcatataaacaactcatttcttattgtttacttgaaaatgagcatggcgagatattagtgtatgaacgattatctggcggtggagaagctcgattgcatggacaatcttcaataggtgtaggcggtcatatgaatgatgttccaggagcagaatctattaacgaagtattgagagttaatgcacagagagaattagaagaagaagtaggtttaagtgagcaagattcacaaaatatggaatatatcggttttattaatgacgataataatgaagtgggcaaggtacatattggtgttgtatttaaaatcactgtaagtacgaatgatgtagaagctaaagaaacagatactttacgaataaaatgggttgaaaaaggcaacatagagtcatatgatgatttcgaaacgtggagtgcattaatccttcaagatttataatcaaacgaggtgacatatatgtcagatattattccag

SEQ ID NO: 355 - DNA, 668 bp; double-stranded, linear
tttattagcacatccaaactattcatatgttggacaatttttaaacgaactaggatttaaaaatgcattaagtgacgatgtaacaaaaggtttaagtaaatatttgaaaggaccttacttacaattagacactgaacatttagctgatttaaatccagagcgtatgatcattatgacagatcatgctaaaaaagattctgctgaattcaagaagttacaagaagatgcaacatggaaaaagttgaatgcagttaaaaataatcgcgtggatattgttgaccgtgatgtttgggcaagatctcgtggcttaatttcttctgaagaaatggctaaagaacttgttgaattatcaaaaaaagaacaaaagtaaggtggaagtaaatggctataaaagaaataagtagccaatctgccatagatcataaaagaaaaagacgcacaacactcacgtatatagtgagtttgtgctttctttttatttgtatatatttaaatatggcgattggttcttcgaaaattaattttagcgatatcattcactatgttactggtcatacagatacgaaagcaacgtttttattgcataatgtacgtatgccaaggatgattgcagggttatttattggcggtgcattagcggtatctggtttgttaatgcaagcaatgac

SEQ ID NO: 356 - DNA, 787 bp; double-stranded, linear
atacaaaaaaacatatcgaaaataaagctaaaagaaactatcaagttccatattcaattaatttaaatggtacatctacaaacattttatcgaatctttcattttcaaataaaccttggacaaattacaaaaatttaactagtcaaataaaatcagtactgaagcatgatagaggtattagtgaacaagatttaaaatatgctaagaaagcttattatactgtttattttaaaaatggtggtaaaagaatcttacagttgaattcaaaaaattacacagcaaacttagttcatgcgaaagatgttaagagaattgaaattactgttaaaacaggaactaaagcgaaagcagacagatatgtaccatacacaattgcagtaaatggcacatcaacaccaattttatcaaaacttaaaatttcgaataaacaattaattagttacaaatatttaaatgacaaagtgaaatctgtattaaaaagtgaaagaggcatcagtgatcttgacttaaaatttgcgaaacaagcaaaatatacagtatatttcaaaaatggaaagaaacaagtagtgaatttaaaatcagacatctttacacctaatttatttagtgccaaagatattaaaaagattgatattgatgtaaaacaatacactaaatcaaaaaaaaataaataaatctaataatgtgaaattcccagtaacaataaataaatttgaaaacatagtttcaaatgaatttgtgttctataatgcaagcaaaattacmattaatgatttaagtataaaac

SEQ ID NO: 357 - DNA, 534 bp; double-stranded, linear
aaagtaaaaataaatctccctttttaactttcgtttctgccatagccattgcttcttctgtgatagttgctacaatatcttttctttcacggttaaaatgttcaacttgttctgctaaaaatgcagcttcttcttcgacgtcagtcatcaacaattcgcaagctaatgatgcgtcatctaaacgacctacagcattaagtctaggtccaataataaaaccaattgtttcttcatcaatattgtcattgtatcccgcttcttttagcaatgctttaacagaggtcggacattgatcatttaagacttttaatccttgtttcactaatgatcgattttcatcagttaaggatactaaatccgcaatggtacctatcgcaactaatgctttaaaataatcaggtacattttcaatcaatgcttgtgctaatttgtatgcaacacctgcaccacacaattgttggaacggataattaaacgatggatgcattggatgtacgattgcatatgcttctggtaatgtactaccaatttcat

SEQ ID NO: 358 - DNA, 3621 bp; double-stranded, linear
ggtgagtcaaattaaatgaatctaataagtcataactatctatttgtaatgtgcaacgcttaacgcatatacaaaatgaatgtgctgataatgatttactcaaattaaaaggtgatttttattcaatgatgaatgaaagttgcctttttatttttggtaaaagttaatgcgtcagtgaattgtgtaagtttttcaaaaagtaaaaagaaataataaaggtgaattattagaattccaraaataattcattacattcataaagcattttacaaatggtaagaaaatgagtgttacaaatctaaatattgcaaaagaagctgatttagtcacaaaaaatgtcctatgtaataattcgagaaagatgcactatatacggtcttcttactattcaaatgtaaaagttgcttatttgcgtggctttttgttttataaaagtataaaattttactataatatatcttgtagagaacaatgaaatgacagacttataaaacaaaatagtaagctatgctaatttttatacaaaaaatatgtataaacatagcaaactgtattactttgatacaaaaatggttgtaataaatatttatcgatatgacgacttgaatatgataaagtgacatatttatgtatatgactatttcgcaaaatgtaatcgaggtagaatttcttgacaattctgtcagtttataagatgttataaatatgtagtgtataaggaggcaaacaagatgactgaagaattcaatgaatcaatgattaacgatattaaagaaggtgacaaagtcactggcgaggtacaacaagttgaagacaagcaagttgttgttcatatcaacggtggtaaatttaatgggattattcctattagtcaactatctacgcatcatattgatagcccaagtgaagttgtaaaagagggcgacgaagttgaagcatatgtcactaaagttgagtttgatgaagaaaatgaaactggagcttacatcttatctagaagacaacttgaaactgagaagtcttatagttatttacaagaaaaattagataataatgaaatcatcgaagcgaaagtaacagaagtagttaaaggtggtttggttgttgatgtaggacaaagaggttttgttccggcttcactaatttcaacagacttcattgaggatttctctgtgtttgatggacaaacaattcgtattaaagttgaagaattggatcctgaaaataatagagtcattttaagccgtaaagcagttgaacaagaagaaaacgatgctaaaaaagatcaattattacaatctttaaatgaaggcgatgttattgatggtaaagtagcgcgtttaactcaatttggtgcatttatagacattggcggtgttgatggtttagtgcatgtatctgaactttctcacgaacatgttcaaacaccagaagaagtagtttcaattggtcaagatgttaaagttaaaattaaatctattgatagagatacagaacgtatttcattatcaatcaaagatacgttaccaacacctttcgaaaatattaaaggtcaattccacgaaaatgatgtcattgaaggtgtcgtagtaagattggcaaactttggtgcatttgttgaaattgcaccaggtgtacaaggacttgtacatatttctgaaattgcacacaaacacattggtacgccaggtgaagtgttagaacctggtcaacaagtaaatgttaaaatattaggtattgatgaagagaatgaaagagtatcactatctattaaagcaacattaccaaacgaagatgttgttgaaagtgatccttctacgactaaggcgtacttagaaaacgaagaagaagataatccaacaattggcgatatgattggtgataaacttaaaaatcttaaactataatttaatatttaatagtcaactccacatgtttatgattgcatgtggagtatttttatgtaacaaaatatactcggaatgataacgtgggacaaatttaactaagtgtttaaaaagataragttttaagtgctgatttttatcattacagtaataaactcattttgaatacacagtctcatgtgatattattaaaaagatataagaaagagaggaagttagcttatgactaaacctatagtagctattgtaggtaggcctaatgtaggtaaatctacaatttttaatagaatagttggagaacgtgtttcgattgtggaagacacgccaggtgtaacacgagatcgtatttattcttcaggtgaatggttaacacatgatttcaatattattgatacaggtggtattgaaattggtgatgcaccattccaaacacaaattagagcgcaggcagaaatcgccatagatgaagcggatgttattatttttatggttaacgtgcgtgaaggattgacacaaagcgatgaaatggtcgctcaaattttatacaaatctaaaaaaccggtcgtattagcggttaacaaagtagataatatggaaatgcgtacagacgtgtatgatttctattcattaggatttggtgaaccgtatccgatatcagggtcacatggtttaggtcttggtgacttgttagatgcagttgtttctcattttggtgaagaggaagaagatccttatgatgaagatacaattcgactatccattattggacgaccaaacgtaggtaaatcaagtttagtaaatgctattttaggtgaagatcgcgttatcgtttctaatgttgcagggacaacgagagacgctattgatacagagtatagttatgatggacaagattatgttttaatcgatactgctggtatgcgtaaaaaaggaaaagtatatgaatcaactgagaaatattcagtattaagagctttaaaagcgattgaacgttcaaatgttgttttagtggtcatagatgcagaacaaggcatcattgaacaagataaacgtgttgcaggatatgcacatgaacaaggtaaagcagtcgtgattgtcgtaaataaatgggatactgtggaaaaagatagtaaaacgatgaagaaatttgaagatgaagtacgtaaagaattccaatttttagattatgcacaaattgcttttgtgtctgctaaagaacgcacaagattacgtacattattcccttacatcaatgaagcaagtgaaaaccataaaaaacgtgttcaaagttcaactttaaatgaagttgttactgatgcaatttccatgaaccctacaccaacagacaaaggtagacgtttgaatgtcttttatgcaacacaagttgctatagaaccaccgacatttgttgtatttgttaatgatgtagaattaatgcatttttcttataaacgctatttagagaatcaaatccgtgccgcttttggttttgaagktacaccaattcatattatagctcgaaagagaaattaacgattgggggataacaatgactaaaattaccgtttttggtatgggaagttttgggacagcccttgccaatgttcttgcagaaaatggacatgatgttttgatgtggggtaaaaatcaagatgctgttgatgaattaaatacatgtcatacaaataaaaagtatttaaaatacgcgaaatta

SEQ ID NO: 359 - DNA, 643 bp; double-stranded, linear
ctttcggaaattaggatcngngctatcttggccccaattaccaagggaactantggcaccaaatggtggcaatcgccgtccattaatatcggtccaattctagtaccgcctgcttcgattaatgcttctttcatctccatgccctgttgctcattattaataacacggtctattaacacaatggcatttgttactacgattccaattaacattagcataccaattaaacttggtactgatattgtttctcctgtgattaatagtgcaataattacaccgataactgtaaatggtaaagagaataaaattgtaaatggtgctaggccacctttaaatgtaataactaggattaaatatacgataatgattgcagctaacattgcaaaggctaattgtgtcattgcattgttaatatcatctgatgcaccaccgatattaacctttacattattcggtttatccaaattatttattttagacatcacttgtcgtgttgtgccacccacatctttatttgttactttagcagataccgtcgttgcataatctccttgttcttgcgtcaatttacttggtgtcgttgttttaactaacgtagcgatatctcccaatttaatcgtaccaccagtcggctttttcaaag

SEQ ID NO: 360 - DNA, 2524 bp; double-stranded, linear
tttcaggcygtgcaagggctttttcttttgcttttaagattatgatttatcgtgcaaagttaagtggtcgtatatagttttagttttaaaaaggtaattaaataaaatagtttgccgagggagatgtcaaaatgattaaaatacctagagggacgcaggatattttacctgaagattcaaagaaatggcgttacattgaaaatcaattagatgaattaatgacattttataattataaagaaataagaacaccaatttttgaaagtacagatctttttgcaagaggtgttggtgattcaaccgatgtcgtacaaaaagaaatgtatacatttaaagataaaggcgatagaagtattacattaagacctgagggaacagctgcagttgtgcgttcatatattgaacataaaatgcaaggtaatccaaaccaaccaattaaactttattacaatggaccgatgtttagatatgaacgtaagcaaaaaggacgctatcgtcaatttaatcaatttggtgtagaagctattggtgctgaaaatcctagcgtagatgcagaagtattagctatggttatgcatatttatcaatcatttggattaaaacatttaaagcttgttattaatagtgtaggggatatggcgtctcgaaaagaatataacgaagcgttagtgaaacactttgaaccagtaattcatgaattttgttcagattgtcaatcacgtttgcatacaaatccgatgcgaattttggattgtaaagtagaccgtgataaagaagcgattaagactgcacctagaatcactgatttcttaaatgaggaatctaaggcatattatgaacaagtaaaagcttatttagatgatttaggtattccatatattgaagatcctaacttagttcgtggattggattattatacacatacagcatttgaattaatgatggataaccctaactatgatggtgccattacaacgctttgtggtggtggccgttataatggtttattagaattgctagatggtccaagtgaaacaggtattggttttgcgctaagtatagaacgattattgcttgcacttgaagaagaaggtatcgaattagatattgaagaaaacttagatttattcattgttacaatgggtgatcaagcagatcgatatgctgtgaagctattaaatcatttgagacataatggtattaaagcagataaagactatttacagcgtaaaattaaaggacaaatgaaacaagcagaccgtttaggtgccaagtttacaatcgttattggtgatcaagaattagaaaataataaaatcgatgttaaaaatatgacaactggtgaatctgaaacaattgaattagacgcattagtcgaatattttaagaagtagagagggcgttaaaatatgagtaagagaacaacttattgtggattagttactgaggcatttttaggacaagaaattacattaaaaggatgggttaacaatcgtcgtgaccttggtggattgattttcgttgatttaagagatagagaaggaattgtacmagtcgtgtttaatcctgcattttcagaagaggcattgaaaattgctgaaacagtacgttctgaatatgttgtagaagttcaaggtacagttacgaagcgtgaccctgaaacagttaatcctaaaattaaaactggccaagttgaagtacaagttacaaatattaaagtgattaataaatctgagacaccaccattttctataaatgaagaaaatgttaacgttgatgaaaatattcgattaaaataccgttatttagatttacgtcgtcaagagttagcgcaaacatttaaaatgagacatcaaattacacgttctattcgtcaatatttggatgatgaagggttctttgacatcgaaacaccagtactaacgaagtcaacacctgagggtgcacgtgactatttagtaccatctcgtgttcatgatggtgaattttatgcattaccacaatcaccacaattatttaagcaattattgatgattagtggatttgacaaatactaccaaatcgtaaaatgcttccgtgacgaagatttacgtgcagatcgtcaacctgaatttacacaagtcgatattgaaatgagttttgtagaccaagaagatgtgatgcaaatgggtgaagaaatgcttaaaaaagttgttaaagaagttaaaggcgttgaaattaatggcgctttcccacgcatgacatataaagaagcgatgcgtcgctatggttctgataaaccagatacacgttttgaaatggaattaattgacgtttctcaattaggacgtgatatggactttaaagtatttaaagatactgttgaaaatgatggtgaaattaaagcaattgtcgctaaaggtgcagctgaacaatatactcgtaaagatatgggatgctttaacagaatttgtaaacatcymtggtgctaaggttagcgtggggttaaagttgtgggaaggtggttttgacaaggtcccaatgg

SEQ ID NO: 361 - DNA, 1507 bp; double-stranded, linear
tcgttgagtaaaagtccagaaaattggatgagtaaacttgatgatggaaaacatttaactgagattaatataccgggttcacatgatagtggctcattcactttaaaggatccagtaaaatcagtttgggcaaagactcaagataaagattaccttacccaaatgaagtcgggagtcaggttttttgatattagaggtagagcaagtgctgataatatgatttcagttcatcacggcatggtttatttgcatcatgaattaggaaaatttctcgatgatgctaaatattacttgagtgcttatccaaacgaaacaattgtgatgtctatgaaaaaggactacgatagcgattctaaagttacgaagacatttgaagaaatttttagagaatattattataataacccgcaatatcagaatcttttttacacaggaagtaatgcgaatcctactttaaaagaaacgaaaggtaaaattgtcctattcaatagaatggggggtacgtacataaaaagtggttatggtgctgacacgtcaggtattcaatgggcagacaatgcgacatttgaaacgaaaattaataatggtagcttaaatttaaaagtacaagatgagtataaagattactatgataaaaaagttgaagctgttaaaaatttattggctaaagctaaaacggatagtaacaaagacaatgtatatgtgaatttcttgagtgtagcgtctggaggcagcgcatttaatagtacttataactatgcatcacatataaatcctgaaattgcaaaaacgattaaagcaaatgggaaagctagaacgggttggctgattgttgactatgcaggatatacgtggcctggatatgatgatatcgtaagtgaaattatagatagtaataaataaggattcaataatgatattaagacgagtatgaaaatagttagattctaattattttcactactcgtttttattttgaaaataagtaataattcaacaatattataaattgaacagattgtttgtgaaatttttgataatattaaagtgaaaaagtgttataaattgataaatatatgtaattaacaaaaacaaatcattttaaaaagaagagagttgtaagatgatgaaacgattaaacaaattagtgttaggcattatttttctgtttttagtcattagtatcactgctggttgtggcataggtaaagaagcggaagttaagaaaagctttgaaaaaacattgagtatgtaccctattaaaaatctagaggatttatacgataaggaaggctatcgtgatgatcagtttgataaaaatgataaaggtacatggattataaattctgaaatggttattcaacctaataatgaagatatggtagctaaaggcatggttctatatatgaatagaaataccaaaacaacaaatggttactamtatgtcgatgtgactaaggacgaggatgaaggaaaaccgcacgacaatgaaaaaagatatccggtt

SEQ ID NO: 362 - DNA, 1216 bp; double-stranded, linear
tacatgtttcggatgctactttatttagtttgaagggtgcattatggacgttagcgcaagaagtttatcaagaatggtatttaggatcgaagttgtatgaagatgttgaaaagaaaatagcacgaactacttttaagacaggttatatttatcaagaaattattttgagaccagtagatgaagttaaggtacttctgaatgatttaaaaggtgctggtttcgaattaggtattgcaacaggtcgtccttatactgagactgttgtgccatttgaaaatttaggattgttaccatattttgaagctgattttattgcaacagcaagtgatgttttagaagcagagaatatgtatccgcaagcacgaccattaggaaagccgaatccttttagttatatcgcagctttatatggtaataatcgcgataaatatgaatcttatatcaataagcaagataacattgtaaataaagatgacgtatttatagtaggcgattcgttagctgacttattaagtgctcaaaaaataggtgcaacgtttattggaacattaacaggtttaaaaggtaaggatgctgcaggtgagttagaagcgcatcatgccgactatgttattaatcatttaggtgaacttagaggtgtactagataatttgtaatttgattgttgtttgacagcataacttgtagtgaatgattgaaccaaaggtttcatattgagttacaatgaaattaataatgaaaaaatgccaagaagcaatggaagtaatccaatgtcttcttggcattttgaatttacataaattgtttatgactgtaccgtcaattcagttgtgaaaatttgattgtattcaccaacttgtttaagttcatcaattatattgtttgaaacaggttgatcaacggataaaatcattagcgcatctccgcccgcttcagttctacctaaagtcatagatgcaatgttgatattgtatttacctaacaatgcgccagtttttcctaccatacctggagtatcattatgatatgacacaatttgatattgatttggctttaagtctacagaaaaattattaattctaacaattcttggaccgaaacctgtaaagacagaagcgccaactttaacggaatcgcnatcgnttgatagttctacctctaagtagttactaaaacctgtctctgctttattattttcaatatttaatgtcacttg

SEQ ID NO: 363 - DNA, 867 bp; double-stranded, linear
atcaaaatattttaaataatattgatggtcacattgtaaatrmaatagaaaataaatttgatcaaatattacaagaaccattaaatccattaaattatgatactgtcagtggattagctgggatagggagatatttgctaaatagagtagatgagaatgaatttaatgttaaagcattaaaaagcatattagtatactttaaagatattcaatattctaaaaatagctgggtagtcccacaagaragtcaatttttagagtctgataaaaattattttactgaaggtaatatcaatcttggccttgcacatggagtgctaggaccgatgtctttatttgcattatgcgtgattaaaggaattacgattgaaaatcatcagcacatattaaaagacatgtacaaatttatcatggacgaaaaattttgtaaccacgaaagatggttgcagcgttacgatttaatttctgaacgtaatcatttcaattttattcggaatggttggtgttatggcaatacgggtgtaatgacgacgttgtttttaatcggccaagcattacaagatgatgaaataattaaaatgtctaaaaaagtgatgctacaagtagtaaatgataaagatgaaaatttaataagtccaactatttgtcatggattgtcatcacaaatattaatgttaacaattatgaatttgaattttgaattaaatgaagtgtctgattatatcactgtattaataaataaactgatttctcattataaggaagattatctggtgaattttatagacattaatgaaaataagcaagatgtatttaaaagtaggaaagttggccttttagaaggtgaattaggggtcatctaacatt

SEQ ID NO: 364 - DNA, 10813 bp; double-stranded, linear
taccttttcttttaaatcattttatattttcccactaatatccgctgttaatcaatcctgacatccttgtatcactatgacaattaattgttaaatacatgaatttctacattttatgaaaaaatccatttttattacaattcaacactttatatgacaacttcattacagttacttttattgttgattgcttacattgttttctaaaaaaaatttgttatcataattaacgttgaataaagaaaaaaattaacttgggagataaaaatggaatataaaaagatactaattcgtttattaattgcttttgcagtacttttctcagcagatttcacttatcaatccgtcgaacaaacgcatcaatcgcatgccgcagttaattattatagtaaaaaccaatgtacatggtgggcatttaaacgtcgcgcacaagtcggtaaacctgtttctaatagatggggcaatgctaaaaattggtattacaatgcacgtaaatcaaaatatgcgactggtcgtacaccaagaaaatttgctgtcatgcaatcaactgcaggatattatggacatgtcgcagttgttgaacaagtatataaaaacggtagtattaaagtttcagaatacaacttttatcgcccattaaaatacaatacacgtgtactaagcaaaaaggcagcacgtaactttaactatatttactaatcaaaaaacttctatcacgaacgcttcaatttcctgtatgcgtgtgatagaagtttttattttatgaaattatattattacttctacaaatttcaaattgccgtaattgaacgtatatttcttcttcaactattatttcatctttagcataatctatatataaaattttatgctattatttaaataattcgctataacttaacatacgttttcgatataaaccttgttctaaatctcaataattttttgctgttttcatcgtcattagttaaaaaaataatttaactgagtttttgagacctgtttaaattgatgactcaaaacctttatccccttttcactcggtttaattgctttaatatttaacacagtctcattgtaattttgctactaagtttgaaatatttcgattcgaatgtgaacatcatttattattactttcgacagctagaaaaatattgttaaaccaaaactataattaccacttttatatagaactatatataaattttaactttgagacagaactgctagtcaggtttatgaatatatttctttagtttacttgatatacttattggtaaatcattatttatttgaagagcatttataacaaaaagtataatcccagttatagcgattccatgaccatttttatcagtcaaagattcatcaacaaaaactttttgataaatttatatatttgtataatttattatggtagatatctacacccgtatctataacagctacagttatcattgcgtcttatccaaatagtttttaagaaataaatataattcattaatatcatggctatttgtaacgtcagtgcttaagaccttgtcaattattgttttatctgtttctaagagcccctgattttctgcatacatattttgtatatcgctgttaatctcatttaattttttaaatttttttctaacctttttcaaaataaaatgctctttaattccatctcttaaatacatataaatctctattataatctccataaatgtcatatctcctctctcaaaaaacattatactcaatatattaaaaataagaaaggttttttcagaatttttagtattttcagatatttattcttaagtatcttattattacttctttttaacgctagtggaataattaataataattgtatttaaatgcaatgctgttgttctttcatacttacaagcaagtcataagaaatgagaaattaaattcttatatgatgaataaatgatgactgcagaagaaattgctaaaaaaggagtggagtgaggcattctactgttcatattgttaacaaatatcaaaatgataggaacttgaagaatctaagactgttaaaatcgagacaagaagaaactcgttccaaatttgaatcctataatgaattcgtctcatgaagaagttatttacttttcattagactgatttactaatcaaaaaacttctatcacgaacgcttcaatttcctgtatgcgtgtgatagaagtttttatttttgttcatattaatttatctaagcgctacgatggactgacttaaacttttctttaaaatcgctattcgccatttactattgttgtctaatttcttgtaaaatatgttccgctgcttgtgtatttgcacggggttcttttttcaaagcttcagctactttagcaatttcatcaccttttgcccctacaacgatagctaatgatttatattgtaaactcatatgaccttgttgaataccttctgacacaagcgcgcgacatgctgcaaagttttgcgctaaaccaacggcagcaactacatgacctaattcttgtgctgactctacatttagtagctctaatgaagctttagcaattggtaatacttttgtaccaccgccaacgattgccaatgtcataggcacttcaattgtaccaatcaatcgttgacgatcttgatcgtaacgccatgtagcaataccacgatactgtccgtcacgactcgcgtatgcatgcgcacttgcttctgcaccacgcgtatcatttcctgttgctaaaacaacagcatgtatgccattcataacacctttattatgtgttgctgcacgatgaatatctacttgggccaatacagaagcacgttccattcgtttggcaacctcttctccagttctctcgccccttgctaaatctttaacatcaatttcgccttgaactttaacaacggacgctgttgcatgattggataaaatactcattaaaatgtcgctttgcggaaattcattttttaaaaatgcagttatggcctctaaaatcgtattaagcatattagcgcccatagcatctttcgtatcaacaaatacttttaaagatagtaactgttgctcaggaaatgtatcaatcgctatacgttggtaaccaccaccacgcgctttaatagaaggatatgcctcatccgcaattttatgaatttgcttttctaaagctttaatgtctgctgataatttttcagtatcgtcaacgccatcaaagacgatttgacctatcataatacgttcagaagataccgttttaaatccgccagtctgattcactagctttgcaccataactagctgcagcgacaactgaaggctcttccaccatcataggtacaacatatgccttatcgtccacaatgatattcggtaataatccaacgggtaatgcaccttgcgcgatgacattttcaattaaactattggctacttcttcatcgattaatggatgattcagtaaaatgtcgaattgttcttctgataaccattgcttatcaaccaattgttgtaacttttctttacgagataaatgtcgaaaattcttatctaaattttgcatggacgtactccttttacttcacataatttttaacatttcaatcactactatttttaccacaaaataacgtcattcgtcttaaaattcaattgaataattgtcgttttgactttaaaataaaacaaggtaaattaaaacgcttacaagaaacgacaaatcatttttaaatttagtatatttctttgtataaaattagcatattctgatatgatacaagtgttgcttttataaatttgaaaggatgtaaaaccttatgacaataggtatcgataaaataaacttttacgttccaaagtactatgtagacatggctaaattagcagaagcacgccaagtagacccaaacaaatttttaattggaattggtcaaactgaaatggctgttagtcctgtaaaccaagacatcgtttcaatgggcgctaacgctgctaaggacattataacagacgaagacaaaaagaaaattggtatggtaattgtggcaactgaatcagcagttgatgctgctaaagcagccgctgttcaaattcacaacttattaggtattcaaccttttgcacgctgctttgaaatgaaagaagcttgttatgctgcaacaccagcaattcaattagctaaagattatttagcaactagaccgaatgaaaaagtattagttattgctacagatacagcacgttatggattgaattcaggcggcgagccaacacaaggtgctggcgcagttgcgatggttattgcacataatccaagcattttggcattaaatgaagatgctgttgcttacactgaagacgtttatgatttctggcgtccaactggacataaatatccattagttgatggtgcattatctaaagatgcttatatccgctcattccaacaaagctggaatgaatacgcaaaacgtcaaggtaagtcgctagctgacttcgcatctctatgcttccatgttccatttacaaaaatgggtaaaaaggcattagagtcaatcattgataacgctgatgaaacaactcaagagcgtttacgttcaggatatgaagatgctgtagattataaccgttatgtcggtaatatttatactggatcattatatttaagcctaatatcattacttgaaaatcgagatttacaagctggtgaaacaatcggtttattcagttatggctcaggttcagttggtgaattttatagtgcgacattagttgaaggctacaaagatcatttagatcaagctgcacataaagcattattaaataaccgtactgaagtatctgttgatgcatatgaaacattcttcaaacgttttgatgacgttgaatttgacgaagaacaagatgctgttcatgaagatcgtcatattttctacttatcaaatattgaaaataacgttcgtgaatatcacagaccagagtagtcggtgtatttaaaacacatataataaaacctaaaagcagcagtaagaccacttctaattgaaatcgtcttactgctgttctctatttataacacttcgtattgaatgaattcattatgcctatttgacacattattgaagttttcctaatgcctggatcctttatacgttacggcttcgtgctatgttttggtacataaagctttgacatatcgatattctccaactctaacagcttaattttattattaatcgttccaccgaaccctgttaagctacccgttttaccgacaacacgatgacatggcacgataatagataatggattacttccgactgcacctccaaccgcttgggctgacatttttggcttgttaagcagcttgcctacttttttggcaatagcaccatacgttgttagagtcccataaggaacctgtcttaattcattccaaacacactgttgaaaatgactacctgttggctttaaaggtattgtgatttcaggattgtcacctttaaaatacgcgtctaaccactgtgtcgcctctctaaatatcgctaaagacgtattttcttccctagtaccatcaccttgttgattttcaaacaaaacagcggtcagacttaccccatcactcaaaagttccaatcgtcctacaggcgaatcatagtaactcttatactccataaaaattccccctttttctaatcatacgccttaattgttaaattagaaaatattcatgttcacattttttaaaaataaataagtcgtcaattacgtatataaacacgtaataccagctatcactttgctgcaatatacagttacatatcttactacacgtgctaacctcttactttgtaaaccaaatcttaaattaaaatattgaaaatgcaatgaatccttaatattttattaaacctataattacttattaaaaataacacacaatattcataaagttttaaaaatattctgttttatcacctactattagtggaaaagtacaattgcaattgtatatagtttgcataacgcttcaaaagtaatttcttttttgtttagttcaaaaaaatttagaggtgatgttatatgaataacggttttttcaatagcgactttgattcaatttttcgaagaatgatgaaagatatgcaaggttcaaatcaagtcggaaacaaaaagtactatattaatggtaaagaagtttcacctgaagaactagcgcaactcacacaacaaggtggcaatcactctgctgaacaaagtgcgcaagcttttcaacaagcagcacaaagacaacaagggcaacaaggtggcaacggcaattatttagaacaaattggtcgtaaccttacgcaagaagcacgtgacggtttattagatccagtcattggtcgtgataaagaaattcaagaaactgctgaagttttaagtagacgaactaaaaacaatcctatattagttggagaagctggtgttggtaaaactgcgattgttgaaggtttagcacaggcaatcgttgaaggaaatgtaccagcagcaatcaaagacaaagaaattatttctgtagacatttcatcattagaagctggaacgcaatatcgtggtgcttttgaagaaaatattcaaaaattaatcgaaggtgttaaatcttcacaaaatgccgtactattctttgatgaaatccatcaaattatcggttcaggtgccacaggaagtgattcaggtagcaaagggttatctgatattttgaaacctgcattaagtcgtggtgagatttctattattggtgcaacaacacaagatgaatatcgaaacaatattcttaaagatgctgcattaacgcgcagatttaatgaagtgcttgttaatgaaccaagcgctaaagatactgttgaaattttaaaaggtattcgcgaaaaattcgaagaacaccatcaagtaaaattaccagatgacgtattaaaagcatgtgttgacttatcaattcaatatattccacaacgattattaccagataaagcaatcgatgtgttagatattacagcagcacatttatctgcgcaaagtccagctgtcgataaagttgaaactgaaaaacgaatttctgaattagaaaatgataaacgtaaagcagtaagtgctgaagaatataaaaaagctgacgacattcaaaatgaaatcaaatcattacaagataaattagaaaatagtaatggtgaacatactgctgttgctacagttcatgatatttcagatactattcaacgattaactggtattccagtttctcaaatggatgataacgatattgaacgtttaaaaaatatttctaatcgtttaagaagtaaaatcataggtcaagatcaagctgtagaaatggtttcacgtgcaattcgccgtaatcgtgctgggtttgatgacggcaaccgtccaattggcagtttcctatttgttggccctactggtgttggtaaaacagagcttgctaaacaattagcaattgatttatttggtaataaagatgcactgattcgacttgatatgagtgaatatagtgacacaacagctgtttcaaaaatgattggtacaactgctggttatgttggttatgatgacaattcaaatacgttaactgaaaaagtacgccgtaatccatactcagtcattctatttgatgaaatcgaaaaagcaaatccacaaattttaacattgttattacaagtaatggatgatggtaatttgactgatggtcaaggtaatgtcatcaactttaaaaatacaattattatttgtacatcaaatgctggctttggcaatggcaatgacgctgaagaaaaagatattatgcacgaaatgaaaaaattcttccgccctgaattccttaaccgcttcaacggcatcgttgaattcttacatttagataaagatgcattgcaagatatcgtcaacttattattagacgatgtacaagttacattagacaaaaaaggtattacgatggacgtttctcaagatgcgaaagattggttaattgaagaaggctatgatgaagaattaggtgcacgtccattaagacgtattgttgaacagcaagtacgtgacaaaattacagattactatttagatcatacagacgttaaacatgtggatatagatgttgaggataacgaattagtcgtaaaaggtaaataacgacactttaacatatcgcgcatcaaaaatgagcatcaggtcgcccttgcctgtgctcatttttttaattatttccctggaaaatgattcgctgtgtgctgttctgttccacaacaatcacgattaatgtcacatgtaccacattttccttgttttgaacgcttgaaaaattttactagtgtatataaggcatatccgaaaattgctaaaaaaattaaaatgttaataatgactgacactttaaccactccttaaacaaataaatgtccgacttgataaaaaatgaatgttaagacatatgcagtgactagaggataggcaactgcaagtgccgtccatttccatgaataagtctctttacggattgctgctactgtagaaacacaaggaatatacaatagtataaatatcataaatgcatacgcagatagcggtgtgaattgattttgaatcacattaacaaggcctgcatcacctgatgaatagataatcgccatcgaacttacgataacttcttttgctaaaaatcctggcactaacgtagcacctgcttgccatgttccaaatccgagcggttgcactaacataccaaagaaactaccaaccatatgtaaaaaactttgattgatattcacattgataccatgtggtcctacataacttaatagccaaatgactactgagccgccaaaaataaatgtacctgctttacgaacaaagcccttagccttttcccaagtactacgccacaacgttttaatggaaggcacacggtatgttggcaattccacaataaagattgcattatcattttttaaaatcgtcttagtaagtactgtactgactaaaaatgccataataatacctaaaacatacaggcttaatactactaaagattgattctctttgaaaaagatacctacgaacaacgcatacactggcagtctagcagagcatgacatgaatggtgcaattaatatcgttgttaaacgctctttttcattttcaatactgcgcgcagccataatactcggtacattacaaccaaatccgataatcattggtataaaagacttcccgcttaaaccgaacgattccataatacgatccattaaaaccgcaatacgtgccatataacccgaatcttctaataaagatataaagaaaaagagcacaacaatttgtggtacaaagactaatactgatcctacaccagcaataatgccatctgtaattaaatcttgtaaaaatggtataacaccaagataattcataatcgtcttcacactatctgtaaatgtaccacctataaatgcatcgagttgatccgacaaaggtgtgccaatccatgtaaatgtagtttgaaagatcaaccacataattgctagaaagataggcatccctatatatttatgtgttaatatcttgtctattctagagctgaaatattgcttatcttcatctggatacgttaccacgtcttgcaataacgtctcaatataatgattgcgtatacgctccatctctcgacgaacagatacagcccctacttgttcagcaacttgatcacgtaaactcgacaatttatttacaacctctgaattaagttcgtttgcaatttgcatgttatttaataagaattgaatcgcaataaacctagcttgatacttatcatgagatgtctctgtcattattatttgacacatatttttaattgtctcttcaatcttctcaccataattgattttaaaatgcggttgatacccttcccctagatgctttatttcgccaagtaaatattttgttcctttgcctgtacgtgccacaactggaaaaataggtgtttttaactttttcatcaatttatgataatcgatttttatcccgcgctttgtagctacatcaatcatatttaatccgatgtatattggttgattaagttctaacaattgtactgttaattgcatatttctttttagttgactcgcatcaacaatgttaatgattcctgaaaatgaatcgtttaataaatagtctgtcactacagtttcatctttagaaatcggcgataaatcatatgtacctggtaaatcaattaattgtcctacattttctttaagtttccctacttttttctctaccgttacgccactccagttgcctatatattcatacgaaccagttaaagcgttaaacaaagatgttttaccaacattaggatttcctaaaatacaataattttccattcgtccggctcctattcttctaatgcaatagaacaagcatcgcaatgtctaatacttaactgttgtccgtttacttcaataatacatggccctttaaataaacatttttgtttaatcgttatgatagcgtcatctgttaacccaaaggcacttagacgatacaacatattctcattagcaatatccattcgctttattttataagccttattcatttcaccatttttaatgtttaacatactatttcgctctcctattagaaataataatcattatcacttaaaaatcataacccttaaaattgtagctcgcaatactttatttaaataattttcatttttcatgtaaaatttgtgacattgcaaaaatgt

SEQ ID NO: 365 - DNA, 6804 bp; double-stranded, linear
tgatggattagcagacattttacgagcgaatggtttcaaagtgtttggtccaaataagcaagcagctcaaatcgaaggctcaaaattatttgctaaaaagataatggaaaaatataatattccaactgctgattataaagaagttgagcgaaaaaaggatgctttaacatatattgaaaactgtgaattgcccgttgttgtcaagaaagatgggttagctgctgggaaaggcgttattattgcagatactattgaagcagccagaagtgctattgagattatgtatggtgatgaagaagaaggtactgttgtatttgaaacgtttttagaaggtgaagagttctcgctaatgacatttgttaatggtgatttagcagtacctttcgactgtattgcacaagatcataaacgcgcatttgatcatgatgaaggaccaaatactggtggtatgggggcttattgtccmgtaccacatattagtgacgatgttttaamacttacaaatgaaacaattgcacawcccattgcaaaggcaatgcttaatgaaggttatcaattcttcggtgtattatacattggtgctattttaactaaagatggtccaaaagtaatagaatttaatgcccgttttggtgatcctgaagctcaagtattattaagtcgcatggaaagtgatttaatgcagcatattattgatttagatgaaggaaaacgtactgaattcaaatggaaaaatgaatctattgtaggggtcatgttggcatcaaaaggatatcctgatgcatatgaaaaagggcataaagtaagtggctttgatttaaatgaaaactattttgttagtggattaaagaagcaaggtgatacctttgttacttcaggtggtagagttatacttgccatcggaaaaggtgacaatgtacaagatgcacagcgagacgcatacaaaaaagtatcacaaatacaaagtgaccatttattctatcgtcatgacattgcgaataaagcactacaacttaaataagtaaatttaaaatactaagattagctatgaacgaatctataacgatagattttttcatagcttttttagttgtagagtctaggacattgatttctgtaccaaatttgtgattatgcatatgtaatacaaaagaggcgccacaacatgtttggatgaacaaaataacatgtttgtggcacctcttttgtttagtatggaataaatggttttctttttctatacaatgaatttctaatttagtatctatacaattatggataaaatttaacctacacgaccaagacgaacatcatctatgcccgtgatgggtaaggtgattgaacaataatatgccatagtaataatggcaattaaaactataataaagattatatctttatatgagaaaggtacgttgtaatagtaagtacgaggaccatctctaaatcctttcgactccatcgcaactgataattgatgtgcctttctaatattttggcttaatagaggtataattaaatgcttaaatcgctttaaccctctataatttgccgcgtctatcatctgatagcgcatttttaaagatctgcgaagctgtattaaagaactaatcattaaaggtatcatacgaatggcagccatgaatgcataagcaacttttgatttaacctttaaatgttgcattaaactataaaatatcatgacaacctgagatgtaagtgcgattaagataccgaaaaatgaaatagcaatggttcttaatgatacatgtaaaccacgaactaaactttctgttgtaatatggataaatccgaatttcaaaattgtatggctaccattcccgtataaaatcatgaacagggaagagagtaatgcaaagccaatacttatagttataaaaattgctgtaattttaaactgagtaccattaaacatcaataagaaaactaacattaagatagtgatataaagcataaaatcgaaattatgcacaaatataataaagaaaaatagtataattccaagaaatagtttcgttataatgttgacatcatcaacaaatgattgccgaactttccattgctcatacattcgtatcaccatcacaatctagtaacgcaccatctgaaattttaagtcttcttgatggataacgttcaattatttcatcgtcatgtgtaaccatgacaatactttgtcccaaattaattcgcttttggaaaagtttgatcaactggaatgtattatggctatcaagtccaaatgtcggttcatctaaaaagataatatcagctttagaacttagtgcggtagctacgctaaggcgtcgtttttgaccaatagacaactcataaggatgttgatcttttacattttgtaaatctaaaagttttaaaagttgtatcgtttcatcatcactttgatctttagaaaggtgattaaaatgaatgttaatttcatcataaaccgaatttgttataaattgtaattctgggttttgataaactaggtacatgtgttttgctgcatgtttaatttttgttaaacgctgattttcaaaataaacatcaccttgatatttaatcaattgcataattgattcaagcaaggttgttttaccactaccatttgcccctgtaattgtaatccactcacctagaccaatttctaaatctgagaatgagagcaatgttgatttaccgcgaataatacgtccatttttaaattgtaataagtgtgagtttgttgttggaaagtcaacacgacttggtgcgaattcccatgcacgtggatgccacacaccatattcactgagtaaatgaacatacttctgtaatatgatttcaggacattcatcggcaatgatatttccgttataatccatcaaaatgacgcggtcgacatgattccagatgtgtttaactttatgttcaacgattacaaccgtttgatcttcccaaagttcaattagtttagtccataaatcttctgttgcttgaacatctaacattgctgtcggttcatctaaaaacaatgtttttgattgttgaagaatggtttcaacaattgccaatttctgtttcatcccgccacttaaatctttgatatacgtttcaggggtaacatttaaattgaccatatttaaagcattgataattaacgcatccatgtcttcacgtggtaattgtctattttctaaaacgaatgcaagttcttcgtatacttttggcatacaaaactggctatcagggtcttggaaaataacgccacttaatgggtcaacgattagttcatcatatttcataggtaattcaattaaattaggaacaataccacttaatacattcagaagtgtacttttaccgcaaccagaaggaccgagtaaaagtactttttctttgtcttgaatagtgatatttaaatgatcgaaaattttacgttgaccacttggatattttaatcgtaaatcacttacttttaacactctgaatgctcctcttataagttgtcgtaatcttctttagcagctggtctaaataattttgttacgcctgtcttatctaaagcttttactaaaaggtaagataggacgccggcgactactgcaccactaattaatctaaatacgatgaataatgttaagttccaacctgcaacttcatttaaataaccatagaaataatctatcgggaaagccgcgattgctgtacaaaaacctgctaacatagctaccataactgaacgtgattgatatttaaaaattgcaaagacaagttcacacgctaaaccttgtataaaagcgtaaacgattgtcggaatatcgaaacgacccataatgatagtttcgccggcacctgcagcaaattcagccagtaaagcaatacctggttttggaataattagatagcagacaatcgctgccatgaaccaaaccccgtttgttaattgttcgaggtgaaggcctgtagcttgcacaccattgtaaacaaaccaccataaattgtaaataactgcgaatactactgaaataagtacggttactagtatttcagatagctttaaaccttttgacatttttacatcctcctaataaaaaaacgcacaaccatccataggaaagttatgcgttcacaatatatattagtaaaacatatgtatagtaacactttcctacgctagttcaagctagatcaggttcaaagggtttgagggcaagcctcatctcagtataaaacacccctagtgtgtgcgatttatttaattaattatactgtaagacgtttgtaaacttatgtcaataggttgtcttcatgaaatttcgtttaattcgatttaaaatttataatattagcattggatttaaattgaagatgtagtaggaatgttagtaattaaagatataaaaatatgtgacatgtaataatattgagctgataaatgaagagggatacttatcaatcatacctctttaacaacagtgaagaacccgtgcataatggcttacgaattatagtttataaggaagaagagggatacatgcgccgagcacatgcataaaagcccctaacaactaaaagttgtaaggaaggagagggatacatgcgccgagcacatgcataaaatcccctaacaactaaaagttgtaaggggatttaaattaatttagtgtatcttggatatcttgttttgkttgattaatatcttctgttttttcttcttttttatcttttaatttttcttcaacttctttagctttttctgctgcttttttattttgattttcattagacatgattaattcctcccaaattggataattatttatatataaatcttacccggttgtactttcgttaaacttttctaagtctatagcactatttattcatttatctaaagacaacaacattagattaatatataatgattttgaggtgaacataatgtcttttcttaggaaacacgccgaaattatttttagctatttaatcggtmwcgttcactcttcactggkctcattattttaattaacttgccattaattaaacaattaaatggtggtaaaaaagttgatacacatgttcataatgtgtgggaatttctgaatgcatttttcagtgaaattattaaagtaatgagtcgatttataggtaatttccctatagttagtgcaattgtgataattatattcggtattttagttatgttgattggtcatacattacttagaactattaagtatgactatgatatttctatctttttcttagttatcggtatcatgtactttattattactcttatattaatgactcaagtttatggattctttgcagtgattttcattattccatttacaattcatataggatatatcgtctataaagatgaattgaatcaggaaaatgtaaaaaatcatttcatgtggataattgtgagttatggtataagttacttaattacacaaattgcattgtatggcagaattgatgctaatgaaatagagtcaattgatatcttaagtgtcaatgctttctttataattatgtggttacttggtcaaatggctatttggaatttcttgttcttgcgccgagctttacctttaacaaagcaagaattaggtgaagaggagccagaattatcaagaacaagtaaagggaatgtcacgaatcaaactaaaattcacttgaaacaactccaagataagactacagaatatgcacgtaagacaagaagaagtgtcgatttagataaaattagagctaaaagagataaattcaaaaagaaagttaatgatattatcgatattcaagaagacgatattcctgattggatgagaaaaccgaaatgggttaaaccaatgtatgtcgaactattttgtggtgtcgtcatctttttattcacatttttagaatttaataatcgtaatgcattatttgtatctggtgattggaaattatcacagacacaatatgttattgaatgggttacattattaattctgttattcattattatcgcatatatcgctacaacgttaactttccacttgaaaggtaagttttattatttacaattatttatggggagcattttattctttaaattgttaacggaatttataaatataatgattcatggactattactttcagtgttcattacgccaacattactattaatgttattggcaatcatcatttcttattcgttacaattacgagagcgaccataattaaaagcattataaaagtactatctattaaacattttgatgtgtacgctataagttagatatatctctaacttacttagatacaggtcaatgaagtttatggatagtactttttttgtaactagatttgattgattcaggtgatgtgaattaagtattgaraattgtatacaaagttttagtgcaaataaaatagttgaaaagttatccatttgtaaaatcaagaaaactagtaaatagttgaagcgacttatggaatttgcgaaacgatatatagtatttcctttgtagaaatttmacatatatcattcaaattactaatttgttaaaatcaacagtaagattagaagtagatgatattgaaatttggcaaacaatttaatctatataaaactacaacgaaacacagaaaggaagttgtcagatgaaaatagcaactctgaacaaaggcaaagaaacaaaatattttaatggatatcctttaattgaagaagaggatatctattcacaagatcatttaaaagaaggagatatttttcaaattgtgactgataaatcacaatat

SEQ ID NO: 366 - DNA, 1717 bp; double-stranded, linear
aaaagagacgcattaaaacaagctatacaaattatcgataaattaacatggggtgtttagtggtggttaaagaaattttgagactattattcttactagcgatgtatgagctaggtaagtatgtaactgagcaagtatatattatgatgacggctaatgatgatgtagaggcgccaagtgactttgaaaaaatcagagctgaagtttcatggtaatagctattatcatttttgaattaattatattaatgtgtgtagcaatagcactggaggtgttgtaaatatgtggattgtcatttcaattgttttatctatatntttattgatcttgttaagtagcatttctcataagatgaaaaccatagaagcattggagtatatgaatgcttatcttttcaagcagttagtaaaaaataatggtgttgaaggtttagaagattatgaaaatgaagttgaacgaattagaaaaagattcaaaagctaaagagaggcgttggcttctctgctctatcyaaaataatgaaaggagccsaacatgttagacmaagtcactcaaatagaaacaattaaatatgatcgtgatgtctcatattcttatgctgctagtcgtttatctacacattggactaatcacaatatggcttggtctgactttatgcagaagctagcacaaacagttagaactaaagaagatttaactgagtacaataaaatgtctaagtctgaacaagccgatataaaagatgttggcggatttgtcggtggatatttaaaagaaggcaaacggcgtgctggtcaagtcatgaatcgttcaatgctaacacttgatatcgattatgcagcccaagatatgactgacatattatctatgttttatgattttgcatattgtttatattcaacacataagcatagagagataagtccaagactgcgtttagtgattcctttaaaacgaaatgtaaatgcagatgagtatgaagctattgggcgtaaagtcgcagatatcgttggcatggattacttcgatgatacaacttatcaaccacataggttaatgtattggccttcaactagtaacgatgcggaatttttctttacctatgaagatttacctttgttagacccagataaaatattaaatgaatatgttgattggactgacacattagaatggccaacgtcttcaagggaagagagtaagactaaaagattagcagataagcaaggcgacccagaagaaaagccgggaattgttggtgcattttgtagagcctatacgatagaagaagctatagaaacttttattcctgatttatacgaaaaacattctactaaccgttatacctatcatgaaggttcaactgcaggtggattggtgttatacgaaaataacaagtttgcctattctcatcataatacggatcccgtaagcggtatgcttgtgaacagttttgatttagtacgcatacacttatatggtgctcaagatgaagaaactaaaacagatactccggttaatcgactacctagttataaagcaatgcagcaaagagcgcaaaatgatgaggttgttaaaaagcaattaattaatgacaaaatgtctgatgcaatgcaggatttcgatgaangagaaaatagcgatgatgcatggtctgagacgttngaaattacttcgaaaggtactttcaaagctagtgatcccaaatatagaaatt

SEQ ID NO: 367 - DNA, 1847 bp; double-stranded, linear
aagattaggcatcaagacagggtcgcgattgtttgaaatcccacatagnaatgatatttacattatcaatccaagtatgcgtaaatatcttaatgtttcagttgctatttctaagattgcattgcgttatattccacctgaagatttacaccaatatagtattgacgaattttttatggatgttactgatagctatcatagatttagttctacagtacatgcattttgcgaaagacttaaacgtgaaatttatgaagaaacaggcatttattgtactgtgggcattggttctaatatgttattaagtaaaattgctatggatgttgaagcgaacatagtcaaaatggtatagctgaatggcgatatcaagatgtaccaacgaaattatggccaattcmgcccttgcgagatttttggggtattaatcgtcgaacagaagccaaattgaataaaagaggaatttttactataggagatttagcgaaatatccatataaatttttaaaaaaagagttcggtattttaggtgttgatatgcatctacatgcgaatgggatagatcagagtaaagtacgtgaaaagcacaagatcagcaatccatcgatatgcaaaagtcaaatattaatgagagattatcattttgatgaagcaaaagtagtaatgcaagagttaattgaagatgttgctagcagagttcgagcaagaaaaaaagtggcaagaacgatacattttgcctttggctatagtgatgaaggcggtgtacataagcaatatactttgaaagatccaacaaacttagaaaaagatatttataaagtagtaatgcatttcgcagataaattatgtaataaacaagcactatatcgtacgctaagtatatctttgagtcaatttattaatgaggatgagcgacgttaagtctgtttgaagatgaataccaacgcaaacgtgacgaatgtctagctaaaacgatagaccaattacatttgaaatacggcaaaggtattgtgtccaaagcagtatcgtttacagaagcaggtacaaaacacggcagattaggtttaatggctggacataaaatgtaatgactatacggtttaagtaatatataactgtgattcgtataaaataagtctctaaagataaatatttcatatatcacaatagattttcacaataatatctaagaatacatggaatttatcaaaagagacttaataattattggatataacaatcaaaatcactcaatgcttgcataccgcgttctcggtcagtagggtttttgaaactaatttttaaagcaccgtatatatcttcgcgtacttctaagattcttaagttgcttatagatatgttatgtaaactcaggatataagtcactttacttatcatacctgattcatccggaatgtctacatatagatcatacgcmgtatttagtccacctagttgtttagcgggtagtgcgtcgcgatacgatttagcttgggcaaaaaatgataacaatttttcagaatcattgctttcaattagtctttctaaatcttgaaactgactttttagctgtcgaatcatttctaaaatatacgttttattactcaaggtgatatctttccacatttgtgcattactactagctatacgagtgatatcacgaaaaccaccagctgcaagtttattaactaaatgatgttcttgaccgttcttttgactaacatgaactaaactagatgcaacgatatgaggtaaatgacttacgacgcttgttacgtagtcgtgttcttcagcagtagttacaataaatttagcaagagtaggtgataacagttcttttaacgtgtttg

SEQ ID NO: 368 - DNA, 494 bp; double-stranded, linear
aacaaaaggcataagttcgtgaattaatgcgtatacaaggataaagcttataacagtagtaattgttgctatcaaacgaacaacatatattctattttcagatagcaatcgattcactaatcgataatttacgtatacaagaattaacaacagcacaatataaacaataatcatatttggccccatttaatttttaaatttgttttcacatcattttctactttattatcatactaattttaaaggcaaaggtggacatcggcaacctctcgtaaactatttatcaaaaataaacgtatctcattgttatgatatttataaatcaattcgtttttattaaagtctttttcaacaagtttgtcactatctattaaataatcacgcatgcatccttttaagaaatcatctttataacttggtgtgtaccattttccatcctcttcaatgacaatgttgccaatatcaaattcaaggaccttgccgtcctctgaagt

SEQ ID NO: 369 - DNA, 2518 bp; double-stranded, linear
gtccatatttcccgtccaaccaactaaaaatgggtaaatccctggatttaaatctacttctagtcccatttatatggaayacctttaanttttaattgtaccaccaccgattgaaataccgataatttcnaatgtagcgaccatcattacgagatgatttgatataagcacagtttggatgttgaccaatactatcgccttcttcttcgatgatatctattttaataccatcatcagctgcaatttctaatgaagatttaattcggttatcaaatgttgaatatcccattgctccacccacaatagcgacatctgtaccatgtccttggtgtgtttgagcaaatgattcataataatgtatttcaatatttttaggaatatctcccaatattgcgcgtgctgaattcccaatctttactgcaccagccgtatgagaacttgaagggcccatcataactggtccgataatatcgaaagcactttgataatcatagctctttgccataattaaacactctccttaatatgattctttttgctcggcattttaaagttgatattcattaaattaaacttattaattagtgttccaataatataggctaagacaatgctgacaataatcactgttgcgattgttacaattgatgtcactgcattattaaagccaaacaatacgatggcgcctgcaattggtgttgccatacctttgacacctattactagtccgctaaatgtcacgatacatgcgttgacgaccccaatcagtgcatttgtaccatatagttgtactggatattgcgctattaaatcaatttgcgtcaatggctcaatacaaactgcaaatgcttttgacggtccaccaatgtttaattttcggaataaaataaggttaacaaatgagctacctgtacatgttagtgctccaatagccataggaacacctgtcagtcctaataaacttgttaataccattgaacttagcggtgtcatacctgtaacaggaatcactagtcctaaaatgaccgctaatgcatatggattgttatcacctaccgcagtgacagcactacctatttgttttaatgttgctagcacaccaggtgtaatgattgatgcaagtccgaaagcaattgctggtgcaaataagatcaccacaattaagtccaagccttctggaactttcttttcaatccatttaattaaaaaagctacgccataagctgcgatgaatgctggtaataatttaaagtcatgtaatactaaaccaacaatgaccgcaaatactggtgcaacgcctaagtttaagcacgttagaatacctactgcgataccgcttaaacttcctgctaaatccccaatatcttgtagaaatttaatatcaaatacgccaccaatagcataacttaagaatgcttgtggtagaaatgtcgcacaagctgcaccggataatgcttgtagtccttgtttaccgtacggtgcatactttaaaaatagcgtcatgatcactaaaaccaagactaatgtgcctacacctaacagaatatccatttcccaaaaacctctctctatgtttattttattttcagaccataaacatcgtacacccttaagaaaacgttttcaacttttatctgttatcaaatcaaatatttaagtgaaatatttcatatttgtgaaagatttttaaaatggattgtttcaaaaactacttatgttgtcgttaatatttactaattaactttttactctatatttcaaacagttgtgtgacagttttttgataacttttttacatctgaaagtaagtaatatttctaaaaacttttaatatttatacactttatctttcgagctatttattttttgtttttgtgctgtgtttataaaaccgcacactatattcaaaaataacttattacacatatatttgcaataagataattaaagtaggatattatttttagttttctgataggaatgatgatagtctataggttgaatctttacttttttttaaagctaaatttacatcaacttaacaatggttggttatactgaagatgaaaatatttagtataacttagtggaggcgataaaggtgcaattgagtcattccgttaaagttgcaatttctatctatttagcacttatctttataacgttcacttcttatttagtcattattttatatacgagtatgactggacatgatgtatcacatttcgtgttagatagtcagcattctcatcatggatctcttacgcaaaaacatttgagtcttcctgaaatctcatttaaatagtttatcctctgtgtttcaacattcatttcccatatcgattcatttatctatcatctagaccactacatcttagatgatttttttattttctcatttcactctttcttaaaagtcgatataatgaattaaatcattatcatacaccgacatattttatgttgttggtgttaagtttaaaggggtgagatacttggcgaataatcattcagcttt

SEQ ID NO: 370 - DNA, 790 bp; double-stranded, linear
atactactggaccgtcnaccaattgacaaaacctgaaaactggatttttattgcaggattacatcgaacctggaagaacaatccccaggagttgatgatattcgagatatggcatacaatcaaggtagtttagataagacaatttatgaaatttctaaacgcacagtactatttttaatacagaaagatattacggtatataataagacgattgactgtttaaattattataactatagtgacgaaagaataaaggatgattaaatgaattcacaagaattattagcaattgctgtggatgcaattgacaataccccaggcgaagatacgatttctttagaaatgaaaggtatcagcgatatgacagattattttgttgtaacgcacggaaataatgaacgacaagttcaagcgattgctagagcggtgaaagaagtagccaatgaacaaaatatagaagtaaaacgtatggaaggatacaatgaagcgcgttggatattaattgacttagctgatgttgtggtacatgttttccataaagacgaaagaaattattataatattgaaaagttatatcaagatgcaccattagaatcatatagtcaggttgcgtattaattatgtcgcaatatgcagaaatgagcctagtgtacgatcaattgactcaagatcaaccatatgaaaaatggtttgaaattgtaaaaaatcactgcaaagatgaatcaaatattttagatattggatgcggtactggtagttaacagttcaattagaagctttaggtaatgtt

SEQ ID NO: 371 - DNA, 1823 bp; double-stranded, linear
atagatgaaggtgcaaatattgaaataggttatttacctggacgcttgaaatggttagttgctgatttattaactaaacaaggattaaaagtagttaacgacgatatgacaggaagaacgttaaaagatcgtaaattattaacaggtgacagtcctttagcttcaaatgagttaggaaaattagcagttaatgaaatgttaaatgcaatacaaaataaataattaaatattaattagaggagcctcatatgtaaatgtatgagggctcttttttttggcaaaatttaagtgatacttgtaaaatagaacctattatgagtatgatttaagaaaacgcttgcaaaactaataaccgcaactagcgatatggaggaaacatgatgtcttatagcattggaattgattatggaactgcttcaggccgtgtgtttttaattaatacaactaacggtcaagtagtatcaaaatttgtgaaaccatatacacatggtgtcattgagagtgaattaaatggtttgaaaataccacatacatatgcacttcaaaatagtaatgattatttagaaattatggaagaaggaatatcatatatagtacgtgaatcaaaaatagatccagacaatatagtaggtattggtatagactttacttcatctactattatttttactgacgaaaaccttaacccggtacataacttaaaacaatttaaaaacaatccacatgcgtatgtgaaactttggaaacatcatggtgcatataaagaggcagagaaattatatcaaactgctattgaaaataataataagtggttaggccattatggatataatgttagtagtgaatggatgattcccaaaataatggaggtcatgaatcgagcaccagaaattatggaaaaaacggcttatattatggaagcgggcgattggattgtaaataaattaactaataaaaatgtacgctcgaattgtggattaggtttcaaagcattttgggaagaagaaacagggtttcattatgatttatttgataaaatagaccccaaattatcaaaagtaattcaagataaagtatctgcaccggttgttaatattggtgaagcagtagggaaactggatgataaaatggcacagaaattaggattatcaaaagaaactatggtaagtccttttattattgatgcccatgctagtttattaggtattgggtctgaaaaagataaagaaatgactatggtgatgggaacaagcacatgccatcttatgttaaatgaaaagcaacatcaagtgccaggtatatcaggttctgtaaaaggagcaattattccagaattatttgcttatgaagcggggcaatcagcagtaggtgatttgtttgagtatgtcgctaagcaagcaccaaagtcatatgtagatgaagcagaaaatagaaatatgactgtatttgaattaatgaatgaaaagataaaacatcaaatgccaggtgaaagtgggctcattgctcttgattggcataatggaaatcgaagtgtattaagtgatagcaatttaacaggttgtatctttggattaactttacaaactaagcatgaggatatttatagagcmtatttagaagctacagcatttggtactaagatgattatgcmacagtatcaagattggcatatggaagtagaaaaggtatttgcatgtggcggtatacctaaaaagaatgctgttatgatggatatctatgcgaatgtactgaataaaaaactaattgttatggatagtgagtatgcaccagcaataggcgcagcaatattaggtgcagtcagt

SEQ ID NO: 372 - DNA, 1600 bp; double-stranded, linear
acgatcatctgcatcagcgaattccgatgcaattcatatgtcctaataacaaaagaataggttttaaaagatatgcataccgtaatgatagatatagttttaaacgtgacttcaagctatatgaatgtgatgactgttcatcatgttctttgagacatcaatgcatgaagccaaattcgaaatccaataagaaaattatgaagaattataattgggaatactttaaagcccaaattaatcaaaagctttctgaaccagaaacgaaaaaatctatagtcaaagaaaaattgatgtagagcctgtttttggatttatgaaggctattttgggtttcactcgaatgtcagttcgggaataaataaagttaaacgagagctaggttttgtattaatggcacttaatataaggaaaatagcagctcaacgagctgtacattataaaatacatatcaaaaaagctgatttctatcaaataaataatagaaatcagcttttttacattgcctaagaactttaaggaacttaatgtcccaagctcttttttgttatatctaattcgtaatttatgattgtttattcggtcctttgatgttcactaaatgtgactttaaatcttgttctaattgttgtaattctttttcagctaattgtcgttcttcgcgaccgtgttgttgaataattaatgtttcttcaattgtctcaataatgttacgctgtgtacgtttcaatgtatcaagatcaacaatgccacgctcattttctgttgcagtttcaatcgcattttgtttcaacatttcagcatttgctgttaataaatcattagttgtatcagtgacagctcgttgtgcagcaactgcattacgctgtctcattaatgtaagcgcaatggccatttgatttttccatagtggaatacttgtcaaaattgaactttgtatcttctcggcaagtgcttgattaacattttgaatcatacgaatttgtggcgcagtttgcaaagctatttgtcttgaaagctgtaagtcatatatgcgtttatctagtctatctataaattgctgcatatctgcaacttgttgaatatccatttgattagtggattgtgcgcttgctgttgcaattgtggtagcttttcattttctaattgcaactttttttgctgtgcagcaatgatatgcaatgataagtcatcaaagtattgtttgtttttatcatatagcgtatctaataattcaatatctcttgttaaatgtgtttgatgtttctgcagttgaatcgttatgcgatcgacttgagcactaactgattgcattcttgaaaagatttcattgatagacgactttgctctgctaaaaattctttttaacatagatggtttatcagtatttaactcatttggattaactgactttagttttgacattagatctgacaaagtatctccaataggaccaacatctttactttgtacttcatccaacatttgatgtgaaaattgagacatttgtttctgkaaatcagaaccaaacgctaataaaccttcattgtctaaagggttaatttgtttactgattgtgtctacctgtttttgttgttcaatt

SEQ ID NO: 373 - DNA, 1227 bp; double-stranded, linear
atgttgataatggtagcttctacaagaataaagaccaacaagttggtgcaacaattcttgatagtaaaactggtggtttagttgctatatctggtggacgtgatttcaaagacgtcgttaacagaaaccaagcaacagatcctcaccctactggttcatctttaaaacctttcttagcgtatggacctgccattgaaaatatgaaatgggcaacaaaccatgcgattcaagatgaatcttcatatcaagttgatggttctacatttagaaactatgatacgaagagtcacggtactgtatctatttatgatgctttacgacaaagtttcaatatcccagctttaaaagcttggcaatcagttaagcaaaatgctggtaatgatgcacctaagaaattcgctgccaaacttggcttaaactacgaaggcgatattggtccatctgaagtacttggtggttctgcttcagaattctcaccaacacaattagcatcagcatttgctgcaatcgctaacggtggtacttataacaacgcgcattcaattcaaaaagtagttactcgtgatggtgaaacaatcgaatacgatcatactagccataaagcgatgagtgattacactgcatacatgttagctgagatgctaaaaggtacatttaaaccatatggttctgcatatggccatggtgtatctggagtaaatatgggtgctaagacaggtactggtacttacggtgctgaaacttattcacaatataatttacctgataatgcagcgaaagacgtgtggattaacggctttacacctcaatacactatgtcagtgtggatgggcttcagtaaagttaaacaatatggtgaaaactcatttgtrggacatagccaacaagaatatccacagttcttatatgaaaatgtgatgtcaaaaatttcatctagagatggcgaagactttaaacgtcctagctcagtaagtggtagtatcccatcaatcaatgtttctggtagtcaagataacaacactacaaatcgtagtacacacggtggtagtgacacatcagcaaacagcagtggtactgcacaatcaaataacaatactagatctcaacaatctagaaacagcggtggattaacaggtatattcaactaatccactcaacataaaatcctcagttataccatatttatggtgtagccgaggattttnttaggttcttcatcttttatgg

SEQ ID NO: 374 - DNA, 1953 bp; double-stranded, linear
ccatatggtgcaacattcttcgtatttagtgattatttaaaaccagcgttacgtttatcatcaattatgggattaaatgcaacgttcatcttcacacatgaytcaattgcagtaggtgaagatggtcctactcatgaaccaattgagcaattagctggattaagagccattccaaatatgaatgttatccgtcctgctgatggtaatgaaacaagagtagcatgggaagttgccttagaatctgaatctacacctacttcattagtattgacacgtcaaaacttaccggtattagatgtaccagaagatgtagttgaagaaggcgttcgaaaaggtgcctatacagtttatggctctgaagagacaccagaattcctattattagcttcaggttcagaagttagtcttgcagttgaagctgctaaagatcttgaaaaacaaggtaaatcagtacgtgttgtttcaatgcctaactggaatgcatttgaacaacaatctgaagaatataaagaatcagttattccatcaagcgtaacaaaacgtgttgcgattgaaatggcttcaccgcttggatggcataaatatgtaggtactgcaggtaaagttattgctattgacggctttggcgcaagtgcacctggcgatttagtagttgaaaaatatggatttacaaaagaaaatatcttaaaccaagttatgagcttataagaataatttataaagcgagtatgtttagaagtctaggatgcataatcttaggcttcttttaaagtgttgaaatttagagtatagcacttaaactacatcataagtgataagttatgaaagtatactatttcagattaatctttaaaagctctgttataacagcatgatttttgatattatttttagtatcgatattaaaatacttgaataaactagttcttgaaataatgtgatgaatttagtaaaattcagtaggataaagaaagcgggtgaaacaatggcaacttggttagcaattatttttatagtagctgcattaattttaggtttaattggaggtttccttttagctagaaaatatatgatggactacttgaagaaaaacccaccaatcaacgaagaaatgcttcgtatgatgatgatgcaaatgggtcaaaaaccttctcagaagaaaattaatcaaatgatgacgatgatgaataaaaatatggatcaaaatatgaagagtgcgaaaaagtaaattcgcaattgatagaggctattttccagatatggaaatggcctctttttataatcaaattaataagaataaatatgtttattaaaattaaagttaacaaaatgacgaatagactgagaaatgctataattcattttgtatgatttacagagagtttatttaacgagaaggtgtcygcgtgctctatttaatattttcaatcattgtagctttatttatgggaactatagttatagttattcgtatgaaagctcaaaattatccggtaaakgagaaaaaaatagttttgccaccgttttttatggcgaccggtgcattgatgtacgtcgttccatattttaggctaacaggatcggaaatgctagaagcctttataattggtttgcttttttctacagttctaatttggacttctcgatttgaagtcaaaggtacagaaatttatatgaaacgatctaaagcatttccagttattttgatttcattacttatcattcgtactgtgatgaaaatattcattagtaatgaaatagatcctggagaattaggcggcatgttctttttattagcattctgtatgattgttccttggagagcagcaatgctatataaatacaaaaaactaaagaaaacattaatcaattaattacttttaaaaccacttgtgatcgacttctaaatcagtcaatgagtgggtttaatnttacttggaaaaggnggaaagg

SEQ ID NO: 375 - DNA, 3787 bp; double-stranded, linear
acatttgatcaanttatcgacattaaagatgaattcanttgatcgtntcaatgattatcctgttgaagtagcacgtttgcttgatatagtggamataaaagtacacgcattacattcaggtatccacgttgattaaagataaagggaaaataattgatattcatttatctgtaaaagccactgaaaatattgatggcgaagtgctgttcaaagcaacacaacctttaggtagaacaatgaaggttggtgttcaaaataatgcaatgrcaattactttaacgaaacaaaatcaatggcttgatagtttgaagtttttagttaagtgcattgaagaaagtatgagaatcagtgatgaagcataaagaagcatttaatggcgttgtcgtgttaactgctgcattaattgtcattaaaattctgagtgctgtatatcgaattccatatcaaaatatattaggcgatacaggtttgtatgcatatcaacaagtgtatccaattgtagcattaggaatgatattatcgatgaatgccattcctagtgcaattacacaaaatatagggaagtatcatagtgacgaagcatatgcaaaagcagtcgcttatatacaattagttggtatattattatttattgctatttttgtgtttgcgaacaatattgcacatatgatgggtgatggccatttaacaccaatgattcaagctgcaagtttaagctttatatttataggtatgcttggcgtgttaagaggttattatcaatctgcaaataatatgacagttccggctatttcccaggttatagaacaagttatacgagtaggtattatcattgttactattgttatttttgtagacagaggttggacgatatatgaagcgggaacaattgctattttagcatcaacgataggttttttaggttcttcaatttatttagtagcgcaccgaccttttaagtttaaaatggtaaataacactgcaaagatcgtttggaaacagttcgcactttcggttttgattttcgctatcagtcaattaatcgtaattttatggcaagtgattgatagtgttactattattaagtcacttcaagcgatacgcgtgccattcgatgttgccataactgaaaaaggagtctatgaccgtggtgcatcatttattcagatgggattgattgtaactacaacatttagttttgcgctcattcctctgttaagtgacgcaatcaaaatgaataatcaggtacttatgaatcgttatgcaaatgcgtcattaaagattacgattttaataagtacagcagcgggaataggattaattaatttattgcctttaatgaacggtgtgttttttaagacgaatgatttaaccttaacgttaagtgtttatatgattacggtcatttgtgtatcgttaattatgatggatatggcattattacaagcgcaacatgctgtgagacctatttttgttggtatgacggcaggattggttattaaatttatacttaatatcattttgattcgtttaagtggcattattggtgcgagcattagtactgttgtatcattaattatattcggtacgattatccatattgctgtcacgagaaaataccacttatatgcgatgagacgattttttatcaatgttgttttaggtatggtatttatgtcgattgttgttcaatgcgtgttaaacatagtgacaacacacggtagaatcactggactcattgaattattatgtgcagcagtattaggtatcattgcattgtttttctatatttttagatttaatgttttgacatataaagagttaacttatttaccatttggttcaaagttgtatcaaattaagaaaggaagacgttgatggcacataccattacgattgttggcttaggaaactatggcattgatgatttgccgctagggatatataaatttttaaagacacaagataaagtttatgcaagaacgttagatcatccagttatagaatcattgcaagatgaattaacatttcagagttttgaccatgtttatgaagcacataaccaatttgaagatgtctatattgatattgtggcgcaattggttgaagctgctaatgaaaaagatattgtctatgcggttccgggtcatcctagagttgctgagacaactacagtgaaattactggctttagcaaaggacaatactgatatagatgtgaaagttttaggtgggaaaagctttattgatgatgtgtttgaagcagttaatgtagatccaaatgatggcttcacactgttagatgcgacatcattacaagaagtaacacttaatgttagaacgcatacattgattacgcaagtttatagtgcaatggttgctgctaatttgaaaatcactttaatggaacgatatcctgatgattaccctgttcaaattgtcactggtgcacgaagcgatggtgcggataacgttgtgacatgcccattatatgaattggatcatgatgaaaatgcattcaataatttgacgagtgtattcgtaccaaaaatcataacatcgacatatttgtatcatgactttgattttgcaacggaagtgattgatactttagttgatgaagataaaggttgtccatgggataaagtgcaaacgcatgmaacgctaaagcgttatttacttgaagaaacatttgaattgttcgaagctattgacaatgaagatgattggcatatgattgaagaactaggagatattttattacaagtgttattgcatactagtattggtaaaaaagaagggtatatcgacattaaagaagtgattacaagtcttaatgctaaaatgattcgtagacacccacacatatttggtgatgccaatgctgaaactatcgatgacttaaaagaaatttggtctaaggcgaaagatgctgaaggtaaacagccaagagttaaatttgaaaaagtatttgcagagcattttttaaatttatatgagaagacgaaggataagtcatttgatgaggccgcgttaaagcagtggctagaaaaaggggagagtaatacatgagattagataaatatttaaaagtatcacggttaataaagcgacgtacgctagcaaaagaagtaagtgatcaaggtagaattacaataaatggtaatgttgctaaagctggatcggatgttaaagttgaagatgtgctgacgattcgctttggtcaaaaattagtaacagttaaagtaactgcattaaatgaacatgcatctaaagataacgcgaagggtatgtatgaaatcattgaagagcgtcgacttgaagaagcgtaaattggaggtgacaagcaatgaaaaataaagtagaacatatagaaaatcagtacacgtcgcaagagaacaagaaaaaacaacgtcaaaaaatgaaaatgcgtgttgttcgtaggcgtattacagtatttgcgggcgtattacttgcgataattgttgttttatcaatcttgcttgttgtccaaaaacatcgcaatgatattgatgcacaggagcgaaaagcgaaagaagcacagtttcaaaagcaacaaaatgaagaaattgcgttaaaagaaaagttgaataatctgaatgacaaagattacattgaaaaaattgcgcgtgatgattattacttaagcaacaaaggtgaagtgatttttaggttgccagaagacaaagattcgtctagctcaaaatcttcgaaaaaataaatccaaattgattcaaaattatccgagtatagacattgtgaaaaaa

SEQ ID NO: 376 - DNA, 1644 bp; double-stranded, linear
taaaccatttcaaactgaggaacgcnaagacggsacgtttccagatttagaagtatttaaaaatgaatgtgatttaagctatgacataacgtcactttatacttttaagcaacctgtatcaccacaccttgcatttaaaatgacagatcaaatttttctaaataagcagcgtgtattagataaggtaaaagttttagataaggaatttgattttatcttaattgagggtgctgggggaattgccgtaccaatatatgaaggtacagatgatttctacatgactaaagatctaatcaatgattgtgcagattgtgtcatcagtgtgttgccatcaaaattaggtgctattagcgatgccattgttcaccaagattatgttaatcagaatgtatcggcgagtaattttttaataatgaatcgctatacagacagctatattgaaaaagacaatcaaatgacgattggaaaattaacaaataaaacagtctatacatttgaagaacatgccacgtatgaaaatttctcagaagcatttttaaaacaattaataggagttaaaaatgaattacacacaacaacttaaacaaaaagactcagaatatgtttggcatccatttacacaaatgggtgtatatagcaaagaagaagcaatcatcattgaaaaaggaaagggtagttacctttacgatacgaatggcaataaatatttagatggttatgcatcgttgtgggtcaatgtgcatggtcataataacaaatacttnaataaggtaattaaaaagcaactcaataaaattgcccattctacgctgctaggatcatcaaatattccgtcaatagaacttgcggaaaaattaatcgaaatcacgccaagtaatctaagaaaagtattttattctgatacaggcagtgcgtctgttgaaatcgcaataaagatggcatatcagtattggaaaaatattgatagagaaaaatatgccaagaaaaacaagtttataacgctaaatcacggttatcatggggatacgattggtgcggtaagtgttggtggtatcaagacctttcataaaatatttaaagacttaatatttgagaatattcaagtagaaagcccatctttctatcgcagtaattacgatactgaaaatgaaatgatgacagctattttaacgaatatagagcaaattctaattgaaagaaatgatgaaatcgcagggtttatattggaaccgttgattcaaggtgcgacaggcttgtttgttcatcctaaaggctttttgaaagaagtcgagaaattgtgcaaaaaatacgatgtcttattaatttgtgatgaggtagcagttggttttgggagaactggaaagatgtttgcatgcaatcatgaagatgttcaaccggatattatgtgtttaggtaaggcgattactggtggctacttaccacttgcagctacattgacatctaaaaaaatatacaatgcatttttaagtgattcgcatggtgtgaatacctttttccatggtcatacatacaccggaaatcaaatcgtttgtacggttgcattagaaaatataagactttatgaaaaacgtaagttnattgtgcacatattgaaacgacatcatcaacacttgagaaacagtt

SEQ ID NO: 377 - DNA, 431 bp; double-stranded, linear
atgatttttaaaaatcattaagttaaggtrgatacacatcttgtcatatgatcaaatggtttcgccaaaaatcaataatcagacaacaaaatgtgcgaactcgatattttacacgactctctttaccaattctgccccgaattacacttaaaacgactcaacagcttaacgttggcttgccacgcmttacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatatccgtgagcaaaaacggcttatggtnttgcgagcttcagt

SEQ ID NO: 378 - DNA, 2006 bp; double-stranded, linear
tttntataacgtattataaatcgttaaaaattttggttgtgtttgcgtcacgtagacaacctccataaagttacttaatcactctcatcatacaataatttttactcaaattggaanaattataaaaattaaatatagataggctttgaaaattagttttatacaaggttagtagctgtaactgtaaaatgttcttaatattgtcaaaatgtaatgcttgaaagcgcttttaaaaaatattattatatacatggttagacaaatagacaaatcactatacaaatattgggaggaatattttatgaaatcaacaccacacattaaaccaatgaatgacgtcgaaattgcagaaacggttctattgccaggagatccgttaagagctaagttcattgcagaaacttatttggatgatgtggaacagttcaatacagtgcgaaacatgtttggttttaccggaacatataaaggtaaaaaagtttctgtcatgggttcaggtatgkgtatgccatctattggcatttactcttatgaattaattcatacatttggttgtaaaaaattaattcgcgttggctcttgtggcgcgatgcaagaaaacattgatttatatgatgtgattattkcacaaggtgcctctactgattcaaattacgttcaacaatatcaattaccaggtcattttgcgccaattgcttcttatcaattattagaaaaagcagttgaaacagcacgtgacaaaggtgtacgtcatcatgtaggtaatgtgttatcaagtgatattttctataacgcggatacaacagcgagtgaacgttggatgcgtatgggtattttaggtgtagaaatggaatcagctgcattatacatgaatgcaatttacgctggtgtcgaagcattaggtgtgttcacagtgagcgatcatttaattcatgaaacgtcaacaacacctgaggaaagggaacgtgcatttacagatatgattgaaattgcactgtcattggtgtagatgattatgaatgttgaatattctaaaataaagaaagcagtacctattttattattcttatttgtattcagtttggttatagacaactcatttaaattgatttctgtagccattgctgatgacttaaacatatctgtaacgacagtaagttggcaagcgacattagccggtttagtaattggtattggcgctgtagtatacgcttcattatctgatgccattagtatacgcacactatttatttatggcgtgatattaatcattatcggatcaattattggttacattttccaacatcaattcccattacttttagttggacgtattattcaaactgccggtttagctgctgcagagacattatatgtgatatatgttgcaaagtatctttctaaagaggaccagaagacttaccttggcttaagtacgagcagttattccttgtcattagttatcggtacattatcaggtggatttatttctacgtatttacactggacaaatatgtttttaattgcattaatcgtagtatttacgttgccattcctatttaaattattaccaaaagaaaataatacgaataaagctcatttagattttgttggcttaattctagtggcaactattgctacaacagtcatgctgtttattacgaactttaattggttatatatgattggtgccttaattgcgattatcgtttttgcgctatatattaaaaatgcgcaacgtccattagtaaataaatcatttttccaaaataaacgttatgcttcatttttatttatagtatttgtaatgtatgctatccaattgggttatatttttacgttcccattcataatggagcaaatttatcatctgcaactagacacaacatcactgttattagtaccggggttatatagtagcagtcattgttggtggcactaagtgggttaaaatcgggcgraatatctggaattccaaaaccaagcggattatcacagccaattaa

SEQ ID NO: 379 - DNA, 4858 bp; double-stranded, linear
tggggaaaaaaagacccagcagtattagaagaatcgttaaatatttctattgaagaaatgaatcgtatcataaaattagtcgaagaattacttgaattgactaaaggagatgtaaatgacatttcttctgaagcacagaccgtgcatattaatgatgaaattcgctcgcgaatacactcattaaaacaattgcatcctgattatcaatttgatacggatctgacatctaaaaatctagaaattaaaatgaaacctcatcaattcgaacaattatttttaatctttattgataatgcaatcaaatatgatgtgaagaataagaaaattaaagttaagacaaggttaaaaaataagcaaaaaataattgaaattacagatcatggaattggtattccagaggaagatcaagatttcatttttgatcgcttttatcgagtggataaatctcgttcaagaagtcaaggcggtaatggactcggattatctattgctcaaaaaatcattcaattaaacggaggatcgattaaaattaaaagtgaaattaacaaaggaacaacgtttaaaatcatattttaatcatgactgagacgtcaatcaaagtcataggatcaattttttaagtacacattagctgtgactaatgtataagaacaactataaaacaaataaacagtggttctttatcatttctgttgtactcccaaaatttacaataaaatacatctataaacctagaagaatcaacgcttttgttgattcttctttttagcagataaataggtaaatctactttaacaaataactaaatagtgatattattacattgtaagcgtttcaacatttttgtggagggtgtaaaatgactaacgaaagaaaagaagtttcagaggctcctgtaaacttcggtgcgaatttaggtctaatgttagatctatatgatgactttttacaagatccatcatctgtaccagaagatttacaagtcttattcagcacaattaagaatgatgactcaattgtaccagctttaaaaagtacaagtagtcaaaatagcgacggcacaattaagcgtgtcatgcgtttaattgataatattcgccaatacgggcatcttaaagccgatatttatcctgtaaatcctccaaaaaggaaacatgtacctaaattagagattgaagactttgatttagatcaacagactttggaaggtatatcagcaggaattgtttcagatcactttgccgacatttatgataatgcttatgaagcaattttaagaatggaaaaacgttacaaaggaccaattgcatttgagtatacacatattaataacaataccgaacgtggttggttaaaaagaagaattgaaacgccatataaagtaacgttaaataataacgaaaaaagggcactattcaaacaattagcgtatgttgaagggtttgaaaaatatcttcataaaaacttcgttggtgcaaagcgtttttcaattgaaggggtagacgcacttgtaccgatgttacaacgtactattacgattgctgcgaaagaaggtattaaaaatatacaaataggcatggctcaccgtggacgtttaaacgttttaacgcatgtcttagaaaaaccgtacgaaatgatgatttcagaatttatgcatacagatccaatgaaattcttacctgaagatggtagcttgcagttaactgctggatggactggtgatgtgaaatatcaccttggtggcattaaaactactgattcatacggtacaatgcagcgtattgcactggctaacaatccaagtcacttggaaattgttgcacctgttgttgaggggcgtacgagagcagcacaagatgatacacaacgagctggggctccgacgactgatcatcataaagcaatgccaattattatacatggcgatgctgcttatcctggtcaaggaattaacttcgaaacaatgaacttaggaaacttgaaaggctattctacgggtggttcattgcatattattactaacaatagaattggatttactacagaaccaattgatgcacgttcaacaacttattctacagatgtggccaaaggttatgatgtgccaatattccatgtcaatgcagatgacgttgaagctactattgaagcaattgatattgcaatggaatttagaaaagagtttcataaagacgtcgttattgatttagtaggttatcgtcgtttcggacataacgaaatggatgaaccatcaattactaatccagttccttatcagaatattcgcaaacatgactctgttgaatatgtgtttggtaaaaagcttgttaatgaaggtgtcatttcagaagatgaaatgcattcatttatagaacaagtccaaaaggaactaagacaagctcatgataaaattaataaagctgataaaatggataatccagatatggaaaagcctgcagatcttgcattaccgttacaagcagacgaacaatcatttacttttgatcacttgaaagaaataaatgatgcattgttaacatatccggatggctttaacattttgaaaaagttaaacaaagttcttgagaagcgtcatgagccgtttaataaagaagatggtttagttgattgggcacaagcagaacaacttgcatttgcgacaattttacaagatggtacaccgattcgcttaactggtcaagatagtgaacgtggtacattcagtcataggcatgccgtgttacatgatgagcaaacaggtgaaacatatacacctttacatcatgttcctgatcaaaaagcgacatttgatatacacaattctccgctttcagaagcagcagtagttggttttgaatacggctataatgtggaaaacaaaaaaagcttcaatatttgggaagcacaatatggtgattttgcaaatatgtcacaaatgatttttgacaacttcttattcagttctcgctcaaaatggggagaacgttcaggattaacattattcttacctcatgcatatgagggtcaagggcctgaacattcatcagcaagattagagcgatttttacaattagctgctgaaaataattgcacagttgtcaacttatctagttcaagtaattatttccacttattgcgtgcacaagcggctagtttagattctgaacaaatgcgaccattggttgttatgtcaccaaaaagcttactgagaaataaaacagttgcaaaaccaattgatgaatttacttctggtggatttgagccaattttgacagaatcatatcaagcggataaggttacaaaagttattttggcaactggtaaaatgttcattgatttaaaagaagcattagctaaaaatccagacgaatcagtattactcgttgcgattgaaagattgtatccattcccagaggaagagattgaagcattactagcacaattgccaaaccttgaagaagtgtcatgggtacaagaagaacctaaaaatcaaggtgcatggttatatgtctatccatatgttaaagtgctagttgcagataaatatgatttaagttatcatggcagaattcaaagggctgctccagctgaaggcgatggagaaattcataaacttgttcaaaataaaattatagaaaatgcattaaaaaataactagggggaaataagtcatgccagaggttaaagttccagaattagcagaatctattacagaaggtaccattgcagaatggttgaaaaacgtaggggatagcgtagaaaaaggtgaagctattcttgaattagaaactgataaagttaatgtcgaagttgtatctgaagaagcaggtgtattatctgaacaacttgcaagtgaaggcgacactgtagaagttggacargcaattgctatcatcggcgaaggtagtggcaatgcttctaaagaaaatagtaacgacaatactccacaacaaaatgaagaaacaaataataaaaaagaagaaacaacaaataattcggtagataaagctgaagtaaatcaagcaaatgatgacaatcagcaacgtattaatgctacgccttctgcgcgtcgatatgctcgtgaaaatggtgtgaatcttgctgaagtaagtccgaaaacaaatgatgtggttcgtaaagaagatattgataagaaacaacaggcaccggcatcaacacaaacaacacaacaagcatctgcaaaagaagagaaaaaatacaatcaatatcctacaaaaccagtgattcgtgaaaaaatgtcacgtagaaagaaaacagctgccaaaaaattattagaggtatctaataatacagctatgttaacaacatttaacgaattgacatgacaaatgttatggaattgcgtaaacgtaagaaagaacaatttatgaaagatcatgatggtactaaattaggatttatgtcattctttactaaagcttctgtagcagctttgaaaaagtatccagaagttaatgcagaaatcgacggcgacgacatgattacgaaacaatattatgatattggtgtagctgtttctacagatgatggattattagtaccatttgtaagagattgtgataaaaagaattttgcagaaatcgaagcagaaattgctaatttagcagttaaagcacgagagaaaaaacttggcttagatgatatggttaatggttcatttacgattacaaatggcggtatttttggatcaatgatgagtacgccaattatcaatggtaatcaagctgcaatcttaggcatgcattcaattattacaagaccaattgcgattgatcaagatacaatcgaaaatcgtccaatgatgtatattgcattaagctatgatcatagaattatt

SEQ ID NO: 380 - DNA, 2222 bp; double-stranded, linear
atcagtcacacggtaggcatataaaatgagtcgtttctacaacatttttaaacagttcattcaatattatttttatctaataatnatattgggaggattatacctttatacacaccatgcatttatcttaggattaatcattggtgttactggttctgcaatcaacacatgtatttttgaatgctatttagctaaagctaaaagaccagacactatgcatatttcaactggaaatatgtggcgatacttagttgcaattattgcctgtatgatttggtaccttaataaagcgcatgtaagtatcatcggtataattattggtttaatgatttcatatgttgtagttatcatacgtcctttactaaaggtgagcaaataaattaagaaagaggtgagattatggatcacaaatccccgctcgtgagttggaatttattcggttttgatatcgttttcaatttatcaagtatattgatgatacttgttacggcgtttcttgtttttctacttgctatcatttgtacgcgtaatttgaaaaaaagaccaactggcaaacaaaatttcgttgaatggatttttgatttcgtgaggggaatcattgaaggtaacatggcttggaaaaaaggtggtcaattccacttcttagcagtaacgctgattctgtacatttttatagctaatatgttaggtcttccgttttctatagtaacgaaagatcacacattgtggtggaaatcaccgacagcngatgcaacagtgactttaacgttgtctacaacgataatactgttaactcacttttatggaattaaaatgcgtggtacgaaacaatatcttaaaggttatgtacagccgttttggccattggcaattattaatgtttttgaagagttcacttcaacattaacgcttggtctgcgtttgtacggtaacatatttgcaggtgagatactattaacattacttgctggcttattctttaacgaaccagcatggggttggattattagtatcccaggattaattgtttggcaagcattttcaatatttgtaggaacaatccaagcatatatctttattatgctttcgatggtttatatgtcacataaagtggcagatgaacactaaaaatttcaataattatatacaatcacaggaggaaattaaattatgaatttaatcgcagcagcaatcgcaattggtttatcagcattaggagcaggtatcggtaacggtttaatcgtttcaagaacagttgaaggtgtagcacgtcaaccagaagcacgtggtcaattaatgggtatcatgttcattggtgtaggtttagttgaggcattacctatcatcggtgtagtaattgcattcatgacatttgctggataattaacagataaaagaggtcgggacaaagcgcataggacataattcatgatgcatatatagtaatatctttgaactttattaaatagttgagatatgaacgcaccatgcctatcgcataaattcagtaggtcctaacctcgtcgtttttttctatataacactagcgattattttaatgaaaggagtgtcatgaacccgtgactgaaacagctaacttattcgttcttggtgcagctggaggcgttgagtggggtactgtgattgtacaggtcctaactttcatcgtgttacttgcgttacttaaaaagttcgcatggggtccattgaaagatgtaatggataaacgtgaaagagatattaacagagatatcgatgacgcagaacaagctaagttaaatgcacagaaacttgaagaagaaaataaacaaaaacttaaagaaacacaagaagaagttcaaaagattttagaagatgctaaggttcaagcacgtcaacagcaagaacaaattattcatgaagcaaacgtacgtgcaaacggtatgattgaaacagcacaaagtgaaatcaatagccaaaaagaacgtgccattgcagatattaataatcaagtatctgaactatcagtgttaattgcttctaaagttcttagaaaagaaatttctgaacaagaccaaaaagcattggttgacaagtatctaaaagaggcaggcgataaataatggtaaaagtagctaacaagtatgctaaagcattatttgacgtgtcattagatacaaataatttagagactattaatgaagaattaacagttataaatgaagcagtaaaagataaaattg

SEQ ID NO: 381 - DNA, 1143 bp; double-stranded, linear
taacaattcctatattcatgtttaatacgaaacactacatttacattgtaattcactatcttttgaagtaataaagtgatttgttcaatcgatagctcattgcttgtgtcgattgtaacaattatatgcaagttttcaggattaacacctaatctttgaatgatttgtttaatagtataataatccatccaataaaaattacttcctttaatataaatgtttttaggttgatacatttgactcctttttgtaggctcaaaaggtatatcaatctcgcgcatacttgaagaactttgattagtatcatcaaataattcaattatatttttatcaatttcaactaattgggaatggttaattgaatgagatgttggactatatctttttctaattaatttaggagtgttaccatacgtttctttaaagaggtgtataaaacgagaataatgattaaaaccatgactacttgcgatttcttcaataggcttcttagragttaaaatatcaattaagcaatgctccagtctaatatgatttaaatattgaataaaattactataaggtgtcgctttaaacatgtcacttaaagctttgtttgtaatactaacttgattaatgacatctttcctatttatctttttatggtggttgtttgttaaataatcgtgcacttcttcggctactaaatgacgactaccatcgtatgtatttaatgacattaattcaacacacatgtaattaataatcttatcattagcattataagactgttgtttaattttgctgtagattaaatacttaatcaagattctaaaagtgctagcaacctcatttgttaatatcttgccacgcatcatatagtttgcattcataaacttcaaaaatgtctttgcacttacttcaacaacacaacatacactatcatcattaccatcaatttgatacaaatcattcaacataataatggtgacatcatttctttttacatcatattgttgtagattgattgaaactacacctgtaccttgtagccaatatataatttttaagttcgcttccttcacactactcattttcatacttttataaatatgtagtgaataatawctgtcacntacatcccacaatacaatatnatggatt

SEQ ID NO: 382 - DNA, 506 bp; double-stranded, linear
ggaccaccttttttacctgtacgactaaagccaactgttttaaaggcaccaacagcatgccacacttgaataatttcttgtgatggtctaaagcgaaccgtataaattaatggatggaaatcatcaacaaaaatataatcggccttaccaagtaaatatggcaatctaaacttgtctctccatttgcgtctatccgtaatattctccttaaataccgttttaatatcataatcaaaatctactttttggcgtagtaactcatcatatacatacttgaaattccctgataaattcggacgcgaatctgatgtgaataatattgttttgcttcttttaatatgtagtaactttgtaatattaaaaatagctttaaataagaaacttctactttcaaatgaagctttatgaccttgtttatgaagccagtgtgcacttgtcgcaatgacccctgatttcycytgaggtaaggkgatttcmatatcaaatacaaattcgttaacgtcact

SEQ ID NO: 383 - DNA, 421 bp; double-stranded, linear
agcatctgcaatgagtctctaatacaacgatacgttttgcatctttaggtacttttactgtaccattttcatcttttaccgaaatagtatctttagttgatgattcttttttacttgaattatccgtattaccacaagctgcaactaaaagtaaggcaactattaatcccaatatactaaaagtttttagacctctcatcgttccactccttaatatgtataacttcatttattattttattgataacaattatcattgtcaagtagcgttcaatcttttttatatttctaaaatgtatgactatatatttcctctaataattatgactacaattagcacatttccttagacaaaatactgataatgtatcattgctatatcatctttgcattaatacaattgacaccatttagcatgacc

SEQ ID NO: 384 - DNA, 862 bp; double-stranded, linear
tgcacttgatactttagcacatgaaattgctaatcgattagttgcaaatgacaagaatgaagcaactttggaaatgactaataaaatggcaacgattcgttttacagaacctacgctgattgcattagcagggggtaatgtcaaagcttacactgagcatatgactatatctccatataaattgtatttgttagataaaggcgatgttttaaagtttagagaaacaagttatacatcgcgagtgtatttagctgtgggaggcggatttgaattagatgcatggttaggatctaactcaaccgactttaatgtaaaaattggtggttttaaaggtagaacattacaagatggcgatgaaataaagcttaagagagattatacagctcgtcatcataagttatttgaaaaccttgctcacacgaaacaaacagattggggtattgatggatacgccttgtcatttaattatatgtctgatgtatttcatgtcgttaaaaataaaggtacggaagattttaaagaagatgccattcaaagatttgtgaaacatgattataaagtaacgagcaaagcaaatcgcatggggatgatgcttgaaggtgaaaaaatcaaagctttttatgaagatatgccaccgtatcagactgtcaaaaaaggaacgatacaaattaagcgtgatggcacacctattatcctattaaatgatcattatacgctaggtagctacccgcaaatcggtacaatcgcaagttatcatttaacgaaattagcacaaaaaccgcaaggatcacgtttgaaatttcaatttatagatattttaacggctgaaaagaaccttgttaagtatagtaactggttaaac

SEQ ID NO: 385 - DNA, 1027 bp; double-stranded, linear
aaatgagttgatgatggctcctattccatctatctctaggtatgacagaasataaacggtcttctacctgtctsacattatctttccaacgattaatacctaagcgtttagaaacacgttctacatgcgtatcaacagctaatgaaggttcatcaaatgctacactcatgactacattagcagttttacgtcctacacctgctaaactttctaattccttatgtgtttgtggtatttctccattaaattgatcaatcaaagattgacaaagtttcttaatattcttagctttgttacgatacagaccgatagaacgaatatcattcataagttcttcatcactgactgccaaataatcttcaggcgttttgtattttttaaacagctcagttgttactctatttactagaacgtctgtacattgcgctgacaataatacagcaatagttaattcgaacggattatcatgttttaattcacattctgcatccggaaacatatttgctataacatcaatcatttctaatgcttttttcttacttaccatcaaggttctccccgtttaaccaatcaaatttaggtaccgttttaactgtgtgcgtcattttcggtttattgaatttttctcttatttttctagaatcgtcaattgttttgacattgtttttcttccaattaagtaaaatacgatctatatatttaaagctaagtttattcaaactattcgcctcgtctaatgccgcttgtataattgcagtatcgtgtttatcaacatcaatccattgatttaacgtttctatttcatatggagataacggccttgcaaatgtatcctctaaaactctaaataattgtttaaatttttctttactatttagctctttcgtttccatactttgttgcttcaatatatgacttaatttttcgaaaaaaggatctagattcatatattcggkaaatctaccttcytcatcyttttgaactkgtaattctagcaattcacgtgtatcaaattttggataccatt

SEQ ID NO: 386 - DNA, 1006 bp; double-stranded, linear
aaggnttggagggaattaatngatggcaaatcccagataaagtacacaacgcatggaatgtgatgcatttaatatttccagtagttagtacgacgtttgcaagctttaaatctatgtatgggggcataccaaaagatttcatagactacttatttattgatgaagcaggacaagcaatacctcaagcagctgtgggagcattatatcgttcaaaaaaagttgtagctgtaggtgatccgattcaaatagaaccggttgtgactttagaaagtcatttaattgataacattcgtaaaaattatcatgttccggaatatctagtttctaaagaagcttctgtgcagtctgttgcagacaacgccaatcaatatggtttttggaaatctgatgctactgatagtaatcaaaaaacctggataggcatacctttatgggtgcacagacgatgtttaaaacctatgttcacgatagctaaccaaatcgcttataataataaaatggtgttgccaagtaatattacaaaagtaggtaaaacaggttggtatgacgttaaaggaaacgcagttcaaaaacaatttgtgaaagagcatggtgaaaaagtagtgggattattagctgatgattggattgaagcaattaaggaaggtaaaaatgaaccgagctcatttgtaatatcgcctttttcagcagtacagcaacagattaaacgtatgttaaagcaacaactaccgactagaattgatattgaacgtacaaaaattaatcaatgggtcgataaatccattggtactgttcatacttttcaaggtaaagaggctcagaaggtgtattttgtaataggtactgataatacccaagatggtgctgtgaactggtcatgcgaaaaaccaaacttgttaaacgttgcagtgacaagagctaagaaagagtttatgtaattggcgacatgcaaagaatacagatgaaaccattttatgagacgatttttanagnaagaaatgtaaaa

SEQ ID NO: 387 - DNA, 662 bp; double-stranded, linear
cgtttcatcaagtnatcgatcctaatttacaaaatattccggttagacttgaagaagggcgtaaaataagaaaagcctttaaaccaacttcaaaagatagcgttatattatcagcagattattctcaaattgaattgcgtgtattagcacacattacacaagatgagagtatgaaagaagcatttatcaacggcgatgatattcatacagcaactgctatgaaagtatttggtgtagaagctgatcaagtcgatagtttaatgcgtcgtcaagcaaaagcagttaactttggaattgtttatgggataagtgattatggtttaagtcaaagtttaggtattactcgtaaaaaagcaaaagcattcattgatgattatttagctagtttcccaggtgtaaaacaatatatgtctgatattgtaaaagatgccaaagctttaggttacgtggaaacattgctacatcgtcgacgctatattcctgatattacgagtcgtaactttaatttacgcggctttgctgaacgtactgctatgaatacgccaatacagggcagtgctgcagatatcattaaactggcaatggttaaatttgctcaaaaaatgaaagagacaacatatcaagctaaactattattacaagtacacgatgaattaattttt

SEQ ID NO: 388 - DNA, 669 bp; double-stranded, linear
tcatccaaattttggaaattccacattttacatatcgtaattttttaggaaactagtgaatataacaaatccctcctctcatttttaaaatagatatatcacttccccacttttacttaactaaactgcaacggttcctaataccaaaatcctgccctctatttttatcaattcaagcatacttattgaaaaatgttaacgttttcttgataatcattgtaagcgcatttattttataaactaacgtttgaaatatactacaggagtgacacgtaatgactcaaattactgaaaaagaattaaaaaagaagtatttagatttactatcccaaaattttgatactccagaaaaacttgcaactgaaattatcaatttagaatcaattttagaattacctaaaggtacggaacatttcgtcagcgatttacatggtgaatatgaagctttccaacacgtattacgcaacggttctgggaacgtgcgagcgaaaatcaatgatattttcaaagagagactttcaactaaggagcttaatgacttaactgctcttgtctactatccagaagrcmaatttaaaattgattaaaagtgatttccaaaattgcggtcmacttaatgtcyggtatatcacaacmatcgaacatttaattgagttaattaaatattgt

SEQ ID NO: 389 - DNA, 1249 bp; double-stranded, linear
cacatggctgttagagatatgaatggccatgcgttacctttaacaaaagatggcaatttttatcaaacgaatgtagatgcaaatggtgttaatcatggtggtagtgaaatggtgcaaaataaaacaggtcatatgagtcaacaargccatatgaatcagaacacacatgaaccaacagccacacatgcaacaaggtcatatgcaatcatcaaaccatcaaatgatgagtccaaaagcaaatatgcattcatcaaatcatcaaatgaaccaaagtaacaaaaaagttttaccagctgctggtgaaagtatgacatcaagtattcttactgcaagtattgccgcactactattagtatctgggttattcttagcatttagacgacgttcaacaaataaataaacataatacgattaataatagaaaaatcgtgtgattatctgagggagcctaggacataaatcaatgtcctaggctcnctaatgttatattggcagtagttgactgaatgaaattgcgcttgtaacaagcttttccatttcttaccaactccctaaatagtcatcaaaaaatttcttatattttaataatttttaataatccgattgtcttatacgtgtcagtgttaattcagatatttcctgtggaatataccacttattaatcataattggataaggtgtttgtgcgtacagtgtttcaataatcagccaacaatgtgtatcaccatcaaacacgtgactatgattttkgaagtggggcgctttggtaatagacatttttaaatctgattgatatgcattgctataaatcgtttgctcaacgaatgtcttcatgtcgtcttcgttttgtgtattcactttaaatgtgtcaatgacatttaacggtataaaggtaaagcaaaatgcatcagcttgcttagaatgattgtcctttttttgataatagcgttccattgcaatgacggcagaaggatggtttgcaaacaaatgatttgtatattcactttctaaatcaacacgataattaattgatgacatagatacgcgagctagcaatatttgatcaagtggatgcttaaattgatccatacttgaagcgtgttgggcatttgtttgtggaataacaaagtgtcccttccctcttgtactctctacgatgccatcttcggctaacaattttatagcttggcgcaaagtcatacgactggacatcaaagcgcgcacaaagttccttttcagtaggtaatgc

SEQ ID NO: 390 - DNA, 1788 bp; double-stranded, linear
aatgatgattcattcaaagaaattaacgctcggtatatgcttggtattactcattatattgattgtaggttatgtcattatgacaaaaacaaatggtcgaaacgcccaaattaaagacacatttaatcaaacattaaaattatatccaaccaaaaatctcgatgatttttacgataaagaaggctttcgagatcaagaatttaaaaagggtgataaaggtacttggatagttaattctgaaatggtaatcgagccaaaaggtaaggatatggaaacgagaggaatggtgctctatatcaatcgcaatactagaaccacaaaagggtattattttataagtgaaatgacagatgacagtaacggcagaccaaaggatgatgaaaaaaggtatccggtaaaaatggaacataataaaatcataccaacgaagccactaccgaatgacaagttaaaaaaagagattgaaaactttaagttctttgtacaatatggcaactttaaagatattaatgattataaagatggtgatatttcatataatcctaatgtaccaagttattcggcaaaatatcaattgaataatgatgattataatgtccaacagttaagaaaaagatatgatattccaaccaaacaagcgccgaaactattattgaaaggcgatggagatttaaaaggttcatccgtagttctagaagtcttgaatttacctttgtcgaaaataaagaagaaaacatttattttacagattctgtacaatatactccaagtgaggatacaaggtatgagtcaaactgaatatcaaataaaacctggtaatataacaagtaactctgaagaaacaagttcgatatctaaagtgagctgtgaaatataggtagccatttcaaaaaatttaaaggtgaatttgataatgtagctcaaggagattgggttaaaaaggcgaagaatgaactggatgatattagtaagaaattaaaaaatattcaaagaacggaagtttaatagcttatatgattcttggagctaagacagcatgcgttcattcatgccattattaatataagcaccgcaacaaaaaagcttctaatgtgatacaggaacctcatattccgtatcatgttagaagcttttaatgtctaaagaacatctacattttatcatattttctgacttattaaacttttatataattaaatatttcttaattttccaaaatagtgataaatttgtgaaatacatcacaaatccctttatttatttggaaattcatgtaatattagacttgtaagaagttaataaatagagagagacgagagagtttatataaatactatataaacattggagtgatgattatgagaaaagagattgaagcgcttattttctcagacgtaatagctatgatatttacgtgaacactggtgtaaatcaaggattaattggtgacatcaaagatggttacctaactattgattctatgccttacattgatgctgagcgtttgtatcactttgctatggaacgtaaatcgttagtcactaactagttcttattgccaatgattactacccctagtcggcggcaattgaagtgtgattgatgtaacttgccctcgttggtgagcaattgagggcagacccctttaattaagtaaaccctaactccccacaaatctggaacgatactaaaagccacgtcctatattggatgtggctttagtcakacttatattatttttaaaacgattacctacaagatttacatataaaattctatcatgnctgc

SEQ ID NO: 391 - DNA, 2407 bp; double-stranded, linear
gcaagtttagttaaacagatattaaaaccagatcaatatacagatgcaaattctctattagagattagtttgcaaacaggtatgtttattgcaggtggattatcaggaatattatataaaataaatggattcactctaattatagcgatgactataatgatgtttctaatcagcatttttatgttatttagattgcatgtagataaaccaactcattcagaggaagaatcaacaaatagcttattgcaagaatatttattaggatggaaatttttaaaagacaacatgatgatatttatttttggagttatttcaatcataccaatggtgtttacaatgatctttaacatatcattaccaggatatgtttataatgttttaaaactttcgtctgtacaatttggtttttcagatatgttatatggcattggaggattatgtgcaggtttaatttcagctattctttcgaagaaaatctcaactaaagtattgatatttttgttatatttcatattagtcataaattcagcactatttatttggataaactcagcattttacttattcataggatcatttatactaggctactcaatttcatcaatcagaatttatatgaatacagctataatgaacactgtttcagataaatatgtcggtcgctcatttacgatatggacgtcaatttcattgttactgcaaagtttaattgctccatntttaggaagatggattaatgaaattaatgataaattcggtttctatattatactcattttatccttactcatatttgtacactgctgcttgttaacaaaacagacaaaataaaatatgcacataaagaagagtgaccgtcactcttctttaacaagcgaccatttatcgatgggcttagttctctctgcacccacacttcactacttcactttttcaaatcattttttatggtcttaaataaatcagtgagatttgttgcttcggtaaagtctagaattaatatcatttctttagaacctggatatggcgaaactaatgtattatcttgcaatttctgctgggcacttttagtcgccttgaccaataatctattatcatacaaaccacctataaccacgccatcataataaataatatattctcccatcatctttcttgtcttaaccgcgtttgaattcacatgatttaaaaataaatcatgtacatctttcttagtcgccattgtaatcgctccttcagttttatgtttaatcacattcgtattaatgattcatttcgtgttgctcttaattttatctataattatatgcgtagttaaaatcaaacctatggaaaagaaaataatgataacaatgttaagaaatatagttataaaattatagtttggaaggtatgcgaatagcagaaaaataggtatcgcaaaaaataaatcccaccaacctaaactttttaaagaatgctttaaaccttccataatatcacctttataaatttgtctttgttataagataactaaaaaatcgctttactgtaaaagtagccaaagaaaattctgaatcatattcataagtagtgtatcattaataatgaacaatttaatactataatccttgatctttgtattgatcaacttaccacaacatttattttagactactcttagacttccctttcaaatggttgcatctattgaaattccttttgtataagttaggcttttgtggtaatatcatcatgcataaaaaatcgagatactaattataaagagggtataaatatattatgaaagaaaatttttggagtgaattaccacgtccattttttattttggcgccaatggaagacgttacagatatcgtctttcgacacgttgtaagtgaagcagctagaccggatgtgtttttcactgaatttacaaatactgaaagcttttgccaccctgaaggcatacatagtgtgcgcggacgcttaacttttagtgaagatgaacagccgatggtcgctcatatatggggagataagccagaacagttccgtgaaacgagtattcaattagctaaaatgggctttaaaggcatagacttaaatatgggatgtcctgtagcaaatgttgctaaaaagggtaagggttccggcttaatcttaagacctgacgttgctgccgaaattattcaagcgactaaagcaggtgggcttccggtaagtgttaaaacacgccttggctactatgaaatcgatgaatggaaagattggttgaagcacgtcttcgaacaagacattgccaatttatctattcatcttcgtacacgtaaagaaatgagtaaagtagatgcacattgggaattaatcgaagctattaaaaatttacgtgacgaaattgcaccaaatacattgttaacaattaacg

SEQ ID NO: 392 - DNA, 2424 bp; double-stranded, linear
atgatgnatggcnccgccaagaagttgaaccagtctattggctagaattgctcaaaaagcgagacatgtggtattcatatgttagtagctacgcaaagaccatctgtcaatgtaattacaggtttaattaaagccaacataccaacaagaattgcatttatggtatcatcaagtgtagattcgagaacgatattagacagtggtggagcagaacgcttgttaggatatggcgatatgttatatcttggtagcggtatgaataaaccgattagagttcaaggtacatttgtttctgatgacgaaattgatgatgttgttgattttatcaaacaacaaagagaaccggactatctatttgaagaaaaagaattgttgaaaaaaacacaaacacaatcacaagatgaattatttgatgatgtttgtgcatttatggttaatgaaggacatatttcaacatcattaatccaaagacatttccaaattggctataatagagcagcaagaattatcgatcaattagagcaactcggttatgtttcgagtgctaatggttcaaaaccaagggatgtttatgttacggaagcagatttaaataaagaataattatgagtaaggagttttatataatgacacactatcattttgtcggaattaaaggttctggcatgagttcattagcacaaatcatgcatgatttaggacatgaagttcaaggatcggatattgagaactacgtatttacagaagttgctcttagaaataaggggataaaaatattaccatttgatgctaataacataaaagaagatatggtagttatacaaggtaatgcattcgcgagtagccatgaagaaatagtacgtgcacatcaattgaaattagatgttgtaagttataatgattttttaggacagattattgatcaatatacttcagtagctgtaactggtgcacatggtaaaacttctacaacaggtttattatcacatgttatgaatggtgataaaaagacttcatttttaattggtgatggcacaggtatgggattgcctgaaagtgattatttcgcttttgaggcatgtgaatatagacgtcactttttaagttataaacctgattacgcaattatgacaaatattgatttcgatcatcctgattattttaaagatattaatgatgtttttgatgcattccaagaaatggcacataatgttaaaaaaggtattattgcttggggtgatgatgaacatctacgtaaaattgaagcagatgttccaatttattattatggatttaaagattcggatgacatttatgctcaaaatattcaaattacggataaaggtactgcttttgatgtgtatgtggatggtgagttttatgatcacttcctgtctccacaatatggtgaccatacagttttaaatgcattagctgtaattgcgattagttatttagagaagctagatgttacaaatattaaagaagcattagaaacgtttggtggtgttaaacgtcgtttcaatgaaactacaattgcaaatcaagttattgtagatgattatgcacaccatccaagagaaattagtgctacaattgaaacagcacgaaagaaatatccacataaagaagttgttgcagtatttcaaccacacactttctctagaacacaggcatttttaaatgaatttgcagaaagtttaagtaaagcagatcgtgtattcttatgtgaaatttttggatcaattagagaaaatactggcgcattaacgatacaagatttaattgataaaattgaaggtgcatcgttaattaatgaagattctattaatgtattagaacaatttgataatgctgttattttatttatgggtgcaggtgatattcaaaaattacaaaatgcatatttagataaattaggcatgaaaaatgcgttttaatatgtttataatagagtagtatgggtatttattattaatgacattattacatgttaattaggaggcgtttttaatggattggattttaccaattgctggaattatcgctgcgattgcattcttaattttatgtatcggtatcgtagctgtattaaattctgttaagaaaaacttagattatgttgcaaaaacacttgacggtgtagaaggtcaagttcaaggtattactcgtgaaacaacagatttacttcataaagtaaaccgtttaactgaggatatccaaggtaaagtagatcgtttaaactcagttgtagatgctgttaaaggtatcggtgactcagtacaaacgttaaacagctctgtagatcgtgtaacaaattcaattacacataatatttctcaaaatgaagataaaatctcacaagttgttcaatggtcaaatgttgcaatggaaattgcagacaaatggcaaaatagacactac

SEQ ID NO: 393 - DNA, 738 bp; double-stranded, linear
cnataatattcntcaancctttaaatagaggaatagactgccgacagagtccgagactttgtgggtagtttttttagttttgataacggaagttagaggctctctgtcaaattgggcagatgcattcagtaacggaagttaggctagtaaacgtgtcctaacttcctttttgcattttgaagtgtaaagttttcaacataatactattagttcggtcatgtatcggactgatggaaaagcgtttcacttttaatgactcattaagaacggcctgaaaatgtttggcgtattaagtgcaatgatagttttgacatttagtttctaattggtcattactgccgagcaaatctagtagagtaatcatgtaaatctttaatgtgccatttgattcactagcggtgttaataactacggaaattgcatttccgactgaaatttttgaaaaatatcaacgtacgctacaaataaaattttaaactgttataaatgtgtctcaatttcatatgttcatcgacgatatgaagcgtattatggtaaaatgaagaaataataaacttgttaataaataaaacatcacgatttgactaaagcactttattattgtgtagataatagttttttaacgaaataaaaatggcgactggttttaataaatcagctaatgaatcactacacctataagtatgaatatagtgattagaatgctttgtatagttggattttgcaaaattgatgtta

SEQ ID NO: 394 - DNA, 1270 bp; double-stranded, linear
aaaagttgtaattaaaagtgggattttacttaagnnagaaggaaactatttatatgactaataaaagagnagatgtccgcaatatagcaattattgctcacgttgaccatggtaaaacaactttagtagatgagttgttaaaacaatctggtatattcagagaaaatgaacatgtcgatgaacgtgcaatggactctaacgatatcgaaagagagcgtggaattacgattctagccaaaaatacggctgttgattataaaggtacacgtattaatattttggatacaccaggacatgcagactttggtggagaagtagaacgtattatgaaaatggttgatggggttgtcttagtagtagatgcgtatgaaggtacaatgcctcaaacacgttttgtacttaaaaaagcgctagaacaaaacctgaaacctgttgttgttgttaataaaattgataaaccatcagcacgtccagagggtgttgtagatgaagttttagatttatttattgaattagaagcaaacgntgaacaattagaattccctgttgtttatgcttcagcagtaaatggtacagctagcttagatcctgaaaagcaagatgataatttacaatcattatatgaaacaattattgattcatgtaccagctccaattgataacagtgatgagcccattacaatttccaagtagcattgttggactacaatgattatgttggacgtattggtattggtcgtgtattcagaggtaaaatgcgtgtcggagataatgtatcactaattaaattagacggtacagtgaaaaacttccgtgtaactaaaatctttggttactttggattaaaacgtttagaaattgaagaagcacaagctggagatttaattgctgtttcaggtatggaagacattaatgttggtgaaactgtaacaccacatgaccatcaagaagcattgccagttctacgtattgatgagcctactcttgaaatgacatttaaagttaacaattctccatttgctggccgtgaaggtgactttgtaacagcacgtcaaattcaagaacgtttaaatcaacaattagaaacagatgtatctttgaaagtttctaacacagattctccagatacatgggtagttgctggtcgcggtgaattgcatttatcaatccttattgaaaatatgcgtcgtgaaggttatgaattacaagtttcaaaaccacaagtaattattaaagaaatagatggtgtaatgtgtgaaccatttgaacg

SEQ ID NO: 395 - DNA, 1365 bp; double-stranded, linear
aagaccaggagaacamgtaaaacaatatacagttgaaatcgctcgtaaattaatggaatttgatataaaatgctcgtgattgcttgtaaatacgcaactgctgtngctttagaatatttacaaaagaccttatcaatccccagtgattggcgtaattgaccaggtgctagaacagcaataatgactactagaaatcaaaatgtattagtactaggaacggaaggcacaattaaatctgaagcatatcgtacgcatattaaacgtatcaatccacatgtagaggtacatggcgttgcctgtccaggttttgtgccacttgtagaacaaatgagatatagtgatccaacaattacaagcattgtcattcatcaaacactgaaacgttggcgtaatagtgagtctgatactgtcattttaggatgtacccactatccattgctctataaacctatctatgattattttggtggtaaaaagacagtgatttcgtctggattagaaacggctcgtgaagttagtgcattgctaacatttagtaatgaacatgcaagttatactgaacatccagatcatcgattttttgcaacaggtgatcctactcacattactaacattatcaaagagtggttaaatttatctgtcaatgtggaacgtatatcagtgaatgactaggaggatttttaatgaaagagattgttattgcatcgaataatcaagggaaaataaatgactttaaagtaatatttccagattaccacgtaataggtatttcagaactaataccagattttgatgtggaagaaacaggatcaacatttgaagaaaatgctatattaaaatcagaagctgctgcaaaagcattgaataaaacggtcatagctgatgacagtggactagaagtttttgcattaaatggtgagccaggtatatactctgcacgttatgctggtgaaaataaaagcgatgaagcaaatattgaaaaattattaaataagcttggtaatacaactgatcgtcgtgcgcaatttgtttgtgtcataagtatgagtggccctgatatggaaacaaaagtatttaaaggtactgtttcaggtgaaattgcagatggaaaatatggcgaaaatggtttcggatatgatccgatattttatgtaccgaaattagataaaaccatggctcaactttcaaaagaacaaaaagggcaaattagtcatagacgaaatgcgattaatttacttcaagcttttcttgaaggtgataaaaatgtctaaatggattattgtgagtgataaccatactgaatcaggcgttttatatcaaatttatgaaatgcacccagatgcagatgtatatttacatttagga

SEQ ID NO: 396 - DNA, 1383 bp; double-stranded, linear
aattcctggtgcaataataaataggatgaaaaagattcggaaaatatgataactcgtaatcatagcaacatcggcaccagtagctaatgcaactaaaactatctgattaacccctcctggtgctgcaccaagaaacaattcattaataggattattatcaaagaaatgtatgatataaaccatgattagcgcaccaattatcaacataatattttgaattgtaattgcgattgctagtctaccttttaaatctgacaataaatgcgcaatttgaactccaattctaatcatatatattagttgtgccatgttcaacaaccaatgatctagtgtaaatgttaaacctgtagaaaaattccaaacaattaatacaatgagtggtgctaataattgaaatgttggaaactttattttagacataattagataaactataaagatagctatcgctaaaataactatttgccctatgtttaatacttgtgataaaggcaagacttttgttaactttccattcgcatgcatgttaccatcatgaaaaaaatatgaaatgaacggtactaaaacaacaacaaatataattcgtgatgtttgcgttaagctaacaactaacaaattagcacgtttgtcttgttcagccatgaccagcatttgtgttagtgctcctggtataacacttaaaatagctgtttctgtattaatacgtgcaatttttttaaaaacaaatgccattactattgcaattaataatatcgaaatagatacaacaataatcgaaagccaattgtttttaatatccataacgacatttttcgtaaacgttgatccgatttgcacacctaatagtacaatacctaattcactaagtaagaatggccatttaatatcaagtttgaaaacttttacacaaatgattgatgcgataataggaccaaacataaatggaagtaatacgtgcgatgaatacagtagaatactaataaaaaatgataaaacgaacacaatgaaattatttctatatatcattgccatgttttccacttctttcaataaaaaataaaatgactaaattgctgcttgagcttcacgtttgttaagataacaatatccgctagcagttttgactacaaagcatatatggactttcactatcaagtcgccgcccatgccttatatacatttaaaangagcctgaacaaagttcaggctctcaatttgtccgtatatttattttacaatacgacttaaagccgtatcaaatgcttgaatcgtttttcaatatcttctttcgtgtgtgccgtagataagaatgtaccttcaaattgagatggnggnaaaaacacacctctttgncattctcggtacatttctgcaataatttcc

SEQ ID NO: 397 - DNA, 415 bp; double-stranded, linear
tccactaanatgattacaattgcattagtttggtggagtgcatttacaatcttaacgggtatgattaagaaccacggtttaattatttagtgagattcttatttggtgtaggtgaggcgccaatgtacccttctaatgctgtgtttaattcattttggttctctaaaaatgaaaaaggtagagcatcaagtgcattattagcaggatcatatttcggacctgtattagcaccaatagttacaattgctattgttaacgcatttaactggcaagcagtattttacatttttggtgcagtaggtattttaatggckgtattatgggcgattattgccaaagacttacctgagcracatagwatggttaatgaagcggagaaacgtttcattatggaaaatcgtgatatcgtagctac

SEQ ID NO: 398 - DNA, 1141 bp; double-stranded, linear
ttttagataaatycaattntcyatactaaatgattntcttattacgtcaattcgccttttattttatcgtaatctttccactgcaaagctaaagcttctcctattctaagaccagaataaaataacagtctagttagctgacgagaagtatcatttgtgatttgttctactttttcatcaaattcttcacgagtgataaatttagcttgtggttttgttctgggaataggagttaccgataatgtggggtcgtataagagcttgtaatgctttttggcgtaattgataactgctttaaaacctgcccacacagatcgtgcatagtcaacagaaagacctgcatcgtttaacaaataattcctgaaagcagtacattgcgtagtagtgattttgccaatagggatatttccgaacctttcttttatgtgagtattatattctgtagttcgcttttctattgagcgtgcagaaagattttcattttttaaacgatcaaaaaatatatattcaaagggttgattgtccgagtatccatatttaacattttgtataaattcgctttcagctagtttggcatctttcttacgttcaaacccacgcttcatttttcgtttgttattaccgtatacatctttatatctaatggaaaaataccatttacctgtattatcatccttatatactggcattttgcttctccctcctcaaaattggcaaaaaataataagggtaggcgggctacccgaaatttagtactaggtactaaatgtgatataataaaataaaaagtaggtgatgttatgacatttaaaaacaatcataatttcaatgaattagttttaacgaatgaagacattagaattttaaaaaatgtcttagaagatgcagtcagtgtttatgatgaatattcggtatgtaatgaagaatccgattttgcttactgtttattaagagacttatatacattagacagcttagctatttcgtcaaataatgtttgaattatcgaattgtactcttcgattttaataccatgcataatagagtttctgtgttcaatagcagctttgactgaatgtkttaaatgttcttctattaaatcgttgtttkccatttcgtktaaaaatgttcytatattcct

SEQ ID NO: 399 - DNA, 706 bp; double-stranded, linear
actgtggtaggttttttattttgaagtattaatcataacagactaataatcatgaggtaactaataacacatatttaacttgtattcttaaactggtataataaatttatgttgaaatgaatattgtatgacagggtattcacttttattaaaaggtaaaattaaataaaggttttatagaacgtatttaaatatatgaggagtaaacaaatggctgatagaacgaataaagaaattaaaacaggacgctttattgcaactgcatcaatcgtattctcaatattattgattattcattactttgtttcgttggataatgcgactgccaaagcattacttaatttaacgaatcaaaacacttcagataaagcgattgattacattttaaacagctttagattcactggtattatgtatattttggcttatctagcaggcttcatcactttttggaatcgacatacttatgtgtggtggtttatgtttgcagtttatgtatcaaatagtttgtttacgttgattaatttatcaatcacaattcaagcaataaaagctgcacacggtgcgtacttaacattgccaattttaattgttattataggttcggttgcattagcgatttatatgcttgttgtttctatcaaacgtaaaagtacatttaatcgctagaaaattgattttaacaataaaaatatgaaaaaaaann

SEQ ID NO: 400 - DNA, 1187 bp; double-stranded, linear
acacaatctgaagattcacgttgtggtgctggacatgatcgaaaaattagagctgaacaaatganagaaatcagtgattttgttaaaaagaaaaatatccctaaagatgaaacggtatatataggtggcgaccttaatgtcaataaaggcactccagagttcaaagatatgcttaaraacttgaatgtaaatgatgttctatatgcaggtcataatagcacatgggaccctcaatcaaattcaattgcgaaatataattaccctaatggtaaaccagaacatttagactatatatttacagataaagatcataaacaaccaaaacaattagtcaatgaagttgtgactgaaaaacctaagccatgggatgtatatgcgttcccatattayacgtttacaatgatttttcagatcattacccaatcaaagcctatagtaaatagtgctcaactaactaataacttgcttcgttctaaaaggacgaagcgagttatattgttaaaatttgaattgacttacattttaataaaatcatcttaacaactttaatttttcattaatacaagtctttactctacactcaaacnagattcatacactgcacgtcataataaatctatctattcaaatataaataaaagttacctactacattctatgtagcaggcaacttttattacttatttcttttcattatcattaagtacttttacaaacttcacattatgtgtcttccaatcaacttcatataatgctgataatttttcttcttttttatctacatggttttcaccagaccaatagccccagaaaccatggcgattccaatctattttaaactcatccattgatcttttataatgaacaacaaattgtgatttacctttgtcttttttatcatgtgacataacagctaaaaattctggattaaacccttcagacacagttacaggcattttgtctttaggtgtgaaattatctttcgcccataaatttccatttcgtgttaaagaaaaaatttcacttttagttctattatcactatcattagttaattgtctcgtatggtcatgtcccatattatttatcaaatgtgcttctactttccaacctacacctttatgtgacgtagattgatcaagtaatgtacgatatgatggttgttgataactaatcgtctctgaata

SEQ ID NO: 401 - DNA, 847 bp; double-stranded, linear
ccagaattattttttcaaaaaggacaatttaacaatgtcgataacgttatcataagcaaaccgatgaaagggacaatgcctagaggtaaaacggaagctgaagatcaacagtattataaaacattgcaaacttcttcgaaagatcgtgcagaaaatgtcatgattgttgatttactaagaaacgatatagggagaatatcacagagtggctcaattaaggtgtataaactattttttattgaggcatataaaactgtatttcaaatgacttcgatggtaagtggaactttaaaaaataatacagacttaactcaaattttaacatcgttatttccttgtggttcgattacaggtgcaccgaaactgaatacaatgaaatatattaaacaattagaaagttcacctcgtggtatatactgcggacaattggactattacttccaactgaagatgataaaatgatttttaatattccgattcgcactattgagtataaatatggacaagcgatttatggagtcggagcaggtattacaattgattctaagccaaaagatgaagtgaatgaattttacgcaaaaaccaagattttggagatgttataatgcaattatttgaaacaatgaaaattgataatggacatatccctagacttacttatcatactaatcgcataaaatgttcttctgagcgattaaactttaaatttgatgaacatgcatggcgaaatgaattaaacgatgtaacaacaaagtatcacagtggtcaatatagacttaaaatcgtattaaatgctgaaagcaaatttgaaacgatagtgtcacctttacctgagaaaagtagtttt

SEQ ID NO: 402 - DNA, 740 bp; double-stranded, linear
tgaagatgaagcagaagcagaagacaatctgctacgagtacaatcgaagaaagaagaagtgtatcgtcgattacttgcttctaacttaacaagcgttcctgaaagtttatcatcatgaaaaatgaaattgatcatgaagttcgtgatgttaacgaacaatttagtgaacgtccaatacacgttaaacagttaaaagataaagtgtctaaaattgtgattcaaatgaatacatttgaagatgaagcaaatgatgttcttgttaatgctgtttatgcagagaaattaattcaatatggaaatagatatcgtaaggactatagcaatgttgataagagcttaaatgaagctgaacgattatttaaaaataatcgctataagcgtgcgattgaaattgcagagcaagctcttgaaagtgttgagccaggtgttactaaacatattgaagaagaagttattaagcaatagaaactagtatgtagttatacttaaataatatgagcactctgtcaaattggactgatgagtttaataattgaagttagccaacgatacgttgtctagcttcttttttatatggataaatgaaagggacaataaatataaatagcaattgtttaaagataaacgtaatcaaatgtgttgttttaattaatataagtagtgaaaaaagcataatcacacagctgtttaaatagagtgaaatagtctaattcttatttaataagtagaaataagattat

SEQ ID NO: 403 - DNA, 630 bp; double-stranded, linear
atgccaataattaaaccatgtaataaatatacgtatagcgtacgactaccaatataagtatataattttttctttgttgacattaaatttagaaacgcagtcattgcgattaatataattccatataatataagtcgtttaaaaggactgaatatactctgtccttcattttcaagtgaagtatatggtgaacttcccaataaccaatctgcattgataggatgaatcacgtaaacgataaaaaacaaaataaaggtaatgatagatactggtattagttttttatttttaaaaatagccgtatgttttttggtgaaaatgtaacctagataaaatattgggaaaaatacgattgtccttgaaatgcttaagtagctatcgatgttatctgaaaaacctgctccaatagatataataattgaaactgatagcactttatatggattaaatcttctaactattactaaaatgacatgaaagaaaaatagcgtgatcaaaaaccataacgcaaatactgggttaaaaggatcaagttgtaattcgtcacttttacctgttaagaaataataaattgaaaagaatgcaaaaaatatcatataaggtactatcaaacgttttgaaattttttct

SEQ ID NO: 404 - DNA, 6254 bp; double-stranded, linear
atttaaacgttcagtttctaaaagtggaacaatccaagaagtacgtaaacgtgaattttacgaaaaaccaagcgtaaaacgtaaaaagaaatcagaagctgcacgtaaacgtaaattcaaataattaatacctctgttgactccctcaacacgaatattaattatataaaacaaacatcacaagttagtgtctgacactaatatgtgatgtttttttgttgtcaatttttaattaaaaaaagttatatagtttataaataatcaaattgatattctataggttcttataactataaagtatattcaatttcatgtataattaatgtgagggcgaggtgaaattgtgagttataataattttttacaaatgacaactatcttggaatcaacggctggagatacttgggttgaacaagttagcaatataattgttcaacctatttttacgttaatattaacctgtttgacattcttaggatttgtatatcaactttactctaaaaaaatcaatgcagctggtattatcgccacattatcattacttattttatttttgggatttctaatccaaggaaatgtcaatatgcattctatcttaatattctcaattggcgttatattagttgtaattgaattatttgtagttggtgcagtaattggtattattggcatgatactgataactataagcataacaacgctcggtgataatttgctatttatgcttgcgaatgttatcgttgccttgattttaacgattgtagaatgggtgatattagtgaagattttcaacagaaagattccgtttttggataaagttatcttaaaagattcaactaattctgagtcaggttacaattctcatgataaccgctcgcacctcgtaggaaagactgctcaaacagttacagatcttcgacctgcagggattattttttgtgaaaatgaacgtattgatgctgtttcagatggcaactttattttgcgcaataaaacggtaaaaatccttgaagttgaaggaacaagagtagttgtgagggaagtagattaattaaaaggagcgataccatgtttagtttaagttttatcgtaatagcagttattatagtagttgcattacttattttattctcatttgtacccattggtttatggatttcagcgttagcagctggcgttcatgttggtataggtacattggttggtatgcgtttacgtcgtgtatctccaagaaaagttatagcgccattaattaaagcgcacaaagcaggactagcattaacaacaaaccaattagaatcgcattatctagcaggaggaaatgttgacagagttgttgacgctaatattgctgcacaacgtgctgacattgatcttcctttcgaacgtgctgctgcaattgaccttgcaggacgtgacgtattagaagcggttcaaatgtctgttaatcctaaagtcattgaaacaccatttatcgcaggtgtagcaatgaacggtattgaagtgaaagccaaagctcgtatcacagttagagctaatattgctcgacttgttggtggtgctggtgaagaaacaatcatcgcacgtgttggtgaaggtatcgtttcaacaattggttctagtaagcatcatacagaagtacttgaaaacccagataatatttctaaaacagttttaagcaaaggtttagattcaggtactgcatttgaaattttatcaattgatattgctgacgttgatattagtaaaaatattggtgcagacttacaaactgaacaagcattagcagacaaaaatattgcacaagcaaaagctgaagaacgtagagctatggctgtagcaactgagcaagaaatgaaagcgcgtgtacaagaaatgcatgctaaagtagttgaagccgaatctgaagtaccattagctatggctgaagcattacgttcaggtaatatcagtgttaaagattattataatttgaaaaatatcgaagctgatacaggcatgagaaatgcaattaataaacgaactgatcaaagtgatgatgagtcacctgaacattaagtcgagaggtgattaaatgagtgtcggtattctaatttttgtcatatcagtgatcatttctatcattactactatgcgcgaaaatagtcataaagatagacaaaatcaaaagccacctcaaaaaacatctaccgataatgaaccaaaaaaaggtggcttttttgaagaaattgagcgaacgtttaaagaaataagtgaagaattaaatgaagaagaaaagaaatcatcgaaacgaaaatatgatgatacgttaccacctttattcgatgaacttccaaaggaagagcctaaatcgaaacctgttgtagaacctatggcacctaaaaaacaacaagaaacaaaaccgatgacagagaaaccaatcacagtgcctaaagcagaaccggtggagcagaaacatagaccttctagacaagataattctgacgaaattagacgtcaattagaaaaatcacttagagatgatattaaaacgattcgtactgacattgatagagaaaaagaaaagcaaattgctaaaatggaaaaacgtgctagagatattattgaggataaatacttatctgaacgtacaaaacgtttgaaattaaagcagctgcttaattctcaaaatgtcgaaaaagatttgactaaatcagcgttccaatttgataaagatgaagtaatcaatggtatgatatggtcagaaattttagctaaaccaaaacaattataaaattttttgaaaacaagcactatcgtaatggtagttgcttgtttttttacgttaaggaaaattaaaaaacaaagagaatttttcgagaaatattagttatttaaattacagcaaaaaattgattagtctaaaattgaatctgcttttatgacaaggtgaaaagtataaatgattattttaaattaaagaaaaatgagtaagtcaatgcaaagatgtttaaatcaatcaattgcatgatataattaagtagatattaaagcatcatagaatgaatataaatgatatatgaaaaggagcgcgtgtatgcctggaattatacaaatagacgatatgaaccaatctcaagctttaattggaaataatgatgaacatttaaaagcaattgaagagagtttcgatgttgtcatccatgcaagaggacaagaagttgccgttaaaggtacaaaaatagaaaacgtagaaaaagcggaatcagtattaatcaatttgctgaaggttattgatttaggtaataatattacaattaaagatgttgaagcagctattaaaatggcgcataataacacaattcaacatctgttagatttatatgatgaagagataactaaagatgcatttggtaagacgattcgtgcgaaaacgatggggcaacgtatatatgttaatgccatgaaaaataatgatttagtatttggtataggtcctgctggtacaggtaagacattcttagctgtagtttatgcagcaaagcaactccgtaaaggtgctgttaaacgtattgtattaacaagacctgctgttgaagcaggagagtcacttggatttttaccaggagatttgaaagaaaaggtagatccatatttaagacctttatatgatggtctatatactgttcttgggcgtgaacaaacagagcgatttattgaaagaggcattatcgaaatagcgccacttgcatatatgcgcggacgaacattagaagatgcatttgtaattcttgatgaggcgcagaatacgacacatgcgcaaatgaaaatgtttttaacaagactaggttttggctcaaaaatggtagttactggtgaccaaactcaaatcgatttacctaaaggtgttaaaagtggacttaaggaagcggtcagtaggttacacaacgttaaaggtataagtatattgaaattagatcagagcgatgtagtcagacatccattggtaagtaagatcattgaacattatgaaggagagaattaaatgtttacgatagattttagcgatcacacaggcttagttaaagatgcttggtataaacaaattgaagatttattagaatttgctaaaaaagaagagcatatagaagacgatgctgagctttctgttacatttgtagataaacaagaaatacaagaaattaatcgaacatatagagataargwtaargttmcagatgtaatcycatttgctttagragragatgagccmgagatkgattttagtggtcttgatataccacgtgttttaggggatataattatctgtacggatgtagcgcaagracaagcaaacaattacggacattcttttgaacgagaattaggatttttagcattacatggatttttgcatctattaggttatgatcatatgactgaagcggatgaaaaggaaatgtttggtcgacaagatacaatattaaacgcatatggattaacacgagactaattatgaaaaggtttaaatatgcacttgatgggctgaaaatcttaattcaaaaagactataaatttcttttacatgtgtttgcaatgattgttgctattgtctttggtctcgtactaaatattaatcggattgagtggatatttatactcattgctattgcattagttctcactgttgaagctttaaacactgctattgaatatgttgtcgatttagtgaccgttgaatatcatgatttagctaaatacgctaaagatattgcggcttttagtgtacttatagtttcaatattagcatttattataggtttaatagtatttttaccacattttatagcgttattttagggaggcatatatgagttatcaacctcattattttcaagaagttagaaaagcacaacaagaatcatattcgccatacagtcaatttaaagtaggggcttatttaaaamcgaaagacggtagaactttttatggtaccaatgtagaaaatgcttcttatccattatcgatatgtgctgaacgagctagtttggtatcggcaatttctcaaggatacagaccaggtgattttgaatcaataactgtaaccgtagatgcagataaaccgtcatcaccttgtggtgcatgtcgtcaagttttgaaggaattatgtgatgatgatatgcctgtgtatatgacaaatcataaaggagatatggttatgatgacagtcgcagagttactaccatttggattttcaggaaaggatttagaataaatgacagaacataaatcaggatttgtttcaattataggtagaccaaatgtaggaaagtcaacatttgttaatagagtgatcggccataaaatagcaatcatgtccgataaagctcaaacaactagaaataaaattcaaggtgttatgacaagagatgacgcgcaaattatattcattgatacgccaggtattcataaacctaaacacaaattaggtgactatatgatgaaagtcgctaaaaatacattatctgagatagatgcaatcatgtttatggttaatgccaatgaggamattggacgaggcgatgaatatattatagaaatgttgaaaaatgttaagacaccagtatttttagtattaaataaaatagatttagtgcatccagatgaattaatgccaaagattgaagaatatcaaagttatatggactttacagagattgtacctatttcagcattagaagggctaaatgtcgatcattttattgatgttttaaagacgtatttacccgaagnacctaaatattatccagatgatcaaatttcagaccatcctgaacaatttgtagtgggtgaaatcattcgtgaaaaaatccttcatcttacaagtgaagaaatccctcatgcgattggtgttaatgtggaccgtatggttaaagaaagcgaagatcgtgttcatatcgaagcaactatatatgttgaaagasgttcgcaaaaaggaattgtcattggaaaaggcggtaaaaagttaaaagaagtaggaaaacgtgcgagacgtgatatagaaatgcttctaggctctaaagtttacttagaattatgggtcaaagttcaaagagactggcgaaacaaagttaactttattcgccaaattggttatgttgaagaccaagattaatcttaaaagtggtgaagataattgttaatgcgccaaaaagggattatcatcaaagcagttgattatggtgaatctgataaaattatcacgattttaaatg

SEQ ID NO: 405 - DNA, 3710 bp; double-stranded, linear
gttgttctaaatgtttcttgnatgaaacgagtcaatgtaaactgatattgctgtatttgttgcagcaattcatattggtctggtgttgcaataacagcagcttgagttggagtcgcagctctgatgtctgcagcaaaatcacttaatgtaaagtctgtttcatgaccaactgctgatataatcggtgtcttacaattatatattgcacggacgacagcttcttcgttgaaattccataaatcttctatggatccaccgcctcgacctacaataatggtatctacacctaaactatctgcatattcaattttttcaataatgtcgtcttttgctttttcaccttgaaccaaagtactaatttgtatttgttcagctaatggaaaacgactatttatcgttgaatggatatctcgaattgcggcacctgtactcgctgttaaaactgcaatttttttaggaaacttaggtattgatttcttattcgctttatcaaaacaaccttcttcagttaattttttctttaatgcttctaatttttgatataagttccctataccatctaattgcattttatttacataaatttgatagtttccacgacgttcaaaaacagaaacacgtgcttctaataagacttcatctccttctttaggttcgaagtttaatttagaagcactacctttgaacatcatggcacttataacgctttctttatctttcacattaaagtataaatgaccacttgaatgctttttgaaatttgaaagctcacctttaatcaatacagattggagatgtggatcttgatcaaatttatatttaatatatttcgttaaagctgaaacacttaaataatctgacatataacatcactcaattttatttttttatattactcaatacaccatttataaatttataatgatcatcatcactgaattgttttgttaattcaactgcttcattcattacgactttagcaggtgtatcactgtgtaatatttcatatgttgccattcttaaaataatacgatccgtttttaataaacgtgcaatagtccaatcttttaaataaggactaattgtctcgtctaatacaggttcgtgatctttaacgccagaaactagccaatgaataaattcgaagtctaaatctggattatcgtctttaataaagcttatcgcttcatttatcgttaaatcactgtccttcatttctaattgaaataaagtttgaaaagcttgcactcgggattctttacgactcatttttaactccttcaaacgtttgtatttttctttatttaattactgaattaggtatgacattacttttcaataacgatttgtgtaatgtgaatattaatttgcttaggttctatcgctgtcatattagaaattgaattaaaaattgacgtttgaattttgtttgcagtttttgaaatattaacaccatgttttaatgcacaatatacatctatatatatgccatcttctttactctcgatttttaaatcacggcttaaatttttacgactaactttttctaaatttgtttcttttaattcagcaaaatggccagtgatgccttcgacttccgaagtagctatacttgcaataacagatagcacttctggcgctatttctactttacctaattttgaatttgaataatcagttactttgaccatggattgacctcctattaaccttcatcattcataatgctattttgctctaaaaagtttgtattaaatttaccgcttctaaatatatcgttattcaataatttaatatggaatggaatagttgtatcaataccaagaaccacaaattcacttagtgcacgaatgccagccataatcgcttcatctcgtgtcggttcatgtatgattaatttcgctaccatcgaatcataatatggcggtatcgtataattagtataacatgctgactctattcgaacaccatatccacctggtgcaagatattgctcmattttacctggtgatggcataaagttcttgtaaggattttcagcattaattctaaattcaattgcgtgtcctgttaatttaatatcttcttgtttatacggtaacacgtcacccatagcaacttgtaattgtaatttaactaaatcaattcctgttaccatttcagttacaggatgttctacttgaatacgtgtattcatttccataaaataaaatttattatcatttaaatcatatataaactcaattgttcccgcattttcataatttacagctttcgctgcacgaactgcggcatttcccatttcacgacgtgtttcatcatctaaaattggggaaggtgcttcttccactaatttctgcatacgtctttgaattgtacaatcacgttctcctaaatgaattacattaccatagctgtccccaacaatttggatttcaatatggcggaagttttcgatgaatttctccatataaagtccaccattaccaaatgcagtttgagcttcttgttctgtcattcggaagccagtttcaagttctttttcatcacgagcaacacggataccttttccgccaccgccagcagtagctttaatgatgaccggatagccaatttttttggcgattttcttagcttctgagacgtctttcattaaaccgtcactaccaggaacaactggaacattggctttgatcatttctgccttagcaacatctttgatacccattttttggatagattgataacttggtccaatgaacttcaattggcatgcttcgcataattctgcaaaatcagcattttcagctaaaaagccataacccggatgaacgccatcacaacctgtagaagttgcaatagataagatgttcggaatatttaaatatgaatctttagacaaagtgggacctacgcaatatgcttcatcagcaatttgagtatgtagcgcatctttatccccttcagaatagattgcaacagtttggatgcctaaatcacgacaagcgcgaataatcctaactgcgatttcaccgcggtttgcaattaaaacctttttcattatttcaccttaaataacggttggccatactctaccatttgtccgtcttctactaagatttcaacaatttcacctgaaatttctgcttgaatttcattaaatagtttcattgcctctaaaatacacactgttgtttcatttgaaacagtgtccccaacttgcacatatgcttcttcgtctggagatggcgatttgtaaaatgtacctaccataggtgcattaattgttttgtgattatctgaagttggctttggagcttcagttttattgctatcagttgattgtgcttgaggcataggcattgccgcagcttcaactggcatttgtgagatttgtggcgtgataatctcagtttctttttctttcttaagcgtcactttgcctttagtatcttcaatattgatttccgttaaagttgatttatccagaatttcaattaattctttgatttctttaaagttcattattactgactccttcagtttgttttcatctacccgtctattttacttgagacaactcttcaattcaagcatgttcatattgctggcgacattataagtctatcccaaagttataataaaaccacattttaaattaaaaacacttgtgtatttattacttaacattgactcatcttaactcttga

SEQ ID NO: 406 - DNA, 1705 bp; double-stranded, linear
gctgatgttcgttgcctttntccaccagacaattcagagggatatttatcactaatatccaatatatttaatgcttctgctactttttcataacgatttaacatatgttctttatctaacttctgtaccgttagtggtaacattatgttttctttaacagtcaatgtatgcagtaaattatactcttgaaaaataaaaccaatatcatgcttgcgtatatcagatwattccttgtttgaaagcttttctaatttttttccttttaatgtaatagaaccttgtgaaatataatcaattgaacttaaaacatttaataatgtcgttttcccagatccagagggacccataatagcaataaactcgccttcttcaatagacatattgatatctcgcaacacttcttgtgccatttttttagttccatatatttttgttaattgttttacttctaaaattgccactttaacactcctataatttatcttaacttcatttcctttaggctttggcacttgtatcttcaatttaacatatgactaacatctatcttattataacgttgaagctgcattgatgtatcaattctaagtaacaaaacgcatgtttaaaatgacaaatttgtcacttccgacatgcgttcaacaatttcattttgtaatgggaaaatcaatctgacagttgtccccttaccaacagtcgacgtgacttgcaggtgaatacctaattgatcctttacactatttactaaatatagacccatacctgaagacgtcgtttcatttctgttagccgttgacgtaaatcctcgttcaaatattcgcggcatatcttttttactaatacctctgccatagtctttaatatataacgaaacatgttgatcatttaattctgtcccaatttcaatattaaaattctcactatatttcaatgcgtttgacaaaatttgtctaataatcatacgacaccattttatatctgtataaacataatcatccactttaaagtcaacatcaaaaccaatacctttaacctgactaatatgtcttgttaattgtatttcatcaatgaccatgcgtttaagtgacacgtaatcaaaatacatatctttacgttgagattctaatctagtaatatacagctgtgtatctagcatcgagtttatacgagaccattcatatagtaatgcttgtwttctttcttgatttttttcttgatcaattaataatttcatagctgtcacaggtgtttttatgtcgtgcacaaattctgtaatggtttgttcatgcatgttcaattgcaactgttgctcaacaaccttttctttgtgcgctgagatttgacgatataaataatcaactgtatgacgttgaaatggcgtttccgctaaatctttatgtttaatttcttctatttctttatctttgtcaaaatgcttatataattttacttctttaaaatatgtcaataaaagaaaaatcattgttaaacttaaattcaaagaaacaatataaaataaactgtctattggaaaatcataatcgattagactartgcctaacataaggaagtttaaaaacaatatccaaaatatccagttcatgcgagatttcaaaaaataagctacccatttcaaattattcatgagccatatatcctttnccnacttttgtttcgattgcactatccatactaatttcagata

SEQ ID NO: 407 - DNA, 1722 bp; double-stranded, linear
tcaatatatcttaaaattcaatgattaaatcnattatcactagacatnaaatacataaatcctattccccattttcatttnttaattcataaatgaatcaataaccacctaataacaaatcatattatacacctttgttctctatttttctaaggtttaaaaaatatttttaggtaaacctaaaaatagatgtaataaaaacgcctcctcagatatttatatatctatgaagacgtttaaatacattatagatggtctggttctgggtgaacgtatactgaggaaataccttttttgtgcaaatgatgttcgacattgtcacaaatttgatgcgcttctactaaggaaaggttagcatctacaacaattgtgacatcaataaacacactacttccatggtaacgccctttaatacttttaacttcttgtacttcatcaacttctaaaatatcattgcgatacgcttctaattcagtttcattgaaaccatcactcaacataaaaattgcttctttaaaaataccaaaaccagtataaacgattagtaagcctagtaatgttgctaaaataatatcgacaattgggaaaccgatttgcgtaaaaattaatcctatcgctgttccaatgctgactaaactatccgataaattatctttggcagccgaatttaaagaactacttttcgttcttttcgctagtctttgattgactgcaaatacaatcaacattacaagaccactgattaagctgacgataattgttattgcgttaggtacaacgtcatcttctttgaacaaacgaggtgcattttgaataactacttggatacctacaaacataatgacaaatgacaccaataatgaagaaatattttcagacttcaaatggccataaggatgatttcgatcggcaggtttaattgaaattttcaatccaataataacagctaaagaaacgataatatctgtcatattgtttaatgcatcggctcttacagctgcagagttaaagacaaaacccgtgacatacttaacaatagataagattatatatacaattaaactcaaataagcaccgcgttgcgccaatttaagattttcattatgagacatgcgttgaaccaccttgaattagtatagtaacaatattatgaatgattcattttaattttacaacgtttttaatttttataaatttttataaaattaaactaatttattcattcgcaacccctaaaaataatttttagcctttctgcgaattttatgagctagaaaggcgcccaactctccctgtttgttaactttcgcctcgaaagtttctatgttgggaccctatgcattagtagcgaagctatctaatgtgttcctttattttctgcgaawwttatgagctagaaaggcttatgcagttgacgttttacgtccaactgcgttcctccgtcttcttcaaatttatttgtnagaaaggcacccaactctccctgtttgttaactttcgcctcgaaagtttctatgttagaaccctatgcatgagttgcgaantatctaatgtcgtgaactaattatatagaagaaaaagtgcatcaatgacaaattaaatgagatttctactctaccaaactctcttcgaaagacaattttctcctctatttattagcaactattgcatttctccatatagtacttccttacttaaaatacgctgaatgtctgaattaaa

SEQ ID NO: 408 - DNA, 5521 bp; double-stranded, linear
gcgagaccccctgagggagcagtgcccagtcgaagacccgaggctgagacggcaccctaggaaagcgaccattycaatacgaattgtgataaatagagaacagcagtaagatattttctaattgaaaattatcttactgctgtttttttagggatttatgtcccagcctgttttttgtgatttttaataatttgaatatggaaaatgtattattctctcatttgtatagattgtatttaataagttaatgtaatccttgagctcacgattaataaaattctataaccttaattattttctcgatacaaagggttattaactttaatataagtataatgatgtgcctcatcttcaagacgcattgttgtaacacacttataatctataaatggcgcgaacatggtatctttaatttcatttatgcgattctcatttacttgattagatttgtgtgtcgaaagtacaagttgatcaaaaatgttatctagtacatcacgaacgatataccacatatgtctttctaagtttgaatcatttgatgctttagagattgtaagaattaattcgcctaaatggttttgaacggtagaataaaaggctttgttaaacacagacgtttttgaatcagtaagaattcttgatttttcatggaaatgagatgtactgtataccatttcatttagttgtgctttatcaattcttaaaccttcaaagtctctaatatacatcgtgtccaatagaccatctttccgaaatgttgcaatagcattttgcaagtgagcctctaatgcaatgccatatttagtaactagtgggattacgagaccaagcaatgctttactataagtttcaacccacgatttcgccgatgattcaaaatcagacaatgatgcagctgattgataacgtttaatcaatgtcacgataggtgattcattgttaaatgggtaggttgcaactaagcttgaaggaatcaatggtgtgacttcttgtggaatcatttggtatatattttttctaaataatgtacctaattgntcnttcgttcagtttgatagtctgcttcgtcttgctcattataaaaatgaataccagcaacttcatcaataattgttgatgcataggacttaaatatgacatctttctccaaaatatcatttaaaatacgtgtcattagtggaccattgtgcgtcgtttgttctgataatgtacgaatctcacctgtaatatgaacgtttgtcgacaatttgatgtgtggcgacatagctgggtatttaggaactaatgttctgaaagataaaccagcataataatccaacgtatgttttgcttcaatgattaattctttatctacttctgcttgataatcagaatgtaatacgtcatctaattgccatggatgaacaatcataatgtgataatcattaaagttaaactttggcgtaaattcattttctaattgtttaattaagtccggaaatagttgatgaacagttgtatcataatctttagacagtgacatagtacggcttaatttactgtgaatcagtactattttcaacttaataggttgattgaattctgaagaatataggaatgtttgtaatgcatttaaacctttacgtaatttagccccaggatgtagcggatgaccttcaataacggcttgctctgaacgcaagtaactatcttcgctattttcgataatattaaataaaggtgcagaatcatgttgcattgacagtgcttgatagctaattgcaaatgtcatattagttgcactgtttattaaatcttgctgaaattgatcactagcagcattttttaaatctggtgcttcaattaaaatacactcaagaatttcatttggatggtgtactcgtgtaatcgtatttgtaatgtcatctttaatgtagaaagggccttcaacatcaattcgatcaaaggcgtgttctccagtgataggagcatataatgtttgcttagcttgtgggaactggatttctagtatatgagtcgttgagatatctaacataatcaaatcacgactcaatattttcttactttgagtgcgcgctttaactaagttttcgcgatgcattgatgtgaccaatctctgagtgactttatctcttccttgtaaaatcatctctttaaaaatattagcccaatcgctattatgttgttgtaaaaataaatatgtttcttgttcttctttgttaaattttaatgtctgttctttaaaaattaagttcaagttcataattcacctctatgaaatattttacaaaagcaagatagatttgtataatccatattaatgataatgaytcttattatcaacagaatgcgggtgtaagttttatgacaaaatatttttttagcagttcttttctactatttctaggtaattggattggacaaatagggctaaattggtttgtacttaccacttatcataacgcagtttatctggggattgtcaatttttgcagacttgtaccaatattattactaagtgtgtgggcaggggcaattgccgataaatatgataaagggcgattgctgagaattacaatttcatcatcatttttagtaactgcaattttatgtgtgctcacgtatagttcactgcaattccaattagcgtcattattatatatgcgacattaagagggattttaagtgcggttgaaacacctttaagacaagcaatcttaccagatttatcagataaaatatctactacacaagctgtmwcatttcattcattcatcattaatatttgtcgttcaatagggcctgccattgctggtgtcatattagcagtctatcatgcgccaacaacatttcttgcacaggcaatttgttattttatcgcagttttattatgcttaccattacattttaaagtaactaaaatacctgaagatgcatcaagatacatgccgttaaaagttattatagattacttcaaattacatatggaaggtcgacaaatatttataacatcattattgattatggcgacaggtttttcatatacgacacttttaccagttttgacaaacaaagtatttccggggaaatctgaaatatttggtatcgctatgacgatgtgtgccattggtggtattattgcaacgctagttttacctaaagtacttaaatatattggtatggtaaatatgtattatttaagttcatttttatttggcattgctttgttaggtgtggtatttcacaatattgtcatcatgttcatttgtattacattgattgggttatttagtcaatgggcacgtacgacaaatcgcgtttattttcaaaataatgttaaagattatgaacgtggtaaagtactgagtattattatgatgggatagaggtatgattccatkgggaagtcnattaatgagtatatgtgcagatgtgtttggcattgttagaactttttcaataatgggaataagtactatatgcattacaatggtattctattttataaatagaaagttgaagttaaagttggaggaaagtaatcatggtatatcttgaatgggcaaaggcagatagaaatattcaatatcgtgtaattaacgccattattaaagaacgtatttaccccgagcaaacatttatttcgcaaaaaggatctttaattgaaattcagtatcatatgcatgtgttgactattgaagttgttagaaaaagtgcattagaacgctatgagtttacaggtgatattacttatttaaataaaggtgaaacgtcattaattataactttagaaggtttattagatgtgttgaatcatgactttgatatccctatttcagagcgactacgcgaagagttaatacacagtcgagatagtttagttgaaacatataagcaaatgtctcacagacaaacgttaataagtcmaagttttaaattttcaaggttaccacaagatattaactttttttcakggttacaacatgtaaaagatagtgataagacagatgatttaacttattctgagagtttggtaccagaggggcatccaacacaccctttaaccaaaacgaaattgcccttaactatggaagaagtacgagcatatgcacctgagtttgaaaaagaaatccctttgcaaattatgatgattgaaaaagaccatgttgtgtgcacagctatggatggtaatgatcaatttattattgatgaaataattcccgaatactacaatcagattcgtgtgtttttaaagagtttaggtttgaaaagtgaagactatagagcgattttagtacatccttggcaatatgatcatacgatagggaaatattttgaagcatggnttgctaaaaaaatattaattccaacgccgtttacaatacttccaaaagcaacttatcatttaggacgatgtctttaattgataaaccataccatgttaagttgcccgtcgatgcacaagcaacaagtgccgttagaacagtctcaactgtgactactgtagatggaccaaagttaagttatgctttacaaaacatgttgaatcaatatccaggatttaaagttgctatggaaccgttcggtgaatatgcaaatgttgataaagatagggcacgtcagcttgcttgtattataagacaaaagcctgaaattgatggaaaaggtgcaacagtagttagtgcaagtctagttaataaaaatccaatagatcaaaaagttatcgtggatagttacttagagtggttaaatcaaggaattactaaagaaagtattacgacatttattgaacgatacgctcaagcattaatcccgcctttaattgcttttattcaaaattatggaattgctttagaagcacacatgcaaaatacagtagtgaacttggggccacattttgacattcaatttttagtgagagatttaggtggttctagaattgatttagaaacattacaacatcgtgtatcagatattaaaattacaaatgatagtttaatagctgattctatagatgcagtgattgcaaaattccaacatgctgttattcaaaatcaaatggcagaattaatccatcattttaatcagtatgattgtgttgaagaaaccgaattatttaacatagtacagcaagtagtagcgcatgccattaacccaacactaccacatgcaaatgagttaaaagatattttgtttggaccaacaattactgtcaaagcgttgttaaatatgagaatggaaaataaagtaaagcaatatttaaatattgagttagataatccgataaaaaaagaggtgtagtactacatggcacacgttaacataaatatatcgaagattaaatataacgccaaagtacttcaaacagtttttcaaagtaaaaatatgcaattcacaccagtaattaagtgcatagctggtgaccgtacaattgtagaaagcttaaaagcgttaggtatcaatcatgttgcagaatccagattggataacataattagtattgcagatacaggatttaaca

SEQ ID NO: 409 - DNA, 1261 bp; double-stranded, linear
aggtcgtctrgcagmagmgmtatttgacgatcttgctttcccaaaacacgatgatgattttaacatactgtctgattatattgagacacatggtgatttcacattgccaatgtctgtatttgatgatttatatgaagaatatacggaatggctaaaattttaatataatttttaataataatagttagaaccagggtgatgcaattcgttatcctggttttaatttaaaataaactaagttgtgactaaaaattaatcaattatagtgaaatatggtgcgctatcttgcataaattgatatgattaactacacagaatttaaaagtacataatacataataaggaagtgatacaatggatgataagcaacacacatcttcatccgatgatgaacgcgctgaaattgcaacaagcaatcaagaccaagaaactaattcatcgaaacgcgttcacttaaaacgttggcaattcatatcaatattaattggtacaatcctaataacagctgtcatcacagttgttgcatatatttttataaatcaaaaaataagtggtttaaacaaaactgatcaagcaaacttaaataaaattgaaaatgtgtataaaatcttaaatagtgattattacaaaaaacaggactctgacaagttaagtaaagctgcaattgatggcatggtcaaagaattaaaagatccttattctgaatatttaacaaaagaacaaacgaaatcctttaatgaaggtgtttcaggtgattttgtaggtattggtgcagaaatgcaaaagaaaaatgatcaaattatggttactagtcctatgaagggatctccagcagaacgtgctggcattcgtcctaaagatgtcattactaaagtaaatggaaaatcaattaaaggtaaagcattagatgaagttgtcaaagatgttcgtggtaaagaaaacactgaagtcactttaactgttcaacgaggtagtgaagaaaaagacgttaagattaaacgtgaaaaaattcatgttaaaagtgttgagtataagaaaaaaggtaaagttggagttattactattaataaattccagaatgatacatcaggtgaattgaaagatgcagttctaaaagctcacaaagatggtttgaaaaagattgttttagatttaagaaataatccaggtggactactagatgaagctgttaaaatggcaaatatttttatcgataaaggaaaaactgttgttaaactaganaaaggtaaagatactgaag

SEQ ID NO: 410 - DNA, 2488 bp; double-stranded, linear
aaatatattgaanaganaattactaagattaaatcntcttaaaatatccctgaaataacgtcctaaagattaaaggaaagaggttataagttatgccaaaattaattttatgtcgtcatggacaaagcgagtggaatgctaaaaacttatttactggatgggaagatgttaatttatctgaacaaggtattaatgaagcgactagagcaggtgaaaaagtaagagaaaataacattgccatcgatgtagcttttacatcgttattaacacgtgctttagatacaacgcattatattttaactgaatctaaacaacaatggattcctgtatataaaagctggcgtttaaatgaacgccactatggtggattgcaaggcttaaataaagatgatgctagaaaagaatttggagaagaacaagtacatatttggcgtcgttcttatgatgtgaaaccacctgctgaaaccgaagaacaacgtgaagcttacttagctgatcgtcgatataatcatttagataaacgtatgatgccttattctgaaagtctgaaagatactttagttcgagtgataccattttggacagatcatatttcacaatatttgctagatggtcaaacggtattagtttctgcacacggaaattcaattcgcgcattgattaaatatcttgaagatgtgtcagatgaagatatcattaattatgaaattaaaacaggtgcaccgcttgtttatgaattaacggatgatttagaagttatagataaatactacttataaaaaaagagctgcatgtacacaaggagtgagtgtatatgcagctcttaaatatgtgaagtaatgtaaggaaatagttaagtatagagtttatattaacgagctagggatactcgaaaatatagttagacatacaatatagtcaaattaaaacaattatttcgctcttttatgttgcttaataatctttaaagcacgctttcttgttttaatgttagggctatttaaattacgacgagcagtctgtaaatctaatttcatctctatccctccttgtaaatatattatgaccgataactactcatatgtaaatagtaatgattacgttttaaagaaattgtaataaagtcgtgctaattttttggaaaatgggtataattaccggatatctaaaaatgtgtgtcgttttttagatggtgagggggaagctttaaatgtcgaagaaacaaaaattaacgatgattattactatgctgatgggtggattttttggattattaaatgaaacactattagtgacggctttaccaagtattatgaaagattttgaaatttcatatacacaagttcaatggctgacaacagcttttttattgactaatgggattgttattcctttgtccgcgcttgttatacaacgttatacaacaagacaagtgtttttagtgggtatttctatctttttcttaggtacattactcggcggcttgagtccgcactttgcaacattattagttgctagaattattcaggcgttaggcgcaggtattatgatgccattgatgatgacaacgattttggatgttttccaaccacatgaacgcggtaaatatatggggatatttggtttggtaattggtttagcaccagctattggacctactctttcaggttaccttgttgaatattttaactggagatcgcttttccatgttgtcgctccaattgcagctgtgacatttttaattggatttaaaacgataaaaaatgttggaactacaattaaagtacctattgattttatttctgtcattttttctgtactaggtttcggcgggttattgtatggaacgagttcaatttcagaaaaaggttttgataatcctacgtattagtatctatgattggaggcgttgttttagtcgcattatttgtawtacgtcaatatcggctatcaacaccattattaaattttgctgtatttaaaaataaacaatttacagttggtatcattattatgggtgtcacaatggtatcgatgattggttcggaaacgattttacctatctttgtgcaaaatttattgcatcgttcagctttagattctggattaactttattaccaggagcaattgttatggcatttatgtcgatgacttcgggtgctttatatgaaaagtttggtcctagaaatcttgctttagtaggtatggcgattgttgttattactacggcttattttgttgtaatggatgaacaaacatcaacaatcatgttggcaacagtttatgcgattcgaatggttggtatcgcgttaggattaattccagtaatgacccatacgatgaatcaattaaagccagaaatgaatgcacatggttcatctatgacaaacacagtacaacaaattgctggttctatcggaacagctgcattaattactattttatcccatgcaagcaaaaacttttctccaactatgtcagactata

SEQ ID NO: 411 - DNA, 1105 bp; double-stranded, linear
ttttacaatttcagatatctctaaaacacataccgatccaatggccaaaattattcgtcaaaaattgaaaaaactaggaattcgtaaagggattccagttgtattttcagatgaaagtccaattgtcataagagaagatgtaaaagatatagttggagataaaaatgctatcaatcgaaaaggacaaatgccaccttcttcaaatgcctttgtgccaagtgttgttggattaatttgtgcaagttatgtggtgaatgacgtattaaaagatattccagttcgtcgcattaaagacaaagggcaataattcattttgaaagggataattttcaacgtaaggcaagtgtaaccacaccataaaactaaaactgactagttcgcaagcatagtagaatatgcctcgtgtactagtcagttttgatttgattatagctaaaatatcaaaggtaatcgatttaatcttatttttacggcctttgtttaagtaagttgttatatatttctttgagttgttgttcacttttagatgtcgtttttggttcgtaataaattttgttttttagtttatcaggtaaatattgctgtgaaacatagccattaacatattggtgtggatatttgtaaccaatagatcggcctagatctttagcaccttgataatgtccatcttttaaatggtttggaatttggcccacatgaccgtttctaatatcggacaatgcactatcaatggcactcattgctgaatttgacttaggtgataagcatagttcgattactgcttggcttagtggaattctagcttctggtaaacctagacgttctgctgattcaatagcagcaagtgttctctgaccagcattaggtgaggctaagcctatatcctcatagctaattacaagtaatcgtcgaactattgtaggtaaatctccagcttcaattaatcgtgctaaataatgtaaagcggcattgacgtcgctaccacggatagatttttggaaagcgctcataacatcgtaatgcatgtcaccatccttgtcacttacaaatgcacctttttgtaaacagtctttagcatcttgcaatgtaacatgtcgataaccgt

SEQ ID NO: 412 - DNA, 579 bp; double-stranded, linear
taacgtcgaacttgagctgttacgttatgactcataattattttagcatagtcatttaaataaacttctgttctgtctgttggataagcaaattcaagcaattgactgtaactatcattaatgacttcttgatcaacatgactatcaaaatatacagcataataataagtaccatcaaccatatataacaaatcttcaaactctgtagttattggattgctatgatatgcataattaataacatcttctaaatcgttaaatttcacaatgattgttcttgtatttttacgtgctgaagacttttgacgtttagaaccttgagcttctttttcttttgttcgttgctcgaataattcttctaattgatcttcaccttctaatgtttgagctaacaattcttgaacttgttcatcaaatkgatcagttgcatcatcatcagacatattcatcatatcttcatttttagatttagaaattgtgacttcgacacctttttcaaaggcatgtacttgaatccataatggacctnctacaacaaaatcttctacttcgttaatttcatccatcattgancaaaag

SEQ ID NO: 413 - DNA, 1342 bp; double-stranded, linear
gtggtgaaacttcttgctttgtaattttataaagtggatcaatatcactctgacttacatcaggttgaactgtcatctttttagttactttgttttcaagcgtaatatttgctaattctaggttttacagaataatgaatgtcatcagctamccctttmmcttgatactyctcttgatattttccagctttagcatttgataaatcaatcactactcttaaatcttctggattttcaatttttattatctttgattgtggtcctgaaatagtcacattaactgtttcaggcgcttttgttaaatgcaaatctttagtgttataaagaatttcaacgggtacatcttgaatcgttttactagacttttgaccaagattaccagtgttaaagatatttccaaaaacattgttaacagataaaaagaaaaacaatgccaaaagaaaggcaataaatctcaagccccatttactttctagcatattatttcacacctttcttttgaaagcgtgtgccaaaccaatgttcagcaagcaactcttcaaaaatttcgtttgaaatgtctcgtcgtaattttccatcaaatgttaccgaaatatcaccagtttcttcagatacaataacggtaaatgcatcagatacttctgaaataccaaccgcagctctatgtcttgtacccaaacttttagatatcttaggactatcagacaatggcaaataacttgctgctgctgcaatcttcgtgccttgaataatcattgcaccatcatgtaaaggtgtgttaggtataaagacattaattaaaagttcttgcgaaatatttgaatccattgcaatacctgtttcaatataatcttgaagacctgtttctttttcaaagacaattaatgcacctatacgtcttttagccatatattgcacagcctttgaaaccgattgaatcaatttctcttcatctttactatacgtattagaagtatagcgttttaaaaagctacctctaccaagttgttctaacgcacgtctaatttctggttggaatattactattaaagctaataccccccattgaataacgatatcgaataatttagatgttgcagtcaagttcaatatcatacttatctgctgaccaataacaattactaatatccctttaagtaattgtatcgctttagttcccttaaagaccgtgatgagaagataaagtacataccaaactatcagtaaatcaaggatactcgttacaatttttaacgtactgaggttttgaaaaaagttggaaaaatccataacatctcctccgggtaatatttttccataatacccattataccaatcattt

SEQ ID NO: 414 - DNA, 1073 bp; double-stranded, linear
ctgtataaagatggaggtgttttgcatggtaaaacgtacttatcaaccaaataaacgtaaacatagtaaagttcatggtttcagaaaacgcatgagcacaaaaaatggccgtaaagttttagcgcgccgtcgtcgtaaaggccgtaaagttttatctgcataagatcactgactcatcagtgatctkttttttcgtttaaattaagaataaatagaaatttatgttataagctcaatagaagtttaaatatagcttcanataaaaacgatanataagcgagtgatgttattggaaaaagcttaccgaattaaaaagaatgcagattttcagagaatatataaaaaaggtcattctgtagccaacagacaatttgttgtatacacttgtaataataaagaaatagaccattttcgcttaggtattagtgtttctaaaaaactaggtaatgcagtgttaagaaacaagattaanagagcaatacgtgaaaatttcaaagtacataagtcgcatatattggccaaagatattattgtaatagcaagacagccagctaaagatatgacgactttacaaatacagaatagtcttgagcacgtacttaaaattgccaaagtttttaataaanagattaagtaaggntagggtaggggaaggaaaacattaaccactcaacacatcccgaagtcttacctcagacaaacgtaagactgaccttagggttataataacttactttaaaatgtattcacatcgttgaaggaggcgagtagcaatatggatttagatacaattacgagtatttcaacaccaatgggtgaaggggcaattggaattgttcgattgtctggaccgcaagccgttgaaattgctgacaaattatataaaggaaaacatcttttaaatgatgttccatcacatacgattaattacggtcatattattgatccagtctaaagaagtggttgaagaagttatggtgtctgtgttaagagcgccaaraacatttacacgcgargatattatagagattaattgtcatggtggtattktaacgattaatagagtgctggga

SEQ ID NO: 415 - DNA, 3176 bp; double-stranded, linear
ctttaccaatgccaaatccgaagtaaagtatagcaataaagattactaatacaattctgtaaatggcaaatggaattagtttgattttgttaattagatgcaagaatgttttgattgcaattagtccaacagtaaatgcagctaaaaagcctaaaatataaaaaggtatatcagcaatctgaatatcttgataatgttttaataaagataaaccactagctgctaacataattggaacagccataataaatgtaaagtccgatgctgctttatgatttaatttcattaataccccagttgaaattgttgagcctgaacggctgaaaccaggccacatagctactgcttgagaaataccaattacaaatgcttggaaataactgatttgatctactgtttgtgggtttttaactttagctgagtatttatcagcaataatcatatagatagcacctacgaataagccaatcataacagttggcacactaaataaatgttcttcgatgaaatcatcaaatagtaagcctaaaatacctgctggcaccatacccactaatacatgtaataaatttaaacgtcttggctttgaacgtctttgttgatcgttatctccttcaacatgtttgtgtttaccaatatgtaaaatctctaagaagcgttcgcggaacacccatgctgctgcaaagacggatcctaattggatgacgattttaaatgtaaatgctgactgagaacctaaaaattcagatgattttaaccacatatcatcaactaggatcatatgtccagtagaggaaacaggtgcaaattctgttaatccttcgacgacccctaagataataccttttattaattcaatgataaacataatgtacccactttcattactcaatttaatttatttaaatatcaaaattaccatatcatgatagcatattcatttaaagacatgctagttatagttataatactagactaaagatgtatatattcattttcttttacatgtaaaactacaatattttattgagctatttaatttgattttaaggaaaaccttttataataggtttaggtgatataattgtgaaaaaattaacaacaatactgtttcaatataaaatttttccggtactcatgttcttggtcagtactggtctcggcataatcgttataacgcaaaatattttaatagcagattttttagctaaaattataagacatcaatttcaaggtttatggattgtattatttattttattaggtgttttacttttaagagcaactgtgcaatttctaaatcaatggttaggtgatacattagcatttaaagttaagcatatgcttagacagcgggttatttataaaaataatggtcatccaatcggtgaacaaatgactatactcacagaaaacattgatggtctagcacctttttataagagttatttgcctcaagtgttcaaatcaatgatggttccgctcatcataatcattgcaatgtttttcatccatttcaataccgcattaattatgttaataactgcaccatttattcctttgttttatattattttcggtttgaaaacgcgagatgagtcaaaagatcaaatgacttatttgaatcaatttagtcaacggtttttaaatattgctaaaggtttagtgacgttaaagctatttaatcgtacagagcaaacagagaagcatatttacgacgatagtactcagtttagaactttaacaatgcgcattttacgcagtgcttttttatcgggattaatgctcgaatttataagtatgttaggtattggattggttgcattggaagcaacgctaagcttagtagtatttcataatattgattttaaaactgcggcaattgcgattattttagcgcctgaattttataatgcaattaaggacttagggcaagcgttccatactggaaaacaaagtgaaggtgccagtgacgttgtgtttgagtttttagaacaaccgaactataataatgaatttctattaaagtatgaggaaaaccaaaagccatttattcagttaacagacatatcatttcgatatgatgattctgatagattggtattaaatgatttaaatttggaaatatttaaaggtgatcaaattgcacttgtaggtccaagcggggcaggtaaatccactttgacacatcttattgcaggtgtttatcagccaacaataggtactataagtacaaaccagcgtgatttaaatataggaatacttagtcaacagccatatattttcagtgcttctataaaagagaatattacgatgtttaaagatatagaaaataatactattgaagaagtgctagacgaagtaggtttattagacaaagtgcaatctttcacaaaaggcattaacacaataataggtgaaggaggcgaaatgttatctggtggacagatgagacgcatagaactttgccgtcttttagttatgaagccagatctcgttatatttgatgagcctgcaactggtttagatattcaaacagaacacatgattcagaacgttctgtttcaacattttaaagatacaacgatgattgtcattgcacatagagataatacaattcgccatttacaacgacgcttgtatatagaaaatggaagactgattgctgatgatcgcaatatttcagtaaatataacagaaaatggtgatgacttatgaaaacacgactaaaatttcaagtagataaggatttattgttagctatagttgttggtgtttgtggaagtttagttgcgctcgccatgtttttcttaagtggttatatggtgacacaaagtgcacttggtgcgccactatacgctctgatgattttagtcgttacagtaaaattgtttgggtttttaagagctattactcgatacgtagagcgccttatttctcataaagctacatttacaatgctacgtgatattcgggtacagtttttcggtaaattagtaaatgtcattcctaatgtttaccgtaaactgagttctagtgatttaatttcacgtatgattagtcgtgttgaggcattacaaaatatakatttacgtgtttattatccaccagtcgtcatcggtttgacagcgctagttacagtcatagttttggcgttcatttcaatcggccatgcg

SEQ ID NO: 416 - DNA, 2109 bp; double-stranded, linear
tctttatttcaatttccaattgaatttttttattatttacgcatagctcttaaaattaacgttacgattgcaattaagataattgaaccaattaatgctggcaagatgtaaatacttcctaattcaggaccccattgtccgaatagtttgccacctacccatgatccaataatacctgcgataatattgcctaaaataccacctgggatatctttacccataatagcaccagcagcccatccaattaagccaccgacaattaacattccaataaatccaaacataattttcagtctcctttttctatttattttgcgttattctaagtagtaccccttatttacaattctaaaacaaattcaaattatttttatccaaatatttttaaaagtagtaattgaatatcaattttattcaatgtagctatcgttatttaaagtctctgtaccgataatatcatatacatttacattattttttctgccgaattcatagcttgattattttatgttataggactagaatatacacatattattagagcatctttgaattttaaatcaagaagcgaggttaatgaacaatgaatatgcatattttatataacttacgaactaaacataatttagaaattgacgaattagcacagcaattaaatgagaaatatggtactaaatatgaagcacatcaaatttgggaatgggagaatcatcaccatgaacctaaatttaaagatgccatgcatttagctgacttctttgatgcaccatatgaaatgtttttagaaagtaaggttaaagaatatcagaaacatttagaagaagtcgatattcgcatggataaatagatgcaaataaaccctcacaacacgtttggcatatatcctttcaaatctatactggatatattacattacgttgtgagggtattttattaattaatatgaattaagacattttacaagcgttaatgcaacgaatctttttagtgatcttgctcactctttaatactttaccgttcttagcatcaacagtaacttcttgttttttattaccttttttcaaatcgatattgtaaacaagtttgccatcatctttttcaagtgaccattctttaatatcaccatcaaattctttttgtccttctttaatggcttttttgtaatctatagcatcgctatatttaaagttatcattttcattcattgtatcttctttttcagtctttttgttaatcacttttttatttttatcagcaacaagtacttctgactcttcaccagatttttgttgcgtcactttataagcccattcaccattagaattttcaaatgaaattcctttcaacttttggcctttgtaagtttcttcagcttttttcacagcatcttctgggcttgttttaacatcttttaaagcaataacatcttttgttgtattagtgtcttgattagtatttgactctgttgattttgtttcatcttttggagtatcattgccacatgcagtaagcaccaccgctgacattgataacactgctaatgattttaatttcataatatcactctctcttcctatttttgaaactcataacaaaagcttatatgctatatagattgtattaccccttgtttttaattttattcataattattacaaatatttttaaattaatcgtcatgcgttactttcgttcgtactccttttataaatgaaccatgtaatataagcatgctattatcgactcagtttgtctaatgctttctttggtacttcttccttttcaacttcttcaaaagtttctacatgatgacctttatgtgtaattttcaagtatctatgcggtttaacatcaaatgtagcagtatacattaattgcgtctctttcccttctttattaaaaacactttgactataacttcggagttgatcatccattctagtagacacctctgtcgttttaacataagaatcatccttctttactaatgggttaaattgatctgttataccatgggagtctattgtttttaaaatgaataaagcagcataagcgccaatgatagtaagtacaagatatgtkattgtttttaaaatcgtttcaaaaga

SEQ ID NO: 417 - DNA, 813 bp; double-stranded, linear
gttacataaatgaaaacaaaaaagataattttactgcttatgctacaccagaacataattatcaatttggtggtgctatgatagaaagtgaaaaattaagcgagttactaaagccagccaatcagttaaaatcaccagatgatataaaaaaagaactaaataaaaagaagagtcactaaagttaggagttactttaatgtccaaaaaacatgtttttataattattggtgtcatattgtgtatatgtacagtttctacggtcatgcattttaaaatgaaatatgatgaaaaagaaaaacaaaaagcgatttactacaaagaacaacaagaacgtattacactctatcttaagcataatactaaagaaacgaacacgattaaatctgtacatttcacaaacttggaaacaagtcctatgggaagtgctgtgattgaaggatacatcaatgaaaataaagaagatgattttactgcttatgcatcgcctgaacataattatcaatttggtggcgctatgataaaaagtgaaggagtagataaattattaaaaccagcacatgaaagaaaatcaccagaaaaaatcaaagaagaattagataaaaaagaaggccactagggtcttctttatttttgatttaatcttccaataatctatgtcattgctatcgaaggtgtttcgcaattaatataaatcacttcatcatcaccaatacttccccagttttgtacagtacattaacacaaacgaaccacgttaatttaaatggawtaatagtttggccattataagaacaatatatatcgantaacaat

SEQ ID NO: 418 - DNA, 640 bp; double-stranded, linear
aaaagcaatcgttggtggtgctaaattcatcggcaactcatatgtaaaagctggtcaaaatacactttacaaaatgagatggaatcctgcacatccaggaacacaccaatatgctacagatgtagattgggctaacatcaatgctaaaatcatcaaaggctactatgataaaattggcgaagtcggcaaatacttcgacatcccacaatataaataagcaacatgaacataggatcaaaagtcatcccccactatcaatcatgggggatgacctttgatcccttttttatacatacacaagcaaaaatagcggtgattgtttaccatcaattttaacaatcaccgctacttttgcttgtaattcatgattcaatttttgttgtgtgcacaacgacactaaattatgtgtttgctattgtcgtgttacaacgatatgcgtcgttgatttaacttatcaagtaattgatttaaattgtctaattcgacttccgataaacattgacatcttgcttcaatcaattcgcaacgtgcattatttatttgtgaaattaatgtacgtgcttgatcagtcaaaattaattctttacatcttaaatcttcgctagattgttgacttgtgatgtacccnntcaaaactaat

SEQ ID NO: 419 - DNA, 1159 bp; double-stranded, linear
ntagttttaaatatagtagtcttcaaatatatcattagcgtttaatactaccttagcaccttcttggatacgtaataaattaccttttgtcataggattaaacatagatccaggtaaaacataaacatttctattttgctctaatgcaaaatctatcgtgatgtgactgccactttgttccttagcctcagtaattaaaaccccttttgacaaaccgctgataattctattgcgctcaggaaatctatatttagcgattggtgtatgtggtggatattcagatataactaaacctttttcttctattttatttcttaatgctaatgtacttttgggataatgtgtttgatggccaaaggctaaaactgcaattgtagggagattgtattttaaagctatttgatgtgccattgcatcagctccttgagcaaggccggaaacaattgttaaatatttgcttttatcatttgataataaaaattctaaagactgttgggtataacttgtagaatctcttgcacctactactgccaaatgatgcatattatttattaatttgatgttccctttatagaaaagaagtaatggaaattgatatatttcttttaatagcactgggtattcagaatccatatatgtaatgtaacttacttttaatttctgcagttctttaataatatcgttatgatcaagttttataaaagcatagtatttacgtaataaatgaacattttcttccctattcacccattcacataaataactatctttttttcttccctcctctttaattacattaggatatgccattaaaaattgatgaatttgtttagtcgaaaagtgtgcccagtataacttaagcaaaaatagtttaatcaataaatcaactcctttttgtaatcatacaaaatcatattctatttttgttttacatttctaatacaaaaacattgtcgatgtaatgttattttaaggagtaaaaatactgacttaaaaagtgaaaagtatgttggaaagaatttaaaatttcaatttccaacatactttataattaaaccttataaataagttttgcaaatttatatagaattggtcttactggtttgatgaaatcaccaattaattcttcaacatgtgcattaaaaccctttttaaattg

SEQ ID NO: 420 - DNA, 1879 bp; double-stranded, linear
tcaatcagcgactacaagaagtgcgggtcttcaaacaattgatgtgacaacactaagtgaccccactaatattatcatgggtattttaatgtttataggatcttcgccaagttcggttggtggcggtattcgtacaacaactttcgctattttaattttgtttttaattaactttagtaataatgccgataaaacatccattaaagtttacaatagagaagtacacattatggatattcaacgttcatttgcagtatttacaatggcgacaattttaacatttttaggaatgctaattatatcagctactgaaaatggtaagcttacatttttacaagtattttttgaagtcatgtctgcatttggaacttgtggactatcgcttggtgtcacaagtgatattagtgatatttctaaggtcgtactaatgatactcatgtttataggacgtgttggcttaatatcatttatcattatgatagcaggacgtcgagaaccagataaattccattatccaaaagaacgtattcaaataggataatataatagcaatctaagtttagttaatgtagattttaactggaacttagattgcttttttagtttgtatttttaacttattttataagacgattggtttcgaaaatggtaaactagtaacaatgagaggtgtaacatgatggaaaaaaatgaaaacattaatgtagagattttaactacgtcagatatgcatagtcatttcttaaatggtgattatggttcaaatatttatagagctggtacttatgttaaccaagtaagagcacaaaatcatcgcgtcattttattagatagtggcggaagtttagctggctcgttagcggcctattattatgctattgttgcaccttataaacgacatccaatgataaagttaatgaacagaatgcattatgatgctagcggtgtgagtccaagtgaattcaagtttggtttatcatttttaactcgttcaattgctttggcacgttttccatggttatcagcaaatattgaatacaatgttactaaggagccttatttttcaactccatattgtattaaacattttggtgacttaaaaattgctatcgtaggcgtcacagcagatggtttaatggaaaatgagtattctgaaatggagcaagatgtatctattgaaaagacattagtggcatcaaaacgttggattagatatatccatgaagttgaagagccagattttttgattgtaatttatcatggtggattgaataaaattagtaatagtacgaaaaataaaaaggcaagttcgaatgaagctgaaaaattaatggaagaactcggtgttatagatttaatgattacagctcatcagcatcaaacaatagtaggtcaagatcatgaaacgtattatgttcaggctggtcaagatgccaaagagcttgtacatctttcgattaattttaaaaagagaacaacaacttatgatgttgaaagcattgattctaaagtgattgacttaaatgagtatgaagaggatcaagaattattagatttaacattctatgatagaaaagcagtggcttattggtcacaggaaatcataagtgataaaggtttgatgttatcagtaaatgggttacaagatttagtctgtcaaacacatccattttcgcaattattacatgatgcaattcaccttgcatttgataatgatataacatgtgtccacgtgcctatgaacggagagaaggggttgagtggacagattcgaaatgaagrtttgtatcatgcatacccatatccagataagccatgggtatgacaattagtggtcaaaatatcaaggtatnttggggtatagttattcaccattagg

SEQ ID NO: 421 - DNA, 2710 bp; double-stranded, linear
aattccccctttttccccatccattttnccatccactggtccttacgggaccatattatttnaaattgganaaaattattttaaagattatwactactctttaatcattttrgtgaattaaaaaaagtagtgcaaaaagcaaaatatactttatacactacaaatcatttatttataataaagtttcaccaaaaaatgttccaactaatgaaaccgcttgttcagcagtatgattattactgtcaatcaatggatttacttcaactaaatccattgaggaaattaaatgtgattgatgcagtaattccaatgcaaaatggctttctctataactaagaccacccaaaactctagtaccagtgcctggcgtttcaagcggatctaaagcatcaacatctaaagataaatgaacgccatcaacattgcgtgacttcaaatattctattgtattttcaattacttcctttatccccaatttatcaatatctgacatagtaaatgttttaatattatgatctttgataaattgtctttcacctttatctaaatctctcataccaattagtacgatgntttctggcttgattacattacnatttaattctaaaagttctttgggaccttcgcctgtcaaaatccttagaggcataccatgaatatttccacttggtgactcttcaggtatatttaaatcaccatgtgcatcataccaaataacacctaaattattataatgtttacttattgctgatactgaacctaccgcaatagaatgatctccaccaagaactagaggaaatctgttattttcaattgatgctgaaacctctttatttaatttttgattaacatctataatttcatcataatttcttaatcctttttgttcactatgaaatttttcaatgttcacagcaggtaccttaatatcccccttgtcatatacatcaaggtctaattgctttaatcttgaaattaatccagcatatctaattgctgttggtcctaaatcaacacctaattttctttgtccaaatgttgatggtgcacctataatatcaattgcttttgtctttgtcataagcgtccccctttgctctatgtaattaaagaataatgtatgcgcttaccattatcaagcaatagctacacatataatctgtttatcttattacttcataaaaaaaggttcttcatcttttatggtgggaaggtaaaacttcctgctttttttaatacacaaaaagcgcaattgcctctataatttaaagtgaccaaacccaaactaaaggagacaagtgcgcctatgtgtaatgataccttagaattactaagaataaaagatgaaaatataaaatatataaaccaagaaattgacgtcattatcaaaggaaaaaaagcaacagtggttaatgctgtactaacgtataagccttcggcctgttattgttgtggagttaaaaatgaaggacaaattcataaacatggtaagcgtgtttctcgtattactttacttaaaactcaagggtataacacatacctcaacttagctaaacaacgttttaaatgcttagaatgcaatggcacttttactgctaaaacgtcaattgttgatgagtcgtgttttatctcaagatgtgttactcaaaaagttatagaagaagctactaaagttaaaacagagattgatactgcagaagataactgtatctctccatctactgtaagtcgtattagaactaaagcggctaattcattacgaattaaaccctttaattgtttgccagaacacatcgctatggatgaatttaaaagcgttaaaaatgtaactggatcaatgagtttcatttttatagataatgatactcatgatgttatagatattttagaaaatagaactacaagattcttgcgtgcctatttcgagcgattcgatttaaaaaatcgacaacaagttaagacggttactattgacatgtatgaaccctatgtccgattatttcgcgacctatttcctaatgcagctattatttttgacagattccatatcgttcaacatttaaatagagaacttaataagtatcgtgtacaagttatgaatgaataccgtaataaaaaaggacctgattatacaatttttaagaataactggaaagtcctattgatggatactagtaaaaccatatttagtaaatacagatggaataaatcttttaaggcttataaacgctcatctgacattgtagaattcatgctttcaaaagacgatatactacgacactcctacgaacttgtccaaggattacgaaaagacctaaggttatgtaattggcctaaatttattaatcgtttaaattcagttagtaaaaagtctgtgagtaagggtgtatggaaagtggttaaatattatagaaaacatcaaaggatgttaagaaatacaatttattacccagcatttaataatggtgctatagaaggaattaataataagataaaattaatcaagtgaatttcttttggttacagaaatttcaacaactttaaagcacgtataatgatgattttcagcttgtacaaaggagaaaaaaagaagacaaccaagcccaataatggactggccgcctaatawangggskctaaaagttgtatttttaaaaatagttcctttaaattatatacccnccacatttgggggaggacctaaaaaagc

SEQ ID NO: 422 - DNA, 1027 bp; double-stranded, linear
cattttaattgttaaaattccaaaaaatgtargtggattwaaagraaaccctgtgtttttaaaaggtaccattaaaatagttccgattgtaccatcccacgtgaaatttttagtattgccggtgagagaaaatgccaatgcaatcatcgcagttcataatcatccatccggtgatgtaacgccctcacaagaagatatcataacaacaatgaggttgaaggagtgtggtttgattttagggatagatttattggatcatattataatcggtgataatagatttaccagtcttgtagaagcgggttactttgatgaaaatgattgaagttgatagaattaatgacgtatcttgtgtataatacctacgaagtactttcattggaggaaaaatagtgactctatttattattatcggggttctcgtgccaatggtttataccatgcagttaaatattaaaaatgaacctgtaacaaagcgcaatcttttaataacattagctttatctacgttaggtattttagtaaccgcgttagcaggtgtaatcgttacgaaacaagcttttcctttattaagtgtagcaattggctcaatttttactggaatcgtttggggccttttactaagtggtagctacgcgctgatacgatttttatctaacgcatttgggcgtaagtaatagtaatctgttcatcaagtagtatccgtgcttgaaaacaaactaaaactcctaatgtggaactagttaaaaaattctaaactagtacattaggagttttgttatgcagaataaatttaattgttaaattgaaagtgcggtaaaaatccactatttatttgaaaaaaatcgagcaaccaaattaaaccttgatatcctaagtaaatacataataaaacaagtccgacataaattaaaaatcgcaaaatagaaagtccaactctaaaaaggaggatgactaatagtgctattaaaataattgttagtatactcaatgctacaaacctcctartacgcttttaaatccataa

SEQ ID NO: 423 - DNA, 569 bp; double-stranded, linear
cggcacatttttaatttatacatattttaaaactaagtaacagtttgaagaaatcgtagttcaataatgttaattgtgaaaatgtatataaacataaaaaaatcatgtataatatatgttgttaattaaacagttcgaaagcgagatgacattatgggacgtaaatggaataacattaaagaaaaaaaggcccaaaaagataaaaacacaagtagaatatatgcgaaatttggtaaggagatttatgttgcagcaaaatctggtgaacccaatccagaatctaaccaagctttaaggttggtgcttgaacgcgctaagacatattcagtgccgaatcatattattgaaaaagcaatagataaagctaagggtgctggagacgaaaactttgatcacctaagatatgaaggatttggcccaagcggatcaatgctaattgttgatgcgttaacaaataatgtaaatcgtactgcctctgatgtgcgagctgcttttggtaaaaacggcggtaatatgggtgtatctggatcagttgcttatatgttgtcatgtggccacatttggtattg

SEQ ID NO: 424 - DNA, 3264 bp; double-stranded, linear
tggacctataaaatggatgcatccaaatatggatgnggggtanggcgggaaaataggaggttatatagtaagtcatttaagtcgaatagccatcctttttaaaatgaaaaaaatagaaagctcaatagtttgttaaagcctttaaatagcgtcgttacgcaattttagaatgctaaaaattgtcacaaatttcaaattacgtgctaaagcttgagatatcaatatttattggcgatagagtgtaatttgactccgcttacatctcagttttatgtttgtaatttggtagcataatattataataaaataaaattgttaatctttaatttcagtatagatatttttacgtgtagtcacgtgtaaaataaattcaattaggttaggagacataattatgaaaacatttggtaaaaaggttgtattaatcggagatggatctgtaggatcaagctatgcctttgcaatggttacgcaaggtgttgctgatgaatttgtaattattgacattgcaaaagacaaagtaaaagcagatgttcaagatttaaaccatggtacagtccacagtccttcaccagttgatgtgaaagcaggtgaatacgaagactgtaaagatgcagatttagttgttattacagctggtgcacctcaaaagccaggtgaaacacgtttacaattagttgaaaaaaatactaagattatgaagagcatcgttaagagtgttatggatagtggctttgatggatatttcttaatcgcggcaaaccctgtagacattttaacaagatttgtaaaagaatatactggattaccagcagagcgtgttatcggttcaggtactgtattggacagtgcacgtttacaatatttaattagccaagaacttggtgttgcaccttcaagtgttgacgctagtattattggcgagcatggtgatactgaacttgcagtttggtcacaagcaaatgtagcaggtatttcagtatatgacacattaaaagaacaaactggtagcgaagctaaagcggaagaaatttatgtgaatacacgtgacgctgcttatgaaattatccaagctaaagggtcaacatactatggtattgcattagcattgatgcgcatttcaaaagccattttaaataatgaaaataatgtcttaaatgtttctatacaattagatggtcaatatggtggtcacaaaggcgtttacctaggtgtaccaacattagttaaccaacatggcgcagttaaaatttatgaaatgccattaagtgccgaagaacaagcgttgttcgataaatctgttaaaacattagaagatacatttgattcaattaaatatttattagaagactaagcctattttaagtattaattagaaatatattaatggtaagaggatctattagtgttgcagtaacacgtggcactgataggtccatttttttagcaagcattgatagaggcaatacttttgcgtaaaataataattgaataaagtattatgactcgtgaaaatttagtgacatgaataaaaatgttgaggcgtcattgagtataaaggaaagtagttctgcattaatcacgaagtagagcatgacmacgaggaataactatagggagatggttttggaatgacgatgtcttgtatcaacatggtacattaggtacgttaatggctggcttactagaaggcacagctacaattaatgaattgttagaacatgggaatttagggattgcaacgttaacagggtctgatggcgaataatatttttagacggaaaggcatatcatgctaacgagcataaagaatttatagaattaaaaggcgatgagaaagtaccgtatgcatcgattactaattttaaagcgagtaagacatttccattgcaacaattatcacaagatgatgtatttgcacaaattaaaaatgaaatgttaagtgagaatttattttcggctgttaaaatttatggcacatttaaacatatgcatgtacgaatgatgcctgctcagcaaccgccatatacacgtttgattgattcagcacgcagacaacctgaggaaaaaagacaagatattcgtggtgccattgttggattttttacaccagaattatttcatggcgtagggtctgctggttttcatatacattttgcggatgatgaaagagcttatggtggacatgttcttgactttgaagtggatgacgttgtcgttgagatacaaaactttgaaacattccaacaacatttcccggtaaataacgagacgtttgttaaagcgaaaatagactataaagatgtggcagaagaaattagagaagctgaatagtctaatataattaaaagaccttagcgatattaggaacaggtggttctaaatgcatcgttaaggtctttttatattatatatgtgcttacatattttgttgatacgcgcgtaaaaagctataaatagtatcaagatatggggtgtcaagaatgtgttcacgtgcacgtcgataaataaagccttgaatcgcttcgacttcaagaggttgctgatgcgcaatgtcgtaatacatgctcgttcccatttcgtcgggataaccttgatatatagtcataatagtatcgacagtttgttctgaaaagtttaacccctctgcctgtgcaacacgacaaccatctagtaatagctgtctacacagtgtacgtatttcaggattatgcatgattgcaacggtctgtctaccgagtgctgtgatagaattaatgcccaagttaactaacaatttataccaaatagcttgttgaatatttgcttctaatacaatgtcgatttgactgtcttggaccaaatctctaaattgtcgagttaatgcattatcttgtatacgtaattgataatctctgaagtgcgtaacaacatcgcctttcttttgaccacttatatagacaactgcttggcatacgtttttaaatgaaatatgttcgagttgaccataaccattttgggctaaaatgatgagcgtgtcctcatgtgcaagatgagttaaatgaggaataactgcatcaagttgatgtgttttgactgcaataataataacatcaaatgtgtttgtgacatcttcataacctttcacaacaatatcttgtgcaggtgcatgtggtacagtataatatgttattgttttggcgtgtctcccgataagcgttgtatgaggcaatgattgttgtaattcataggcaatagttgtaccgacagcgcctgggcnnttac

SEQ ID NO: 425 - DNA, 796 bp; double-stranded, linear
agaacgaacctttaatacgtacgtgtcgaccacgaactgtcatgacaaattgataaaacgaatagtttttcattagttcattgtcacatcaatcacttttgtktcacctttaatcacagcattttcatcataaatattaattgaagctgcttgatcagtgttagtaattataattggtgaaattacagatttagcgttattattaatatattcaaggttgaatcttactaatggatctccgacgttaacttcgtcaccactagacactaacacttcaaatccttcaccgtctaattgaactgtgtctaaaccgatatgaactaataattctaatccgttatctgcttttaacccaatcgcatgcttagttggaaagacattgtcaacacgtcctgcaattggagacacaacttctccttcagttggattaataccaaaaccttcgcccatcattttttgtgcgaatacaggatctggaatatcttcaattttcacgaattctccagttaatggtgcataaattgcgatatctttctgaacttctttgccttttccgaataattttttaaacatactttccactcctacttatcaaaatgtgatattaaatcgccataacccaattcttctaacttttcatatggaataaattgaattgcagcggaattgatacagtatcttaagccgccactttctttaggtccatcattaaagacatgtcctaaatgactatttgattcttctgaacgcacttcagttctcaacataccaaatgatttgtcgactaattctataa

SEQ ID NO: 426 - DNA, 3393 bp; double-stranded, linear
atccagcaaatctttcttatcacgttctgtaattttcttagtatccatcttgattagctttgataacttttcagccgtatccaacatttccgattgtgttgtttttcgacccctagtatatgtaatagccattttagaagcattatcaactaaaactttcccatttctgtctaaaatacgacctcttggcacagactcattcactgtaatgttttcatcattttttataatttgtttataatgtgagccttgtgcgatttgtaaataacctaaacgtagtactagtactgcaaaaataaatacaatcacaccaaatataaagttaattctcttgttaattgtattttgaacgatttcatcatttgatttttcttttagtctttttaacaaaactacctacctctattcaaagtctttcactttaaatcatatatgaatttagaaattatttctatctttttgacaaaaaaataacggtctcatttaagagaccgaacaagtaatcatactttattttgttgcattatataattcgtcaactttttcccagttaactacattccaaaatgcgccaatgtagtcagggcgtttgttttgatattttaggtaataagcgtgttcccatacgtctaaacctaaaataggtgttttaccctcagttaatggattatcttggtttggtgtagtcacaatttctaactggccattgtttacgactaaccaagcccaacctgaaccaaagcgtgcagctgctttgtcagcaaattcttttttaaattcttctaaagaaccccattgttctttaattttttctactacagtacctttttcttctgagtttggtgaaagtaactcccagaataatgaatggtttaaatgtccaccgccattattacgtacagcagtttggatgttagctggtacactgtctaaattagcaacaatttcttcaatagatttagattctaaatctgtaccttctactgcagcatttaatttcgtaacatacgtgttatgatgtctgtcatggtgaatttccatagtttctttgtcaaaatgtggttctaatgcatcaaatgcgtatggtaattttggtaattcaaaagccataaataatcatcctcctaaaatgtctgtaagtaaataataacaagcagtgactggttcaacaaagaatttgcttaaattctactacttattattttctctactcatttaatataactcaaatcaaaaataattaaacattttgtatataaaaagttaacagatttgccataaaatcatacgaacggagtatgaaatgaacctttatcttctataatttaaaaaatgagatttatgcatacatcggaccaaatgtgcataaatctcatttctttatattaatcttggcaagactcacatacaccataaacttcaagtttgtgtttgtgaatattaacaccaggtagtgataattttatctgatctattggacaataatctattacctttgtatctccacacttttcacagataaaatgatgatgatgatggtttgtacaagcgattctaaacttcatttcaccatcaagttctgtattttcaataattcctaaatctttaaataagtgcaggtttctatatattgtgtcgaatgaaattccaggataattttcatccataacttgttgtatatactttgcgtttatatacttatcttcttcgacaaaaatatctaacatatctttacgtttatctgtatattttaaaccgttctcttttaaaattttaatagcatcatttgtattcattgatattagctccctttttaaacttcattcgcattttctgataagccattgtaatcataagtaaaataacaagtagaactacaattacaccacccggagaaatgtccatatagaaagctaggactaagcctaatattactgataattcacctaaaaatacacttagtaatatcaattgcttaaaactttttgttattcgcatacttattgcaattggtaacgtgattaacgcacttactaacagtatccctacaacacgcattgaggcagaaataaccatcgctacaataacaataaataaaaattgaatccatttaggaatgccaatgactttactatattcctcatcaaatgacaatataaataattctttataaaacaatgtaataaacagaacaactatgatggcaatgacaataatcgttgttaaatcacttatattcactgcgcttattgagccaaatagcaatccaacaatttcttgattgaacccatcagctaatgaaatgaagattgcactcaaggcgataccagcactcattataattggaatagcaatttcttggtaagcagtgtatgacgttcttaatttttcaattagaagcgcacctactattgcgaataagattccaaaccacattggattaataaatactagtgttggcataatagtaagtaaaaacataccgaaagatataccacctaaagttacatgacttagagcatcagctwtaagtgatagtcgtctaacaacgataaaagcaccgattagaggcgcaataaaacctatcaagataccactaattaaagagtacctcataaaatcaaaattcaataatgcatctatcaattgtgacacgcctttccattttaaataaactcaaatctttattaattacaacattctcgattatgctgatgatcgacaaaacgtacaggatgtccataaatttttgaaatttcaacttcatcaagtgatttaaactcatcagttgtaccatggaaatgcaaatgcttatttaaacatgctacttcagtagcagtatctgctacaacaccgatatcatgagtaactaagataatggtgataccttcttgttttaattgatctaaagtattataaaattcacttacatgttttgcatcaataccattcgttggttcatcaagtactaatactgcaggttctgaaatcaatgctcgagcaatcattacacgttgttgttgaccacctgataattctgctatatttttatgaattaaatcacttatattcagtctttctagtactttaatcactttttcattatctttgctattaaatgtttggaaaagacgttttgtctttgttaatccgcttaaaacaacttctttaacacttgctgggaaacctgaattaaaggcatttgctttttgtgatacatagcttaatttaattgatgtttcttatttttaaaatcaataccttcaacaaaaatctcaccactttgtaaaggtaataaccctagaatcaacttcaataatgktgatttaccagcaccatttggkccaacaawtgctaaaaattcacctttatttattttgaatgnnntatatt

SEQ ID NO: 427 - DNA, 1123 bp; double-stranded, linear
taattttttgcttcgccattactacgcactacctttacattatcgttctcaaggctcatcccctgtttcttagccttttcgtatatgcgttcataagaagaattctttttgatttcagattgtaaagcactgttttcacttgattgtttatctattttataatctaaatctgcaatctttcctcgcgtatcatacgcatccatttttaaagatagcatataaatacttaacatagcaattacagtaatcaaagttatgtataaaactttttcaaatttagttaattgtacaaccacttttctcgaaacagtcttcttttcgggcttagtttgtggttgttgcttcggtatactattataaacttgttcgtcatatggttggtacactttttctacagccattataaattgctccttatttaagtatttcagctacacgtaatttcgcgcttcgtgctctgttattgtcatctaaatcttcttctgtagcggtaatcggtttacgattaacacgctttaacttaggtgtatatgcttctggtataactggtaatcctcttggtacctctggacctttttcatattcttggaacacctgtttacataaacgatcttctaaagaatggaaagtgattaccgaaatcctgccatctactttcactaattcaatcgcttgttctattgaatcttcaaaagctgacaattcatcgtttactgcaattcgtagtgcttgaaatactcgttttgcaggatgtccgccttttcttcttgcttttgcaggaataccttcttttataatgtcaactaattctaatgttgttgttattggttgttgttcgcgatgtgcttcgattcttcgagctatctgttttgaaaatttctcctcgccatagcgataaaaaatcttcactaacgcttcatatgaccaattgttaacaatttcatatgctgttagttcttgtgtttggtccatacgcatgtctaatgttgcgtcatggtgataactgaatcctcgttctggaatgtcgagttgtgggcttgaaacacccaagtcgtaataaattccatctactttttcaatgtttaagtcttttaatatttgagttaattcacggaagttgcta

SEQ ID NO: 428 - DNA, 838 bp; double-stranded, linear
tatatcctccanaccataaaaatggaattatagtgaagaccgctatgatccaggatgaccacgtattatagaatctttcgatagagaaacgaatcaacgtatccgacatcacgaaatgaaattagaagattataaagatgagttaagaagagaatatctaaaacaatctgacagaattgaaggagatgaataagcgtgggacttgattttagtggtttaccagatttagcagtattggaacaaatgaaggaaaaagaacagattagtgaggttattgcgcctgaacatgttcgtatgcatcatgatcatcaaaataagctgaaaagtgatgagaaaatattacttgaccaaatggtaagtcatttcaaaaaatttgaagatgattttaaaaatgcggcacaaggggcttgggtgaaaaatgccacagacgaattaaaagatattagtaatgatttagaaaaaattcaagatattaaagtataaaaaggtattaagaaacacaataagtatataatccatttaataataaatgaattatatagttcataatttcgactataagtggctattagccattatttttcgggatctatgtcaaatcggactaatgaattcaataatggaagttaagcaaccaatctttgtttaacttcttttttattttttggaaaataaagttttgaacataataaaatttgattatgttttaacgaattttgatgtttcttgaactatatatcatctagtcgtcatttacaattggtaaatatgacttcaaactgkatgaaggtgatggcgattaaaaggctcatccgtaggttctaaagaactaganttt

SEQ ID NO: 429 - DNA, 1150 bp; double-stranded, linear
ngtgttcaaataatagaatggctaataccccaacaataaataggaataaatatgttgatgtcgtaattttagtaaataatgaaaatctaaaattagtaaccctattttgaatataagctttaacttctaataatactgggaagccgattgatcctaaaattattaaaaatataactatcgcttgtacaaaataatcatgtgcataaggaattaatgacttacctgtaatatctaatccaccattggtagtggcagaaatagaaacaaaaacaccttgcatgattgcatattttaaatctggattatctcgataaaagtaaaatgctaataacatggctcctacgagttcgattacaaatattgattttacaatatcaataatcaatttgacggtaccactcattgtgtttttgttattatctaacataattaactgacgttctctaattccaatatgtttacctagtaccacccataacatcgtaccaattgccatgacgccaattccaccaatatttaatatcacgaggataattaattgtccaaatgtagaataggtatcgacaatacttatcggagacaatccagtaacactaattccggatacggcaacaaataatgtgtcaattggatttacttctacacctggtttatgaacatacggtaagtttaataataaaaatgcaatgacaattgcgacgatatagtacaatacaataccttgttgagggcttgatctttttaaaaactggctaaaaattgacacgttgttcacctcaacattattttagtttaatattaatttctttctctttaccatctctataaatcttcgctgtaattgatttcaagtcatctttatgactaaatataatctgcctaaagcgtaaatcatcttctaaaagtttgccatctaattcagtaattacatcaccttttttcagaccagattgatctgctaaaccattgttgtcaacttgatctacaacaacaccgttcttaacttttcctggcaatttaactgcttgtctttcaaaactatttagactgacaatattcttcattttaacacctacatcgggatagtcaattttaccttttgtttctaaatcttttacaatcttttgtacttcattaacaggtattgcaa

SEQ ID NO: 430 - DNA, 797 bp; double-stranded, linear
aagaatatttaggattttatgtttcgcaacacccagtagataaaaagtttgttgccaaacaatatttaacgatatttaaattgagtaacgcgcagaattataaacctatattagtacagtttgataaagttaaacaaattcgaactaaaaatggtcaaaatatggcattcgtcacattaaatgatggcattgaaactttagatggtgtgattttccctaatcagtttaaaaagtacgaagagttgttatcacataatgacttgtttatagttagcgggaaatttgaccatagaaagcaacaacgtcaactaattataaatgagattcagacattagccacttttgaagaacaaaaattagcatttgccaaacaaattataattagaaataaatcacaaatagatatgtttgaagagatgattaaagctacgaaagagaatgctaatgatgttgtgttatccttttatgatgaaacgattaaacaaatgactactttaggctatattaatcaaaaagatagtatgtttaataattttatacaatcctttaaccctagtgatattaggcttatataactttyatcaactaataaattatgatatagtaaactgatggttagatatttytyaaccatcagtttgcgtktatattagttttttatgcttattatttttatgagtttcactttacattattgattaatccataagaataattagcacaaaaagcagtatacataaattgagtaaagaattttgtcgatataaccgngcggaaaaataataacnttttggatn

SEQ ID NO: 431 - DNA, 1466 bp; double-stranded, linear
tttccaagagaagttgcggaagtaattaataaaacgcatcataataaattggtcatttcgatgatttcgkcacaaatcgatgcggatagaatggattatttacaacgtgatgcgtatttcacaggtgtatcatatggtgcttttgatatggagcgtattttaagattaatgcgaccttctaaagatgaagtactaatcaaagaaagtggtatgcatgcagttgaaaactttattatgagtcgttatcaaatgtattggcaaatttacttccacccagttagtcgtggtggagaagtgctgcttaataattgtttgaaacgcgcaaaacagctttataatgaaggctatgaatttaagttgcatccacatgattttattccattttttgaagagacagttacgattgaacaatatgttgaactcgatgaagcggtagttacgtattatttggaaaaatggacaaaagaagatgatgctattttaagtgatttagcaagtcgatttattaatcgagacttatttaaatatattccatttgatggctcaattattacaatatcagaactgcaagaactgtttgaagcaggtggtattaatccagattattattttgtgagtgaagcattttctgatttgccatatgactatgatcgaccggggtcaaatcgcaaaccgattcatttattaagacaagatggtacgattagagaaataagcaatcaatcattagtcattcatagtattacaggcattaatcgccaagactataaattatattatcctagagaaatggttgcaaagattaaagataagacaattagagaagctattgaaaatttgattaatgagcttaattaaacagggctaaaattgttatcgttaaatatggaggttatatcattgtctgagaaaaaaggctttaattttaatatcataaaaaatgaccctctagatggtcataaaggtacaaatattggttcaattagcttagacaatattgcaccagtttttatcgatgttgctaacaaagaagcatttattgatattggaggcatgcatgctcgtgccaaagttgaaaaaggtgtgaaatggattactgataaagctgctgttgaaggcgatgaagctaaagaatattggttgtgttgggtaacaacagaacgtaatgaacaaggaccatattacgctggtttaacagcgtgctatttattagtgaataaagcaattcgtcgtggttataaaagtatgcctgaacatgttaatatgatggataaatcaatgaaacatcatattatcatagatcaaattggtgacgagaataaagctattttaaaagactttttaatgaaccatgatgaaggtatgtggaagcattcttctgatgctttacatcaagcatttaattaaatattagaaactaaaatttcccaattaatctataaagatatgattcatttctcaatgac

SEQ ID NO: 432 - DNA, 2304 bp; double-stranded, linear
ttgtacgaatacaaagttgcattaatatagaatcatttatgctttttaatatcacaaaacaaattgattaaactagctaaaatagtcaaaattggaatcaagattacataaatatcataacctctagatattagtatacataatataattagcgaccctattataattgctaaattataagccaaactaattttatatttcatttcaattcccaccttaatagcatttattaaaattctataatgtttacatagacttcttaacaaactttaacccagctaagctaagtattgaaataattacacctcctaatataaatatattacttaagcttagtaaaggtataattatacttatcagtcctaaagacaatgtatccgctgcataattcgatgtagatgagatactaaatactttccccatcaaatgatttggcgtttttatttgaatggcaactgatcttgttagtccctctatagattgtccaagtcccaataatgttgcacctatatataatatcgccacacttggaaacacattaataatcgataagccaattccccaaactaaaacaccaatactaaatttaaagattaatcgcttttctgacagcaaacccataatcaatgacattaataaagatgctatacctaaacatgatgtagctagtccatatacaccaacgccctcttttaatatattggaaataaacaatggtaatacaacacgccaaaggccagtattaatcaatatgcaggcaaattggatgattataataaatggaatttctttagattgtttcaagaattcccaagtttcagaaaaatcttcttttgagtgtctatcaatcatgttgttatttgtatattttaaaagtgcattaaaaataaatcctaaaaatagcaatatactacaaataaaaaagacgccaacattaccaactagtattacaatgacaccaattaaagcaggtaaaataatatttgagcctctttgcaaactatcgattaacgcattacttgttgctaaatgctcctcatcaataatttcaggaagaattgccctaaacgcaggatccgtatagcagttaataatggtgatagctgtagatatggttagaagcgtcagataatttaaatttgatgttattgcaagtaaaggaataattattataatcaaacttagtataagatcagatagataaagtattttctttttattatgtttatcagaatatgcgccaccgaaaataccaaatataataaatggaagtgtttgactcataaccatcattgataattttaaagatgattggtttgtcaattcaacagtaaaccaaattatttgtaacgaaaacagcacaaaacaactccgacgtaagarattaccaatcaataaatatgtaaagtttctatttttcaaaacttctaaatacaacatatttatcacctctcataaaaataattgaatgcatccaccagcttttttagaccttcttctaaactctctttatccaaagcgcaattaattctaatataatttagtcagttaaatatcaattatttcgaaatatacatactacttgaaacaccatacataacccccaaaatgactactcagaggttatattctactaattatgattatattaaatatgaaaatattatcaaaaaaatcaaatttataacaaaaatacaccccttaaagttaggtctttcaatccaacttttggggtgtatatcattctcatcatattctaggttgtttttaacaaactaaatatagtgaatgcaaatcaactattatttaaattatgaattattttaattctttcttctacgagccaataacattaatccagcaattccaattatactactaaagatcaaacctttttgcgtgctttctaaacctgtttttggtaattctgctcgttttttctcttgattagctactgattctttagcaattttagattttttaactttatcatttttatccattgaatgaactgggccatttggttttgctctgtctttcgataatcctggattgttaggatttactgggccacttggatgagttggtctgctcggcttctctgggttttcaggtccttttggatcttttggtttctctccaccgaactctacaatcttatctactggttgttttgtgatctcttctgttggttgaccctcgccaactttttcacctgttaatgggktcactgtgawtggtgktgtgawtgtcytacttcctggktgtccttcttgtttcactcgctcttcaccaggttgtaat

SEQ ID NO: 433 - DNA, 4733 bp; double-stranded, linear
gtcttaatattttacaagatacagcctgacaatatttatattacaaaccaatatggtaaagaggctgtgtctcgattaaaaagaattttagagcaaagtatacctaataaagaatatattgatttatcagagatatcattaattacattttttaaaccagaatataataaacaacatgtgaatgaggagtttaattctttatcttcttcgaaaataaagaatttagccaaagaaaatgatggtattattatttatttaaattttaaggatgttaattatcaactgataagtgaaggcaatacttttttttctgcaaaaccatatttgcattgtgtgttcaataaagatattttaaatatggataaagttgatatagaaaattttttcaaaagtatagaagtcaaatacagtaaataagatcaattattgaatccaccgaccagcagatttttttaaaaaattaataccccgttaataccctttgcttcaatttgatgaaaatcaatgaaattcaaaattgaagaaatcctttaatatcaaggtgtacgacagtctatataatcatgcgaaattctaaaattttctgacgtaaaaaaacaaattcytaaagcagctcgtcgttcacctcaattctcaaaacgttaattgtcggacgatatatatacaaaacacctcgatgttatgtcgaggtgtttttttgcgtttgtgtggggaatatggaatagagtataaatgaattaatgtctcaggtatagaattaattcaactatgaattattgatttacacgtataatttgtacatgcttacacaatcaaaagtgtrcattattaaattgtcatttagcttgcggagaccgtacgatagtgttctaataatagatattcaagggaaagagctatcggatgataaccagatgataactcaagaaccatgrtttaagagtgttatcaaaataaggagtgacttaattgaaagattctatattttggaagaaagcttttattyctgtttattttattgttgsgatgctggtgtttctactttttaggttttatattaaaacagataacttttctatatatttaatgagtatcttcttaatttgtttaggaactgcttctatcatttataactataaaaccaatcgataaatataagtatgaaatgtataagtcacagttagatctaagtcttgctgtggctttttatatctccataaaacgacaaattcaagcccgacataaaacagcattttcagcccaccataaaacgacaatttcagcccgccattgactaaacaccacatcccaaaaatatcgtaacaatcctctacatcaatcaatccaacatccctcataatcacaacgcacaaaatctattcatgcatttttggaatacttagtattacaaataacgatttttattcatctaacaaaggttatataatgtactgaaggcaatttttatgtattacaaatctaatcgtacatgtaaaattttgataaacatcattaattttgcgtaactatcattagattacaaatcacaaagtaattacatgtaatacacatctatacatcacatttgaagggaaatgaatataaatgactgataaaaagtacactgcagccgatatggttattgatactttgaaaaataatggggtagaatatgtttttggtattccgggtgcaaagattgactatctatttaatgctttaattgatgatggtcctgaacttattgtcactcgtcatgaacaaaacgccgcaatgatggcgcaaggtattggaagattaacaggcaaaccgggtgtagtacttgttacaagtggtcctggtgtaagtaatttaactactggattattaaccgcaacatctgaaggggatcctgtattagcgttaggtggccaagtgaaacgnanatgatttattacgattaacgcatcaaagtattgataatgctgcgctattaaaatattcatcaaaatatagtgaagaagtacaagatcctgaatcattatcagaagttatgacaaatgcaattcgaattgctacttcaggaaaaaatggcgcaagttttattagtattccgcaagacgttatttcttcaccagttgaatctaaagctatatcactttgccaaaaaacaaatttaggagtaccgagtgaacaagatattaatgatgtcattgaagcgattaaaaatgcatcatttcctgttttattagctggtatgagaagttcaagtgcagaagaaacaaatgccattcgcaaattagttgagcgcacgaatttaccagttgtagaaacattccaaggtgcaggtgtaattagtcgtgaattagaaaatcatttcttcggtcgtgtgggcttattccgcaatcaagttggtgatgaattattacgtaaaagtgatttagttgttacaatcggttatgatccaattgaatacgaagctagtaactggaataaagaattagaaacacaaattatcaatattgacgagttcaagctgaaattactaattatatgcaaccgaaaaaagagttgattggtaatattgctaaaacgattgaaatgatttctgaaaaagtggatgagccatttataaatcaacaacatttagacgaattagaacaattaagaacacatattgatgaagaaactggtattaaagcgacgcatgaagaaggaattctacatccagtggaaattattgaatctatgcaaaaggtattaactgatgatactactgtaacagttgatgttggaagtcactatatttggatggcacgtaatttcagaagttacaatccaagacatttattatttagcaatggtatgcaaacgcttggtgtagcattaccgtgggcaatttcagctgcacttgtgcgccctaatacgcaagttgtgtccgttgctggcgatggtggctttttattttcatcacaagatttagaaacggccgtacgtaaaaatttaaatatcatccagcttatttggaatgatggaaaatataacatggttgaattccaagaagaaatgaaatataaacgttcgtcaggtgtagacttcggtcctgtagattttgtaaaatatgcagaatcatttggcgcgaaaggtttacgagttactaatcaagaagaattagaagcggcaattaaagagggctatgaaacagatggtccagtattaattgatatacctgtaaattacaaagataatatcaaactttcaacaaatatgttacctgacgtatttaactaaaataaagataaatgttaaagaggagtgggagattttatgactaatgttttataccaacatggtacattaggcacattaatggcaggattattaaaaggaactgcatcaataaatgaattattgcaacatggtgacttaggtatcgctacactaacaggttcaaacggtgaggtaatctttttagatggaaaagcttaccatgcaaatgaacataaagaatttgtagaattaaaaggtgacgagttaacaccatatgcaactgtaactaaatttgtagcagatacaagctatgaaacgaaagataaatcttcagaagcagtttttgcagaaattaaggaaaagatgttgagtgaaaatttattttcagcagtaaaaatttcaggcttatttaaaaaaatgcatgtacgtatgatgccggctcaagaaccaccttatacacgtttaatcgattcagctagaagacaacctgaacaaactgaaacgtatgtcaaaggttcagtcgttggtttctttacaccagaattattccatggtatcggatcagcaggatttcatgtacactttgcgaatgatgatcgtaactttggtggacatgtcttagattttgaagtagaagatgttaaagtagaaatccaaaatatagaaacatttgaacagcattttccaattcaagataaagatttcactaaagcaaatattgactataaagatattgcagacgaaattagagaagctgaataatgaatccagaaatataatgacggtttatgaaaattgacttcataatgcgcgatttagaaatgatagtttgtaaatatgattaaccatgactacaatagaacaaatatatttataattacgtctaagtaataaaataaatcccttcactattagcagtagtgaggggatttattaggttccagatatttgagatttgctgttatgtttagattataaattgtggtacacactcatataaaatttactattgtataggccaatctgttactacgagaagcaaacaacaataatttacaagttcaataactaaaaagacaaacgccaatttttcagcgcttgccctataaaactattttcaaattattatttaactacaatttgtatctgtttgattgtacttggatcaattgaatttttagcgtcgtcatttttctttagattcactacttttttattaccatcattcaaagtaagcgtataagttgctgtttgggcattattaattttttctgttgtaacaccacgttgagaagctaattcattttttactttactgtcaatttcttgataaagaacatttttattttctgggaagataaagtaagttcgatgtaatgcagtaataccatctactgaaattgtgtaaggaacagtgtgataaccatccacagtcatttctttatagccgttattactatctgcagatgcttcgtgactcggta

SEQ ID NO: 434 - DNA, 1284 bp; double-stranded, linear
aataaatggtaattttatatcatcaacggctacaaatggggcagtttcatatataaataaacacatctactcaactgntcttaattaattaataaatgatttaccagatgacatataacagccattattagnttaattctaatagtttatttaaattttcttcggttgtcgcccaactggttgcgaatctaacaacacgatgttgatcatcgtatttttcccaaacagcaaatttaactttttgttctaactctgctattttctcgttacttaaaataaaaaattgttgattggttggagaatcaaagtaaagacgatagcctttatttttaaacccgtctttcatcttatttgccatttcgatagcatgtctgcttatattaaaatataaattgtccgtaaataattctaaaaattgtatgcctgttaaccgtccttttgctaaaagggcaccgtggatgcttgattcgagtggtaaattgtttcggttcattatttttcgtaaaaacaatggcttccccgcataatgcacctatctkcgtaccacctatataaaatacatcacaatatttagcgrtgtctttaatagtcatatctgattggtcactcatcaatccataccctaatcgtgcaccatccataaataatggaagctgatattgcttacatactttgcataactcttccaattctgatttagagtataatgtgccatattctgtaggatgagaaatatataccattcctgggaataccatatggtcctttttaaaatcacttttaaatgtctccatgtaagtttcaacatctgaagcactaacttttccttccttagagggtatagtaattactttatgtccactatattcaattgcaccgccctcatgcacagcaacatgaccagtgtctgctgaaatgaccccttcgtaactttctaacattgaattaataacaacctgattggtttgtgttccacctactaaaaaacgaattgtagcatttggacagtcaattgtatctttaatcttttcaattgcctgagctgtgaattgatcaaagccatatcccgaagcttgtacaagatttgtatctactaatcgttttaatactttttcatgagcaccttctaaataatcattttcgaatgaaatcactacatttccccctaaaactaatatcaacattttaataagataaaccaatttcaaaactagttcgatatttaaaatgtattatggatggntaaagtttgtatcgcattatcgcgaagttgnataaatatat

SEQ ID NO: 435 - DNA, 1072 bp; double-stranded, linear
acagcttttggtaarggagaaawtcaatatgaaacagtataargcgtatttaatcgatttagatggcacaatgtatatgggaacagatgagattgatggagcaanacaattcatcgattatttaaatgtaaaaggcattcctcatttatacgtaactaataattcaacaaaaacacctgagcaagtaactgaaaaattacgtgaaatgcacattgatgctaaaccagaagaggttgtaacgtcagcgttagccactgctgattatatttcagaacaatcaccaggagcatcagtatatatgttaggtgggagtggtttaaatactgcgttaaccgaagcgggacttgtcattaaaaatgacgagcatgttgattatgtagttattggacttgacgaacaagttacatatgaaaagcttgcgattgcaacgttaggtgtaagaaatggtgcaacatttatttctacaaatcctgatgtatcaattcctaaagagcgtggtttattacctggtaatggtgctattacaagtgttgtaagtgtatcgacaggtgtatcgccacaatttattggtaaaccagaaccgattattatggttaaagcattagaaattttaggattagataaatccgaagttgctatggtaggcgatttgtacgataccgatattatgtctggtattaacgtaggtatggatacgattcatgtacaaacaggtgtatctacgttagaagatgtgcaaaataaaaatgtgccaccaacgtattcttttaaagatttaaatgaagcaatagctgaattagaaaaatagatatagtcattttataaagtaggtgaattgatttggtaaaaatagttgtttcgaggaaaattccagataaattttatcaacaattaagtaaacttggtgacgttgttatgtggcaaaaatcattagtgcctatgcctaaagatcaatttgtgacagccttcgtgacgcagatgcttgttttattacattaagtgaacagatcgatgcagaaattttagcgcaatcaccaaatttaaaagtaattgcgaatatggctgtaggata

SEQ ID NO: 436 - DNA, 3271 bp; double-stranded, linear
taaaaacttactttaacaccattcctttttaacttttttcgtgtttcntttncttaagtccatccatatttttaatgatgtcatctgctgttttatcttttaaatctaacactgagtgatamcgaatttgtagcacaggatcaaatcctttatggaatccagtatgttcaaatcctaagttactcattttatcaaagaaccaatcattaccagcattacctgtaatctcgccatcatgattcaagtattgatatggtaaatatggatcgatatgtaggtatagacaacgatgttttttaacatattttgataattcattaaagaaaaagtgtacgagttcttgattttcataatcaatcactggaccgcgatttgaataaaaatacttgaacactttcataacaggtacagcagtaagtaagcaagctgcaatgacctcgttattattgttttttattcccactaaatgtgtttcataaccttcagcaagctttaactcatagtggccaacagtttgcgtgaaatgactgtatggcatgctatctgtaaaggcaccaaactctttagctgttaaatttgtaaacttcattatcattactcctatttgtctctcgttaattaatttcatttccgtatttgcagtttttctatttcccctctgcaaatggcaaaaataataaatctaatctaaataagtatacaatagttaatgttaaaactaaaacataaacgctttaattgcgtatacttttatagtaatatttagatttttgaatacaatttcaaaaaaagtaatatgaacgtttgggtttgctcatattactttttttgaaattgtattcaattttataattcaccgtttttcactttttcaaacagtattcgcctaatttttttaaatcaagtaaacttaattattcaatgtttgttggatagattgtaaatatttaatgatttcctcacgcgtgttagatttaaatcgcttaacgatttcgctaccaatgacaatgccatctgcaacctcttttatatctgcaacatgttgtggtgttcttataccaaatcctgcgacaactggcacattggctatcgctttaattgactcaatttttcgttttaattctggatgaaacgcaccgttttgccctgttgtcgcattcatcgtcacagtataaataaagccttccgcatgggatacgatatcttttatacgtttgtcatcagtagtcatcgcaactaacgatatgattttgacgccatagtgactaaattgttgttttaaacgctgcgataattcatatggtaaatcaggaataattaagccgtagacaccagtatctcgacatttttcaaaaaacgcttgttctccataatgacaaataatattataatacgtcattaatacatagttacacttaatttgatcaccatgtttttctaattgattgaaaatataatctatcgtgatgccttgtttaatcgcttgttgacctgcttccatgataactggaccatcagcaaccggatcagagaaaggtactccaatttcaattatatctgcaccattttcactcaacaatgttgcattttcaatcaaatctttattgcccataatataaggtataaataatttagtcatttgcaagacctcgctctaccatatattgtctaattgtttccatatctttatcgccacgtccagaaatagttactacaataatatcttctttcgacatcgtaggcgctagtctttcaacataactcagtgcatgtgcactttcaattgcaggtataataccttcatgttttgtaaagttgattaaagcattcattgcttgtgtatcactagcattttcaaaagttactctaccaatgtcgtggtaataagaatgttctggtccaataccaggataatcaagtcctgctgaaatagaatgtgctagttgcacttgcccatcttcatcttgaattaaatacattttagtaccatgtaatacgccaggtgatcctttgccaattgcaagtgcatgtttatcagtatcatcgccttgacctgcggcttcaacaccgtataatgcaacatcatctttaataaatggataaaatgtaccgattgcatttgagccaccaccgatacatgctacaattgcatccggaagtcgaccttctttcttcaatatctgtgattttatttctttaccaatcacactctgaaaatctctaacaatcgttgggaacgggtctggacctaatgcagaacctaataaataatgtgtatcatctacatgacttacccaatattgcaatgctttattaactgcatccgataaagtcccttgaccatcttcaactgccacaacctttgcaccaagtaattccattctaaatacattaagttgttgtcttttaatatcttcacttcccataaagacaacaagttccatatcaaataatgcagcaaccgtagcactagctacaccatgttgacccgcaccagtttcagcaacaagcttcttcttgcccattcttttagcaagcaacgcttgacctaacgcattattaattttatgggcgcctgtatgatttagatcctctcgtttcaaatatattttagcgccacctaggctttcagtatatgatgcagcatatgtaagtggtgtcgcgcgtcctacatactctgataaatagtattccagttctctttgaaactctgggtctgcttttgcctctttataagcttttttcaactcaataattgctggcattaatgtttctggaacatattgccctccatattcaccaaagaaacctaattcatctgcttctgtttgtatttgtttattcattgtctctatctcctttcacaatatttacaattgctgtcattttttctatatcttttcgcccatttacttctatacctgatgcaagatcataaccttgatgtgataatttaagttgattaactgtttgaatattttcagagttaatgcctcctgctatcaaataaggtatgtcttttatgtgcttcaaaatagtccagtcatatgtttgaccggtaccaccatacgacactgagggtgtgtcgataataaataaatctacgaaccctttatatttatttatgttttggattatgttttcatctngcagtaaagctttagtgattttaatgcttgaatatktctttttaatttcctgtataaaatcaatagattctgtgtaactgtattgtgktaawtgacgwatgcttaawacgtgtgccaatggt

SEQ ID NO: 437 - DNA, 1553 bp; double-stranded, linear
ataatgaaataatactgtgttttatctgcgaaatgtatcattttctaatcgtttcacagtaaaatgaaaagataaagtgtgtttttacttgaattttgactaaaattactctatatttattaattgagctatgcttattattacaatttgattacaaattttaaatttgttaattgaatgataatattaaataaagaaacttacacaagcaaatatgagttgtagcccaaaatacttgttaaatcaaagttgaaagctacaaataatgaaaattataaacttgaatctgaaagtaattactataattatgacaatgttaacttttaaacgcacttattaattaactacataatgttaatatctaatttattcaagtactttcgcaagatttattatctaaataacgggggaaagaatcatgagttcacaaaaaagaaaattagtctttttgcgttcttcttattaaccgtaataacgattaccttgaagacgtatttttcttattatgttgatttttctttaggtgttaaaggtttagtacaaaacttaatattattgatgaatccttatagtttagtagcactggttttaagtgtgttcctattctttaaaggcaaaaaagcattttggttcatgttcataggcggcttcttattgacgttcctattatatgccaatgttgtgtactttagattcttctctgattttttaacgtttagtactttaaaccaagtaggtaacgtagaatctatgggtggtgcggttagtgcatcattcaaatggtatgactttgtttatttcattgatacgttagtttacttattcattttaatatttaaaacaaaatggttagacacaaaagcatttagtaagaaatttgttcctgtcgtaatggcggcttcagtagcattattcttcttaaacttagcttttgctgaaactgacagaccagaattattaacacgtacatttgaccataaatatttagtgaaatatttaggaccttataactttacagtatacgatggtgttaaaactatcgaaaataatcaacaaaaagcgctagcatctgaagatgacttaacaaaagtattaaattatacgaaacaacgtcaaacmgagcctaacccrgawtattatggggtggcaargaagaaaaatattattargattcatttagaaagtttccaaaccttcttaattaataaaaaggttaatggtaaagaagtaacaccgtttttaaacaaattatcaagtgggaaagagcaattcacatacttccctaactttttccatcaaacaggtcaaggtaaaacatctgactctgaatttacaatggataacagtttatacggtttaccgcaaggttctgccttttcattaaaaggagataatacgtatcagtcattaccagcaattttagatcaaaagcaaggctacaaatctgatgtcatgcacggtgactataaaacattctggaacagagaccaagtatataaacactttggtatcgataaattctatgatgcaacatactatgacatgtcagataa

SEQ ID NO: 438 - DNA, 1419 bp; double-stranded, linear
acaaaatcaatcagcaaaatgattggattaagacgcaaattgagcgttcaatggaaggcgaaacagttggcattaatgatcaaaatatagaaatatatagtgaacgttgagatttataccatacactcgtacctttaaatcaagaattgcataagttgcgacttaaaactcaaaacttaaccaatgaaaattataatattaatgatgtgaaagttaaaaagattattgaagatgaacgtcaaagactagcacgagaacttcacgattctgttagtcagcaactttttgcggcmagtatgatgctatctgctatcaaagaaacgaattagaaccaccattagaccaacaaattcctattttagagaaaatggttcaagattcgcagttagaaatgcgtgctttgctgttacatttaagaccgcttggtttaaaagacaaatctttaggtgagggtattaaagatttagttattgatttacaaaaaaaagtgccaatgaaagttgtgcatgaaatacaagattttaaagtgcctaaaggtattgaagatcatttgttcagaattacacaggaagcaatttcgaatacattgcgtcattcaaacggtacaaaagtgacagtagaattgtttaataaagacgattatttattgttgagaattcaagataatggtaaaggttttaatgttgatgaaaaattagaacaaagttatggacttaaaaatatgcgtgaaagagctttggaaattggtgcaacgttccatattgtatcattgccagattcaggtacacgtatcgaggtgaaagcacctttaaataaggaggattcgtatgacgattaaagtattgtttgtggatgatcatgaaatggtacgtataggaatttcaagttatctatcaacgcaaagtgatattgaagtagttggtgaaggcgcttctggtaaagaagcaattgccaaagcccatgagttgaagccagatttaattttaatggatttacttatggatgacatggatggtgtagaagcgacgactcagattaaaaaagatttaccgcaaattaaagtattaatgttaactagttttattgaagataaagaggtatatcgtgcattagatgcaggtgtcgatagttacattttaaaaacaacaagtgcaaaagatatcgccgatgcagttcgtaaaacttctagaggagaatctgtttttgaaccggaagttttagtgaaaatgcgtaaccgtatgaaaaagcgcgcagagttatatgaaatgcttacagaacgagaaatggaaatattattattgattgcgaaaggttactcaaatcaagaaattgctagtgcatcgcatattactattaaaacggttaagacacatgtgagtaacattttaagtaagttagaagtgcaagatagaacacaag

SEQ ID NO: 439 - DNA, 608 bp; double-stranded, linear
atgtnggcggacgtaaaggacatgtttatactgatgatcgagcattagatattgatatcgttccgcctgctcaagcagatggtaaagctactaaccccgaacaattatttgcagcaggttatgcatcttgcttcaacggtgctttcgacctaattttaaagcaaaacaaagtgcgtgatgctcatccagaagtaacactaacagtgagactagaagatgattcagactcagaaagtcctaaattaagtgtttcaattgatgcgacaattaaaaatgttatatctcaagaagaagctgaaaaatatttacaaatggctcatgaattttgtccatattcaaaagcgactcaaggaaatattaatgtcgatttaaatgtaaatgttgtagattagcattaacttaaagagattattcaacgttattaataaaattcacataaaattcaaatttstcraccaaaaatttttggttggytattttttctattcgtgattgaaatttctggcaatatttaactgaaaatgattgtaccttagtcatcataaatgtgaccggttccaatactggcttgacttcttcgcataccgtctacaaataaaagtccagtg

SEQ ID NO: 440 - DNA, 682 bp; double-stranded, linear
cctttcaatttctcccaagatttacgcatgtctgaccaaatgtcaatacaatacctgaataatgatttctggagtaattgcgaaaaatatttaaaagttgctatagatcaattttcaaattatagtatctcatctcaagtttctaactatcatttcacagtattacttggagatcgccaaaaaccacttatgtatctaaataaaaatcgcggtggtgatggtggcataccaggttatattatgatttatttagtgccgagtacaagtacaattaattctatgaaaagcttaattgcacatgaagtaaatcataatatgcgctatcaatatattgattgggatggcggaagtttgattgaattgattattgcagaaggattagctgaaaactatgtagaatcattgtatggtaaagcgcatattggaccgtgggtaacaaatactaattgaagtcgtgataacgtaaaaattaaaaatactatttataatcatttacatttaaagcatatatttgaatcgatgccttatctctatggtgatgatattaataaacttcaaggtaggcctatcgttggcttatctcatgctgccgggtatgcatgtggctatcacttggtaaaatactttttacaaaaaacaaacatacctattgaagttgctacaacacttccagcacaaaaaa

SEQ ID NO: 441 - DNA, 2574 bp; double-stranded, linear
atcttcttttaacatgacaaattgcaacaaaatattaatgacgccaaaagacattttttcacgttcaattaattcttcaaccattgtcttttgcgatatagttggttctgattcagaccaagaagctaacatatcaattggactcgtttgttcaagtaactcaaaccattcatcactttgtggctttggattcacttctgaagatttgcccgccgaagatgatgtagcaggagatttcacctgtaatttaggcatttgattttcgtgttccattaagtaatacgagcgtgcttgtttacgcatttcttcaaaggataactgttgtccacttgtaattgaatttaaaataacatgcttcatgccatctgctgttaaaccatataaagtcgcgagttgtgtaattaaacgctttgcatctttggtaacaatgtcttgactaataaaatgtttacctaacatttgtctcaacatttcaaagtcaaaagattcatttgataaatcgataccttggtacggttcattaatcggaatatcacttgtatcgatatctatttttgtagacggcactttaaaaacatcagtaaattgtcttgttacctgtttaaattcactcaaatcaatttgttgatactcaaagtatttcttcaactcatgaaatcgacgatgctcgacttcactatataaaaagattgacaacattggatcattaaaaaataaatgtgctgaaggggttgaattaattggtaaacaaattgtgtttcttgttcatcatgtttgacaaacgcctttaacaatccaatcgcttcaagtaagtccatttgttgtctaaactctagtaaattaattttaagttcattcataaaaatataatgagaaagaatcaatgtttcattatgactttctttaacgaattgagtcataaaatgatataaacccactgcttgcgttccaattagcggtgtatacagtcgattcaatacctctaaatgattcgtatttaaatcaaagtgttgcataactttgaattgatcctttggtcttaagccgaattcgaaggcttgtcgtcccatttaagcnatcactccgtttgttttcgcttaaaatcccttgcatcgatgctaacaattgatcaacatctttaaattctttatagactgatgcaaatctaacatatgaaacttgatcaacatgcattaacaagttcataacgtgttcacctatatctcgtgaagacacttccgtatgaccttcatctcgtaattgccattcaaccttgttagttatgtcttcaagttgttgatatctaactggtcgtttctcacaagaacgcacaagtccattaagtatcttttctcttgaaaactgctctcttgtgccatcttttttcacaactataagctgactaacttcgatatgttcaaatgtagtgaaacgtgttccacaattttcacattctcttcgtcttcgaatggcatttaattcatcggcatgccttgaatctacaactttagattgtgtagaattacatttcgggcatttcattacatcaccctctttattttgattatgcctaattatactataaatctagagatgaaaaaagaatccctcaatttaattcatttaaccaaataatgaaacaataaaaaacattatatcgttacttattaagtaatttgcatgacaatattattgtattaaaaataaaaaacctaactccgaagtcagagttaggctataaattaattgtattaacttgcacttacagtttcttttgatgtcaaaagtgctccaatttgctcagcaacatctacaactctatttgaataaccccattcattatcataccaagcaataacttttactttattccctgacatgaccattgttgattttgcatcaataatagctgaatttggattagtattaaaatcaacagacactagtggttgatgttcgacttctatgataccttctaaacctgcattttcaaaagcttggtttacttcttctgcagttacttctttttctaaatcaacaactaaatcaacgagcgatacattctttgttggtacacgtaatgccatgccgtgtaatttaccttctaattctggtaatacttcttttaaagctttcgccgcaccagtagaagtaggaataatgctttcattacatgaacgtgcacgtcttaaatctttatgtggattatcaatatttttttggtcatttgtaatagcgtgaacagtagtcattaaaccattaactattccaaactgattatttaaaacttttgcaactggaccaatgcaattagtagtacatgaagcattactaaaaatgtcaaatgcttctatatctaattggttatcatttacgcctttaactaccatttgaacatgtccaccttttgnaggaccagttaacaaaasttttttggcacctgctttaatatgtgcgatggctttatcaccatgattaaatttaccagttgcatctatagcaatatcgatatctaattctttccatggcaagttttcaggattgcgatcagcaaccaatttaattttatgatct

SEQ ID NO: 442 - DNA, 3326 bp; double-stranded, linear
caaggtaccggtttaggtttgttcatttgtaaaatgattatcgaagagcatggtggttccatagatgttaaaagcgaattagggaaaggcacaacatttattattaaactaccaaaaccagaataaaattgaatatagttatttcagaacgcatgttattgattagagactctaatttatagcatgcgttttttgattgatgtggggaattttgtatgtggattagaacttagggtttttgcgaatatcaactattaaatatattactaatttatacaaaaatataaagtttgataaagttatttatttgattataaaaatagggtaaaatatagatatattgtattaattaaattattcgaggtgtcatatgaaaaaattcattggatcagttttagctacgacattaattttagggggatgttccacgatggaaaatgaatcaaaaaaagacacaaaaacagaaacaaaatctgtaccagaagaaatggaagcttcaaaatatgtaggccaaggcttccaaccgcctgcagaaaaaaatgcgattgaatttgcgaagaagcatcgtaaagaatttgaaaaagtaggtgaacaattctttaaagataactttggactaaaagttaaagctacaaatgttgtaggtaaagatgatggtgtagaagtttatgtgcattgtgaagatcatggcattgtatttaatgcaagtctacctttgtacaaagatgccatccatcaaaaaggatcaatgcgcagtaatgacaatggtgatgatatgagtatgatggtgggtacagtgctgagtggctttgaatatcgagcgcaaaaagaaaagtatgataacttatataaattcttcaaagaaaatgaaaagaaatatcaatatacaggctttacaaaagaggcaattaacaagacacaaaatgtcggatataaaaatgaatatttttatattacatactcttctagaagtttaaaagaatatcgaaagtattatgaaccactgattcgaaaaaatgataaagaatttaaagaaggaatggaacgagcaagaaaagaagtgaattacgctgcaaatacagatgctgttgctacacttttttctactaagaaaaactttactaaagacaatacagtagatgatgtaatcgaactaagtgataaattatataatttaaaaaataaaccagataaatctacaatcacaatacaaatagggaaacccactattaatactaagaaagccttttatgatgataatcgtccaatagaatatggggtgcacagtaaagatgaataaaattaatgatagggatttaacagaattaagtagttactgggtttatcaaaatattgatataaaaaaagaatttaaagttaatggaaaaaggtttaaacaagtagacagttataatgatgataagaatagtaatttgaatggtgctgctgatattaaaatatatgagttattagatgataaaagtaaaccaactggtcaacagacaataatttatcaaggaacatctaatgaggcaattaatccaaataatccattaaaatcatcggggtttggagatgattggctccaaaatgctaaattaatgaataatgataatgaaagcacagattatttaaagcaaacagatcaattatcaaatcaatataaaataaagttagaagatgcagatagattatcaaatagtgattttttaaaaaaatatagaatggaatcaagtaacttcaaaaacaaaaccattgtggcggatggcggtaattcggaaggcggtgcaggagcaaaatatcaaggagcgaaacatccgaatgaaaaagttgttgctactgactcagcaatgattccttatgctgcttggcagaaatttgctagaccacgctttgataatatgattagttttaatagtaccaacgatttattaacatggttacaagatccattcatcaaagatatgccaggaaaacgcgttaacattaatgatggtgtgcccaggttagatactttaatagacagccatgtaggttataaaaggaagttaaatagaaaagataacacatacgatactgtaccactaatcaaaataaagtcggtaaaagatacagaaattaaaaatggaaaaaaagtaaaaaagactattaacataacattagatatggatgggcgaattccaataaatgtttggacaggagattcgattgcacgttctggaagaggaactttaattaaacttaatttagaaaatcttgatgcgttgagtaaactgattactggtgaaacaagtggtatgttagcagaatgcgtaatctttttaaatgaaagttttaacatctcagaaaatgaaaataaaaattttgcagatagaaagaaacaattatcagaaggatttaaggataagattaacttatttcagttagaagaaatggaaagaactttaattagtaaaataaactcacttgaagaagttgcagatgaaacaatagaaagtattagtgctgttaaacacttattacctgattttgcattggatgcattaaaagaaagaattaatgagttgtttaaaggtataaaatcttttatagaaaaagtgtatgatagtatagataatgaaattttagaaattttcaaaaatatagatcacgacttcagagatggagtatctgaagaaatgatgaaacatttgaaagtagtgaaacagaatatagaccaaataaaaaatcaaaatgatatttatggtaggcaaattgcagatattagaagtattatgaaacaacaagatgcaacaattttagatggaaattttcaaattaattgtagcggcgaaaatatggtacagggtctagttataccttctaattatttaggaagaaaaatgaaaatattaaaagaccatatcgatgatggtattaaaaaaatagcagactatgttcaaggtatatatgatgaatatgcatcgaaaattgtcgatgtaataaaatatttgattaatacaattcccaaaatacgtaagaatttaagacatgcaattgaaatgttaaatgtaaaaaagaaagaatttttgtccctgattcctaatgtaacttgtaattatattaaaactaaattagaagaattagataatactttaggcaaatgggagccttttcttaatgatttaaaagcagtgtcaccaattttagataaccatttagatgatattgttaagaacatgaagcctttgattgtacaaatgayatwtgaaccatcacattatgacgatatgtttaattcaagaaaagctttaacgccagtgttctcaagcgttttataaaggttg

SEQ ID NO: 443 - DNA, 5301 bp; double-stranded, linear
acctatagctggcccgtcaagtcctgaatcatatgtcgctataaacccagttgcatgcccagcaatctcggtttcaatttcaaaatcatgctctttcaaacgatctattaaagttcgagacgcaaatatttcttcattaccaagttcaggacgttcatgaattctatgactgatttcgatataactatatttatttgtttctatataatcgagaatttgttgtttttcactcattttttactatctcccttttaccctacactcattttaatcatccacaatattttgttctttcaaaatgaattattacttattctatcggttttatctcatgatgtcatctagtttttctttatttacaaaattttctaataactaaaagcctttcataaatttataaaacagtttcaaattgtaaaacataagccctattgttacaatttaagtattgttagaaacacaacttacaacaaacttaagttttataatgcaacaaatcataagcgttttatagttttgagtagttaataggaggaaattcaaaatgacaaaaatgaatgttgaaagtttcaatttagatcatactaaggtggttgccccatttattagattagcgggaacgatggaaggattaaacggagatgtcattcacaaatacgacattcgtttcaaacaaccaaacaaagaacatatggatatgcccggactacattcattagaacatttaatggctgaaaatattagaaatcatagtgacaaagttgttgatttaagtcctatgggttgccaaactggtttctatgtatcatttattaatcatgataattatgatgatgtattaaatattgttgaagcaactttaaatgatgtgctaaatgctactgaagtgcctgcttgtaatgaagtacaatgtggctgggcagcaagtcattcattagaaggtgctaaaactatcgctcaagcatttctagacaaacgaaacgaatggcatgatgttttcggtacaggaaaataaatcttagtcaatcaagttaatcagaaaagcagtcgaacaatgattttacaatcgccattgtccaactgctttttattatgcttcaaagtcaaaaaatcgaacaaatgaaaaagtaaaatctttaacatttgtccgatttatttgagaaccactataatttcttaattagtcccattaacacgaactgcataggtaaccttaaatatagttgccatgttggcaattgtttatctcctaaaggtaactttttaactgccatatagatattagctgggaatacagctagcaagaatagattgattgtatttttcaagcattgagatggtcttttaattaaaagtgcaagtccaaataatatctcaaagattcctgtaacaagaaccgctgtttttcgaagtggcaaacatttcggtatgatatttctaaattgtcgttctcgtgtaaaatgcaatacacctattacactaaaacctattcctaataaatatcttagtatgttcaatcagcttcaactcctattctgtaatgattttatgaattaatgtaggcgatacaacatgatcagcaattgttatgcttgaatctaattttttaacaacatcgtctacatcttggcgattactgtgaatcgttaataatgattctccttcttctactttatcaccaatttttttatttaaaacaataccaaccgctaaatcaatatcatcctcttttgttaaacgtcccgctcctaacatcatcgaagcgacacctatatcgttagagactaattcagtcacataacctgattttttagctttatattcaatttgatattgagcttgtggcaaacgctctggatggtcaataacagtttcgtcgccaccttggtttttaataaatgttttgaatttttctaatgctgcacctgaattaattgcctcaattagcaacgctctcgcttcttcaagcgtttcagctttgtttgcaagtacaaccatttgagaacctaatgttaatacaagttctgttaaatctttcggaccttgtcctttcaacgtatcaattgcttcttgtaactcaagcgcattgccaatcgcacgtccaagtggctgattcatatcagaaataatcgccatcgtattacgtcccacattattaccaatacgtaccattgcgtgcgctaatgcttcagcatcttctaatgttttcataaatgcaccgctaccagtttttacatctaatacaattgcatctgcaccagcagcaatctttttactcataattgaagaggcaattaatggtattgaattgacagtaccagtaacatcccttaaggcatataattttttgtctgcaggagttaaatttcctgattgtcctacaactgccactttattttcattaaccaatttcacaaatgttgcttcatctatttcaacatgaaaaccatcaattgcttctaatttatcaatcgtaccacctgtatgacctaatccacgcccactcatttttgcaacaggaacatctacagctgctactaatggtgctaaaaccaatgtagttgtatctcctacaccacctgttgagtgcttatctactttgacacctttaatatcactcaaatctatcatatcaccagaattaaccatagccatcgttaatgctgcacgctcatcatcattcatatcttggaaataaatcgccattgctaaacttgatgcttggtaatcaggaatatcccctttaacatagccgccaataaagaaattaatttcttccgttgttagtgtatgaccgtcacgctttttctcaataatgtctatcattctcatttttatcatccttttcttaaaaagcttaggacaaagcatctgcgctttctctagtccatttttaaaagcacaagcgaaaattattatagcaagctatcgatttcatttttaatatcacaatttcaatgcgatgttattattcttaaatagattggttataacgttaaagtccctattaaattatcttagaatcatcatggcatttatgatgtcttaaagctgatatcgacatacttatatatggttacgatgtcccatgcttacatatttttataaaattagtaatctgaatctgcttctaaaccttgcataatttgaacgcctgcgctcgcaccaatacgtgtcgcacctgcttcaaccattttattgaaatcttctaaattacgtacgccacctgatgcttttacttctatatcagcacctactgtatctttcattaatttaacgtcttctgcagtcgcaccgccacctgcaaaacctgttgaagttttaacgaagtccgcaccagccgcttttgttaattcactcgcttttacaatttcgtcatggtccaacaataccgtctcaataatcacttttactgtgtgacctttcgcagctttcaccactgcttcaatgtcttgttgtacatcatcaaaacgtccatcttttaatgcgccgatgttgatgaccatgtcaatttcatctgcaccattttgaatcgcatcttctgtttcaaatgctttcgtcgcagttgtcgatgcacctaatgggaatcctattaccgtacaaactaacacctctgaatcagctagtcgctctgctgcatatttaacatgcgttggattcacacatacagatttaaaatggtatgctttcgcttcatcgatgatttgatcgatttgcgtacgtgttgactcaggcttcaataaagtgtgatcaatcaattttgcactattcattttctatctcctcctttatggttgattataaaaatacggttgtaaattagttgattgagcgtcaggttcatttaaatatcaggttagatgttcgctttttatgtaaccgcatacatatactattacattaattcatttcccataaacaaacaatacaattgaacgtgatatcttcattatgaacgatgacttgacaacaagctaatcaggattatatttttataattctttaattctatagtacaaaaattcgcaaaaaagggaaacaaatgttatcttaaaattattaatgaatattaaggagaagataacaaatgacaaaaggtacaccacatattcaaccaaatggagtaaaaattgctaaaacagtattaatgcctggcgatccgctacgtgcaaaatatattgctgataattttttagaaaatgttgaacaatttaacgatgtacgtaacatgtttggttacactggtacatataaaggtaaagaagtttctgtaatgggttctggtatgggtattccaagtattggtatttactcatatgagttatacaacttctttgatgtagatacaatcattcgtatcggttcttgtggcgcattacaagaaaatgttaacttatacgatgttattattgcacaagctgcatcaactaattcaaattatgtagatcaatacaatattccaggtcatttcgcgcctatcgctgacttcgagttagtaactaaagctaaaaatgtcgctgaccaaatcggtgctactacacacgtaggtaacgtattatcttctgatacattttacaatgccgatccaacattcaatgatgcttggaaaaaaatgggtattttaggtatcgaaatggaatcagctggtttatatttaaatgcgattcatgctggtaaaaaagcacttggtattttcacagtaagtgatcatattttacgtgacgaagctactacacctgaagaacgtcaaaattcatttacacaaatgatggaaatcgctttagaaatcgcagagtaacttatttaaattgactttaattgctctttaacaatgcgattaaactcaaaaagccaacacattctgggcgtatccccatttatgtgttggcttttatttatattattacttatctgtagattagcttaagtaagatttaaacatccaattatgtttatctactgatgtttgcatacctataaacatatcttctgatacatcatcgccagcattaccagcaatttcgattgcgttttctaattgttttgagatatttgtgaagtcttgtgataattcttcaaccatttgttctgcagagtaacctttcgcagcttctttaacaattgattgctctaagcattcagttaatgtacctacagggtttcctcctaccgctaaaattctttcagctaattcgtctacatattggcttgcttcattatataattcttcaaatttaacgtgtaatgagaagaagttaggccctttcacataccagtggaaattgtgtagctttgtgtaag

SEQ ID NO: 444 - DNA, 11466 bp; double-stranded, linear
gaagatgaaagctatattgaagatgatgttactaaaaaggaagctattttaagtatgcaaattcctaaaggtttctctcaaaaattaaaagagaaccgtttaaaagaaacgatacagttatatggtagagatgactttataggtggtattgctgtagaaattgttagtagttcattatatgagcagcaaattcctaacattatttatgaacaccttgaggatatgaaacagcatcaatccatcgatgctatcaacaagtcctatcataaacatacacctgaatctaaaatcaaatttgtgtcgcttactaaacaagcacaacactctatttcaattagcttaatctttgcggtgattttatttgttagcgctgttcaagtagtacttcattatcgtttaaaccaacaagcagcattgcaacgattatcacaatatcatttaagccgtttcaaactatatagtacttatgtaatgacacatacgattttgttattgttggtactattggcagttagtctatatttgtctcaaccactcagcttaatattttacttaaaatcactgttacttatattgatttatgagataggtatcgtctttatcttattccatattcaaacaataagtcatcgattattcatgacatttatatatgcacttgctatgggtatcgtatacttgattattttcatgtaaaggagcgtaactgatgatagaaattaataacctttcaaagcgttaccgtaacaaacagattttcaatcatttaactatgtcctttgatagtaatcgtttaaccgtattacttggtgataatggtgctggaaaatcaacattacttcgtatgattgctggtattgaaaaagctaatgatggaactatcaactatttcggcgaaaaatggaatcaaagacaaatacaaaatcacatcggttatgtgccacaagacattgcgttatttgaacacatgacagtggctgaaaacattaaattttttaaatcactttgtaaaaatccaattaacgatacaactatcaacgaatatttacagcaattaaactttgatgatacgtctgccaaagtatctacattgtccggtgggaataaacgtaaaattaatatattagtaggtttactaggtcaacctcgaattctcattttagatgaaccgacagttggtattgatttaaaatctagacatgacatccaccaactacttaacatcatgaaatctaaatgtttaattatattaactacccatcatttagatgaagttgaagcacttgcagatgatatcaagttaattggccaagatcctttttatcaacatgttttagaggacaaacaatggacttatacctatyattaaaacgaaaaaatcccaagctgcgtatgatatcgcaacttgggattttctgtattatctactttgcaagtatgacgttgggtctactgcatattgattaccgatgccaccagacatacgttggaagtgtacgtgaggcgctgttgaattacccgtactacctgaatatgcaatttggtcaccagctttgactttatcaccagctgaaacagttaaacgattattatgcatataccattggtagttattactgttcgcttctttaatcgttacttgattgccgccaccatagttactccaacctgcttgtactactgtaccatcagttaatgagtaaactggtgaattttcaggcattgcatagtcgacaccgtaatgcgcaccaccaccgtgatattgtccatatggttgtagttgtttacgacttgttaaccagcttgcgtctttcgcatgaccactagctgtcgctttacttgctgatccaccattttgattagatgtgccattaggataattgacctttccattaccatcatggctgttatacgcttggttgttgttactatgtgaataatagctcgcgtctggacctacatttgattgataaccatattgattaatatgctgttggctttgactcgctgtgtagtcattgttatctcctgctgttgctggattcacatatgtttggccgcttccattggcatttgcattttttggataacagttataaaaataatgcgtatgtccttgagcatctacgaatgtatagctatattctttattatcaaacattgcttgattccagttaccatcaggtgtgtgatgataatccccattagaatcaattgtataataagtaccataagatacgtcttgtgattgtgttgacatttgtgtatgtgcttgttgggtgtttgtcgtttctgctgcatctgcttgatgcgccattgtaaatgtagcgaasccatcgttgcaatcgctgctgctgttaattttttcatgtataaaacatcctccattaaagttaaagttagttttcaattaaactgtactgcacatactaaaagaattagacaactgagtaaaggatttaattctcattttccaactatttaatattcccgaaatgttttactaaactcattacattgtcattacaaaatagccatacattgatattaaaatgacatctctcactgcattcgtttaaccttttataaattttcaaaattaacaactaatcgttcgtccatgttcgcgattcaacgctaatgcatgatagtaatcatccatcaaatcatatcaaccaaattccattatcaatcgctattgattgtcattcaactttctaatagtgatatgcttctcaggcttaaaaatcgtcatatcttttctattaattaaatcatctgtgagctttaatgctactaattcattgctgccataatacttaatatataacgttcttgtagttaaatttattacggtctgatacatcgtatagtgattgtcagcatcatgcggacgtacaattccaatcggtatatttaccgcatctaataaataaaatgcattcattaaatccatttctttatcattgttttgagcaatgtttgctttcataaatgccattctcacaaagcgctcagttgaagtaaatccacctggcaatccaaatgtacctgcttcattgcctaaaggttcaatcgttacaccttccaataaatttgctgttgctggataaggagaaatattgatatattgtcttaaattactataatgccaatttaagtctggatgatttgttaagacaccaataggattatcttttataaccacttcaccctctttaaatgaaacttcgactgtatgtccagttgcatcggaaacatgataatgcaatggcggaacttcaccgatgtcatttaaatatacagctacaacatgtatttgggatgcttgttgtttcatatcttcaatgcttgttgtatatcccaaaatccatgtcacaatttcattttgcgtaatattcatcgcgtccgctttgtgtgttgatccatatgaactataacctcggaaatattgtgttgaaatggcaacgccatgttcattaacaccatcaccataaataaaaccttccatatctgttcctgtgccaataaagccatattgcgtttggcctgtcgtgccagtgcaagatttccaacgataatttctaggcgtcactgctggcgaaccatctaatggataatcataatccatcgtgcgtccaagaagtacttgattatttaaagtttgtattgtgaatcctgtgcacattgttctcactcctctgtaccttcatttactttaatcactttcaaataaagctgtttcacttaaacatactataaaaaatcaattatacaagcaattaattgatattcattctcaataactgtggtatgatatgtaaggaaatcatgacttatgtgtgagtgaacgatcatctatacatccgttcacttcatctcatgactttctatatttaatttttacaaggagtgacatctgtgaataacacacaatcttcaccacgcagtaatattattattgcgattatgttgtctgcattaacatattggttgtttgcacaatcatttattaatataggacctctcgttggtcaaacatatcaaacctctcctgccgtgttaaatttatctattagtttaacttccttcgccacaggtatcttcatggtggctgcaggtgatattgctgataaaataggacaactgagaatgacatacatgggtctcataatcagtatgtttgcatctcttctattaattatatcggacatcactgcactgctcatcatcggtagaattttacaaggtctatcagcagctatcttgttaccttcaacagttggcgtgttaaataatcaatttaaaggagaacatttaagacgagcgattagttatctaatgattagtactgttggtggcatcggcctagctggtgttatcggcggtttaattgcctcaaatttcggatggcaaacgaatttcatcattagtatagtcattgctttcattgccatattgcttctaaaaggcacacctgaaaaagtaagtcaacatagccaccgtcatccattcgattacaaaggtatgtcgattttcgctgttatgattggtagctttacattattgttaacacaaggattcgaacaaggttggtttagtacattttcaatcatttgtctgagcatttttatcatcactacgttgatattcatcatcatcgaacgtcgacatgaagtaccttttattgatttctcagtattacgcaaccgtccgttcattggtgcatttttaaataactttgttttaaatagcggtctaggcgtaacagtggtctttttcatatatgctcaaacacaccttggtttatcagctgcgcaatctggacttgttacattgccatatgccattgtggcagttgcgatgattcgtttaggtgaaaaagcaacattacgtttcggtggcaaattgatgctcatcattggtccgttgttccctgtcatcggcatcactattattagcatgactcaattattggcatcacaatatgtcattgcagttatcattggtttcgtcatatgtgcgataggtaatggtttagtcgcaacacctggacttacgattgcaattttcagtatgcctaatgaaaaagttggtttagctacaggattatataaaatgagtggtacattaggtggctcctttggtatagcactaagtactacagttttcagtatgttacaactaaactatgcaccaagtgtagctgcaaccgtaacatttatagtcagcattgtattgatgatccttggctcattgtctgcatacatgatcattccaaaaacagttaaatcttaaatataatagaagaattatgtttcgaaatatctttatcactttaaaatgatatacaagaaatccaagaaaaataagcgaactgaataaataaagattcaattaacgcatcagtattaggattcactctaaaacgattaatagttttataagaaggtgtttgatcttgagctaaccacatcattcgaatactgtcatgaagtaatttctctattctacgaccagaaaatacagattgagtatatgcatataagatgatttttaacatcatctttggatgataggatgttgcgccacgatgatgtctgaattcatcgaatttgctatcaggtatcgtttcaacaatttcattaacatgtcgcgaaatatcattttgaggaattctaacagaagtttttattggtagtgtaagttgggcaaagtgtcttatttttttaaagtatttcaaagtaaaattacatgttaatacgtagtattaatggcgagactcctgagggagcagtgccagtcgaagaccgaggctgagacggcaccctaggaaagcgaagccattcaatacgaagtattgtataaatagagaacagcagtaagatattttctaattgaaaattatcttactgctgttttttagggatttatgtcccagcctcttactctaattatattcactatcaattagacaaaatggccattttcaaatatcacgcgttgtttctgaccttgaatatatttattataattctctttttgaaaatcagttaacattaatttagatgtaccgtattttaacactttttgcattgtttctattctcatttttctaaataaccatccatcttttaacacaatacgattaacagcatcatatgataattctactgtttctttaatttcaaatgtcttgaatgaaataatcgtgcacattaaaaacgtatcaccaaagtaataaacatctaaatcatcacgtttatgttgtccaactaacaaacgaccatattcgaactctttttctggatatttcaattctaaaaaactaataatctcttcttcttttaatttgaattgcatttaaaaacatcctctcttaagttttaacaagccttaattaaaaattttttcaatcacatagttcaatatacatcatttcgttatgttttttaatactttgttcaaaaacaaatattttattctttaaaataatgacttttgtatttttaatcacaataaacattttaaaattcttgttatcataatcattaaaaggtattaaccttaataatatattctctcgtctcaaccttaatcgtatacttcagacgtctgtttgtagacaataaaagtcattcacgtcttcatatgtcatcaaatgtttatcatgatatgatgaatataataatcgggtatataactgtatgattaattacacaataaagagaaggaatataatatgaaaaaagtgtcaattaaagatgttgctagagaagctggtgtatcagttacaactgtgtcacatattttaaatcataatgatagtcgtttttccgcaacaacgataaaaaacgtacatgctgtttcagaacgtttaggctatgcccctaataaacatgcaaaacaattgcgcggcagtaaaattcaaactattggcgtcattttgcctagcttaacaaatccgtttttctcagcactgatgcaaagtattcatgaccataaaccatctgatgttgatttatgctttttaacatctacagcaactgatttgtatgacaatattaaacatttaattgatcgaggtattgacggattaattatcgcacaatacatatcatccccggacgccctaaataactatctaaagaaacatcatgtaccttatgtcgtactggatcaaaatgaccatcaaggctatacagattttgttcggacaaatgaatatcaaggtggacaacttgcagcacaacatttaatagaactcggtcacaaccatatgataattgttgcaccatatgacatgatggcgaatatgtcgactcgtgtcgctggatttgtcgatactttgcgcgcgaatcaattgccagaaccacaaatcgtccatactgaattatctaagcgcggtgggctaaccattgttgatgacatcatggttcaatctgccactgcaatcttcgctattaacgatgaactcgctattggcattttacgaggactaattgaacatggcatcagtatcccgaaagatatctcattaataggttatgacgacattgattatgcagcgtacgtctcgccacctttaactactgtggcacaacctataactgatattggcaaaacatctttaaccttattacttcaacgattacagcacttagataaatccattgatatgattgaattaccaacgactttaaaaattcgtgcaacaactggctatcatctttcaaactaactacgtatcttccgaaatatactcatcattgttaggcccttagcgttgctttaatgctgagggtttttaatcataattattttactaagaaattaaaataataatgtatgaatttttaaatatgatttaaacgttttcagtttttatgaaaacgcatgcattttacaaataaaaatggtacgatggcactggtaaaacgttttactaaaaacaaatcatgaggtgtataacatgagcattgttgcattacttatcgggttaggccccttaattggctggggcttcttcccaacagtcgcttcaaagtttggtggtaaacctgtacatcaaattatcggtgctactgtaggtacgttaatcttcgctattttattagccgtagtcacatcaagtggcttccctactggaaccaatttgctattcgccttattatcaggtgcaggatggggattcggacaaatcattacatttaaagcgttcgaattagtcggctcatctcgtgccatgccagtcacaacagcattccaattattaggcgcatctttatggggtgtctttgcattaggaaattggccaggcattggtcataaaatcattggatttacagctttagtcgttattctaattggagcgcgtatgacagtttggagtgaacgcaaagaagcaagtaacgccaaaaatttacgtcgtgcagtggtacttctgttaattggtgaatttggatactggttatattcagctgcaccgcaagcaacttctattgatggcctaactgcctttttacctcaagcaatgggtatggtaattgttgcagtcatttatggctttatgaatatgaaagcagagaatccattccgtaataaaattacgtggttacaaattatttcaggtttcttctttgcatttggtgctttaacatatcttatttcagcacaacctaatatgaatggtttagcaactggatttattctttctcaaacatccgttgtgcttgctacattaactggtatttatttcttaaaacaacataaaacgtcaaaagaaatggttattacaatcatcggcttagtactcattttagtagccgcttctgttacagtatttataaaataaggagtgtagatgtcatgaaaaaatcagctgttttaaatgaacatatttcaaaagcaatcgcgacaattggtcattttgatttattaacgattaatgacgctggcatgccaattccaaatgatcatcgtcgtatcgacctagctgtaactaaaaacttaccacgctttattgatgtcttagctacagtgttagaagaaatggaaatccaaaaaatatacttagcagaagaaataaaagaacataaccctacacaattgcaacaaattaaacaattgatttcatcggaaatcgaaatcattttcattcctcacgaagaaatgaaaagtaacttagctcacccattaaataaaggtaatattcgtactggtgaaacaacgccctactctaatattgcattagaatcgaatgttactttttaaaagttataacttgaaaggagcgtacacatgaccaacaaagttgttattttaggttcaacgaatgtcgatcaatttttaacagttgaaagatatgcacaaccaggcgaaacattacatgttgaagaagcacaaaaagcattcggcggaggtaaaggtgccaaccaggctattgccactgcacgcatgcaagcagacacaacatttattactaaaattggcactgatggcgttgctgatttcatcttagaagattttaaagtagctcatattgatacatcatatattatcaaaacagctgaagcaaaaacgggccaagcctttatcactgtgaatgcagaaggacaaaacaccatctatgtttatggtggtgcgaatatgacgatgacacctgaagatgttattaacgcaaaagacgctataatcaatgcagactttgtcgttgcacaattagaagtacccatcccggctattatatctgcatttgaaattgccaaggcacatggtgtgacgacagtattaaatcctgcaccagcgaaagcattacctaatgaattattatcattaatcgatattattgtgccaaacgaaacagaagccgaattgttatctgggattaaagtaactaatgaacaatctatgaaagacaatgccaattactttttatctataggcattaagactgttttgattacgctaggtaagcaaggtacatattttgctactaaaaatcaaagccaacacatcgaagcttataaagtaaatgcgattgatacaactgctgcaggcgacacatttattggtgcatttgtcagtcgcttaaacaagtcgcaagataacttagcagatgctattgattttggtaataaagcgagctcactcactgtacaaaaacacggcgcgcaagcatctattcctctactagaagaagtaaatcaagtttaaatgaatcaaacacagctatgatatgaaggtttagcatataacatgcaacattcgtatatcatggctgtgcttttttatctttataaaacatcatctattagaaataattttccactaaacctatgcttgttgactcatgtttagttataaatgaagtgacaattttttgtaatctttttaacttccaaattatcgcatataaatatgctatattaatgataataattatcaattaaaaggaggttatgctatgtctaaagaagctggtcatacatttttagctaaattaggaaaaactcgtctacgccccggtggtaaagaagcaacagattggttaatacaacaaggggcattttcacaagataaacaagtgttagaagtggcatgtaatatgtgcacaacatctatttatctagctcatacatatggctgtcacattcaaggcgttgatataaataagaaagcattagaaaaagcacaggaaaacatttcagcagcaggtcttgaatcatatattcaagttcaacaagcgaatgctgttaaattgccctttgatgacaatcaattcgatatcgttttaaatgaagcaatgttaacaatgttacccatcgccataaaggaaaaagcattacgcgagtactaccgagtcttaaagcctgggggtatcttgttaacacatgatattgtcatcgttaatgaatcacatgccacacatgttgttaaatcattatctgcagcaattaatgtcaatgtctcaccgcagacgaaacttggctggttagatttatataatcaagctggttttaatcatgtgcattatcatactggtccaatgagtttaatgacaccaaaaggtttaatttatgacgaaggtattgttggaactataaagattatcaacaatgctttgaaaaaagaaaatcgaccaatgttttgtaaaatgtttaaaacgatgactaaattgcgtaaagatatgaattatattacttttgtcgctaaaaaagagcactaaatataatgccactaactgtactttgtatctatgtttgactatcactttaatttctttgtgacactaatcatctacttaacaatatcgttatcgttgattagtaagtcatcaattttggttaaagactttcataaacactcaaacattaacactatacatagttagtggcattattttttyctnaaaattttaacmtcmcgggrttgggamcrgaaatgrtawttcgcrmaatttawtct

SEQ ID NO: 445 - DNA, 2176 bp; double-stranded, linear
ttacatagttaacactagttaatctattagttaacattagttaataattagttaatttccatttgtattctcatgtgataaattctaaaagcatacaataaatttaatatgtaaaaagaaagggaatacacatgaaaaataaatatatctcgaagttgctagttggggcagcaacaattacgttagctacaatgatttcaaatggggaagcaaaagcgagtgaaaacacgcaacaaacttcaactaagcaccaaacaactcaaaacaactacgtaacagatcaacaaaaagctttttatcaagtattacatctaaaaggtatcacagaagaacaacgtaaccaatacatcaaaacattacgcgaacacccagaacgtgcacaagaagtattctctgaatcacttaaagacagcaagancccagaccgacgtgttgcacaacaaaacgctttttacaatgttcttaaaaatgataacttaactgaacaagaaaaaaataattacattgcacaaattaaagaaaaccctgatagaagccaacaagtttgggtagaatcagtacaatcttctaaagctaaagaacgtcaaaatattgaaaatgcggataaagcaattaaagatttccaagataacaaagcaccacacgataaatcagcagcatatgaagctaactcaaaattacntaaagatttacgtgataaaaacaaccgctttgtagaaaaagtttcaattgaaaargcaatcgttcgtcatgatgagcgtgtgaaatcagcaaatgatgcaatctcaaaattaaatgaaaaagattcaattgaaaacagacgtttagcacaacgtgaagttaacaaagcacctatggatgtaaaagagcatttacagaaacaattagacgcattagttgctcaaaaagatgctgaaaagaaagtggcgccaaaagttgaggctcctcaaattcaatcaccacaaattgaaaaacctaaagtagaatcaccaaaagttgaagtccctcaaattcaatcaccaaaagttgaggttcctcaatctaaattattaggttactaccaatcattaaaagattcatttaactatggttacaagtatttaacagatacttataaaagctataaagaaaaatatgatacagcaaagtactactataatacgtactataaataccaaggtgcgattgatcaaacagtattaacagtactaggtagtggttctaaatcttacatccaaccattgaaagttgatgataaaaacggctacttagctaaatcatatgcacaagtaagaaactatgtaactgagtcaatcaatactggtaaagtattatatactttctaccaaaacccaacattagtaaaaacagctattaaagctcaagaaactgcatcatcaatcaaaaatacattaagtaatttattatcattctggaaataatcaatcaaaaatatcttctctagttttacatcattttttaaataattttcgtaacaaaccgtgattaaaaagaaccgttgattctcaatcgaatctacggttcttttttcattttccatcaattaaatgcttcttcgctatttgtcagcccacttttttacctgcaacttgttaaataatccttacatcgttaacgaatagttcatcatttagttgaatcagctcaactttattaacttcatattttcacaaactattgcgcaatccattccttttccactacaagcaccataattaaacaacaattcaataaaataagacttgcaaagcatagttatgtagctatataaacgcctgcgaccaataaatcttttaaacataacataatgcaaaaacatcatttaacaatgctaaaaatgtctcttcaatacatgttgatagtaattaacttttaacgaacagttaattcgaaaacgcttacaaatggattattatatatatgaacttaaaattaaatagaaagaaagtgatttctatgattaaaaataaaatattaacagcaactttagcagttggtttaatagcccctttagccaatccatttatagaaatttctaaagcagaaaataagrtagaagrtatcggccaggtgcagaatcmtycaaargacacagacattactagccaacgatttagctatnactccaaaccttccattggatttggtaaaggnt

SEQ ID NO: 446 - DNA, 1557 bp; double-stranded, linear
aaaagcatggcttaaatgaagtacgctataacaaattacaagaacatgctattgttatgcatccggcacctgtgaatagaggagtagaaatacaaagcgatttagtagaagcttcaaaatcaagaatttttaagcaaatggaaaatggcgtttacttaagaatggcagtcattgatgaattattaaaataggtaaggggacgaaaatgatgaaattaattaaaaacggtaaagtattacaaaatggcgaattacaacaagcagatattttaattgatggtaaggtaattaaacaaattgcacctgcaattgaaccaagcaatggtgttgacatcatagatgcgaaaggtcactttgtgtcacctggatttgtcgatgttcatgttcatttacgtgaacctggtggtgaatataaagagacaattgaaactggtactaaagctgctgctagaggcggatttacaactgtatgtccaatgcctaacacaagaccggtaccagattctgtagaacattttgaagctttacaaaaattaatcgatgacaatgctcaagtacgtgtattaccttatgcttcaattacaacacgtcaattaggtaaagaattggttgatttcccagcactagtaaaagaaggtgcctttgcgtttacagatgacggtgtaggagtacaaactgcaagcatgatgtatgaaggcatgattgaagctgcaaaagtaaacaaagccatcgtagcacactgtgaagataattcattaatctatggtggtgcaatgcatgaagggaaacgcagtaaagagttaggtataccaggtattccaaacatttgtgaatctgttcaaatcgcaagagatgtactattagctgaagcagcaggttgtcattatcatgtatgtcatgtttctactaaagaaagtgttagagtcattcgtgacgctaaacgcgcaggcattcatgttacagctgaagttacaccacaccatttattgttaacagaagatgatattcctggtaataatgccatttataaaatgaatccaccattgagaagtactgaagatagagaggctttgttagaagggttactagacggtacaattgactgtatcgcaacagaccatgcaccacatgcacgtgatgaaaaagcacaaccaatggaaaaagcaccattcggaattgttggtagtgaaacagcattcccattattatatacgcattttgtaaaaaatggtgattggacattacaacaattagtagattacttaacaattaaaccatgtgagacatttaatttagaatacggcacattaaaagaaaatggttatgcagatttaacaatcattgatttagatagtgaacaagaaattaaaggagaagatttcttatcaaaagcagataatacaccatttatcggctataaagtttatggaaatccgatcttaacaatggttgaaggcgaagttaaatttgagggggataaatartatgcaagcaaacgttatctagtgttagaagacggtcttttacgaggctaccgttaggtctgataacttactga

SEQ ID NO: 447 - DNA, 1799 bp; double-stranded, linear
gctagaaatmttgmatgacaatacaactctgttaaaatgatggacgtagacaaatatgcgtattgacgctttattttaaaaattaacatgcttataacatgtttatagaaggagattaacctatgaactatcaagttcttttatattataaatatatgacgattgatgacctgaacagtttgctcaggatcacttagccttttgtaaagcacaccatttaaaaggtagaattcttgtttctacagaaggtattaacggcacattatctggtacaaaagaagaaaccgaacaatatatggcacatatgcatgccgatgaacgattcaaagatatggtgtttaaaattgatgaagctgaaggacatgcttttaagaaaatgcatgtacgtcctcgaaaagaaatcgttgctttagatttagaagatgacgtcgatccaagacacacaactggccaatatttatcacctgtagaatttagaaaagctcttgaagatgatgacacagtcattattgatgcacgtaatgattatgaatttgatttaggtcatttccgaggtgcaattcgtccaaatatcacacgttttagagatttgcctgactggattaaagagaataaagcgttatttgcagataaaaaagtggttacgtactgtactggtggcattcgatgcgaaaaattttctggatggcttttaaaagaaggtttcgaagatgtagctcaacttcatggcggtattgctacatatggtaaagatcctgaaacaaaaggtgaatattgggacggtaaaatgtacgtatttgatgaccgtatcagtgttgatatcaaccaagttgaaaanacaattattggtaaggattggtttgatggcaaaccatgtgaacgttatattaattgcgctaacccagaatgtaataaacaaatattagtttctgaagaaaacgaaactaaatatttaggtgcatgctcttatgaatgtgctaaacatgagcgtaatcgttatgttcaagcaaataatattagtgataatgagtggcaacaacgtttaacaaactttgatgatttacatcaacatgcttagttttaattaaatacctttcaaaacacgctttgaaaatccgatttataaaggtttttcaaggctgttttttatgcgcatacataacctgatatgtttttaattatgcgcgtgttatactaaattaaattttaatactgcggggtgtcttaaaatgcacattttagtaacagggtttgcgccttttgacaatcaaaatatcaatccctcatgggaagctgtgactcaactagaagatattattggcacacatacaatcgataaattaaaactaccaacctcttttaagaaagtagataatattataaataaaacgttggcatctaatcattatgatgttgtactagctataggacaagctggtggtagaaatgccattaccccagaacgtgtcgccattaatattgatgatgcacgtattccagataatgatgattttcaacctattgatcaagccattcacttagacggtgcgccagcttatttttcaaatttaccagttaaagcaatgactcaaagtattattaatcaaggacttcctggagcactttcaaatagcgcaggtacatttgtttgtaatcacacactttatcacttaggttatttacaagataagcattaccctcacctacgattcggatttattcatgtgccatacataccagagcaggtcattggtaaacccgatacaccatctcatgnccattgaggaaaagatnagttg

SEQ ID NO: 448 - DNA, 1341 bp; double-stranded, linear
acttggttttttattgtttataaataaaactcacttaataatgttttcataatcttcttcgactacttaattctttaagatattcgtgaaaagagacattacactagttaattttcaaacaatacaaaaagcgtctacctcctacatataattgtagcggagatagacgcttaatatttatttaaaaattattttaaaccaccgaatgtcataacatcacgggcaatcatactttcttcatctgttggaataacgacaactttaactggtgaatgaggatagttaataaatccttctttaccacgtagtaagttttcatttttcttaggatcccagtaaacacccataaattctaagccttcaagaactttcgcacgaatttctactgagttttcaccgatacctgctgtaaatacgataacatcaacaccatgcattctcgcagcatatgatccaatatatttgtgaattttagaagcaaatacatctaaagccatttgtgaacgtgctttacctgattcagcttcttctgataagtcacgtaaatcactagatgtacctgataatcctaataaacctgattctttgtttaagatttccaatacttgttcagcagttttacctgttttttccataataaatggaattaaagcagggtcaatattaccagaacgagtacccattgttacaccagcaagtggtgtgaagccattgatgtatcaatagatttaccgccatcgatagctgcaattgatgctccattaccaatgtgacatgaaataatacgtaaatcttcaattggcttatctaacatttctgccgctctttgtgatacaaatttatggcttgtaccatggaaaccatacttacgaatgccataatctttataataatgatatggcaagctatatagatatgctttttcaggcattgtttgatggaatgctgtatcaaaaattgccacatgagggatatttggtaataatttacggaaagcacgaatacccatcaagttagctgggttgtgaagcggtgctaattcgcttaattcttcaatttccttttcaacctcatcagtaatagctactgattcagggaatttttcaccaccatgtacaacacggtgacctgttccatcgatatcgttaatatcattaataatattgtgcgctttaaaagcatccaacatgatatcaactgcctcaacgtgatccttgatatcttgtactgttttaactttttccccgttgacttcaattgtaaaaattgaatccttcaatccgattctttctactaaaccttttgttactaattcctcttcaggcattctaattaattgaa

SEQ ID NO: 449 - DNA, 1529 bp; double-stranded, linear
ttttgaagatactaccgatgaaaatagacaaaagatttttcaatatttatcacctgaagaagttgcaaatttctttgatcaattagatattgatgacgatgaatatgagttgctatttgataagatgaatgcgacatacgcaagtcacatattagaagaaatgtcatacgacaatgcagtagatattttaaatgagttgactaaaccaaaagttgctagtcttttaacattgatgaataaagatgacgcgaatgaaatcaaagcattacttcactatgatgaggatacggccggcggtattatgacgacggagtatttatcacttaaagcgcatacgcctgttaaagaagcattattattggtcaaagcgcaagcaccagacgcagaaacaatatatgttatatttgtcgttgatgatgatggtaaattagtaggtgttttatcgctaagagatttaattgtagctgaaaatgatgcttatattgaagatattatgaatgaacgtgtcattagtgtgaatgtagcagacgaccaagaagatgttgctcaagttatgagagactatgatttcatggctgtacctgttatagattaccaagaacatttgcttggtatcatcacgattgatgatattttagacgttatggatgaagaggctagtgaagactactctcgtttagccggggtatcagatatcgattcgactaatgattcaatcattaaaacagcattaaaacgtttaccatggttgattattttaacatttttaggaatgattactgcgacaattttagggagattcgaaaaaacattagaaaatgtagcgctactcgcagcgtttattcctattattagtggtatgtcaggaaattcaggtacacaatctttagccgtttcagttcgtaacattacgacaggggaaattaatgagcaaagtaaatttagaattgcattaagagaagcaggaagtggtgtattatcgggtgttgtatgttcaacaatattatttacaattattgttgcaatatatcatcagccacttttagcattaatcgttgcaggaagtttaacttgtgcgatgacggtggggacgtttgtaggttcgatgattccattattgatgaataaattaaatatcgatccagcagtggctagtggaccatttattacaacaattaatgatattattagtatgttgatttattttggtttagctacatcatttatggcttacttaatttaaggaggagttatggagtttttatctttagttattgttgttttagcagcgtttttaactccaataattgtcaatcgattaaatattaatttcttgccagttgttgttgcagaaattttgatggggattgtgattggaaattcatttctaaatatagtagaaagggattcaattctaaatattttatcaacgttaggctttatctttttaatgtttttaagtggtttagaaattgattttaaagcttttaaaaaagataaacgcgcacgtcaaggacaaaatgatgatg

SEQ ID NO: 450 - DNA, 1827 bp; double-stranded, linear
ttctggaaaccaaagtattgtcatcttctactagtagtatnggcatccatatcacccaatatcatttagtatatttcatattttctcctgattttaatcgactttgaaaatctttaatccggcagtcaacttcaaagccatgaatcatcattttttgcattggtgcttgtataaagtaataaatcggccaaaataatcgagggatataatcgtatagatgtatataaacgactgccgactctttgattaatctaaattctaacttcccttgattaactgtatattttttcactaaacttccactcaataaaattaaagttattattccatcagctgtttcttctattttaaatactgcgagcggtcgcaccttattcttaatatatatcttaaattgatcatgtgatttttctgttttcacaaaagttcctttagtgtaacccatccatgcaataaaatggtttacaacgttctttaatgtccatccctttggtaaaactaccttcatcgttgatctaacatcatcatactttgaaacttgtaattctacattaactaaagaacgtttaaaaactaaatttgttgtttctacaggtgtaccatatgcacctaggcgttcaattgtttcattatcataacgactcccaggtatgtagattactttttttacttgattgatagccgctgctcgaccaaaattatctgctgcgattaatgttaaatctcttgctgatgattgtgttattttggcagaattctttgttgggtcgataaagaatacagcaatatctatttgattcattgctgcaacaacctgttcgtaatgaaatatatcacactgaatccaagtcatttcaacatcatctgtttktttattgtctggatattttgatatagcaaaaagttcagcatcattttcaatcacttcacttaaatacttaccaatatatcctgttccacctgctaataaaactttaggtttcatctaaaatactcctttaaactgtaaccaaaaaacatattactccaccttttagttacatatatattataatagtagcaaatgttttaaaatttcaaaatactggaggctttttatggcccatattatacgtagagttagtatcaaagatgtagaaaatttcatttcaatgttagcgaacatatacgacgaatctccgtatatgttctacacaccaggagaatatgatcctagcgtcacatcggctagtaaacaattagaagaatatatcacttctccgcataaagtcatcttcgttgctgaaagtgatgaacaactcgttggctttgcctttgttaatacgacaccatttcaacgcattaaacatgttgctaaaattgatttaggtgtaaagaaattatatcaacatcgtggaattggccaagcacttcttgatgccattatggcttggtgtttaaacaatcaaatacaccgaattgaagcaaatgtaccactcaataaccaacctgccctcgagctttttaaaagtgccgattttcaaatcgaaggcgttttaaaagataagttatttatcgatggtaaatattatgatgactatatgatggctaaaattcttaattaaagctattttatcataatcttgtatcagaatcgtataacaacgaatttaatggttacctaatacattactcatacttatcaatgttatctaatctcaaataaatacgtacactcttattcatttatcaaatttaaattcaaaatanaacaccactaatgtgtaattgattaactatcaactacgattagtggtgctttatatatgtggttagttttcctnacta

SEQ ID NO: 451 - DNA, 616 bp; double-stranded, linear
atatagattaatgtttgttatttgtactgtgtttgccagtgacatttattataaaacatatgacgttattctatgktgtactcattttctatattgtaggtttattaacgattagaagtattattaaaaagttgaaatatcaggaaacattattacgagactaaaaaacttccattggcatgtatgttgtaaaggtgcatgtaatgttgaacgccaaatgatacggcgttcagattacattagcatctatacgttaacagcataaccaatggaagttttcttcgaatctattcttttattgggtatagatatctttcaaaataacttgaatgttgtccgcttgaaccaaagtaatgacttaatgcgtcttttgaaaaatggtcattaaaggcatcagattgcttaaagtcttcgtatgcatgtcgatcagcaaatccgaaataaattttgtatgttgtacctttagcaggtcttaacaaacgatagcttttaaagccaccaaagtttctgaaattatcgtctacactaatcagtttcttttcaagttgatatgcatgatcttctgttgatggaatgaagattgcacaatagaaatgatgttcactgaattcaccaa

SEQ ID NO: 452 - DNA, 944 bp; double-stranded, linear
gcacgagtgattaaacggttaatcaatgaaacatttgatgcaaattacattgaagttattgagggaggaattgaagaaacgcaaacgttaattcacttaccttttgactatgtcttctttacaggaagtgnaaatgtaggcaaaatcgtttatcaagctgccagcgaaaatttagttcctgtgacattagaaatgggcggtaaatctccagtcatcgttgatgaaacagcgaatattaaagttgctagtgagcgcatttgttttgggaaattcactaatgccggccaaacatgtgttgcaccagattacattttagtacacgaatctgtaaaagatgatttaatcacagccctatcaaaaacgttgcgtgaattttatggtcaaaatatacaacaaagtccagattatggccgcattgtaaaccttaaacattatcatcgtctgacttcattacttaacagtgcacaaatgaatattgtatttggtggtcatagtgatgaggatgaacgttatatagaaccaacattgttagatcacgttacaagtgattcagcaattatgcaagaagaaatttttggtcctatcttaccgattttaacgtatcagtcattggatgaagcaatagcctttattcaccaaagaccaaaacctttgagtttatatttatttagcgaagatgaaaatgctacacaacgtgtaataaacgagctatcatttggcggcggcgctattaatgatacattgatgcacctagcgaatcctaaattaccatttggtggtgttggtgcctcaggtatgggacgctatcatggtaaatattcattcgacacttttacacatgaaaaaagctacattttcaaatcnacacgattagaatcaggtgtccatttaccaccatataaaggtaaatttaaatrcatcaaagctttctttaaanattaatt

SEQ ID NO: 453 - DNA, 4820 bp; double-stranded, linear
tctccagtagaccttgtgtatgaacagtttctttcatatgaatgaacatcgtttttaaagtttgtttcaactcagccttatcaggataatatctagagacagtcgtctctggcatctccattgtatgatatttaaccttatgcagcgacccatgattttcgttataaacaaatgtatgattcacttcatcgaaatcatgatcttctcctgcaatccaaaaaactggtactacttgttgcttatgtgtatccgttaattccttagataaagtaatgattgaaaatattttatggaatgtatacaatggtcccccgaaaagccctgcttgttgtccaccaatcacaacttttgaaccattagctaaatgttgtatgtttaattcttgttcacttgaaagcttgaaagctttaaatcactcatatattcacgaataacattcgctaatgccgcttctcttccattattttctttagacatccttttttcaaaactagtttgttgagctgcatcatattgaaataatcctgttattacagggtcactgctctttatttttggtataaactgatctttttcatttaaactaactactttacagtccatgttttttctccttaagtacgcgattacaaactatagtataaagtctataccggtgattgacaattttacggcttgaaaatcaatttaatcatggaaaatttataatattcattgttttacattttcaaatcaatgaaaaacacaagtggtttaatgtataataatagtagtaaacaaataaggggtagataaatatgagtgaaatcaaacgtcttgaaattaattacaaaactgacgaattattcgaaaactttagagcgtttggcaacaaagacttatacatggtcaatgagttaaacggtcaaatgattgatgcaagttcagattcaccattttatggcatatttgtcgagatcaattaggagctagaatggcattactaaaaaaaggtgatgtcgaagaaatctacttcccagattttgaagattatatattattatggaagttagaagtattaccaaaatatcaaaacagagggtacgcttcagaattgattgattttgcaaagagtttcaatatgccaattaaagccattggcagaaatgattctaaggatttctttttacatcatggatttacagatgtggaagctaaaaatatagagggacatgatgtcttattgtggaaaccataagataataatattcgacactacgagcatgaaaatgcatcttttcgtagtgtcttttttacaattactttcttaagctaatataagtaaatcattttcaaattatttgtcttaacgtacaatatcatttagttgtttccatgrattaatttcataatcaggtataattcctggattatgatcaaatcctctaaaattaaaccagcaagtagctatacccgcattgattccacctagaatgtcagatgttanagaatctccaactataatcgagtgctgtctttcatcctcaccaatatcattaaaaacataattaaaaaattccggattaggtttttgatatcctgtttcttcagatataaatatctttttaatatatttatgcaacggcgtctgatttaaccttctcttttgcgtttcggttacaccattagtaacaatatataaatcatgtcttttcgataattcgacaattgtttctaatgtttgatcaaagtatttaactttagcttctgctaatccatttctaaataacacatctgcacgatgcccatcaacttccatttgatgatgtttgaagtaattcacaaatcgttctgataatacttcagacttcgktaatttattttgktgaaaagcttcccaatgttggtgattgatttttttaaatgktaaaaaatcatccyttgttgctttatgattaaaaacattcgccatatagtgaancgcccattcttctgcatcataaaaatcaacaattgtatcatcaaagtctatcaaaatatttttatatcccaatttccccatctcctatattgtctatgtatctaaatcttaacagaggctcaaatttctgcaaataaaataaactgagtgcataacattaaagtatgctcacccagtttattttaaagaatattagttattatattagaatccaaataatttacctagtaaacccacaccgttagcaacgatgtctacgatacttgtgcctaatttcacactatcatgttgttgtgcagcttgcacagtatttgcgattgcttctgctagtccagtcatttaaatctctccctcacctttgaaataatactgattacttacataacatattgaaattagaatccgaataatttacctaataaacctacgccattttcaacgatgctcacaatgcttgtgcctaattttgcgccatcattattaattgctgcagttacggtatctttaattgcgttaaataaaccttccattgaaaacactccttaaaatttaaatttgaagataacaaaaacgtgcgtagyttttaaatcaccgaaatgttattcgcttaacgttttgttgttgttattttaaaataaatttgatgcaattagtttgtttatccgcacaacatcttataatgtacttaactgtattttaaagagaaaagaaatacagttaggcattcaaaactgtatttaacacaattaagttgcctgaattcgtatttaagtcttattgaacctttttagataaatagctctataatagtgaaaaatataaacattttttatttacaaggtattgctaatttaagttcatttagatataataattcttgtgttgttaaacgtgtcctggtagctcagctggatagagcaatggccttctaagccatcggtcgggggttcgaatccctcccaggacgtttataggtatttttatacgcattaccaaacaaaagagttccgtgattacggggctctttttgttttgaatttcagtaatatagtatgatgcgtcaccaaaacgtcccccgcataagccccgaaaatacagtaattaaaacaagcatgcttattcgttatagaattttttgacacacaattgacacgcgtctgacacttgtttatacatttttaattaagtaattttgtgctcaaatttcatctatactgcacctgaactacaccaacactacaccaagatttttaacactcaccatttgcatgcgtagagatttttattattatattattcctatagattttgatactattcaaaattttagggacttttcaggggcccgaaatcctataattataattatatacatctaaaaaaaataaccacgtccatcgagacgtggttttttaattatttaactcactaattattcttcttaattttcattgctaaatatactattggcaaatttataaagtagttcagcgtttttcaatgacatattgtctaatgatctttcattttttctcattctgtgtattgtgctttgtggaactcctgtttgtttcgatatatgtaaactgctcaaatcactgtctaatagtttttgaatttgatttctcattttgtacacccccttgtaaatcttcaatcatcatttaaattaaataattacttttccacatattccaatatttaggttgcaaagcatacctcaaatatcattaattttgagatttaaatgtcaattatgtgtctatcaatccaatatacatactctaataacgtaatagtacacactcttcttattaattggccatagctatcatgatataattagtgaagaaaatcacataagaaaggttgtaaatcatgagacttcaaaaagcacctctagtaacgtcaggactagtcttaggattattaggcctgggtaatctattaaaagacttatctcttactttaaacgctgtttgcggaatctttgctttcttgatttggattcaccttttatgtactatgatcaaatattttaataatgtgaaagaacaattaaacagtcctctagtttcatcagtgttcacaacatttttcatgtctggctttttaggtactacttatttaaatacattttttagtaacataacttttatcaatagcttaataacgcctatttggattttatgccttgtgggaattatgacgcatatgattattttttcaataaaatatttaaaagatttttcacttgaaaatgtttatccttcgtggactgtactttttattggtattgntatcgcaggattgacggcacccgttagcggatattttttcataggtcaattaacagtaatatatggctttgtagctacttgtattgtcttacctatagttttcaagcgattaaaagcatttccattgcagacgtcaatcaaaccgaacacatcgacaatttgtgcaccattttctttagycgctgcagcatatgttatagcttttcctaaggcgaatgcttttatcgtaattatatttttactattagctcaaatattttatttttatatcattatacaattgcctaaattactaaaagaacctttttcgcccgtattttcagctttcacattccctttagtaatctcagcaactgctttaaagaacagtttgcctgtacttatgtktccagacatttggaaaggkcttttgtttatcgaagtgttattagccactgtaatagtacttagagtctttataggatatcttcacttctttttaaaaaaggaaaaacaagataaatttctncgtaatgcgtctcagtaacactattaccaagaattaacacgtatatttaata

SEQ ID NO: 454 - DNA, 4358 bp; double-stranded, linear
atttggatctttaatatcaccaatatttttaatatcttccggattcaatccatatacttgtactgtatctgagtatttaattgtgaaataatcacctgatttaactttgtcatcaactgtaatttgtgattttaatgataaataatcttgggctggtacgattttattgtttttatctgcatcaacgacagttaatgttgtatttgatgtgattaaatcattaacatttttagcctctgttgatgatggctgtactgctgctatacgcattcttgtattcaaacgtttaggtgctgtactttttggcaaaatgatatctgcattattttcattatttgaattactattgttatcaacaagagtttcatcattactcttgatagcatcacttttaacatttaatgtagttgattcagttttggcatctacctttttgttttcctcattagttggttgaacatttaccactgatttattctcttgcaaatcaggttgtaacgcttcttgattacttatagtttgtttagtgtttaaatcttcattcgtagattttggtgaagcttgctcatctgatttggcagttgaaacttcaactttatttccagtggtagattgtacactttctttttctattaatttattcccatttgaagtcgtttcattaccttgagatgataccatttctttttgattatcatttttagtattgtcttcttgatttagttgctgcatatcaactttatcactcgattgattatcacttgctgaagttgtcgctcgttcaattctttattagtactttctgcagcctttgcttcttggttccccagaccaaaaattaatgttgtacctactaaaattgatgctgttcccactgtgtactttctaatcgaaaatttatttaatcgattggataccatgcctttccttgttattgccgttttattttctctgtttagcattagattactcctaattcatcaaatttttaaataatacaattgttttaaatacaaaaatgtatatcaatatagtattacatttttagataaagcacaatactttaattatttttctttatcgtaaaacgttatttaacatttgtgtttaaataaaagtttttatgagttttgtaatctttatttaatcatcataaaaaatagtattatttgcccttgaaattaatatcttagcttttctaattcatagacaattacatttctgtaacaaattaaattgtatctattccttaaagattttttgttttatatctgggaatttctaaacagaaaaaaccaggccacatggacctggttaagttaatcatattatttattttgttttttacgacgaccgaataacaataatgatcctaatgccgcgaataatccaccgaataatgtgccattatttgaattattattttcactacctgtttctggtaatgctttagctgttttatgctgatctttaaccgtactcattggtttagccggagtatgtttacctgcatctgaatctgaatcgctatctgaatctgagtcgttgtctgagtccgaatcgctatctgaatctgagtcgctgtctgaatctgaatcgctatccgagtctgagtcgctatctgagtctgagtcgctatctgaatctgaatcgctgtctgagtctgaatcgctatctgagtctgaatcgctgtccgaatctgagtcgctatctgaatctgaatcgctatctgaatctgagtcgttgtctgagtccgaatcgctatctgaatctgagtcgctatctgagtctgagtcgctatctgaatctgagtcgctgtctgaatctgaatcactgtctgagtctgagtcgctgtctgagtctgaatcgctgtcagaatctgagtcgctatctgagtctgaatctgaatcactgtctgagtccgaatcgctatctgaatctgaatcgctatctgagtctgagtcgctatccgaatctgagtcgctatctgagtctgagtcgctatccgagtctgaatcgctgtctgagtctgagtcgctgtctgaatctgaatcgctatctgagtctgagtcgctgtctgaatcgctgtctgaatctgagtcgctatctgaatctgagtcgctatctgagtctgaatcgctgtcagaatctgagtcgctatctgatgtttcttcttcgtagtagccattatcaagtgtgaaatcatcatgatccgtaattgttacatcaacttcgccaccatcggcatctttatcatcttcagttgtatttgtacctgtttgagttaagccagcaggtttttcaaagataactttgtatttaccactatctaaattatcaaagcggtatttaccattttcatctgtytcagttgtaccaattacttcgcctttttcgttttgcaaagtaactttaacacctttaattcctttttcagtcgaatcttgtttaccatctttattactgtcgtaccaaacataatcacctaaactatattttggtgttttgtagaatccactatctaatgtcatgttgtcagcgtctttaatgacacctgttgtagttagtccatcagaatctacagcatcatctgtacctacatttgcagttgtcggtgtataaccggctggtgttgaaaactctacactataagttccattgcttaaaccagtgaactgatatttaccattttcatctgttgtcgtacgatctaattctttaccgttactatctttaagaatgacataaacacctttaatccctttttcattggcatcttgtttaccatctttatttgtatcttcccatacatagtcacctagattatatttcttttggtcgccattagcagttgatgagccattcacatttgaataactatttgaccaactatatttagttttgtcagtgtctaaagtataatcaatttttccattatctgttgaactattatctggataagcaacttgttgaatgatgtattgtttattgctgcttgtttggcctttcattaaatcgactgtagctgttttattatcattactataaataacatcgaattgatcagtaacatctttaagttttgaagtatcaggggtgaaactatccacaaattgattttgatctgtcacttcgtaaattttgaagttttttgcatttggattaaatttatatccagttaaattagtaacaaacgtttgtttagtatatgtatttttaggttgatttacatatgcagtcatattacgcgataaatcttcattgttaatatagtttgtacttgaaataagcggttgtgcttttttattaccataatcgacaatgatttcttcgctatatgtatcattacctaaagttacttccattttataagctgttttatcagttgttgcatttttacgtttcgcaaatgcaacttgttcaaagctacctctaacatttgtatattgatctacatagttcgtaaaagtatatgttgttgtgtttgttgtactatcataaataccttttgcaataatattaccttgggcattatataaattttgagtttgtgaaggtaatcttactgatcctggacggaaatattgaccatatttaaaagtaaatgtatcgccctctttaacagaatcatcgattgtgtaatttgcttttaattttaaaacatcacttgaagttgcccaaaattcagttttaccagtagtctgattaacatgtcctttatcaatcgcaatgtcaatatttgaaaaatgtactttatcattaacatttgttccttgttgtggagctgcaacagtattcactgccatgcgatttaaagttcttggtttaatagtcgttgttttaggtgtagttgaaacatcttttgcttgtgttaaattacttttatcagtttcattactatatgtagttgatgatttatcatttgttgttacattgctagtttttgtagtagattgattagctgtagcgttttgtggtgattgcatgttactactagtttctttaactgttgcactatcactcattgtcactttaggctgatctgcagttgcagtttgcgtattgtcttttagttgacgactatcaacttttttagttgttttattctcacttggggctgtcgtttcattttttgattgatttaattctccattcgtatgttctgccgctttagcttcatgaccacttaacccaaaaatcaatgttgtccctactaaaattgaagcagtacctacagaatactttcttatcgaaaatttgtttaatcgatttggtatcatgcctttnctatttgtngctgtctttttataattcatttaataatactcctttaaaatatcaaaatttgataaatataa

SEQ ID NO: 455 - DNA, 1060 bp; double-stranded, linear
ttgacttcttaattcagcattttctgcacttaatgctttgttctttttaataagttgctttcttgcataaacttcggtatctattttactattactatacctttgatttaaaactaatataccaattaatgctacaatgataatgataagtacaacataaaaagacattttttcaccaatcctttttgacttctttaactttgtatacaataataattaataaagattaattgttattcaatttcccacatttttattagttgattttagttcatcattgttataatcaaattataaactgacagatattgatgttcaatgaatatgacgtgaaagattcgtgaattcaagtttatgtcgaatttatgttataacggtcatttaaatgacagaattaggtcactcatagtattttgaagattgaattcattaattttaaaatgtataatgatatttgtgaaagcgcttgcttaggaggtgtatttgagagtgaatgaaatgaatgctaaagaacaattagtggacaatttaatgaaaacatcatcgcaattatttaaatttcacggtgaagttgccatgcagcttttcttaaatgatgaattaaaattaccttctattgttgaaatatgcgtggaacgtaagcgtttaagtgatattgtgaaagttattccgcaatcatatgcgttactatacatagataagcaagatcaagcaatagctaaagaagatttatcactttcaaaaattgcaaaagtttatgtgcaatatgatgatacaacaataatgagtattttcgtttatgatgtagtaaacgatgaatggatttttagattggatccgaatatacgtatacctaagagtaacatatacttccatagtttaaattgggatgtggatatattaaaccggagtcgtctaatgtatgtctaatgcacaccatcagatcatcattatccattataacgrgcatagtgcataanyactwcattttattaaattgagaggggcacgataggtgcatcaggacataatataggaagcatcaacgcgtgancaggtc

SEQ ID NO: 456 - DNA, 1262 bp; double-stranded, linear
ataatnactaaatacnaaagtttaactgtcttactaataatgactatgttataattttaaaagtgatattttgggtaatcgctatattatatagaggaaagtccatgctcacacagtctgagatgattgtagtgttcgtgcttgatgaaacaataaatcaaggcattaatttgacggcaatgaaatatcctaagtctttcgatatggatagagtaatttgaaagtgccacagtgacgtagcttttatagaaatataaaaggtggaacgcggtaaacccctcgagtgagcaatccaaatttggtaggagcacttgtttaacggaattcaacgtataaacgagacacacttcgcgaaatgaagtggtgtagacagatggttatcacctgagtaccagtgtgactagtgcacgtgatgagtacgatggaacagaacatggcttatagaaatatcactactagtttagctctcctagatgatggagagcttttttcatgaaaagaacacttaaaattaacgccytgtcttgatataatgacactgccttgttttaaaatagtaagcggatgcgttaatgtatcagcgattaaatttgttggaaatgtataaaaaacacaagctaagaataaaatacctgtataaaaggagaatcatatatgtttcaattacttgcagtttgtccgatgggattagaagctgttgttgctagggaaattcaagaattaggctatgaaacaaatgttgaaaatggtcgtatattttttgaaggagacgcaagtgcaattgtaaaggcaaatttatggttgcgcacagcagaccgaatcaaaattgttgttggacgttttaacgcaacaacgtttgacgaattattcgaacaaaccaaagcgctcccttgggaatctataattgataaagagggtaacttcccagttcaaggtagaagcgttaaatcaacactacatagtgtgccagattgtcaggcgataactaagaaagctattgttgaacgattacgtcgcgcatataacgaaaaaggttggttaaatgaatcaggtgccaaataccctgttgaagttgccattttaaaagataatgtattattgactatcgacacatcaggttctggtttgaacagacgtggttatagattagcacaaggtgaagcaccaattaaagaaacgttggcagcaagtttaatccgtcttgccaaactgggaaaggtgattacacctttnaattggtcccatttgcggttcnggttaca

SEQ ID NO: 457 - DNA, 1142 bp; double-stranded, linear
cctggctgctttatcagcatctactactttaaaaccgaatacggataagagttctgatactgttgattttcctgaggcgattccacctgttagaccaataactttcggcataatttcactctttctttatttttgacatactggacaataatgactatttcttgtcgcgatgatttttgtttcaatttgacttccacacactttgcataccggctgcttatatacattaagatgcaattgcatctcaccagtttttccatcagcatgacgataatctgaaatacttgtaccgccatatttaataccttcttctagtacttctctaacataataaaaaaccatttcttgttgttggtgtgttaagtcttttacttttttatctggtaaaacacctgcacgaaacaacgcttcacatgcgtaaatatttccacaacctgcgattactttatgatccaaaatcacttgtttgattggtttattcttattagactgttgatgaattcgatttaaataatacgtcaatgcttcatttgaaaaaggttcaggcgctatttctaaaaatgaaggataagatgctacagacgcaacatttctaatttctccaaaacgacgtatatctgaataaattaactttttgtcatttgacaactcaaaaataacatgccaatgcttacgataattaggtatcataatatcttcaagttcatctacaatgaaaaaaccgcccgccatacctaaatgactaattaatgtacgttgttctcgtttattatctagctgaaaaacgatatatttacttcttcgttctacatttgtaatggtatagccttccgataaagttttaaaagtatctaattcaattccttttataattgtttccttgccttgagctttaccttcgattactttatccgaaaatataacgtgttcaattttttgatttataacgtagggttcaattcctctttttacatgttctacttctggtaattcgggcataccattaacctcactttattttgcatcataccaggttgcaccataacttgagtctacttttaatggaacatctarttgcaatgcattttccattakctcttctacaaattcactaaatgaatctacttctgacttaggtactt

SEQ ID NO: 458 - DNA, 1814 bp; double-stranded, linear
cctttagtaaacaatccttctttagttttagtacgttgttccaatccaaataatttgtatttcattgcctcgcccgattgagtgccgctaaagttatcatctttcatgttaggcgtgttggtaaacatgtgtatatcactgtttaaacggtctttataagcttcggtaccttgtacatcgtattgcttataaatataaccaccatcaacagagccttctgtttctctaccttcgctatcagcataaacagtcggttctaaaaacaacacgttagcttccttttgttttctaacttctacaggatctaaatttaaattacctttaataagtaacatagcgtcatttaaatcactcatatagttagcasymyctgattcagcattatcatacaaatcaattaaagtgattactttctcataatccccttttcttctttcgttgttgctaaattctgtaataggcatacgttcgaaagagtgtgattcaaaaccgttttcacgtggtgtgagcttcaatccatttgttctactggtaagatatctataaacaccgtgtgaagtgaataaatcaactgtaaacacttcatcttcgtcagtcttgtctattggtttagttcttaaatatctaacgcctgcgatactattacgttcaattgtattgtcgtatatgacaaaagtactcattgcatcactcttgtataaacgcgtttcatcatcttggtttctaatcattaactcataagctttgccataaattgacaaatctaatcctaaagatctattgtgtgactcaacatcatttaaatcattgaacgcctcaataacttctaatacatctttgtcatcatcttgatattgaattggattacccaagaaatagccgttgataaaatcgctaatataagatgcgtaatcatgcgctacacggttatctgccatgtactcttctttgcgtcgtgttaactcaactaagttcttagttttaccttcgtaataatcacttaacactttcaatctaggtcgttggtaatccatgtgatgttcaatgtatttacttacttcattaacgttttgtaataaatcggattccgtcccgtcatatgtgtaaacaacattggcttcatcattaaataagtaatttatgtttccccgtagatctgtatctgtttcaaattcgtttacttttaacatttgttccctcctataatcctagagattttattgtgtcaactttcgaactgagatttgtgcgttttctaaccggtctgtagaatcgttccactgaataacgcaacgaatcgatacaatgattgtatgtatctactggttcattggtatattcacctgtatctttgtccttttgccatgtgtagttgtcaaactcttcaatagtcttgaaacaacgttcatcaacaatgatttcaaattgcattaagaattgtaacccttgtacaaccgagcccttcccttttttggttggtaaaatccttttaagccctagattccttaattcagctatacttttttgttctgcactatctgctgtaatttcttctttagcataaccaagttgctttatgacattagctatttcatcattcagcataccttgtttaacatactcttcaatgatgtataacttctttttctttacatctattttagaatgtataaaagcactaggatcattaacgtagccaaagtccaatccaaaataagaaggtaaatgtcttaactcatctttatttattaaacgtttttcatacttagggaaaaccaatttgtctagtgtagcaaattcacctaacgcataaa

SEQ ID NO: 459 - DNA, 686 bp; double-stranded, linear
aattnagattattaccctcctttaaaaatatttgtttcacaattttttattacctatttactggtttcatgtcttatggggcattttacttgttggtatttgaaaatgtgcaaaatttaatcttatatgtttcttggcttttcatgactatgctatttatgtttatgaatatgcattcaattatagataaaaaagtacatatattcttaaagtctaataaatagttacaaatttagttagttttcaattgttaattaggggtggtaaacagtgctttgtgaatctagacaaatttataaaaatcctaaatatcgagttattagatataataatgaatatttcatggtcgatttagtaagtacttggattacttattttttccctatgattaattggtttttgcccaaaaaatacgcaaaaattagcgaaaatgaatttgaaaggttaaatatagtcgagcctgttaaaaataatgttttttggccggttgcaggaagttcagttctatttggaattatattgagaaagtacggtaacttctttaatgttcagtttgaaaaacaactagcaatcactgtattttttatcatgttaatagggatgttaattttttatttttatctaaataaaaaattaacattaaaaatttttaataccaacgtgggtaataagaataggagttgtat

SEQ ID NO: 460 - DNA, 1300 bp; double-stranded, linear
atctgcaattatgggcacacccaagctnatgcaagtaactaaaggagaagtacttttagacggtgtaaatattttagaattagaagttgatgaaagagcaaaagcaggattattcttggcaatgcaatatccatcagaaattacaggtgttacaaatgctgatttcatgcgttcagcaatcaatgcgaaacgtgaagaaggacaagaaatcaacttaatgcaatttattaagaaattagataaaaacatggattttctagacatagataaagacatggcacaacgttatttaaatgaaggtttctcaggtggagagaagaaacgtaacgaaatcttacaattaatgatgttagaacctaagtttgcaatcttagatgaaatcgattcagggttagacatcgatgcattaaaagttgtatctaaaggtattaaccaaatgcgtggggaaaactttggtgcattaatgattacacactatcaacgattattaaattacattactcctgataaagtacatgtaatgtatgctggtaaagtcgttaaatctggtggtccagaattagcaaaacgtcttgaagaagaaggatatgaatgggttaaagaagagttcggttcagctgaataatcttattaatacagtatccatgagatgttcatctatatatgatgaaaatgaacatttatacgaaatagtaaatttcatcaagtaggaggaaaaagttatgacaactgatattttgracattyctgaagaacaacttgttgattattctaaagcccacaatgaaccttcttggatgacagaattacgtaaaaaagctttgaaattaacagaaactttagaaatgccaaaacctgataaaacaaaattaagaaaatgggattttgattcttttaaacaacacgatgtaaaaggtgatgtttatcaatctttatcacaattacctgagtcagtaagagaaattattgacgtagatcattctaaaaacttagtaattcaacataataatacgattgcgtacacacaagttgatgataatgcatcgaaagatggcgttatcgttgaaggtttagcagacgctcttatgaaccatagtgatttagtacaaaagtactttatgaaagatgcagtaacagtagatgaacatcgtatcacagcgctacacacggcattagttaatggtggcgtatttgtttatgttcctaaaaatgtagttgtagaacatccagtacaatacgttgtgttgcacgacgacgaaaatgcaagcttttataaccatgttatcatcgttactgaaga

SEQ ID NO: 461 - DNA, 3135 bp; double-stranded, linear
gacagcaaattcaagatacattaaataaagatattgtcataaagcatattcttgttcgagataaatctaaaaagagaccgctaaatattagccaatatcatttaactgaagatgttaatgaaattttaaatgatgattcattagatattatcgttgaagtcatgggaggaattgaaccaactgtagattggttaagaacagcacttaaaaataaaaaacatgttattaccgcaaataaagatttattagcagtacatcttaaacttttagaagatttagcagaagaaaatggtgtagctttaaagtttgaagcgagtgtagcaggtggtattccgatcgtaaatgccataaataatggtttgaatgcgaataatatttcaaaatttatgggaattttaaatggtacctctaattttattttatctaaaatgactaaagagcaaacgacatttgaggaagcacttgatgaagcgaaaagacttggttttgctgaagcggatccaactgatgatgtagaaggggtagatgcagcgcgtaaagttgtcattacatcatatttatcatttaaccaagtcattaaattaaacgacgttaaacgaagaggaattagtggcgtaactttaactgatattaatgtagccgatcaactggggtataaaattaaattgattggtaagggaatatatgaaaatggcaaagttaatgcatcggtagaaccaacgttaattgataaaaagcatcaattagcagctgtagaggatgaatataacgcgatttatgttattggtgatgccgttggtgacacgatgttttatggaaaaggagcaggcagtttagcaacaggtagtgccgttgtcagtgatttattgaatgtagcattattctttgaatcagatttacacacattgccaccacattttgaattaaagacagataaaacacgggaaatgatggattcagatgcagaaattaatattaaagaaaaatccaatttctttgtagtagtgaatcatgtcaaaggttcaattgaaaattttgaaaatgagttaaaggcaatattaccatttcaccgatcattaagagttgcaaattacgataatcaatcatatgccgctgttatagttggattggaatcatcaccggaagaattaatcactaagcatggatacgaattgacaaagtatacccagtagaaggagtttaattataatgagaagatggcaaggattagtagaagagtttaaagcacatttaccagtaaatgaaaatacaccaaaattaacattgaacgagggaaatacaccactcattcattgtgaaaatatgtctaaaatactaggcatagatttatatgtgaagtatgaaggtgccaatccgacagttcatttaaagatcgcggtatggtaatggctgtgacaaaagcaaaagagcaaggtaagaaaattgtaatatgcgcttcgactggaaatacatcagcgtctgcagcagcatatgcagcgagagcaggtttaaaagctatcgtcgtaataccagaaggtaaaattgcattaggtaaattgtcgcaagcagtaatgtatggtgcagaaatcgtttctattgaaggaaactttgatgaagctttagaaattgtaaaagaaattgcaaaaagtggcgaaatcgagcttgtaaactctgtcaatccatttagaatcgaaggacaaaagacaggctcatttgaaattgtacaacaattagacggtgaagcacctgatattttagcgattcctgtaggtaatgcaggtaatattactgcatattggaaaggctttaaagaatatcatgaagctaaaggatcacaattgccgaaaatgtttggcttccaagctgaaggcgcatcaccaattgttcaaaataaagtcattaaaaatcctgaaacgattgcaactgctattcgaattggtaatcctgctagttgggataaggcgactaatgctcttaaagaatcaaatggattaatagatagtgttactgatgatgaaattctagaagcatatcagttaatgacaactaaagaaggtgtctttagtgaaccagcgagtaatgcttctattgcaggtttaattaaattgcatagacaaggtaaattacctcaaggtaaaaaagtagttgctattttaactggtaatggattaaaagatcctgatactgctatttcactactagataatccgataaagccattgccaaatgataaagatagcattatcgattatattaaaggagctttataacatgtcgaatgttttggagttaacaattcctgcatcaacagccaaccttggagttggctttgattctataggtatggctttagataaatttttgcatctgtctgtaaaggaaacatcagggacaaaatgggaatatattttccatgatgatgcatctaagcaattgcctactgacgaaacaaactttatttatcatgtagcacaacaagttgcttctaaatatagtgttgacttgcctaatttatgtatcgaaatgagaagtgatattccattggcaagagggttaggttcgtcagcttctgctttagtaggagctatatatatcgcaaattattttggtgatatccaactgtctaaacatgaggtattacaattagcgactgaaatcgaaggacatcctgataatgttgcgccgaccatttatggtggtttaatcgctggatattataatgatgtctcgaaagaaacgtcagttgcacatatcgacataccagacgtggatgtgattgtaacgataccaacttatgaactaaaaacagaagcatcaagacgtgctttaccacaaaaattaacacatagtgaagcggttaaaagtagtgcaattagtaatacaatgattttggcattagcacagcacaattatgaattagcaggtaaactcatgcaacaagatggctttcatgaaccgtatcgtcagcatttaattgctgaatttgatgaagtgaaaacaattgctagtcaacataatgcctatgcaactgtaattagtggtgctggaccaactattttaatatttagtcgtaaagaaaatagtggggaattggttcgctctttaaatagtcaggtagtatcatgccattctgaa

SEQ ID NO: 462 - DNA, 1209 bp; double-stranded, linear
aacaattaaaactgaacttgacttacgaggctatcgttatgaggatgctttaattgaactagntcaatatttagatcaagccgttttaagtaattacgaacaagtttatatcattcatggtaaaggtacaggtgcacttcaaaaaggtgtacaacaacatttgaaaaagcataaaagtgttagtgactttagaggtggtatgccaagcgaaggtggatttggcgttaccgttgcaacactaaaataaattataatttgataaattaaatagctgcagttaaaataatgtaaagcaacaagaatacatttcaaacatgttatttgaaataagcataaaaattgagcaaatagaaatacatgaagcatgttatctgatataatttgaacatcataataataattaaggaggattggcatttatggcaatcgtaaaagtaacagatgcagattttgattcaaaagtagaatctggtgtacaactagtagatttttgggcaacatggtgtggtccatgtaaaatgatcgctccggtattagaagaattagcagctgactatgaaggtaaagctgacattttaaaattagatgttgatgaaaatccatcaactgcagctaaatatgaagtgatgagtattccaacattaatcgtctttaaagacggtcaaccagttgataaagttgttggtttccaaccaaaagaaaacttagctgaagttttagataaacatttataagttacaaccaatgacgactggggcatttctttaatgaattgctccagtttttgtttgtgtttttaatataaaaagttgaatgataagtcatcatattgtttacgacttgagaatggtgggattaataaatctatgaacgttaaatgataatctagcatgctgatagatttgtagcagttggtttgataaaaccatgttcaatattacatgatgtgcatgaaaagtcatactcgaagatgttgattattaactagaattagtggtgataaatttgaagcacttttgtagcatcattcattttaaaattagaaggggggatatttttggaagactataagcaacgaattaaaaataaattaaatgtcgtacctatggaaccaggatgctatttaatgaaagatcgtaatgatcaagtgatatatgttggcaaagctaaaaagctaagaaatcgattgcgatcatattttcacgggtg

SEQ ID NO: 463 - DNA, 2410 bp; double-stranded, linear
agttcaacacgacgaattttacctgagtttgtttttggtaagtcgtcaacgaattcaatctctctcggatatttatatggtgcaacttcatttttaacaaattgttgtagttctttaactaacgtatcatcacccgcagtatggtcctgtaaaataacgaatgctttaacaatatttcctcgtatatcatgaggttttgctactacagcacattctttaacggctggatgattcgttaacgcatcttcaacttcaaaaggcccaatcgtatagcctgaactaataataatgtcatctcgacgtccttcaaaccagaaataaccatcatcatctacatgagctaagtcaccagtgatgtagtatttacctgtttgcgctttcgccgtacgttctggctctttataataccctttgaaaagtgctggcaaatcaagtggtactgcaatattccctttcgtattagcaggtacgctattcccctcatcatctactacagtgaccgaactacccggaatgcctttacccattgatccaatcctctgtggtgtatcttttaaaaagcctataagcaaggtactttcagtctggccatatccatctcttacagttaaattaaagtatttcttgaattgttcaactacttctcgatttagtggctcacctgcagaaacggcactatgtaaatgcgttaagtcataatcatttaagttctgtaatttagccatcatacgatattctgtcggtgtacaacataaaacattaatttgatatttttgaagcaattctaagtatgtttcaggactgaaccttccattaaatacaaaagcagttgcacctgaacctaatacagataagaaaggactccatacccatttttgccaacctggtgctgctgttgcccaaactaagtcatcttcattaatacataaccaatgttttggtgccatttgtaaatgtgcaaatccccatccatgacaatgtgtaacggctttaggattgccagttgtaccagatgtatatgacagaatcgccatatcatcacgcgtcgtatctgccatttctagtttgttacttgcgttttctttttcagcttcaagtgaaatccatccatctttttgaccggcaataacaaatttagttaacgcatcatattctttaattttttcaaattcaactgtgaatggctctagtgcaataactgcattaatttcaccatgtgtgatacggtattgtaaatctttagttcttagcatttcagaacatggaatgattgcaacacctaattttaaagcagcaatatataattcatacgtcgcaatagatcgtggcatcataatgagtactttatcgcctttagataaaccgtgcgatgctaaaacattacctactttattagactgttcaatgagctgttggtaagtgactgatatatcttcgccttcagtattatgatataaaattgcctttttatctggtatgtggctatatttttcgatttccgaaataatgttatatttttcaggcgcgaatagagctgacttttgcataactaacttcctttcatacatccacttttcctgtgatgaacattgtaattttataaatgaattatatacatcatacgcctatctttacagaattttcaattaaatagggttaaataccaaagtcctcgacactacactttgacatgacgtagcattcaaggactttcaaatgattgagggttgatatctcgggctagaccatatcagctaattcaatacgaatattgtatgataattcacgattaattatttttacatctgcacctttcgaagtgccacgatgcttgtgtgtatgcttgtactcagctgaattttgccaatgataaaatgcttgcctattttcccacagcgtaataatgatatagtgtctaccagctgttctaggtcttaaaaaccttaatgctttaaatccatcaacgttttttaaatgcttattacgtcgcaaaaatttttgctcgaatgtttcttcttgtccttcgttaatatataaatgatttaacacacataatgaatcatttgataaatcatttatcgcttctagcacatcgtaatatgcagtgtcattatttttttgtattgtgagacaatcatccagttcttctattacataacttctatattcatcataaattttcataataaatgccttcatttcatttatatttttggtcatattactktatatctattactaatkcattcccgtatttattaattacaatcatagtttggctyctttttaaaagataagactttgtaaaaagtattaatatttcatgcaaatgggggacaggagtcgcccactatttttgtgtcttcaatttcatgatcattatttaacattagtcatgaaaatagccgac

SEQ ID NO: 464 - DNA, 590 bp; double-stranded, linear
tttattaattgtaaaaaattgagtaaattatctttacattctaaattagtcttaactacaactagtatcctaataattataggagctattacattctttttattagaacagtttaatactatgcaacatatgggactagttgaaaaaatcggaaattcttttttccaatcagtaacaacacgaacagcgggttttaacagtatagatatagcaagcattarcaaatctaccgcattaatgttaatgctacttatgtttattggtggtgcccctctcagtgcagctggaggaattaaaataactacttttgcagttgcgtttatttttgtactaaattatakacgtaaagaaaataatgtttcagtattcaataaagaaatatctgacaaacatataaaactatctattgttaccattaatatctcatttctatttatcagcatcattacttttatattatcgataattaatccgaacatatcattaatcaagttattattcgaagtggtttctgcattcggaacagtagggttaagtatgaaccttaccacagaatatcatggtattactaaaataattattatattcgt

SEQ ID NO: 465 - DNA, 905 bp; double-stranded, linear
atctaactctgtatgttgctcaatatgcgataratctaacagatctgttactaaagattctattcgatttgantcttttaaaattatgtttaaaaacatgtctaatgattccgcatcattttttgcaccatcaataagcgtttcagcaaaccccttaattgaagtaataggtgtttttaattcatgtgaaacatttgctacaaattcacgtcttagattttcaagttgtttcagatttgttatatcatgcatcacaactaaaatcccttgcaaacttttttgagacctagttaaaatcggaacgcatgaaatatcaaagtacttggcatggacttggtttattgcaacttccaattgttcataaataggtttttcaactttaaaactttctaaaattaattgctcaatttcagtattaacatagccgtgatagcctacttgttcaatattatgcgagatgttgaactgttcataatacgctttatttgcaacaacgatttttccatttcgatctatcattaaaatagcacttggaatattttcaatcgttgtttttaaacggttggattgaattttttgctcattattaagcttttgaaggcgtcgtgctaaatcattggtagacacaaaaagcgctttagtttctacaacattactttcaggtacacgtatgtgataataaccatttgccaacaattgtgttgcataagtaacttcttgaatgggacggattaatgtacgcttaaaactacggcttgcaaaatacagacaaatgagtacaactaaacatgtcaaaataagatatttccacaacgtccaatgcatttctgtaatatcgttattgtaacctttaatccatacatgataaccgttaaccttcttattaaaaataaaaacgtcccttt

SEQ ID NO: 466 - DNA, 1016 bp; double-stranded, linear
tttggttagcccataaaagaaaaaaacaagtagtcatttttaaacaacatatcaagtctacccaagaaatacgttttgacaaagcgaaagtgcttgaacacaaagatgaaatagcaaattttatttctttcgaaccacaaagttttgaattttattattttacagaatcggaattttcagaagaacaattaaatgaagtttcgccaattagaattaaattcaatgttataagacacacaaaagatttgataaagcatatgccgaatatatttttggctagacttatttcagaagataatgataaaaagacatatatgttctataaacgcaaagtattaaccgataactttttagataaatatatgcagaaattttcaccggcaacatacacaataatatttgtaaatgtcttaatatggttatgtatgattttatatttaaataatttttcggatgtaaaattattagatgttggcgggttagtgcattttaatgtcgtacatggtgaatggtatcgaattgttacatcgatgtttttacattttagttttgaacatatacttatgaatatgctttcattatttatttttggtaaaatagtcgaagcaattattggttcatggcggatgttaactgtatactttattgcagggttgtttggaaactttgtatcactatcatttaatacgactacaatttcagttggggctagtggtgctatatttggtctgattggatcaatttttgcgatgatgtatgtttcaaaaacatttaacaaaaaaatgttaggacagttattaattgcattagtgatattagttggtgtttctctgtttatgtcaaatataaatattgtggcgcatattggaggattcattggtggtttattaataactttaattggctattactataaagtgaatcgtaatattttttggatttactaattggtatgcttgttatatttawtgcacytcmaattagatttttacmattaaagaagataatawttataa

SEQ ID NO: 467 - DNA, 406 bp; double-stranded, linear
aactttaaatttagacatctttaaaacctctcttaaaccatgcctatatctcaagatgatatttcaaatgaacaatactattgcttgagaccattaatgaatgatcataaatatttctttctataaaattagctttccaataactgtgttgttgcataatatcattcacaagtacaccattttcggaagtatgattatctttatctatacttaaaacaatttgtttagttttagcatggctaaattgttgaagacccttacacgataaacgtatagcgtctgaattctcatttaacaatgcggctgggcaaacaaatgacacattgtacttcatgtttgaacttcgttacaatcatcgtgkcattttgataaataacaatccctcgtaatkgattaagtatattat

SEQ ID NO: 468 - DNA, 1378 bp; double-stranded, linear
agataatacacttgaagttggaatggtttgtgacggttatttaatgcgaattgaaaacttaacaccatcaaatttcttcaactcagcaagtgaagatacgattactaaaattaaattaaatgcattgagagaacaacgtcgcattttacgtgagttgattgatacagatgaagtatcagaaggtacagcgttaaaactaagagaagccatcaattatgatgaaatggttattgtagatagtatgacgtagttcctaattatgckaaaagggattgatgaaaaactgaagggcttttcatcaatcccttttattttaggggaattgaatagatagttttaaactatacgaattattaatatttgagatttaattgaaataagttttaaaaattggaggagatagattaagcgaagtcatttaaaggtgaagttaagtgtattcacaaaaantagccacactcatatgacatcggatgagtgtggcttaaggatctatggggggaggaanccatagatgtttactttgataggccagattaaatatcaaagtatgcgattatttatagcttgatgcaaaagtggtatgcctattaaaagttactgcacatagcttttaatattccgttcaaaggaaaggggcatacaattgaacaatctgtaatagtacttttaaccagctatgctaaaagtctagtagggagaacagttgtccaatcacataagaacctctaacttcgttagtacgattaagaaaagctttttagttagtatgtaatacaatttattgacgcgcgtgaatctcttttataagagtgtgtagggaatggcgttgtataaattgtattagaagaacttctaacgcatctctgtggttaaaagagatgaagggaacgacagtttaattaaaactgcataagaacttctagcttttctctctcgttcaaagagaagcagctgttcgcagtttaatcaaaaccacataaagcttttaactttactctttgatttaaagagtgataaatgtttacagtttaattaaaactgcataagaacttctagcttttctctttcgttcaagagaagcagctgttcgcagtttaatcaaaaccacataaagcttttaactttactctttgatttaaagagtgacaaatgtttacagtttaattaaaactgcataagaacttctagcttttctctttcgttcaaagagaagttctaataccaccatatcgtgcgatcgggaacggtatatatattaataggagggtaatatatatttaacgcacgatatgggactattagccttcgactttgttatgttgatgtgtggcctaaaatattggagataccaatattttaggttgcatcaacatca

SEQ ID NO: 469 - DNA, 4171 bp; double-stranded, linear
tcccaaccaataatcgtggcaaaaatacggatattggtatggcttaacaaattgcaaatatcgtttaatcatacatcccccctaatctattgccctatcctattcataagcataaaaatgaatagaggttggatacataatttgtagatgtaaattcttcttacaatttacatttttaaaattaagatatctcaacctctgtcatattcatgtgattaaatacgttgtcttattcgtatgttatattctattcaatttaatctatggatactgtgtccccacacgacagcaaaagttatcatacttctttacatcactaagtcaatataaatgatttaatcagtatttacactttatttgcttaatactgtctaatttttttgtaacgttctttccaaactttgataaaatctggcgcgaatgggcccttcttctgttctatccattgttgaagaatgtccacgttgcgtcttaaaataatatcaatatcatgcggataattcatttgattcatatgttgctcatattcatcttcatctaataaatgatactttccgtttggatatactttaatatctaaatcatagtctatatattttaatgcctcttcatcacaaacaaatggtgatgacaaattgcaatagtaataaattccatcttctctaaacatgcagataacattaaaccaatattctgagtgaaagtaaacaattgccggttcacgtgttatccaagttcttccgtcactttcagtcactaacgtatgatcatttccaccaatgacaacatgatcagtaccctttaatattgttgtttcagaccaaacgcgatgaatcttaccatcatgtttataactctgaattttaatgttttccccttctttaggtatggattctctgaccatactccacaccaccttctgttaatttaaccattataaattatagcatatttcagaaatagtattatataaatacatatttttacgaaataagattttactacttaataattaaactcggtaatattgctaagtactacaacagagatttacatgtcccatttaaagtatataaaatcatcacttttatatatcaacactttaactttttgacattgttattctatgagatttaaagatatcatttatactttttaaaattaatgtcactatgttttccgataatattaccaatcatcgaatgttacccatttataaattgataaatstttgacataggtacagggaatgtatattgatctcgatcacttaaatcaaaccaaatcatgtcatctggtaatgtttcaatgttaattgctcctgaaacggcgtatactttaatcttccatgttaaatgagtaaattgatgcttcaactcaaaaataggtgtttctactggttgaatgtcatgaccgattttttcagtcattttacgtctagcatgctcactttcaaacataggaaattgccacataccatgcaataatttttcgctacgcttttgcaacagatattgaccttgattatttctaattaaaaagacggattgctcaattacttttttacttacatttttagatttaacaggtaacttttcaaatgtacctttatcaaatgcctcacagttttcttgaactggacaaaataagcataatggattttttggtgtacaaattaacgcccctaattccatcatagcttgattaaacgttccagcttctgtagtaacatacggtaataattcttgttcgtacgatttcctcgtcgattgtaatttaatatctcgatagtcatcattcaatctagaccatactcgaaaaacatttccgtctacagttgctagtggtacattatatgcaatgctcattactgcagcttgtgtgtatgggccaacaccttttaacgctttaaattgatcaggatctttgggaactaagccttcatatttatcatgaacttctttaatcgccgtatgaaaatttcgagctctactataatatcctaagccttcccaatactttaacacttcatcttccgaagcttgactcaaaacttccacagttggaaatcgttcaacaaaacgatgataatagtcaataactgttttaacttgtgtctgttgtaacatgacctcacttaaccaaatatagtacggattggtcgtttgtcgccatggcatttctctttgattttcatcaaaccagtgtatcaaattttctttaaaactagactgctgatacatttataaaaccctttcctcaccaaaattaattgtctttactcataatgtttttattgtacattaaaatcatggttagtatgtaagttaatttagttatttgcgaaattggattataatagtatatataatattatgaaatgagtgaactgatatggacactgcaacacatatcgcaattggggtgggccttacagcacttgcaactcaagatccagcaatggcttctacgtttggtgcaacagctacaacccttatcgttggttcattaattcctgatggggatactgttcttaaattaaaggacaatgcaacatatatttcgcatcatagaggtatcacgcattccatccctttcacaatactatggccaattttaattacatttttaatattcacgttctttagtggaaccaacccatttcatgtatggatgtgggctcagctcgcagtatttttacatgtctttgtagatatattcaattcttatggtacacaagcgcttagacctatcacaaacaaatggattcaattaagtgtgattaacacatttgaccctattattttcacagttctttgtattggtattgtattatgggttataggcttgcatccatttgcagtcttctttcctataatcgctttactaatcatttattacatgattcgttttaaaatgagagccgtaattaagcaacaagctttaaaagcaattcaacaagagcatcaccctgttaaagtatttgttgcgccaacaataaaatttatggaatggcgtgtcgcgatacaaactgatgcacatgactatgttggaaaagcatatggtaggaatgtggtgtttagtgataaagtggaacgtcaaacattatcaacagactccattttatggaaagtcaaaggtaataaagatatacgtacttttttaaacttttcatcaatctatcgttggcaaacaacaacgttagcagatggttctactgaaattcgtttgattgatttgcgttatttaaaaaatgatcattattcatttgtggcaattgcacatgtaacaaacgataatgtcatagaccactcttatattggctgggtatttacagaagataagttacaacgtaaactgtatgctaaataatttcaagttattattcactaaagttaatctataaaaaatgaacaaccgggcagaatgaaaatcaaaacgatttttactctgtccggttttttaatgtaaaactatgaatgcttttacaaaatctaaaatttatattgttgctaacaaactacctttaatgactcgaaatatcaaaatcagtataggaaaacaatatctagatgatattctaattgtttctgattctcacagattaatttacacaacaggtcagctaaacatcatgaagaagtatccgcctcgtctgtactatcatttgaaacatcctgttgattatcagtttgtgtcactttagatgttttattataaattgcgtgtgtcgtataccttgctaatacgaaatttactgcagctattaaacataagaataaaataaagtaaaaatgatatggaatgttttccatacttgatataccaaatatgatagattgtgctataccattaacaatgtaatacattggatttagcattaggatgtgattgataaatacatgatttggatttggtatgaaaataattggtaacaataagaaacacaatacacaaaccccataaaatatgatatttattttttcagwtaacagtcgaataagaccaaaagtaacggatattaatcctacaaaaatagttgccatcacaataaaatagaatagcgctatatatgatgtttcgaagtttactggtttaaccaatgcactaatcatcgtcaaaatgactagcataataaaacttaaaatagacataataactactggcgtcg

SEQ ID NO: 470 - DNA, 9821 bp; double-stranded, linear
tggttgaagtagcagttaattcaaaatctgcaacagtttcagcagaataggggctttcaaaataatcaaaggagaataatttatgactaaaactttaaaggtttataaaggagacgacgtcgtagcttctgaacaaggtgaaggcaaagtgtcagtaactttatctaatttagaagcggatacaacttatccaaaaggtacttaccaagtggcatgggaagaaaatggtaaagaatctagtaaagttgatgtacctcaattcaaaaccaatccaattctagtctcaggcgtatcatttacaccagaaactaaatcaattatggtaaataccgatgacaatgttgagccaaacattgcaccaagcacagcaacgaataaaatattgaaatatacaagtgaacatccagaatttgttactgtagatgaaaatacaggagcaattcacggtgtagctgaaggtacttcagtaatcactgctacgtctactgatggaagcgataagtcaggacaaatttcagtgacagtaacaaacggatagggatttaaggcgcagtatatctgcgtcttttttatttgaataaaaggagctaatacaatgattaaatttgaaattaaagatcgtaaaacaggaaaaacagagagctatacaaaagaagatgtaacaatgggcgaacagaaaaatgctatgagtatttagaattagtaaatcaagagaataaaaaagaagcacctaacgcaacaaaaatgagacaaaaagagcgacagttattagtagatttatttaaagatgaaggattgactgaagaagatgttctgaacaagatgagtactaaaacttatacaaaagccttacaagatatatttcgagaaatcaatggtgaagatgaagaagattcagaaactgaaccagaagagatgggaaagacagaagaacaatctcaataaaagacattttatcgaacattaagaaaatacaacgtttctgtatggagcagtatgggtggacattaactgaagtcagaaaacagccgtatgtaaaacttttagaaatacttaatgaagagaataaagaagagactgaagaaaaacaaagtgaacaaaaagtcattacaggtacggatttaagaaaactttttggaagctagaaaggaggttaatatgaatgaaaaagtagaaggcatgaccttggagctgaaattagaccatttaggtgtccaagaaggcatgaaaggtttaaagcgacaattaggtgttgttaatagtgaaatgaaagctaatctgtcagcatttgataagtctgaaaaatcaatggaaaaatatcaggcgagaattaaggggttaaatgataggcttaaagttcaaaaaaagatgtattctcaagtagaagatgagcttaaacaagttaacgctaattaccaaaaagctaaatccagtgtaaaagatgttgagaaagcatatttaaagttagtagaagccaataaaaaagaaaaattagctcttgataaatctaaagaagccttaaaatcatcgaatacagaacttaaaaaagctgaaaatcaatataaacgtacaaatcaacgtaaacaagatgcgtatcaaaaacttaaacagttgagagatgcagaacaaaagcttaagaatagtaaccaagctactactgcacaactaaaaagagcaagtgacgcrtacagaagcagtccgctaagcataaagcacttgttgaacaatataaacaagaaggcaatcaagttcaaaaactaaaagtgcaaaatgacaatctttcaaaatcaaatgataaaattgaaagttcttacgctaaaactaatactaaattaaagcaaacagaaaaagaatttaatgatttaaacaatactattaagaatcatagcgctaatgtcgcaaaagctgaaacagctgttaataaagaaaaagctgctttaaataatttggagcgttcaatagataaagcttcatccgaaatgaagacttttaacaaagaacaaatgatagctcaaagtcatttcggtaaacttgcaagtcaagcggatgtcatgtcaaagaaatttagttctattggagacaaaatgacttccctgggacgtacaatgacgatgggcgtatctacaccgattactttaggtttaggtgcagcattaaaaacgagtgcagactttgaagggcaaatgtctcgagttggagcgattgcacaagcaagcagtaaagacttaaaaagcatgtctaatcaagcggttgacttaggagctaaaacaagtaaaagtgctaacgaagttgctaaaggtatggaagaattggcagctttaggctttaatgccaaacaaacaatggaggctatgccaggtgttatcagcgcagcagaagcaagtggtgcagaaatggctacaactgcaactgtaatggcttcagcgattaactctttcggtttaaaagcatctgatgcaaatcatgttgctgatttacttgcgagatcagcaaatgatagtgctgcagatattcaatatatgggagatgcattaaaatatgcaggtactccagcaaaagcattaggagtttcaatagaggacacttctgcagcaattgaagttttatctaactcaggtttagaggggtctcaagcaggtactgcattaagagcttcgtttattaggctagctaatccaagtaaaagtacagctaaggaaatgaaaaaattaggtattcatttgtctgatgctaaaggtgagtttgttggaatgggcgaattgattagacagttccaagataacatgaaaggcatgacgagagaacaaaaattagcaacagtggctacaatagttggcactgaagcagcaagtggatttttagccttgattgaagcgggtccagataaaattaatagctatagcaaatcattgaagaactctaatggtgaaagtaaaaaagcagctgatttgatgaaagataacctcaaaggtgctctggaacaattaggtggcgcttttgaatcgttagcaattgaagttggtaaagatttaacgcctatgattagagcaggtgcggaaggattaacaaaattagttgatggatttacacatcttcctggttgggttagaaaggcttcggtaggcttagcaatttttggtgcatctattggtcctgctgttcttgctggtggcttattaatacgtgcagttgggagcgcggctaaaggctatgcatcattaaatagacgcattgctgaaaatacaattctttctaataccaattcaaaagcaatgaaatctttaggtcttcaaacattatttcttggttctacaacaggaaaaacgtcaaaaggctttaaaggattagccggagctatgttgtttaatttaaaacctataaatgttttgaaaaattctgcaaagctagcaattttaccgttcaaacttttgaaaaacggtttaggattagccgcaaaatccttatttgcagtaagtggaggcgcaagatttgctggtgtagccttaaagtttttaacaggacctataggtgctacaataactgctattacaattgcatataaagtttttaaaaccgcatatgatcgtgtggaatggttcagaaacggtattaacggtttaggagaaactataaagttttttggtggcaaaattattggcggtgctgttaggaagctaggagagtttaaaaattatcttggaagtataggcaaaagcttcaaagaaaagttttcaaaggatatgaaagatggttataaatctttgagtgacgatgaccttctgaaagtaggagtcaacaagtttaaaggatttatgcaaaccatgggcacagcttctaaaaaagcatctgatactgtaaaagtgttggggaaaggtgtttcaaaagaaacagaaaaagctttagaaaaatacgtacactattctgaagagaacaacagaatcatggaaaaagtacgtttaaactcgggtcaaataacagaagacaaagcaaaaaaacttttgaaaattgaagcggatttatctaataaccttatagctgaaatagaaaaaagaaataaaaaggaactcgaaaaaactcaagaacttattgataagtatagtgcattcgatgaacaagaaaagcaaaacattttaactagaactaaagaaaaaaatgacttgcgaattaaaaaagagcaagaactcaatcagaaaatcaaagaattgaaagaaaaagctttaagtgatggtcagatttcagaaaatgaaagaaaagaaattgaaaagcttgaaaatcaaagacgtgacatcactgttaaagaattgagtaagactgaaaaagagcaagagcgtattttagtaagaatgcaaagaaacagaaatgcttattcaatagacgaagcgagcaaagcaattaaagaagcagaaaaagcaagaaaagcaagaaaaaaagaagtggataagcagtatgaagatgatgtcattgctataaaaaataacgtcaacctttctaagtctgaaaaagataaattgttagctattgctgatcaaagacataaggatgaagtaagaaaggcaaaatctaaaaaagatgctgtagtagacgttgttaaaaagcaaaataaagatattgataaagaaatggatttatccagtggacgtgtatataaaaatactgaaaagtggtggaatggtcttaaaagttggtggtctaactttagagaagaccaaaagaagaaaagtgataaatacgctaaagaacaagaagaaacagctcgtagaaacagagaaaatataaagaaatggtttggaaatgcttgggacggcgtaaaaactaaaactggtgaagcctttagtaaaatgggcagaaatgctaatcattttggcggcgaaatgaaaaaaatgtggagtggaatcaaaggaattccaagcaaattaagttcaagttggagctcagccaaaagttctgtaggatatcacactaaggctatagctaatagtactggtaaatggtttggaaaagcttggcaatctgttaaatcgactacaggaagtatttacaatcaaactaagcaaaagtattcagatgcctcagataaagcttgggcgcattcaaaatctatttggagaggcacatcaaaatggtttagcaacgcatataaaagtgcaaagggttggctaatagatatggctaataaatcgcgctcgaaatgggataatatttctagtacagcatggtcgaatgcaaaatccgtttggaaaggaacatcgaaatggtttagtaactcatacaaatctttaaaaggttggactggggatatgtattcaagagcccacgatcgttttgatgcaatttcaagttcggcatggtctaacgctaaatcagtatttaatggttttagaaaatggctatcaaaaacatatgattggattagagatattggtaaagacatgggaagagctgcggctgatttaggtaaaaatgttgctaataaagctattggcggtttgaatagcatgattggcggtattaataaaatatctaaagccattactgataaaaatctcatcaagccaatacctacattgtctactggtactttagcaggaaagggtgtagctaccgataattcaggagcattaacgcaaccgacatttgctgtattaaatgatagaggttctggaaacgccccaggtggtggagttcaagaaataattcacagggctgacggaacattccatgcaccccaaggacgagatgtggttgttccactaggagttggagatagtgtaataaatgccaatgacactctgaagttacagcggatgggtgttttgccaaaattccatggtggtacgaaaaagaaaaaatggatggaacaagttactgaaaatcttggtaaaaaagcaggggacttcggttctaaagctaaaaacacagctcataatatcaaaaaaggtgcagaagaaatggttgaagcggcaggcgataaaatcaaagatggtgcatcttggttaggcgataaaatcggcgatgtgtgggattatgtacaacatccagggaaactagtaaataaagtaatgtcaggtttaaatattaattttggaggcggactaacgctacagtaaaaattgctaaaggcgcgtactcattgctcaaaaagaaattagtagacaaagtaaaatcgtggtttgaagattttggtggcggaggcgatggaagctatctatttgaccatccaatttggcaaaggtttgggagttacacaggtggacttaactttaatggcggtcgtcactatggtatcgactttggtatgcctacaggaacgaacatttatgctgttaaaggcggtatagctgataaagtatggactgattacggtggcggtaattctatacaaattaagaccggtgctaacgaatggaactggtatatgcatttatctaagcaattagcaagacaaggccaacgtattaaagctggtcaactgatagggaaatcaggtgctacaggtaatttcgttagaggagcacacttacatttccaattgatgcaagggtcgcatccagggaatgatacagctaaagatccagaaaaatggttgaagtcacttaaaggtagtggcgttcgaagtggttcaggtgttaataaggctgcatctgcttgggcaggcgatatacgtcgtgcagcaaaacgaatgggtgttaatgttacttcggctgacgtaggaaatatcattagcttgattcaacacgaatcaggaggaaatgcaggtataactcaatctagttcgcttagagacatcaacgttttacagggcaatccagcaaaaggattgcttcaatatatcccacaaacatttagacattatgctgttagaggtcacaacaatatatatagtggttacgatcagttattagcgttctttaacaacagatattggcgctcacagtttaacccaagaggtggttggtctccaagtggtccaagaagatatgcgaatggtggtttgattacaaagcatcaacttgctgaagtgggtgaaggagataaacaggagatggttatccctttaactagacgtaaacgagcaattcaattaactgaacaggttatgcgcatcatcggtatggatggcaagccaaataacatcactgtaaataatgatacttctacagttgaaaaattgttgaaacaaattgttatgttaagtgataaaggaaataaattaacagatgcgttgattcaaactgtttcttctcaggataataacttaggttctaatgatgcaattagaggtttagaaaaaatattgtcaaaacaaagtgggcatagagcaaatgcaaataattatatgggaggtttgactaattaatgcaatcttttgtaaaaatcatagatggttacaaggaagaagtaataacagattttaatcagcttatatttttagatgcaagggctgaaagtccaaacaccaatgataacagtgtaactattaacggagtagatggtattttaccgggcgcaattagttttgcgcctttttcattagtattaaggtttggctatgatggtatagatgttatagatttaaatttatttgagcattggtttagatctgtgtttaatcgcagacatccttattatgttattacttctcaaatgcctggtgttaaatatgcagtgaatacagctaatgttacatctaatttaaaagatggttcttcaactgaaattgaagtaagtttaaatgtttataaagggtattctgaatcagttaattggaccgatagcgagttcttattcgactctaattggatgtttgaaaatggaattcctcttgatttcacacctaaatatactcatacatcaaatcaatttactatttggaacggttctactgatacgataaatccacgattcaagcacgatttgaaaatattaattaatttaaatgcgagtggaggatttgaactggttaattatacaacaggtgatatttttaagtacaacaaaagtatagataaaaacactgattttgttttagatggtgtgtatgcatatcgagatataaacagagtgggaattgatacaaatagaggcattataacattagcgccaggtaaaaatgaatttaagattaaaggagacgtcagtgatattaaaactacatttaagtttccttttatttataggtaggtgatttaatggattatcatgatcatttatcagtaatggattttaatgaattgatttgtgaaaatttactagatgtagattacggttcttttaaagaatattatgaactgaatgaagctaggtacatcacctttacagtttatagaactactcataatagttttgtttttgatttattgatttgtgaaaacttcataatttatcatggtgaaaaatacacaattaagcagacagcgccaaaggttgaaggtgataaagtttttattgaagttacggcatatcacataatgtatgaatttcaaaatcactcagtggaatcaaataagcttgatgacgacagtagcgaaactggtaaaacgccagaatactctttagatgagtacttaagatatggatttgcaaatcaaaaaacgtcagtcaagatgacctataaaataattggagattttaaaagaaaaataccaattgatgaattaggtaataaaaatggcttagaatattgtaaagaagcagtagatttgtttggttgtattatttatccaaatgatacggagatatgtttttattctcctgaaacattctatcaaagaagcgaaaaagtaataaggtatcaatataatactgatactgtgtctgctactgtcagtacgttggaattaagaacagctataaaagtttttgggaaaaagtacacagccgaggaaaagaaaaattataatcctattagaacaactgacattaaatattcaaatggttttataaaagaaggtacttatcgtaccgcaacaattgggtctaaagctactattaactttgattgcaagtatggtaatgaaacagttagatttacaataaaaaagggctctcaaggtggaatatataagttgattttagacggcaagcaaattaagcaaatttcttgttttgctaagtcggttcagtctgamacaatagatttaataaaaaatattgataaaggcaagcacgttttagaaatgatatttttrggagargrccccaaaaatagaattgatatatcttcaaataaaaaagctaagccttgtatgtatgttggaactgaaaaatcaacagtcttaaatttaattgctgacaactcaggtcgcaatcaatacaaagcaattgttgactacgtcgcagatagtgcaaagcagtttgggattcgatatgctaatacgcaaacaaatgaagatatcgaaacacaggataagctgttagaatttgcaaaaaagcaaataaatgatactcctaagactgaattagatgttaattatataggttatgaaaaaatagagccaagagatagcgtattctttgttcatgaattaatgggatataacactgaattaaaggttgttaaacttgataggtcacatccatttgtaaacgcaatagatgaagtgtctttcagcaatgaaataaaggatatggtacaaattcaacaagcgcttaacagacgagttattgcacaagataatagatataactatcaagcaaatcgtataaatcatttatacactagtactttgaattctcctttcgagacaatggatatagggagtgtattaatataatggcaacagaagaagttaaaatcaaagcgctacttgaaaacgataaac

SEQ ID NO: 471 - DNA, 1017 bp; double-stranded, linear
ttattgttttccaaatggtcttctcggttatttaaccatcggtttcaatcctacgtgcttcactttctatctattaattcaatttcagcttgaccacccgctgtataaagggtcaaagttgctaatcgatagcgtctcattataggaccaacatcgatatcaatattttgaatacgaaaatatggtattaccttttcatccaaaaataaaatgccgtttcgtacacgcaaatggtgtttttcaaatgcatatctgcagtgcttatatcgatagactggcgctataacaagcgtgaaaacagcaacaagtaatattataatcacactactaacaatggataaatggttatctaaaatctcccaaaatagccagttcaaaatattaaatgcgattaaaagtacaagcgctatgggtatccaaaacagcacagcacttaacctcatcacttttttagcgtgtggtgacataaaattataatccctcatcattttcacctcttaaataccatgatttcaatttatttgcatcttcacttcttgcgtattttaagttaatcgattgggctcccacacctttagcaacaataaagctaaaattatttaaattgttgcgtttaagtaatgtatgttgccaagtgtcaaatcctataatgtgatgcgctttaaaataataaatatttcgtttcaatagctcgaaattctggatagtaatttgttcttctgtcattttaaaacccgcatgtttgacataaagatatcctttgatcacaaataaaccaataatgactattgttataatcgtaaataacaataataattgattccaaaaataacagcctatacctgccatagctatgacaataatactaggtattaaaaagtgtctgtggaaacctgacaaaggcataccttcattaacttgttgataagataaatctggtactaaattctggataatttgatatgctttgtctcgtttaataaacggcaatatcggcacactacctgaatcattgtc

SEQ ID NO: 472 - DNA, 6806 bp; double-stranded, linear
taggattgattaatcctttcttcaaaatgatgaatgtgtaatgttaaatatataatttcagactcactgatattaacatcaaattgtttttgtatcatagttaaaattttatatgctgtgttatagcaaatcggatagtgatttttaatcatagacacaaaatcatcttgtgcatgtatatattcttttcttcttaatcggcgaattaaaaattgtacgtgccttataaaacgttggtattgtaatgattccttatcaacagttgtcacaaggtctgattcaatgatatctataccttttttaataacattattngatcaaggtcatctcatgcatagataaatcttctgtattagatgcaatatgtaatgcaataaatcctatctcatcttcaggaaaatgtacatctaatgctgcatttaactgatcaatcacctgtttagcaatatgatatgcatcactatataactgcatagtttccataacaaatggattgctaataacttgattttgttttaagcgtttataagcaaatataatatgatccgttaatgaaactacaagttgttttgaatcaacattcatcgcagtattagaaataaaattcaacgaatcaataattacttgtaatacattatcatcagcgatttcaactaaacttttataatgtgctttttgttgctcactttctaatttataaattttctctattgtaatagtttggtcgtttaacgccattccctcttttttgttaaaaccaatacctttaccgattaaaataacttcttgatcattattagtacatactacgacattgttgttcaatgttttagtaacaatatattctcccattatcatcacctatttttctattattaagattatatatcggaaatgtctaacttgaaagtataataatttaaatacttgtgttctattacacgcctatcctatatgatatatcttaatttaatttcgatgtctctcaaagtggaataactataataaaaaaatctgactcccatatttacaaataattctatttatttatatattatctgaattaatactcaatacaaactaaaacgtactattaaattgtgcaaagctaaaacaaatttatattcatctatccaacaatatgtcttatcaatggtatagtctttgcacaccaatggaggaaataaatctcaaccttactatattaatatataatcaaatcttagattaactagtgtaatgatacagatgataattgagtacaaatttaaaaccctgagattttcgctttaatttgaaaacctcagggtttatttgatttttatataatgaatcgttacattaaaaatatttatttatcagagttcttatatttgttagcgccccaagcactaattccaaataagttaatttctaagttttcaggtttaaagacagggttcttgccttcttttttctgcttttgataatctttcatcaatgcaaaagctacattggacagtcctataatggaaataatgtttacaattgccattaagcccataaataagtctgccgtattccatactgtttctgtttttacaactgcaccgacaaagacaagtactacaacaagacatctaaagataaataatattacacggtttgttgataaaaattcaatattagattgaccgtaatagtaattacctacaacagatgaaaatgcaaacagtgtaactgctattgttaagaaaatacctccagcagaacctaaatgctcattaagtgctgattgagtaactgcaacaccttgaggtgcgttatcaccaaatttcagtcctgaatatagtaaaatcatgattgcagttgctgtacaaaccaacattgtatcaaagaacacacctaatgattggattaaaccttgcttaacagggtgtggtacggcagcagttgccgctgcattcggcgcagaacccataccagcttcgttagagaataaaccacgtttgataccttgaagaaccgcagcacctacagcgccaccagttacttgttcgataccaaatgcacttttaataatcgtacctatcataggaacaatttgatctaaattaaatagcaatattactaaaaccataccaatgtaaatgatagccataatcggtacaattaacgaagataacgtagcaatactacgtacaccaccaaatataataatagctgttacgattgctaaaataatacctgtgattactggactaatattatattgcgtatttaacgactccgcaattgtattagattgcactgtgttaaatacaaatgcaaatgtaattgtaattaaaatcgcaaatacgatacctagccatttttgatttaaacctttagtaatatagtaagctggaccaccacggaatccaccatctttatcatgtactttataaacctgagccaaagtcgcttctataaatgcactcgctgcacctataaatgcaataacccacatccaaaatactgcacctggaccgcctaaaacaatcgcagtcgcaacaccagcaatattaccagtaccaactctcgaaccagcactaatcgcaaatgcttggaatggcgaaatacccttcttaccatcttctaaagtttctggacgttctactaaagctctaaacatttcaggtaacattcgtaattgaacgaatttagaactaatcgtaaagaagaatccagctgtcaataatagaccaattaaatattgagaccatattaaatcggtaccaacatggacaaattctttaaaccatccaggtattaaactatcgaaatctttcaaaataaacccctcgcatcctctacatgaatcatgtaccttctataaaattagaccgaattgaaccttcagtaaatatagagatacatcatcatttcttatacaatacaagagatttatattagtttggtcaaagtatatcgctaatttaacgataagtacttggtcagcatttaatataaatcccttgaatttagtcaaaatttaacattactgtattttatcatttaatttcgtgattgcatatagtttttagctaatatacatgtctattacttcaccaaaatcatctgtatctacaatgaatgagccatttgtatattgttcagatttatgaatatcattaattaaaccatgttcttcatttgattttgaatataatgtatattgactatgttcacctgtcactacatgtgcagctacaatacgatgtggatttttctttaattcttttaataaagttattccacgttgtgctcttttagcaacttgtaagattttaaaactaatacgttttaacgagccgcgttgtgtggccatcaatatagtatcattttcagaaacaccttctgtcataacaacgaaatcttcagctttaagatttattgatttaacaccagctgcccttaatccggtatctgatagttcacttgtattatacgttaatgacatacctttattagtaatgacggtaattaattgatctttttcaaagcgcataacactaatcaaatcatcattttctttaactttagtagcaattaaaggtttattaaaacgcgttgttttaaatagaggcactgtacttttcttaatcatgccattttgagtcgcaaaaacataaaatgcatctgtattaaagtccttttcattaaagacattaataaccacttcatcttcttcgataggaactatttgtgatacatgttgtcccaattctttccaacgaatatctgctaatttatgaaccggtataaatagataacgacctttatttgtaaatactagtacggtatcttgcgtatttacttcttgatgtttaagtaaactgtcaccatcttttaaaccaatatcttcaacaccgctagcattaaagctacgaatagaagtacgtttaatatatccatgacgtgtcatacttaaaataactycttcactaggcaccataacttctttgtcaattttaatttcttcaatttctgcttcaattaaagacagtcgttcagatttgaatttctttttaatttcattcaattcttcttttatgacattcaataatgcatcatggttatcaagaatatgacgtaattgtttgattaatgcttcaagttctttatgttcaccttcaagcgcaactatgtcagtatttgttaaacgatataactgtaacattacaattgcttcagcctgttcttctgtgaactcgtatacttcgataaggttttctttagcgtcacgcttgtttttagagcwacgaatcaattcgattactttatctaaaattgacaacgctttaatcaaaccttcaacgatatgcatacgtttttctgcattatctaattcaaacttcgttctatttgcaacaacctcaatttggtgattcaaataactatctataatttgacgaatacccatcaattttggacgaccatcactaatagcgaccatgttgaaattatatgaaatctgtaaatcagagtttttataaagataatttttgattgattcactgttcacatcttttttcaattcaattgctattcgtaaaccagttctatcagtttcatcacgtacttcaacgataccatcgacttttttgtcagcacgtaattcatcgatacgttttactaagctacttttgttcacttcatatggaatttcagtaataattaactgtttacgtccattgcgtaaagtttcttcttcaactttagaacgaactataattctacctttacctgattcataagcttttttaataccatcaataccttgaataataccaccagttggaaaatcaggacctttaatatatttcattaattgattgactgtaatatccggattatcaatatatttaagtgttgcttgaatcacttcagctaaattatgtggtggtatatctgtcgcgtaacctgcagatatacctgtagaaccattcactagtaagttaggaaatcttgatggcaataccattggttcgagtgtcgtatcatcatagtttggaatgaaagaaactgtctctttattaatatcacgtaataactcttcagctagtaagcttaacttagcttcagtgtaacgcattgccgctggcggatcattatcgatactaccattattaccatgcatttctattaagacatgtcgtaacttccagtcttgacttaaacggaccattgcttcgtacactgaggagtctccatgtggatgatattgaccaataacatcaccgactgttttcgcacttttacggaaatttttatcgtgtgtattaccacttgaatacattgcatataaaatacgacgttgtactggttttaaaccatcacgaacatctggcaatgcacgctcttgaataatatatttactatatcttccaaagcgatcacctaaaacatcttcaagtgataaatcttgaattatttcactcactagatttcctcctcatcaaattgatcattttcaagcacttgtacttcagaattatctaaaatactttggtcctcttgcataccaaactcaacatgcttttcaatccattcacgtctaggttgtactttgtcacccattaatgttgttacacgtttagatgaacgcacttcatcttcaacttgtacacgaattaaagttcgtgtttctgggttcatcgtcgtttcccataattgttcagggttcatttcacccaaacctttgtaacgttgtaacgtgaagcctttaccaagttctttttgcaatttattaagctcttcgtctgtccaagcgtattcaactcgctttgttttgcctttacctttttccaatttataaagtggaggtaaagcaataaatacacgacctgcttgaacaagcggtttcatatatttgaagaagaatgttaacaatagcacttgaatatgcgcaccatcagtatcagcatcagtcataataattacacgattataattactatcttcaattttaaagtcagtaccaacgcctgccccgattgtgtggataattgtattaatttcttcatttttaaaaatatcttctagacgtgctttctctgtattaattaccttaccacgtaatggtaatatcgcttggaatttgcggtctcgtccaagttttgctgaacctcccgcagaatcaccttcgactaaatacaattcatttttttcagtgtttttactttgtgcaggtgttaatttaccagatagcaaagtgtctttacgcttgtttttcttacctgaacgagcatcttcacgagctttacgtgcagcttcccttgcttgttgtgctttaatcgcttttttcacaagtgatttagacaattgtcctttttcttctaaatagaatggcaatttgtctgcaacaactgaatcaacagcacttctagcttcagaagtacccaatttagatttcgtttgtccttcaaattgcaataattcttctggaatacgaacagacacaacagctgttaaaccttcacgaatatcattaccatctaagtttttatcttttgttttaagttcattaatacgacgtgcataatcattaaatacacgtgtcattgctgttttaaaaccaacttcatgtgtaccaccatctttagtacgtacattatttacaaaacttaaaatactttctgaatattgatcattatattggaaagctacgtctacctctataccatttgcttcacctgaaaatgtagccacgtcatgcaaaacttcttttccttcattgacataactaacaaactctttgattccttcttataatggtatgtctt

SEQ ID NO: 473 - DNA, 1716 bp; double-stranded, linear
ggggcanaaattccaatacactcattaccaaatatatacaccacttcctgctacaagtnnttttacttgatcttggtcttttccgcagaaagagcatttccaaattttcttcatcttccattgaatttaaacattctttttacacccctattcgttaaagactatactagattggatgttacaatgcaacatattaacatacaaactttttgcttaaagaatagtagcagatacataagctakgcatckgctactcattttkgtaatttaatatttaatgaagattaatcttctttagttccttcaacgaactttgcgttatctcttaataaatcgataactttttggatacgaacatcatttttaatgatatcagtattacctaaagtatttttgatatcttcaactgagatattaaattgtttactcattttttctaattctttatcgatatcttcatcagtagcttcgattttttcagcttcagcgatcgcagttaaagttaagttagttttaacacgttgttctgcatcgtctttcatttgctctcttaattgagtttcatcttgacctgagatttggaagtacgtttgtaaatctaaaccttgttgttgaattctttgtgcaaattcagacaccatacgatctaattcagtattaaccattgcttcaggaatatcgattgttgtattatcagtagcttttgtaatcgcttcttctttttcaacattttcagcatctgtagctttttgttcagctaaacgtttacgtaagttttctttgtactcgtctactgtatttgcttctgcatctaattcattagcaatttcatctgttaattctgggacttctttaaatttaatttcgttaacttttgttttgaaagttgcttctttaccggctaattcttcagcatggtattcttctgggaatgttacgacaacatctttttcttcgtcaactttcataccttctaattgctcttcgaaaccaggtatgaatgaacctgaaccgatttctaaatcgtaaccttcagcttgtccaccttcgaattcttctccgtcaactgaaccactaaagtcgatgttaactgtgtcgccattttcaacaacaccatcttctttaacgaccatttcagctaaatgtcctaagctgtggtcaatcgcttcttgtaactcatcatcagataattcagtttcttgtttttcaatttcaagacctttatagtctcctaatttaacttctggctcaactgtaactgttgcttcaaaaatgaaatctttacctttttcaatttgagtaacacttacttctggttgtgcaactggtttaatatcagtttcgtcaattgcttcaccataagcatctggtaataaaatgtcgatagcatcttgatataatgcttctacaccaaagcgttgttcaaaaattggacgtggcactttacctttacggaatccaggtacgttaatttgtttaaccacttttttgaatgcttgatctaacgctttgtttactttttctgcaggaacagtaacagttaataaaccttcgttaccttcctttttttcccaagttgctgtcatgtatatatacctccatgattaactaatttattttttcaacttccctattatatcatacgtctattccctatacaaacattgaaatcacaacgtttatatatttgtaaatcaacttttttcgtcaaaacta

SEQ ID NO: 474 - DNA, 795 bp; double-stranded, linear
tgaccaagtacgtttcgaagttgccattaaagcattaaacccatcattgaaagcattcgcacctgtacgtgagtgggcatggagtcgtgaagaagaaatcgattatgcaattaaacataatatccctgtatcaatcaaccatgattcaccttattctatcgatcaaaatctatggggcagagcgaatgaatgtggtattttagaagatccttatgctgcgccaccagaggatgcgttcgatctaacaaatgctttagaagaaacaccagatactgctgatgraatcattttaacgtttgataaaggcatcccagttcaaattgatggcaaaacatatgaattagacgatttaattttaacgttgaatgcattagctggtaagcatggtatcggaagaattgaccatgtagaaaatagacttgtaggtatcaaatcaagagaaatttatgaggcacctgctgcagaagttattttaaaagcgcataaagcattagaaacgattacgttaacgaaagatgtcgcacactttaaaccaatcattgagaagcaatttgctgaacaactatacaatggactttggttctcacctttaactgatagcttgaaattatttattgatagtactcagcaatacgtaagtggtgatgtcagaattaaattattcaaaggtaatgccatcgtgaatggtagaaaatcaccttacacattatatgatgaaaaattagcaacttatacaaaagaagatgcatttnatcaagacgctgctgttggctttatcgatatctatggtttacc

SEQ ID NO: 475 - DNA, 887 bp; double-stranded, linear
cgattgaaagaagacggttcagttgaaaagtttccaaagccagtaattagccaacaaccagaaggatatacgagtcattttagagatcctaaagtttttaaatatgatgrgaaatattatgcaatcattggtgcmcaaaataatgatcagcaaggtcgattattactttataatactgaagatataattaattggcattatttaggtgaaataaatacagagttggatgattttggatatatgtgggaatgcccagattactttaatgtagataatcaagatgtcatacttatttgtccacaaggtattgaaccaaaaggcgatcagttcaaaaatatttatcaaagtggttatatacttggaaagtttgatattgaaaagttaacatatgaacatgaaaattttgtcgagcttgataatggttttgatttctatgcacctcaaacatttttagatgaaaaaggccgacgagtactaattggatggatggggttaccggaaatcgaatatcctactgataatgaaggatgggcccattgcttaacaattcctcgtgtattaaatgtagaaaatggtcaacttaagcaacgtccatatccagcgttggaaaaattacgtcacaataaagagacagcatttaggctacgcaaataaatttactcgaaaattacatccgtatgaaggtaaacagtatgaattaatcatagatattttggataatgatgctaccgaagtgtactttgaattacgtacatctaagacttcttcaacattaattgcttataacaagcgtgaaaataaaataacattagatcgcagcgacagtggtttattgccgacaaatgttgaaggtacgacgcgtagtacgatattagacacgccattaa

SEQ ID NO: 476 - DNA, 1183 bp; double-stranded, linear
ttggaancaaaaaaccattggtaaaccgtgttnaaccggatttccgatggaccttttaaaacnaccaaatagaaagctttgataaaaggtaattatggtactgataacaaacaagttcaaaaacatcatgatttagtacgtatgcttttgatggatcaagatggttttttaactgaaaataataaagttgatcatttcattgatggaaatgatttatatgatcaagttttaaaagatattaaaaatgcaaaagatatatccatttagagtacwatactttcgcttwagatggttwaggtaaaagaattttacatgctttagaagaaaaattgaaacaaggtctagaagtaaaaatattatatgatgatgttggatctaaaaatgttaagatggcaaattttgatcattttaaatcgttaggtggagaagttgaagcattttttgcttcaaaattaccgttattgaatttcagaatgaataatagaaatcatagaaaaatcatcgtaatcgatggtcaactaggttatgtcggaggatttaacattggtgatgaatatctmggattaggaaaattaggatattggagagatacgcatttacgtatacaaggggatgcggttgatgcactgcagttgcgatttattttagactggaattcgcaagcgcaccgtccacaatttgaatatgatgttaagtatttccctaaaaagaacggaccattgggcaattcaccaattcaaatagctgcaagtggcccggctagtgactggcatcaaattgaatacggttatacaaaaatgattatgagtgcaaagaaatctgtatatttacaatcaccatatttcattccggataattcatatataaatgccattaaaattgctgctaaatcaggtgtagatgtacatttaatgattccatgtaagccagatcatccattagtatattgggcgacattttcaaatgcctctgacttattatcaagtggtgttaaaatttatacgtatgaaaatggatttatacattctaaaatgtgcttaattgatgatgaaatcgtatcagtgggcacagcaaatatggactttagaagttttgaattaaattttgaagtaaatgcctttgtatatgatgaaaatcttgctaaagatttaagggtggcttatgaacatgatattacaaaatc

SEQ ID NO: 477 - DNA, 2332 bp; double-stranded, linear
ggttatatgtttggtattactcattatattgattggaggttgtgtcattatgacaaaaacaaatggtcgaaacgctcaaattaaagaaaatttcaacaaaacattaagtgtatatctaaccaagaatctcgatgatttttacgataaggaaggttttcgagatcaagaatttgataaaagagataaagggacttggattatttattctgaaatggttatcgaaccaaaagggaanaatatggaatcgagaggaatggtgctctatatcaatcgcaatactagaacmacgaagggtaattttattgtcaccgaaataactgaagatagtaaaggatattcacgtagtaaagaaaaaaaatatcctgtcaagatggaaaataatcgaattattccaacaaagcctataccggatgacaagttaaaaaaagagattgaaaactttaagttctttgtacaatatggaaattttaaagattttaaagattataaaaatggtgatatttcatataatcctaatgtgccaagttattctgcaaagtatcaattgaataatgatgactataatgttcaacagttaagaaaacgatatcatattccaaccaaacaagcgcccgaattaaaattgaaaggatccggcaatttaaaaggctcatccgtaggatctaaggatctagaatttacgtttgtagaaaatcaagaagagaatatctatttttcagattcggtcgaatttacacctagcgaggatgataaatcatgagtcaaacggaatatcaaataaaatctggcaatataaaaggtaactctgaagaaacaagtacagtatctaatataagttatgaaatagaaaacgcaaataacagtggtttaaaacaaaataaaattgataaacaaattaaaaagttacaagaaaaaaataaattccctaaaaatctttcatatcttaaaagttatacggaccccaaaacaggcacgactacaagcgcctttttaaataaagacactggcaaagttactttaggtatgacaggtactaatgtacacaaagacgcaatattaaaacaaacatttggtgttccttcttatcaaggatatatagacgtgagtgaaacgctaaaagatattggggccgatgtcaatattggccttcattccgtcacagataaagatccacattataaaaatacccaagactttatcaaaaatatcaaaaaagactatgatattgatattattaccggacattcgctgggcggtagagatgcgatgattttaggtatgagtaatgatattaaacatatcgttgtgtataatccagctccattagcgatcaaagatgtgagcggcctttatgccgatcaagaagaacttaaaaaattgattgaaaagtacgatggtcacattgtaagatttgtgtctgatgaagacgaattagatgcaggtgtccgcaatcatttatatgaaactgctggagaaaaaatagtacttaaaaatggagaaggccatgcaatgagtggtattttaatgagcagaacacaggctataatcttagctgaattaaacaaagttaaaggctaccaagacgaaaataataaagcattaaaatccgttcgtaaacaaacgaggcatagattacataaagtagagacgttaagagcgaattggattcaaacaacgggtggatcactctcttcctcccwacaacaattattagaagctttaacagcactaaccattgccgaaggcttaaatcaattagtgaatgaagaaagccaacatttgaaaaaatgtatcacgcgatggcacataaatttggagacaactggaaaaaagcgcaagaagttggaaatgaaattggtgaaaaattaacctctgaagaggttatagatgrattaagaaaaggtggcgcgtatgaaagtaaacttgaaacagatcccaaaagaaaaattgatgataagataaagaaattaaatgatgtttataaaaattgtaatggctatatcgcaaaaattaaacagagtatcgaagcaattgtttctaatgaccaaatgttagcgagccagattgatgggatgatgtaatgtttactacgtataanaatattaatgaacttgaaaatgcctatgatgaagaaagaaaacaattgaatgatgcattcaatcaaattgatgaattaagacatcaaacacgcaagamatgtgaacaaatgtatgatcatttcttatatctcaaacataaaatgaattmymstgaagacgctatgatcaggatgacacgtattatagaatctttcgatagagaaacgaatcaacgtatccgacatcacgaaatg

SEQ ID NO: 478 - DNA, 865 bp; double-stranded, linear
tttactacccagtatctctttttataaattatatagccaccacatatggtggaaagtctttttaattagaattttgttttttcagttaagaaagcttctaactctgagattggcatacgaacttgttccattgaatctctgtcacgtactgtaacttgattatcttctaatgaatcaaagtcgaatgttacacaataaggtgtaccgatttcatcttgacgacggtatcttttaccgatagattgtgattcatcgaaatcgattgagaatttagaacttaattgctcaaaaatcttaatcgttcgccagataatttcttacttaaaggtaaaatcgctgctttatatggtgctaatgcaggatggaagtgtaaaactgtacgtgcatctttactaccttcaacgccttcttcatcatatgcatcacataagaaagctaatgttacacgatctgcaccaagtgatggctcgatacaatatggaatatatttttcgttcgtttctggatcatggtatctgaaatcttcaccagagtgttcagcatgtttacgtaagtcgaagtctgtacgacttgcgataccccataactcaccccaaccaaatgggaatttatattcaatatcagttgttgcatttgagtaatgagataattcatcttcatcatgatcacgtaaacgcatattttcactgctcatatttaagcttgttaaccagtcacttgcaaaagttttccaataattttgccattcgatttcttctccaggtttacagaagaattcaagttccatttgttcaaattctcttgttctgaaaatgaagttacctggagtgatttcattacggaatgatttaccaatttggaccgg

SEQ ID NO: 479 - DNA, 1444 bp; double-stranded, linear
taatgagtaaataagtaccagataaaatcatgaatatcatccaacatgcggttaactctactaaataattaataatagtattttcagtaaacaaagaactatgtatacttcgcatcacattagaatacgtatgtttcgcattttgatctgcaacaaattgattgttatgatctagaaagacgtaacgttgatttcctgccatatcactcagtgtaattcgtttgttatatggttcatcaagtatgctaactttacttacaaagaatccttcatattgttgttcaacttgatgtactgcatcatttaatgtttgatgcgtttttacatcactgtcaccaaaaaactcattcttataaatattattttcaacttctggaaagaacaagtaaccaatgcccgaaatggttaaagtgattaacagtggagcaataaatattgctgcatagaaatgtaatctttgtaatggattaaatgtatttttcatatttccctcccaattggctattatacggtgtcaattctgtgatgtgtgtgaacaaactgtgacaatatttattttctagaaaaatttaacgatgatttgtgatttttagaaaaatgaacttttaagttggaatgtttgaagaaaattgattattcgtatgttttatcaagcagctatgataaaatttaaacataatacaatgcgagccatttaacgatctatgtttaaatggacatcgatattgtatgaattcgttgtaacaagcaagcatttctatgtgaacgaaccaaaggggaaagtaacatgattaataaagaacaattagatcttttatataaattaaaaaaagaagttgaaaagtcgcgaaatgaagcacttttacatacaattaaccaagtaattaagaaagtatatttgcagcaatatacatgttcgttcgttggacatttttctgcaggtaaatcgacactgataaatttattaattgaacaagatatcttaccaagttcacctgtaccaacgacaagtaatactgctattgtgtcagtttcagacaatcacgatattattgctaatttgccgaatcaaacgtatgccaaattatctaattatgatgaagtaagggaaatgaatcgccaaaatgtcgacgttgaatctgtagaaattaattttcaatcagctaaatttgaaaatgggtttacgttgcaagatacaccaggtgttgattcaaatgttgcatcacatcagtcaataacagaacaatatatgtatacaagtaatatgatattttatacggttgactataaccacgttcaatctgaacttaactttaagtttatgaagcatataaatgatgttggaatacctgttgtgtttatcattaatcaaattgacagcatccaagacgatggaattgtcattctctacgtnttaaatctcgagttggaaaaatcaattggc

SEQ ID NO: 480 - DNA, 6309 bp; double-stranded, linear
gcagcagcttatcgtgagttatcattattattacgtagacctccaggtcgtgaakcatacccaggtgacgtattctacttacatagtagattattagaaagagcagcaaaattaaacgatgacttaggtggcggttcaattactgcattaccaattatcgaaacacaagctggtgatatttcagcttatgtaccaacaaacgttatttcaattacagatggacaaatcttcttacaatctgatttattcttctcaggtgtaagaccagcgattaatgccggacaatctgtatctcgtgttggtggatctgcacaaattaaagcaatgaagaaagttgctggtacgttacgtcttgacttagcgtcatacagagaacttgaatcatttgcacaattcggttcagaccttgatgaatttactgcaagtaaattagaacgtggtaaacgtactgttgaagtcttaaaacaagatcaaaacaaaccattaccagtcgaacaccaagtgttgattatttatgcattaacaaaaggatatttagatgatattccagttgtagatatcacacgttttgaagacgagttaaaccactgggcagaatcaaatgctactgaactgttaaatgaaatcagagaaactggtggcttaccagatgctgagaagtttgacacagcaattaacgaattcaaaaaaagctttagcaaatctgaataataaacaagtttagtataaggtggtgagatagtggcttctcttaaagaaatagatactcgaataaaatcaaccaaaaaaatgaagcagattacgaaagcgatgaacatggtatcaagttcaaaacttcgtagagctgaaaaaaatacaaaacaattcacaccatatatggataaaatgcaagatgcaattactgcagttgcaggggcaagtagcaatacaaaccatccaatgctaagacctcgtaaaattactagaagtggatatttagttatcacgagtgataaaggtttagcaggtgcatatagtgcaaacgtgcttaaaaaattgattactgatattgaagcgaaacatcaagatagtagcgaatacagtattgtagttttagggcaacaaggtgttgatttcctaaaaaatagaggttatgacattgagtattctcaagtagacgtacctgatcaaccttctttcaaatctgttcaagcactagctaaccatgctatagacttatacagtgaagaagaaattgatgaattaaatatatactatagtcattatgtcagcgttcttgaaaacaagcctacatctagacaagtattaccattatctcaagaggattctagtaaggggcatggtcatttgtcttcttatgaatttgagccagataaagaatctatcttaagtgtaatcttgcctcaatatgttgagagtttgatttacggaacaatattagacgcaaaagcaagtgagcatgcaacacgtatgactgcgatgaaaaatgccactgataatgcaactgaacttattgatgacttatcattagaatataacagagcgagacaagcagaaattacgcaacaaattactgaaattgttggtggttccgcagcgcttgaataatatttaaaggaggaaaatagcatgggaattggccgtgtaactcaagttatgggtcctgtaattgatgttcgatttgaacataacgaagttcctaaaattaataacgccttggttattgatgtgcctaaagaagaaggtacaatacaactaacattagaagttgcgctgcaattaggtgacgacgttgttcgtacaattgcgatggattcaactgatggtgtccaaagaggcatggatgtaaaagatacaggcaaagaaattagtgtacctgttggtgacgaaacattaggtcgtgtatttaatgtactaggtgaaacaattgaccttaaagaagaaattagtgattctgttcgccgcgatcctatccatcgtcaagcaccagcattcgatgaactttcaacagaagttcaaattttagaaacaggtattaaagtagtagatttactagcaccttatattaaaggtggtaaaatcggattgttcggtggtgccggtgtaggtaaaacagtattaatccaagaattaattaacaacatcgctcaagagcacggtggtatttctgtattcgccggtgtaggtgaacgtactcgtgaaggtaacgatttatacttcgaaatgagtgacagtggtgtaattaagaaaacagccatggtattcgggcaaatgaatgagccacctggtgcacgtatgcgtgttgcattatctggtttaacaatggctgaatatttccgtgacgaacaaggtcaagacgtattattattcatcgataacattttcagatttacacaagctggttctgaggtatctgcattattaggtcgtatgccttctgcagtaggttaccaaccaacacttgctactgaaatgggacaattacaagaacgtattacgtctacaacaaaaggatcagttacttctattcaagcggtattcgtacctgccgatgactatactgacccagcgcctgcgacagcgtttgcccatttagatgcaactacaaacttagaacgtaaattaactgaaatgggtatttatccagccgtggatccattagcgtctacatcaagagcattggaaccatcaattgtaggtcaagaacattatgaagtagctcgtgatgtacaatcaacacttcaaaaataccgtgaattacaagatatcattgctatcttaggtatggacgaattatctgatgaagataaacaaacagttgaacgcgcacgtagaattcaattcttcttatctcaaaacttccacgtagcggaacaatttactggtcaaaaaggttcttatgtacctgttaagacaacagttgcaaactttaaagatatcttagatggtaaatatgaccatattccagaagatgcattccgtttagttggtagcatggatgatgttattgcaaaagctaaagatatgggtgttgaagtataacaattaggaggaatggataatgaatacattaaacctagatattgtcactcctaatggttctgtttacaatcgtgataatgttgaactcgttgttatgcaaacaacagctggtgagataggtgtcatgagtggacatattccaactgtagctgctttaaaaacaggctttgtaaaagtgaaatttcacgatggaactgaatatattgctgtaagcgatggctttgttgaagttagaaaagataaagtttcaatcattgttcagactgcagaaactgcaagagaaattgatgttgaaagagctaaattagccaaagcaagagcagagtctcacttggaaaatgatgacgacaatactgatattcatagagccgaaagagctttagagagagcaaataaccgtttgcgtgtggctgaattaaaatagtaaataaagggtcgaagatgtgatttcatatcttcgacccttttttgaattatattgatttaaagatacaaaacatgagaggggggaaggaattgataaagaaccattaaagatttatgatgtagtggttctttatcattaaacacagctaatgtgtatttaaaaataggaayacatgagtaaaactcatgtataagaaatactaatttctaaagaaaaagtatttctttatgttggggccccgtcaactactgccaaatacaacactatagagtctagacattgatttatgtccgactcccaagaatagttttacttttttacaatcactaatagattgctaaaatcaaaatttccttcaccactatctacagtcgacatttcattttttgaaattatctacattttttcataccaagatattttatagttatgatatttatgtaaaaagaattatatagtaagttagcttaaactttactaaaaacgggtattaaactttgtatcattatttaaatttttcatgtacaatgtaatacagtaatcttatgaggtgataaaatggattatatcggacaatatgcagttatccatttagtgttacatgttgtatgtatttgtattgcctattgggctttacaatcaattagattagatcaattttttaaaaaaggatacgccactcaattacaagtgtgtatgatatttgttgctattttattaggcactgcagtaagcaattttattgtagatttgttacaatactcgacgcaggtaaaatatttaataaaataagtctaactctatgatttgtaatcaaaactagatataattaaataatgacttaaaataattttaaaatagggaaatgtaaagtaataggagttctaagtggaggatttacgatggataaaatagtaatcaaaggtggaaataaattaacgggtgaagttaaagtagaaggtgctaaaaatgcagtattaccaatattgacagcatctttattagcttctgataaaccgagcaaattagttaatgttccagctttaagtgatgtagaaacaataaataatgtattaacaactttaaatgctgacgttacatacaaaaaggacgaaaatgctgttgtcgttgatgcaacaaagactctaaatgaagaggcaccatatgaatatgttagtaaaatgcgtgcaagtattttagttatgggmcctcttttagcaagactaggacatgctattgttgcattgcctggtggttgtgcaattggaagtagaccgattgagcaacacattaaaggttttgaagctttaggcgcagaaattcatcttgaaaatggtaatatttatgctaatgctaaagatggattaaaaggtacatcaattcatttagattttccaagtgtaggagcaacacaaaatattattatggcagcatcattagctaagggtaagactttaattgaaaatgcagctaaagaacctgaaattgtcgatttagcaaactacattaatgaaatgggtggtagaattactggtgctggtacagacacaattacaatcaatggtgtagaatcattacatggtgtagaacatgctatcattccagatagaattgaagcaggcacattactaatcgctggtgctataacgcgtggtgatatttttgtacgtggtgcaatcaaagaacatatggcgagtttagtctataaactagaagaaatgggcgttgaattggactatcaagaagatggtattcgtgtacgtgctgaaggggaattacaacctgtagacatcaaaactctaccacatcctggattcccgactgatatgcaatcacaaatgatggcattgttattaacggcaaatggtcataaagtcgtaaccgaaactgtttttgaaaaccgttttatgcatgttgcagagttcaaacgtatgaatgctaatatcaatgtagaaggtcgtagtgctaaacttgaaggtaaaagtcaattgcaaggtgcacaagttaaagcgactgatttaagagcagcagccgccttaattttagctggattagttgctgatggtaanacaagcgttactgaattaacgcacctagatagaggctatgttgacttacacggtaaattgaagcaattaggtgcagacattgaacgtattaacgattaattcagtaaattaatataatggaggatttcaaccatggaaacaatttttgattataaccaaattaaacaaattatacctcacagacagccatttttattaattgataaagtagttgaatatgaagaaggtcaacgttgtgtggctattaaacaagtatcaggaaacgaaccattctttcaagggcattttcctgagtatgcggtaatgccaggcgtattaattactgaagcgttactcaaacaggtgcggtagctattttaaatagtgaagaaaataaaggtaaaatcgctttatttgctggtattgataaatgtcgttttaaacgtcaagtagtacctggtgatactttaacgttggaagtagaaatcactaaaattaaaggaccaataggtaaaggtaatgctaaagctactgtcgatggtcaacttgcttgtagttgtgaacttacatttgcaattcaagatgtaaaataaaacaaaaaaaacattcaaagatttaatgtgttggcataatctttgaatgttttttattttactcttctaatttttcatcctttaactttggtttagactgcatcattcgattaaatgatttttttaattcttcaccagataatccatcatcaataagttggttctaataaactttcagcatactgttggacgtaaagng

SEQ ID NO: 481 - DNA, 1717 bp; double-stranded, linear
agttgctacaccagacatgatgggtgaagttggtaaattaggtcgtgtattaggaccaaaaggtttaatgccaaaccctaaaactggaactgtaacaatggatgttaaaaaagctgttgaagaaatcaaagctggtaaagtagaatatcgtgctgaaaaagctggtatcgtacatgcatcaattggtaaagtttcatttactgatgaacaattaattgaaaacytcaatacyttacaagatgtattagctaaagctaaaccatcatctgctaaaggtacatacttcaaatctgttgctgtaactacaacaatgggtcctggagttaaaattgatactgcaagtttcaaataataaatgatataaacaattacaggctgaaagaaatatctttcagtctgtaaaaatatattgacaataagtaatttccaagttatattacttattgtgattattttacctaagacagtaggagttatttataacttaaaatttatcctgccgaggctaaaattgacttgaacgtgatgatctatgatctttcaagcactttttgccgtgggtagaaagtgctttttttattaattttaaaaaaagcaccaaaaatttaaatggaggtgtctgaatgtctgctatcattgaagctaaaaaacaactagttgatgaaattgctgaggtactatcaaattcagtttcaacagtaatcgttgactaccgtggattaacagtagctgaagttactgacttacgttcacaattacgtgaagctggtgttgagtataaagtatacaaaaacactatggtacgtcgtgcagctgaaaaagctggtatcgaaggcttagatgaattcttaacaggtcctactgctattgcaacttcaagtgaagatgctgtagctgcagcgaaagtaatttctggatttgctaaagatcatgaagcattagaaattaaatcaggcgttatggaaggcaatgttattacagcagaagaagttaaaactgttggttcattaccttcacacgatggtcttgtatctatgcttttatcagtattacaagctcctgtacgcaacttcgcttatgcggttaaagctattggagaacaaaaagaagaaaacgctgaataatttttagcgtaaaaaaattaaaaataatggaggaattataaaatggctaatcatgaacaaatcattgaagcgattaaagaaatgtcagtattagaattaaacgacttagtaaaagcaattgaagaagaatttggtgtactgcagctgctccagtagcagtagcaggtgcagctggtggcgctgacgctgcagcagaaaaaactgaatttgacgttgagttaacttcagctggttcatctaaaatcaaagttgttaaagctgttaaagaagcaactggtttaggattaaaagatgctaaagaattagtagacggagctcctaaagtaatcaaagaagctttacctaaagaagaagctgaaaaacttaaagaacaattagaagaagttggagctactgtagaattaaaataattcaagtatcttaaacttaataatcaaagttttatagcaagtattgctataatataatgattctttgagaagttaaaaccccgttattttgataacggggttttattcatttaaagactgagtgaaatgttataattataatgacgagttacaaagtgaagatgaggtgggaataatgagtca

SEQ ID NO: 482 - DNA, 1279 bp; double-stranded, linear
gtaaatctgttactcgaaatgtaacgattaaagaaaagggctcatctcaaacatatattttgttaggctatccaacaaaagcacagaagaatagtcatagcaaatatagtggagtctttatatataaagacttgaaatcaatcgaagatacaaataatgctattacgattatcaccataattacggctgttattttcttaacaattacaacagtctttgcgtttttcttatcgtcaagaattacaaaacctttaagacgtttaagagaccaagctacacgtgtatctgaaggggattactcttataaaccttctgtcacaacgaaagatgaaattggtcaattatcgcaggcatttaatcagatgagtacagaaatcgaagagcatgtcgacgcattatccacatctaaaaatattagagacagcttaattaactctatggtagaaggtgtcctaggtattaatgagagtcgacaaattatcttatctaataagatggcgaatgatattatggacaatattgatgaagatgctaaagctttcttattaagacaaatagaagatacttttaaatcaaaacaaactgaaatgcgcgatttagaaatgaatgcacgattctttgttgtgaccacaagctatatcgacaagattgaacagggaggtaaaagtggtgttgttgtgacagttcgtgatatgactaatgagcacaatctagatcaaatgaagaaagatttcattgctaatgtatcacatgaattacgtacaccgatatcattacttcaaggttatactgaatcaattgtagatggtattgttacagaaccggatgaaataaaagaatcgcttgccattgtccttgatgaatcgaaacgtttaaatcgtttagttaatgaattgttaaatgtcgcacgcatggatgctgaagggttatccgtaaataaagaagttcagcctattgcagcgttactagataagatgaaaattaagtatcgccaacaagctgatgatttaggtctaaatatgacttttaattaytgtaagaagcgtgtttggagttatgatawggatcgcatggaccaagtactaacgaacttaattgataatgcatcacgttatacgaaacctggagatgaaattgcaattacttgtgatgaaaatgaaagcgaagatattttatacattaaagatacaggtacaggcattgcaccagaacatttacmacaagtatttgatcgtttttataaagttgatgcagcgnanaaccccgnggtaaccangta

SEQ ID NO: 483 - DNA, 1144 bp; double-stranded, linear
gagctgttgttactttgatgcctgcagctttattacggctgacttggtaatgataagtttcagcatattgctcaatatatgctatatcatattgaatggtacgaggtgatacaccaagttgattagcaatggtattgattggaataaacgtttgctcatgaattaaaagatacaaaatttcgatttgtctataacttaacaacgtaatatcctcctatttgtaattgtaagcgatttcttaaaaacgtagatatgcaatctctttcatattttaatccgaaaaattgcatatcaaaatgtttatggcgcaagattttataggaacttttaaaataaattaratattcatgttgacaatttaaaaatgtcgcagtatatttagttagacatctaacgaaatggtggtgcaataaatggaattcacttattcgtatttatttagaatgattagtcatgagatgaaacaaaaggctgatcaaaagttagagcaatttgatattacaaatgagcaaggtcatacgttaggttatctttatgcacatcaacaagatggactgacacaaaatgatattgctaaagcattacaacgaacaggtccaactgtcagtaatttattaaggaaccttgaacgtaaaaagctgatctatcgctatgtcgatgcacaagatacgagaagaaagaatatagggctgactacctctgggattaaactcgtagaagcattcacttcgatatttgatgaaatggaacaaacactcgtatcgcagttatctgaagaagaaaatgaacaaatgaaagcaaacttaactaaaatgttatctagtttacaataaatgataagtgtgactggtagaaatcagtcactttgtctttaatattatagttagatatctaattgttagtaagctaattattggaaaagacaaggagtattgaacaatgaaagacgaacaattatattattttgagaaatcgccagtatttaaagcgatgatgcatttctcattgccaatgatgatagggactttattaagcgttatttatggcatattaaatatttactttataggattttyagamgayagccacatgatttctgctaatctctctaacactgccagtatttgctatcttaatggggtta

SEQ ID NO: 484 - DNA, 1158 bp; double-stranded, linear
acaaccaattttactaaacatggtrrtcatgcattttcaatatttagatgtcgaccgcataatcgaagaatcgccgacaatagtacttatcgatgagttagcacatacgaatatttctagagatcgtcatgagaaacgatatatggatattgaagaaattttaaatcatggtatcgatgttcataccactttgaacattcaacatattgaaagtttaagtagtcaaattgaactgatgaccggtgtacatgttaaagaacgtgtacccgactatttcataatgagcgccgatgtattagaagtcgtagatatctcacctgaacaattaattaaacgcttaaaagctggcaaggtatataaaaaggataggctagatgtagcatttagtaatttctttacgtatgcccacctaagcgaatgcgtacattgacgttaagaacagttgccgacttgatgagtgataaagaaaaagtccgacacaaccataaaacgtcactcaaacctcatattgctgtggcaattagtgggagcatttataatgaagcagtaattaaagaggcattccatattgctcaaaaagaacatgcgaagttcactgctatttatatagatgtattcgaaaaaaacaggcaatataaagatagtcaaaagcaagtgcatcaacatctcatgcttgcaaaatcattaggagcaaaagtaaaagtagtttatagccaaaccgttgcattaggattagacgaatggtgtaaaaatcaagatgtaaccaaattaattatcggacaacatattagaaataagtggcgagactttttcaatacacctttaattgaccatttaatgtcctttgaacatagctataaaatcgaaatcgttccaatcaaacaaatacctgttgaattgaaaatgaacaaatcaccctatcgtcctaaaggcaaacgtttcgccatagatatgttaaaaatgattttgattcaaataatttgtgtaatgatgggactgtggatttatcaacttgataagcatgagtctagtacgattattttaatgatttttctcatcggcatcattttattatccatttggacgcggtccttcatcattggcttttagcagcaattattaacgtatttgtgtktaattatktttttacggaaccta

SEQ ID NO: 485 - DNA, 2224 bp; double-stranded, linear
atcatatggtcgatttaacagatccaacgtactgctaaataattacatgacgtttaaacatagcattgattataactatttctaagtcttcgcattatttgcgatgatgtgggaatagttatttttatttaaaaatataaaaaaatagatgcagcaaaattttaaagcattttattttgaacatattaaaagggagcgtatcataatggaatgtaatgtttatatcgtatgcattacggataaataatatataaatcattcttgaggagtgaaagaataatgagagactacacaaagcaatacattaatggcgaatgggtagaaagtaatagtaatgaaacgatagaagttataaatccagcaaccgaagaagtaatcgggaaagttgctaaaggtaataaagctgatgttgataaagccgtcgaggcggcagacgatgtttatttagagttccgtcatacatctgtgaaagaaagacaagcgttattagataaaattgtaaaagamtatgaaaacagaaaagacgatattgtacaagctattacggatgaattaggtgctcctttatcattatctgagcgtgtccattatcaaatgggactaaaccattttgttgcagcgagagacgcattagataactacgaatttgaagaacgccgcggagatgatttagttgttaaagaagcaatcggtgtatctggattaattacaccgtggaacttccctacaaaccaaacatcattaaaattagcagcagcatttgcggctggtagtccagttgtacttaaaccatctgaagaaacaccatttgcagctgttattttagctgagatttttgataaagtcggtgttcctaaaggtgtatttaaccttgttaatggtgatggtgctggtgttgggaatcctttatctgaacatcctaaagtacgcatgatgtcatttacaggatcaggccctactggttctaaaattatggaaaaagccgctaaagattttaaaaaggtatcattagagcttggtggcaaatcaccatatatcgtcctagatgacgtagatattaaagaagcggctaaagcaacaacaggcaaagttgttaataatactggtcaagtatgtacagctggtacacgtgttttagtgcctaacaaaattaaagatgcattcttagctgaattaaaagaacaatttagccaagtgcgtgtcggtaatccaagagaagatggtacacaagtaggccctatcattagtaaaaaacaatttgatcaagtacaaaattatattaataaaggtattgaagaaggtgctgaattattttatggtggtcctggtaaaccagaaggacttgaaaaaggatactttgcacgtccgacaatttttattaatgtagataatcaaatgacgatagcacaagawgaaatttttgggccagtaatgtcagttatcacttataacgatttagatgaagcgattcaaattgcaaatgatacaaaatatggtttggcaggatatgttattggtaaggacaaagaaacattgcataaagtagctcgttctattgaagcaggtacagtagaaataaacgaagcaggtagaaagccagatttaccatttggtggctataaacaatctggtttaggtcgtgaatggggcgattatggtattgaagagttcttagaagtgaaatctatagctggatattttaaataaatttgatttttgaattaaaaatcgcaataaaacagtgcacatgactaattaagttttgtgtactgttttaattttgcaatttttataaatagattttgtaattaaaataaaaatttgctatagttattcatgtatttaaaaggttggggattagcataatgggattgtgctagcacagttatttatgcattgtcatgcctatctattacttactaactaaaaaataatgaaatgggtgtaaactatatgcctgaaagagaacgtacatctcctcagtatgaatcattccacgaattgtacaagaactatactaccaaggaactcactcanaaagctaaaactcttaagttgacgaactatagtaaattaaatnaaaaagaacttgttctagctattatggaagcacaaatgganaaagatggtaactattatatggaaggtatcttagatgatatacaaccagatggttatggttttttaagaacagtgaactattctaaaggggaaaaagatattt

SEQ ID NO: 486 - DNA, 1690 bp; double-stranded, linear
acattacnttgaatcgaaagtttcataaacgacttgaatgccagtttctttttcaaatttcttaattaactctggatcaatatattcgccccaattgtatacgtaaattttttgatttgtatgcacttgttctttagatttaaaccaatgacttaaagtaagacaaagcatacccacaactaatgcacctataatgagttgtaaaaatcgtttcattattttacacctcgcttgattagttttttcttatttatcacgtattgaatcaaataatatcctagtattcctaatacaataacagcaaacaataatgttgaaatcgcattaatttccatactaattccttttctcgccatagcataaacttcaactgataacacactaaagccattaccagtaacgaagaaacttactgtgaaatcgtctagtgaataagttaaagccataaagaatcctcctataatagaaggtaaaatattaggaataataatgttgcttaataattgtggttcagtcgctcctaaatctcttgcagcatttaacatattattattcatytcatacagttgtggtaagacgataatcacaactataggtatgcaaaatgcaatatgagatattagaactgtccaaaakcctaaaccaagaccagtaaaatggccaatcgttgtaaacataattaagaatgatgcacctatgacaacgtcggatgataccatcaagacattattcaatgttagtaaagttactttaaactttttatttcttaaataataaatagcaatggcaccaaatgtaccaataactgtagaaattgaggctgctaaaagtgctacagctatcgtattaaaaatgaccgacattaaatgatcattttgaaataatgattgataatgctctaatgtaaaatgttcaaagtgaatcatattaccagccgaattgaatgaatagaacattaaaaagaatattgggatgtataaaatcgctaaaagtatcccgatatacagctttccataccatttcatatgattcaccctctcccattagatgattttgtaatgattaaaatgaatgccataaatacaattaagaatatagctatagttgatcccataccataattttgaattgttaaaaattgttcctctattgccgtacctatatttatgactttattacctgcaattaatcttgtaatcataaataatgaaagtgatggaataaaggttacttgaatcccagtcataacaccttcttttgttaacggcatgattacttttctaaaagtatagaaaggactggcacctaaatcacttgaggcctgcaataaattattaggaattgctttcatgctattaaatataggtaaaatcataaatggtatataaatgtaacttgccactactaaaaacgcaccagttgtaaataacaaattgaatgatggtaaattaaataagtggaaaattgattaatcacgccatcatgacttaataaacctataaaagcatatgtctttaacaataaatttatccatgttggaataatcattatcattaataagatattttgaaatttcgaacgagtaatataataggcagntggataactgatagtcaaggtaataattgttattgaagcggcatataaaattgaatatgcaaacattttcaaatattttgtagtaaaaatt

SEQ ID NO: 487 - DNA, 2112 bp; double-stranded, linear
acgaaaagaaatattatgatgaacaaaaagaaagaataacgatttatatgaagtacaatgtgaaaggttataaaaatataagcttcgctaattttaaagaaaacccaatggatggttattctattagtggttatataaataatgataaaaagttatcatttacagctggtataagatctgttgatgattttcaatttgataccgatatttcttatacagatgaattgggtagaaaatttaataaaaatcctaagtcagtttctgaaataaaaaaagagcaaaatacgtccaataaataattgttcatattgtgatgaaacaaaaatataagtcattagatgagtttaactatgttataaatatttgtagtatctataaaaatctcgacactattaaaatgataaagtgccgaggttttcttacttatttagttaattcaaagtttatgccagattcataagaatttgtgacacttttaatagtgtaccattgattattacaatttatcaaatggtcctttagaaggtataaataacaaaataaaattaattaaacgtacatcttttggttatggaagttacaatcatttgcgcaatcgaatattattatgttcaaaactttacgctccaaaaagtaaaaaggaagttaagcaatgtttagttgcttaacttcggatattgaacgcatcagtccaatttgacatagagccttttttagttcttgatgtttctctttaaaaccttgcatattttacaaaaagaaaaattagcagtataattaagacaacgaaaataagtatttacttatacaccaatcccctcactatttgcggtagtgaggggatttttattggtgcggctatatgtcacctattttgtattgcgtctacttagccaataagaaaaaaacgcaatggcacagccactgatgactggtgctatgatgtgaacgaaaataagcatcaccttatacacctcctctctgcgtctaaattgacgsctgagagrtaggcgactctactattatatcatcggcaaatatacaagcacagtcacttgcttctgataagttatatgattctagctgatagattgaatcgtctacacttaattggacaaattctatgagaatagatattgttaatttaagaaagtaggcgattttattatgacaagagaaagaagatcatttagttcagagtttaagttacaaatggttagattatataaaaatggtaagcctaggaatgaaattatacgcgagtatgatttcacaccttcgacgtttgtaaatggcggttataaaatgtaggaaaatggataaagcaacatcaaaacacgggtacattcaatcaccaagataacttatcggatgaagaaaaagagctgattaaattacgcaaagaagttcaacatttaaaaatggagaacgatattttaaagcaagtagcgctgattatggggcaaaaatagaagtcattcaaaagaatgcacatcaatattcagtatcagcaatgtgtaaagtcctgataatactaagaagtacctattatgattctataaaaagaaaagataataaaatcactaaagatgattcaaacatagaacatgccgtcataaatatttttaattctaatagaaaagtctttggtacaagacgaattaaaaatcatttaaatgacaagggtctcactgtatctggacaaaagataggtcgatcatgaaaaaatctagtttctgtttatacgaaatctaaatacaaaaatcatctaaaagaaactaatgaaaaacgaattaaaaatctttattattagctgctggtgtattatttgttagtccaatttcattatcttataattcagatgtagctcatgctgaagataagttagaccattctcaagcaaaggtaatatatttgagtaaccaaaatttatttgatgaacttgagaaaaaaggttataaactggaagatatatttacaaaagaagaaataaaaaaatataaagctgaagaccaattgagagcgggtaaaactcaatatgtagaaacaggtaaagatactgcaacattatatctttcttctgcatatacaaaaacaatagctgctttaggt

SEQ ID NO: 488 - DNA, 454 bp; double-stranded, linear
gtaggcacacatctgccatataaacattcttttatactagtgttctcatatagtgtagagttatagtctccttcttgaatctcgaataattcaatcaacctatcaaccttagtctcttccgttacttctttttcaatatcaactatgaaggggatatcaattggaataaaacttgacgtcgaacacttatttgtatttggatgaaaacgaacgaatccatcactaaatcctgttgaaaaaaatatttttccttgtgatagatccggattttctcgcgcccatttaattaattcatctaatctcatttcttttttaactttgattttcattgttatatctcctcttgaacagtaaatttatcgttaattgatacgtatccagtcacattacataagatgctatcaacatcaaaagtcacacaacagttgcgttcaacatcatttgaatagaatct

SEQ ID NO: 489 - DNA, 1372 bp; double-stranded, linear
ttgtcagaattagaatgcttttgagttacttcataatactcatcagttttttgtgtatccttttgacttttatttatttctttccacttaccagtatgactttctttttttacagttattttcggtttgtttaaaaaatgataaccgatgttctttttggtatctgtggactctaaaaagactgaattgttttcctgattatcagaattggttgtttgtttatcgtctgtatataacgtatacccattcgctttgcgattttcaatcgttgtaactggattctttgatgaatcagtacttttaatgccagttcctaagaagacaattttatcgtttaatatgaaatatgattttttggcagttaaagttttgtcctgattttcaaaatccattccgatactagcatgttggtcatcaacttttgttccgccaacaaaagttttactcgactttttatcatccgtatcttttaatatttcattgtctaaagttgttgtacctgataaacgtttcatatcggctgtcacccagaagttatcatgatagtgtttgacatcgctgttatataaataagacattccagcaccagtgtgccaaccttttaaattctctccgttgatactttcatagcgtgctacgtttttcgacgtcatacttaaaccaaatgcaaagtctaagtctttgttatgataggtgacacgatccatgtcattatatattttaagttgttgtgttaatccgtttttagaaatactgttatctgtcattaaagacttcattttatctatgtccgaatatgaatttaaataatcattttgtttataacttgaatctgactctactgaagatttgacaatctttttatacttagcttttgttgaatcatccatggcatcacttaatctcaacaatgatttcattactgttgcagatgctgagtgactggtttcattttcacgactgatagctctacctcgtgataaatccatcatttcacctttataaatgagtggcataaatccgtcgtcaatccatgactttaaggttgtatcattttgggttttatcattaaaaggtgtttcttttatcatcggcatcatttgagaaatcccctctaagagtacaacgccataagcaccagtgtatggaacgtcttgatgatcaatgtaagagccatctttataaaatccattacgttctttaccagtggcagaatcttgaacgtaagtgaagactttattaaatgaatctatagactttttcatcatatctttatcttcttcgataatacattctaaaagtttcaccttagaaatgtctactanatttccgcctttagcaagttcagnttttcctacacaagataatattt

SEQ ID NO: 490 - DNA, 564 bp; double-stranded, linear
acaacaatatagtaaagcgtcgttaattaaacaatgggaccaatttgttcgtcttatataaatgtactttacctttatttttacaaaaatagcattttcctatgtcatttaactaaacatgtaagttcgtatgaacgaggtttgttaaatagatgattctaggaaaatgcttttttcttttgacttagtttaaaatattttgccactttgtactgatagtagttgcattgtactgttgtgcagattctatgctattaattgaaaactgttgcaatttttgagtattatttagtaattggtcgaccttttcaaccatttgattgatgtcaccttgaggtactaaatagccattaaatccatcttgaatcagttctgatggaccataatctacatcataactgatcactggtgtacctactgaaagcgactctaaaattgctaagccaaaaccttccattttacttgtcgataacatcagttctgctttagcaatctcttcattaatatgcgtcttaaaaccatgaaatttaacatgttccagatatnatgataatcttctacaag

SEQ ID NO: 491 - DNA, 1277 bp; double-stranded, linear
tatccaccccacganagccccggaaacttattgtgttacaagatatataagcagaaacgaacaacagttaacaaaataaatgaaattaaacgttttaaaaatgaaacaaatgaaatcatctattaggttatgaaactgtttatagcttgaatagaagcatttattttttaggaggacaattattatgcgtcaaacatttatggcaaatgaatcaaacattgagcgcaaatggtatgttatcgatgctgaaggccaaacattaggtcgtttatcatcagaagtagcatctatcttacgcggtaaaaataaagtaacttacacaccacacgttgatactggtgattatgtaatcgttattaatgcatcaaaaatcgaatttactggtaacaaagaaactgacaaagtttactaccgtcactcaaatcacccaggtggtatcaaatcaatcactgctggtgaattaagaagaactaacccagaacgtttaattgaaaactcaattaaaggtatgttaccaagcactcgtttaggcgaaaaacaaggtaaaaaattatttgtatatggtggcgctgaacatccacacgctgcacaacaaccagaaaactacgaattacgtggttaattagaaggaggaaatgactttggcacaagttgaatatagaggcacaggccgtcgtaaaaactcwgtagcacgtgtacgtttagtaccaggtgaaggtaacatcacagttaataaccgtgacgtacgcgaatacttaccattcgaatcattaattttagacttaaaccaaccatttgatgtaactgaaactaaaggtaactatgatgttttagttaacgttcatggtggtgnttcactggacaagctcaagctatccgtcacggaatcgctcgtgcattattagaagcagatcctgaatacagaggttctttaaaacgcgctggattacttactcgtgacccacgtatgaaagaacataaaaaaccaggtcttaaagcagctcgtcgttcacctcaattctcaaaacgttaattgtcggacgatatatacaaaacacctcgatattatgtcgaggtgtttttttggcgtttttgcggcgaatatggaatgtgtagaatataaatgaatttttaccttcccaccataaaagatgaagaaccatgaatgtggagaacaataaatagttggatattctgttatttttttggaagtggaagtggatttggaatactttactcnaaacgattaaaaggtttaaaaaaacaacaaanagaaa

SEQ ID NO: 492 - DNA, 673 bp; double-stranded, linear
ntcaacaccttttatnccaccaagttattccactctttgttgataagtacgcatgttctcttattgacattgtttttatccaaaattcattgttaagacattttctttatgaaataataatnatattgaagtatatttttattattattaaaaataaataaggggatacttatgagcacaaatcaaacatttttaatatttgttatagcaattattctacttacatctgtaataggaattgttggacgatacatgagtcgtcaacgtctattaaaatctatggaaacattatggcaaacgatttctccattagaagcttttatcagaccgaactcacatttcgactatgagtataagctctacaaggaaaaatttgaatcacattcattagttgatgataaaacttggtccgacttaaatatgaatgcaatctttcataagatgaattataatttaacagctattggtgaaatgaagctatatgcctgtttacgtggaatgctttcaattacgaacaaatcattacttagtttatttaatgataatgctgaatttagaaaaaacgtaacatatcatttagctttgattggtaaaactgttatccaacatttccagaccaaatcacaccggkaaacgtccaaatatattgntctatgcccggtttaccagtatc

SEQ ID NO: 493 - DNA, 1240 bp; double-stranded, linear
aaaaaaagttaatgctgacggtgtattaacttttgatattctagaaaataaatatacttatgaagttattaacgctatagggaaaagatggattgttagtcatgtcgaaggtgaaaacgacaagaaagaatatgtaataactgtcattgataggaaatcagaaggcgacagacaactggttgaatgtactgctagagagattcccatagacaagttaatgattgatagaatttatgttaatgtaacaggatcttttacagtagaaagatattttaacattgtgtttcaaggtactggaatgctttttgaagtcgagggcaaagttaaatcttcaaagtttgaaaatggtggtgaaggcgatacaaggttagaaatgtttaaaaagggattagaacatttcggtttagaatataaaataacgtatgacaaaaagaaagacagatataagtttgtattgacgccttttgcaaatcaaaaagcgtcttattttatttctgacgaatcaacgccaacgctataaaactcgaggaagatgcaagtgatttcgccaccttcattagaggatatggtaattattcaggagaagaaacattcgaacacgctgggctcgtaatggaagctagaagtgcattagctgaaatatacggcgacatccacgcagaaccatttaaagatggtaaagtgactgaccaagaaactatggataaagaattacaatcgagattgaaaaagtcgttaaaacaatctttgtctttggactttttggtgttaagagaatcatatccagaagcagacccacaacccggagacatagtacaaataaaatctaccaaactaggtttgaatgatttagtccgtatagtacaagttaaaacgattaggggtataaacaatgtaattgttaagcaagatgtaacgcttggtgagtttaatcgagaacaacgatatatgaaaaaagttaatactgcagctaactatgtttctggattaaatgatgttaacctttctaatcctagtaaagcggcagaaaacttgaagtctaaagtagcgtcaatagctaaatcaacactcgatttgatgagtagaactgatttgattgaagataaacaacagaaggtaagctctaaaactgtgactacatctgacggcactatcgttcatgattttatagataaatcmaacattaaagatgtaaaamcgattggaacgattggcgattctgtagctagaggatcacatg

SEQ ID NO: 494 - DNA, 1311 bp; double-stranded, linear
acggtggatttagcctagaagatttaacgcatcaaggtaaattatcagcatttagctttaatgatcaaacaggtcaagcaacattgattactaatgaagatgaaaacttcgtaaaagatgagcaacgtgctggcgtagatgcaaattattacgctaaacaaacatatgattattacaaagacacatttggtcgtgaatcatatgacaaccaaggtagtccaattgtttcattaacgcatgttaataactacggtggtcaagataacagaaataatgccgcatggatcggtgacaaaatgatctatggtgatggtgatggtcgcacattcacaagtttatcgggtgcaaatgacgtagtagcacacgaattaacacacggtgtgacacaagagacagcgaacttagaatataaggaccagtcaggcgctctaaatgaaagcttttcagatgtttttggatactttgtagatgacgaggatttcttaatgggtgaagatgtctacacacctggaaaagagggagacgctttacgcagcatgtcaaacccagaacaatttggtcaaccagctcatatgaaagactatgtattcactgaaaaagataatggtggcgtacatacgaattctggaattccaaataaagcagcttataacgtgattcaagcaatagggaaatctaaatcagaacaaatttactaccgagcattaacggaatacttaacaagtaattcaaacttcaaagattgtaaagatgcattataccaagcggctaaagatttatatgacgagcaaacagctgaacaggtgtatgaagcatggaatgaagtaggcgtggagtaaaaatatataaacaagaagaagtaatgttaaacacttataaataattaaattttaaatacagcttatatatggggtatacctacattgataattgactttgtaggtataccctctctttgtaattagatgagaggagtgtgagggttgtctgccgaaagactactcggcagtctaaaatcattacaagtagtagatatgtgataattaaatgctgacttagaatacaaaattcattttaaaagttgtcacaaaaaatttacatgtatttttattatcttttgcaaaacaaagtgttaaattataaatgaaacatgcatgaatttattttttaatacaagaaacgtaactaccaaaggagtttacaatatgaagaaaagtaaacgattagaaattgtttctacaatagttaaaaagcataagatttataaaaaagaacaaatcatttcatatattgaagaatattttggtgtaa

SEQ ID NO: 495 - DNA, 1761 bp; double-stranded, linear
tgcactttctaaaaatacttgctttacttgttccaattccttgtcagacattgattcggctaatttattcattattgcctcaaatacgttaattatgtcatccatttcagtactataaaaatcaaaccattttgccgtatctttttctctattaagcttatgatcactttgagagcgcttagctaattctgcataaatatatggacaaggtgccattgcagcaattgtataaatagcattttcacgactatgcgcttggaaatacatatgttttatgtaatggtcgccacttggaggccaaacttttgttttaatgatttcttcgtatgattcaccaacaatttgcgctaaaatatcatgcgcaagtacttcaccttcaaccataaattctatttgctctactaaaaattttacgtcattcatgctattcatttttggaattaacaaagcatataagtttgtaaattcttttaaatacgcagcatcagcttttaagtaatggcgtaatgcgtcagctcctatatctccggataacatcttctgaataaagtcatcctcataaatatcattaatgattggctttgcagcttggtacaatttttgtgaaaattccattgtaaaaaatcctccctaaataaaaaaactacttccaacatgaaagtagtttgatggcaatgttgctatactagccccatcacttcaataactactttcctacgttggtactaaccaaatcaggtcataagggtctgaacaattcatctcagccatatcattaggctcccctagtagttccttagtattcaattgcaaattaatcttagcaaacggtttcaacattttcaattattgttgctcagttgtattattatctttaaataataattctataatgacatatatttgcgaaataaaaaaaccggaacatatcgagaattccccgatatattccaatctaaaagttacttatataactattaattagctatgcataaatggcttatgcagtaacccaatgtccagcgccaccagtgttatataattttactgctgcggcatcttgaacactttcaggagcatttgctggtgatacacctttatatttagcaggtgctactgaatcccaagttgattgtaagaattgatacttaccagctgcacctggatgttggrtttacagcatgaatattgccacctgattcacgttgrgcaatttgttttagatgagcattcacatttactgatgaaccttctgatgattttgatycagttggtgttgcagtaacttgtgaattgtttgatgttgatgcttgtggttgttgagtttgagcattttgtggtgcttcaacttcttgtgattgtacttgattagcttgaacagctgatggtgcaacattattagttgcaggtgcttgtgcactcatgtctgctccattagtacctgttgcatggtaattccaagcaaagtgtgtaccatctgattcaaagtgataagtaaacccttcatagtcaaatgtataattataagccccagcttcaattggtttttgatttaatgtttgatcatttgattgcgccatttgcctgaaagatgctttatttaagtccgcttcacntgcatgggcttcgtggacctgcatttcctggctacgattcctaaacctactggcnaangatgatgcgagtaatgttttcttcataatcttaaaatcctcctacaagtgaatttgtgtctctaaaagttttacagtggacgactgt

SEQ ID NO: 496 - DNA, 794 bp; double-stranded, linear
tcatttatgaaaaatgtcgganaganccaagaaamacaattgagcgtgaagaaaaagcaagacttaaagaagaacaaaaggcacgtcaaaatgaacagccacaaataaaagatgtgagtgattttacggaagtgcctcaagaaagagatattccaatttatgggcatactgaaaatgaaagtaaaagccagagtcaaccaagtcgaaaaaaacgagtgtttgatgcagagaatagttcgaataacatcgtaaatcatcatcaagcagatcagcaagaacaattaacagaacaaactcataacagtgttgaaagtgaaaacactattgaagaagctggtgaagttacgaatgtatcgtatgttgttccaccgttaactttacttaatcaacctgcaaaacaaaaagcaacatctaaagctgaagtgcaacgtaaaggacaagtactagagaatacattaaaagattttggggtaaatgcaaaagtgacacaaattaaaattggtcctgcagtaactcaatatgaaattcaaccagctcaaggggttaaagtgagtaaaattgtaaacttgcataatgatattgcattagctttagcagcaaaagatgttagaatcgaagcgccaatacctggtcgttctgcagtaggtattgaagtgccaaatgagaaaatttcattagtttcactaaaagaagttttagatgaaaaattcccgtctaataataaactagaagttggattaggaagagatatatcaggtgatccaattactgttccactaaatgaaatgccacac

SEQ ID NO: 497 - DNA, 1161 bp; double-stranded, linear
agccagttttgcatttcgtcaaatcgcaatgaatatattgattgcttgtcaaaatttggaagaaatttattcttctttttcttttcagcagttatcattcctaattgtcctttctttttatcttagtgataaagaatccatctgaattaaagtcttgcggcatgatttgtaacgttttgaccaactctccagttatcggatgttgaaacggttcaaattcgaagtttttattatttttcaaaaacgtataaatcacgttttcattttctagttgctcaattgtacatgttgaatagatgatttctccacctatttttacattgttttttacattttccaatatttcaagctgtaattcaactagtgactcaatatgttgtttgctttgagtatacttaatctccggcttatgtctcattacacctaatccgctacatggtgcatcaacaagtatcttatcgtatgttttatcataaggttttgtcgcatcatgttgaaaagctttaatatttgttaatcgtaattnttttatattaaaattaattaagtctattttgtgatcatgtatatctgaagcgtcaacttgcccttctggcattaaaacttcagcaatgtgacaagctttaccgccaggtgcactacatgcatctaatacgtgatcatgtcggtctacattcataatgtgtgcaacaaacattgagcttttatcttgaattgaaacgaatccatctttaaatgaacgagaatgaataattggttgtcctcctatatggagacaataaggtaagtcatgatctttttcaacgtcataaccttcgtcttgcaacttttcaataatatcatctaatgatgctcgcgtcaggttggcacgcacagttgttgatgtcgtttctaaaaatgactgtaaaattttttcagtttcttcgagaccataatgtgttgcccaatgatctataatccacttcggcatactatactcgattgccattctttttttaggatctgcaatttcattaaaatcaggtaagtcactacgcatcattgtacgtaaaataccatttacgacattaccattatgatagccaccgcgttcttttgctatttcaactgcttcattaataatggcatgatttggaactttatctanatanacatattgat

SEQ ID NO: 498 - DNA, 1504 bp; double-stranded, linear
agctcacgtcatcttcggcggcgctaaattaaaataatcaatttctgagttaaacttttatttacaacatactattactatacattacaaatttttaaaatatacattacactcattactcaatggmaagcgtatgatttcmcagcccccctagcttgtagaaatcatactttccttttttcaatatatatacaactattaaatcccataagattgcagagcacataagtaaatttttttagagcttgaggtttgtttagcttaagcaacccatgagctcaaacacttcctgttcacataacactacaaatcgcattatgttgcttaatcttatgtttatataaattacacacaataaatagaaagaatgtgaacatcatgaataaattattgctactcgttacatttatcattcgtgtgggttcaggtattgttatgttaatgcaaggctacgaaaaattaacgggcggatttacgctgaaaggtttagtaccagtcatcgctaacaatactgattcaccagagtggtataagtggtttttcgcaaatatagttgcacatacgacgtcattatttgatattgttgtcccactcggagagattgcaattggattaggtttaatttttggagtttttgcatatgctgctagtttctttggagcctttgttatgataaattatatcttagcagatatgatatttacgtatcctcttcaattaactttctttatccttttactaatgagtcactcattgttaaaacagatttcacttaaagaaatcattaattactttagaggtcgtaagaacagaggtgaaaaaatagatgacccacttactgatcgtggatgatgaacaagacattgtagacatttgtcaaacctattttgaatatgaaggttacaaagtaacaacgacaactagcggtaaagaagcaatttctttactatcaaatgatattgatatcatggtacttgatatcatgatgccagaagttaatggttacgacattgtcaaagaaatgaaaaggcaaaaattagatatcccctttatctatttaactgccaaaacacaagaacatgataccatttacgccttaactttaggtgcagatgactatgtcaaaaaaccatttagtccaagggaactcgttttacgtattaataatttacttacaagaatgaagaaataccatcatcaaccagttgaacaactgtcgtttgatgaattaacacttattaacttaagtaaagttgtgactgtaaatggtcacgaagtccctatgcgtattaaggaatttgagttattgtggtatttagcttctagagaaaatgaagttatttctaaatcagaattacttgaaaaagtttggggatatgactattacgaagatgctaataccgtgaatgtccatatacaccgtattagaganaaattagaaaaagagagctttacaacatataccatcacaactgtatggggattaggatataaatntganagg

SEQ ID NO: 499 - DNA, 1623 bp; double-stranded, linear
attgaaagcgataattcgtantaattgagtttgttgaaaaatttagggtaatgtaaagatataaaagatacatagaytggagagatataaagatgttgaatgagatacaaatattaaataatggatacccgatgccttcagttgggttaggtgtttataaaatctctgacgaagatatgactaaagttgtaaatgctgcaattgacgcaggctatagagcgtttgatacagcatacttttatgataatgaggcttcactaggacgagcattaaaggataatggcgtcgatagagaagatttgtttataacaacgaagttatggaatgactatcaaggttatgagaaaacattcgaatatttcaacaaatcgattgaaaatttacaaactgattatcttgatttatttctaatacattggccttgtgaagcagatggtctatttttagaaacatataaagctatggaagaactttacgagcaaggtaaggtaaaagcaataggtgtatgtaattttaatgttcatcatctagaaaaattaatggctcaatcaagtatcaaaccaatggtgaatcaaattgaggtacatccatattttaaccaacaagaattacaagaattttgtgatcgtcacgatattaaagtgactgcatggatgcctttgatgagaaatagaggactactagacgaccctgtcattgttaaaattgctgaaaaatatcataaaacaccagcacaagttgtattacgttggcatttagcacacaatagaattattattccaaaatctcagacacctaaacgcattcaagaaaatatagatattttagattttaatttagaattaacagaagtagctgaaattgatgctttaaatagaaatgcaagacaaggtaaaaatccagatgatgtgaaaattggggatttaaaataactggatgttaaattttacgtttatgaatgccttttaatgtgtacattaaaataaatgagttggtttttactatttgataaaacaatactcaggtacattcaaaatcttttaaataaaaaggatggacatagatgaaaattagagtcgtcattccttgttttaatgaaggggaagtcattacacaaacacatcaacaattaactgaaatactttcacaagatagtagtgtgaaaggctatgattataatatgcttttcatagatgatggtagtacggataccactatagatgaaatgcaacatcttgccacaatagataggcatgtcagctttatttcttttagtagaaattttggaaaagaagcagctatgattgcaggttaccagcatagtactgaatttgatgcagtcatcatgatagattgtgatttgcaacatccacctgaatatattccgaaaatggttgaaggttttatggaaggctatgatcaagtgattgcaaagcgtgatagaagtggtgaaaattttagtcgcaaaacattaagccatttgtattataagttagttaattgctttgtagaagaagtacaatttgatgatggtgttggtgattttagacttttaagccaaagagctgttaaatccattgcatcacttgaagaatataatcgnttttcaaaanggntatttga

SEQ ID NO: 500 - DNA, 605 bp; double-stranded, linear
aaagtnggtgaanctatatacttaatctatatttatatattaaccattagggttaaaaattactctagcatttatgaatagatgggagtttattttattattatataggagagatgttgaatgacacatcgcgcactattagttgttgactattcatatgactttatcgcagacgacggcttactaacatgcggtaaacctggacaaaatattgaagattttattgtttctcgtatcaatgactttaattattatcaagaccatatattctttttrrtggatttacattatttacatgacattcatcatcctgaaagtaaattattcccaccacacaatatcgtagatacaagtggtagagaattatacggtaaagtaggtaaattatacgaaacaattaaagcgcaacctaatgtacatttcattgataaaacgcgctatgattcgttctttggtaccccgcttgatagtttattgagagaaagaagtattaatcaagtcgaaatcgttggtgtatgtaccgatatttgcgtgttacatacagcaatttctgcatacaacttaggttataaaatttcagtacctgctgagggagtggctcattt

SEQ ID NO: 501 - DNA, 1739 bp; double-stranded, linear
taggttnaaagcatagntttntcaaaaagacaaatcattcatatattggaggatattttggtgtaagatatagtgcaaccacaattgctaaagacttgaaggaactaaatatatatcgtgtccctatcgattgtgagacatggatttataaagctattaataatcaaacagaacaagagatgagagaaaagtttagacactattgtgaacatgaagttctaagttcaatcatcaatggttcatacattatcgtcaaaacctcacctggtttcgcccaaggcataaactattttatcgatcagctaaatatagaagagatattaggtacggtgagtggaaatgacactacattaatcttaactgcctcaaatgatatggcagaatacgtatatgcaaaattatttaaatagacatgtatcaaatgaataataaaaatttgtttcgtatcacgtgtactcaagttagttaccaaatattaacttgtgtacgcgtttttttatggaaagaaagaattcatagtcattcaattgactgtataaaaaactttatacaacatgtttttatgggtatttttgaataaaaaatgtatattttgacccaaaatacctttatttatgtataaaaatccattattatgtattgtataacaaaaagatatgaaattttcgactttctttatgtgaatataatcacatgtaagcgtttgaagattgtctatactctaaatgaattcaaagataaaaggaggaaatagacatgacagatggtccaattaaagtaaatagcgaaattggagctttaaaaactgtgttacttaagcgtcctggaaaagaattagaaaatttagtacctgattatttagatggattactatttgatgatattccatatttagaagtagctcaaaaagagcatgaccattttgcgcaggtgctaagagaagagggtgttgaagtactttaccttgagaagttagcagctgaaagtattgaaaatcctcaagtaagaagtgaatttattgatgatgtattagcagagtctaaaaaaacaatattaggtcatgaagaagaaattaaggcattatttgcgacactttctaatcaagaacttgtagataaaataatgtcaggggtacgtaaggaagaaattaatccgaaatgtacacatctagtagagtatatggatgataagtatccattctatttagatccaatgccaaacctttattttactagagatccacaagcctcaataggacacggtataacaatcaatcggatgttctggagagcacgacgacgagaatcaatatttattcaatatattgtaaagcatcatcctagatttaaagatgcgaatattccaatctggttagatcgagattgcccattcaatattgaaggcggcgatgaacttgttttatctaaagatgtcttggctataggcgtttcagaacgtacatctgcacaagctattgaaaagttagcgcgacgtatttttgaaaatccgcaggcgacgtttaaaaaagtagtagcaattgaaattccaactagtcgaacttttatgcacttagatacagtatttacaatgatagattatgacaaatttacaatgcattcagccattttaaaggcagaaggcaatatgaatatatttattattgaatatgatgacgtaaataaagatattgccatcaaacaatctagtcntttaaaagatactttagaagacgtactagg

SEQ ID NO: 502 - DNA, 1745 bp; double-stranded, linear
ctgtacatacagcaatatcgttaacaaatgaaaacagtattttaggattgtaaaccatgataaacctaaaatactgttatttttattacttaaatttcttcttcaatgccttttcaacataaggtggaacgaattcagaaatatctgctcgataagctgcaacttctttaacaatacttgaacttataaatgaataattagtactagacatcatatataacgtttcaatttcattgttcaactttttattcattgaagttaagcgtaattcatattcaaaatcactgactgctcttaaaccacgtatgattgttttagctcctacttgttcacaataatcgactagtaaaccactaaattgatgaaccttgacattaggtaaatgtttaacagattgttcaattaaatccatacgctcttctaaactaaacgtaccttcttttttactatttttaagaacacagacatgaatttcatcaaatctatctgtacttctctcaataatgtctaaatgaccataagtaatggggtcaaaactacccggaatgaccgctattgtatgttccatgctattctcccttttctaataacaatgtgtctgtcaacccataatggtaacgtttaatcatattaaacggttgataatctatttcttcatgattgctaaattcacaaacgatgataccattttctttcaataaattaaactctgaaattagttttaaagctttatcaatgagacctttattataaggtggatctaagaaaatgacatcaaattgaatatcacgttttgacaatgcttttaaagctctatctgcattatttttataaacttcagattgtgcctctaaatccaaattcgcaagatttgatttaataacttttacagctttaaaattttgatcaacaaagattaccttatccatacctcgagagagtgcttctattccaagcgccccgcttcctgcaaataaatctaaacctatacctgacacatcatataaactattaaagataccttctttaactttatccatagttggtctcgtattacggccttccatactttctaaagctttacttttatgtttacctgcaatgacgcgcatgttgttcacacttccaattcatttagttatttaatataatttattgagaaaaaggagaatgataaaccaatgaaacaaacatttattacacttggtgaaggtctaacagatttgttcgaattcatgacgatgattgaatataaccatcaacgtattgataaaattatctattttcattcaccacaagctgaaaataaaaagtcatctgtagcaatcattatgaaccctacaactggcaatcatttccaagcattttatatcatgataaacgctattaaatatccatatccagattcaaataaaaagtttcaaatgataaatgattgtgctgaaaaattcgacataccaattttaggtatcgatgtacagccccctcaagcatttcatgatttatcgttatattataattatttaattagtgtgttaaggctccaaaaatggataccagaacttcaataatattaattatatatttcgtgtttctctttttcgtaagttttctttaagtatttatatggtgagccatcaatgtgtctaacgtatttaagttgcattagtttatgtacaatttgatcaacatcttgctcattcacatacataattacaaatttacgatctctatttgaatgaacg

SEQ ID NO: 503 - DNA, 1035 bp; double-stranded, linear
tcgtctttaatcttgctgactttagaaggcttacgagtgcggttaccattttttgcatctttaactgattgaactaaagcttgacgtgtagatttatcagctaaactaattgcaccaccaattacggcaccaattaaaataccaggaacaaatttattttccataaaaaactacccctctttcaaatttgcatcttttacgatgtagtctattaaattatcacaagatgataataccatgtcgtatacaccttcaaaattattcgtgtagtatggatctggtacatcactctcttccatattactaaattctaacagtttgaacaattgtcccttaagattaggattgatagatttaatattatcaacgttactttgatccatagccacaatgtaatcaaaatcatctgtcgcttcgaataattcactaatcatgccatcaaatggaatattgtgtttgttgagaattttttgtgtaccttcatgaggtggctctcctaaattccagctaccagtacctcttgaatgtactttaatatcatgaatatttctgtctttaagtctttgtcgcatgattgcttctgccattggagaacgacatatattgccaagacagacaaatgctacatctaccattttgattcctccaaactatgtagttatatccccattttatagcgactttaaacaataagaaagcagattatataaaattctattaaagtttattaaattgtgatactttgataacataactattattagaggtgaacattgtggctatgacaaatgaagagaaagtnttagctattagagagaagttaaatattgttaatcaaggattattagatcctgaaaaatataaaaatgcaaatgaagaagaattaacagatatatatgattttgktcaaycaagagaaagattgtcgccaagtgaagtgmcagctattgctgacgctttaggacaattgcgacacgaataggagtgggaattttgactaattacaaagaaaagttacaacaatacgctgaacta

SEQ ID NO: 504 - DNA, 1284 bp; double-stranded, linear
ancctgacaagattcttatattcatagatatgagagctaaaaatgaaatcaacaaacanacaataaagtaaacgataatagcccatataccattttgtaaccatattacaaattgtgttgtattatagccatttccagctaataattgctggataaatgcattattgtttaatgtattttcaagattagcaatcgatgtgttattactgaatgaaacaagtgctataaacatcgtaatgacagtaagcactaataacatcacccaacataaccaacctagaactttttcagttaatctacttactggacgtttaatttgagtaaattgttctccagtcattcgttacaactccttatagtacttatcccgttattataactaaatatacagtaaataactactatttatgattttattttaatgacattttgaaattcaaaaagttttcattgtattcacttaaaacttcaggtcctaaatctttataaacttcaaggcgttcttgctctttcttagtcggataaaaacgatggtcgtctttaatctctttaggcaacaattgtcgagcagccttgtttggcgttgcatagcctacgaattctgtattttgcttgttatttttagcatctaataaaaaattcataaatttatatgcaccctctttattttgtgccgtttttggaattaccatattgtcgaaccataaattcgatccttctttaggaataacataattatatttatccccttcttgcactagaggtgctgcaacaccactccaaacaaccgctatgttaccttcattttgttgaagcatcatggtaatttcatcacctacgacacctcttacttgtggtgctagtttggttaaatctcgctctgcttcttttaaatggtgcgaattacggtcattaagattatacccaagtttattcaaactcatgcctataatctctctagcaccgtcaactagtaaaatttggtttttaaatttaggattatacaatgacttccaactatcaaatgattcatttggatacttttctttattatataaaatacctacagttccaaagaaataaggtaaagaatatttattgcctctatcaaatgacatattcatataatctgaatctaaatttttaatattaggtaccttattatgatctattggtaacaataaatgatctcttttcaatttttgaactgnatattcactagganaagcaacatcataatgtgtaccgccagtgcgaattttggngtccancgcttcatttgaa

SEQ ID NO: 505 - DNA, 5763 bp; double-stranded, linear
ataattaacatcttttgctatataccaccagtttgatacataaaatatcgcagcaataatatcatgtttaaccctaatgatattatctgattttaataataaggttgctgtccctacaaccattaataaaactatgactgctggtaataaacgttttaaacgacgtatccaaaagcttttcaatttaatgatacctgtgtcatcatactctttgagtaataagcttgtaattaaataaccagagatcacaaaaaatgtatccacacctaaaaagccacctgtcaaccattgcttatttaagtggtaaataataattcctagaacagcgattgccctcaaaccatcgagccctggaatatatctcattttcttatactttgtaaaaccctttgttttgttcatttttgcattcttcccttttaaaactgttcttcttagatgcttaattaaatttagttatgctgtttaaaagaatattgaaatgcatatgtatattattgaattacgacatcatcaaaatcatattgactaaaatactgttaaattaaaaaaattaccaatgatgattcttacttcgaaatccaatttgtaatgcaactcggcaacttaaaaactatgaagtattatgtattgtaatataactgtaatataaattcaatttattataaaaattttcaagaaaatattcaactagaaaatgaattgtgcactcttggaagtgcaagtcactgtcttaattcatattttttgaaacaagttagatataaattttcaaaataaaatcagaaactagaacataaataaggctcccttcaaaattttcatttttcaatgtctactttgaagggagcttattcacaatgaattatactctacaatgttatattgactgcgggcccaaacacagagaatttcgaaaagaaattctacaggcaatgcaagtttatgttagctcacaccaagtgcaatcttagcgtaacgtgacatcatatcttttgtccaaggtggactccatacgatattcacttcagtatcctgaatttcaggaatctctgctaatactgttttaacttgatcaataatttgaggtcccattggacatcccattgatgttaaagtcatatcaactgtacatacgccttcatcatcaacattcactttgtatactaaacccaaattaacgatatcaattcctaattcagggtcaattaccatttctaatgcacctaagatactatctttcaatgcctcttccatccatatcacctctttaatgtcatattattcataatatatcaaatatccgacaaaacgccaataaaatgctatgatgtatctatatgaactaagcaacttatgaggagagagatatgcaaccacatttaatatgtctagacttagacggaacattattaaacgataacaaagaaatttcatcatatactaaacaagtattaaatgaattacaacaacgtggacaccaaattatgattgcgactggcagaccttatcgtgcaagtcaaatgtattatcatgaattaaatttaacgacaccaattgttaattttaatggcgcttacgtacatcaccctaaagataaaaacttcaaaacttgccatgaaattttagatttaggcatcgcacaaaacattattcaaggattacaacaatatcaagtatcgaatattatagcagaagtgaaagattatgttttcattaacaatcatgatccaagattatttgaaggtttttcaatgggtaatccaagaattcaaactggtaatttacttgtccacttgaaagaatcccctacctcaattttaattgaagccgaagaaagtaaaatacctgaaatcaaaaatatgcttactcatttttatgccgatcatattgagcatcgacgctggggcgcaccattccctgtcattgaaattgtaaaacttggtattaataaagcaagaggcattgagcaagttagacaatttttaaatattgaccgaaataatattattgcattcggtgatgaagataatgatattgaaatgattgagtacgcgcgtcacggtgttgctatggaaaatggtttgcaagaacttaaagatgtagcgaacaatattacattcaacaataatgaagatggcattggtcgatatttgaatgatttctttaatttaaatattagatattactgttaatttataactaatcattttataatattttaaaacaataggaggtaagttacgatgcccaaaatagtcgtagtcggagcagtcgctggcggtgcaacatgtgccagccaaattcgacgtttagataaagaaagtgacattattatttttgaaaaagatcgtgatatgagctttgctaattgtgcattgccttatgtcattggcgaagttgttgaagatagaagatatgctttagcgtatacacctgaaaaattttatgatagaaagcaaattacagtaaaaacttatcatgaagttattgcaatcaatgatgaaagacaaactgtatctgtattaaatagaaagacaaacgaacaatttgaagaatcttacgataaactcattttaagccctggtgcaagtgcaaatagccttggctttgaaagtgatattacatttacacttagaaatttagaagacactgatgctatcgatcaattcatcaaagcaaatcaagttgataaagtattggttgtaggtgcaggttatgtttcattagaagttcttgaaaatctttatgaacgtggtttacaccctactttaattcatcgatctgataagataaataaattaatggatgccgacatgaatcaacctatacttgatgaattagataagcgggagattccataccgtttaaatgaggaaattaatgctatcaatggaaatgaaattacatttaaatcaggaaaagttgaacattacgatatgattattgaaggtgtcggtactcaccccaattcaaaatttatcgaaagttcaaatatcaaacttgatcgaaaaggtttcataccggtaaacgataaatttgaaacaaatgttccaaacatttatgcaataggcgatattgcaacatcacattatcgacatgtcgatctaccggctagtgttcctttagcttggggcgctcaccgtgcagcaagtattgttgccgaacaaattgctggaaatgacactattgaattcaaaggcttcttaggcaacaatattgtgaagttctttgattatacatttgcgagtgtcggcgttaaaccaaacgaactaaagcaatttgactataaaatggtagaagtcactcaaggtgcacacgcgaattattacccaggaaattcccctttacacttaagagtatattatgacacttcaaaccgtcagattttaagagcagctgcagtaggaaaagaaggtgcagataaacgtattgatgtactatcgatggcaatgatgaaccagctaactgtagatgagttaactgagtttgaagtggcttatgcaccaccatatagccaccctaaagatttaatcaatatgattggttacaaagctaaataaatgaatcatgcgattcaatctaatcttaattgtctaggttagaattatgttggactggtactactatccagtccattttttatgtttaacatttttagaatcaaaaaagacataaggtcttggactaataattgtccatgccttatgtcatatactatatgtcttatcaattagccaataccgaataattttgatataggscctaacggtagaatgacacctaataccattgtgatgataattaatgcaattgttatccaaaacattgtgtgactttgttcatgtctctttcttttagcaatcgacacttccatcaatccaactactgcaacaccacacagcattttcaatgtaagcaacatatgatttgccccgccattcataaatgactgaattaatatccaaaatcctgaaattaacgtcaacagcataaataagcgtaaaatcatgtgcaacggtttgaaaaatggtgatctgccttgattttttgaaatgtttaagtatgtagcgataaataaaataatcgctaatacccaacttaatatatgtaaatgtaacatactgattccccccactttaattatttatattattaaattaaagcttcttgggattaatacccacttgcttgtaatttaatcatgatttgattatacacgaatatatattctaccacacttctatatttgagaggaagaacatgacattttattccttattagaatattgtgaatctgctgtaaaataatcaactacttcttaatatcaatatttcactttcatctcaaaatggtaacattataaataatttatctttaacacctttttagaaaagcaagaaaaaactaaccaatctatataaagactggttagctttttaaatgataattatttagcgatataagttgtcagcgttccaatattatcaatagtcactttaacttcatcacctggttgtaaaaatttaggtggttgcatacctgcaccaacgcctgctggtgtaccagttgcaataatatctcccggatgtagtgcaacatattttgaaatttcttctattaattcatcaattttaagaatcatttcgccagtgttaccatcttgtctaatttcattgttaacttttgtaacaatatttacattttcaggtaatggtagttcgtctttagtaacgatataaggacccattgggcaaccgccagttaaactttttgataaaaatgcttgatcttgttcactttgtgctttgcgatcagtgatatcgttaataattgtatagccgtaaacataatctaaagctaatgcttttggaatcttttcaccagacttaccaataacaatacctaattcaccttcataatctaattgatcagtaatatctttatgatttggaattgttgcattatctcctgttaaagatgacgctgcttttgtaaatacatataatttttccacttcatgatttaattcgttcgcatgatctttgtaatttctaccaaaagcaatcacattattcggaggtgttactggtggtaaaaattcaatgtcattaaatgaaattttatagtcttcagctttgccgctatcttctgctgctacaactgctttacgtacttgttcttgaaaatctaaagtatgattttgttgtaaaccagctaacaatgttttaggatggaaatctccttctgcaaagtcagcaaatacttgtgttaaatcccatacagcatcttcgcgttttactttaacgccatatgaagttttgtcattatacttgaatgataagaatttcattcattctcaactcctcatctttatcttaattcacattataacttttttcgttatcaaataacaaataaataagtaagacaattttgaaaatgagttgtgttcattctgctacaaggactttgcacttaatcgaaattattttttattcttttgaaaatcaaaatactatagttgcaatgtaccaaatttgaagaagtataaataacctttaacttctttattaagaatcgtttgaagcgtattttgataatatttcatctgtatcttatatttattttttaattgtgtaccaatttcttcatctgtcatcccacggcgacgattaaatgcatcggttttatagtctacaaaataatgcacaccatctttaacaaagattaagtcaatcataccttgaataattgagacg

SEQ ID NO: 506 - DNA, 422 bp; double-stranded, linear
ccatatgattttgtgcaataactctttttctttcttcttttcgtaaaaagttgtacatcgcttttgtgtttaagagactattgttttctttaggtttttgaacttcactcagtgtatttctagttgttaacactaaaattccaactgttgtatctttgtatctagccataactttattcagatgtttgtcatttgtaataactacgacataattaaacacttcataataatcattaatttgattatctaatctatccagcttatctaattctgttttaatctcatagacaacgcctttgccgtttaacaatataaaatcagcaatacttttccctatgggcatctcagaaagtgcagtagttgtattaatagaatgtcgtcctagaaggagtktattaagtatngtgtttttgtaaaaatat

SEQ ID NO: 507 - DNA, 1188 bp; double-stranded, linear
gcttatgtattctcaaaatatttatgtgatacgcaaaggagacatggttattcgaccagcatttgatgatgacgatcaaagaaacggtagtgaaataattcggtttgacaaaacgcgtattcaaaatccttttaaagtccagaaaatcattgaacgctcttgcaaattttatggtaatacttatcttggcaagaaagcagagacaaaccgcattactggcatttctagtaaaccacctattttactaacaccattatttccaacttattttttcccaacacattctgacagacaaaatgaaaatatttggttaaatatgcattatatcgaaagtattaaagaattaaaaaatcgtaaatgtaaagtgacatttattaataatgaatcaatcattcttcatgtttcataccacagtttatggcatcaatataacaattccattttttactattacatggtagataaacaatctcgcatgatatcaaaaaatcccgaccaaccaatagattataataaagccacattgaatgtgtttgaagcattgacacgctattctttatttgaagataaataaattgtttatttttaaaatatgcggaatgttttataaatatagtgtaaatgttctgcatatttttttaaggtatctattgcaaattaacttaatcttgttataataatatttgtgcttgatattcaaacacatacaaattaatccacagtagctcagtggtagagctatcggctgttaaccgatcggtcgtaggttcgagtcctacctgtggagccattggaaacgtactcaagttggctgaagaggcgcccctgctaaggtgtaggtcgcgaaaggcgcgagggttcgaatccctccgtttccgttacttgctaaaatggtatataccattttancttttttgtttacttatatataatgaatgagaatttcactgttcttttatatcaattttaaaattctaaaaacctttcctagataatcttctctaagaaaggtttttatacttgttgaacttataattaatttattacatagcaatatttacctgtttttaactataaaattatcactacatgaaatacgataattcggatctcttaacttctctgcaattaatgtactcattggtttcatcgtatgattcatgtataatagcatttkttaaataattc

SEQ ID NO: 508 - DNA, 840 bp; double-stranded, linear
cccaacttcggttataagatccctcaaagatgatgaggttaataggttcgaggtggaagcatggtgacatgtggagctgacgaatactaatcgatcgaagacttaatcaaaataaatgttttgcgaacaaaatcacttttacttactatctagttttgaatgtataaattacattcatatgtctggtgactatagcaaggaggtcacacctgttcccatgccgaacacagaagttaagctccttagcgtcgatggtagtcgaacttacgttccgctagagtagaacgttgccaggcataatattaatccacagtagctcagtggtagagctatcggctgttaaccgatcggtcgtaggttcgagtcctacctgtggagccatggctccttggtcaagcggttaagacaccgccctttcacggcggtaacacgggttcgagtcccgtaggagtcatacaagcagaagtgaaatatcgcttctgtttttttattacatatttattgttgaggaaggttgtccgagctggccgaagagcacgcctggaaagtgtgtaggcgtcacaagcgtctcaagggttcgaatcccttaccttccgtaaaggcgcttaaattggttttacccattttaagcgctatttttattttggactcaatcccttgatatatctgcatttgagctattatcctcatttttacacttcttatttatttatatccatttaaaattttttagccacaatgtgactaatttttgatgaataatcctaattttagtcacaagattttgaagtttagtcacaaaacaaatcattcagatttttttcyataaatttagtttca

SEQ ID NO: 509 - DNA, 1373 bp; double-stranded, linear
ttctatgaaactatcagctgtttctttttccttggtaaaaatcgttttaacgccatgatacatgtattctctttcaacacccgattggtcataagcatcgaaaacacaaataatttcatctgaaataactgcattataatttgcaattgcatctattaattgcattctagcttcttctaaattctcttttgcaatggcgcttagcgttggtgattgtcctatcatattgtatccatcaatgattaagtaacgttctttcattatatttctccaacatcatgtctttttcgaaatacttcgtacatcattaaacttgctgcaaccgaagcattcaaactgtttacatgtccaaccattggaatcttaatataaaaatcgcatttatcacttactaggcgactcataccctgtccttcgctaccaattacaatagccaatgacatgtccgcttctagatttctataatctgttgcattattagcttcagtgccagctacccaaaagccattatcttttagttcatcgatagttttagctaaatttgtcactcgaataactggtacatgttcaattgcacctgttgaggcttttgcaactgtttgcgttagtgtaactgaacgacgtttaggaataataacaccatcaactcccgttgcatcggctgttcttaaaattgatcccaagttatgtgggtcttctaagccgtctaatataagtactgtcaataaaccttctttttctttttgctgttttaaaaattgatcgaagtcagcatattcatatggtgcaataagcgctgcaacaccctgatgtggtgcatttgctaaaaaatctaatttagattttggtacagtttgaacaatgattttttgatcttttgcattttttaaaatttcattaatttgttgctttttaataccttcttgaatcaatatcttatttaycggatgcccagtaataatcgcttctctaacagcatgcctaccaacaataaccgtatcttccacatcgtcactmcctttcgtttactattgttattattttatttaataatgcctctaatcgttcttctcttttttctaaataaagaaaacctatcactgcttctatckctgaacttttacgatatgtttgaacatcagtgtttttagctttagtatgacttttcgcgttacgccctcgcttcaaaatatccatttcttcgtctgtaaaccattcttgctccattaaatattctaacgtttgcgcctgacttttggcagatacatattttttagacatttgatgtagtttattaggcttacttttaagctttaaaacgatataggtacgtacatattgatctaagactgcgtcncccatatatgctaagg

SEQ ID NO: 510 - DNA, 717 bp; double-stranded, linear
tcaagtgccaactacacaactgatttacattctttaggtcaatatgtacaagaaggccgtcgcttcttattcgaaacagttgtaaaagtaaatcatcctaaatatgatattactattgaaaaagatagtgatgatctagacggattaaattatttagctggtaaaacaatcgacgaagttaacacaaaagcattcgaaggtacattattagcgcatactgatggtggtgttcctaacatggtagtgaacattccacaattagatgaagaaactttcggttacgtcgtatacttcttcgaacttgcttgtgcaatgagtggataccaattaggcgtaaatccatttaaccaacctggtgtagaagcatataaacaaaacatgttcgcattattaggtaaacctggttttgaagacttgaaaaaagrattagragaacgtttataaaatacattacttcaaagattagtgaagtttgaaaagatagaactagacgttaactatttaaagcatattttcgaggttgtcattacaaatgtaaaaatgtaatgacaacctcgtttttatttatatgcaagaactaggttactagctaatgtgacaagatgttaagagaaaattaaagataaaataatatctgccttacaataatattgttatactactagngactgatttattagcatgattacatgttaatgtttctttacttagtaatta

SEQ ID NO: 511 - DNA, 2700 bp; double-stranded, linear
aatctaatttttcctcctaatctcggattggatagtggtcaatttttctggcccgccattttagcgtttgttctaactgggattggtttaccattattaggtgtgattgtaggtgcacttgataaagaaggatatattggcgcattaaataaaatttcacctaaattttcaatattgttcttaatcatcatttatttgactataggaccactttttgcaatacctagaactgcatctacatcttttgaaatgacaattacaccaattatacatagcaatagtagtatcgctttatttatatttacgattatctacttcatagtcgttttgtatatttgtttaaatccatctaagttaatcgatcgtattggttcattattaacaccattattattgattactattttagcgatgattattaaaggatacttagactttagcggtaatagtgctggaaagggcaatgaagcactatatcattctaatttttcaagttttgctgaaggctttacacaaggctatttaacaatggatgccattgcagcaattgctttttcaatgattgttgttaatgcagtaaaactaacaggcattactaaaacaaatcaaatattcaaacaaactttgactgctggtttaattgcagccgtagctttaattttcatatatatttcattaggttatattggtaatcatatgccagtaagtgacatgacgttagatcaattgaaatccaaagatcgaaacattgggacatatttattaacgacaatggcttcaacaggatttggttcattcggaaaatatttattgggcatcattgtggcgctggcatgtctaactacagcatgcgggcttattgttgcagtttctgaatatttccatagaatcgtacctaaagtatcatacaaagcatttgtattagttttcattttaatgagttttattattgctaaccaaggtttaaatgctgttatctcaatgtcaattccggtattaagcattgtatacccagtagcaataactgttgtattattaattttaattgccaaattcataccgacaaaacgcatttcacaacaaattccagttattatcgtatttatattgtcgattttcagtgttattagtaagttaggttggctgaaaattaactttatagaatcattgcctctaagagcgtattctttagagtggktcccagtagcaattattgcaacgatattaggctatctagtcggcatatttgtaaaacaagatccaattaaatatcaacaggaataacgaataatataaaagaggttgggacataaatccctaaaaaaacagcagtaagataattttcaattagaaaatatcttactgctgttctctatttatacaatacttcgtattgaatggcttcgctttcctagggtgccgtctcagcctcggtcttcgactggcactgctccctcaggagtctcgccattaatactacgtattaacgtgtaattttactttgaaatactttaaaaaaataagacactttgcccaacttgcacataaatgtaaaattcaataaaataaattttctgtgttggatcccttcgtataatttaataaatactactaaactaaattaacgaggtgccttatgtataaaaattataacatgacccaacttacactaccaatagaaacttctgttagaattcctcaaaatgataatacgcgatatgttaatgaaattgttgaaacgatatctgatagcgaattcgatgaatttatatgtcctaataacaaaagaataggttttaaaagatatgcataccgtaatgatagatatagttttaaacgtgacttcaagctatatgaatgtgatgactgttcatcatgttctttgagacatcaatgcatgaagccaaattcgaaatccaataagaaaattatgaagaattataattgggaatactttaaagyccaaattaatcaaaagctttctgaaccagaaacgaaaaaaatctatagtcaaagaaaaattgatgtagagcctgtttttggatttatgaaggctattttgggtttcactcgaatgtcagttcgaggaataaataaagttaaacgagagctaggttttgtattaatggcacttaatataaggaaaatagcagctcaacgagctgtacattataaaatacatatcaaaaaagctgatttctatcaaataattaatagaaatcagcttttttacattgcctaagaatttaatgtcccaagccctttttatcgaataacttattgtaaaccttgtctttcttggttattgttttcgttatttttttcgtgtttttgtttccactctttttgagtcattacatcgtcaacttgcatgttaacttcaactacatctaaaccagtaatatatttaacttgttctttaactaattcagttactttacggaagatttttggtgctgattcaccatattctaagattacttttaagtctacagcagcttgtttttcaccaacttcaacagatacaccttgagtaacattgttgccacttgagaatgcattagtgaatgtatcagttaagccacctttcatatctaagatacctttaacttcacgtgcagcgataccagcaattttttcaacaacttcatcagagaatgttaatttgnttttgaattgaggctcctgatttngttcntg

SEQ ID NO: 512 - DNA, 1135 bp; double-stranded, linear
atcaaatacaataattaaaataatggctaatacacctaaaataataatcgagttagagtagcctaagcgaycaccctaacagtaracattctaggcatatatttatctttagacattgaagccgctaacatcggaaaagctgtaaatccagtgttggctgctaataccaaaatcatcacggtcgttgcctgtacaaaatagaaggcagcattatcaccaaatatttgcatagctaattgtgataaaactgtcgtttccgtttgtggcaaaattccataaacatatgctaaaccaacgataccaactaataaaaacgctaaaattgaacccatagcaattaacgttttcacagcatttttagcacttggctctctaaaattggttaccgcatttgaaatagcttcaacacccgttaacgatgaagcccctgatgaaaatgcttttaatascaagaataatgttactccaggaaccgcagttcctactgatgcatgcatatgtggttgaatatctcctgtcgccacacggaaagtacctataaatattaatatcactaaccctataatgaaaagatatactggataggataatacggtggcagattcagttaaaccacgtaaatttaatattaaaataaaaagtacaagtawacatgcaatcagtrckttatgcccatataaacttgggaatgcagcaacaaatgcatcagcaccagatgatatmctaacagcgacagtcagtatgtaatcgactaataatgagcctcctgcaagcaatccccatttttctcctaaattggtcttggacaccatatacgcgccgccacctttaggatatgcataaataatttgcctataagacataattaaagcagctaataagatcagaacagcacctgcaatcggtaaagtataccaagttgcaactgcacccactactgatagtgtaatcagtatttgttcgggaccgtaagccactgaagataatgcatccgacgaaagaatcgctaaccctttaaacttcgatatcttttcgtcttttagttctctgttttttttaggttgccctataataagtcttttaaattgatkgacataatctcctattcctttttatagttttngatggaaatcac

SEQ ID NO: 513 - DNA, 918 bp; double-stranded, linear
ttatggtaaaactttaacacaagcattacataaatcgcaatcatttatgtggcaaaaacgttgaatttaagccatttctattcattttacgtaattattagccgtatatgtgtaataatacacattttattcagattttttatcgcgctccattaaatcttttacgcattcttttactgagatattttcaaataatactctatataatgcatttgtaattggcatatccacatttttttctttagctaaatgataaactgatttagttgtataaataccttcaacaaccatattcatttcagataatgcttgatccattgattcaccttgtccaagtttatatcctaatgtgaaattccgagaatgtgttgatgtgcaagtaacgattaagtcaccgataccacctaaacctagaaatgtcataggatcggcacctaacttttcacctaatctactaatttccgctaagccacgagtcattaatgcagcttttgcattatcaccgtagccaattccagctacgataccacttgctactgcgatgatatttttcaatgcaccaccaagttcaacaccaatcaagtcatcattcgtgtacacacgcaaataatcattcataaataaatcttgcgttaatttacttacacttttatcttttgatgaagcagcaactgtagttggttgcttgactacaacttcttccgcatgacttggccctgacaacacgccaatacctgcattatattcaggtgaaatagaatcttcaatcatttctgacacacgtttaaacgtcccattttcaatacctttagcaacatgtataaaagtctttttagaggtcagcttatcattaatttgagaagcaacttctcgcattgctttagtaggtaaagccattaagtaaatatctgcaaattg

SEQ ID NO: 514 - DNA, 587 bp; double-stranded, linear
caatactcggtattatagatagtcctactacatttatatgggtttgtatcattacattaattgcacatcaacttgaaggtaatatcattacaccaaatgtaatgggtaaatctttaagtatccatcctttaacaattatcgttgttattttagcagcaggagatttaggtggctttacattagttctgattgcagtgccattatatgctgtacttaaaacggttgttagtaatattttcaaataccgccaacgcattattgataaagcaaacagtaatgttaaggactaattctgtggatgtcttttaagaatataagatactatcgcatcaaaagttgaaactacagcttttgaggcgatttttttgtgcataaaaaatcagtcmaatgaaatatcaaataattttccatcagtccgattattataaaagcaaaaaagctttgctcacatatataataacgtgaacaaagctgttgaatgatattatttaattgcgtggaatccgctatctacatgaatattttcacctgtaacgccacttgataaatcacttaataagtaagccgcagttttacctacttctact

SEQ ID NO: 515 - DNA, 812 bp; double-stranded, linear
ggttcattccaaaaaagtacgcgataattagcgaagaagaatttgaaaatttaaatgttgttaaaccaaataaaaataatgttttctggtcagttataggaagttcggttttgtttggagttactttaaggaaatacatacatgtttttgatgttcaattagataagctagttgtaatgatattgtgtgctctcgctttaatttgtgttatagttttttattttaacttaaatagaaagcttaagttaaaagtgtttgatacaaatattgaaaaanataagagagttatataaawaccaacgtttaaacttggctgttttttagttttcggatatattttcgctggaagtttttcaatattttcattaattgcccttatgacaatcgaacctcaaaatataataatatttatttattggattatgatgacaatgcttttctttttgttaaatatgacttcgataggtaatgaaaaagttcgcgttataatgaaaaataattgattacatttaaaatattctaaatgttgtcgacacaatccttttaagacgctagtagaatttaaatgacttctaatgtatatgaaagtgtatcaatataaaaccaattgaaaagaagtggagacattgctttgtgaaactgaaaatattaataagaatcccaaatatagaattatcaaatacaaagatgaatatttgatgattgatttagtaagtacatggttagcactctttttcccaatgattaattggctgattccaaaaaagtacgtcaaaatcagcgaaaaagattttgaaactttaaacattgtg

SEQ ID NO: 516 - DNA, 526 bp; double-stranded, linear
gttctattatttcttccaatggtaatggattttcgtaaaatgattgatataagttgataatctcaataacttttaattgatctggaaacatcgttttttggaacattatactgcgattttcactttgtaataacttgtctttatcaaatatctcaccagaattagcattaacattaccaattaatatatcaattaacgttgactttccagcaccattttttccaattaaagcgatacatttaccttgttcaatatcgaacgaaatattttttagaacacatcttttattaaatgacttgttgatattagatatttgaatcaatttaatcacctctatttttttcttaatttaatattagtaaatttattagatttaaaatagaacactttgtcatagatttgaaatgacaaatgtcattattagatktacataatatatttatcgttattttaattttgggcaaaataaaaagagcctctataatcgrgctccttacaaataaattataaaattggcgaactaaat

SEQ ID NO: 517 - DNA, 4544 bp; double-stranded, linear
tgggttgatgaagttgataagtggaaccatttaaatcatctgaaagtgtctttagtcttaggaacacctaaagaaagaaatgatgcattaaacacagaggctgatatctatgtaaccaataaagaaaatactaaatggttatgcgatcaatataaaaaagaatggccatttgatatggttgtaattgatgaactgtctacatttaaaagtcctaagagtcaaaggtttaaatctattaaaaagaaattaccactcattaatagatttataggattaacaggaacacctagcccaaatagtttacaggatttatgggctcaagtttatttgatagacagaggcgaaagacttgagtcttcattcagtcgttatcgagaaaggtactttaaaccaacacatcaagttagcgaacatgtttttaactgggagctaagagacggatctgaagaaaagatatatgaacgaatagaagatatatgtttaagcatgaaagcgaaagattatctagatatgcctgacagagttgatactaaacaaacagtagtcttatctgaaaaagaaagaaaagtatatgcagaattagaaaaaaactatattttagaatcggaagaagaaggaacagttgtagctcagaatggggcatcattaagtcaaaaactacttcaactatctaacggtgcagtttatacagatgatgaagatgtaagacttatacatgataagaagttagataagttagaggaaattatagaggagtctcaaggccaaccaatattattgttttataacttcaaacatgataaagaaagaatacttcaaaggtttaaggaagcaaccacattagaggattcaaactataaagaacgttggaatagtggagacattaagctgcttatagcacatccagcaagtgcagggcatggattaaacttacaacaaggtgggcacattattgtttggtttggacttacatggtcattggaattataccaacaagcaaatgcaagattatatagacaaggacaaaatcatacgactattattcatcacattatgaccgataacacaatagatcaaagagtatataaagctttacaaaataaagaactaacgcaagaagaattgatgaaagctattaaagcaagaatagctaagcataagtaatggaggtataagatgggaaaggcatcatacgatattaagccaggtacatttaaatatattgagtcagagatatataacctacaagagaacaagaaagagataaatagattgagaatggagatacttaacccaacgaaagagctagacactaacattgtgtatggaccgttgcaaaaaggtgaaccagttagaacaactgaactaatggcaacaaggttattgactaataagatgttacgaaacctagaagaaatggtcgaagcagttgaaagtgaatacttaaagttacctgaagatcataagaaagtaattaggctaaagtattggaatagagataagaagctaaagatagagcaaataggagatgcatgtcacatgcatcgtaatacagttactactatacgaaagaactttgttaaagcggtacgwtatcatgcaggtatcaaataacattgtgcaaagattgtgcaaaaggcctacaaatctgtagtaatatgatagtatcggaaagatgtataaagttatctaaaagttatacgacacaagtacacgaggcacatcgctatgcgtgtgtcttttgttatgcaatcaaagaggtgtaagagatgaccaagcataataacatttataagcatggtcgtaagtcatatcaatacgattggttctatcattcaaaagcatggaagaagttaagagagatagcattagatagggataatcatctttgtcaaatgtgtttacgtgaagacatagtaacagatgcaaacatagtgcatcatattatttatgttgatgaagattttaataaagctttagacttagataatttgatgtcagtttgttatagctgtcataacaaaattcatgcaaatgataatgacaaaagtaatcttaagaaaattagagtattaaaaatttaaataaaaaaataatttatttttatagccccctacccatcggcttaaaatgttttttcgacgggtaccggcgggggcccttcgcttgcaacgcggataaacttttatgaaagggggtctttatatgaaattaacaaaaaaacagctgaaagaatatatagaggattataaaaaatctgatgacatattaattaatttgtatatagaaacgtatgaattttattgtcggttaagagatgaacttaaaaatagtgatttgatgatagagcatacaaacaaggctggtgcgagcaatattgttaagaatccattaagcatagaactgacaaaaacagttcaaacactaaataacttactcaagtctatgggtttaactgcagcacaaagaaaaaagatagttcaagaagaaggtggattcggtgactattaaagttttaaatgaaccttcaccaaaactattaacaacatggtatgcagagcaagtcactcaagggaaaataaaaacaagcaaatatgttaaaaaagaatgtgagagacaccttagatatctagaaaatggaggtaaatgggtatttgatgaagaattagcgcaccgtcctattcgattcatagaaaagttttgtaaaccttccaaaggatctaaacgtcaacttgtattacaaccatggcaacattttattattggcagtttgtttggttgggttcataaagaaacaaaactgcgcaggtttamagaagctttgatatttatggggcgaaaaaatggtaaaacaactactatatctggtgttgctaactatgctgtttctcaagatggagaaaacggcgctgaaatccatcttttagcaaacgtaatgaaacaagctaggattctatttgatgaatctaaggcgatgattaaagctagcccaaagcttagagaaaattttagacctttgagagatgaaattcattacgatgcaactatatctaaaattatgccacaggcttcagacagtgataagttggatggtttaaatacacatatgggcatttttgatgaaattcatgaatttaaagattataaattgatttcagttataaaaaactcaagagcggcaaggttacaaccccttcttatctacattacgacagcagggtaccaactagatggaccacttgttaatatggtagaagcgggaagagacaccttagatcgaatcatcgaagatgaaagaactttttactatttagcttctctcgatgatgacgatgatataaatgattcgtcgaattggattaaagcaaatcctaacctaggtgtttctatcgatttagctgaaatgaaagaagagtgggaaaaggctaagagaacaccagatgaacgtggagattttataaccaaaaggtttaacatctttgctaataatgatgagatgagttttattgattatccaacacttcaaaaaaataatgacattatttccttagatgagttggaaggtagaccatgtactataggttatgatttatcagaaacagaggactttacagccgcatgtgccacttttgcattagataatggcaaagttgctgtcttaacacattcttggattcctaagcataaagttgaatattctaacgaaaagataccctatatagaatgggaagaagacggattactaacaatacaagataatccttatatagactaccaagatgttttaaattggataataaagatgaatgagcattatgttgtcgaaaaaatcacttatgatagggcgaatgcttttaaattaaatcaagagttaaagaattatggctttgaaacagaagaaacwagacaaggggctttgaccttgagccctgcattgaaggatctaaaagaaatgtttttagatgggaaaataatatttaataataatcctttaatgaaatggtatatcaataatgttcagctgaaactagacagaaatgggaactggctgccatctaaacaaagcagatatcgtaaaatagatggttttgcagcatttttaaacacatatacagatattatgaataaagttgtttctgacaagggtgaaggaaacatagmatttattagtattaragatataatgcgttaaggaggtgaatgttatcgcaaaagagaatattgtcacacgcataaagaaaaaattgatagacaattggattgatcagtcagcttctaagctttatgactttagcccatggaaaaataaatctttttggggtgtaatcaataatacgcttgaaactaatgaaacgatattttcagctattacnaagttatctaattcgatggctagtttgcccttgaaaatgtatgaagattataaagtagttaatacagaagtatctgattnacttacagtgtcaccgaataattctctgagcagttttgattttattaatcaaattgaaacaatcagaaatgaaaaaggtaatgcatatgtg

SEQ ID NO: 518 - DNA, 881 bp; double-stranded, linear
catggcagaatattgaagctgtaaaaaaaggacatgtaatttcatataaagcagaagattattggttcacagatcctattacattagaacatttgagaagtaaattaaaaaaagaaattttaaataaaaaataatagaaataagttgtaaaaattttcttatgcattggtactaatgtttttaaggagtgattaaatgaagcaactggttggaattcccgaatcaatgttaattcctttgatagctcgagcaaaagagtacgaaaacgaaaaaccaataataaaagacgcactatcaaaaaaaatatttgatggtttagatgatatgtacaaaaatgttacatgtgatgacatgtctcaaattggaattagtatacgtactgtgataatagattgtgttactaagaggcttatcaaggataataaagatttaatcgtggtcaatataggttgtggcttagatacaaggtttcaaagatttaataaagaaaaaatatcatggatagatttagatgtaccagaatcaatagaaatacgaaaaacattttttaaagaaagtaatagttataagatgatatctaaatctatgctagattacagttggattgatgatgtcaaaaattataaattttttaatagtaagtcagatatattgtttattattgaaggtgtattgatgtattttgatgagagtgtaatgactcaattattggacactattatcaaaaagatgggagatcataatttgacatttgcgattgaattttgctcaaaaacaattgcgaataatacmaagagacatcaatcggtatccaagttatcctcaccacctgtttttaaatatgggtaccatgatttanaaaaattggatganatttaccc

SEQ ID NO: 519 - DNA, 3122 bp; double-stranded, linear
tgaataaaaatatattaatagataaacacaaatgtgtccaaatacccctagaggtatttgacnagttccatccaactgtttaaaatacccctacaggtatttttagggaggttattatgaaacaatacggagaaaagtttatcgatgaatttagtaaagcagaattggaaaaactagccaagcaagggcaattaattgacgttagaacagaagaggagtatgcattaggacatatcaatggttccatacttcatcctgttgatgagattgagtcattcaataaagaaaaaaataaaacctattatgtaatctgtagaagtggtaacagaagtgctaatgctagtaaatatttagctaaacaaggttataacgttataaatcttgatggtggttataaagcttatgaagaagaaaacgatagttatgatacacaagaagaatataaaagtatagaaattaaagcagatcgtaaacaatttaactatcgtggtcttcaatgtccagggccaattgtaaaaattagtcaagaaatgaagaatattgaagtaggtgaccaaattgaagtcaaagtcacagaccctggattccctagtgacattaaaagttgggtgaaacaaacaaggcatactttagttaagcttgatgaaaataacaatggaattaatgcgattattcaaaaagaaaaagcaaaagatttagatataaattattctgctaaaggtactacaattgtattatttagtggagaattagacaaagctgtagcagcgttgattattgcaaatggtgctagagctgctggaaaagatgtaactatcttctttactttttgggggcttaatgcattaaaaaaagtgcaaacagttaatgttaaaaagcaaggtattgcaaaaatgtttgatttaatgttgcccaaaaagaatatacgaatgcctctttccaaaatgaatatgtttggtttaggaaatatgatgatgcgctacgtaatgaaaaagaaaaatgttgattcattaccaacacttatcaatcaagctattgagcaaaatatcaaattaatcgcttgtacgatgagtatggatgtcatgggtattcagaaagaagaacttagagatgaagttgagtacggtggtgtaggcacttatattggtgctactgaaaatgcgaatcataatttatttatctaattaaatctattaataaaaggagttgttatcatgttttttaaacagttttacgataatcatttatctcaagcatcatatttagtgggttgtcaacgtacaggagaggcaataataatagaccctgttcgtgatttatcgaaatatatagaagttgcagattctgaaggtttaacaattacacaagctacagaaacacatattcatgctgattttgcttcaggaattcgtgatgtggctaaacgcttaaatgcaaatatatatgtgtctggcgaaggtgaagatgcattagggtataaaaatatgccatcaaaaacacaatttgttaaacatggagatatcattcaagtaggcaatgttaaattagaagttctgcatactccaggacacacgcctgaaagtattagctttttactcactgatttaggtggtggttcaagtgttccgatgggattatttagtggtgactttatttttgttggtgatataggtagacctgatttattagaaaaatctgttcaaataaagggttctacagaaattagcgcgaaacaaatgtatgagtccgttcaaaatattaaaaatttaccagactatgttcaaatctggccgggtcatggtgctggaagcccttgtggtaaagcattaggtgccatacctatatctacaataggttatgagaaaattaataactgggcatttaatgaaattgatgagactaaatttattgaatcattaacatcaaatcaaccagcaccaccgcatcattttgcacaaatgaaacaagttaatcagtttggtatgaatttatatcaatcatatgatgtttatcctagtttagataataagagagtagcatttgatcttcgtagcaaagaggcctttcacggtggccacacaaaaggaacaatcaatataccatacaacaaaaactttattaatcaaattggttggtacttagattttgaaaaagatatagatgtaattggagataaatctactgttgagaaagcgaaacacactttacaattaattgggtttgataaggtagcaggctatcgtttgccaaaatcaggcatttcaacccagtccgttcatagcgctgatatgacaggtaaagaagaacatgtattagacgtacgtaatgatgaagagtggaataatggacacttagatcaagcagttaatattccgcatggtaaattattaaatgaaaatattccttttaataaagaggataaaatatatgtacattgtcagtcaggtgttagaagttcaattgcagtgggtatattggaaagcaaaggttttgaaaatgtggtgaatattagagaaggctatcaagattttccagaatcattaaaataatttaaggatgtggaaaaaatgaataagcattatcaaattgttattattggtggcggtacagcaggtgttaccgtagcatcaagactattaagaaaaaatcaaaacttaaaagagaaaatagcaattatagatccagcagaccatcattactatcaaccattatggacgttggttggtgcaggggtatctagtttgaaaagttctcgtaaagatatggaaagtgttatacctgaaggtgctaactggataaaacaggctgtttcaagttttcaacctgaaaataatagcgttattttaggagataatacagtcgtttattatgattttttagtagtagctccaggattacagattaattggtcttcaattaaaggactaaaagaaaatataggtaaaaatggtgtttgctctaactattcacctgactatgttaacgaaacttggaaccaaatttctaattttaaacaaggaaatgccatttttacgcatccaaacactcctataaagtgtggaggtgcgcctatgaaaattatgtatttagctgaagattattttaggaaacataaaatccgt

SEQ ID NO: 520 - DNA, 3982 bp; double-stranded, linear
atanagatatanatnaatatattgaggtcaaacgatgataattaaaattttaacaattctattactactttgtatattgagctatttggttacaaatagaaagaagccttttctgttcttaaagacactctttatgggtgtggtatttatctttataggatatatttcactggcaatatctgccgtaattatttatggtattattcaatttatcacaattgattttggtagttttttcttaatgggtattatattgatcttgatttcaagtatattccaattatttatagttagattactttttagaaaaaagaatgtcgatttgacagaggttgtcgttttasascatttaattcaatggttcttagtttactttgcgatctatcaagcagtaaatgaaaaaatggacattaatgatattaatatcgacaatttccaatctgtcttttttgacgtgtctaatttgaatttagtaattctaccaacgttaatcattagctgggtcacaatatttaactatagaatgagaagttacaaataaaatctatgagattataccttcagacaccaacattcaaatggtgtcttttttgttgtgtggttttatttttgaaattcgaaaaagtagaggcatgaattttttgactagtgtataagtgctgatgagtcacaagatagatagctatattttgtctatattataaagtgtttatagttaattaataattagttaatttcaaaagttgtataaataggataacttaataaatgtaagataataatttggaggataattaacatgaaaaataaattgatagcaaaatctttattaacattagcggcaataggtattactacaactacaattgcgtcaacagcagatgcgagcgaaggatacggtccaagagaaaagaaaccagtgagtattaatcacaatatcgtagagtacaatgatggtacttttaaatatcaatctagaccaaaatttaactcaacacctaaatatattaaattcaaacatgactataatattttagaatttaacgatggtacattcgaatatggtgcacgtccacaatttaataaaccagcagcgaaaactgatgcaactattaaaaaagaacaaaaattgattcaagctcaaaatcttgtgagagaatttgaaaaaacacatactgtcagtgcacacagaaaagcacaaaaggcagtcaacttagtttcgtttgaatacaaagtgaagaaaatggtcttacaagagcgaattgataatgtattaaaacaaggattagttaaataaaacttcaatcgttgctgttatctggaaataattaattaaatgttatgttaatttttgttaatgaaaaaagtaatctatttaatgacaggttaatgtaattgtcctgaaattgactatatactcagtaagtatcaattttaaggagagcttataatgaaatttaaaaaatatatattaacaggaacattagcattacttttatcatcaactgggatagcaactatagaagggaataaagcagatgcaagtagtctggacaaatatttaactgaaagtcagtttcatgataaacgcatagcagaagaattaagaactttacttaacaaatcgaatgtatatgcattagctgcaggaagcttaaatccatattataaacgtacgattatgatgaatgaatatagagctaaagcggcacttaagaaaaatgatttcgtatcaatggctgatgctaaagttgcattagaaaaaatatacaaagaaattgatgaaattataaatagataataaataaaacaggttgagacaaaaaatggtcttaacctgttttcaatttgcatatgtgataaattctatatcaaaatgcttatgtataatgaatgacatttaaaagtaggggagacaaatataaatacaatagttcctaggattactctcaaaataactatatcaattatttactttgctctcctattttttaaaatatgtacatgtttaaacaatcaaaagtgtacaatattaaattatcatttccagttctagtgctatattggtagtagttgactaaatgaaaataagcttataacaagttttttcaatactcgtggggccacaacagagagaaataggatcaccaattccaacagacaatgcaagttggcggggccccaacatagagaaattggatcaccaatttcaacagacaatgcaagttggggtggggcccaacacagaagctggcgaaaagtcagcatacaaaaatgtgcaagttggcggggccacaacagagagaaataggatcaccaattccaacaaacaatgcaagttggcgggggccccaacatagaagctggcgaaaagtcagcttacaaaaatgtgcaagttggcggggccccaacatagagaaattggaaccccaatttctacagacaatgcaagttggggtaggacatcgataaagaaatactttttctttagcaattagtatttcttatgcatgagctttactcatgtattcattttttaagtacacattagctacagctaatgataaagaaccactacataataaatcattagtggttctttatcatttctatctcactcttttactggaagaaaaagtttacgtttgtagaacatgccacaataccaaaaataattaagaaaaataagacgataagcatgatgacacttttcaaacaacctctatcagtttctttcgattttctttgttgaacctttttataatcttcaagtagttttgcggcttttttatttatatgtttattcatgatgttgactccttataatatatgtttaattcattaaaatagttgaaaacatgacttgaaataaagatataaagctaaagtaaggatgttcaattgtttcaaattttatgaaagtataacgttaaatatgttaatttgatgatgatatttgctttttattttccaaatggaatttacttaaactgatgcattaaaatattaatgaagcactagaatacataaatgaatagtaatggtgcacagtatagaataattaaggctatattaagtataaatatcgttaactgtaagctatctttagttttaatataaactattaggataatcgacgtaagaagaatcatatatattaatgatgaagaagtccatacaaaatccgcatcatttgttgttaataatgggactataattaatccgaaattaatcatgcatgctatatatactataatgttatacacaatgttaatttttgttcaccaccttatacttctattttaaaaacttctttataatgatatattgtttaatgttgaaataattagattatctaattttcatttgctttacatgtaaaaggctatatatagtatgctctttatgattctaaatgctttttaatatttaatgctcatcaacatttggattttgaatattcaattcaaaaactttattagctacgtcaattgtaaaatcagaaccatagttgacatgagctacttttaattttccatctaaataatagattgcgattgcaacatcgtaaaattcgtcaatgacaaataaactcttttcgtttgttacaacctcatgctctcctgagtatacaacgttaatttcccaatcattaaaaaccatttgttaacctccttgaacatttaaattgattcaacttaagtttaacttattcatacaacttcgtacaatatctagatgaacattaattgtatttctagaaatctttttcaattatatgtactaattatacttttaaatttcttatttcagtatagttttaaaacgattttaaaataattctgcaaatatattaacacataatgtgttcaaaaagttttgaacaatttcaaaacttttatataaagggnttgacaacatggattcaaatntcttattttaaaaattacctcatatagtgtcatgttagccaatttttaag

SEQ ID NO: 521 - DNA, 1353 bp; double-stranded, linear
agcttggatgatttaatatggtcctttcccaaccttagataatgaaagatttgataatcctgaatataaagaagctatgaaaaaatatcaacagagatttatggctgmagatgaggctttgaagaaattttttagtgaagagaaaaaaataaaaaatggaaatactgataatttagattatctaggattatctcatgaaagatatgaaagtgtatttaatactttgaaaaaacaaagtgaggagttcttaaaagaaattgaagatataaaaaaagataaccctgaattgaaagactttaatgaagaggagcaattaaagtgcgacttagaattaaacaaattagaaaatcagatattaatgttaggtaaaacattttatcaaaactatagagatgatgttgaaagtttatatagtaagttagatttaattatgggatataaagatgaagaaagagcaaataaaaaagcagttaacaaaaggatgttagaaaataaaaaagaagacttagaaaccataattgatgaattttttagtgatatagataaaacaagacctaataatattcctgttttagaagatgaaaaacaagaagagaaaaatcataaaaatatggctcaattaaaatctgacactgaagcagcaaaaagtgatgaatcaaaaagaagcaagagaagtaaaagaagtttaaatactcaaaatcacaaacctgcatctcaagaagtttctgaacaacaaaaagctgaatatgataaaagagcagaagaaagaaaagcgagatttttggataatcaaaaaattaagaaaacacctgtagtgtcattagaatatgattttgagcataaacaacgtattgacaacgaaaacgacaagaaacttgtggtttctgcaccaacaaagaaaccaacatcaccgactacatatactgaaacaacgacacaggtaccaatgcctacagttgagcgtcaaactcagcaacaaattatttataatgcaccaaaacaattggctggattaaatggtgaaagtcatgatttcacaacaacgcatcaatcaccaacaacttcaaatcacacgcataataatgttgttgaatttgaagaaacgtctgctttacctggtagaaaatcaggatcactggttggtataagtcaaattgattcttctcatctaactgaacgtgagaagcgtgtaattaagcgtgaacacgttagagaagctcaaaagttagttgataattataaagatacacatagttataaagaccgaataaatgcacaacaaaaagtaaatactttaagtgaaggtcatcaaaaacgttttaataaacaaatcaataaagtatataatgggca

SEQ ID NO: 522 - DNA, 1987 bp; double-stranded, linear
gtctgagtcaggtgctgtttggttagatgctgaaaaaacaagtccttatgaattttatcaattctggattaatcaatcagacgaagatgtaattaaattcttnaaatactttactttcttaggaaaagaagaaattgatcgcttagaacaatctaaaaatgaagcaccgcatttacgtgaagctcaaaaaacattagctgaagaagtaactaaatttattcatggtgaagatgcattaaatgatgcaatccgtatttcacaagcattatttagtggtgatttaaaatcattatcagcgaaagaattaaaagatggatttaaagatgtgcctcaagtgacattatcaaatgacacaacaaatatcgttgaagtccttattgaaacaggcatttctccttctaaacgacaagcacgtgaagatgttaacaatggtgcgatttatattaatggtgagagacaacaagatgttaattatgctttagcaccagaagataaaattgatggcgaatttacgattattcgtcgcggtaagaaaaaatacttcatggttaactatcaataaatataattgcatagctaaataaattagagcctactcatattcattcctaagaatgtaatgagtaggctcttaatgtacttttctgtctgtaaattatctaaagaaatctctatcgccttggccaggtgattgacgttctgatcggctttgacgttttggttgttctttttgttgttttaatttcactttaacttcttttgttttaccatcacggataacggtaacagtgactgattcaccaggttttttattttcatataaatagcttcttaaatcaacatcatctttaattttcttgccatcaatttctgtaataatatcaccttttttaagatcaatatcactatcagctttggcgacataaataccgtcttctctatcagtatgaagttgctcgcgctcttcttcaggaatatctttcaaattaattaaaccaataccaatcgaagggcggtcaattttaccatgttttacaagttgttcaattgttactttaacttcattacttggaatagcaaacccgataccttcaacttgtgtcgcagcaattttcattgagttaataccaactaaattaccattaatatctactaatgcgccacctgagttacctgggttaatagcagcatctgtttgaagaacgctaacttttgtattgccaccagttgtctcagcgtcaatcgtacgttcgcttgctgaaatgataccagatgttacagagttagcaaattgtaatcctaatgggttacccattgcgaatacgctatcgccagtttgtacttttgaagagttggcaaattgaatcgctttaataccttttgtattttcaattttaagtacagcaatatcagttactgcatctttaccaactaatttcgctttaacttgttttttattatgtaattggactctaatttcatttgcgccatcaataacatgattgtttgtaacgatataagctgaattgttgtttatttgatagataacacctgaacctactccagcttcagatggtttagatgatttgccytttaataagtcgtctacacttgatgctttttgcatgtkaataactccaacaattgtaggggagacagattttatcatttcatgaacggtaccgaatttcttgctttgaccgtctaattgattgccacctttattatttgttgtctgaacagttgaaccatctttatttaaaattgtactatttaatactttgcctataccaagtactagaagtgcaccaataattccagcaatcaatgcaacgatgactgtnttaaaccatggaaatttaggtcttctgtatctaggtgtttggctatggtttgttgtagaatgatctgtatgattaaaatctgacatacttaacctccattatatgatttatatatgctttaattatgtcttttntttataatt

SEQ ID NO: 523 - DNA, 1351 bp; double-stranded, linear
ttagaagtcaaatcattantggcgtcntatcgagtatactattaacttcaactattttagcaattgcatatattttaatgtggtttaacggccatatgacactaactttgaccttaacgacaataattacaagctgtttaaccttattaatatgtagtatttttattaatccacttatacaaaaaattaagcagtttaatataaaaactaagcaatttgctaacggaaattacgcaagcaatgataaaacgtttaattcaccaaaagaaatttatgaattaaatcaatcttttaataaaatggcttctgaaattacgcaacaaatgaatcaaattaaatccgaacaacaagaaaaaacagaactgattcaaaacttagcccatgatttaaaaacacctttagcaagcattatttcatattctgaaggactacgtgatggtataatcactaaggatcatgagattaaagagtcatacgacatattaattaaacaagcaaacagattatcaacattatttgatgatatgactcatattatcactttaaatacaggtaaaacatatcccccagaattaatacaactagaccaattacttgtatcaatattgcaaccatatgagcaacgtatcaaacatgaaaaccgcacattagaagtgaatttctgtaacgaaattgatgcattttatcaatatcgaacgccacttgagcgtattttaacaaacttacttgataatgcgctaaaattttcaaatgttggtagtcgcattgatattaatattagtgaaaacgaagatcaagatactatcgacattgctattagcgatgaaggtattggcattataccagaactacaagaacgtatattcgaacgtacattcagagtagaaaactctcgtaatacaaaaacgggtggttctggattaggcttatatatagctaatgaactcgcgcaacaaaataacgcaaaaatcagtgtaagcagtgatatagatgtaggaactacgatgactgtaacattacacaaattagacattacgtcataatccgatttatttataaaataaaatgcaaagactaaaaagaagctcccattaatgagggcttctttttttgtttatttagaataaactttatgggtatccttctcatcattttcaagacttgaaagatttgtagcttgaataatatatttaggacgtgccttaacttcataatatatcctgccaatatattcacctacaacaccaattgaaattaactgtatgccgcctaataataaaatagctgcaatcgttgaaaaatatcccggaatattaacaccagatatcataatattgatggaataaataga

SEQ ID NO: 524 - DNA, 433 bp; double-stranded, linear
ttgttgtcagtttaacgcaacgtgttaccgacttttcaagtacacaacaatatatatgtctattccatttttagcccctgccattttcatcattggtggtattatgttgtttatttcaacatttaatagcttagatgaaactgctgaaaataataacaaaataaagaaactaatgattaaaggacttatcattattaacatttcatttatcgttatgatggttttaacaccatattggtacttgtatttaatcgtctatcttattttcttgttgtttttattgtggcaaaaggtttataaattttaataccaaaactattaaacacttctgatattcttagttcaaaatatcagaagtgttttatagtgttatctagttcagataaatatttccttacttaaaaaaacgccctcctcttattttgaccccnat

SEQ ID NO: 525 - DNA, 1845 bp; double-stranded, linear
cccccactatgatatgcttggcctattgcgtcaatccccttatatttcggcaatagagatggatgtatattcaatattttaccttcaaatgaagctaataagtctggaccaattagacgcatgtagccagctagaataatccactctaccttatcttcatttaataatgttactaaatgttgttcatacgctgcttttgaatcaaattgttttggttcattaatataaacaggaatatcgtgcttttttgctctatctatacaaaacgcattttgatgatccgtatatagcgccgtaacttcaatattttcaagttttcctgattcaacatgctcaactatatttkcaaagttacttcctgaacctgatgcaaaaatcgcaattttaaccattgttatacccccaacaattcaattgcagttgactcatttttcacaatatgaccaatttgataggcttccacattttgttctgctaaaatcttcaaagcgcgtgatacatctttttcatcaacgataaccgtatagccaatacccatattaaaaatgttatacatttcatttgtgtctatattgccttgttgttgtaaccaatcaaatatttttggtgttggaaatgatgtagtatcaattctagcagcatatccggctggcaatgcacgtggaatattttcataaaaacctccaccagtaatatgattcattgccttaatagaaacttcttttttcaaagcaagtacaggtttgacatataatttagttggttctaaaaagacatcgataaatggacgattatcgaagtttgatgccaaatcaatgcctgattcattaattaatttgcgcactaaactgtatccatttgaatgaatgccacttgacgcaagccctataacaacttgtccctctttcacttctgaaccatctacatagtcatccttttcaactgctccaacagcaaatccagctacatcatattcgccttcgtgatacatttcacccatttcagcagtctctccaccgataagtgcagtattcgtttcaacacatgcatcactaatacctttaacaatttgttcaataacttcaggaacaactttgtttgtagcaatgtaatctaaaaaatataatggttctgcacctgtcgttaaaatatcattaacacacattgcgactgcatcgatacctatcgaatcatgtttaccatagtcgatagctagttttaatttcgtacctactccgtctgttccagaaactaaaactggcgctgtcatatttaattgtgataaatcaaatgtagcaccgaatccacctaaaccaccgataacttctttacgcatcgtacgtttaacawgactagacattctttctacagcttcataaccagcatgaatatttacaccagattgttcatatgctttagacatttaaatttccctcgctatcaaaaaagtgtttgtttttagaaatatattgcttttgtcgatgacttaaatgcgctttataatttgcttcataatcatataaccctgcaggataatctccagtgaaactttctacacataagccactatatggcgcgtcataatctaaaccaattgattcaattaacccatctacagatagatatgctaatgaatcagcgccaatataatctttaatttcttcaggtgatttgcttgcagaaattaattctgccgtagttgaaacatcgattccgtaaaaacttggaaacataaattccggtgatgctatacgcacatgcacttkatttgcaccagaatcktttaacattttcacaatgcgtcgaattgtcgtaccgcgnacaatggaatcatcaacaagactg

SEQ ID NO: 526 - DNA, 1141 bp; double-stranded, linear
tcataaatngtaaatgttaatcgtcatataatattaatttacaacaccattttggttatttgaagcttgtggcgcttgttgtgtgccaccttgattttgatttgagttttgatctgtagcaggttgttgttgattgctggamtcactgttattagttgamtcactgttctcgttagatgtcttatctttatctgtcgtatcattttgttcttttctcaataaactattatctaaaggcgttaatggtattaatgaaccataatgattaatgacacgttgatctaagaaatcatttttatcattaataggtgataattctaagtctttacgaagtaagtttgcatatttttgaatgctttcaacacttggatgataatagtaaataccatttaacatatcatctttaccttttaattgcgcagttttaatttcaacatcatttgttaagtacatttttgctaaagctttaatttcagagttagttaaattatgctttgcatttttacctacaatttgaatcacgttatcaagtttatcaatagaatcaacttcctgtgctttttggaataaaatcttaattaattccatttgacgttgtccacgttttaagtctgaatcatgatgtctagttctagcaactgctaaagcctcatcaccatttaatttttggtacccttttttaattttaatcttaccagtatcatctgtgttaggttcatttaagtcgtatggcacatcatagtatatgccaccaagctcatttacagcctcgacaaatgctttcatattgactctcacataataatcaacaggtacattcatggtagcttctaccgaatccattgcggcaattggaccaccatatgcatgtgcatgggtaatcttatcgtaatagccaactttaggaatgtagctgatagtatcacgtggaatactaagcattctaatttgatgttttgattgattaaaagtagttaaaatcatagcgtctgatctagagtgttcagcatcctgtcctttttttcttcttccatcgttatcatcgatacctaagaaaagaatagagataggttgttcttcgggatgactttattatctcttaagttggattgacgttagcatttttgctgtcttgagaaga

SEQ ID NO: 527 - DNA, 1565 bp; double-stranded, linear
gcaccattagcattgggcncactgattggagtancagttgttgaaaattcggcgccaacaagtaaacmggcmcaggcagcmatamccccatattatacttataatggttatattggtaataatgctaattttattctggataagaattttattaacgcgattaagtatgataatgtgaaattcaatggtattaaattagctaaaacgaatacgataaaaaaagtagagaaatatgatcaaacttttaaaggtgtttctgcaaaaggaaacgaagcaagtcaattgcaatttgtagttaaaaataatatttcattaaaagatatccaaaaagcttatggcaaggacttgaaaaaagaaaatggtaaaacaaaggaagctgatagcggtattttttactatcaaaatgctaaaaagacattaggcatctggtttgtcgttgatcataatagagttgtcgaagtaacagttggacatacaccatacaaaacaagtaaataaaataatggcatattaaggctagagtgtgaggagtgataccgcattctagtcttttttattaaataataacgattattgcgtcttacatagttgtttgaaattgataaaaatgtttatttgattatgattatttaaatagttatctcacatatttcaagcattgattaagtatatagagcactattttgtatttgttaatattttcacaaaaataaagccttgataaattttaaaatataattaagctcaatttttaaaattttatttagctacagataacatttttaaaaaagaaaagaatcaataaataaaatcaacgaacaaaaagtatagaaataaatagaaataatcatttacttttctgaaaaattaaattaatattttatttataagctgtttttaagatttcaggaggaatgaaatgtgaggaaattttcaagatatgcatttacaagtatggcagcattaaccttgttgagcactttatcaccagcagcattagcgattgattcaaaaaataaaccagctaattctgatattaaatttgaggtgactcaaaagagtgatgcggtcaaagcattaaaagaattgcctaaatccgaaaatgtaaaaaatatttatcaagattacgctgttactgatgtaaaaactgataaaaaaggatttacgcattatacattgcaaccgagtgttgatggtgttcatgcacctgacaaagaagtgaaagtacacgcagacaaatcaggaaaagtcgttttaatcaatggggatactgatgcgaagaaagtaaagccaacgaataaagtgacattaagtaaagatgacgcagccgacaaagcatttaaagcagttaagattgataagaataaagcgaaaaatcttaaagataaagtcattaaagaraacaaagttgaaatcgatggtgacagtaataaatacgtttataatgttgagttaattacagtgacaccagaaatttcacattggaaagttaaaattgatgctcaaactggcgaaattttagaaaaaatgaacttagttaaagaagctgcagaaactggtaaagg

SEQ ID NO: 528 - DNA, 2870 bp; double-stranded, linear
ggataggtaaatccattcaaaattggttgtactcattttaaatcatattttttaatatagaaacacataattaaaggagtgatgatattaatgaataaacttcgagacactacttttctatcatatttatttactatcatattgtggggatctgcatttccaatgataaagattgcgttaaatgattttagtgcagaatcattgtcggcatttcgtttaattttagcaacaataattctcttgccgttcgtaattataaagaaattgcctacccctgaactaagagatatccctgttatttttattttaggattttgtggatttgtgatatatcacacagctttaaattttggtgaaactttgattagtgcaggtatatctggrattcyagtctctacaacgcctattttttctagtgctttagcttatatatttttaaaagagcatttttcaaaatggaattggttaagttcactcgtcgcatttataggaatatccattatttcaataagtaaagatgattacacaactattaatgtattaggtgtttttattattttacttgcatcttttagtgaaagtttgtattttactttccagaaaaaatacatagaaaaatacggcttcatcgctttcacactatatacaataatggcaagctcaccatttatgcttatttttattcctgaaatcatcaacgatatacacggcgccacttttacatcaatagtatcggtactttatttagctatattccctactataattccatacgttttgcttgcttatattgtgaagtcagttggtgtctctgatgcaacaatgtctctttatttaacacctatcgtttctttattattatcttatctgttattagacgagctaccaacaacccttgctattataggcggaattatcactctactaggcgttagtttaagtaacttctttcaaaatacataattattccaagtcccgcacctcagaatccaaaaacattcgagtgataaaattttaaaaatcaaaaatataaaaatgatctaatttcgtcaaatttaccaatataaatactaatatttgcaattcacaaaggggtatagtctgagtgtattctaatacgaaaggacttggtggatatgtattacagttatggaaattatgaagcatttgcgcgccctaaaaaacctgaaaatgtagaaaacaaatccgcttacttaatcggatctggtctagcttcacttgctgcagcttgttttttaataagggatggtcaaatggaaggttcgaagattcatattttagaagagttacctaaagcaggtggtagtcttgatggtgaaaatatgcctttaaaaggctatgttgtccgcggtggtcgtgaaatggagaaccactttgaatgtttgtgggacttattcagatctatcccttcattagaaatcgataacgcgtctgtattagatgagttctattggctaaacaaagaagaccctaactattctcgctgtcgtgttattgagaaacagggtcaacgtttagtcacagacggagacttcactttgactaaaacggcgattaaagaaattttagatttatgcttaacgaatgaagaagatttagatgatgtcaaaataacagatgtattttccgatgacttctttaattcaaacttttggatttactggaaaacgatgtttgcatttgaaccgtggcattctgcaatggaaatgcgtcgctatctaatgcgattcgttcatcatattagtggtctcgcagacttttcagctttaaaattcactaaatataatcaatatgaatctttagtattacctatggttgaatatttaaaatcgcatggggttcaatttgaatacgatgtaaaagtcgaagatattaaaatagatgttacgacaagtcaaaaaattgcccgagaaatattaattgaccgtaatggtaatgcagaatctattaaactgactataaacgatcttgtctttgtgacaaacggtagtattacagaaagctctacttatggtgataatgatacaccagcgccaccaactgacgaattaggtggtagttggacactatggaaaaatttagcgcgacaaagtcctgaatttggtaatcctgataagttttgccaaaatattcctaaaaaaagttggtttgtttcagcaacttctacaacaaacaataaagagattatcgatacaatagaaagtatttgtaaacgtgacccacttgcaggcaaaacagttacaggcggtattattacaatcaatgattctgcatggcaaatgagttttacaatcaatcgtcagcaacagtttaaagaccaacctgaaaatgaaatatctacatggatttatgccttatattcagatgtaaacggcgattatattaaaaagccaattacagaatgtagtggtaatgaaatatgccaagaatggctgtatcacttaggtgtatcaactgacaaaattgaagacttagcaaaacatgcatctaatacgattcctgtttatatgccatatatcacatcttatttcatgacgcgtgctatcggcgacagacctttagtcgtcccgcatcaatctcagaacttagcatttattggtaactttgcagaaacagagcgagacactgtatttacaacagaatattcggttcgtactgccatggaagctgtttatcaattactaaatatagatcgtggtattccagaagtcatcaatagtccatttgatcttcgcgtcttaatggatgccatatacgaactgaatgaccaccaagatttgcgtgagattactaaagattcgaaaatgcaaaaactcgcattagcaggattccttaaaaagataaaaggt

SEQ ID NO: 529 - DNA, 3105 bp; double-stranded, linear
cngtttagctgcaaaaagtaaataacgacactgtatttggaattttgcaattagaaacacttttgggtgacattaactcaattttcagcgagattgaaagcgaatacaaaatgtctagagaagaaattttaattttactaactttatggcaaaaaggttctatgacgcttaaagaaatggacagatttgttgaagttaaaccgtataagcgtacgagaacgtataataatttagttgaattagaatggatttacaaagagcgtcctgttgacgatgaaagaacagttattattcatttcaatgaaaagttacaacaagagaaagtagagttgttgaatttcatcagtgatgcgattgcaagtagagcaacagcaatgcaaaatagtttaaacgcaattattgctgtgtaagtttaatagcataaaaagaggttttcattaagttgaaaacctctttttgttgttggcattaatttttcaaatgttgactactcaatcctaaattataaatagtatagcgcacaaatgcttaagaaattttttctatggcacaaatgaatggagcatgattacgttggtttaaaaattgatattgcaaaacttgcgcatgcttttgatccaaagtactcaagtaatcaagcaatgcatgcttctcaatttgtccttcgctatgaccatgatatataacaagtacaataataccttcaattgacattaatgatagcaatgaattaatagcttggattgtcgtgtcaggctttgtcacgatagatttatcacctttaggcaaataacctaggttaaagatggctgcatcaatatgacctttatgtgcatcatttatatgatgttcaatattttcatgtccatcttttattaaagaaacatgattgaaatccttaactttatcacgtgtattttccaaagctaaatcttgaatgtcgaaaccataaacatgtccttctggtacttgttcggctaaaaataaagtgtcattgccgttaccgcaagttgcgtctacaacaatactttctggtgttatatgttgtttaataagtgtttttgaaaaagggagtatacgttctaatttcattgcttcaccttagacttgtaacgcaagccttgataagaatttctacgtgctaattcagcatcgatgccatttaatacttcccatttattaacactccacattggacctaccatgatatctattggaccatcaccggtaattcggtgaacgatcatttcagggggaatcacttctaattggtccacaactaggtttgtgtactcttcttgagtcataaaagttaataaacctttatcgtattgttttaccatcggtgtaccttttaacaaatgaagtaaatgaattttaataccttgtacatccatttgtgcacttctttggcagtagccatcatcatgtcatagtcttcgccaggtaagccattaatgatgtgtgtacatacattgatattatgcttacgtaattttgccacaccatcataataagttttcatatcatgggcacgattgattaaatcagatgttgactgatggattgtttgtagtcctaattcaacccataagtatgttcgttgattcaaatctgctaaatattcgacaacatcgtctggtagacagtcaggacgcgtaccaatagataatcccacaacacccggttctttaagtacaggttcgaatttttcttttaatacttcaaccggtgcatgtgtatttgtaaatgcctgaaaataagcaatatattttccttcgtgccatttctcatgcatcttttctttaatttctttaaattgtactgcgattgaatctgcacgattacctgcaaagtctccgctacctgcagcagaacaaaatgtacatccaccatgtgctacagtgccatcgcggttaggacagtcaaacccgccatccaatgcaactttaaatattttttgtccaaatttattttttaaatggtaattccatgtgtgataacgtttgttttcaaaagcgtattggaaatgattgcccatatgtcattttcctttctataaaaaaagagttctaagtacagattttaacatattttaatgttatagtgtttattatagtttgacaaaaaagagagaggaactatgaaatatgaatatacctaaatcagtctggtggctagtaattggcatggcgttaaatattactggttccagttttttgtggcctttaaatacaatttatatgaaacaagaacttggaaaaagtttaactgttgctggtttagtgctaatgataaattcatttggcatggttattggaaacttattaggtggttcactatttgataaattaggtggatacaagacgattttaattggaactttcacttgtctttgtagtacaacgctacttaatttctttcacgggtggccttggtatgctgtatggcttgtaatgttagggtttggtggcggaatgattattcctgcgatatacgctatggctggagcagtgtggccaaatggcggaagacaaacgtttaatgcgatatacttagcgcaaaatattggtgtggctgtcggtgctgcaatgggcggctttgtcgcagaatttagctttaactatatctttttagccaatcttattatgtatgttgtgtttgcgcttgtcgcggtaacgcaatttaatattgaaattaatgcgaaagttaaatatccaactcatttagatattactggtaaaaagaataaagcaagatttatttcattagtactaatttgtgcaatgtttgcaatttgttgggttgcatatattcaatgggagtctacaatcgcttcatttacacaatctattaatatttcaatggcacaatatagtgttttatggacaattaacggaataatgattttagtagcacaaccattaattaaaccgattctctatctgttaaaaggaaacttaaagaagcaaatgtttgtcggcatcatcatttttatgttgtcgttctttgtcacgagttttgccgaaaactttacaatatttgytgtcggtatgattattttaacttttggagaatgtttgtatggccagcagttccaactat

SEQ ID NO: 530 - DNA, 5532 bp; double-stranded, linear
taatgattaaaccagatgcagtacaaagaaatctaattggtgaagtaatttcaagaattgaaagaaaaggactaaaacttgtcggtggtaaattaatgcaagtaccaatggaacttgctgaaacacattatggtgaacaccaaggtaaaccattttataatgatttaatttcatttattacatcagcaccagtgttcgcaatggtagttgaaggtgaagatgcagttaatgtatctagacatattattggcagcaccaatccttcagaagcttcaccaggatcaattagaggtgatttaggtttaactgttggtagaaatatcattcacggttcagattcattagagtctgctgaacgtgaaattaatctatggtttaatgaaaatgaaattactagctatgcttcaccacgtgatgcatggttatatgaataaaatataaactgtaaacctttacgatttatttataaaggtagaaagggttttgttatgtggttagtcattatgattatacataacaaggcccgttttttatgttgtagtaaattacttgaaaaattttatagtttttkggtaacacgtattaaaaagagaggaatattctttatcaaatgaaactaaacagagagaaggggttgttaaaatgaagaatattatttcgattatttkggggattttaatgttcttaaaattaatggaattactatatggtgctatatttttagataaaccacttaatcctataacaaaaattatttttatactgactctcatttatattttttatgtattagtaaaagaattgattatatttttgaagtcaaagtataacaaaagcgcttaacatatgtatattttaatatcataatttttttaaacggactgattaactttattaataattaacagttcgttcttttgtattaagaaatgtagtcagtatattatttgctaaagttgcgatacgattatattaaaacggctaatcatttttaattaatgattatatgatgcaactgtttagaaattcatgatacttttctacagacgaatatattataattaattttagttcgtttaatattaagataattctgacatttaaaatgagatgtcatccattttcttaattgagcttgaaaacaaacatttatgaatgcacaatgaatatgataagattaacaacatattataatgttatcgtggaagtatgaaaggagcgagtgtgtatgagatacctaacatcaggagaatcacatggacctcaattaacagttattgttgaaggtgtacctgcaaatatagaaattaaggttgaggatattaataaagaaatgtttaagcgtcaaggcggttacggacgtggacgtcgtatgcaaattgagaaagatacagtagaaatagtatcaggcgttagaaatggttatacattaggtagtccaattactatggttgtaaccaatgatgactttacgcattggagaaaaattatgggagcagctccaataagtgaagaagaacgtgaaaatatgaaacgtactattacaaaaccaagacctggtcatgcagatttggttggaggtatgaaatataatcatcgtgatttacgaaatgtgctagagcgatcatctgctagagaaacagcagctcgagttgcagtcggtgccttatgtaaagtgttattacaacagttagatatcgatatatacagtcgtgttgttgaaataggtggaattaaagataaagatttttatgattcagaaacatttaaagcaaatcttgatcgtaatgatgttcgtgtaattgatgacagtatcgcacaagcaatgcgagataaaattgacgaagctaaaaatgaaggagattcaattggcggtgtcgttcaagttgtagttgaaaatatgcctgttggtgtaggtagttatgtgcattatgatcgtaagttagatggtaagattgcacaaggtgttgtcagcataaatgcttttaaaggtgtaagctttggtgaaggatttaaagcagctgaaaagccaggtagtgagattcaagatgaaattctatataatagtgaaattggttattatcgtggatctaatcacttaggtggtttagaaggcggtatgtcaaatggaatgccaattatcgttaatggtgtaatgaaaccaattccaacgttatataaaccattaaattcagtagacattaatactaaagaagactttaaagcaacaattgaacgttctgatagttgtgctgttcctgcagcaagtatcgtctgcgaacatgtcgtagcatttgaaatagcaaaagcattattggaagaattccaatcaaatcatattgagcaacttaaacaacaaattattgagcgcagacaattaaatattgagttttaacaacaagaacaattgaggtgtaatcatgaaattacaaacaacatacccttcaaataattatccaatatatgttgaacacggtgcaattgaccatattagcacgtatattgatcagtttgatcaaagttttatattaattgacgagcatgtaaatcaatattttgctgataaatttgatgatattttatcatatgaaaatgtacataaagttattattccagctggtgaaaagacgaaaacatttgagcaatatcaagaaacattagagtatattttatcccatcatgtaactcgtaatacagcaattattgctgttggtggtggtgcactggtgattttgctgggtttattgcggcgacacttttacgaggcgtgcactttatacaagtgccaacgactatactagcgcatgattctagtgttggcggtaaagtgggtattaactcaaagcaaggtaaaaaccttatcggtgcattttatcgtccaactgctgtgatttatgatttagtctttttaaagacgttaccatttgagcaaatattaagtggctatgcagaagtttataagcatgcgttattgaatggtgaatcagcgacgcaagatatcgaacagcactttaaagatagagagatattacagtcattaaatggtatggataaatatattgctaaaggtattgaaacgaagctggatattgttattgcagatgaaaaagaacaaggtgtacgtaaatttttaaatttaggtcatacatttggtcatgctgttgaatactatcataaaatacctcatggtcatgcagtgatggttggcattatctatcaatttatagttgcgaatgctttgtttgattctaagcatgatattaatcattatattcaatatttaatacaactcggctatcctttagacatgataactgacttggattttgaaacgttataccaatatatgctaagtgataaaaagaatgataagcaaggtgtacaaatggtcttgattagacaatttggagatatcgttgtacaacatgttgatcaactaacattacaacatgcatgtgaacaattaaaaacatattttaagtaggtgaatgaaatggtaaatgaacaaatcattgatatttcaggtccgttaaagggcgaaatagaagtgccgggcgataagtcaatgacacaccgtgcaatcatgttggcgtcgctagctgaaggtgtatctactatatataagccactacttggcgaagattgtcgtcgtacgatggacattttccgactgttaggtgtagaaatcaaagaagatgatgaaaaattagttgtgacttccccaggatatcaatcttttaacacgccacatcaagtattgtatacaggtaattctggtacgacaacacgattattggcaggtttgttaagtggtttaggtattgaaagtgttttgtctggcgatgtttcaattggtaaaaggccaatggatcgtgtcttgagaccattgaaacttatggatgcgaatattgaaggtattgaagataattatacaccattaattattaagccatctgtcataaaaggtataaattatcaaatggaagttgcaagtgcacaagtaaaaagtgccattttatttgcaagtttgttttctaaggaaccgaccatcattaaagaattagatgtaagtcgaaatcatactgagacgatgttcaaacattttaatattccaattgaagcagaagggttatcaattaatacaacccctgaagcaattcgatacattaaacctgcagattttcatgttcctggcgatatttcatctgcagcgttctttattgttgcagcacttatcacaccaggaagtgatgtaacaattcataatgttggaatcaatccaacacgttcaggtattattgatattgttgaaaaaatgggcggtaatatccaacttttcaatcaaacaactggtgctgaacctactgcttctattcgtattcaatacacaccaatgcttcaaccaataacaatcgaaggagaattagttccaaaagcaattgatgaactgcctgtaatagcattactttgtacacaagcagttggcacgagtacaattaaagatgccgaggaattaaaagtaaaagaaacaaatagaattgatacaacggctgatatgttaaacttgttagggtttgaattacaaccaactaatgatggattgattattcatccgtcagaatttaaaacaaatgcaacagttgatagtttaactgatcatcgaataggaatgatgcttgcagttgcttctctactttcaagcgagcctgtcaaaatcaaacaatttgatgctgtaaatgtatcatttccaggatttttaccaaaactaaagcttttagaaaatgagggataatataaaatggaagatatctataaattaatagacgatatcaatctacaaaaactagaaaatttagactctcgtgttaatgaagcaataactactgacaacgatgacgcattatttattctaggagagacactttacaattttggattaatgccacaaggtttggaagtattccgcgtgttatatcacaaatatccagacgaaagtgaattgctgatttattttattgaaggtttaatgtctgaaaatcaaactgacgaagcgttagaatatttaagttatgttgaaccatcacctgaaaagttgatgttagaagcagatttatatcaacaaattaatatgatggaagttgctattgataaattacaagaagcacttgaactagagccaaatgatccaataatccattttgcattggctgaaatgttatattatgatggtcaatatttacgtgctacctctgaatacgaaaccgttttagaaactggtgaatatcaagttaatggtgtaaacttattctctcgtatggcagattgtagtttacaaagtggkaactatagtgatkccgattcgcttatacgatgraattaatgaagatgaaatgacttcagaagattatctcaaaagagccatttctnacgataaaaatgacatcactcaagaagcaattaaaataatgactacattactttctaaagatcctgattatattcaaggctacttgtatttacaatcattatatg

SEQ ID NO: 531 - DNA, 942 bp; double-stranded, linear
aattgggttatactataggtaaatttaaggaggtaagaaaatggataaaaaagaattagcgaaatttataggcaataaaatcagatactatagaaccaaattgaacttaactcaagatcaacttggagaaaaactcmacactaaaaargctactatttcaaattatgagacagggtacagaactcctaaacaagatgatttgtttgaaattgctcatattttaaatatcagtatcgatgatttgtttcctacaagaaataataaaaaaaacgacatcacttccatatacaacaaactcacacctccccgccaagaaaacgtacttaactacgcaaatgagcaattagatgaacagaataaagtcacttctatagatgaatataaagagtctaaactagtatcgtatattgcatgtggtgcaactggtgctggcataggagaagaattatatgatgacatattgcatgaagaagtattttttaaagaagacgaaacgccatcaaatgctgatttttgtattttagttaatggtgattcaatggaacctatgttaaaacaaggaacatacgcttttattaagaaagaagattctattaaagatggtacaattgcactcgttgtattagatggagtaagtcttatcaagcgtgtagatatatgcgaagactatattaatttggtatctctaaatccgaagtatgatgatatcaaagtcgcttcgtttagtaatattaaagtaatgggcaaagttgtattgtgattaatagcgcctatatggcactttaatataaaagacgtctatttcagcagtgtttaaaaggagtttataatgaaaataactaattgcaaaataaaaaaagaaactatagtatatgaagttttaactagtggtaatcaaccattcacttatgagttacctaaagatttatcgtcacataatgc

SEQ ID NO: 532 - DNA, 417 bp; double-stranded, linear
tggnaaatgcaaaccaaaatatgatcctcgtgcaagttgaagcgggacgttatgaagaatgggtaaagaatggttattttaaaccgtcagaagataaatcaaaagaaacatatacaattgttatcccgccaccaaatgtaactggtaaattacatttaggacatgcatgggatacgactttacaagatatcattacacgtatgaaacgtatgcaaggatacgatacgttatacttaccaggtatggatcatgctggtattgcgacacaggcaaaggtagaagctaaattaaatgaacaaggaataactagatatgatcttggtcgtgaaaagtttttagaacaggcatgggattggaaagaagagtatgcgtcatttattcgtgcgcaatgggctaaattaggtctaggtttagatt

SEQ ID NO: 533 - DNA, 733 bp; double-stranded, linear
gatcctgaacccgcatttgtttccactaaaacagtatgcccactttctactaaagcgtgcacaccacttggtgataaaccaacacgattttcattatttttaatctcccttggtataccaattttcataccatccacctccataatcatcttaacgcgaacattttgaaagcgcaatcaaaaatccacaaaattgtaaaggttattacactgacttttccgaaaattgtggtaaaatataattaagaaagaacaaggaggcacttactatgattacttacaaaaatattttaatcgcagttgacggttcacatgaagcggaatgggcatttaacagagcagttggtgttgctaaacgtaacgatgcgaagttaacaattgtgaatgtaattgattcaagaacgtattcttcttatgaagtttatgatgctcaatttactgaaaaatctaagcattttgcagaagaattattaaatggttataaagaagtagctactaacgctggtgttaaagatgtagaaacgcgtctagagtttggytctcytaaatctatcattcctaaaaagcttgcacatgaaattaatgcagacttgattatgagtggtacatcaggcttaaatgccgtggaaagatttattgttggttctgtatcagaatctatcgttcgtcatgcgccatgtgacgtgttagttgttcgtactgaagagttaccagcagacttccaaccacaagtt

SEQ ID NO: 534 - DNA, 6060 bp; double-stranded, linear
tgatgatcctgaagcgctattggataattacaacactgaagatgttgatgcacacaattacaataatataaatcatgttatttttgcctgcgatgcgggtatgggttctagtgcaatgggtgcargcatgttacgtaataaatttaaaaaggcgggcattaatgatattacagttacaaatactgcgattaatcaattgccaaaagatgctcaattagttatcactcagaaaaaactaactgatcgtgctattaaacaaacaccaaatgccatccatatttcagtggataatttccttaattcaccaagatatgaagaacttttaaataatctaaaaaaagatgatcaagcataataattaaataaattaaaaaatggaggataccgccatgttattgagtacacgtgaaaaagaaatgatagccctattgattaagtaccacggtcaatatatcactatacacgacattgctcagcaacttgcggtgtcctctcgtactattcaccgtgaattaaaaggtgttgaagcatatttaacttcattttcattaactttagaacgcgcaaacaaaaaagggctacgcattgctggcacagattctgatttaaacgatttgaagcaatcgattgcacaacatcaaaccattgacttatctgttgaagagcagaaagtaattattatatacgctttgatacaagccaaggagccagttaaacaatatagtttagcgcaagaaattggcgtttctgtccagactttagcaaagatgttagatgatttagagcttgatttaaataagtaccaactatctttatctcgaaagcgtggcgaaggcatttacttggtaggtactgaatcaaagaaacgtgaatttttaagtcaattaatggtgaataacttaaatagtactagcgtttattcagtaattgaaaatcattttgtctttcattcattaaatcaaatccacaaagactttgttgacttagagcgcatttttaatgttgaaagactattaatggactacctaagtgccttaccctaccaacttaccgaatcaagttatttaactttaactgtccatatcgtgctctccatttcacgtataaaaaatggagagtatgtcgcattaaacgatgatatttatgattctgtacaaaacacatttgaacacaaagtagcaagcgaacttgctgataaacttggtcaaatatatgacgtcacgtttaatcaggcagaaattgctttcattactatccatttacgtggagctaaacgaaaaaatcttaatgatacatcattaaataatcgttgtgaagaaaacaaaattaaagcgtttgttaacaaagtagaaatgatttccggtatgacatttgcagatttggatactttagtagatggactgacgctacaccttaatcctgcaatcaatcgtttgcaagctaatatcgagacctataatccgttaacagacatgattaagttcaaatatccaagactatttgaaaatgtaagattagctttaaatgattgttggcctgatttgatttttccagagagtgaaattgcttttatagttttacactttggtggctcgattaaaaaccaaggtaatcgatttttaaacatattagtcgtttgcagcagtggtatgggaactagtcgtctattatcaactcgtctagagcaagtttttagtgagattgagcgtattacacaagcatcagtcagcgatttgaagtcactagatttaagtcaatatgatggcattatttctactgtgaatttagacatcgactccccctatttaacggtaaacccattattaccagatagtgatatcagttatgtcgcacagtttttaaatacaaagtctacgttccaagagacgcatgataaatcatcaaacatgattgataaggatgatgttcatgttgaaacgaaagatgttgatggcaacacatcttttgaaaatgaacaaacttcatacttaacttcagttttcgaaaaacatttaagtgacgaaaaatcagaacaattattgcatcatatgcgttcgggtttaactttgcttgattcagtgaaaatagttagtaccgaagttaaacagtggcaaacatatatcgcagattatctatatcaatgcgatgtaataaacgatccaacgtcattcgctgaactactagagcaacgattgattgacaatccaggatggatattaagtccatatcctgttgcaataccacacctaagagacaatatgattaaacaccctatgattctaatcacagttttagaagaaccgttaacattgcctagtattcaaaatgacaatcaaacaattaaatatatgatttccatgtttatttctgacaatgattttatggcatcactggtaagtgacttgtccgaatttttaagtttgaaattagaatctattgatacttttatggaaaatccacaggaacttgaaacattattaagaaacaaatttttagaacgaattaaaaaacaatttatttaggagtgtacaaaatgagcgaattatttagtaatgacaatatctttttaaatgtaaatgttaacagccaaaatgaagcaattgaaaaagcaggtaaagccttagttgatagtggtgctgtaacagatgcttatattcaagcaatgaaagatcgtgagcaagtcgtatcaacatttatgggaaatggcttagcaattcctcatggcacagatgaagctaaaacaaatgtgattcactcaggtttaacattattacaaatccctgaaggcgttgactgggatggcgaagtagttaaagttgtcgtgggaattgctggtaaagatggcgaacatttagacttgttatctaaaattgcaattacatttagcgaagaagaaaatgtggatcgtatcgttcaagcaaaatctgcagaagaaattaaacaagtattcgaggaggcagatgcataatgaaagcagttcactttggtgctggtaacataggtcgtggtttcattggttatattctgcagacaacaatgttaaagtaacatttgcagacgtcaatgaagaaatcattaatgctttagctcatgatcatcaatacgatgttattttagctgatgagtctaaaacaacgacgcgcgtgaataatgttgatgcaattaattcaatgcaaccttctgaagcgttgaaacaagcaattctagaagctgatattattacaacagctgttggtgttaacatactacctattattgctaaatcttttgcgcctttcttaaaagaaaaaacaaaccatgttaatattgttgcttgtgagaatgctattatggcaactgatacattgaaaaaagcagtacttgatattactggccctcttggtaacnatattcattttgctaactcagcagttgatagaattgtaccattacaaaagaatgaaaatatattagacgttatggttgagccattttacgaatgggttgttgaaaaagatgcatggtatggtccagaactaaaccatattaaatatgttgatgatttaacaccatatattgagcgtaaattattaactgtgaatacaggacatgcatatttagcgtatgctggtaaatttgcaggtaaagctacagttttagatgcagttgaagatagttcaattgaagctggcttacgccgtgttttagctgaaactagtcaatatattactaatgaatttgattttactgaagcggaacaagctggttatgttgaaaaaataatagatcgtttcaacaattcttatttatctgatgaagtaacacgtgtcggacgaggtacattacgtaaaattggccctaaagatagaattataaaaccattaacatatctttataataaagatttagaacgcactggtttattaaatacagctgcattgttattgaagtatgatgatacagcagaccaagaaactgttgagaaaaataattacattaaagaacacggtttaaaagcgtttttaagtgaatatgctaaagttgacgatggcttagccgatgaaataattgaagcgtacaattcactttcataatttattgagctttgtttgaaacaagaagtttccaacgttattcgttaacaatcagtaataatgtagtagttcccttgaattaacaatattaaatttctgaacataaaaaatactcccttcaacatagacacttaacttgtgttatgtatgaaaggagtatttttgcgttaataatttgttttattttcgagccacagccacctattcaatggctattggtcattactaaaacaaattcatattaactgttagacttggttacttagtaaggaatatttccctatgaaataactagatgttcacattcttgaataaattttattcttcagtttgttggtctttcttagtgaatcttctaattaagaatgccatacctgcacctagagctaattcagcatatggtaaatcgtcattatgtgacataccagtatctggtaaagttttagcttgttgtttagctttattaacttttccttgttgagctgattttgtcttagcttggtggtcgtcagtgttagttacattaagcatatcttgattagcactattgcttccatttgaaactgtagctggagatgcattggcaccgtcgttttgcgtagytttattgtttgcagctgaaccaactgatttttgcgtatcattagtatctgctgttgccgtatcatctttttggctaacattagttgaagtcattttttcttttgcttcagaagatgcagatgttgatggtttattcgaaacttcagtatcagctttgcttggcgatttatctgcttcgttagatgcaacgttagtttcagacttaagttgtcctgcatcagtttgatttgtcgtactttcttctttatcttttgatgtattagaaggtacatttggttctgttatgtctgctgaaggcaatgtttcagttgttgattcaaccatactttgatttgttgaatcactaccatctttttctgccttagctttattttcagattttggttgtgcaaccttgtcattagttgattgagattcagcactattatttacttcagcattttgttttgaatcatttacagatgcattatctttgctatcagcagatgatgctgcttctgtgctcgcagttgttggagccgttgctgttgatcctgttggtgcattctcgtttgttgctgtagttgtactattgttatttgttgtgctttctgctggcgttgcattatcagtttctgttacaggtttatcagttgtgccgttattagttgattctacttctggtttactagttacatcgttatccattgtcggactgtttgttgatgcatctacactagaattgttattagcttgcggtttatcatttgcatcatcagttgctgatgttgctgttgtttcacctgttgccgcatcactattatttggtgttgtcggagaagcgtctgctttgccattagctgtcgtctcagatacgttaggttgtccagtattttctggtgttgcattagcatttgaatttgctgttgcatcattattatctataccattattagtatcattagcatctggatcattctgaggcacaatcgcttcaattgcaggtatcgttacattttgtaattcagcaacttctgcatttgtttgtgttttatctaatttatcagcaaatctgtcaaaatatctacctaaatccgtacgtgcaatttctttcgccgatgcatctgcatctgcatttttaattatttctatttgcttgttaaccacttctctgattgcttccaaagcatttttcttaacttcaggattaatacgttgtgctttaagttgttcaagcgcactatttttgacagtagcgatttctgcatttgtagtttgatcagaaatatcttcagttgcttttgataaaatgtcttctaaagcattcgtaaacgcttctttttcttcagttgtagcatcagcgttgacatttacacctgcttcaatctggtctagtgcagtttct

SEQ ID NO: 535 - DNA, 977 bp; double-stranded, linear
aacaaagccttccaattatctgcgtcggtagaacaagtattagcaactttatcacctacgctaaacagtccttacgatttatacggcacgacaaaaatgctagatattacattcgattcatttgaacatgatggtacaacgtaccctgtcgactatgctacgtttgaaaatgattatgaagataataaagatcctgagtttagacgtaaaagtttcaaatcgtttagcgatgggattcgaaaatatcagcatactaccgcggctacatataatatgcaagtacaacaagaaaaaattgaagctgatttacgtggatttgaatcagtcatcgattatttattacatagtcaagaagtaacgcgtgatatgtttgaccgtcaaatcgatatgattatgcgtgacttggcaccagttatgcagaaatatgctaaacttttacaacgtattcacggattagataacatgcgttttgaagacttgaagatttctgtagaccctgattatgaaccagagatttcaattgaagactcaaaaaattatattttcggtgcgttaagtgttttaggtgatgactatacaaacatgttacgtgaagcatacgatcagcgatggattgattttgcacaaaataaaggtaaagatacaggcgcattttgtgcaagtccatactttacacattcatatgtgtttatttcttggactggtaaaatggctgaagcatttgtcttagcacatgaattaggtcatgcaggtcattttacattagctcaaaaacatcaaccatatcttgaatcagaagcatcaatgtactttgttgaagccccttctacaatgaatgaaatgttgatggccaattatttatttaacacaagtgataatccaagatttaagcgttgggttattggctcaattttatctagaacatattatcataatatggtacccmtttattagaagcngcttatccacggggagtg

SEQ ID NO: 536 - DNA, 1440 bp; double-stranded, linear
agacagtgatygaatttcatttacagtacacaaatcatcgaaaaattggtaacattcttctctattttctaacgttagwattgcatcaaacaattcatctaacgctgcacctcgtaatttttcaatttgcatatcgaaacaacccctataattttattctttatgtcattttaacgcattaatctattaaagtgtagcgatttatattttattaaatctgaatcgttactttatttaattttatgctaatccagcgcgttcgaaaatagtgtcaacttgattcaaatgatgtttaggatcgaaacattcatccaattcttcttttgttaaaacacttgtaatagactcatcttgttcgattaattcacggaacggtgttttcgtttcccaagatatcatcgcttttggttgtactttgtcgtatgcttcttcacgaaccatacctttattaattaatgctaataagacacgttgtgagaaaatcagaccaaatgttttatctatgttattacgcatattatcttcaaatacagttaaacggtccacaatatttgtgaacgattcaatgcataatctagtgctattgtaacatctggtaacataatacgctcagcagaagaatgagaaatatstctttcatgccataatggcacattctcataagctgtagtaatataaccacgaatgactcttgaaatacctgtgatattttcagaaccaattggatttcgtttatgaggcattgcagatgaacctttttggccttttgcaaatgcttcttcaacttctctcgtttcggttttttgaaggttacgtatttcaacggcaaatttttctagtgatgtcgcgattaatgctaatgtcgcaatatagtatgcatgtcgatcgcgttgcaatgtttgcgttgatacaggcgctgtgccaatacctaaatgtttacacacataactttctatttcaggaggaatgttagcaaaagtacctactgcaccactcattttccctacttcaatttcttctcttacttgtttgaaacgttgtaagttacgttgcatttccgtgtaccacaatgccattttgacaccaaatgtagttggttctgcatgcactccatgtgtacgtcccatcatcaatgtatatttataattttttgctttttcagctaaaacgtcgataaatctttctaaatctttttcaataatgtcatttgcttgtttaataacgaaacttaaagctgtatctacaacatcagtagaagttaaaccataatgtaccacttacgttcttcacctagcgtttcagaaacttgtctagtaaaggctacaacatcatggcgcgtttcttgttcaatttcttgtgcacgttcgacatttacctttgcgttttgacgaattttttgtacgtcagctttcggtatatgtcctaattcactccatgctt

SEQ ID NO: 537 - DNA, 784 bp; double-stranded, linear
gataaatctatncagtttccgtccaaatatctgcacctaaagcttttaagtgttctacaatatctgtataacctctataaatatgtttaacattgtaaattgtagttacaccctcagcaattaaaccagcaataattaaacaagctcctgctcttaaatcgctagcataaacttcagcaccatgtaatgttgatggttttatcgttgctgtgccttcgtcaacttcaatatttgcacccatgcgctttaattcttcaacatgtttaaaacgctccggataaatcgtatcagttacaaatgaaggaccatttgccataaataataatggtgtaataggctgttgcaaatcagtagcaaaacctggatatactagtgttttaatatcaacaaattgatatggcgcattattattgatgcgaattctttcgtctcttacatcaacattcacacctaattcactaaatttagcagttaatgtttctacatgtttcggaacaatattatttaatataacattttctccacatgctgcagcgatacacatatatgtgcctgcttcaattctatcaggtataacttgatactcagaaccatgtaattctttgacgccattgattttaattgttgatgtacccgctcccttaatattagctcccatacttgttaagaagttagcaacatcaactacttccggttctttagcagcattttcaattacagtttgtcctgttgcataaactgcagctagcataatgtnaattgttgcacctacgcnaaccatatc

SEQ ID NO: 538 - DNA, 3733 bp; double-stranded, linear
caatctccaccaatgacacgtcgtcattcgtgacctcataccaracaaaaaacagtctcgcaatcaagactgttttccactcaatatattcatccattagcgtaatagattatttgacttctgtagctacaaagattttacgtttttcccaaacgcctgtcttttcattgtaatcatcacaagtaattaatgttaattgtttatctttacctttttgttcatctagaactcctacatctgtaggcttaacatctcttatacttgtcattttatacttacgtgtttcattaccaactttaaagtacaccatactaccttttttggctgctttaagatttgtaaattgatagttcggacggtcaatgaaagtgtgtcctgcaattgaaatattttgatcatctagtgattcattttcttctgcaaagcttacacctctatttaattgttcaggtgttgctggtcctggatatactggttctttaatatcagcatctggaatttcaatatagcctgccactttcgatttatctttcggaatttgaggtttagcttgctgctttttatctttactcgcctgttcttttacatttttatcatattgttcaatcttttcatctttatctttatcgtgaagataattatcgatatgtggtttagcaaacaaatatgctgccactaggataagtaccacaccagcgattgtcattaatcgatttgtccattttttcatacgttaaggctccttttatacatttcacaatgcctgttaacatttcatatagtataccattaatttcaaaatgactcatagcaattcattttatactataaaatttacatgtatacttttacgttagatttcattacacatatttgcattcaaataacgaaacgcttttaataattactaagggggaattgatatgattagatacgctaaaaaagaggatttaaacgctatattagcgatatacaatgatgccattatcaatactacagctgtttatacttatgaaccacaaaccatagacgaacgtgtcgcatggtttgaaacgaaacaacgtaagcatgagcctatctttgtatttgaggaaaatggaagtgtcttagggtttgcgacgttcggttcatttagaccttggccagcatacctatatacaatcgaacattctatttatgtcgatgcttcagctagaggaaaaggtattgctagtcaattactacaccatttaattgtggaagcaaaagctaaaggttatcgtgcgctagttgcaggcattgatgcttccaacaaagcgagtattcagttgcatcaaaagtttgcttttaagcatgccggcacactgaccaatgtaggttttaaatttaatagatggttagatttagcattttacgaattagatttacaagactagtaatgtttgaatcacataatataaacaagacaaccatgttaattcccttaacataacaagccaacatataaaattttaaacttctcaggggagtgggacagaaatgataaagagccactaatgatttattatgtagtggttcttacacattagccacagctaatgtgtacttaaaaataggaatacatgagtaaaactcatgcataagaaatactaatttctatagaaaaagtatttctttatcgtcgtcccaccccaactcgcacattattgtaagctgacttttcgtcagcttctgtgttggggcccaaaaagcttgttacaagcgcattttcgttcagtcaactactgccaatataactttgtagagcatattacattgatttacattgtcccttttatttattcttttcaaatactatccccatagctttgatttaacgctttttctcaataacaaaacgaatatagtagaacatgaaaacgataatcatgctgagcgataaagatttaaataatagattgacccacgttccctcagtcgtatatccatatgtaatcgttgtgttaatgatgaatgctataaagatgattgatagtcttagcatatcatcactccttttaagttattttagatatacgggggcgcttttgcaatcactattttgattagtatgcattttccataaatctttcaacttcttcagagataattaagaagcatctatctggtactaatgatccagacagatgcttcttttttatcaatattttattgttatctcattaattatttttaaccatatcttcagctgtgccaaagattttacgtttaattgcttcgccagttggtgtgcctgctagtccacccaatccagtttcacgtaatgatgcaggaaggttacgaccaaccttatccattgcttcaataacttcatcaacagggattctactttcaatacctgctaatgctaaatctgctgaaattaaagcgttacccgaaccaattgcatttctcataacacaaggaatttcaacaagtccggctactggatcacaaactaaacctaataaattacttatcgctaatgccatagcgtgcccggatgcttctggtgatcctccgaatatagctactgctgcagctgcggccattgcagatgctgaaccaacttcagnttggcagccacctgttgcaccagctacacttgcattgtttgctacgacacgcccaaacaatgctgaagtgaataagaaatcaatcatttgctcttctgttaaatcatgtgttttttctaatttaaaaagtgcaccgggaatggtacccgaggaaccagctgttggcgttgcacaaataatacccatcgcagcattgacttcatttgttgcaatggcacctttgctgcgtcaatcatttcatatccagacaaagcatgatgtgtttcattataatcacgtagtttagcagcatcatgaccagtgtagcccgttacactttcaaccccatcacctgtcgtccctttgattactgcgtctcgcatgacatctaaattttgtttcatttgcgctcgcacttcatcacgtgatttaccgcttaattccatttcttctttaaccatgatatccgcaaatgacatattattttctacggcataatctatagtctctctaattgaatcaaacatgtttattccccctctaatttatataggaaacgtttacgtcactgtatttctctttaattgtatttaatgttgattctgagattgctttatttaatggtattacaaccaagcatttatcttcatctatcttaataaattcatctttacagtctaatttcatatcgttgatatcattgatgaaatgatttacttgtgctttagtcatatttccgtcaacaactaaaattggtaatccatgatttaaatctacttctagtccatttatatgaatacctttaattttaattgtaccaccaccgattgaaataccgataatttcaatgtagcgaccatcattacgagatgatttgatataagcacagtttggatgttgaccaatactatcgccttcttcttcgatgatatctattttaataccatcatcagctgcaatttctaatgaagatttaattcggttatcaaatgttgaatatcccattgctccacccacaatagcgacatctgtaccatgtccttggtgtgtttgagcaaatgattcataataatgtatttcaatatttttatatctcccaatattgcgcgtgctgaattcccctttactgcaccagccgtatgagaacttgaagggcccat

SEQ ID NO: 539 - DNA, 525 bp; double-stranded, linear
tggctgtcttctctatgagtgtagtaagtaagttaacggatttaacgccaaggcaaatacgttactatgaaacacatgaactcatcaaacctgaaagaacagaaggtcaaaaacgtctgttctcactcaatgatttggaaagattactagaaattaaatcattattagaaaaaggatttaatatcaaagggattaaacaaatcatttatgactcacaagagcatttaacaacagatgaacaagagataagaaaaaagatgattgtagatgccacgcaaaagcctattggagaractttgccaataaatcgtggtgatttatcccgatttattaaataaaatttggaggattttaaaatgccaaaacgtactttcactaaagacgacattcgtaaatttgcagaagaggaaaatgtaagatatttaagattacaattcactgatattttaggaacaattaaaaatgttgaagtgcctgtaagccaattagaaaaagtacttgataacgaaatgatgtttgacggta

SEQ ID NO: 540 - DNA, 1408 bp; double-stranded, linear
ttgatttgctacaaagtatctnctcatttctgtatcctgaaaaatctttagtgtaataatgttgttcagttttaatattttcagtcatagttgactacctccgtatattttgatttaattaagttgtatattttgatgaacacttattgttacttgttggcgcaagtagcagttttttcattcttcataaaagtattccttatagaatatgaatgttgcgatacttgcgaatcctgcaattgaccatgctgtagtgaagtatagaaacggcataagtacaatcgctaagactgtgaagcatagtactgctactaggtagcttttataaatgttactcattttcttttttcaactcctccattattctctggtctgataagtcgtgataagggaattttttcctagctaattggactggtattctgcctcgtatcgcaatgtatccttcatcttcaagctctttattcagttctcttattatttgtcctgctttggatttagaaacagataaaattaccgcaagttctttagcttgcaaactatttttcatcatatcttttcctcctttaaaataactgttgattctctgggttatctgcttcgtaattatctgcaataatacttttagcgaaaaagtccaaactgaccttatataggttgttcatagatttctttacgttaaccccttcctcaagtacataaggcaccctaaaatcatttataaacagtccgttttcgtctaaagtaacggttggtaattcaggtttgttccgtctataaacttctcctagtgtaggtttttgcttttcagcttgtttagtgaagtcggaaaatgccttaagtagttttattcctgaatcaggatcactgtgtcgctcaatcgtttctgctgtagactctttactaaaatcatttctattgattacaggctttctcgtatttcgttcaatcttccaaaccttccacgtcacaactgccattgtggtgaggagggttgttttgtatagtgcgttcatttgtaattcctcctattaagttgtttgttcaattgtgtgtgttattcttcttcgtctaaatcaaagtgctgttcgatttggtcaattgcccactcaatcattgattcaaggtgtttctctctgtcgacttcgtaagtgtgctcaatctcgcctgcatatgtcacagtaagagtatctttgtgtgtgtatgtttgacttttgttytctttaactgcataaagtgttaatactatattgtttagctttyctttttgttctggtgtcatttacgctccccctamattagcytcataaccgaattcagtcatgatttcatgtattttcaatctgcctttttgtgtccatctagtttgtaaaactgtgtcttctctgccatcagaacgcacaattgt

SEQ ID NO: 541 - DNA, 432 bp; double-stranded, linear
gttcgtcaatgatttttatccgatgctatgagcattatcaaatacaaaatgctctcttaaaagcagttattgactgaaaatctacttctaagagagcactttatttaattacttaagaaatcttgaaatttcaatatacgatgtttatgataagtcgcttatttcatctttaggcttgttattagtaagtagtttaataccactgattaaccataaagcaaatgtaattatgttaccacttattacagctccaataatcaacaatataccactcatttttttgtttttagatgctttaaacataccgattgcacctaaaataattgaaatgattccaaatatgaatagggataagaataatacagtgaaaattgctgctgctgtttctgcatcaactgggncaacctcaccattaactgttgttggacacat

SEQ ID NO: 542 - DNA, 2426 bp; double-stranded, linear
ataatcatgaagtngctaaancgccaaataatgatggttctggacatgttgtgttaaataaattcctttcaaatgaagagaatcaaagccatagtaatcgactcactgataaattacarggaagcgataaaattaatcatgctatgattgaaaaattagctaaaagtaatgcctcaacgcaacattacacatatcataaactgaatacgttacaatctttagatcaacgtattgcaaatacgcaacttcctaaaaatcaaaaatcagacttaatgagcgaagtaaataagacgaaagagcgtataaaaagtcaacgaaatattattttggaagaacttgcacgtactgatgataaaaagtatgctacacaaagcattttagaaagtatatttaataaagacgaggcagttaaaattctaaaagatatacgtgttgatggtaaaacagatcaacaaattgcagatcaaattactcgtcatattgatcaattatctctgacaacgagtgatgatttattaacgtcattgattgatcaatcacaagataagtcgctattgatttctcaaattttacaaacgaaattaggaaaagctgaagcagataaattggctaaagattggacgaataaaggattatcaaatcgccaaatcgttgaccaattgaagaaacattttgcatcaactggcgacacgtcttcagatgatatattaaaagcaattttgaataatgccaaagataaaaaacaagcaattgaaacgattttagcaacacgtatagaaagacaaaaggcaaaattactggcagatttaattactaaaatagraacagatcaaaataaaatttttaatttagttaaatcggcattgaatggtaaagcggatgatttattgaatttacaaaagagactcaatcaaacgaaaaaagatatagattatattttatcaccaatagtaaatcgtccaagtttactagatcgattgaataaaaatgggaaaacgacagatttaaataagttagcaaatttaatgaatcaaggatcagatttattagacagtattccagatatacccacaccaaagccagaaaacgttaacacttggtaaaggtaatggattgttaagtggattattaaatgctgatggtaatgtatctttgcctaaagcgggggaaacgataaaagaacattggttgccgatatctgtaattgttggtgcaatgggtgtactaatgatttggttatcacgacgcaataagttgaaaaataaagcataattatattgggggaagagcatctatatatttttttaagtatataagacgtcttatttccccttaatttattgtgaagtatatgcaaaatgcaatgaatagattgtccatcattttaacgttataatgaatttaacgacttagaactacacaagtaaaggagaatgaagatgtctcgaaaaacggcgctattagttttggatatgcaagaaggtatagcgagtagtgtacctagaataaaaaatattattaaagcgaatcagagagcaattgaagcagcaagacaacatcgaataccagtcattttcatacgtttagtgttagataagcattttaatgatgtctcctcgagtaataaagtgttttcaacaattaaagctcaaggatatgcgattactgaagcagatgcatctacacgaatacttgaagatttagcaccactagaagatgagccgattatttctaagcgacgctttagcgcatttacaggtagttacttggaagtttatttacgtgcaaatgatattaatcatttagtattaacgggtgtctctacaagtggagctgtattgagcacggcattagaaagtgtagataaagactattatattactgttttagaagatgctgttggtgatagatcagatgataaacatgactttattattgaacaaattttatcacgctcatgtgacattgaatccgtagagtcatggaaaagtagtttatagttaatataacgtcaattaaagctcggcagtaatgtttgagaataagtacatttgctcatatttataaaatgtgtgagatggcaattgaaacggatatgatgaggaacatttgaacataaaataatatatttatataaaacgaccgaggcgttcgaactgaatgtcctcgggtttaattgaatagaaatcggacttatgaacgaaatatgtttaagtcgaactccttgtttatacttataaattttacgggtttaatataatacttatttacctgtaatatatgcataattncttcagtcggtcagcctgtcgttgcatagttcctatgcagcaaatgcatatcctaatcctttaacattggcattnctgcaaatgaacgcatagaatccattcactgttaactttttncaacaaatgtctnacatg

SEQ ID NO: 543 - DNA, 1874 bp; double-stranded, linear
gagttggggaatgtgctcaaaatatgcggactttatgcattycggaattgsccaattgcagctttaagctatggtcaaaaaaagagggtcactatagcatctgttttagtcttaaatccggaaataatcatattggatgaaccgactgctggtcaagatttctatcattataatgagataatgtcatttttaattgaactaaacagacaggggaagacgattattatgattacgcatgatatgcatttattgtctgagtatagttcaagaacagttgtattatcaaaaggtcaagtcgttgctgataccacgccagtattggttttaaatgataaaaaaatctgtgagattgcatcattgagacaaacatcgctatttgaaatggccgaatatatagggattagcgagccacagaaattagtacaattatttattaaccatgataggaaggtgagacgccaatgaatcaatataatactataggttttcacccgggaaatagtcgtattcatcaattaaatgcgactgttaaacttttattcttattagttgtttctatttctgcaatggtgacttatgacacaagatatttaattttaattagtgcttcatctattttattggtcaaatatgctcatattgaatggaaacaagttcgctttgttgttaaattcattctgtttttcacaatattaaatattattgccgtgtacatatttgaccctgaatatggtgtgaagatttataatcagcgtacagagttagtcaatggtattggtcgatttacgctaacatcacaggaattattctatctttttaatctaatattaaaatatattagtacagttcctttagcgttaatatttttattcacaacgaatccgagtcattttgctgcaagtttaaatcagctaggtgtgaattataaaatcagttacgcagtctcactagcattaaggtatattccagatattcaagaaacatattttaatatttcacaagcgcaacaagcaagaggatatgataattcgaaaaaagcaaaatttactagccgtgttaaaggtatcaaacgcattgtgttacctttaatattttctagtatcgaaagaattgacactattagtactgctatggagttaagacaattcggacagtataaaaggagaacctggtacgtcaaaaaacaattaaaaaaagatgattatgttgttttgtgtttgacgttaatacttctgatgttagtagttacattattctttttaaataatagtcgatatttcaacccgtggcattagtattcatataaatagtctttaaatagaaataggagggagacatttaatgataaatactgaaagattaaatttaatgattccaagttcctcgcatttaattgaactttataatatttgtagtcatccacaagcaaatatatacactcccaaaggtttacataattccaaattagacacacaacggtggattgaaaaatggcgaaaccattggcaacaatatcaatttggttactttgtattggtaaaaaaaatagattgtagtgttattggtatttgtggatatgaatatcgacaattaaagcaagaaacagtattaaatttattttataaattacatccaagttttgaaggacaagggtacgcatgtgaggctattacagcaatcacaaattttgtgaattatatcgatcaagaaacagtaaaagttatcaggacaaataagtgtaaccaacgttcaataaatttagcagaaaggcttaaattcaagcgagacgatactatggacgacattatcaatcaaggagatattgtgttttaanaataaaatactatgacattatctaaaaaataaaattaaaa

SEQ ID NO: 544 - DNA, 5280 bp; double-stranded, linear
tcaacatttctaacaccaatgtgaaaatgatctatgtgatttgcaatggcttgatttgtaatatgtgtgcctaaatgacctgtagcacctgttaacataatattcattcacttcatctcctaatctttatatacataacataatacttatttgatggttttcaaaacatttgattttataaaaaattctaatctgtatttattgtcgacgtgtatagtaaatacgtaaatattattaatgttgaaaatgccgtaatgacgcgttttagttgatgtgtatcactaatatcattgaaaattttaatcaggtactacgacaatatgatgtctgttttgtgtctgaaagttttacagtttttaaaataaaaatggtataaagtgtgatttgtataaaaaagagtctcgacggataagaattgattaataacagttagcattttattaattaccttaacaatgattcaagtttagttaaatgaggtttaatttgaaaggggatagcgcctcaatataatgtaggtagattgttcatattacgtaattgaaaaatcaaatttaaatagattggggctaaaaattatgaaatttaaagcgatagcaaaagcaagtttagcattgggaatgttagcaacaggtgtaattacatcgaatgtacaatcagtacaagcgaaagcagragttaaacaacaaagtgaatcagagttaaaacactattataataamccaattttagagcgtaaaaatgtgactggatttaaatatactgatgagggtaaacactatttagaagtcacagtagggcaacagcattctcgaatcactttacttggatctgataaagataaatttaaagacggagaaaactcaaatatagatgtgtttatccttagagaaggtgacagtagacaagcaacaaattactcaattggtggcgttacaaaatcaaatagtgtgcagtatattgattatatcaatacgccaattttagaaatcaagaaagataatgaagatgtacttaaagatttttactacatttcaaaagaagacatctcattaaaagaacttgattatagattaagagaacgtgcgattaaacaacacggcttgtattcaaatggtcttaaacaaggtcaaattacaattacaatgaatgatggcacaacacatacaatcgatttaagtcaaaaacttgaaaaagaacgtatgggtgagtcaatcgacggcactaagattaataaaattctagtagaaatgaaataatactttctaacaacaaagcgctatgttgaatagtgcttgttatggaaatatatggaagttaagcgacgtactgttgcttagcttctttttttgaggggaaaagttacaaaactcacacaaacagtcgcaccacgcattatcttttgcttaaatagcttaatcatattttatgaatagttaaaaacaggttaatgtgaatatccgaatacagctcctataatatgggtgtatgattcaaattacgtaataaaacaatctaattataatagattggagcatacaactatgaaaatgaaaaatattgcaaaaataagtttgttattaggaatattagcaacaggtgtaaacactacaacggaaaaaccagttcatgccgaaaagaaacctattgtaataagtgaaaatagcaaaaaattaaaagcttattataatcaacctagtattgaatataaaaatgtgacaggttatatcagtttcattcaaccaagtattaaatttatgaatatcatagatggtaattctgttaataatattgctttaattggcaaagataagcaacattatcatacgggtgtacatcgtaatcttaatatattttacgttaatgaggataagagatttgaaggtgcaaagtactctattgggggtatcacgagtgcaaacgrtaaagctgtcgacctaatagcagaagcaagagttattaaagaagatcatactggtgaatatgattatgactttttcccatttaaaatagataaagaagcgatgtcattgaaagagattgattttaaattaagaaaataccttattgataattatggtctttacggtgaaatgagtacaggaaaaattacagtcaaaaagaaatactatggaaagtatacatttgaattggataaaaagttacaagaagaccgtatgtccgatgttatcaatgtcacagatattgatagaattgaaatcaaagttataaaagcataacacatatacttgatgacgaaataagttgaaattgaaatagagaggttaagtgacgatcaaacgttgcttaacttctttttaatgcttaaaaattatttcaaaggcacatagaaacgctatattaatctcatactcactcattattttttgcttaaattacttaataatacttcaataattgttaaaaggggtttaatgtgattatcttagaacgccatctataatgatgttgtatgattcaaattacgtaaaaagacaatcgaatataatatagattggagcatacaattatgaaaatgagaacaattgctaaaaccagtttagcactagggcttttaacaacaggcgcaattacagtaacgacgcaatcggtcaaagcagaaaaaatacaatcaactaaagttgacaaagtaccaacgcttaaagcagagcgattagcaatgataaacataacagcaggtgcaaattcagcgacaacacaagcagctaacacaagacaagaacgcacgcctaaactcgaaaaggcaccaaatactaatgaggaaaaaacctcagcttccaaaatagaaaaaatatcacaacctaaacaagaagagcagaaaacgcttaatatatcagcaacgccagcgcctaaacaagaacaatcacaaacgacaaccgaatccacaacgccgaaaactaaagtgacaacacctccatcaacaaacacgccacaaccaatgcaatctactaaatcagacacaccacaatctccaaccataaaacaagcacaaacagatatgactcctaaatatgaagatttaagagcgtattatacaaaaccgagttttgaatttgaaaagcagtttggatttatgctcaaaccatggacgacggttaggtttatgaatgttattccaaataggttcatctataaaatagctttagttggaaaagatgagaaaaaatataaagatggaccttacgataatatcgatgtatttatcgttttagaagacaataaatatcaattgaaaaaatattctgtcggtggcatcacgaagactaatagtaaaaaagttaatcacaaagtagaattaagcattactaaaaaagataatcaaggtatgatttcacgcgatgtttcagaatacatgattactaaggaagagatttccttgaaagagcttgattttaaattgagaaaacaacttattgaaaaacataatctttacggtaacatgggttcaggaacaatcgttattaaaatgaaaaacggtgggaaatatacgtttgaattacacaaaaaactgcaagagcatcgtatggcagacgtcatagatggcactaatattgataacattgaagtgaatataaaataatcatgacattctctaaatagaagctgtcatcggaaaaacaagaagttaagtgacaacggtttacatgttgcttagcttcttttattatgcgtaatgatgtaaaaagacgaatattcatttgtttgtaaaagtggcatttctatgtcttaaaagtgacgaaacttcaaatgtgccaagtgttgaatcacatcaaaatcatttttatttaacgaacattatggatttcttaatttacttaacgatgattcaaatatagttaaacaaggtttaatgtgaatggagcaatacgccatctataataaagctgtatgattcaatgaatgtaatcgaacaaatctaataattacgaatggagcatacaactatgaaaataacaacgattgctaaaacaagtttagcactaggccttttaacaacaggtgtaatcacaacgacaacgcaagcagcaaacgcgacaacactatcttccactaaagtggaagcaccacaatcaacaccgccctcaactaaaatagaagcaccgcaatcaaaaccaaacgcgacaacaccgccctcaactaaagtagaagcaccgcaacaaacagcaaatgcgacaacaccgccttcaactaaagtgacaacacctccatcaacaaacacgccacaaccaatgcaatctactaaatcagacacaccacaatcgccaaccacaaaacaagtaccaacagaaataaatcctaaatttaaagatttaagagcgtattatacgaaaccaagtttagaatttaaaaatgagattggtattattttaaaaaaatggacgacaataagatttatgaatgttgtcccagattatttcatatataaaattgctttagttggtaaagatgataaaaaatatggtgaaggagtacataggaatgtcgatgtatttgtcgttttagaagaaaataattacaatctggaaaaatattctgtcggtggtatcacaaagagtaatagtaaaaaagttgatcacaaagcaggagtaagaattactaaggaagataataaaggtacaatctctcatgatgtttcagaattcaagattactaaagaacagatttccttgaaagaacttgattttaaattgagaaaacaacttattgaaaaaaataatctgtacggtaacgttggttcaggtaaaattgttattaaaatgaaaaacggtggaaagtacacgtttgaattgcacaaaaaattacaagaaaatcgcatggcagatgtcatagatggcactaatattgataacattgaagtgaatataaaataatcatgacattctctaaatagaagctgtcatcggaaaaacaagaagttaagtgacaacggcctacatgttgcttagcttcttttgttatgttcgatgatttgagaacccgaattttcgatgggtccaaatatgacgtggaagagacctgaatttatctgtaaatccctatctatcgggtgtgaagcacaacgggatcagttttatttaacgaacattatagattccttaatttacttaataatgattcaatgattattaaacatggtttaatgtgaaaggtcaaatacgctaactataataaagctgtatgattcaatagacgtaagcgaacaaatctaataattacgaatggagcatacaactatgaaaatgacagcaattgcgaaag

SEQ ID NO: 545 - DNA, 886 bp; double-stranded, linear
agtaaaattgccggtatgatggacacaaacggtgaccttggtcaaggtgaattagcgattaatccacctaaatcagatttgaacgaattaccttgggctacacgtaaaaataaacagccagcttcatccgaaaaaggttcaagtggtcatcatggtaatgcagcaatgcctcaaaccamattagattatcaaatatctattgataaggtcgttgaacaggcgcaaaaagctggtattaaaaagccgttttcaatcgtatatccaagtgataaaaatggtacctttattgtatctaatactagtaattcaggtgttactgggctagatgtatcaccatacaaggaacaaacactttatttcgatcaatatagcggtaaaaagctaggtacgattaaatatgatgactacggtattattgctaaatggtttacatggggcattccgcttcacgaaggtcatttattcggcattttaaataaaatcattaatttatttgtatgtatcgctttattagtagccattggcatggggtttgtctcttggataaagcgtacaaaaaatactgcagtaaaagtaccacatcgcgtaaaaaaaccagcatctatatcactcataatatgtttaattgtattaggattattaatgccattatttggattatcacttatccttgtatttataattgaattaatattatatattaaagatcgtcgtgctaaacaataatgcacttaaagttttgaactgacgaaatttacaaaatggattctcgtctctctaattacttaaaacggggttcyaataataaatcgtactgatgggaaagtttttactttttatctgtccgattttttngaawttgaagataaaaaagcatctaaaacgc

SEQ ID NO: 546 - DNA, 4336 bp; double-stranded, linear
ggcatttgtgtccttatataaggaactgtgttaaatacattactgttgttaagttgtttttgtaattcaaagagcagaacagagtaacatcatcagttgtagtaaacgataatccggtaaaacaactaaatgaaataatgaaagtcatttaacctgaacattaaaatatatttgtttttcattaagaataattcaagtatatttaaatcgaggttaattatcgtatgaaacgatgcacgttataataaaaatgtatgattcaaattacgtaatgaaaacaatccaatatattaagattggagcaaataaatatgaaatttacagcattagcaaaagcgacattagctttaggaattttaacaacaggaactttaacaacagaagttcattcaggtcatgcaaaacaaaatcaaaagtcagtaaataaacatgacaaggaagcattataccgatactacactggaaagactatggaaatgaaaaatattagtgctttgaaacatggtaaaaacaacttacgttttaagtttagaggtattaagattcaagttttactgcctggaaatgataaaagtaaatttcaacagcgtagttatgaggggttagatgttttctttgttcaagaaaaaagagataagcacgatatattttatactgttggtggtgtaatacagaataataaaacatctggagttgtcagtgcaccaatattaaatatttcaaaagaaaagggtgaagatgcttttgtgaaaggttacccttattacattaaaaaagaaaaaataacactaaaagaactggattataagttgagaaagcatctaattgaaaaatacggactttataaaacaatctcaaaagatggtagggtcaaaattagcttgaaagatggcagtttttataaccttgatttaagatctaaattaaaatttaaatatatgggggaagtcatagaaagcaaacaaattaaagatattgaagttaacttaaagtaaatcattacgaataattaaaagtaattgaagcggcttaacggtgaaatgtaaattggtgcgcatagcttatacaaaaaggatgcatcaatcgatatcgtcgttaagccgttttggtttgtgtgtcatgaatcctatcccaatctccataaaggtaaaatttccaccaccaacatcaaaattctccacatcgcaacataaccaaatgttataataaatctattacacaaagagataaattacttattcaaaggcggaggaatcacatgtctattactgaaaaacaacgtcagcaacaagctgaattacataaaaaattatggtcgattgcgaatgatttaagagggaatatggatgcgagtgaattccgtaattacattttaggcttgattttctatcgcttcttatctgaaaaagcggaacaagaatatgcagatgccttgtcaggtgaagacatcacgtatcaagaagcatgggcagacgaagaataccgtgaagacttaaaagcagaattaattgaccaagtcggttacttcattgagccagaagatttattcagtgcgatgattcgtgaaattgaaacgcaagatttcgatatcgaacacctggcgacggcaattcgtaaagttgaaacatcaacattaggtgaagaaagtgaaaatgactttatcggtctgttcagcgatatggatttgagttcaacgcgactaggtaacaatgtcaaagaacgtactgctttaatctctaaagtcatggttaatcttgacgacttaccattcgttcacagtgacatggaaattgatatgttaggtgatgcatatgaattcctaattgggcgctttgcggcgacagcgggtaaaaaagcaggcgagttctatacaccacaacaagtatctaagatactggcgaagattgtcacagacggtaaagataaattacgtcacgtgtatgacccaacatgtggttcaggttcactgttgttacgtgttggtaaagaaacacaagtgtatcgttatttcggtcaagaacgtaacaatactacatacaacttagcacgcatgaatatgttattacatgatgtgcgttatgagaacttcgatatccgtaatgatgacacattggaaaacccagcctttttaggcaatacatttgatgcggttattgcgaacccaccgtatagtgcgaaatggactgcagattcaaagtttgaaaatgacgaacgattcagtggttacggcaaacttgcgcctaagtctaaagcagactttgcctttattcaacacatggtacattacctagacgatgaaggtaccatggccgttgtactcccacatggtgtattattccgaggtgctgcagaaggtgtcattcgtcgttatttaattgaagaaaagaactacttagaagctgtgattggtttgccagcgaatattttctatgggacaagtattccaacatgtattttagtatttaaaaaatgtcgccaacaagacgacaacgtactatttatcgatgcatccaatgattttgaaaaaggaaaaaatcaaaatcatttaagcgatgcccaagtcgaacgtattatagacacatataagcgtaaggaaacaattgataaatatagctacagcgcgacactacaagagattgccgataacgattacaacctaaatataccgagatatgtcgatacattcgaagaagaagcaccgattgatttagatcaagtccaacaagatttgaaaaatatcgataaagaaatcgcagaaattgagcaagaaatcaatgcatacctgaaagaacttggggtgttgaaagatgagtaatacacaaaagaaaaatgtgccagaattgaggttcccagggtttgaaggcgaatgggaagagaagcagttaggggatcttacagatagagtaattaggaaaaataaaaacttagaatcgaaaaagcctttaacaatatccggacagttaggtttaattgatcaaacagaatattttagtaaatcagtttcgtcgaaaaatctagaaaattatacactaataaagaatggagaattcgcgtataacaaaagttattctaatggatacccattaggggctattaaaagattaactagatatgatagtggtgtattgtcctctttgtatatttgtttttctattaaaagtgaaatgtctaaagacttcatggaagcatattttgattcgacacactggtatagagaagtttctggaattgcagttgagggtgcaagaaatcacggattattaaatgtttctgtgaatgatttttttactattctaattaaatatccaagtttagaagaacagcaaaaaataggcaagttcttcagcaaactcgaccgacaaattgaattagaagaacaaaagcttgaattacttcaacaacagaaaaaaggctatatgcagaaaattttctcacaggaactgcgattcaaagatgagaatggtgaagattatccagattgggaaaatagcaaaatagaaaaatatttaaaagagagaaacgaacgttctgacaaagggcaaatgctttcagtaactataaatagtggcattataaaatttagtgaattggatagaaaagataattcaagtaaagataaaagtaattataaagtagttaggaaaaatgatattgcatataattctatgagaatgtggcaaggggctagtggtaaatcaaattataatgggattgttagccctgcatatactgtgctttatccaacacaaaatactagctcattatttattggatataagtttaaaacacatagaatgattcataaatttaaaattaattcacaaggattaacatcagatacatggaacttaaaatataaacaattamaaaatataaatatagatatacctgtattggaggaacaagaaaagataggtgatttctttaaaaaaatggatatattgataagtaaacagaaaatgaaaattgaaatattagaaaaagagaaacaatcctttttacaaaaaatgttcttataactttgataaatacatagattgcataagaataaaatttgtataatttaacataaaagttgtaaaagtaaagtgaattaaaaacgaacattaaatttaggcactgtgaaagcgcagtgtcttttttgtgtcgaaattgtgtacagaataagtagttaaataaagattaagttgagataaagtgttattcgtaaataaaagagagtagatcgataggaattgaatgatattagttaactatttattaaattacttaataatgattaatttttagttaaagtaagtttaatgtgaagcacgaccattgctcattataatga

SEQ ID NO: 547 - DNA, 487 bp; double-stranded, linear
taagctatctgagataattgctgataacattaaaccggcaatttcaggtttaatttcaaagccacgttctctaaacattttgtataaaattgtagctgtacaaccaactggttcagcacgataacataaaggaccagcagtttcgaaatttgcaattctgtgatgatcaattacatgcttaattgtagcagaggcaatcgtatcagaactttgttggaattcgttatgatcaactaagataacatcttgaccatctaaatcatctgttaataattccggagcaggtacattaaatgtatctaacgcgaattgagtttctgcactcacatcacctaaacggtatgctttggctcctgaattacctcgaagttgttcaaattctgccataataatcgcagatgaaattgcatcagtgkctggattcttatgtccgaaaatatatgttttagccantgtcaaatatctcccttgtaaattgtattcttta

SEQ ID NO: 548 - DNA, 871 bp; double-stranded, linear
ttggtggtgcagcagttatagcaattgttttagcattcattggtaagttcactgcattaatttcttctatacctacmccagttatgggaggagtatctatattacttttcggtattattgcagcaagtggcttaagaatgttagttgaaagcaaagtagattttgcgaacaatcgaaatttagttatagcttctgtaattttagttgtaggtatcggtaatttagtatttaacttaaaagaaattggtatcaaccttcaaattgaggggatggcattagctgcactttcaggaattattttgaacttaatcttacctaaagagaaaaaacaaaacaattaagatttacaaattaaggagggcgcttttatgaatcatttattatcaatggaacatttatctacagatcaaatatacaaacttatccaaaaggcaagtcaatttaaatctggtgaacgtcaactaccaaactttgaagggaaatatgtcgcaaatttattctttgaaaattctactcgracaaaatgtagttttgaaatggcagaacttaagctagggttaaaaacgattagctttgaaacatcaacatcatctgtttcaaaaggtgaatctttatatgacacatgtaaaactttagaaagtattggctgtgatttattastcattagacatccgtttaataactactatgaaaaattagcgaatattaacatcccaattgcgaatgctggtgatggtagtggacaacatccaacacaaagtttacttgatttaatgacgatatatgaagaatatggatattttgaaggcttgaatgtattgatttgtggagacattaaaaattcacgtgtcgcactagtaattaccanagt

SEQ ID NO: 549 - DNA, 400 bp; double-stranded, linear
tcaatctaatatatacttcatgacttcccgccaaaggcgcaatcgtaggattagtctgtttatcgataagatctattaatattgtttctactttagattcacctattcccgcaaatcttaatagttcagaatgtataattcgattatggtttataaaatgtgacaacaattcatttttcaccattggttgcatttctttcggtggacctggtaataaaataatttgtttgttttcaaaattcaccatcattcctggagccatgccatgatgatttgttaatacagttgaaccttcaattactaaagcctgttgtctattattaggtgtcatttcttgtccttgttcctcaaaawagctttcaatatattgaaagaaggctcatcaataactaaatctnta

SEQ ID NO: 550 - DNA, 1523 bp; double-stranded, linear
atacctccagctagaataccagcgtatttcataaaatacttcctccattcaactatatctatatttaattatttaaatttcgttgcattttccaattgaaaactcattttaaaatcaaaactctaaatgtctgtgtattacttaaaattatacatattttgcttatattttagcatattttgtttaaacctatattacattatatcagacgttttcatacacaaataataacatacaagcaaacatttcgtttattatttatatcacttaactaattaatttataattttttattgtttttaagttatcacttaaaaatcgtttggcaaattcgttgtgacgcttgtccatcttctaatgaacagaatttttgataaaataccgttcgtgcttcaatatactcatttgcagtctcatcgatttgttttaatgcatcaatgagtgctgtttgattttcaacaattggacctggcaactcttttttataatccatgtaaaaacctctaagctcatcgccatatttatctaagtcatatgcatagaaaatttgcggacgctttaatacaccgaagtcgaacatgacagatgagtagtcggtaactaacgcatcgctgattaagtataaatccgaaatgtcttcataatctgaaacgtctttcacaaaatcatcatgttcatcaatacgtgtcacaactaaataatgcatgcgtaakaaaataacatartcatcatccagcgcttgacgcaaagcttctatatcaaagttaacattaaattgatatgaaccttctcgaatcgcttcatcgtcacgccaagttggcgcgtacataatcacttttttatctaatggaatatttaatcttgtcttaataccattaatatattcagtatcattgcgtttatgtgataatttatcatttcttggataacctgtttccaaaatcttatctcgactaacatgaaatgcattttgaaatatcgatgtcgaatatggattaggtgacactagataatcccaccgttggctttcttttttaaagccatcttggtaattttgagtatttgttcctagcattttaacgttactaatatccaaaccaatcttttttaatggcgtgccatgccatgtttgtaagtacgtcgttcgcggtgatttatataaccaatctggtgtacgtgtgttaatcatccwcgctttcgctcttggcatcgctaaaaaccatttcattgaaaactttgtaacatatggtacattgtgctgttggaatatgtgttcatatccttttttcacaccccatattaattgggcatcgctatgttcagttaagtattcatataatgctttggggttgtcgctgtattgtttaccatgaaagctttcaaaataaattagattcttgtttggcaattttgatagtaatttaaaagtcgtatatatactatgttctatcaattttttaattgtatttttaatcatgtcgtacctccgacgtgtttttgtaattatattaatatgtatgagc

SEQ ID NO: 551 - DNA, 4923 bp; double-stranded, linear
cagtaagagattttcttaattgaaaataatcttactgcttttttaaatttaatttcgagattcaatattagtttatctcattgtggcattaattgataaaattgttttaatgttataaatcaaagtcttcttcaacaatttcaatgtctgcatcagatctatgatatgtgaaaaagctaattcttatgcggtctaaatgctctaaatggtgtcgatactcttcgatggctgcaacaatttgcataacattggcaaacgaatattccgtttgataaggangatttattaactcatgctgaaatgtggacaataaatcttttttctgcggattatctaactcataatcaacatgtgtcacattataacgtgcttttttagaaaggctagctaaaatttgctcgtgaaaagcagttaatgaatctaaatctaatttgatttgtaataggaaattgttattaagtaaatataagtcgttttgataacgcgacaatttgtttaatacttcataagcttgtctagtcgtctgaactacttctctgaaaagtattttctttctattctgttggtgaatatgtttttttgtaataggacgttcttcgctatagtaatcataaattttctctaacttttcgacacgttgttttaaattatgactatcttgtttaatattattaaactccgtcgtatcatttaatactaatttaaaccacataaaaatatctgaggatatatttaatgaattatagtaaatttttgtttcaaatttaggtggtagaaacacaaagttaactagagatgaacttatgacaccaatcattacaagtacaaacctgtaaaaggcggtaatatagaaagaaccggtatgttgtcccataatgattaatgctgttacactcgccaaagtagcaacatgtgctaaattaaatttaaataaaatagcaataagtactatgacggtaacacccataatgataaaattatcactaaaaattgttaccattgtaacagatagtatggcacctataatgttacccaatgcttgatcagaaactgttttaaatgaacgataaatactaggttgcattgcacaacagcactgacaccagctaaggctttcagaccaacatcatccggtagtaaagaagcgatagacatagctaaaataatggctataccagttttaaaaatccgagctcctagtctcaaaaataatgacgccccttttaagtttattgaatatctaatattcgtattcattactgttatacacttactagttacaaaattcaagcttatttatagttgttaaaataaatcatacataatactgatagcgatgtaaaactttagtcagagattaaaatagtataaatttgtaaaataaaaactcacatagtgacatatcaagttaaacgttaatagttaacgatataaaatgaatctactatgtgagcatttgctttattttaattcaattaaaaatatacttccttaaaagttatttcatttgactaaaagcatagtctgcagcttttaaagtttgtttaatatcttcttctgtatgttcagttgttaagaaccaagcttcaaacttagaaggtgctaaattgataccttgatttaacattaatttgaaaaatttaccgaacgcttcgccgtcagaatgttcaacttgatcataatgtgtgactttttcatctgtaaagtacaatgttaaagatccataaatacgattaattgtagctgtgatattatgtttttcgattaatttaagtaaaccttcttctagttgttggcctaagctgtctaatttttcataaacaccgtcttgttctagtacttcgagtaatgcaatacctgctttcatagataacgggttaccagccattgtaccagcttgatatgcaggtcctagaggtgctacttgttccataatatcttgacgtccaccatagcctccaattggtaaaccaccgccaacaattttaccaaatgcagttaaatcagggataacacctaataaatcttgagcggcaccgtaatggaaacggaatgcagtaattacttcatcataaatcactagggtcccattgttatgtgaaatttcattaacctcttctaaaaatccaggttgaggcattaccattccaaagttaccaacaattggttctactaatactgcggcaatttcatcaccccaaaattcaattgcttctttataggcgttaatatcattgaaaggtacagtaatgacttcacgtgcgacgctttctggaacaccagctgagtctggagaaccgagctgagatgggccgctacctgctgcaaccaatactaaatcagaatggccatgataagatccagcaaattttataattttatttcttttagtatatgcacgtgcaacacgaattgttgtcatgactgcttctgttccagaatttacaaagcgaattttctcaagagatggaattgcatcacgtaattttttgctgaattcaatttctaattcagtcggtgtaccaaataaaacacctttagcagcttgttcttgaattgctttagtaatatgaggatgtgcatgccccgtaataattggaccgtatgcttgaaggtaatcaataaatttattgccatcgacatcatataaatatgcaccgtgtccttctttcataacaacaggtgcaccgcctcctacagctttataagaacgagaaggggaattgacaccgcctagaatatattcgtttgaaagttgttgtaaacgttcactttcactaaaattcatttatatcaacctcttttaatttaatattttcatctaatatcgtatcataaaattattataatgaagaaaaaggtgattatatgttgcaaaaaggagaacaatttccaatatttaaattagaaaatcaagacggaactgtcattacaaatgatacattaaaaggtaaaaaggcgattatatatttttatcctagagataatacacctacttgtaccacagaagcttgtgactttagagacaatttagaaatgttcaatgatttagatgttgcagtatatggtataagcggtgattcaaagaaaaaacaccaaaattttattgagaaacacggattgaatttcgatttattagtagatgaagattttaaattagctaaagaaatggcgtatatcagttaaaaaaatcatttggcaaagaaagtatgggcattgtaagaacgacttttataatagatgaacaaggtaaagtattagatgttatcgagaaggttaaggttaaaacacaaatagaagaacttaaaaacattttggggtgacatatatgaaagttgttgggttaaatcgtatgcgtgaagttgaaactgaattacaacaacgcttttcagatttagattttaaattttataaaaaagcatcagaaatacctgagagcgacttggctgatttagatatattagttggttatgatggcggtatcaatgaggcatttttacgacgttgcccgaatttaaaatggattgcatggtttgcaacgggtgtaaatacattgccgttagattatattgcagatcacggcatacttttaactaatggaaaaggtgttcaagctaaacaattatctgaatacattttagctttcattttagatgattataaaaagatgaaactatcatatgataaccaacgacaacatatatatgattcgaaaataactggtaaacgcctatcaggacaaacagttttatttttaggtacaggtgcaattgctactagaactgcgaagttagcaaaggcttttaatatgaatttaattggtctgagcaagtcaggtcagaacaaagatgagtttgacgagatatatactatcgaatcacttgaaagcacattaccaaatgctgacattattataaatgctttaccagaaacgcaagaaacgattcatttactaaagaaaaaacattttgaattaatgaaagatgaagcactttttataaatataggacgaggtagcatagttaaagaagcgctcttaatagaagtattaaaaagtaaagttattcgacatgcatatttagatgtgtttgaaaatgaacctttgaaacctaatcatgaattatatgaattggataatgtaactataacagcgcatataactggtaatgattatgaagcaaagtatgacttattagatatttttaaaaacaatctagttaattttctcaataagaatggtctaattgagaatgaagttgatgctaaaaaaggctattaaatgaratcatcatgtaaatattgacacgcgcgcaatactacagttatatttatagtaagttaataatgattatataagaaagatggtgatatagatgagtgttgaaatagaatcaattgaacatgaactagaagaatcaattgcatcattgcgacaagcaggcgtaagaattacacctcaaagacaagcaatattacgttatttaatttcttcacatactsatccaacasctgatgaaatttatcaagcactttcacctgattttccaaatataagtgttgcgacaatatataataacttaagagtgtttaaagatattggaattgtaaaagaattaacatatggagactcatcaagtcgattcgactttaatacacataatcattatcatattatatgtgaacaatgtggtaagattgttgattttcaatatccacagttaaatgaaattgaaagattagctcagcatatgactgactttgacgtaacacatcatcgaatggaaatttatggagtttgtaaagaatgccaagataaataatttaactttggtagtatgacaaattaaaaaagcgttactwacttcatataagtaagcgtaatatttaagangttaaacgacatgaaagttgtttaactttttt

SEQ ID NO: 552 - DNA, 917 bp; double-stranded, linear
tccggctttaaaaacttttcccaattccagcttgggcctttggcattaatattaacctcctggttcggattaattgggaacctaaccntttaggcaataattggtttaggcaacttccaaattggtggttcaaccaacgtctttggataccytgctcatttaattctaaaatggtyrgaacgcattttggtacccaaaatggtgacgttcgtttgcacggtctaataaattgtctaagttgtcgattggtttcattaattgaacaccattttgctcttcagcaagacctttgtctacttttaagaacggaacaacacctttatcagctaagtaatctgcagtgtatttgctttctacttcgcgatccattgtttgttcgaaaagaatagcacccaaaattttatctggtgagaatgaaggtgaagttaccacacgtgtacgcatatcgtgaacaagttggaacatttcgtcttcattgctatattgatcttcgtttacaccatattctttaagtgcttttggtgtactaccaccactttggtctaatgcggcaataaagccttttccatttttcattttttctaattgctctttattcatactttccactccttaacttttcaatacacctccagtatgataaaaatgagaacatttctcaagtcataaaccttgaaaagtgtataaaatgtgaaaaataattgtcagtttaattaaaaatattattttattctaggtatgactaacgccattaatgacataaagaaaatatgtgtaataatccaaccgattaattctgtcacactaaattgaaaaattggacgttgcgcaataaatactaaaaagggatacaatgctataaataagaaaaataaagggatataacatagatagtaaagccttttagaagtatgaaa

SEQ ID NO: 553 - DNA, 432 bp; double-stranded, linear
actcccatatccactggcaagatttataatttgtaattctaaagtataatagcctatatttttcaaaatctctttttttatgattaacatccctctaagtgcacctaaaggtttttatgtaatgtattaaatatttccatttatacatatacatcttgtataaaaagaaagaactccatatatactcaaaaggtatactgaagctctatatattatataaaattattatactattttgaaaaacataagtaaatcactaaacatgatttctttcacttttagaaaacttttaatactataaaagcacccactcagtcactagtttgggcagttattgtatgcctattgaactcaatgcgtatattacaatacctttttcgcatattcatataagactttgcatctttaagcttaattgctatctctttctct

SEQ ID NO: 554 - DNA, 1374 bp; double-stranded, linear
ttttgctttatgttaaatggattattattagaataaaaaatcggtgatgagctaaaaaagtgtgtaggatgttttcckaacccaatttttacatccgaagatatcgaacaatatcttcctacttctacattattaaaatcactaccaaatccaatataactgtattcaccaatgtgagaattcctgattttacaccatctatctatatagttattgccatcaaattttgagtttgtaatatacgccaagcgatgaatcttaacattcgattctttagaggactggtttttcagcaaaccaattatcttttcaatcgctatcctcatcgtcatttcctccaagtatttcgattgataatatctttatagctttgaataattttaactacctttgtcgaaacgttagtgtctttataatcaatagcatcaatcatcggttcgttattgttttgcatctctcttgctagttcaacggattggattagattgttataggtaataccacctacaataaccgtacctttatctagtacttccggtctttctgtggaagttcgaataaggacaccagggaacttcaaaatagacgactcttctgacaatgttccactatctgatagcacaacaaatgcatctttttgcaatgcattataatcaaagaaaccaaatggctttaactgtttaactaatggatcaaattcaaatttactttcttcaattttcttccaacttcttggatgcgttgaataaatcacaggcattttatactttttggcaatatcatttatcgcattcattaatgatttaaaattcttttcattatcgatattctcttctctatgcgcagatactaaaatgtattgttgcggttctaatcctagtttatttaaaacgtcactgtgattaattttatctcgatgcgcttctatcacttctgtcatcggtgatcctgtyacaaagatattcgctttattgaagccttcatctaataaataacgtctgctatgttccgtataaggtagattcacatcactgacatggtcaacaattttacgattgatttcttcaggtacattctgatcaaagcatctattacccgcttccatgtggaacacaggaatctttaatcgtttagcagatactgctgctaaacaactatttgtatcaccaagaattaaaagtgcatctggttgttcgcgtaataaaacatcatatgtcttcgcaataatattccccatcgtttctccangttacttccaactgcctctaagtagtggtccggttgtcttaattccaaatcatcaaagaaaatttgattcaatgtataatcataattttgaccagtgtgtactaatatctgattanaaatattgat

SEQ ID NO: 555 - DNA, 1472 bp; double-stranded, linear
tgcatttctgccgacttcgagaagttgcaatgtttataatactgtggacttcagctccgtttacctctaggcatgtccctttcacggtttgcttatgataacgttatcgacattgttaaattgtcctttttgaaaaaataattctggtgagatagacgctacttggatttcatcagtttgtaataacgcagtataattaccattactaaattgagttaatcgttcatataaagtactaataggataataaatgttatccgttaagcgcgccgtatagttcacttgatacgtttcgccttcaacaattgcttgttggacacgtttaatattagtcatcataacctcagaagattcaacaaatgaaaaatgatactttgatacataagaagtttgatgttcatatgttgaatttatgctttccgctttttcaaaactataagctgctgcataaatatcatctttagctaatgaatgtgtacacatagcatgattaaaatactttgccgcttcgtaacttaaatataacgagacatatctaccttgtcgtkgtgcgcttgtgcaaagtgtatcacttctcccacatcagccaacttagtagcaacatacttctttataaatccctttaattgaatatggtattgcttatattcattttcagttaaatagtagcgataattatattctattctcacagtaatcacctaccttcgataaaaataattcaacttgtcgataaccgtattcactcaaaatagattcaggatgatattgcacaccaaaaaccggaaatctaatatgctcaaatgccataataatcgcttcatcgttttttgctgtaatctttaagcaatttggaaaagtcgctccgtcagcaattaatgaatgataacgcattacattgaaattttgaggcagtccttgaaaaataccttcattggtatggcgtaactgtgtagtatgtccgtgtacaggatgatagccgtgaatgatatttccaccaaaataagacacgatacattgaaatcctaaacatacacctagtataggtacacgctgataaaattgttctaacacttcattcaagataggataatcatccggattacccggcccaggcgaaataacaattgcttttggcttcatattaatgacgtcttctatcagcagattatcaataccaacaacttgaactgttagtttcgtttgagtcttaatatagtctattaaattatatgtaaatgaatcattattatctatgactagaatcattgtatactccgttctaaatgtgttttatttttataatatgtattggatgtagctaaaactttaaaagcattgtcattatcctgaccttgattttaactaatatatggtatattctattcatcgtacataaatgaatatcagaggttcctagctgaaaccctctataaaaaactaggccattgaaatttcaaacattcgttggg

SEQ ID NO: 556 - DNA, 1054 bp; double-stranded, linear
agaacagcaaggattacttactgaggaattaaagaaggatattttaaaacagaacaaattacaacgtgttgaagacctatataggccttttaaacaaaagaaaaagacaagggcaactgaggcgaaacgtaaagggttagagccattagcgatatggatgaaggcacgtaaacatgaagtctcaattgaagaaaaagcacaacaatttataaatgaagaagtgcaatcggttgaagatgctatcaaaggtgcacaagatattattgcggaacaaatttcagataatcctaaatatagaacaaaaattttaaaagatatgtatcatcaaggtgtgttaactacatctaaaaagaaaaatgctgaagatgaaaaaggtatttttgaaatgtactatgcatatagtgagccaattaaacgcattgctaatcatagagttttagctgttaatcgtggtgaaaaagagaaagtattatctgtaaagtttgaattcgatacgacatcagtagaggatttcattgcacgtcaagaaatcaatcataataatgtaaatcgcagttatattttagaggcgattaaagatagcttgaaacgcttaattgtcccttcgatagagcgtgaaatccatgctgatttaactgaaaaagctgaaaatcatgcaatagatgtttttagtgaaaacttaagaaatctattactgcaacctccaatgaaaggtaaacaaatattaggcgtagatccagcatttagaacaggttgtaaattagcagtcattaacccattcggtacttttatagcaaaaggtgtgatttatccgcatccaccagtttctaaaaaagaggcagcagagaaggattttgtacaaatggttaaagcgtatgatgtgcaattaattgcaattggcaatggtactgcaagtcgtgaaacagaacaatttgttgcagatttaattaaaaagcatcagttgccagtacaattcatcattgtcaatgaagcgggcgcttcagtatactcagcatcagaaattgctagagatgaatttcctgattttcaagtg

SEQ ID NO: 557 - DNA, 1057 bp; double-stranded, linear
aaatgtcagaatacaagaaaaaaataattgaattaattgaaagtaatttaacaggatatgaaatttctaaaaaaactggagtttctcaatacgtactttcacaattaagacagggcaaacgcgaagtagataatctaaccctgaatacaacagaaaaattatatgaatatgccaataaagttttgtaatttaactaatgtataaattaatcaagctatgtttatttgatttaactattaataaaaatcatatggtgaatggatattataataattaaaatacaaaaatagtagattccaatttgtgaaaaaggagtatgtcgtttcatttagaatttattgcacgaaattagcatcgaataagggaaaataagtgttaagttttaaatgataaaaaagattggaatggatcgtcttgaaatgctcccttcaaagttttcattttttcaatgtcgacttcgaagggggcattttcattaaattgttatagctttttatatttgtataatgaacatataagtttaagaaggtgcgagtgaaggaaataaaaaagctcaaatgtaccaaattgttaatcttaataaatctctactttataaagattgaatggacattcgagcgttaatcagtcaggagggactttccctcctacaatttaataataatacttgcttcaccactatacaaggagtgagttgttatgttcaaagtgaattattcgattttaagttattatccagaatataatatcgcagtaagttggcaacgtttaagagaaggaaaaacaataaaaaacaagatttaatactgctgcgtcatgaggcgcttgaacattatttgatgaataagtataatttcaactatgattatgcacataaaattgtatcaaaaaaatacgattattcaatttttataaaaaagaaggtggattaaatgcttacattaataaaattggaaagaagatgaacaggttataatatatgratatatacctgaagatgatataagtaccgggtaaagggtcccgtacctttttaattaaaaaagttccagggggt

SEQ ID NO: 558 - DNA, 3754 bp; double-stranded, linear
ctgtgctgtatttactttaatttgacgacatttgagaagtattatgatggntgtagttattttatgaaagtaatgtattaacaatcgaattactaagtctatattggtaggaatatcgatgtttagtttaaatggaatgcactatttaagtttttaatatggagatgtttgtgacttttcgatgattaagatttttataggtgtgcatcatttcaaataaactttgtgtttaaaattgagcttaggaaatcgataggtttagatgaggatattgttgaagttatgtgtcttgtatccttagttgttataaaagcgcaaaaaatagcaccgctttctctttatctgtgtagaaaggatgctattattgtaaaacaatagttttaatttnattttctgatatatcatatgtrattctacctgtatcaatttctatcgaattataaccatcaaaattatcaactttatcatcaaagtctatcacttttccaattaatattttattattagtaagcgttaatttgactaatttgcctatgtatgactgtaaattcatatttaatcactcctttttaatatacggaactacatgaaaaccagttttagaataatgaaccttacctaatttcgtttcaatatatttaccattcacataagatttacctattatctttttataatctataacttgttttattctaaaattcccttcatcatcaaacaaaactggaatatcaataaattcttttttagtcatcttttcactttcattagaatctattatagtataacttggtaataaagatgaattatttttcttattattatattcatttgtgcataaaatatgacgcttttgcttaacattattcaatttcatcgtcattttaccattacttatcatttcaagcatttcttttttagctttttgtagaaaggatgctattttgtaattattttaataatctaatactttttatctcagtttcatcaaacgaataaacagcaaaatcagtctgtatatctacaacaagatttcctgtttcgctctcgaattcattttcatagtcagttacaaacccttcgtattcttcattattcaaaagcgtgataataacatctttacgatatgcatctncaattctcaatacttttcacctacttatcaatataaggtactatatgagcacctggtcttcgaataatggcacttccctttctggtttcaatatacacattttcgatatgtatttttccaataatttgattaaaattaataatctctttcaaatcaaatcgctcatcacttaatattagattgcctgttgacattttttctcttaacaattcattcaataaatctatagaaagtattgtatagctaggcaatttcttattatttaaaatggctctttttttattttcattatataggtgatgacctaacatatatctattttattttccgcaatttatttctatttttattttaccatttttaatcatttctttcatctggtttttagctttttcctgtaattatgcttcttttacttctacttgatatttaccttcacgctctttaaagaacttgtcccgccaattgccaacatgtggcactgtggtacttctacaccaaggatgcataggtggcgcattcacacctggtatcatatctttaactttaaatatttttccgttaagtgaatgacataatttagatgttttactatctattttggcaacatatttatattcgccatcttcaccaagttcttttaaatatgttaacttttgtgcttctgcattttcagtaaatagttaaaaaagcgtataaaaatagcaccactttctctttakctgtctaaaaaggatgctatttatcttttgaatttgaattctttttcgctttttctatactttcaaattcttcaactaattctttaaaagattcactcaattcttttgcagttacatttccatctaattgtgaatctaacataattaaaatcatctcactttatatttaatcatatttatactataaagttttttcaataatttttcaatatggctatcattaatgatattaatatgcgtaaaatatttagcacaaaatttactcactattttaccatgaaacctatttgacttggtaataaattttacttgtcccttattagtaacgattgtcattgattttattgatggatgcttaaaaaatgtaaataaatcatattctgaaaatcctgactgtccaggatggttatgtaacataacaattgaattcggtttactgttaaataataattcggttgcttgttaccctggcacaaaagatacactatcttgattgacatatacttttgtaaatttaccatcttttaacaaataagctacttcattgctatcattgttttccatgagatatacctccgtttatagtctgtcgactgatattccatacttgcttttaaaatgtcatcagcacgttttggacaataaaaaataaccttcacatttgaaggttaaaatttttaaagtaaactttctttatccccatgctacgagttcagattcaggaaatagccctttactagtatttatgtatattctgtctatggcatgaataaaataattatctcttgtatttttttctaaactagatttttcagcattgataacttcaagactatctatatccatttgaataataccaggcttaatattttcatcattattaggaaaatatttatatgtaacacttttatcattaatttcttttatttttaatattagcaatcatttccacctctaattaattaaaatactataattatattttatttctgtaagtttatgtgcctctatatagtgtaaattatacttattcattagatagtgttcaagagcttcatgtttctacattattatatccatttttttaatatttttcccttctcttaaacgttgccaactttgagccatataaaagtcaggatcaaattgtttaaatccactttctaataaatacttattttcaaatatatgttcataaactctttgaattaaatttttatttatattagtatttttagcaattttagaaatctctatctgtttatctcgatttctaactgaattataataaatttgagcatgtctgttccttttgataccgtattcatcacttttattattaagtgcacctgattcaataaaacaaccttctacttgatatttaccttcacgctctttaaagaacttgtctcgccaattgccgacatgtggcactgtggtacttctacaccaaggatgcataggtggcgcattcacacctggtatcatatctttaactttaaatatttttccgttgagtgaatgacataatttagatgttttactatctattttggcaacatatttatattcgccatcttccaccaagttcytttaaatatgttaacttttgtgactcttcyttttcaacgaataatgaaaaaagcatataaaaatagcatcgctttctctttatctgtgtagaaaggatgctttaataccatgctattttataattttcgggaaattcttgcttctcgataaagtctcttactacagaaaaagacttattacgatataacataaaatattcttcattttctatttcagataatgagaaatctataacctctgcatcttttttattaaaagttactgaacctttaccgttacttatatcatcttcaggtatatattc

SEQ ID NO: 559 - DNA, 815 bp; double-stranded, linear
atttaactaaaactataaataatcaaatgatattggaagatattagcatagatatcgaaaaaggtaaattgacttctttaattggacctaatggtgcgggtaagagtactttactttcagcgatatgtaggttaattcgttttgagaacggtgaagtgaaaatagatggacagctcatgtctgattataaaaataatgacttgtcgaaaaaaatatctatattaaaacaaacaaaccatactgaaatgaatattacggtagagcagttggtaaactttggacgattcccttattctaaaggtcgtttgacgaaagaggatcatgatattgtcaatgatgcgctagatttgttgcaactacaagatatcagaaatcgtaatattaagtcattatctggtggacaacgtcagcgtgcatacattgcaatgacaatagcacaagatactgaatatattttgctagatgaaccattaaataatttagatatgaagcatgctgttcaaattatgcaaacgttaaaaatgttagcgcataaaatgaataaagcgattgtcattgtgttacatgatattaactttgcgtcctgttattcagatcagattgtagcattgaaaaacggacaactagttaagtcagatttgaaagataatgtcattcaaagtagtgttttaagtgatttatatgacatgaatattcaaattgaacatataagaaatcaaaggatttgtttatattttaaggattgataatttggagacactttaaaggggtgatgcgccaattaaagaagggttaaacgtaaagcatttatttat

SEQ ID NO: 560 - DNA, 919 bp; double-stranded, linear
gaaacgaataataaatttactgagttattagttgaaaaagctaataaacatgatgatgttctcgatamgttgattaatattttaaaataagcgatacacactactaaaattgtattattattatgttnaattgacncctcctaaatttgcaaagatagcaatttaggaggcgtgtttatttttattgacgtctaactctaaaagatataaattagacatttacaaatgatgtaaataacgcaatttctatcatcgctgataacaattcatggtttaatatgcaatgagcatatactttttaaatagtattattcactagttttaacaatcaattaattggtatatgatacttttattggttatttttatcccatagtgtgataattactatttttcattcataataaaggtttaaagcatgttaatagtgtgtaagattaacatgtactgaaaaacatgtttaacataatgatataaggagtgacgtacatgatccgtctaggtaaaatgtcagatttagatcaaatcttaaatctagtagaagaagcaaaagaattaatgaaagaacacgacaacgagcaatgggacgatcagtacccacttttagaacattttgaagaagatattgctaaagattatttgtacgtattagaggaaaatgacaaaatttatggctttattgttgtcgaccaagaccaagcagaatggtaygnygacattgactggccagtaaatagagaaggcgcctttgttattcatcgattaactggttcgaaagaatataaaggagctgctacagaattattcaattatgttattgatgtagttaaagcacgtggtgcagaagttattttaacggacacctttgcgttaaacaaacctgcacaaggtttatttgccaaatttggatttcataagg

SEQ ID NO: 561 - DNA, 518 bp; double-stranded, linear
atcatataaaccggctgcttctaaaaacgaaaatactgttactggacctaaaaatttaaacccgtattgttttaaatctttagatagttgtgttgcagtatcatcaactgtgatacgatcagaagcatgttcatactgcaaatctttaggcttaccatttacatatgaccataaaaatttactaaaactaccatatgcttgttcaatttttaaatacccttgagcttgattaacaattgcttctaattttttacgatgatgaacgatatttggaaaagtcattaagcggtcgatatcttgagcggtcatttgtgctaccttttctggttcgaaatcataaaatgcttcttcataggcttctttcttttttaaaatagttaaccaagatagcccagcatgttgtgattctaatgctaaaagtttaaacaatgccttgcnatcatagagcggttgtccccatacatggatcmtgatagtctaagtagactgggatctttagtaccaaatgcgcattcatt

SEQ ID NO: 562 - DNA, 1539 bp; double-stranded, linear
cttatttaaaagtaaatcaatcaatgtattataatccgaatagtccgcataaagctggtttgcaggcaaatcaattactacaacaagcaaaaacccaaattaatgcaatgrttaattcaaaaacaaattatgatgttgtattcactagtggtgcactgaatccaataatcttgctttaaaaggtattgcctatcgtaaatttgatacagcgaaggaaataattacatccgtgttagagcatccgtccgtattagaggttgtaagatatttggaagcacacgaaggatttaaagttaaatatgttgatgtaaagaaagatggcagtattaacttagaacacttcaaagaattaatgtcagacaaagtcggtttagtaacatgtatgtatgtaaataatgtaactggacaaatacagcctattccacaaatggctaaagttataaaaaattatcctaaggcacattttcatgtagatgcggttcaagcattcggcaaaatttcaatggatctcaataacatagatagtattagtttaagtggacacaagtttaatggtttaaaaggacaaggcgtcttacttgtaaatcacattcaaaatgttgaaccaactgtccatggtggtggtcaagaatatggtgttagaagtggaacagttaatttgccaaatgatattgcaatggttaaagcgatgaagatagctaatgaaaactttgaagcattgaatgcatttgttactgagttaaataatgacgtccgtcaatttttaaataaatatcatggagtttatattaattcttcaacttcaggttcaccattcgttttaaatattagttttcctggcgtaaaaggtgaagtattagttaatgctttttcaaaatatgacattatgatatctacgacaagtgcttgttcatctaaacgtaataaattaaatgaagtattggctgcaatgggattatcagacaaatctattgaaggtagtataagattatcatttggggctactacaactaaagaagatatagcgaggtttaaagaaatatttatcatcatttatgaggaaattaaggagttgctaaaataatgaagtatgatcacttgcttgttagatacggggagttaacattaaagggttcaaatagaaagaaatttgtaaatcaattaagaaataatgtaaataagtcattaaaaggacttgatgggtttgtcgttaaaggcaaacgagatcgtatgtatattgaacttgaagaccatgcagatataaatgaaataacatatcgattatcaaaaattttcggtattaaatctattagtccagtattaaaagtagaaaaaacaatagaggcaataagtgcagcggcaattaaattgcgcagaatttgaagaaaacagcacatttaaaattgatgtgaagcgtgcccgattaaaatttccccaatggatacggtatggaattacagcgtggaattggggtggtgccagtattggagcacttcgccatatttccagtggatgtccaacgtcccagncccaggaatt

SEQ ID NO: 563 - DNA, 968 bp; double-stranded, linear
atancgtatacatgtgttctttaaaattgtgataaggagtttaggatggtttatttaaaatcaatagatgccattggatttaagtcttttgcagatcaaaccaatgttcaattcgataaaggtgtaactgcaattgttggtccaaatggaagcggtaaaagtaatattacagatgctattaaatgggtgttgggtgaacaatcggctaaatcattacgtggctcaaaaatggaagatattatcttctcaggtgcagaacatcgcaaagctcaaaattatgctgaagtacagttaagattagataatcattctaaaaagctcagtgttgatgaaaacgaagttattgtaacaagaagattgtatcgaagtggtgaaagtgagtactacataaataatgaccgtgcaagattaaaagatattgccgatttatttttagattctggattgggaaaagaagcgtatagcattatctcgcaaggtagagttgatgaaatactaaatgctaaaccaattgatagacgtcaaattattgaagaatcggctggtgtacttaaatataaaaaacgtaaggctgaatcattaaataaacttgaccaaacagaagataatttaacgagagtagaagacattttatatgatttggaaggtcgcgtagaacctctaaaagaggaggcagctatagctaaagaatataagacactttcacatcaaatgaaacatagtgacattgtagttacagtscacgatattgatcaatatacaaatgacaatagacaattagatcaacgtttaaatgatttacaaggccaacaagcaaataaagaagctgacaagcaacgtttaagccaacaaattcaacaatataaaggtaaacgtcatcaacttgataatgatgttgaatcgcttaattatcaattagtaaaagctacggaagcctttgaaaaatatacgggacaattaaatgtttt

SEQ ID NO: 564 - DNA, 436 bp; double-stranded, linear
ttgtgtgtatgcattcaatgtgctctgtttgtaaatggctagctatataatttaggattcgaggatcgtcatcgacaacaagacattgcaccatagctataaactcccttatctttttcatttattatacatgtaaaatatttttgcgtaaaaaaacaattgttcatattgagttcatatttcaaccttatactgacgctaaagaagaaatagggagaagtgaatcgatatgaaattagcgataaaagagattatgttttacaaatttcgttatattttaatcacattaatcattcttttattaagtattatggtgttatttattagtggtttagctcangggcttggtagggagaatatttcgtwatttgaacactttggataatgatgaatatgttgttcaaaaaatgaaagagccgcaaattgagaaatcgca

SEQ ID NO: 565 - DNA, 2554 bp; double-stranded, linear
atgttttgtcaatatcaattgtttgagataaatccgcttgtataaaacgaactttatcatcattaaatttgctagttaattcatttatatcagtacgataatattgcacataaacttcaaatccatcagttaataattgtttgactatctcagaaccaattgaaccagaaccacctaatactaatgctttcattactttttaatctccaaacgactatcgacttgctgatctaaatttaaatataacgatgacgtttcgttaatactatctaacgtgatattttcaacaatgtctaacatgtcaaacacgctaacaccttcaaaatacaatttagtatattgattagcaatatattcaggtgagtttaaacttgatatgaattcacctataaattgctttttcaaaagttcaaatgcttctgcatcttggaaattgccttttttatcacgcaactcatctaataataatttttttaatttatctggttcttcagtagcacttgtcacgattgaaaaactatacgtcggctctagtacaaattgataaccaaatgtatcatcgataagtccttcgtttaataaattctgataaaaatctgtttcttccccaaaaattaactcaaagaataatgacatttctaaatcacgttgtacatatttttgaggcgcttcttgtaatggtttatttttaaaaccaagcattagtcttggtgattgaattttcatagattcagtaacaaatgcttctttaacatcctccggttcatcaacaagtcctcgttcgattttgggttggttaactttattacgagcatcctcgtgttgttttactattcgacatattgcttcaggatccacatcgccaacaacaaataaaaccatatttgatggatgataaaacgtttcataacatagatacaaatcatcttttgtaatatcgtatatactttctacactaccggcaatatcaacacgtattggatgttgttgatacattgcacgcaatgtattaaacattaatttatatccaggttgctcttgatacatttttatttcttctgcaataatacctttttctttatcaacagtttcttttgtaaaataaggcgtttcaaccattgtaagtaaacgtttaatgttgttttcaatattatcagttgcactgaacaagtagcttgtacgatcaaagcttgtaaacgcatttgcttgtgcgttatcttcagcaaacgcagtaaataagcttcttcttctttttcaaataatttatgttcctaaaaagtgagcaactccatcaggtacagtaacaaattggtcttgtccaaggggtttgaattgattatctaatgaaccaaattgtgtagtgtaagtgacaaatgtcttttgaaaacctggttkggggataataaataatcgtaaaccattttctaattcttgttcgaatactctttcgtctattaattcataataacgctctttcattatttatcccctccttttgtcaacacatagattgtatctaaaaatgctttttcagcaacagaaacaatatcttcgcgacttaccttctgtatatcatttataaatgtttctttgctttgtggttgctctaataatatttggttatgcataatctctataatacttttcggacgatcttcagattcatatcgatgagaaatgattacttttttagctaactctaatttttcttcagtgaaatctcctgcttttattttttcaaattcacttataatagtgtcttttgcagtttcgtacttatcacttgaaaccccactcaaaacaaataaatagccatttttgccatcaatttgtgaatgtatagagtacgctaaactttgcttttctcgcacttcattaaataaaacagatgaaggatctcctccaaacatcatgttaaatacaacaaaggcagcatatccactttgtccatattgtgttggaaaacggtatcccatatttaatttagcttgatccacgtcatcatattcaacaatataatcaacttcttcatcgtgtaaatgatgagtagaatgttggaattgatgtttatcgaatggtttaagtgcaaatttttcacgtatttgtttctcaacactttcaggttctacattgccgacaacataaacagaacattgatcattattaatcattgattgatatgtatgatatagtgtttcagcagtaatatgtgggatttgttctagttgtcctgtagataagtatttatatgcttcattttcaaacatatggtcgagtaattttaaaaacgaatattgtgctttattatctaccattgcttctatttttttggctaataatgttttctcttggttaacaaaattatcattgaatgctttattttcaattaatggattccaaatgatttcttgtaataaatctaatccttgattaaataatgawtcaccgkttcytaaataacgkkcattaacaattyctaatgaaaatgtaatgacatgctgatctttgaattttgaaattgtactattcacatacgcaccatataaatcggcta

SEQ ID NO: 566 - DNA, 1424 bp; double-stranded, linear
tntcgctattttnaattggttttgtatggtttaagttatatcaatatacaacanaccctaaagctgatatcccaggtatcatttttagtacgattggttttggtgctttgttatatggtttctcagaagctggcaacaaaggttggggttcagtagagatagaaacaatgtttgcgattggtattatctttattattctattcgttattagagaattaagaatgaaatcaccaatgttgaatttagaagtattgaaattcccaacatttacattaacaacaattattaatatggttgtaatgttaagtttatatggtggtatgattttattaccgatttatttacaaaatttacgcggattctcagcattagattccggattgttattattacctggttctctaattatgggtctactaggaccatttgcaggtaaattgttagatactattggtttaaaaccattagctatctttggtattgctgtaatgacttatgcaacatgggaattaactaaattaaatatggatacaccatatatgacaatcatgggtatctatgtacttcgttcatttggtatggcatttataatgatgccaatggtaactgcagctattaatgcgttaccgggacgacttgcctctcatggtaatgctttcttaaatacgatgcgtcaattagcaggctctataggtacagcaatcttagttactgtaatgacaacacaaactacacaacacttatcagcttttggggaagagttagataaaacgaatcctgttgtacaagatcatatgcgtgaattagcatcacaatatggcggacaagaaggcgcaatgaaagtgttactacaatttgtaaataaactagcaacggttgaaggtattaatgatgcatttatagttgcaacgatatttagcatcatcgccttaattttatgtttatttttacaaagtaataaaaaagcaaaagctacagctcaaaagttagatgcagataatagtatcaatcatgaataaataaaataaattaattgaagtgtgactaatcaaaaattatgttgtggggacatgatttttaaagtatcggtgccaaatatggttatcgatactttttttatttgttgatttatagaatgttagaggaattatattaaaatttggcattgacgtagtaggtcattaataaagaaaaagcaggaagtgggtcaacgaaatgaattttgtgaaaataacatttctgtcccaatccctactatataacattattttaaacgaggcatgcgattacggaagaataagcttataacaagtaaaccgatgctacagccaagtaaaatgatgccgttatgaatagcgtcacttgctgtaatcacttgatctggtggtacatttaaataatattttttgaaaacatctgcaatt

SEQ ID NO: 567 - DNA, 676 bp; double-stranded, linear
tctcccatgttctgctaaatgacgcatcacttttacttcatgaggcgtcaatacacgtccttcaccagcattcaaaccgacaacatttaaaggcccatattcaatacgagacagtttcgtcacttgatgaccaaaatgttcgaacattcttctgacttggcgattacgaccttctgtaattgtaatttcaaccaatgttgtgtttttatctttatcttgtttcttaactttcacttcagccggttgcgtcataccatcttctaattcaatacctttttctagcgctttcacttcttctctcattaaataaccttttaatttcgcaacatattttttcttaatttgatatcttggatgtgtcattaaattagtaaattcaccatcatttgtgagtaataacaatccagaagtatcatagtctaaacgaccaacaggataaatacgtgcttctatatctttaaagtaatctgtaaccactgtacgtcctctatcatcagatacacttgtkatcacttgagttggkttatggaakaaaatgkaaattttgtcttctagttctattttaataccttcaacttcaatcgtatctgatggcttcacttttgttcctaattcagtgacagtcgtaccattcactttcacttttccttcagaaattaaagtttctgccttacgt

SEQ ID NO: 568 - DNA, 454 bp; double-stranded, linear
gaaacggttctaccaaaaaacagtaagggctaaacccaatcatggtaagacaaaaagtacaaatagccatgcccaagttgaactcgctgtacgcctatttctttctaaaaagataataataaaagccaatactaaattaatgatgaatccaatggctaaaataatagtaaataacgttcctaaatcgtttgaaaatgtaaatcgcatagtcttttctcctataaagaaaggcacaaaaaaacattttgcacctttcacgtcatattatttattcacagataaagttaaaattgcattgaattcttcttcattatttgggaatgttctttcttctatttctttaatagtaatatttactaattttaaatttgtagcttcttcagaacttaaaaaagcattaatgtttttttctaataactckaaagtctcagctgtaaaagttttaagtttaatt

SEQ ID NO: 569 - DNA, 894 bp; double-stranded, linear
acgatattaccaccctctgaaataacatcaatcatgtgatctgtaaagtcccaaggatgacttgttgtgaaacgaactcttggaatcgctattttagaaattgcttgtaaaagatctcctaagtcatattctatatcctgtaaatctttaccataagaatttacattttgacctaaaagcgttatttctttgtaaccttcacgagcaagttcacgtacttcatctataatgtcttcaggtctacggcttcgttctttacctcttgtaaatggaacaatacaatatgtacaaaacttatcacaaccatacataatattgacccatgctttaatgttgccttcacggacttttggaagattttcaataacgtctccttctttagaccatacttcaacaaccattgctttagataagtatgcttcttctaaaatttctggtaaatgatgaatattatgtgtaccaaatatcatatctacattttgatacgattttaaaattttattcactactgactcttcttgtgacatacaaccacaaacaccgattaaaatatcaggtcgttcttttttcaaatrcttcaaattacctatttcactaaacactttgttctcggcattttctctaatcgcacatgtattaattaaaataacatctgcagtgttaatatcagtcgtkgcttgatagcctaatgcytcmagtataccagcaatgacctcagtgtcatgtgcattcatttgacatccatatgttttaattaaaaatgtacgctcgttccccataccgcgatattttycatcaatttgggaaatcnctattataacgaacttctkgtttaccnccttttttncgctcctttaaaattaaggcggctgataaacaggtccaaaatattac

SEQ ID NO: 570 - DNA, 441 bp; double-stranded, linear
tatcaatcccacagcacatgctgaacaagatcaaacatgggagaagattaaagaacgcggtgaacttagagtgggtctttctgcagattatgcaccaatggaatttgagcatacagttaatggtaagactgagtatgcaggtgtagatattgatttagctaaaaaaattgcgaaagataataatttaaaattaaaaatcgtcaatatgtcatttgatagtttgttaggagctcttaaaactggaaaaattgatattattatttccggaatgacttcaacgcctgaacgtaagaagcaagttgatttttcagattcatatatgatgactaaaaatatcatgcttgtaaagaaagataaagttaatgaatataaagatatcmaagactttaataataaaanagtnggggcacaaagggactgaaccagaaaaaatcgctcaac

SEQ ID NO: 571 - DNA, 1205 bp; double-stranded, linear
tgttaaaaattgtttttgtttacgacttgtttctgcaaaatctcctggaaacaggtgattaagtcgttcatctttttctacaagggtgtaaaaataatcaatcatatcgtataacgcttctttaccaatgatgtcatatggtgttgttgtcatttaatcacccattttcaaaaatttactgttacgaacttaagttaatatataactaatataacatgattttaaacatttgaaagaaatatgcatatttgccaatttaatttatattgtttgaaagtgtttcttttttcttgaaaaaacgttgaactttatttaaaggttgatgatgttcgaggtttagttcgtttaataaagattggaacttttgtaaaccttgattatagtctttaacttcgaactctaactcataatccgtagtatcgaaatactcacttttatctaaaaccagtaaatcacctttatatttagtttcttggcgatatgtcgttaatgcaccaagtattgataaagttgtatcttttacaccaaactgttcaactataatttgacgaatgtcatctggaagattgtcgtttgaaataatcaagttcatctctggtttaatgtcgacgatatagttgtattctaatagaccaacctttgctggtgtctttaaagtcatttcatattgattgtctttaactcttatgcgtagtgcagagcgatgttcctttaatttgaaatcgggtgtatcaatatagtaattgacttgcttamaaagcacactgtctttaaaatatttctcttgcaatttattatagattgatgcagttatcatttgtttaaattctatttcatgatttgttgccatgatatgtatacacctcgtatcaaattcaatttatcttaactatattatgaatgacaaagttgaattttaaaagtaatttcctttatctattatcaatgttaatttgaccattaaaaatagtgttcgtaagtgttttgtattattgaattgtgttaaaatgttatggaataagaggaggattaagcatgsgtttwtatattaatgaaattaaaattaaagatgacatactttattgttatacagaagattctattaaaggattatctgaagtaggacaaatgctcgttgatagtgataattatgcctttgcgtatacattagatgatggtaaagcgtatgcttatctcattttcgt

SEQ ID NO: 572 - DNA, 570 bp; double-stranded, linear
tgaagaaatagcaatgatgaaatgccgtatgttatatgagacggggtcatttcttgaattaagagaagaaacaattgtcttattgaaaactggcatacaacaatatgatgcattgatgatttattacgtgaaaagtttgattggtttgggacaatattttgaagcggtagaagtaattcatcaaattattgatgaagtcaaagatcacaaaacaagaatggcattacatcctcttaaagaatttgctaagtcaaaattaattgaagatgaaaaacgattgactcagtcattagctgattttgrtacgttatcaatgagggaacagacgcacttgattttgaagttaatagacaatggtcattttcaatttcaagaaacggtattatatatatkaaaayctaatacgtacagttataacctcattagtttaatgattgagtatttaaggttcgcaaattgtacacaagaactgacaattgaaaagtatggtatggatgtaacttttgtaccagctaatttaaaagggctagaacatacaacacttaaagaaaaagttatacctaacgttat

SEQ ID NO: 573 - DNA, 939 bp; double-stranded, linear
gttgaatggttagcagctgcagttgtattatatttctgtggtgtaattgttgacgctcatgtatcattcatgtcctttattgcaatatttatcattgctgcattatcaggtttagtcagctttattcctggtggtttcggcgctttcgatttagttgtattactaggatttaaaactttaggtgtccctgaggaaaaagtattattaatgctacttctatatcgttttgcgtactattttgtaccggtaattattgcattaattttatcatcatttgaatttggtacatcagctaagaagtacattgagggatctaaatactttattcctgctaaagatgttacgtcatttttaatgtcttatcaaaaggatattattgctaaaattccatcattatcattagcaattttagtattctttacaagtatgatcttttttgtaaataacttaacgattgtktacgatgcttttatatgatggaaatcacttaacgtattatattctattggcaattcatactagtgcttgtttattacttttactgaatgtagttggtatttataagcaaagtagacgtgccattatctttgctatgatttcaattttattaatcacagtggcgacattcttcacttacgcttcatatattttaataacatggttagctattatttttgttctgcttattgtagctttccgtagagcgaataggttgaaacgcccagtaagaatgagaaatatagttgcaatgcttttattcagtttatttattttatatgttaaccatatatttattgctggaacgttatatgcattagatatttatacgattgaaatgcatacatctgtattgcgctattacttctggcttacgattttaatcatcgctatcatcataggtatgattgcatggttgtttgattatcaatttagcaaagt

SEQ ID NO: 574 - DNA, 1059 bp; double-stranded, linear
gaattaattaaatattacacacagcctcatttttcattttcaaataaatggctatatcaatatgataatggaaacatttatgttgaacttangagatattcatggtcagcacatatatctttatggggcgctgaaagtyggggaaatattaatcagttaaaagatcgttacgtagatgtgtttggactaaaagacaaagatactgatcagttatggtggtcttatagagagacatttacaggtggcgttacaccagccgcaaaaccttctgataaaacttataatctttttgtgcaatacaaagataaactacaaacgattattggtgcgcataaaatataccaaggcaataaaccagtattaacattgaaagaaatcgatttccgtgcacgagaagcgttaataaaaaataaaatattatataacgaaaatcgtaataaaggtaagcttaagatcaccggtggcggtaataactacactattgatttaagcaaaagattacattcagatctagcaaatgtttatgttaaaaatcctaataaaataactgttgacgtcctctttgattagtatatgaaggtgacttatacttcatgcactttaattccaaatcagattatttaaatgataatttttaaagtgtatgatgtatataataggtaaaattttctatatatttaaatggaattgggagtaggaatgtgacagaaatagtattttataaaatttattcttgtcactccccaacttgcacattattgtaagctgactttccgccagcttctatgttggggccccgccaacttgcattgtctgtagaatttctttttgaaattctctatgttggggccccgcctataattgaaaaatgcttgttacatgggcattttcattcggtcaactactaccaatataatattgtagagcctaagacattgatttattatgtcttaggctctattccttcatttaatgattaanttattatagcaatactttattgtcccatgattagtgttcttttaatgagacatagtaactataaagtttaataatcgt

SEQ ID NO: 575 - DNA, 574 bp; double-stranded, linear
gtttgctttaggtcctgtttcatatttatacttcgaaggatttacctttttgaagtctggatttttgtagaatctaaacaaatcaccattaagcacgtkgtcactcatttcgagatccttttcaactkgctttttattcttttcgaaatcagctggttgagtagttatgagttcattatttttattagmataaatcttaccattaacatatttataatcttttgttataaagtcaccatttctgaatggaactacttgattatgacctttagagaataaatcagtaccgaacattaaatagttcttcgtatctataccagccaaatgtaaaattgttggcattacatcgacttgaccagcatattcattattgataccaccagatttaccagggattttaatccagaaaccagttctgtttaaatctgtaaatttagccggtgtgattttttcacctaatagtttttccatggcattgttatggttttcagagataccatagtggtcaccataaatcataatcactgaattgtcatataatccttttttcttcaagtcattaatatattcttct

SEQ ID NO: 576 - DNA, 796 bp; double-stranded, linear
caatgttttatagtacaatatattttnaataatactcgttaaggagaatgatatgatatcaattcacgcaatttcgacaggaaaaatccaagatttgccttatagctcgaaaagaccgatgcgctctgctttagataaaactaagatttcacaaacaacatggttatcttcaactggtttcactggtgatgaacaggcttataaagatcatggtggaccacataaagcagtttgtgggtttagtaagcataattatgcactgtatcaagatgatttacctacactacctactcatgcgatgtttggagagaatttaacatttgattatttagacgaatctgatgtttactttggtaatcaatatcgtttaggtgaagcgttaattgaggtttctgaaattagagaaccatactggaaaattcaagcaaaatataatattcctgatttagtgaagcgcatgtctacatctggtaaaacaggtttctatttccgggtattaaaacaaggctatgtatctccaaatgatcagctttacttaatacaagaagcaccaatcgaacatcgtttatctgtacaacagcttaatgacctttattataatgatagacaaaatcaagatatgttacgatatgcactaaacaatccatttctgtcaccaacaagacgcgataaacttcaaaaaatgtataacagaacattggaaataattacctttcattnataagtgttaaatgaacttttcaaaacanaaaggaatcaacttcacacatcgtttgtatgaatagtcttatctata

SEQ ID NO: 577 - DNA, 1095 bp; double-stranded, linear
agaaattatgacaaaatataaagatggaaagttagtttatgcatcagtcgaaccaggatcttacgtaatacataaagatgatgcaattaaatatgacgattattctaagttaaaaaaattaagtcagctaactaaacttgatcatccaaaaccagttccatatagcgtactcaaatcaaatctttcggagtacctttaacaagcgtttcatttatgacacatggatcaaaggatactaaagatgaagtgttgccggcattggcctatttcactttttcaccaaaaaattatgaagacaagtctaatccagatccaaaagttttaaatttagtacatatggatttcttaaatgcatctagtgattttggtaacgcacattttgttgttttaagtaaatatattaaagagtatgaatcaaactatgaaacagcgtcagatgattctttaaaatagtatttactgtgtgaaaaataaatagtgtactacattaaataatcgcaataataatcccgataaacaatcagcattactgcttatcacatagagttcgtaataactataactctatgattcgcaaataataaatgattgtcatcgggatttatttttatcaatttataaagtgacattaccttgttcatcagcaggtttgaaaacagtaatcactgcactaataattgctaaaatgtgtgggatacctgtccaacagaatattaagtgtagaataccttgcatattcttgccggcataaaatttatgaataccaaaactacctaagaacaatgctaataaaatataaataactttgtttacttgcatttctttccctccagttgaattgcttataatgacattagcttctctttttattatacccacttttagttcaaacattctagtttaagcattcccaatcatctaaatttcagttattcaatccttacaataaatttaggattacatttcagttgcattgtattattttacgtgtgaaatatacgtaatgaatcacatgacaayctycaaattgaaaaatatacattctatgatgtaaggtcgcatttttaatatatttacgtnaaaatagtttggatg

SEQ ID NO: 578 - DNA, 489 bp; double-stranded, linear
gacatccataccaagttcattgattaattgtgcgttctttttaggtgataatgtgattgcactgccaaaataatcatagccatgttctacagctgctttcgctacaatatccaaacgcatttcaaaacaagcggtacaacgtaagccgccttctttttcatcagctaattctttatccttcaccattttcacaaacttatgtggttcataaggtgcttcaatatacttcacattcgcaccagtcttgcgattaaaatcttccacaaattgttcttgcactttagcacgtcgtaagtactcatttttcggatgaatatttgaattcgcgaaataaattgcaatgtctgcatattgtgttaaaaactctaatgtatatgtactacaaggtgcacaacaactatgcaataagattttaggtctgattgcttctctttcccactgsccgattaatntcttcaacaccttgtccataattaatttgtngatttn

SEQ ID NO: 579 - DNA, 1287 bp; double-stranded, linear
cgtactgcatcatttgttgaaaaatttgcaaacttcttcaagatgttatggcttagacttaaagcgatgaagcactacaaagccttaaataaagaatctaagaagcaagaatttgaaaattcattcaaagatgttcaaaaaattatgcgtattgtgaatcacaatattattttacgcttaaaagaagaacaaaatagtacaaatgtacttgaggttagcttagtcattaatcattactatgatatgagtcgctcattaaagtggcgtgcacaacgtcgaaaagaacgtcaagaaaacagcaatcaaatcataccgcaagctatgttccataaccacaaattggaagcattgtacttacaacgtcatcttttagatgaattaattcgcaaaaataaaatcaacaatatcgttgcagctcaaattcgagaaaatatcaattacaacgaaattgtcttgtctttacagtccaaacattaagcaagacwtacawtmcccccgtacatatgagacaaagtcattatcatctcatatgtacggggtttttatattcaacatcaaaaaatcagattgatgaaaagtaaataacctttcatcaatccgatttgattatagaatctattttttaagtttaaatggaattgtacatacgttaacattcttttgataaattaaatacaatttcatacgcaaactagtttgattgtgtaataaattatgccaacgtttcttagtaataaattctggtatcactactgtaatcatatagttttgatcgttggctttacgattaatcttatcgataaaacgtgaaattggtcgtataatactgcgatattccgaatgtaaaataactaatcttacatctgggaaatgacgtttccatttctcttggaatgctttttcatcttcatctccaaatgatacatgtactgctatgacatcattattcgcaagcatttgtgcgtaataaatagacttatcaactgctgttgtaatacttgttatcggcacaattgctaaattacgatctaccacgtccacattaagaacatcaatgtcagaacgtaattgttctgcgatatctcgataatgkttgktaattttcaagaagaaaatcaccacgaacggcaagaaaataagtatcggccatacttggctaaatttagttatgagtaaaatccataanaacaataaatgtcacgataccaccaagtaagttcacagacaacttacttaaccaattcttaggacgttcatgaatccatttaataaccataccgaattgtg

SEQ ID NO: 580 - DNA, 1223 bp; double-stranded, linear
gcctcctttcctatatccatgggtgtcctagttgggaatggcttattccctatcccaaacatctgtcaattcaagactatcactgtatactaaatcgcctntctatacntccatncatttcattttccagttggaacaatttgtttaattattttaaatatcattatcaatccagaagtatttactattcacttttacaataatcaatcatttaactacacatgggtagtcggtggtttgcttggggttagctttttaactggcaatttattgttattgccaaaattaggtgcaacattaactgtaattgcaacagttgcgggtcaaattattatgggtgtcattattgatacatttggattatttggcgctacaattcatgattttaatttaattaaagcaattggagtattgttactcattgtcggcatcgtcataatgaatcaatttaacaagaataatttattactaactgatcaaaagtatttactgttttggcttctattaggatttatttttggtttctttccacctattcaaacgacaattaatagtgctttagctagtcatactcattcaccagcctttgcatcattagtatcatttacaattgggtcaatagcgctattgattttaaccgctatttttaatcgttctttaaaactaaaaacaagtcatttaaaattcggtaaattaaagcctatctattttactggcggtatacttggcatggcttttgtaacagctaacattatcttaatgcctcatatgggtgcagcattaacaacacttattgggatgtttggccagattctaatgggcatattgatagatcactttggattatttggttcacctaaaatagcaatgacatccagaaaaactattggtctattatgtattttgacaggcattatacttttaagattattttaaattaacttttagcttatcattttaacttgtaattatttttaaaagtgataagctatttttttgtggtctaaaaatctttagaaaagcgttgatttgggtagtatgctttgacacaacaaattttaatttagcaaattcgatagtcaactcattcttaagacctaaattaatgttatnttttaataatttacaccaaattaatagcaaaaattatgttattcgtgctaatatttcatagttggttattcaattaattaaaaataagtcaaaatgcacaactttttatn

SEQ ID NO: 581 - DNA, 454 bp; double-stranded, linear
cacctttttatcatgcttagttatcaataaatctatattttgctgttttacaatttttttaactttatcaatctcattatcttggactaaataaatatatgatcttgcatctgttgctagagcttgttcgtgtttttctgataaaacatatgtgatggaagcgtgaataataatgcctaatgtaacaaaactgataattaatatactgcttatcaataacattaagcggtggtgaaacttcatcattgttctttaggtctttccaatttatagcctaagccacgcacagttttaataagttgtggcttcttaggattatcttctaatttatctcttaaatgactgatatgtacatcaacaattcttgagtctcctgcaaattcataattccataccgtatttaacatatgctctctcgtaatgactctgccttgtctttctatcaaataaagca

SEQ ID NO: 582 - DNA, 452 bp; double-stranded, linear
tttataagattttatttacaaataattggttttcatatgtataaacacttttgactttcaaatcttaacgataattctattacaatacaatcccctattagaatgatttatgtaataaaaaaagcggagtttcccccagcttttctaaacgactacataaaatataagattgcaattaaatgcaatagtgatgctattacaataaaaatatgccaaatcatatgaaaatatggtctattcttttgtgcataaaaccatgcaccaattgtataagacacaccacctaagaaaatgaataatatgaatatccatgatgtgcgaataaaaataattggtaacaagataatacctacccagcccatcactaaatagacaattaagcttaacttttggttaactttgacagctatggatttatataaaatcccccaaagtgtcgttccccataataa

SEQ ID NO: 583 - DNA, 1472 bp; double-stranded, linear
cgctttttgcaataagtcattagccgcttttaagccttcttcttttcgatctacaacaagtaaaataaatggctttaacgcttcttctttttcactttcaagcatatctggtttttgaaccatttcaaatggagatttcaatccattattatcgctcatttcaataattgcatcatactgtgcttgtgacatacttgcaatagcctgttttgcattttcttgaaggaaatataagtttttcaatttaggatgcttatttaatgtacttaatgtaatcggtgtaatgtctttctcataagacacttcaatcactgtactatttgttctaccaggaattggtggtttttcatgaatatgctttgatacttctccaattccaacgacagattgatttttcgttcgattataaaaaataatattgtcgccttcttctaactgagtataaaaatgataaccattacgtttaataccgttgtacgtgtgcgtataaatcgtatattggtttccaggttcaaattcttcagtttcagctaaaaagaaataacgcggtatcttaatttcgcctttaccaagaccacttattaaatcaaactcttctgcagtgatttgattgaacaatgtctctttcatatnacttatacgaaattccaaagcttcactacgctttaaataatctgctgttaatggtttcaattgttcattaaaacgaaactgtacacgtattttattttgtgcacctgtttcaacactaataatttcaccacatccaagtagtccagtatccgtctgaacttgataaaagatgacttgatctcctactttagcctttttaaacgctctaaatccttgagatgggttaaaatgtgcgcctgattcaaataaagctgtttgtcctactaacggttcattatgattccaacggttatatccacaattcaaccaaaaataattcgtttctgctgtcatcttaatactccttaacctgaataaattttagaaacactatgaattacattcttttagtgtttcttatgcagttggacgcgtatgcgaacaactgtataccctttgttcactgcgattttaatcgcatttcctataacattgtagcgcccaggacattaatttacgtcccagacccttatcgttttcacttctaagtaagtcgaactattttgctttacaacaagtgcgactctaaatacagttggacacacatacgagcaactgtataccttttaatcagttttctatattttatttattatatctgtcttaatgataaaaattgttacaaacagtttaacatatttagctacctattttgcatataaaaaacatgcttgcatacactatgcaataaaaattacaaatntatatatgataccactatgcttgcntatctctatagcgccattgatacacatttttaaatatctatactgccgttagaattttatcatgtctnaatt

SEQ ID NO: 584 - DNA, 787 bp; double-stranded, linear
ggtagtgaatggggttcaagacaacagtattggaagtacgaatgaatcacagtttttaggaaattatattgtaattaagcacgcagaaaatgagtatagcttaatagctcatttacaccaatattcaatcattgtgaatgaggggcaaaatgttaaatatggtgatatcattgggaaggttgggaattctggcaattctactgaacctcatatacattttcaagtaatgaatgataagaatattgaagcatgtacatctttaaaaattcgatttataaataatcgagaacttatcaaaggggatgtggtctgcggattacaagctgaatgatggcgatacttataaaatctcgacactataaaaatggtatagtgtcgagattttcttgcttatttagttaattcaaagtgcacgccggattcattagaagtcgacgtatttttgtttgtaatagagtaaccggtcattgaaattttagattcaatatctgaagcggaatttgtagattcaggattatagaagctacattcataagtgttatcatctttctttttaagtataaacatacctttggctttaacttcgactttagtgttgttaatgtcaaaagtttgagtgctattactataattaacaccagcccaaaccgattcattatctttcacaacggggaagtcatcttcttgcttaacgacgtnacttcatctttctctgtcttaaagacatctttagataagcctggatacaacacatatccatatttattgtcagaattagaatgctttt

SEQ ID NO: 585 - DNA, 830 bp; double-stranded, linear
atgctaaattagggggaatatttacgataaagagaccagaaaaataataaaacacatgctatagcggtataccgtttatgaattgaatcaaaagtacacaggtgctaaagtatgtgcttctaaaatgaagactattttttattacaagaaaatgtatctagtaaacttaaagtagcaagacctaataaatttaatgcatgttgtgcaccttttttaccttggccagcttcgaaatgtttgtaagcagctacacttaaaatgcctatcgttgatagtgatgcaaggcgagaaatgtttttattgataaagctagctgagtataaagcagcagtagttgcttctgcaatgccgacgtattttacaagttctttttgcaagccaaaagtatgttcaaacagttcaatcatacccttatcttcttgcaatttaggtttactggcttggtatagctctttcgcaagttttaaattcgttgcgtaacgcaaaatcatatttaattcctcccaatatttgattttttgtgaaagatgattactttatcatttttacccgtttctataaaaatgaatcaattatgtaacgtatgtgtagtttaggaatgtttgctatggaaatataattctgttcactcaaaatgtatgaaattaatgtgtagttttgtcgagttgctcttttaatttggttagattgttttttagagaagcggtactatttttaagtgcatcaacagatttaccttcgttttgagacattgagtttattacagcacgaagttctgtttctagtatgtcagcgtcgctttagcattagaacttaatatttatactctt

SEQ ID NO: 586 - DNA, 412 bp; double-stranded, linear
ttaggacgtttttacaatcagtacaatgagctcattgttattagtcctttaacggcgtcttttaatgctggcgctacatttgggcgatttcatcatttaattgatactgaaactttagcaaaattagaacatgaaaaaggacattattatcagaagatgatatgtgatgacaatgtagaaatgatttctataaataacataccgaaatatccgagaaatcataatgtattaactaatcatgactcatacgaatattcattgaatttaggaagtagtaatagttattcaaagtatgagcttaccttagatgatatttatgttggtgctaccttttaacaaattatatttatattctagccmactaaataaaagggkactatttgaatcaaacmatatgtattaacctttttta

SEQ ID NO: 587 - DNA, 4709 bp; double-stranded, linear
ttcagtttgaaattaatcatataaatttcttatgggagggttgatatcttaatgattaacattatttcagctataggatctattggaacatttattatggctttattttattttgtatcagtttcagttcaactttatcaaatgaaaattagctttctgccagctttaggttttaaccaaattttattagaaagggaggaggatcaacttaatataatgaattcggcaacagaagagcatcatcataaagattatattaaactatataatttaggtggcggtgctgctaaraaaattgcaatagaggttttattggggaaggataragtcattcagaaaaaatacgtgcatattktacctagtaaagaagggtacatgttaccaattaataaaaatgtgtacgaagaattagaaagaacgattgasaacaatggtcatgaagctgatttgaatgtacgtatgacttattatcataatgtaagtcgcaaacaacaggaagttatattaaaaggtcaaatcgaccgttttaatacttataataataaagaaatttatgatttgcagtttatctaaaaattgatttaagagggtagttgtttattgcgaaaaatatcattcaattttaatgaaataatggcgtcattactataaaatattactttatgttgtaatgcatttttctataagatagaactaaaaggaggggcaaagatgcaaattagacaaatacatcaacatgactttgctcaagtggaccagttaattagaacggcatttgaaaatagtgaacatggttatggtaatgaatcagagctagtagaccaaattcgtctaagtgatacgtatgacaataccttagaattagtagctgttcttcaaaatgaagttgtagggcacggtttactaagtgaagtttatcttgataacgaggcacaacgggaaattggattagtgttagcacctgtatctgttgatattcatcatcaaaataaaggtattgggaagcgattgattcaagcattagaacgagaagcaatattaaaaggatataattttatcagtgtattaggatggccgacgtattatgccaatctaggatatcaacgcgcaagtatgtacgacatttatccaccatatgatggtataccagacgaagcgtttttaattaaagaattaaaagtgaacagtttagcgggaaaaacaggtaccataaattacacatctgcttttgaaaaaatatgatttcaagctaggattacattaggtagagttcatattaataataaaaaatgtttgcaatcaaatcgtacgttgtcgtttgtaattcttaaaatagcaataaataaaatgtttgttagtaaagtattattgtggataataaaatatcgatacaaattaattgctataatgcaattttagtgtataattccattgacagagattaaatatatctttaaagggtatatagttaatataaaatgactttttaaaaagagggaataaaatgaatatgaagaaaaaagaaaaacacgcaattcggaaaaaatcgattggcgtggcttcagtgcttgtaggtacgttaatcggttttggactactcagcagtaaagaagcagatgcaagtgaaaatagtgttacgcaatctgatagcgcaagtaacgaaagcaaaagtaatgattcaagtagcgttagtgctgcacctaaaacagacgacacaaacgtgagtgatactaaaacatcgtcaaacactaataatggcgaaacgagtgtggcgcaaaatccagcacaacaggaaacgacacaatcatcatcaacaaatgcaactacggaagaaacgccggtaactggtgaagctactactacgacaacgaatcaagctaatacaccggcaacaactcaatcaagcaatacaaatgcggaggaattagtgaatcaaacaagtaatgaaacgacttctaatgatactaatacagtatcatctgtaaattcacctcaaaattctacaaatgcggaaaatgtttcaacaacgcaagatacttcaactgaagcaacaccttcaaacaatgaatcagctccacagagtacagatgcaagtaataaagatgtagttaatcaagcggttaatacaagtgcgcctagaatgagagcatttagtttagcggcagtagctgcagatgcaccggtagctggcacagatattacgaatcagttgacgaatgtgacagttggtattgactctggtacgactgtgtatccgcaccaagcaggttatgtcaaactgaattatggtttttcagtgcctaattctgctgttaaaggtgacacattcaaaataactgtacctaaagaattaaacttaaatggtgtaacttcaactgctaaagtgccaccaattatggctggagatcaagtattggcaaatggtgtaatcgatagtgatggtaatgttatttatacatttacagactatgtaaatactaaagatgatgtaaaagcaactttgaccatgcccgcttatattgaccctgaaaatgttaaaaagacaggtaatgtgacattggctactggcataggtagtacaacagcaaacaaaacagtattagtagattatgaaaaatatggtaagttttataacttatctattaaaggtacaattgaccaaatcgataaaacaaataatacgtatcgtcagacaatttatgtcaatccaagtggagataacgttattgcgccggttttaacaggtaatttaaaaccaaatacggatagtaatgcattaatagatcagcaaaatacaagtattaaagtatataaagtagataatgcagctgatttatctgaaagttactttgtgaatccagaaaactttgaggatgtcactaatagtgtgaatattacattcccaaatccaaatcaatataaagtagagtttaatacgcctgatgatcaaattacaacaccgtatatagtagttgttaatggtcatattgatccgaatagcaaaggtgatttagctttacgttcaactttatatgggtataactcgaatataatttggcgctctatgtcatgggacaacgaagtagcatttaataacggatcaggttctggtgacggtatcgataaaccagttgttcctgaacaacctgatgagcctggtgaaattgaaccaattccagaggattcagattctgacccaggttcagattctggcagcgattctaattcagatagcggttcagattcgggtagtgattctacatcagatagtggttcagattcagcgagtgattcagattcagcaagtgattcagactcagcgagtgattcagattcagcaagcgattccgactcagcgagcgattccgactcagacaatgactcggattcagatagcgattctgactcagacagtgactcagattccgacagtgactcagattcagatagcgattctgactcagacagtgactcggattcagatagcgattcagattcagatagcgattcagattccgacagtgattccgactcagacagcgattctgactccgacagtgattccgactcagacagcgattcagattccgacagtgattccgactcagatagcgattccgactcagatagcgactcagattcagacagcgattcagattcagacagcgattcagattcagatagcgattcagattccgacagtgactcagattccgacagtgactcggattcagatagcgattcagattccgacagtgactcagattccgacagtgactcagactcagacagtgattcggattcagcgagtgattcggattcagatagtgattccgactccgacagtgactcggattcagatagcgactcagactcggatagcgactcggattcagatagcgattcggactcagatagcgattcagaatcagacagcgattcagattcagacagcgactcagacagtgactcagattcagatagtgactcggattcagcgagtgattcagactcaggtagtgactccgattcatcaagtgattccgactcagaaagtgattcaaatagcgattccgagtcagtttctaacaataatgtagttccgcctaattcacctaaaaatggtactaatgcttctaataaaaatgaggctaaagatagtaaagaaccattaccagatacaggttctgaagatgaagcaaatacgtcactaatttggggattattagcatcaataggttcattactacttttcagaagaaaaaaagaaaataaagataagaaataagtaataatgatattaaattaatcatatgattcatgaagnaacrccttaaaaggtggcttttttacttggattttccaaatatattgtttgaatataattaataattaattcatcaacagttaattattttaaaaaggtagatgttatataatttggcttggcgaaaaaatagggtgtaaggtaggttgttaattagggaaaattaaggagaaaatacagttgaaaaataaattgctagttttatcattgggagcattatgtgtatcacaaatttgggaaagtaatcgtgcgagtgcagtggtttctggggagaagaatccatatgtatctagtcgttgaaactgactaataataaaaataaatctagaacagtagaagagtataagaaaagattggatgatttcaatatggtccnttccca

SEQ ID NO: 588 - DNA, 1554 bp; double-stranded, linear
cttttttaattawcggaatattgtcatgattacacttcgttagggtttacgtcgtaatttcatttaataagcgcttcaccattaaatgtggtamcctttaattcgccagtagaaacatcacagtaactaagcgcaatttcaggttgattcataacaaaacttaaaatatagttattttgtttatcatctacaccaccttgctccatcacagttcctggagtcacaattcttactacctcacgtctaaccatacctttcgtttgtttcggatcttccatctgttcacaaatagctactttatatccattattaacaagtgtatctatataactatctgcagaatgatacggaacaccacacatcggaattggattttcttttttagcatctcttttagttaaagtaatttcaagtayacgtgatgcctccttggcatcttcataaaacatttcatagaaatcacctagtctaaaaaataataagcaatcttggtattctgattttatttttaaatattgctgcatcattggtgtaacattagacatattatttcttcacaacccttgtctctttttaaaatttgtctttacaatatattcgtttgtaagytttttaattattaattatttaacttatacattttaacatacttacttttacaaacctattcataccatataatcacgaagcatcttaaatgtataagaaaacgcctcaaacctaataaaatgtgtcaatagcatgtttagaattaaattaaaattctaacattcaagacatttaattaagtaagggcgttcaatattaaaatgaacaatgactctgtttgaaatcatatatcataaaattattttataaacctttgaagaataccacgtttttttagagtaattaataagaaataacttataatagatccgatagcacttgagactatgaacgtaatcattaacggtttaatgaagaagtcttgaagcccaaggaaatatgctaatggtatacaaattaaacttccgatgacaccagttccaagtacttcaccgaccgcggccataaatatatgtttacgatatnygtaaaacatactagccaataaaactccaatcatactacccggaaatgcaaaagstgtaccagtaccaaaaagaactcttaaaattgatgatataagcgcttgagctaatccataccaaggacctactatgaccgcacttaatacatttacaaaatgctgtactggtgctgccttaactggtcctagaggaatgatgataatactgcttaatacaacatttattgcaattaaaagtgcagttatagccagttttcttgatttcatatgattgttctcctttttgtttgtaattaatcactatgcttggctttattatggtcatttaaacgtgtttccattgttgatacaaacattttcaataattgattcgcttcatattgtgaagtttgaaactgttcaactatgggcaatgtatttatttctgcttctatactctgaatggtatgttccgactgntccagcgcatttgtttcccgnaa

SEQ ID NO: 589 - DNA, 638 bp; double-stranded, linear
ttttgacgaaaaaagttgatttacaaatatataaacgttgtgatttcaatgtttgtatagggaatagacgtatgatataatagggaagttgaaaaaataaattagttaatcatggaggtatatatacatgacagcaacttgggaaaaaaaggaaggtaacgaaggtttattaactgttactgttcctgcagaaaaagtaaacaaagcrctgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgsccgcaagccaacatgttagttgaagcatcagggcgattagcagcatgmtatcaaaacgctctgagctgctcgttcggctatggcgtaggcctagtccgtaggcaggacttttcaagtctcggaaggyttcttcaatctgcattcgcttcgaatagatattaacaagttgtttgggtgttcgaattkcaacargtaagttagttgctaganccca

SEQ ID NO: 590 - DNA, 1242 bp; double-stranded, linear
aaaatattcccgtacattttgatgtctgtaggggcttttttgactttaggatttgtcattttttcaattcataaagggagacgaacgaaaaatgaatcagcacgtaaaagtaacatttgattttactaattataattacggcacatatgacttagcagtaccagcatatttaccgataaaaaacttaatagctttagtattggatagtttggacatttcaatatttgatgtcaatacacaaattaaagtgatgacgaaaggtcaattacttgttgaaaatgatcgactcattgattatcaaatcgctgatggagatattttgaagttactataggagggaaaatagatggttaaaaatcataaccctaaaaatgaaatgcaagatatgttaacgcctttagatgctgaagaagcagctaaaacaaaattacgcttagatatgagagagattcctaagtcttcaattaaaccagaacattttcatttaatgtacttattagaacaacattctccatattttatagatgctgaattaactgaactacgtgacagtttccaaatacattatgacattaatgacaatcatacaccttttgataatattaaatcatttactaaaaatgaaaaattacgttacttactcaatatcaaaaatttagaagaagtaaatcgtacacgctacacatttgtgttggcaccagatgaattatttttcacaagagatggattacccattgctaaaacaagagggttacaaaatgttgttgatccattacctgtgtcagaagctgaatttttaacaagatataaagcgctggttatctgtgcattcaatgagaaacaatcatttgatgctttagttgaaggaaacttagaactacataaaggaacgccatttgaaactaaagttattgaagcggcaacgttagatttactaacggcatttttagatgaacagtatcagaaacaagaacaagattatagtcaaaattatgcatatgtacgcaaagtaggacataccgttttcaaatgggttgctatcggtatgacaacgttaagtgttttattaattgcattcttagcctttttatatttttcagtaatgaagcataatgagcgcattgaaaaaggataccaagcatttgtaaaggatgttatacgcaagtactaaatacgtatgatgatttagatggtaaaaattgataaagaggcactttacatttatgccaaaagttatatcca

SEQ ID NO: 591 - DNA, 744 bp; double-stranded, linear
ttccagatagagccttagttgctgccgctgaattgtctgatcgttacatcactgatcgtttttttaccagataaagcgattgatttagttgaccaagcatgtgcaacaattcgtacggaaatgggatcaaatccaactgaattggatcaagttaatagacgtgtcatgcaattagaaattgaagaaagcgcacttaaaaatgaatctgacaatgcgagcaaacagagattacaagaactacaagaagagcttgccaatgaaaaagagaaacaagcagcacttcaatctcgtgtagaatcagaaaaagaaaaaatagcaaatttacaagaaaaacgtgcgcaactagatgaaagtagacaagcgttggaagatgcacaaacaaataacaatttagaaaaagctgctgaactacaatatggaacaattcctcaattggaaaaagaacttagagaattagaggataatttccaagatgagcaaggtgaagatacagatcgaatgattcgtgaagttgtaacagacgaagaaattggcgatattgtcagccaatggacaggcataccagtttcaaaattagttgaaacagaacgtgaaaaattacttcacttaagtgacatcttgcataaacgtgttgtaggtcaagataaagcggttgacctggtttcagatgcagtagttagagcaagagcaggtattaaagtncaaacagacctattggtagtttctnattcctaggtccnactg

SEQ ID NO: 592 - DNA, 1449 bp; double-stranded, linear
ttgttatagtgtctgaatctgtgtaactcttgcccatgtgttctgagtaaagcacccactgtttatttacttttcgttgtagtctagcttcgtgtagtagtttgtttaacttttgtgctgatataccgtagtctgccgcgatttgagttgtggctaatgtgccagttgattttaagatttcatcaacataatctgctttgggttttagctctccaatttcttgttgtaaaagtaagttttgctctttttctttcttatactcagtcaacactgtaatgatgtagtctggatcttttaatgtttgttcaattacattgtctgttgcgtatataccgtgtttgcgaatagctggtaggacatctgatgttacccagcgtttgaattttctagcggtttctctaattttttcgtttttgctttgtttagaagcatcgaagattagactgtataatcctgattcgttgataatgatcatatttctgttttgacctgatgcactaaattggtgcgtcagtttgtcctcgctatcaacatgatttctaatggcattgtctgatcttgcatatcctaaaatctcagcaatatcttttcctacaaaataaggttcgttttcaatttctactgttcttactggtagctctttaaaattaaatgtttgtaatgcttgcatttgagtatcctcctttttcctcaacacccacattcagcagacggttatcgcaatgactatcgaatgtatttaaacgcggctcatatcatcgccagctctcgctcacatctgctcaatgtggatgttgataagcgtggttatattaagaagtgaatgttactgattcactttccgccactctgttaaatcagtaactttgttatcgctttcaacaccgttaagcttgtctaacgctttcactactttttggaactctttgatagcacttcgtagctttttagtaatttcatcttctaccatttccaaaccagcaaatgcgtcttcgttattcatgcttagatgtttgttgaaaagatctcgagtgtatcttatttctttaagtgatttatcataagcttcaatttgtcctgaaaggttatgatattttagttgtagttttactaattttaatgattggtcttgcatttgttatgtctcctttaagatgtttgtttgcgtttcgtgtactttgtgggtaaaaaaatatctccaatattttcgtcaaaaaaatcagcgataataaacatctcatcattcttaaattgatgctttcctaattcttttaaacgataaccttcagttgatatattcaagaggtttgctaaatcttcttgagtacactttctttcttttctcaactttattaaattccattgcatgttgtcacctcccgctttacaaaacctactatacacgatacggtacttgngtcaacataaaagtttgcttttcgtgtattt

SEQ ID NO: 593 - DNA, 1170 bp; double-stranded, linear
accaaaaacactttctaaagaaattgtttcagaaccatttgctaaaaaccaattacgtgaaaaagctcgtctaactaacattaaaggtttagagattccaagagtttcatacactttagacgatgatgatttcattacagacgtagaaacagcaaaagaattaaaagcaaaaggtgatacagtcaagttcactactaataaattcaaagtatttgctgcaatttcagatactgtaattcatggatcagatgtagatttagtaaactgggttgaaaacgcactacaatcaggattagcagctaaagagcgtaaagatgccttagcagtaagtcctaaatctggattagaacacatgtcattttataatggatctgttaaagaagttgarggagcagacatgtatgatgctattattaacgctttagcagatttacatgaagattatcgtgataacgcaacaatttatatgcgatatgcagattatgtcaaaattattagtgttctttcaaatggaacaacaaatttctttgacacaccagcagaaaaagtatttggcaaaccagtagtatttacagatgcagcagttaaacctattgtgggagatttcaattattttggaattaactatgatggaacaacttatgacactgataaagatgttaaaaaaggcgaatatttgtttgtattaacagcatggtatgatcagcaacgtacattagacagtgcattcagaattgcaaaagcaaaagaaaatacaggtccattacccagctaagccccaaaaggttaatgtaacagctaaggctaaatcagctgtaatatcagccgaataggggtgatgaaatgagtttagaagaaaktaaattgtggttgagaattgactataatttcgaaaatgatttaattgaaggtctcattcaatcggctaagtctgaattactattaagtggggtnccagattatgacaaagatgacttggaatacccgcttttttgtacagcgattaaatatatcattgcaagagattatgaaagtcgtggatactcaaatgaccaatctagaagcaaggtgtttaatgaaaaaggattgcaaaaaatgantttgaaattaaaaaagtggtaggtgatttttaaatggaatttaatgaatttaaagatcgcgcgtatnttt

SEQ ID NO: 594 - DNA, 1393 bp; double-stranded, linear
tgaagggtgttttgtttatggccaattgctgtgttattaaancgaatgtttcgaatggaacacaatccattatttgaatatatttatcaacaaaaagaagacattgatgcatgttattttatcattccggaagaggacatgtcttcagcttctgatttgaaagcacagttttatcgcggtactttgcagcgcttttaccaatcnttgcacgcagaaaagcttacaccttatgttatgtcttatgacgatatcatttcattttgtaaagaaaacaatatctctgaagtagtgactgcgggtgatattatgagttatcatcttgaagaatatgatattttacatcaacgttctttattcaatgaagcacgcattgccgttactttgatacgtgggaatcattactttaaagcgagtaaaacaatgaatcaacaaggggagccatacaatgtttttactagtttctataaaaaatggcgaccttacttgaggcatagagacgtatatcactatgatttaaaatcattcgaaaactttgtcattgcatcacctgatgatttagtgtttgatgacatagcatttggatcctcacaaataattgaacagataaatggcaacattttttagatcaagatatacagaattacgaaagcggaagagactatttacctgaagtattaacaagtcagctaagtgttgctttagcatatggattattagatattattgaaatttttaatgatttattggcgcgttatgatgaagatgaggcaaactatgaagcatttatacgtgaactcatttttagagaattttattatgtgttaatgacacagtatcctgaaacctcataccaagctttcaaacctaaatatcgacagataaaatggtcgcaaaatgaagcggattttaatgcatggtgcgaagggcaaacaggatttccaatcattgatgcagcaataatggaattgacacaaactggttttatgcataatcgaatgagaatggttgtgtcgcaatttttaaccaaagatttatttatagattggacatggggagaaaaattctttagaaagcaccttattgactatgatgcagcatcaaatattcatggatggcaatggtctgcttctacaggtacggatgcagtgccgtattttagaatgtttaatccaataagacagagtgaacgctttgatgctaaagctttgtatatcaaaacatatcttccgatttttaatcaaattgatgcaaaatatttgcatgatacacaacgcaatgagtccaacctttttgaacaggggattgaattaggtagtcattatccaagacaaatggtagatcatcaagaaaaacgtacacaagttttagctacatttaaagcgctagactaatt

SEQ ID NO: 595 - DNA, 1484 bp; double-stranded, linear
ttaacttgaaagatttccccgacatctataacttgtataatgtgtatatgtcgtttttagagtataataatataaaagaccttgaataaaggagggataatatgactacatttgatgctaaaaaattaaaaaaagaatatcttgattggtataatcagaccttagagttttctaatttatcaaacaatgtagtaagwatagatactccttttaaagataattctttagataatttaataatttacgctttatacgatcagtccagagacatgattacactgacagatgacggctatactatatttgatttagaaaataatggtatttctttaaataaatcaaaaaaacgtaaaaagatttttgaagagcacctttcagcttacggtattaaatataacgataaaactcacgaaatttttgttcaaactaactttaaaaattttaataaatcgaaacataatttattacagtgccttatatttgttaatgatatgtacttactttctaatcctaagtcacagaacatatttacagaagatgttgcaaacaaattggatgaacataacatttattacggaagagatttacctattataggaagcagtggtgttgttcataatttcgacttttttattagcgctaagaaaaatcaaaaagaaaaatttatcaatgctatttctaaccctaataattctatgattattaagtcgaaaataacggatgctatgcaagcaaaaaaaataaaaagacacaggcaaaatgagtttatttttattttaaatgactcaaaaaaagaaataaatgaacataataaaaatcttcttcatgaaaactatattagtacaatagattatagcgaattagatgaaaagataggtttattgatttaatatatatagacgtgataatatcaatgtttatattaaatgaaacgaatttgaaaatttcgaaacagcttaagatagcaaattgaatagccttattgataatgcagaatcgtctacacttagttgaacaaattctatgagaatagatattgttaaactatttgggtaggcgattttattttgacaagagtcagaagattatttagttcatagtttaagttacaaatggctaaactttatgaaaatggtatgactagaatcgaaattatactcgaatacgatttaacactctcaatcttctcgaactgaataaatactgggtcattcaatcatcaagacaacttaataagtgatgataaatgttcataccattttgcaaatataaccagatactctcaacaaaatgtagagttcaaaattaaaaatgtccctaattggcacattgctgtatgataataaattcaacttagatttcaacaatataactaatgatgcttatatttaccgcgatatcaaaccaaacagcccatccacaaacaaattagaatatatcmtgttaataatagtaaatgatatatcttccaaagaccgcaaact

SEQ ID NO: 596 - DNA, 1435 bp; double-stranded, linear
tacccgttttaccagcagtaggtactactgtatctttaaaactaacatatccagtaccatctttatcattaaatgccattttgaatccttcttgaatttgtttgatttccttttcagtattattaaccttgttcaagacagtgccattaattttcttcttgagtggaccaacctcatctttattagttgattcatgaatcgttaatccaatgtgtggctgtattctataaccatcattcgctatagttgaaacatattgtgataattgtaatggtgtataggtatcatattgaccaattgataaatctagataattacctggattatttgttaatggttcgatttgacctcttgtttcatttggtaaatctatccctgttttcacacctaagcctacttgatttaatcctcttcttagcttttgggcaggtgaacttatgtctgaaggtaaagccataccagaataataagggtctcccgctaattttaatgctgttttaaacatatatacgtttgatgaatgcatcaaagcttgcttatcattaatagttacatgcccgtttttattgaagtatgatcgttttgtcaaaccaccttggaaatgtaatggttcatcgaccattgtttctccaactttgatagctttattctgataaccggctaataatgttccaccttttacagaagatccaaccgcaaattgagaagtaaacgtaccaatgtcataatcagtcattttaccactcttattaatctgctttccggcaagcgcaagaatgtctccatttttaggattttgtacaaccatcattgcattatccatatctttggcaccttgactgcgasttcttaatttgtttatctaataatgcttctacttctttttgaagatctatatcgatcgttaatttcaaatcttgaccgcgagcgccaggrtttaacacttctgaagatgtaactttaccagatttgtccgttgtgtatttcatttctttcttcttaccacgcaatacatcttcatattgatattctaggtaagattttccaacacgatcattgcgtgaatatcctttggataagtaatgttctgtcaattcttttggaataccttcagcaggtgtcgatacatctccgaatatacctcttaaagtatcgccatatggatattttctatcccaatccatagacgtgttaacacctggtaatttggaaagttgctgagaaactgctgcatactctttttcactgacatcttcattttttatcatttgtggatctaaaactgttcctggcattcatctctcgaaaaatagctaaaacttggtaaatctttagaagacaattcatctaattgtggattttccggatttcggataacagttggtntatccataatggatcctggtttaataccttccancnggcgaacatagcc

SEQ ID NO: 597 - DNA, 516 bp; double-stranded, linear
agataggcgnattagaaagacaaagtcctccattaaacaagcgttcactaaattactacaagaaaaagatttagaaaagattaccattcgcgacataacaacacgcgctgatatcaatagagggacattttacttacattacgaggataaatatatgttactcgcagatatggaagatgagtatatttcagaactaacgacatatactcaatttgatttgttacgcggttcttcarttgaagacattgcgaatacttttgtaaataatatactcaaaaatattttccaacatattcatgataatttagagttttatcatactattttacaattggaacgcacgagtcaattagaattgaaaatcaacgaacatattaaaaataatatgcaacgttacattagtatcaatcattctatcggaggcgttccagagatgtatttttacagttacgtttccggagcaacaatttcaattanntaaatactggggtaatggacaaacagcccattttcagt

SEQ ID NO: 598 - DNA, 1955 bp; double-stranded, linear
agtactttaccatgaggtaagactttattccctgcttttatagattgtgcttttatttgtgtgccagaaccaatagtactggtctaatgattttgcactcacattatcaatagctttttgtttgtcttgaccttcaacatctggcactttactatactctgcattagatgtgtcatcttttgatttacctacatttaaatatttcaaagtattttccattattggtttaaacgctttactaacacctaattcataagcttcttggtcatttttttgtgccaagctcataccagcgtatacaataactttaggatttttcttcggcgcgtcacccataaaacttacaaaatatgggtttggacctttaacgtatccaccaccattaggtgcagcgacttgtgctgtaccagtcttaccttcgacctcataaccatcaatacgatagtttgcagcgtgactcttcttactattcacaactaaatccaattgcttttcaactttttcagcagtatcttttgttattggtttgcctgcgatttgtttttgccctttataaaattgtcttttactaacaggattttcaacgctattcacaaaccatggttttaacatattaccatcattaaagaacgctgattgcgcttgtaacatttgaacaggtgttactgttgtcgattgaccaaatgatgacgttttttgttgcaactcattactccatccaatttgaccaggtgcttctccatcaaacatacctttagttgattttccaaatccaaatcgttcataccaagatttcattttgtctgcaccaactaaatcttgtaaatgcatcatcaatgtattagatgaataagtaaatccgagtgacattgggatttcaccccaaccgactctattccagtctgaaatacgtgaacccataatatctctatgtccagatttatatttcttatcaggatcaaaagcaccttcttgaatagcagctgctaacccatatgatttaaatgttgatccaggctcgtatgtgttttgataaaggtcatttgcccactttttaccaaagtctttaccagtttcaggattaaatgttggtcgctgactgtatgctaaaatttctccagttttggcatccatgacaaccgcaaataaatctttcggctggtatctttcaaccatgccatctaaagcttcttcaacaaatacttgaatatttgaatcgattgttaaatggacatcatcaccacgtttaggctgcttctcttttttagtatttggtgcgatatatccccaaatatcatgaatatatctcaatgatcctttagatccacttaaataactatcaaaaatcttttcaactccaagtgcacctttaagttcaccagtatccggatttttctgagctctaccaattaagtgtgatgcaaaattgccatttggataaaagcgttctgtttcaggcaataaagaaataccaggcaaattcattttctctattttcaatttgtcctgatacgttaaatttgttcctttgcgtccaaattcaatttggaaagctttcttttgactaagtctcttttcaatttcctctggcttcatattaatgactgtagataatttctttgcagtctcttttttatcaactacatgcctaggttttttagaattggcactcgcctttttatctattactgcaacaagtttatatctttctacatcttctgctagcactttaccatkacgatcatatatctttcctcgttctggttgttgtgcattcttaactaaatacttttcatttgccttcatgactaaatcttgaccattagaatgtccagtaatcatgatatatgaaattcttaaaaccaatataaaaaagagcagtccgaataaaccaacaagtaggactgcccctattttattttttttaattttaatttttttggtcgccattacta

SEQ ID NO: 599 - DNA, 704 bp; double-stranded, linear
tagcaagagtaggtgataacagttcttttaacgtgtttgctgcttgctcatttcttggctcattgtagactaaaatataataagcgttttcaaataagtgctttttagcatttagtacaccagatttatgactaccagccattggatgaccactgactaaatgaatattatgctttaataaattgcattcgtgttgctgtatcattgctttagtactaccagtatcagaaacaataacaccaggtttagttggcatatctataagctcgctaagatatttatttgtgatagcaacaggtgttgcataaataattacatcggcttttttaatagcttcactataatttaaacatttttcattaataatgccgattgatttagctttatctaactgagaaatatctgcatcgtatgcaataatattagtattagggttatggtattttatattgctagcaagacttccaccaattaatccaagcccaacaaataaaactgttgtcatataaatcaccttatttcgaaattttcagaataataacattgtaaatgagctgttgacacagtgcaatagtaaataaaaatcgataatagcattaatagataaacggagataaatcatctacaataaagagtatagtaacacaatggcaacggaggggtaaatcaatggaaccaatattagaaatgattaaaacattaac

SEQ ID NO: 600 - DNA, 1158 bp; double-stranded, linear
cctctaaaggatcacgaacctttttcatcgtgactaagcctataatacccttaaacctattattattaacttttacctctgtgtattccctatcaattaggcgacgccagtgacgtttatctatatactttactttcacagtcaccaactccttgtcattattatataaaactacataaatgatgtcatgtcatgatacagttttatagtttttgttaatcatatgaaaatatttattattattttactacaactcgcttcaatttacttaaaatagacaatattaattagatagtacacacatttcttcataaaagtgatttttcaaaaatataaataacacactcttatcgttttcaaaatcatttaatgctattttcattaaaaacagctgaagcatcaaatctattctgattcaatcaagaatacatataaaaatgaagtgactcaaaggtttattaacaaccttcaaaccacttcattgatcacttttattttaaagcatatttttcgattactgatttaagatgcggatattgcgtaattaattcagattgcttaaacaattcaaactgcttaaactcaaatgccggttgacacatacaacctactaaactaaaagtatttgatatttcgattgaagaagcaaaaattgttcctttaggcactacatattgcaatacatctccattttggatatcagtacccaatgttgcagtcgtatattccccatccggatttatcatatgaattgttagagaatcgccagcatgatagtaccatacttcatcagcatcaattcgatgaaaatgcgaaatattgtcatctgtaagtaaaaaataaatactactaaacggcgctctgcgtccatctttcaatacttctcgaattgtctctctatagaaaccaccttcaggatgtgattcaagttgcaattcatcaatccattgttctgctgatttcattatttcaaatccacattatggaatacgttttgtacatcttctaaatcttctaatgcatcgattaatttttcaaatgttacttggtccgcttcagaaagttcaatatctgtttgaggtaacatttcaaattcagcaactttaaattcttcaacacctgctgcacgaagcgcatcttgaacgactgcaaattgat

SEQ ID NO: 601 - DNA, 827 bp; double-stranded, linear
tgatacttatttttcaatattatttggaataaantcttntaattgtggtgtgaaataaacaccgaaattcttttcagattcatcttttccactacctgcatataaaataccaatcagtycatgtttagaattcaatacaggagatcctgaattacctggttgtgcatacgcatcaaattccataaacgttccactgatatggttaatcgttcctgtcgattcaaacattttatattttgtttgtgcaccctttggataaccaataacagaaattctatctttcacttttgctccgtctgcaaattttgtataactaacgttcttattaaaattcaaaccttctgtacttgtttcatgaacatgaactatcgcaaggtcttcttttccgggatattctacaatgtctttaacgtcgtagtttcctccgcctttacctttactcgaatgatgtgctgatactctatttttaaaaatatcattacttttagcgatatgtttgttagttacgattgtatttttaccaacaactacaccagtaccacccacaaatgctaccactgaattgtatggttccttagttgcatcggtaatttctttgacattcttttctgctttggcaattgaatgargctgattagaaatattttcagcaaaaccaagagatgttaaaatagttaaagcagttaaacctttaaccattacatttttattcatattttacctccttccaaatttattttnatagttaatgtatctagatacacatttactatatacattttaaataaaaatattnattaaatattaattaaccacttatnaacgtt

SEQ ID NO: 602 - DNA, 796 bp; double-stranded, linear
nggnacgtaaagtatttatgttaaatggcanaaatatatgaatgatgagttacctggattaccaatgttccaaggtaaatcgataactattgttaacgataaagtacgaaacttagacattgaaattggaactgatcaaagtttatataatttaactaaagaagcttagtaatgtaacctcgacgattttgtcgaggtttacttatatggggggatgttatgaataatgtattgttagaggttaaagatttagaaacatcattaaaaataaataatgaatggttagcaactgttgaaaatatttcttttgaattatctaaaggagaagttttgggtatagtaggggaatctggttgcggtaagtccatattaagtaagtcaattattaaattattaccagaaaagatatctaaactaagtaatggagaagttatatttgatggtaaacgaatcgatacgctcaatgagaagcaattgctagatattcgaggaaatgatattgctatgatttttcaagaacctatgactgctttaaatcctgtatttaccataaaaaatcaacttgtggaatctataaaatcacataaaaaaatttctaaaaaagaagcaaataaattagcaaaagatttactaaaaaaagttggaattgctagacaagatgaaatattaaatagctatcctcatcaattatctggtggtatgagacaaagagtaatgattgcaatggccatttcatgttctcctaaattattaattgctgatgaacctacaacagcattggatgtcacgattcaag

SEQ ID NO: 603 - DNA, 1618 bp; double-stranded, linear
ggatgtgttcatcccaaattgaaacagaaatttatgatcaaatgatgtggattggttttaaaccattcaaaattaccaatattamacaagaatctgaagacattaaatcattttacagttgaaactgaagaatatgactttagtgaatttacaccaggccaatacatcacagttgatgtttctagtgataaacttccatatagagctaaacgtcactattctatcgtatcaggtgaaaaaaaccatttaacttttggcgttaaacgtgatgtcacaacagaacatgaaggcgaagtttcaacaattttacacgatgagattaaagaaggcgatatgattaatttastgcgcctgtaggtggattcgtattagagaatacgactgaaccacaacttttcttaggttcaggtattggtgttacacctttagtagctatgtatgaagctgcctctgccaaaggtttagatacacagatggttcaagttgctgaaaatgaacaacatttacctttcaaagacaacttcaacagtatcgcaagccatcatgacaacgctaaattatatacacacttanagataaacaaggctatattggtgctgaagaattacaagtatttttagcaaataaacctgaaatttatatctgtggtggtacaaaattcttacaatctatgatcgaagcacttaaatctttaaattacgatatggatcgcgtacactacgaaacatttattccaagactaagcgttgcagtataactgagaaaagaggtttagtgctcatatgaaacttaatcaacgttacgtaaaagtatttgcattatatttcgtaagtattgttactgcaaatattattgttaaaaataataatttaattaaaacattgatacaaaccatagccgggtacacggtctttgcagttggtttgaagtatttaactaaacgtaaaaataaatgacatctataccaaaacagctatgactttactttgtcatggctgttttttaattgggagtaggacagagatgatattttcgcaaaatttatttggtcgtcccaccacaacatgcattgatgtatgctcactgaatttcataagaaaggagttcacaagatgaccgtagatattggacggatttatgacaataaagataataccgacgctattcgtatcctagtcgatagagtctggccgagaggtatttcgaaaagaactgctaacctagattattggttaaaagacattgccccttctactgagttgcgacaatggttccaacatgatcctaaactttttggagcttttaaagaaaaatatgaaaaagaattacgtgatcaggatgcgcaaaaagatgcttttgaaaaattaaaggatattgtaaatcagcataatcatgttctattgttatatgcagcaaaagatactaaacataaccaagctgtagtactacagcagttgctcaatacttagttatatatgtttatcgtgaatcactataaatgtcgctaacttcatttctaatatttatttttaaaaagcataattactacaattaattggaactttaataattactaaacttggaacaatattttactttaacaaaataaagttttaaa

SEQ ID NO: 604 - DNA, 2115 bp; double-stranded, linear
attataatgcaaatattgaagcatttaaaacagtcgctaaagcagtaggcaaagagaaagaaggcgagaagcgtctggaaaagcatgataaaatattagcggagattagaaagaaaattgaacagagtacgttaaaatctgcatttgcattcggtatctcaagagcaggtatgtttattaataatgaagatacatttatgggacaattcttaattaaaatgggtattcaacctgaagtcamaaaaramaaaactacgcatgttggtgaacgcaagggtggtccttatatatatttaaataatgaagaacttgccaatatcaatccaaaagttatgattttagccactgacggaaaaacggacaaaaatagaacgaaattcattgatcctgcagtttggaaatcattaaaagctgtgaaagataacaaagtttatgacgttgaccgaaataagtggttgaaatcaagggggattatcgcaagtgaaagtatggcagaagatttagaaaaaattgcagaaaaagcaaaataaaaatacagcgctactcgtaaatcatataagagtggcgctgtatttttaattatgtttattatctgtcggatgtgatgatttacctgaaagtttatttcgaataaatttaattacataaccgacaaggattgttttaacagttcttttaatgaattggcgcatcgttacatacctcatttctctatatcttacgaactatatacccattcatatatgctttttaaacgtcattgtcacaatttaatttttagggaatataatataaccatctttatctgcttttttagtaaaaatgacaaaaattgcatgtattattgagatgatggtagggatacctgtccagaaaaataataagtgaaaaagaccttgtccaaatttatcagcataaaatttatgaatacctaaacctccaagaaataatgcaacmataacataaatggctttattgactttcatttgtaatcctccttaactataattctacttaaattcgttgtgaaaaccaatatttctaactttagaattttcaaactttctaaaattataagtatatctttttaaaataagctagaatttctatataataaatgttaataacgtaaaagggaatgatgacatagtgatacgtcaagcacgtccagaggaccgatttgatattgcgaagttagtttatatggtttgggatgatatggaattagaattggtaaagcatctacctaaagacatggtattagatgcaattgaaaaaagctgtgttgatgcaacatatcgaactttttatcagcatattttagtttatgaagtagaaaataaagtagcaggttgtattattagctatagtggtgaaaatgaattgaaatacgaaaaagcatgggaactacttgacttgccagaaaaaataaaacaatatggcacgccattacctgtaaaagaagctaaagacgatgagtattatatagaaacaattgcgacatttgcagcatatagaggtagaggcatcgcgacaaagttattaacgtcattacttgaatcaaatacacatgttaaatggagtttgaattgcgatattaataatgaagcagcattaaagttatataaaaaagtaggctttatatctgatggacagattgaattatacaagcacatgtatcatcatttaattgttaaataaaatactcgacagttcgatgtaagtcgattgccgagtagtatcattttctattaaatgcctgcaaataatgcactaatataaatacctaatgcatataataaaccgaaaaatgtatttgttttaccagcagcagccattgctggcatcattgtaggcggtgtatcattcttcttgaaacgtctgataactttaacaggcattgggaatgataacaacgcaagtaagtaaaataatgagccaccaggtttaataatgatcgtaagtacaataaaggcataagcgataaagtacatgattgccataaatgttaaagaagcatttttacctaatagaatgggtaaagttttgcgaccacttgctttatctttgacacggtcgcgaatattgttagccatattaattaaaccgatagtg

SEQ ID NO: 605 - DNA, 1003 bp; double-stranded, linear
tatgtctcaaactcaaattaatcaaatgttccagcagaaaaacatgtctactgaattaaaacgtcgttatgcacaacgtttattacagtttccacatgtacacaataaagaatacttgaaatcttatgctaaaaaccctaaagaaactaaagatagttatatttctggttttaaagagaatcaattgattaaaatagaagcgattaaatcattgtttgcaatggataaatctccattagaacatgttaaacctgctacaaaaccagacgcttcttgggatgagatgaaacaaaaagcagttgaaattggtaaagctgatactacatcgaataaatttggtattagagatcaatactggaaattaattcaagaaagtaagcgtaaagttagacgtgactacgaattcaatgttaattctccagaattccaagatttagaattacttgtaaaaacaatgcgtgctgctggtgcagatgttcaatatgtaagtattccatcaaacggtgtatggtatgaccacattggtatcgataaagaacgtcgtcaagcagtttataaaaaaatccattctactgttgtagataatggtggtaaaatttacgatatgactgataaagattatgaaaaatatgttatcagtgatgccgtacacatcggttggaaaggttgggtttatatggatgagcmaattgcgaaacatatgaaaggtgaaccacaacctgaagtagataaacctaaaanttaaaatacaaatagcacataactcaacgattttgattgagcgtatgtgctatttttatattttaaatttcatagaatagaatagtaatatgtgcttggatatgtggcaataataaaataattaatcagataaatagtataaaataactttcccatcagtccaatttgacagcgaaaaaagacaggtaataactgattataaataattcagtattcctgtctttgttgttattcataatatgttctgttaacttaatatctt

SEQ ID NO: 606 - DNA, 1097 bp; double-stranded, linear
gctnttatatttaaaaaatttattngcggataattacctttattaaatcccacccattaggawtacgagtaataggactaatactggaatcacataatgtaacataacgtccctcctttaacttaattttaattgtaatcaaatttgacaataagtcaaamcattaatacctatgatargtatcatttattaacatatgtatcatatttttaatcttgcgtaatttttatcgttaactatgtgatttaatcaacaggccaataagacgtttgtcattcgtgcacataacggtacgacgcgcttttgtcattttaattatgttaagataatagtagttatagaagttcaatctataggaggcatagcatggatattccaaaaatcacgacatttttaatgtttaataaccaagctgaagaagctgttaaactatacacaagcttatttgaagatagtgagattataacaatggctaagtatggtgaaaatggacctggtgatcccgggactgtacaacactcaatatttacattaaatggacaagtattcatggcgattgatgctaatagtggcacagaattaccaatgaatcctgcgatttcattatttgttacagtaaaagatactattgaaatggaacgactatttaatggattaaaagatgaaggtgccattttaatgccaaaaacgaatatgccaccatacagagagtttgcttgggttcaagataagtttggagtaagttttcaattagcattacctgagtaaaaggattcgcacagcttggaatgataaagaaacactttttcttatgcatgcgttttacctatgtatttctattttaagtacacattagcattttagtttcgctcatttttaaaatcacaaagataatttgtaacttaaatgatgatacgttatttaaaaacacgatacttcgtttcaatgaacgcattaaataataaataaacacctcaccataagaaaggactactttcttttgtgaggtgtttatttgtcgacaacttgattatgattgtttcattttttgaataagttcataatcaggtgtagcatacaaagttttttgattgtca

SEQ ID NO: 607 - DNA, 2031 bp; double-stranded, linear
gaggtctagcatgtctcgttcaaaaaaatacttttacttatctagcttaatgattattttaagctttttctttaatacaaataacgttttcctaagtggactttttaattcttttattaaattaatacttttctgcagtgttattaactcaattgtactaattttgtctataatttttgcagatcgttcaattaaatcactaaagcctgatgcagattggattagaattgcgagtaaaagtttgccttggattattctaattgttattttagtacatatcttttcaattgttcgtacattcggttttatttaaaaaagttaatatgtcattgtagccttaatacaaaacaatacaatgtatcatgctataatgagtaaaacaatttgataacgttgttgcgtataaaaaatattagattttcgaaatcataactatgcatctaatcgctatagttatacaacaagatataacatataatgaggtttgataatgcatcgacaatttttgtcgtcgcgttgccaaaacctcttttttaaattcaaactacttcttttcgaggtgaaccaaatgcaatatgtatatatttttatcggtggtgctttaggcgctttattacgttacctcatttcttttctgaatactgacggaggttttccaatcggaacactgatagccaatttgactggtgcctttgtaatgggattgctaacagccttaacaattgcatttttttcaaaccatccgaccctaaaaaaagctattacgactggttttcttggtgctttaacgactttttcaacatttcaattagaattaatacatatgtttgatcatcaacaatttataactttactactatatgctgtaacaagttatgtctttggtattttgttatgttacgtcggtataaaactaggtggtggtttatcatgatatcaatcattttagtcatgattggcggcggttttggcgcaattgctagaagtgccattactgattattttaatcataaatttacttcaaagttacctatcgcaacattgatagtaaatctagttggtagttttttaattggattaactataggcttatcaatttcaatctcatggttccctgcgttctttgttaccggttttttaggtggcttaacaactttctcaacgttagccaaagaacttacactaatgatgacgccaaaatttaatattaacctttttctcaattattcacttttacaattcatcattggatttatagcttgttatattggctatcatatttaaaaataaaatgcttcattcagcaaataggtaaattacgacaccttcctgaacgaagcattttttaattttcatgcaaatttttaagcaccatataatgcctaccaaatttcaataatctttgttgccgtttaaataatgtgaatgtcaataaattctccaaactagtcgaaaataaagggagtgggacataaatccctaaaaaaacagcagtaagataattttcaattagaaaatatcttactgctgttctctatttatacaatacttcgtattgaatggcttcgctttcctagggtgccgtctcagcctcggcttcgactggcactgctccctcaggagtctcgccattaatactacgtattaacatgtaattttacttttacatactttaaaaaataagacactttgcccaacttacactaccaatagaaacctctgttagaattcctcaaaatgatatttcgcgatatgttaatgaaattgttgaaacgatacctgatagcgaattcgatgaattcagacatcatcgtggcgcaacatcctatcatccaaaaatgatgttaaaaatcatcttatatgcatatactcaatctgtattttctggtcgaagaatagagaaattacttcatgacagtattcgaatgatgtggttagctcaaaatcaaacaccttcttataaaactattaatcgttttagagtgaatcctaatactgatgcgttaattgaatctttatttattcagttcc

SEQ ID NO: 608 - DNA, 687 bp; double-stranded, linear
tccccgggaatcgaacccgcganctcctgcgtgacatgcaggcgtgttaaccgctacactacgagacctattanattaaaaactatgtattgcgggaggcggatttgaaccaccgaccttcgggttatgagcccgacgagctaccgaactgctccatcccgcgctaatattattttgaattacctaattaatataccataatcaaaaacctaaagtsrrgaactttttgaatttaatttaaatgttatctcttaaataattacttaaatatcgtagcaacatgttctctgttgaacacaaatattagtatattcatttttgtagtgtacgtcaacgacattttcaaagttttttgtgtaaaaaaacgcttcttattcccttttatcatataagtgtctaatagttgtcataaatagtgktaaagcatttaaaaaggtataggagttataaagtttacaacgcctataccttctgaaaaagaaattataaaagcttgttacaccgcatattctttcagtcagcgactaccaatataacattgtagccctaagacattgcttgacgcctcanttacaacaatttttcaaaatcagcagctacctactgacacaacataacacaacccntacactanctatcgtgtcatgtaatcttgcatccgatcttgcaacgctgtaaatgtttcga

SEQ ID NO: 609 - DNA, 843 bp; double-stranded, linear
gtgttgaatactttgacaaaatgaaatcatttgttctttcgtttcaaatttaactgtttgaattaaatcagttcgtttttcgtagtacttcggcgttgtgttcatattcattttttctaaaaataaactagtaaacaatgcacctttaagactctgactgacaacgtgtggtgctaaaaagaaaccttgatacatttcaagcaatgcatttaatgatgcacccgcttctttaccaataccaggtgctgtcaatctataaccacatcgttcaattaaatcttttctaccagcaatgtatccaccaatcttagctaaaccaccgccagggtttttaattaatgatcctgctattaaatcggcaccacattctataggttcacgtctttcaacaaattccccataacagttatccacaaatattaaaatattaggatgcacgtttttcaacctagtaattaccttttcaatttcatctagcggaattgaaggtctttgatcatagcctttcgaacgttgaatcgctattactttggtgcgctcagaaaccccatctaacacactttcaatatcgatcttaccttctttaagtgcaatatctttatacgatmcgccatgctccattaaactttcaataccatttccgtttacgccaatgacttcaagtaaagtgtcatatggactacccgttatataaattaattcatcaccatgttttaataaactttgtaatgcaatagtaatcgcatgcgtacctgaaataatttgcggacgaacaattgcatcttctgctttaaatgcctgcgcatatatttcttaattgaacgaatttagaactaatcgtaa

SEQ ID NO: 610 - DNA, 775 bp; double-stranded, linear
gattattataaaccgaatgaaacaaaaaagtttttacatattttcaacaactttatttcaataaagcatcaagttgatctaaagtttgattcataccttgttcaacacccatgtttatgacttgttgagcggcttcttttgttggaaataccgatgttgatgtcactgtcgttttcgttgtattgctcttggaaaatgacaaagtaattttcatgcttggcatttttgtatcttttgcaccttgaggtgtcgcaaatgagtcaatatattcaattaaatatggacgcttaaccgttttatattctgctaatgtatagctggtcattgtaggtgttttaatcgcataaaatgcatcaccgcctgaaacagcattaaagcgaaacactttggtactagcgtcttttggatgaaaccatttttcaaataatgctttkgtcgtataggcatcaaacaccttttcaatcggtgcttctatcgttcttgaaaaaataattttattatcttcaactttaatcgtcatcttcccactccctatcttttatatttactcatcttaacatgcattgagtaacatatgttaccaaatcatttgttataaactatagtaatattaatcattccctctgtngaaattgataactacgaaataaaaaacacactctattcagctattaacagttgagtagagtgtgcaaacctgttgaattaatgcgctaacatttcttctttgatttggtcttnatntaattttgaaggataatatgttggccagtta

SEQ ID NO: 611 - DNA, 728 bp; double-stranded, linear
atcaaaatttgatactaaagggctcacgctattttatgtatttattggattgattatgtttgctttattaaaccaacagctgttacttttaaatttcttgagttttatcttagctatcgttgtggcaatgtgtttatttaaagtagaaaaacatgtttcttcaccatttttacctgtggttgaatttaatcgttcgattactttagtttttataactgaccttctaacagctatttgtttaatgggattcaatttatatattccagtctaccttcaagaacaactaggattatctccattgcaaagtggattggttatttttcctttatctgtagcttggattacattgaattttaatttacatcgaattgaagcaaaactatcaaggaaagttatttacttactatcatttacattgctactagtaagtagtattatcatttcatttggtattaaattgccggtacttatagcatttgtgttaattttggcaggattaagttttggatatatttatacgaaagatagtgtgattgtccaagaggaaactagcccattacaaatgaagaaaatgatgtcattttatggattaactaaaaatcttggggcatcaataggttcaacaataatgggatatctttatgcgatacaatcaggaatctttggtccaaacttacacantgtgttaagtgctgttgctgtaattagcatgggcttatngttttatg

SEQ ID NO: 612 - DNA, 913 bp; double-stranded, linear
tatcagagcaaataagcaagttagataaaaagatttctgacttacaattaattagacgctctgtatgtgaatttattaaaggactctctctaatagataccagcattttaaacaagacactacagtcacaatatgataaagaagcatctataaaatatggtcatacgaaagcatatcantcatttattagacgtaaagacagcttacaatcgcaggatatcagacataaattgacaactatcttcaataaatttaatcatatgtctttgagtcattatccaatccaagattgtagtgatctcgtatttgagtggaaggcatttatgaacactatcgctgattttgmtgatgaaacattatgctgtattgctaaaacatatgaagatgatacgcgtttcaaagattactttaattcatatgataatcaaaatttagcatcatacatttcagaagctgttaattattttttgagcaatgtgaataagagcgacaatttttaatcctcatacagatgctacaacactgaatacaccaactaaaataattgttcaaagtagaaaactaatcatttattctctaaatcaataactatattaaaagttatacctttgcaaagcgaattagtataggttaccgaaaggagaaaggattaggttccattcgatttataaaaaaatatatttcgaaacatacaaaagcgccagaagataatcatttcctctcgcgcttttatactgaattatattaatttcaaactctaaaactctaataatttctttttcaatgcatattcaactagctcaggtttactctttaagccaagctttgtcataatatgcgtcttatgtgcttctactgttttcacagatacaaataatttctctgcaatttctttattcccgtaacctttggc

SEQ ID NO: 613 - DNA, 654 bp; double-stranded, linear
acaagtgttgatgtcatagtagcgtcaawtgtgctttatttctgggacacatttaaatttttccaccccattacttggagcttaatctttattacaattttactattattaaacattttttctgtaaaatcatttggagaaactgagttttggttatcattgattaaagtgttaacaattatcgtattcgttatttttggctttttaatgattttcggtatcttaggtggtcatacatatggatttgaaaactatacaaaaggccaagcaccgtttgttggtggtatctctggtttcttaggcgtattattagtcgccggattttcggttggtggtacagaagtagtagcagtaactgctggtgaatcagatgaccctaaaaagtctatgcctaaggcaattaaacaagtattttggcgtattcttttattctatgtcttatcaattgcagtaattggtgcaattattccgtacacagatccatcattattaagagcaagtagttcaataagtcaaagcccatttacaattgtattcgatagagtaggcatagcctttgcagcatcagtaatcaacgcggttattttaacttcattattatccgctgcaaattcaggtgtttatacaacaggcagaatgttgtattccttaagt

SEQ ID NO: 614 - DNA, 642 bp; double-stranded, linear
tcgatctttattgataataattaaattgtcgcctttaaaatgtgatattaatcctgcggcaggntgtacaacgagtgatgaacctagtacaacaagggtgtcagcatgttcaattttatttaatgcccttatgatggtaggttgatctaacatttcaccgtataatacgatgtccggtcgaatggcaccaccacaattatcacaatgtttcaaagttctatcaataacatctgacttcgtataagatttatgacatacattacaataaaaacgatttaacgtgccatgtaattcatcaacatgttgacttccagcgtctgagtgcaaaccatcgatattttgcgtgatgacacctaaagattgttgattacgttctaattttgcaatccaatcatgaacgatattgggcatcgtatcgacaaatagtaagcgcttatggcagaaattgataaaaccttcaggatcatcttctaaataatcacggcttaacaagtattctggcgaaagcccatcttttgaaatttcatcaaataagccacccattgaacggaaatctggaacgccacttgcgacagatacaccagcacctgtaaaaaatgtaatacgattcgaactatctataatatgttttagtgtctctaa

SEQ ID NO: 615 - DNA, 1210 bp; double-stranded, linear
tttccccnccccnccaaatatccaanggaactttaatagtccaattggcacagtaaaactatggcattttataagtataatatatctgtaatttatggtcaattagtaaattgttttttatttgaaacatatttcacatcaaaatcacaaagacttttagattttgttctaaaaatctcttaataatttatttaatgagaagagttgcttatatagtaaattgtgaagccgttaaaacaacgttacaaaacctatatctttaatacggaaccatatggtatgaatcaaggaatacttaaactaaaacttctctatcagatttatttgttgcgaaatcaacaactttaattgcttgcccttcatttaatggataatttgcttgcgtaattttaacttttacaatttgacctatgagtgattcgtcaccttcaaattgtactttcatataattatctgcatatccaactaatgtaccttctgtgtcaccctgttcctcaggaattacttcaagcacatcttgatcaaatttagacgcatataactttccgagttgattgcttagcgtaattaacttatgcacccgttcatttttaatttcttcatcaatttggtcatccattcttgcagctggcgtgccaattctaggagaataagggaaaacatgcagttcagagaacttatgctttacgataaaatcatatgtttcttggaactcagcttcagtttcacctgggaaaccaacaattacatcactcgtaaytgccaagtctggtaaagctttatgcaattttgttaatcgttctgaaaatctatccattgtatacttacgtctcatacgttttaatactgtatctgaaccagattgtaatggaatatgcaaatgacgcacaacttttgttgaacgttctaaaacgtcaattacttcatctgtaagttgacttgcttcaattgaagaaattcgaattcgttctaatccattaatcgtttcaagatcacgtaataattgggccaagttataatcttttaaatcttgaccatatccacctgtatgaattcccgtcaatacaatttccttatatcctgaattcactagttgcgtcgcttgttcaactactttttccggatctcttgaacgcattaagccacgagcccatggaataatacagaatgtgcagaagttgttacaaccttcttgaatttttaatgacgc

SEQ ID NO: 616 - DNA, 652 bp; double-stranded, linear
taataaaatacaatacttttcaatacagagaatcccgcaatgtcgggattcttatttatgctgattttgtttttgtctatgatcagggactttcagggactcaattaattatcacattcatattttcttatgaccaaattgatacatatgatgctatttaatgagaaaattaggcatcacttggttattgaatttccttcattaaactttccagctcaatttaatagttagtcgactattattcattaaacactttttaatcataaaaaagtgtttttgataattcactaccaaaaacaccttcttacttataattctatttgttcaccatttctaatcttatcggctaaatcattcagttttcttaatcggtgatttacacctgattttgaaattggaccagttgataccatttctccaagctctttcaacgaaatttcttgatgttctactcgaattctagcaatctctctcaacctgtctggtaaattttcaataccaatttctttatcaatcaatttaatgctctcaacttgtttcatcgcagcactaactgttttatttagattggccgtttcacaattaacgagtcggttaacagaattacgcatatctcttacaatacgtacgtcttcaaattttaataacgctt

SEQ ID NO: 617 - DNA, 798 bp; double-stranded, linear
tnaccactttaaaatagcgcttaataaatgaagggggcaagtcttatgacgttttacaatttcatcatgggttttcaaaatgrtaacacaccatttggtatattggccgaacacgttagtgaagataaagcattccctcgattagaagaaagacaccaagtaattagagcatatgtgatgtctaattacacagatcatcaattaattgaaactacaaatagagctattagcttatatatggcaaattaatttgagtagtaccaattatgatgtattagtgcatcccaaatatcttttgttttaaagtttatttcatcatttcttatcgaaaatggtgtaataatgtctttatctaaccaagtgttgataagttcatttggtacaccatctaacaacatttcacttttactaattataaaacattcccagtcaagtgaaacattttgtggattcacataattacattgattatgattatccataaacactcactcctttaaaattctgtactcttcattgcgttttaccccgtcacattatcttttaaactaaaatcatcattacttatgaaaaaaatgtacatcaaaagcaaaggttttcgctaccgaaaaagtttaaataatggtttaatatatttggtactcattttaataaaaagagaatacattttgagctatcaatactttttattgaagaggtgttattsytggctaaaacgttatatttaatgcgccacggacaaactttgtttaattttaagggactaattcagggatttggagattcgccgctaacaga

SEQ ID NO: 618 - DNA, 1786 bp; double-stranded, linear
atacgctcaattgataaaaatttaatatctgccatttgtatacgcatcgcttcgaatgtttccgttgcaatatcaaatgataattgtgactggaaccttaaacatcgaatcatacgtaaagcatcttcttggaatcgttcctcagctatacctacagttcttattattcgattattaatatcttgttgaccatcaaaataatcatacaatttgtatgctgtatccattgctatcgcattcatcgtgaaatctcgtcgttgcaaatcttcgtataaatcacgaacaaatgtaacaccacttggtctacggtgatcgacataatcttcttcagcccggaatgttgtcacttcataattttcatcattaaaaactacatttatcgtgccatgtycttnacctacaggtatcgtatgactaaagatagattctatttcatccggcgttgcacttgttgtgatatctatatcatgaatatttcttcccatgacataatctcttacagagccacctacataatatgcttcaaaaccattgtcttgaatttgttctaatataggccttgcctgttcaaataatgatttatccatattattactcgcctttacttttgttatgctcatttagcattttttgataataatactcatattgatctgtaataagttctgatccaaaacgttcagcaatatctgctagcatgtttttctgaagtttgttgtataacaccttatcttcaagtaatcggatagcatagtcactcgctgaatcacaatcacccacatctacgacaaatccagtttcaccatgtttaataacctctttaattccaccggcatttgaaccaattggaacgacgcctgtwttcatagcctcaagtaaagttagtccaaagctttctttttcacttaataataatactaagtcagataattggtaaaattcacttacgcaatcttgtttccctaaaaataaaacatcctcttctacgtttaactctttcgtcaattgacgcattggcactaattcaggaccatctccaagtaaaattaatttactaggtatcttttcacgtacttttgcaaatgtttctataatagtatctatgcgttttacttgtctaaaattcgatacatgtattaacactttttcatctggtgctataccaaattgtgattttaatgctgtgttatgtttagttggaaactcattttcacgtacaaaattataaatcggtataatttctttgttagtttcaataatttcatgtgtttcttgtgctaaagatttactcacacttgtcacaatatcacttttttcaatgccaaatttaattgcaccttggagtgaatgatcatagcccaaaacagtaatatcagtaccgtgtagcgttgtcataatttttatatctttacctgacatctcacgagctaaaatcccacaaattgcatgaggtacagcatagtgcatatgcaacaaatcaagatcatattctttaataacttcagcgattttagtacttaacgtaatatcatacggtggatactgaaatactgcatattgattcacttcaacttgatgaaaaatcatattcggtaatggttttcttattctaaacgggatatttgaagtgataaaatgtacttcgtgacctcgctctgctaatttaattcctaattctgtggcaataattccagaaccacccatggacgggtaacatgttatacctatcntcattcgcttgcccatcctttctttctatttctcnctatgatnctcgatgcgtaga

SEQ ID NO: 619 - DNA, 844 bp; double-stranded, linear
acaggtatggacttngctcaaatgacacgacattatttatcaagacctattgctataatcttttggatcattgcagaactagcaattatcgctacagatattgctgaggttattggtagtgctattgctcttaatctcctatttaacatacctttaatcgtcggtgcactaataactgtacttgatgtatttttactactttttataatgaaatatggttttagaaaaattgaagctattgttggtacattaattttcacagtgttattcatctttatatttgaagtctatatttcatcaccacagttgaatgctgtgttaaatggatttataccacatagtgaaatcattacaaataacggcattctctatattgcattaggtattattggcgctacaattatgcctcataatttgtacttacattcatcaattgtacaatctagaacatactcaagacataacaatgaagaaaaagcgcaaggattaaatttgctacgatagattcgaacattcagttatcaatcgcatttgtagtcaattgcttattattagtgttaggagcatcactattttkcaactcaaatgctgacgatttaggtggtttctatgatttatatcacgccttaaaaactgaacctgtactaggtgcaacaatgggtgcaatcatgagtacattatttgcagttgcattattagcgtcaggtcaaaattcaacgattactggtactttagcaggacaaattgtaatggaaggatttttaagattacacataccaaattggttaagacgtttaattacacgttctcttgctgtcattcctgttatcgtatgcttaatcat

SEQ ID NO: 620 - DNA, 574 bp; double-stranded, linear
tgtattgcagtcatgccataaattttttgaataataaacggagacgcagaaatataagtaaataatattacaaatgtcataccttggaatgagcattggtaatacaaaacgtggcgtcttcantaatattttgaagtttttaaacattgtctttaatccactacttgactcacgatttgtcactgttaatgattcaggtacttttaataaagaacctatgaccatgacgaagccaaagatagtcagaatgacaaagaccatacgccagacagaataatttaaaattatgccccctattgttggcgcaacaactggtgcaataccattaacaagcatcaataatgccataaacttagttagttcattaccactatacatatcacttgctatagctcttgaaataactgctgtgcgccacctgtcactccttgaagaaatcttaatgcaaccatcagccaaatattatgtacaaaaacaatacctaaacttgctaatgtaaaaataatcatagctataataagcggctttctgcgcccagttgaatctgaaattggacnagcaaccaaattaccaa

SEQ ID NO: 621 - DNA, 523 bp; double-stranded, linear
aagcaagagagagtacaacatttatatgatattaaagacttacatcgatactactcatcagaaagttttgaattcagtaatattagtggtaaggttgaaaattataacggttctaacgttgtacgctttaaccaagaaaatcaaaatcaccaattattcttattaggtaaagataaagagaaatataaagaaggcattgaaggcaaagatgtctttgtggtaaaagaattaattgatccaaacggtagattatctactgttggtggtgtgactaagaaaaataacaaatcttctgaaactaatacacatttatttgttaataaagtgtatggcggaaatttagatgcatcaattgactcattttcaattaataaagaagaagtttcactgaaagaacttgatttcaaaattagacaacatttagttaaaaattatggtttatataaaggtacgactaaatacggtaagatcactatcaatttgaaagatggagaaaagcaagaaattgatttaggtgataaat

SEQ ID NO: 622 - DNA, 1871 bp; double-stranded, linear
agaagtgtganaaaaatttaanagagatatgcacatagatgacgcattgctatatccaagcaattgagaaagctgctgatgctccaaatcacggaatgagggaaccatggagagttgtgcatgttccgaaagacagattaggagatatgagtaaggatatttctaaatttgcatttcctaatgaattagataagcaacaatgtcattatgatgcagttacgaaactaggtggcatgttattgcttattttaaaaacagatccaagacaacgtcaaaatgatgaaaactactttgcatttgtgcatatgcacaaaatcttatgttgttactttatgaagcgggaataggtacatgttggaaatcgccattatatatctatgatcctaaagtaagnaaacacttggtataaagnaagatgaagttcttgctggattcttatatttaacggatttagaagnagatatgcctaaagcaccacgtaaaaatagaaacttaattacattatattaatatgtataattatagaaacattaataaaagctgagtcatgaattgatggacatctatcgagttagagatttaatctaacttactagagtcggtacaataacagtctcagctttttattgtgcagtatatacacatttttattttagtatttatttaaaagtttctgctaaaaatgattcaacttgttcaggtgacttagcatttgctgaatgaaggtgtgcaattttatcgccgtttttaaatactagcaagctagggatacccataacttcattttcaacaactacatcttctaattcatcacgattaacagtataccattggtaatcattatattgttctacgattgggtcaatccataaatccatagcacgacagtctgggcaccatcctgcctcaaatttaacaattacaggtgtatcgctattaattacagatttaaatgattcattacttttgattgattgcattgtaacaactcctctagatagtttaataatttttattatagctaaatttatatcataataaaaaattttagcttcaaaatgaaagccttttgctttggaaaatgatatatttattttaaatacataaaggaggttgcagtcgtatgattaaattttaccaatataagaattgtacaacttgtaaaaaggcagcaaagtttttagatgaatatggcgtaagttatgaaccaattgatatcgttcaacatacacctacaataaatgaatttaaaacaataattgcaaatacaggcgtagaaattaataaattgtttaatacacacggcgcgaaatatcgtgagcttgatttgaaaaataaattacaaactttatcagatgatgaaaagttagagttgttatcatctgatggtatgttagtaaagcgtcctctagcagtaatgggcgataagataacattaggatttaaagaagatcaatataaagagacttggttagcgtaagtgaaatgtaagcgtttactaaatatctcgatatttagattcattacatgtaaaatgaaataagctatacaattgttaatttttataaatatagttgaatagcatctagccttatggcatcattaatgatgtaaagattaattaggaggggattctcttggcagtaccaaatgaaytgaaatattcaaaagagcatgaatgggttaaagttgaaggtaatgtagcaataattggaatcacagaatacgcacaaagcgagttaggtgatattgttttcgttgaattaccagaaacagatgatgaaattaatgaaggggatacgtttggtagcgtagaatcagttaaaactgtatcagaattatatgcaccaatctctggtaaagtagttnaa

SEQ ID NO: 623 - DNA, 451 bp; double-stranded, linear
ttgctgtagaagataaagagtcccatcaatggataggctttataggtttgaattatattccagaaacaagcgattatccatttaaagaattaccgctttatgaaataggttggcgcttgttgccagaattttggggaaaaggattagcaactgaaggcgcaaaggcaacattgaagttagcagaagaacatcaaatatacgatgtctatagttttacagcagaagcaaataaagcttcacaacgtgtaatggaaaaaattggcatgacagtgtatgatcatttcgaattacccaatctaagtaagtatcatttattaaaaaggcaagtgcgctattacattaatcttccgaaagtggaaaaatttatacataagcgtaacaaacaccccctaacattggtttagctggatggataacmatattagggggtgtttngtktnatttttttaan

SEQ ID NO: 624 - DNA, 665 bp; double-stranded, linear
cgatagttatctaaagccattttngattgtgttatgaaatctaatgatgcgtgataatttaatgcracataacgrtaatataaaatatcaatagtgaacatttgagcaaataatgaagttgttgctcccatatgcatctcattttcatcagttttcccataagttaaaacaatatttgatgcctgtgctacgggattatcccttgtactagtaattgtaattataggtatatggtagtcatcaataactttaaccattgattgcatttcactttgcgtaccattgttagtaataagaataacactgtcgttcgaattgtgagttgctaataatgtagcaaaaatatgtgtttcttgaacaagttgaatattaagacctattcttgataacttttggtataagtcggtagcaactacaaaagatgcgccaaaaccatatataaaaatcgtctcagaacgttttaaacaatgacatatttgatcaatagttttatcatttaattcgttatttgcatgattaagtgcgcgtgtagtacgtgtatggagtttagttcttaaagattctgtgctttcgttattcattaattcaacattgtaaattgatgatgctttaggaacatatttagatatatttattttcaagtcgtgaaaaccgccatcagtaat

SEQ ID NO: 625 - DNA, 2549 bp; double-stranded, linear
gatgccaattaaccgtgcatataatgttgagaagttaatcgaagcaattcaatattatcaagaaaaaacaaatcgtcgtgttacttttgaatatggtctgtttggtggtgtgaatgaccaactagaacatgcaagagaattagcacatttawtaaaaggcttaaactgccatgttaacttaattcctgtcaaccatgttccagaaagaaattatgtgaaaacggctaaaaatgatatctttaaatttgaaaaagaattaaagagactaggaattaatgccacaatacgtcgtgaacaaggttcggatattgacgcagcttgtggtcaattaagagcaaaggaacgacaagtagaaacgaggtaaagacaaatgctagaggcacaattttttactgatactggacaacatagagataagaatgaagatgcgggtggtattttttataatcaaactaatcaacaacttttagttctgtgtgatggtatgggtggccataaagcaggagaagttgcaagtaaatttgttacagatgagttgaaatcycgttttgaagcggaaaatcttatagaacaacatcaagctgaaaattggttgcgtaataatataaaagatataaattttcagttatatcactatgcacaagaaaatgcagaatataaaggtatgggtacaacatgtgtttgtgcacttgtttttgaaaaatcagttgtgatagcaaatgtcggtgattctagagcctatgttattaatagtcgacaaattgaacaaattactagtgatcactcatttgttaatcatcttgttttaacgggtcaaattacgccggaagaagcatttacacatccacaacgtaatattattacgaaggtgatgggcacagataaacgtgtgagtccagatttgtttattaagcgattaaatttttatgattatttattattaaattcagatggattaactgattatgttaaagacaatgaaattaagcgtttgttagtaaaagaaggtacaatagaagatcatggtgatcaattaatgcaattggcattagataaccattcgaaagataacgttactttcatactcgcggctattgaaggtgataaagtatgataggtaaaataataaatgaacgatataaaattgtagataagcttggcggcggtggcatgagtaccgtttatcttgctgaagatacgatacttaacattaaagttgcaattaaggcgatttttataccacctagagaaaaagaagaaacattaaaacgttttgaacgagaagtacataactcatcacagctatcacatcaaaatatagtaagtatgatcgatgttgatgaagaagatgactgttactacttagtaatggaatatatcgaaggtccgactttgtctgagtatattgaaagtcatgggccattaagtgttgacacagcgattaattttacgaatcaaatattggatggcattaaacatgcgcatgatatgcgtattgtacatagagatattaagccacaaaatatattaattgacagcaataaaacgttgaaaatatttgattttggaattgctaaagctttaagtgagacgtctttaactcagactaatcatgtgttaggtactgtgcagtacttttcgccagaacaagcaaaaggtgaggcaacggatgaatgtacagatatttattctataggtatkgtgttatatgaaatgcttgttggtgaaccaccctttaatggagaaactgcagttagcattgcgattaaacatattcaggattctgtgccaaatgtgacaacagatgtacgtaaggatattccgcaatctttaagtaatgtcattttacgcgctacagaaaaagacnaagcgaatcgttacaaaacaattcaagaaatgaaagatgatttgagtagtgttttacatgaaaatcgagcgaatgaagatgtctatgaactcgataaaatgaaaacgatagcggtacctttgaaaaaagaagatctagcaaagcatattagtgaacataagtcgaatcaacctaaacgtgaaacrwcgcaatacctattgtaaatgggcctgctcatcatcagcawttccmraagccagaaggtacggtgtacgaaccaaaacctaaaaagaaatcaacacgaaagattgtgctcttatcactaatcttttcgttgttaatgattgcacttgtttcttttgtggcaatggcaatgtttggtaataaatacgaagagacacctgatgtaatcgggaaatctgtaaaagaagcagagcaaatattcaataaaaacaacctgaaattgggtaaaatttctagaagttatagtgataaatatcctgaaaatgaaattattaagacaactcctaatactggtgaacgtgttgaacgtggtgacagtgttgatgttgttatatcaaagggccctgaaaaggttaaaatgccaaatgtcattggtttacctaaggaggaagccttgcagaaattaaaatcgttaggtcttaaagatgttacgattgaaaaagtatataataatcaagcg

SEQ ID NO: 626 - DNA, 2286 bp; double-stranded, linear
tgcttacttcgccttcaatacgtactaattcatgtccacaacttggacaatgggttggcatatgatatgtgacagcatcctcaggtctacgttctggaatactacgtacaacttcaggtatgatgtcacctgcttttttcactacaacactatcaccaattcgaatatctctgtcatgaattaaatcctcattgtgcaaagatgctcttgatacagttgtaccagctacttttactggttctaaaatagcagtaggtgtgactacacctgttcgtccaatacttaattcaatatctaataatttagttactacttcctcagctggaaatttataagcaatggcccatctaggagatttttgtgtgaatcccatctcatcctgttgatctaaatcattaaccttaataacaatcccatcaatatcataaggtaatgactctctttggcttgtccatttttcaatatactctaaaacaccatcgatattatttacacgcgctctatttttattcgttgtaaaacctaatttatctaactcatctaatgcttcactttgcgaacgcgcattgaaatcagtgaaatcattgacactatatataaatacgcttagctttcgttttgccgttaatttagaatctaactgtcttaatgatcccgcagcagcgtttcttggattngcaaataactgctcatcatttttttctttttcttcatttaatcgtaaaaatgaacgtctcggcatatatgcttcaccacgaacttctacatttaatggttctttcattttcaaaggtatcgcatgaattgtttttaaattttcggtaatatcttcacctgttgttccatcaccacgtgttaaaccttgaacgaagtatccatcaacatatttcaatgatactgctaagccatcaatttttaattcgcacatatattcaacgttgccaatttgttcacgtatgcgttggtcgaattttctcaaatcatcctcattaaatgcattccctaaacttaacattggcgtgtcatggttgactttattgaaagaggcttgggcttcaccgccaactctaactgttggagaatctacagtcttatactcaggatgctcctcttctattttaatcagttcatgaagtaatttgtcatattcactatctggtacagatggattatcctctacatagtattcataactgtattgatttaataaatcatgtaactcgttcacacgagacgataaatcagccatcccttaatcctcctttttttcaattggtgcaaattgcgctaacaaacgttttggcccttgtgatttaaagataatatctagttcgattgagccatttttctcgtttacattactcaccatgccttctccccaggctttatgcatcactttgtcacctacattccaatcagatgacaatacttgttttttcgttgacgttgttcgttgactaaatccgcgtttagcaaaaggttttgccttaggttgtatcgtttgtcgtttgccacttgaatgattttctaatagtgattctggaatttcctttaaaaatctggatggcatatttgactgagggcgaccaaataacattcttgatgtcgcatgagtgatatataacacctcttcagcccttgtaattgctacataacaaatacgacgttcttcttgcatttcatgatcatcttcactcttaatcgctctaatatgtgggaataaagattcttccatccccattataaagacaattggaaattcaaggcccttagccgagtgcatcgtcattagtgttacgccattttcagtatctgcctcatcaatatcagctactaacgataaatccgttaaaaagttaattaatgactgttcttctaatggggtattttcctcatagtcttttggtactgacataaattcatcgatgttttctaatctacttcgagattctaatgtattttcacgttcaagcatttctcgatagccagacttttgtaatacttcatcaactatttcatgaatttctaaaaattcttgttcttttatcaagctttggattaactcgtaaaaattaagacactcttgtgtcaccttttttgacaatccgataaaatcagcttctccaagtgcatcaaacatactgatattgttttgaagtgcatagttttgaactttttcaacagatgaaggacctacacctctttttggaacattaataatacgttgcaaactaatgtcatcattactattggcaattatacgcaaataacttaataaatctttga

SEQ ID NO: 627 - DNA, 400 bp; double-stranded, linear
gaagaatattgaagtaggtgaccaaattgaagtcaaagtcacagaccctggattccctagtgacattaaaagttgggtgaanaaacaaggcatactttagttaagcttgatgaaaataacaatggaattaatgcgattattcaaaaagaaaaagcaaaagatttagatataaattattctgctaaaggtactaccaattgtattatttagtggagaattagacaagctgtagcagcgttgattattgccaatggtgctagagctgctggaaaagatgtaactacctccttactttttgggggcttatgccnttaaaaaagtgccaccgttaatgttaaaagcagttgccaaaatgtttgattnatgttgccccaaaagatttacgatgccccttcccaaa

SEQ ID NO: 628 - DNA, 453 bp; double-stranded, linear
aataatttgggcgctntttgcgtcgggatattataccgcttccttaattgttcaacattgtaatcactgtttttcaattgatattttgcagagtaaattggtacttctgggttatatgacacttcgtcctctttatagttttccaattctttgaaattcccgtattgtacaaagaagttaaattcttcgatttctttttttactttttcgtcatcgattggttttaatggaatcattttattaktttccattttcacaggatatctttttgtatgattgtgtgtcattccatcgctatcttcaacaacttctctaacaatataatgccctttagccgttctagtatttctgttaatttctaaaactgctcctctrgattccagattttctccttttaattggattttcatttcagatctaattagccaagtacctttatcatcttttttaaat

SEQ ID NO: 629 - DNA, 1221 bp; double-stranded, linear
tcatatgcatttgcaaaataaacgccagaagcaaggtttagaattgggccgtccgttttgctcaattcacttgcattcaataattcatgctgatcatgatcaatttgcttatctaattctgcaattttcttcatttgcttatctgatttgttttctttcgccatcatttgatcacgacgattttctttgtcattcaattcctgttgcaactttaacacatattcatcaaggtcaatatatgctaatggtactaatactttatctccatatgtgtcaataaagttataaaaataatcatctgtttttgatacaaatccagcacgctcttcagtttcacgatataaatctaagaaaagattgaactcatcacgttcaaggaatctgactttaacaccatagtttatcgctttattaatattacgtttacgttgactatcaaatgtctttttcaatgtttcgggtgttttaccttcaaggtttaatacgcccatccatcgtacttggctcgatgtatcatactcagttgtaaagccatgatgctcgtaaccatgtgatttaaacaagtttactagggcatcatttttctcgcgaccttcaaatggcacgatatctttatcatatagatgatataaccaatacggatctaatttaacatataaacattgatgttgctgtaaatatttatctaactcttttaaataataatcaactaatcctaaatctgaaaaatccattactggaccacgattcgaatagtaaacataacttcccatagtaggaattttagagaaaaggcttgctgcaattactttgttattgtcgtctttaatacctaataaaactacttcaaagccatcattctcacgggtaactatattttcttttacttggaaataatgactttccaatgatggattttgtacaaagttgtcaaattcggtaacagttaactctgtaaatttcatgttttgataattccttcctaaaaaattctgtctttaacttttttaagtgcggtatatgctgcgtaaacaggtttattaattggtttaataaagtcaccaacatattcmataatttcagcattgtaaccttttttgaatttaactacaccagcatcttcagcatcttctgtaaatttrccactaacaccatagaaattataacggtcaatgcatgatttaatgcataattaatcatttcccattgcactgcataact

SEQ ID NO: 630 - DNA, 1121 bp; double-stranded, linear
tggcccaantaacacaagtaattgctgctaatggtaacatcacaaaaaatgaaatcgtaactacaaatgttaaaccttggaatacaccaaccatttctggtaatcgtttactatagtatctattgtgaatccaagtaataatagctgaaataataataccacctagaatattcgtatccaatgtggcaatacctgcaattgattttaaaccaggtacattttcaacgcctttttctaaattagcgccaaacgtatgtggccattgtgttaaaatggcatttataaatgtattaaacattaagtaacccatcaatgctgcaagtgctgcatgacctggtgcttttttagctaaagaaagtggtagacctacaacaaatacaacttccatatgcgtaaaaataacccagccaccagattctattactgaccaaaatttaaaccaaaacgtatgttgatctgctaaactccccatgattgtaggatttttaaataatgtcgcaaagccaagcactatcccaaagaaagcgaacattaataccggtacaatcattgcactaccgaaacgctttatcgcattcatcttctattccctccatatcatctttcctaacaatacatctaattagattcatttataaatagatgtcttactatttaaatataatatatagtaaacgcttacacacctacaacgacattgacgtattttgaaagtattttgtataatcagattatcttttcatatagtgaaaattttttcacgaccttatatatgacatcgttgtatttgtaatacattcgttttaaacgcataatcaaacctatatcaatacacaaatatatataatgacatacaagattttaatgtaataacgatctattacacatttattttcaaggaggttgaatatgtttttagatgaacacattaatcgaaactttgataaacttaatgataatgatttacatatcgctcactttatcaatacacatatagatgaatgtaaaaatatgaaaatacaagatttagcgcaattcacacatgcctcgaatgcaaccattcacagatttacacgcaaatnaggttttgacggtnatagtggatttaaatcgtaccttaa

SEQ ID NO: 631 - DNA, 4005 bp; double-stranded, linear
aaccttccattttacttgatcgataacatcagttctgctttacaaatctcttcattaatatgcgtcttaaaaccatgaaatttaacatgttccgataaatgataatcttctacaagttgtcgatattctgacaaaccatttccatgtccataaatattcaattgaatattgggatgttttgttactaattgcttgattacttcaatttgatgtttaatttgtttattttcaacgaggcgagcaattgatatgatatgatttttctccttttgattgatgtcaaattgatactttaaatttgccacgtagccaaccggaatattgataactggtattttattttcaatatattgtgaaatatcttggcattgcttttctgttgatacaacaatcgctttataacgtgttaaattattaaacactgttttataaaaactttttataccattaccggcaccggataaatgtgtactatggagcacaacaataactggaatactttgatttaatcccgctataacatttcctaattcatgaggacgatctaatatgatttgatcattatttttacataattgatggagaaaatattgaactaattcatcttctgtatcaaaaaattgttgatgctggtcttcatttaagataacctttgtgagcgtgtttttcccttttatatcgtcaaaatatttttggatgacgatttccccattaggtgtatagtaattttcgagtacaatccgttgtccttcacctaaaattcgagaacaacttaaaaagcctcttccatcatacaattcgcgttttacttttcttcttttatgatcaaaataattcacataatttaattgatgatactgtttatctaaaaaatgagcatacattacaaattgctcttcatcatatattctgacatcatttgaattttccacaaatttcaatgtgtacctacatgacttttcccaatactgtatccagttaacttgctttgtctttttataattgattgctttttgaaaatagtcatacattgtaaatacatcattttcaatctgatgttgcttcgcatatgtgtatgaataaggattccatttaacatatacacattttgaagatatgccgtgttgtttgaacaacttcaatctatttatttgcgctttttctacacctgtaattttactttctaaaattgttcctaaaatgtaattcatattatcgcctcatataagttttattccgtatctttattgtttattttatatgaaaaatacatctattgcatgtgtaattataaaaaaaccaggccacaaggacctgggtcatattgtattatttgttttgttttttgcgacgaccgaataacaataatgaacctaatgctgcaaataatccaccaaataacgttgcgttatttgagccgttattttcactacctgtttctggtaatgcttttgctttattgtgatggtctttagtagtactcattggtttaacaggtgtatgttttcctgcatccgagtctgaatcgctgtctgaatcactgtctgagtctgagtcgctatcagagtctgagtcgctgtccgaatctgagtcgctatctgagtctgagtcgctgtctgaatctgaatcactgtctgagtctgagtcgctatctgagtctgaatcgctgtctgaatctgagtcgctatctgagtctgaatcgctgtctgaatctgagtcgctatctgagtccgaatcgctatctgaatctgagtcgctgtctgagtctgagtcgctatctgagtctgaatcgctgtctgagtccgaatcgctatctgaatctgagtcgctgtctgagtctgaatcgctatctgaatctgagtcgctatctgagtctgaatcgctgtccgaatctgagtcgctatctgaatctgagtcgctgtctgaatctgaatcactgtctgagtctgagtcgctgtctgagtctgagtcgctgtctgagtcactatctgagtctgaatcgctgtctgatgtatcttcttcgaagtatccgttatcaagtgtgaaatcatcatgatccgtaattgttacgtcaacttcgccaccatctgcatctttatcatcttcagttgtatttgtaactgtttgtgttaagccagcaggcttttcaaaaataactttgtatttaccgctatctaaattatcaaagcagtatttaccattttcatctgttttagttgttccaattacttcgcctttttcatttaataaagtaactttaacatctttgatacctttttcagttgaatcttgtttgccgtctttattactgtcgtaccaaacataatcacctaaactatattttggtgttttatagaaaccactgtctaatgtcatgttatctgcatctttaatgacacctgttgttgttaaaccattagaatctttttcagtatcatttccagaagttactgaagttggtgtataacctgatggtgtctcgaattcaactttataagttccattgtttaaatcagtgaattgatatttaccattttcatctgttgtaactgtttttaaaactttgtcgttttcatcttttaacgtaactgttacacctgaaatgcccttttcatctttatcttgaacaccgtttttatttgtatcttcccatacatagtcacctaagttgtaagtcggtttgtagaaaccagagtcaatagtatcgttatctttatctttaatgacacctgttgttgatgtaccatttgaatctataccttcatcagttcctgaacctacttgtgttggtgtgtaacctgatggtgtttcgaattcaactttataagttccattttctaatccagtaaattgatatttaccatctttatctgttttagttgtttgtaaaacttcaccgttttcatttttcaatgtaactgttacgcctgaaatacctttttcagttgaatcctgcttaccatctttatttgtatcttcccatacataattacctaaattatattttggtgttttgtagaatccactatctaatgtcatgttatcagcaccattaataacacctgttgttgttaaaccattagagtctttttcaatgtcgctaccagatgttactgtagtcggtgtatagccttctggtgtagtaaattcaactttataattaccattatctaaatcagtaaatttatatttgccatcagcgtctgttgtaactgtttttaacagttaccgttttcatcttttaatgttaccgttacgccagatatacctttttcatcttggtcttggataccatttttatttgtatcttcccagacatagtcacctaagttgtatttaggtttgtaaatacctaagtctgcagataagttatctttgccattaactgtaataactgaagataagccgtttgaatctaattcttcgttattaccttgttttgaaggggttacttcataaccttttggtaagtttgaaaattctacacggtaatctccattaggtaagtttggaatcaagtatgacccatcttctttagtaactgcttctcctacttttgtatttgtattattatcaaatacagttacagttacattgccaacgcctttttctcctaattcttgaacaccgtttttattagtatcttcccatacgtagttaccaattttatatacttcttgaccagctccgccactttggttattagtaaatcctaaagcattgccagtagaaacggatttattacctgttgaagataaagtagccatttgaacaagtgttgggctttcgctatttgtatattggaattttgtattaaccattacaacataagcagaatctgcatttccaaaatcaataacagcgctattgttgtcgccatatgtaattttctgcaagtattgatttgttacatctgtaagctctttagtattcacatcgtatcctttatttaatgtataacctttaggaacttgatatatttttatatctgttacatctttattt

SEQ ID NO: 632 - DNA, 1440 bp; double-stranded, linear
tattaggttactctagtttccaaagcgggaattttaatgttattaacagcaaggacagcaaaagcaatatcggcgcattgattgaaaatccaggaatatatccttttatgtctggatatgaaaacttgaagttattgaatgaatcaaaaaacactcaagatatcgataaaattgtctcacaacttcatatggatgaatacattcataaaaaagctaaaacgtattctcttggtatgaaacaaaaattaggaattgctatagcatttttaaataaacctcaattcattatcttagatgaaccaatgaatggcttagatccaaaagctgtgcgagatgtacgtgaattgattgtccaaaaagcgcaagaaggtgttactttcttaatttcgagtcatattttaagtgaattagttaaaatcacaaactctatccttattattaacaaaggtaaaattgttacagaaacatcggaagaagaacttaaacaatttaaagataatgatttagaaaatgtattactagaaatcatagaaagggaggaccaagcataaaatgggaactttaattaaacaagaatgtttcaaattatttaaaaagaaatcaacttttatcgcacctattgtctttattctactaatggttgctcaaggttatattgctacaaaatacaatgaaatttttacgccacaggaatctttcacatctgcttataatggtttttcatggtttgcatttttattaattattcaagcaagtacaatcatttcaatggaatttcattacggtacgattaaaaatttactctatcgtgaatattcaagaacaactatgattgttagcaaaatcatcacattatttattatttctttaatttattttgttattacaattattgcttcaattgttattgggtctttattctttaatgatttaaatatatttgaaagtagcggtaatcaattatctttattgaatcaattattattagttagtttaggcacatttgttggcgtttggttagttttaagcttaacgttgctattatcatctgcaacaaattcaacgggagtagccattgctgtaggtattgttttttattttgcaagttctattttagcagttattcaaacggcacttttagaaaaaatagactggctaaagtggaatcctattaatatgatgaatattatgcttcaaacagttgaaaaaggctttagtaagtcgacaaaattagaacttcatgaattgtttattggtaatattgcttatatttctattttcttaatacttgtagtatttattttcaagaagaaaaatatttagtaacttaaagtattaaatgtctaaatacacacatattccatcgtaattcaaaatcattttcaaatcccttcacccaaataatggtgcggggattttttcatccaaattttggaaatt

SEQ ID NO: 633 - DNA, 1323 bp; double-stranded, linear
gctgacataattgcatcaaatttcacatccccataaaaatcgctaccacataacctacgataatacctacaagaactggaattaaagataggaatcctttaaaaaatccttgaacgactattgttacaagcaaggttatcattgcaacaattaagaaactgatattgtaacctttcatatctccaggattttcatacattgccatattgactgcagtaggcgctaagcttaaaccaattaccatgatgactggtccaacaacaactggtggtaataatttcattaaccatgctgtcccacttaatttgattagaatcccgatgatgacgtacataacaccactcatgaataatgctacaagcatgtctcctaagctatgcgtacttaatcccgtgataattggcgtgataaatgcaaagctagatcccaagtatgctggtatttgcgccttcgttattaagatataaagtaatgtaccgattcccgaagctagtaacgctgctgatattggtagtcctgttaagaatggtactagtactgttgcgccaaacatcgcaaataaatgttgtaagcttaaaaatgcccattgcgctggttgtggtttttcatttacatctagtacgggttttactgttcgttcaaacatttcatcattttgcataatattcatttcctccgataataaaaaaatctctttacatcagtatatgtaaagagacaaaaagtgtgacaagttgctacaagtcattttcgtccatagaaattgacttatagttgtcgaacatgagggtattattagataaacaagcatatgaaaacttatttatcattcaactcccccacctttttcagtctctcgtactgaattaaaaggggtattatttaattataactgcatttctttgatccatttcttcyaaatagacacttaccgtttcctctttagaagtaggtawatttttaccaacaaaatctgctcgaattggtaactcacgatgtcctcgatcaaccaaagcagctaaaccaattttaataggtctagcatttagcaaaatagcatcaagtgaagcacgaaccgttcgaccagtatacagcacatcgtcaataatgatgactactttatctgtaatatctgtgtcgatgtctattgcgtcttttgtcgtaagtgatgacatgtgctctatatcatctctaaagtatgtaatatcaattgttccagtaggtatacgttgttgctcaatttgatgaattttatcttgtatacgattcgctaaatattcacctcttgtnttgatacctaaaagattaaattatcagtacctt

SEQ ID NO: 634 - DNA, 761 bp; double-stranded, linear
acccatctcatcgtattttgaatttaatagacgagatcgatgtatatctgaattcatcccaactatggattaatgttggtacatcattaacgcataaccaacattttgagcagttgttttataagtaacgtgatttttatctaattgccctcttaatgcgtcctctgtaaattcaacactatcagaaccattagaggtcgcttcatataagttattagatgcaatatgtgctaaatcgctattgattttcaatggttttaatccttttaattttctcatttcattcgttacttcataaagagaaattaattgatttggattttgctcaactggacgcttattatgctcttctgacgtagaattagaatttaattgataaggttcaatatctgctaacatttcttttgttaaaaatcgtacacttagcacctttttcgattgttgatcagaatacacttgtgcatatatgtcgccatatttaatcagtgtttgtgtttttaaatcttcatctgaaagttcaaattcatattttttaccatcaactttaaaggacggttctggattaatacttgtatgattaaaaatttctgcagaatgttgtcctatttttaacggactaacattgactttctcacctgtagcatacactgaaacgatttcttcacgtttagttgaaacaatgtaataactgtttttgtctttaaacacataatttttgtarccatctctaaaagggtagacrcgatctgcttgtccaaatt

SEQ ID NO: 635 - DNA, 827 bp; double-stranded, linear
ntaaatatatttatatattatagaatagaaagacctgaagattgaatatctttcgcaaagcctttaactgtatctactgataattcgttaatatcgcgacctaagtttgtattcacttttttcacaacatctgctgggcatgtaataatatctgcaccaatttcatcagcttgaatcacattgaataattcgcggcaacttgcccataataatttaacgccgtctttactatgcgtaactttnacagcctctktcattaatggtaatggatctacgcctgtatctgcaatacgtcctgcaaatactgaaacatatgttggcacaccttcagttactgcttcagttatttctttaacttgttcaattgtgtaaacagccgtaacgtttaatctcacattgtcagctgaaagttttttaattaaaggaatcgttgattcaccttttgtatttacaataggaattttaacaaatacattttcgccatattgttttaaaattgctgcttctttktccatagtttctaaatcgtctgcaaatacttcaaatgarattgaagcatctggaatttctttcacagcttcttcagcaaaagctttgtaatctgttacgcccgctttagccattaaactaggatttgttgtaaaaccatccacttgtttgtttttataagctgctttcattncttcaatatctgcaccgkccgcaaatacttctacatttagtttagccatataayatagcctccttgattcttattaaaattttaacaacatctgcatgkctttttcttacaaccatttgtaaaaaatgatttttatttctttgtt

SEQ ID NO: 636 - DNA, 1478 bp; double-stranded, linear
ttagtcggtataaccatcggctaggtggtttttgtattaaaaaagtggataccaaaatttattaataattattttaatgttagaaaaaaactaaataaaaactcgctaatgatatccaataatatgtatacaaaacgagacatatattgcatatgattaacgagatactgaaaatattttatcacccctaaaatgattattcattttcagcggtaattcgacctaaagtcaaacttacaataaaaccgatgataaatactactaatgaaacgaaccacatcacgatattagttggtaaacctggaaatactgcaaagagggagccaacaacaaaaccaatgattaatgcaaaagtcattagtttatgatgtgttaggaaatactggataattttgcttgaaataatgaatccagcaagcacgccaaatccgactgcaagtaatataggaagacctgcaaagttaagtttaacaacttcagatattgctagcatgaccgtaccatagacgccaaatactaataacataaatgaccctgaaatacctgggagtaacatagcactagatgcacacatacctgcaataaaatatttaataataagactagttgatagagtaagtgtttctccagcatgtttatcaccattattcattaatgtaataacaattaagatagcgataccagctataaccatcatgtaatgtytagttgtaaatgacgttttatagttagaaattttcaataaatatggaacgataccaatgattaatccaccaaagaaaaacatagttggaatatggtgttggcttaataaataattaaaaagattacttagtgatcccattgccagtaacattccaattataatggggattaaaaatgtaaaacttggccaaaaacgtcgtgagaatatgccgctaattgaagcgataaattgattgtaaatacctaacaataatgcgatagtcccaccgctaacaccaggtaccaagtcactcgttcccatagcaaaaccttttagaatattaatccatttaaattgttgcatgaataactcctttcaaacgattggaataaaatcataaatagcatcataccatattacaaatgtcctagtgaaatgataacatattttaaattcataaaatccattgagaaattatgtgcacttattatcatttatatttttaaagagagcggattagagttgtactttagagttattaaaaataataaaaagggtttaagttgtttatattaaggtataagtaagttataattaactgaacgcattattacaaagtctttttgactacaaattaaaattattataaactagttaagaaaactttatattttacggagggaatataaaatggcatcaacattagaaatyaaagacctacatgtgtctattgaggataaagaaatcttaaaaggtgttaacttgacaattaacactgatgaaatacatgcga

SEQ ID NO: 637 - DNA, 1995 bp; double-stranded, linear
attacagcatcttctctaggtagattattaaaagatagaggtctaaatgtaacaattcaaaaattcgatccatacttaaatgttgacccaggtacaatgagtccttatcaacatggtgaagtattcgtaanggatgatggtgcagaaactgacctagacttaggacattacgaaagatttattgatattaatttaaacaagttttcaaatgtgacagccggtaaagtgtattcacacgtattgaaaaaagaacgtcgtggtgattacttaggcggaacagttcaagttattccgcatattacaaatgaaattaaagaacgtttattacttgcaggggaaagtacgaatgcagacgttgttatcactgaaattggcggtacaacaggtgatattgagtcattaccgtttattgaagcgattcgtcaaattcgtagcgatttaggtagagaaaatgttatgtatgttcactgtacattactgccttatattaaagctgctggagaaatgaaaacgaagccaacacaacatagtgttaaagaattacgaggcttaggtattcaaccagacttaatcgttgtaagaactgaatatgaaatgacacaagatttaaaagataaaattgcattattctgtgacattaataaagaaagtgttattgaatgtcgtgatgcagactctttatacgaaattccattacaattaagccaacaaaatatggatgatatcgttattaaacgtttacaattaaacgcgaaatatgaaacacagcttgatgaatggaaacagttgttagatatcgttaataatttagatggtaaaattacaattggtttagtaggtaaatatgttagcttacaagatgcatatttatcagttgttgaatcattgaaacatgctggatatccttttgccaaagatattgacattagatggattgattcaagtgaagtaacagatgaaaatgcagccgaataccttgcagatgtcgacggtattttagtaccaggtggatttggtttccgtgcaagtgaaggtaaaattagtgcaattaagtatgctagagaaaacaatgtaccattctttggtatttgtttaggaatgcaacttgcaacagttgaattttcaagaaacgtattaggccttgaaggcgcacattcagctgaattagacccagcaacaccatacccaattatagatttattaccagaacaaaaagatatcgaagatttaggtggtacattacgcttaggcttatattcatgttcaattaaagaaggcacattggcacaagatgtttatggtaaagcggaaattgaagaaagacatcgtcatcgttatgaatttaataatgactatagagaacaattagaagcaaatggtatggtgatttctggtacaagtccagatggacgtttagtagaaatggtagagattccgacaaatgtttctttattgcttgtcaattccacccagaattcttatctagaccaaatcgtccgcacccgatttttaaatcatttattgaagcttcattaaaatatcaacaaaataaataaatttgctaataaaaccggtactttcattgttaaacattgaaagtaccggtttntcgtataattttaatattatgttagtgacaaggtatgaaataacaatagtgacttttataattctaagtctcttgtcatttcaatcatttgtgtataaatgtcatagtatacataattcaatgccatcgcatgtggtyggacaatcttatcgtaatcttcagtgtagactataggtcttggtgtagataaatcgataaaatgtacgagatgatcagggaaatcatctgttttaggtttgttgcttattaagaccacatcgatatctaagtcgataagtttttgaatatctaatgcaacttgatyattataaaatggtgcgaataataatacacgatcagttgagtcaatttctttaawktctttaatagcgtaagtttncggctag

SEQ ID NO: 638 - DNA, 1107 bp; double-stranded, linear
attagtgatgaaagtcagattgaagctttattaacagctgaaaaatattcagaaatgattggtgaataatcaccgtgtaactccttaatctaagattgaggagtttatttttagtctgagaaaataaatgatatgaaagaaaaattattaggtactattatttggagtattgctacattttattattcaagaatgatggaaataatgaatttagctattttaaaaataaaaattgggggaagttaatatgctaaacattcaagacgttancatnctttctaaaaaggagcaaaaagcatataaccgtttcgtagaatctgtagaaaacggtaatttaccagtactaccatgtattgaaatggatctaaaagagatgcaagaagaaacattaaaccagagtaagattggtggaatgccatttttaaaatcttttaaagatataccattagatgaaaataatgtaccaatggtattgctagcacagattaatttggatgatcttccagaacaacaagaattatttcctgtaaaagaagggatattgcagttttggattagttcagaagatcaaatgtatggaatgtctgaaaatttaaagggaaacaatataaactcaaggcttgtttatataaaagagccaattacagatttatcactcgaaaatattcaagcgcatttgaagtcattagatgctgataatgaggatatcccgttcagtggagcattttctatagaatttagattgtcgaaacaaactattacatgtactgattataagtacgatgaggacgtgcttgcattgtggaataaagtcaatccatccttcgcgctaaaatcaatgtttggtggttatgatgaattgatggaacctgtgtgtamcaywtttactgctaaggaaccatttaatcaacttggtggttatccatattttgaccaaatagatccaagaacgaacgatcaagaactgaaaatgtatgatagagtcttactgcaaattgattctacaagagatggtaattcttcgattatatggggtgatttaggtattgccaatatcttagtgaaatctactgraccttgaggctatgaagttttgaatgattacct

SEQ ID NO: 639 - DNA, 904 bp; double-stranded, linear
attcatattattataaattatttctacaccatcccaattgagttgtttttcataatttaaatgtaattccactaactccctaccaatttcaacaaatccatatacatcctttaatatcggtattcgcggaaaacctttactcaaatcacttgaatatttgttcacataatatttatgatgcaaaattgcatatatataatatactatctcttctgaattaagatttattttctttttaaaagaattaggaaatattatctacargcctcaaactatctttacctttgtatgtagcaaagccttkgccattaccaataaattggaaattaggtaatatgtccgtgatcatagccgagaattctttattcattccctgtccttgtatataaatcacctgtccagtattctccattatattataatatctacttggcatttccataatatttttgtcgtacactatccatttttttgtaaatggtctatgcataaatttaacaattctctctggattaattgaaatattttttcctttagaaaatttttgggtaagtcctcgtgtccaactaataaatgtttcatctttgttcactaaatttatacgttctcttgaatctaagatatcaattaatctatctatttcagaattatagttatctacaagtaattttgcatttactaatgctttttcattcgaaaaatttgttacccaattatctcttgctgaatttactccattaaatkgakctaaatatatagaattttcaatatccttggaatcatacattggtaaataattccccatagtttatgtctcggtgattaatccaatcattggggtttaancggggaaaaccattccaactttccaaattcaccaattgaatgganggttccattaaag

SEQ ID NO: 640 - DNA, 436 bp; double-stranded, linear
cgatgtctttactattagacttagccattggtttcacctctccaaaaattgtaaatgtgtatcatcaatatgaaagttacataaaactgacatatttctttaaaatatcaacgccattgataacttcctgttttaattgatacgctgtaacaaaatactatagttagtgcttacatgtatatgttaaagcaagcagtggtaaatgtaaattataattattcattaactttgcaatatattaaatcttttattcatagaagataaatatcaaatcaatcataattatttgacaacaaatagctaacgattgttttaatctacatttggcttatagcattttaaacctatactctattttgatacaatataagtgtaaaatcaatcataaaaaggatattcaatatctgcatccaagaaaaacattacaattaccttt

SEQ ID NO: 641 - DNA, 442 bp; double-stranded, linear
gttattaaattcagagtggtagcaaattaaagttantcaagagttaagatgaatttaattcatgaacacgtctattatttttataattgtagcaaataaagctttacatcaaggaggtaattaaatatgttcaaaaaatatgactcaaaaaattcaatcgtattaaaatctattctatcgctaggtatcatctatgggggaacatttggaatatatccaaaagcagacgcgtcaacacaaaattcctcaagtgtacaagataaacaattacaaaaagttgaagaagtaccaaataattcagaaaaagctttggttaaaaaactttacgatagatacagcaaggatacaataaatggaaaatctaataaatctaggaattgggtttattcagagagacctttaaatgaaaaccaagttcgtatacatttagaaggaacataca

SEQ ID NO: 642 - DNA, 2472 bp; double-stranded, linear
ccaattttggtatgaattatacagataattcngcgcccggaggatcatttgcttatttaaatcaattcggtgtggataaatggatgaatgaagggtatatggcataaggagaacattttaactactgccaataacggaagatatatttatcaagctggaacttcattagccacacctaaagtttcgggagcactagctttaatcattgataaatatcatcttgaaaaacatccagataaagcgattgaattgttatatcagcatgggacatctaagaataataaaccatttagtagatatgggcatggtgagcttgatgtgtataaagcattaaatgtagcaaatcaaaaagcaagttaataaatcaaaggagtttttgattatggcaaaattagttactgaaaacatttcgaagcggtttaaaaatcaagatgtattaaagcatattaatatcactttagaaaataacgaagtttatggattacttggtattaatggagccggtaaaacgacacttatgaaaattatatgtggcatacttcaacaagattcaggggaaattaaattagataatagaccaatgacacgaaatgatttgcacaaagttggttcgcttattgaaacacctgcgacatataatcatttaagtgcacaagataatttgaaaattgtgtgtttaaatgaaagcgttgatttcagcgaaattaatagtgttttaagcttagtcaatttaaatgtcgataaaaagaaaaaggttaaggacttttctttaggtatgaaacaaagacttggaattgcaatggcattaattaaaaagccagaaattttagtattagacgaaccatctaatggtttagacccatatggaatccaagaacttagagaacttctaaaattattaacagaacaaggtactagtattattatttcaagtcacattttatctgaaatccaagttttagcagatcatatcggtattattcatgagggtgagctaaaatatcagcaaagaaataacaaagatgaaaacttagaagagatattcttcaaaataacgaaaggtgattacaaatgatacatttaaagatagaaggtatcaaatttaaaaattctttcagtatgtatgttttattaataagtccgctggtatttctttgttttgctattttcacagtcttattcgccaaaagtaatacgggaacagcgaatagtgtgtcaccatatataactttactatttaatatttggccaattgctttcatcccgattgtattatgtatggcttgtaattcgttatttaaaattgaaatgagaaataaatcatttaattattacttaagtaataattggtcgattacaaaagaaataagagcaaagattttcattttatcaatagcatttttggtacattgctttttagtatttattattgcttatataggtgacctaattattaatccacatccggttaatgctatgttgttattggtgacaatattgttgatgtatgtagtatctctaccattgataccgctcaactttttattaactcgatactttggtgtgttcgtatcaatattaataaacttagtattatcagtcatttgtgtcttgtttttaacattgaagagtttattttgggtgttgccgtgggggataatgcagagaatcccgcttattacgcttggtatactacctaatggtttagttgtaaaccataattcaaaatactttaatgatctcaatgccttatatatttcgattattgttagcatcattattttcgcgatagtaacatttttaaataataagaaaagttggcgattaaaatgataattaacgaattaaagtcatgtaagttgaaattttctaagcaagcgctcacatttgtacccattattgtaaccatattgtttatattatttataaattggtatttaaacgtaaatttatggaatggtcgacaaatmagtttgtttacagcgagttttaatgcaattacatcgctattaatttctataaacgtctatcaagttatcaattttgaagaaaatattggtcactttaatcatattttaggaaaagctaataggctaaattggttaaatgcatcaatgatttttacttatactattacagccatatgtattctattagcatcaattaatttattgtggcattcacatgatatgaaaataacacttatgtttataggcgtatcattgtttttcaatgtaattatattactgctactttttatttttagtattttcattaaagatgtaatggctattgttgtcggagttttaatgtttatttttaacgtttattttggattagaagtgcttggagatcattcgtggttctatttaccaatcacatatgctacacgttacgtttatatgtttancgaaggggagtataccagttacattaacattgggcaatctatatnattatcacgntgccgat

SEQ ID NO: 643 - DNA, 646 bp; double-stranded, linear
ataatataggaattatttcgatnacagattttacgaatcgtgctacgatgcaaaatgaanataaagatccatatggcgaaaagttagcttatggaattgcttttaatggcagtgtggatatgcaaggggataaacaagtcacaattccaaaatatagtgtagttacaattactggcgaaaatagtaaaaattatcgtgttaccgccgataataagacttactatgttagtaaagataaattagaatattttaacccggcaggtttatatcaaacgcatagttttaaaaaattagcaccatatatgaaatcaaattatagtaattactatgcatactttaatagtcaattacataaaaagcatagttcagttataaaaactttagttcctgatgatgataaccgtttcgttgcatccgttacacaacaaccgatacaattacttttcaatgataataatcagttatacggttttgtttatccaattgtagataaaaaagaattaaaagataagtttaatattaacaataacatttggattactaaagttgggaatggatattgtattgccaatttgaaagaagacaaatggatttatattgaattgtaggtgtaaagatgctagataatattattttatattttaaa

SEQ ID NO: 644 - DNA, 426 bp; double-stranded, linear
taatatcggaatttgataatgaagatatctaattttttaatattcgtagcttttatttttctacttattttatgtttatttttaatcttacaaatgacaaaccattaaaagtagcatcccaacatcaaacaaaaaaacaattcatcaaataaaaatcgctacaaaaccaagtcattaaacacgcaataattaaaattttccactcattataattctgaattccaaatgtcgaattccgaaaaccaaactccaaattccaaaaacgcaactccaaaattaaaagcatttccctaccattcgggaaatgctttttacatactggattactctgtcattaatgattttacaacgggaaaccatgtcgtcatgtatgaccaaagtagcgtcgctatcataaggtggttcggatctttattggataatnat

SEQ ID NO: 645 - DNA, 3241 bp; double-stranded, linear
nttatttacccacaacatgttgcgacattaggtaaatgggtaccttatttacttggtattgttatgttaggtatgggattaacaattacacctaatgatttcaaaatggtctttaaagcacctagagcagtaattattggtgtctgtctacaattcagtattatgcccacattagcatttataattgcaaagtcttttcatttaccacctgatattgctgttggcgtaatattagttggatgttgtccgggtgggacatcaagtaatgtaatgagttatttagccaaagctaacgtagcactttctgtttctattacgacggtctctacgttgctagcgccattcgttacacctgcgttaatatatctatttgcaaatgaatggttggaagtatctttcgtgagtatgttgtggtcagttgttcaagttgtattaattccaattgctttaggtattgttttgcaaattattaatcgtaaaattgctgaaaaagcttctacagctttgccaattatatcagttgttgctatttcattaattttagcaatagttgtaggtggcagtaagcaccaaatcttaactacaggattattaatatttttagtagttattttacataacgtattagggtatacgattggatattggttagctcgtcttttaaaattagatcgacaagatcaaaaagcagtcagtattgaagttggaatgcagaactctggtttagctgtgtcattagcagcattgcattttaatccaattgcagcagtaccaggcgcagtgtttagtttcattcataatataacagggcctattttagcaaagtattggtcaaaaaagttataattgcactaatagaatgaagtggtcatcggactatgttaagctttgataaagagaaaaaatagaggagtaaatatatgtatagagcagttatatttgatttcgatggaacaataatagatacggaacaacatttatttaatgttattaataaacatttagagatgcataatgccgatcctataagcattgatttttatcgttcttctattggaggagcagctacagatttgcatgaccatttaattaaagcgattggttcggaaaataaagataaactttatgaagaacatcatcttactagtacaacattaccgatgattgatacgattanatcattgatggcatttttaaagcaacgtcacattcctatggcaattgccacaagtagtgtgaaagcggaaataatgcccacctttaaagcattaggtctagacgattatatagaggtagttgttggtagagamgatgttgaacaagttaaacctgaccctgaattatatttatctgcagtacaacaattaaattatatgccgacacaatgtttggctattgaagattctgtaaatggtgcaacagccgcgattgcagctggattagatgttattgttaatacgaataaaatgacaagcgcacaggacttttctaatgtagattatgtagcaaaagatattgattacgatcaaattgtagcgcgtttctttacgaaataggaggcgtatcatgatgggttacattatattgttttttctagctggtccagtaattttaggcgttggaaatttggtgattggtcctatatttaacaaacagacaccatttcgcgtgcaagtaagatcttttgttgktggktcmatgrtttacttaatactcgcaacaattggctattttttactattacaaggtaaactttaacgagaaaaccaccttacctcattaaatggacgaccatatgtatgtgaaatggtagaacgttcatgtttatgtatgagatagggtggtttaaatagttacatatattttaataataacgtcacgatgataagtacaattaagataatatctatgcctaccataattgtagctcttgttgcattacttccttgttcttttgctgatttcatagcacggtagtttggcacaaagctaataattagtaagattaatacaattacaccaattaatgctgttgtcatgatgaacgacctcctttatttttttcaatcaattcccaaataaacgtagcaatcacaccgatgattaacccagtgatgacaccgatttgtaccgttamaaatatggcgccgaaaatgataccaataattaatgcaatcggtaaagtcgtaccgagtttaatcttgcgctctggagaattaataatagtaaatactgtaagacaaatgagtatgaaagcaagtgttgcaataatagttcttccaactaaatataggatgtcaggtttttccataccgatataatttatgatgaaaaatgctacagcaaagagtaccgatatttttgtagcacgtagcagtatttgttttaacattgatatactcctttttaatattattaaaattatatcataattaccaagaatagctgaagttgtatgtgactcaacggtacttgagcaacttttttaattttttagaaaaatcacaaaataattgtttgcaaagttgcaaaagcctgctatagtagttctgtaaacgattgcatggtatgcaaatattaatgtaccaaaatcgataatttatagtataattacggcaataagtttttttatggatttatttagtatcaatcagagatggggtaagaagttatggagaacaatgaactacaaaggggattgagtgcccgtcaaattcaaatgattgcacttggtggtacgattggcgtggggcttttcatgggtgcgacaagtacaattaaatggacaggcccatcagttatccttgcatatttaattgcgggtatctttttatttttaatcatgagagcaatgggggaaatgatttatttaaaccctacaacaggatcatttgcaacatttgcaagtgattatatacatcctgcagcaggttatatgacagcatggagtaatatattccaatggattgtagttggtatgagtgaggtcatcgcagtaggagaatatatgaagttttggttcccggaattgccaacttggattcctggtgttattgctattttattattaatggcagcgaatttattctcggtaaaagcgtttggagaatttgaattttggtttgctttaattaaagttgtaacaattattttaatgattattgctggttttggtcttatnntctntggttttggaaatggtggccatgcggtaggtatttctaatctatggacaaatggc

SEQ ID NO: 646 - DNA, 1311 bp; double-stranded, linear
aggcgtcaactcagatggtttaataattgccgtattacctgctgcaatagcaccgattaaaggttcgaacactagttgaaaaggatagttaaatggtgcaatgatcaaaactgttccataaggttcttttttgatatagctttttgttggaaataaatataaaggtgtgtctacattktttgttttagtccagtttttaagttccttacgggcaattttgatacttytcaaagttatgccaatttcagtagcataagcttcgactttattttttcctaaatctgtatatagtgcttctaaaatatcgctctcgtatgatttaatagctttgcttaacttctttaattgctcttttctaaaactaatatctttagtttgttgtgtattgaaaaaagctttactgtcataaaatttttgctcaatgatattcataatgaaaagaacctccttatatgattattttggaaaaagcgattaattgatttgaatgttgtggccgttaattttaaatggtctttcgaattatatatgttgaaagttgaaaatagagcgatgaatcgtgtacataataatatttataactttaatcataacgaaaaaggtaggaagaaaacaaaaatttatactcaacatcgcaaatattttaagaaaatgtaaagacaaaaggggaattgtatagaaatcactaatctgtgggttagggtagctaaaggaataaaaactactattgaaaaagggttgtaaattagtcaaacgtaaataaaaaacagttcattgaaagtgaaataaattctactttaatgaactgttagttaaatacaacatgtctataattagacagtaatatagtattattttgttaatgcttcagtgatttgaggtacgatttgtttttttcgagaaacgacaccagataagaaggccatgtcatcttctaattgaacattgaatgttcgccaactttatctttttcagcacctacaactaaaattttagaatcactattaatgatgtcagtaacaacaagtacaaataagtcatatttttcttgtgcacttacagctaacatttctttttctaratcttctttacgatttaacacttcgtcaaggtcaacagcattaacttgtgcaatacgagtcacatagtcacccatagtaaatgatttagcatccatgtttaataagaattcaactgatttatcagttgttgaagcacctgcttttaacatatctaagccgtacttttgaatatcaactttagcaatatctttnaattcttcagctgctttaacatcttgttgtgtacatg

SEQ ID NO: 647 - DNA, 1498 bp; double-stranded, linear
catatactttttcatttctttacgagatactttaccagaggatttagacttcatacgctgatccatatgtgcttgcgtttcagaatgtccacaaacacaacgatataccgcttctttccctttaccaaacaacgttaatttctttttacagtttggacatcttgcatttgttttgcgctgtacattctttttcgtcttacaagatggatcttggcacacaagcatctgaccatttttagttttaactttaatcatgaatttaccacacgttgggcattctgtggttgttaaattatcgtgtttatatttacgatcactatttttaatcccatttacaacatctttcgtaaaatctttcatttcattaataaatgttttcgcctgatatttaccacgttcaattaaaagtaatttttcttcccattgtgcagttaaaagtggcgacgttaattcttctggtgctaattctaatatttgtttaccttttgacgttactttaattttaccgtctcttgattcaatggcattcatattaaataatttatcgataatgtcggcccttgttgcaactgtgccgataccacctgtttgttttaaagtttgcgcatattttttatccttcaattgaataaagttctgagggttctccatcgcttttaataacgaaccttcattaaaatattctggaggtgttgtttcatgttctctaatatttgtttttgaaatcttcacttcatcgccttctgaaaaaggctgttgcatctctgtaatagattcaccttgtctaatagatttaaaacctaaaacagttgttacattctctttcaaaacaaatgtgtgccctgcaacctctaaagttacagttatcgcgtcatactcgtgcggaggcattaaagcttctaaaaaacgctcgacaatcatatcgtataactttaattctctattacttaagtctgacatgacaggtctcacttctgtaggaataattgcatggtgatcagatactttttgattattaaatatcgacatttttgatgaaaatgttttagacattaatgggcgtgcttggtctttatatgttgttgccatcgtcacctgaatacgttctttcatagtatctaccatatcagttgttaaatagtttgaatctgttcttggataggttacgactttatgtctctcatataagctttgaagtgtattcaatgtttctttaggtccaattttataacgtctatacatatcttgttgtaaatctgttaaattgtacagtgattgcggatacgacttcttatgtttagtagcaacagatttaatcttaccatcgacatttttcaaattattaaccatctgttctaaagtttctttawtggtatatcgctgatttgawtctagctgaaaatcaaacccttttaccgttaatgataatgtaaagtattgttgtggnttgaactgattaatctcttgttggtcgtgtaatttactaaattgaaacggn

SEQ ID NO: 648 - DNA, 1044 bp; double-stranded, linear
taaaacaattcgttttattaatacagtttgtaaaagtattctcttagtactaatagctaatgtaatgatagaaaatactagtgttattaaagatttgaataaaataaaagaaactgagaaatattggaatgtattagatgattattacacgattgaatttgcaccttatcacgaaacaaaacaaagtttgattgataatatggtgcgatcagaacaattagtaaaggctagtgaagcagaaaataatgcgattttattcaaaccaaagggtgactccgttgacaatgacaacttttcgcctgatgaggggaatgtaatattagtaaataatcagttctggtcgatttattacaagcagtttcaacctgatattccgataaaaaatcaaaaaaataatgtcgaagtaattattccacaaaagtttcatgcaatgcgtaatgaaatcaatcaagcatatcattcatggtttgaatttgtacaaaataaaaataataaagagaataagttatctatacagtttatcaacaaaaatgattgtcgaattttttcatttgatgcacgagatagtcgccatttgtcatttatagaggcgccaatcattgtgaatgttcaggcatcagatttatcgaatgatttttattatgccatgatcagtcaaggcgggtatttattcaaaaattatgacgcgctagtaaaaaatattggaaaagtatccatcttgatggggaaatccagtggaataaccaattataaagatagcgtgatggaaatgtatcatgaaaacaatttgaaattaacagtactcaacttttcacaaatcattatcgcaatcattttaataattattattttatttgatgtgaaatattattttgaacagcatcgaaaattactcgtaatcaaaaagctatatggttattcaacattaagagccaattaccaatacttattaataaataatatagttgttatttttattggaatattgacgaatgtaattttacattctcactatataatgatgttatttgcaacgattcttgt

SEQ ID NO: 649 - DNA, 399 bp; double-stranded, linear
gaacatattgggttatgcaaggnggtcactcttcacacttataaacaacattttaataatgtaaagtttaaccagctaacacttttgttagctggtttttattttccttcaatttttaaatggttaagtccccttctatatcttataagacaatcattataatcaattcaattaatacattaacaaccacaactaataaatatagtaacttcaaaatccatatttatgtctaaagataatctcaatgttgttcacgtcaataaaattatccctaggtttttaaaaattgtacatgtttaaacaatcaaaagtgtacattattaaattatcatttccagttagatttagaaaacattcacaccacgcatggaccaacgtattcgtcttcattcattttag

SEQ ID NO: 650 - DNA, 747 bp; double-stranded, linear
gtactaggttctangattccctactgtagtcatagatattttccaaacagagcctgacaacttttcatttttaatagtgatcactatattaatcgctattgcaatttatgcatgtcgatttgtttgggtttatttctggtacaaagatttttatttcccgaaaaatatacaatcttatctagacgaggaacatgattcacatgaaacaccaccttctcgagtgcgttacgcatttattatgaccatgtgtggtattcacggtacaatttcactttcaatggcacttacattaccatttatcattacaaaaggacaagcattcgaataccgtaatgatttattgtttattgcatctttcatggtattaattagtttaatcttagcgcaaattgttttacctttaattacaccatctgccgaagatactacttttaaaggtatgacttatcaatctgccaaaattttcattgttcaaaaagtgatccagcattttaaaaacgaaagtaaaaaagacaaaaacgatacaaattatcgcccagtattaaaccaatactatggagaattgttatttttattaaattcagaacctgataatcaaaatacraaagaactcaaacgtttagaagatattgcaaaagtaatcgaaacatctacacttgagcgtttaattgataaaggtaaggcaacatatcaggatattaataattaccgcaatattgtcgaattaacagagacacaccgtactgc

SEQ ID NO: 651 - DNA, 1373 bp; double-stranded, linear
atacaatactcttttattattcaataagccacttcctatagcaaatgtttaactttaaatatttttcgatgctaacaaaaaatcacactatcatcttttaaaatgaaagtgtgattacaagcaaatctgtaaaatttataaagcagaaacaattcaactttatcattatgacatttcaattaaaccttctacattatagttccaagcatcttacacatgaatgcaagtatttaacgatttaattgtgacatagcctgttgatattgtgtttcattgatataattttgttgcttcattttttctaagttcgtgcttacacgttgcgtaaaattctctgacatattattgatattatatacgctaggtgcattgactttactagctaaaatagcgctttgtaaaactgttatgtgagacattgttgtactatttttattcacggttgttccaaagtaatggtttgctgcgccctcaagcgtatattgattatccccaaagtaaatattatttaaataaaagcttaaaatttcgttcttattatatwgtwtttcaactcgatgagctacaaataattcttttacttttctagtaaatgaacgatcattatcataaaaataatttttgacaacttgttgtgtaatggtactaccaccttgcacatctctgtcgctaatcgttgaaaataaagctctagttgtacctttcaaatcgaatccatgatgattgtagaatcgttcatcttccattgaaataaaggcacctttaacatactctggcatgttatcagctgacacaaaactacttttattttcaatttttcttagttcatccacattatcgcgtgtagataaaaaatacatgataccaataaacaatgcgataatgattagaatggttaataatatttttaatagtattcgtttactttttttctttttcggcggtttgccaactggttgataatacgtattatagtgaggttcgtgtttcatatgctcaaaatgttcatttgagtttgagtacctatcgcttcttttcatgcgtttgctccttcttttaaaactcacttagtatataccttgagtttaccagtactatcacaaataggctacactttttgggaaaatcagtccaagggcttacaatcgtatacgccatcatacttacttttttgttttttgaaaaaattatagataaatcattgcaattttaaatattaatcatgtcaaatattgttatattttataaaaataaaagaccatccctattaaatgccaatagagacgaccttttatttgttattcatttattaaaactaaaatccatatttcatttcaaacgaaaatatataaattttaacaatcgrtaaccac

SEQ ID NO: 652 - DNA, 859 bp; double-stranded, linear
ggcagataatttagtcattgttgaatcgcctgcaaaagcaanaaccattgaaaagtatttaggtaagaaatataaagttatagcttcaatgggacacgtcagagacttaccaagaagtcaaatgggtgtcgacactgaagataattacgaaccaaaatatataacaatacgcggaaaaggtcctgttgtaaaagaattgaaaaaacatgcaaaaaaagcgaaaaacgtctttctcgcaagtgaccccgaccgtgaaggtgaagcaattgcttggcatttatcaaaaattttagagcttgaagattctaaagaaaatcgcgttgttttcaacgaaataactaaagacgctgttaaagaaagttttaaaaatcctagagaaattgaaatgaacttagtcgatgcacaacaagcgcgtcgaatattagatagattagttggctataacatctcgccagttctttggaaaaaagtaaaaaaagggttgtcagcgggtcgagttcaatctgttagcmttcgtttagtcattgaccgtgaaaatganattcgaaactttaaaccagangaatattggactattgaaggagaatttagatacaaaaaatcaaaattcaatgctaaattccttcattataaaaataaaccttttaaactaaaaacgaaaaaagatgttgagaaaattacagctgcattagatggagatcaattcgaaattacaaacgtgactaaaaaagaaaaaacgcgtaatccagcaaacccatttacaacttctacattacaacaagaggcggcacgtaaattaaactttmaagcaagaaaaacaatgatggtcgcacaacaattatatgaaggtatagatttg

SEQ ID NO: 653 - DNA, 747 bp; double-stranded, linear
ttcaacttcgtttggaaatcatgttcctcaattgttggacttaaacgaatttctttaacattgataattttttgtttctttttcatttctttttcttttttctgttgttcgaatttgaatttaccgtaatccataattcttgcaactggtggtttcgcattcggtgcaacgaccactaagtctaaatctacacgttcagccatttctaaagcttcacgctttgatttaacaccaatttgttcaccatcttgaccgattaaacgtaattcttttgcacgaattttgtcattgatttgagtttgatcttttgctatggttgacacctccaaaatttttacgaaatttgcaccaagcaaaaaggaagagcaggtataaaatacccgctcttccttatacacagttatgtgtaatgtgattaacctgccaactgctttatgcgtcgctacaggtgagaagcgggtgcttctacttggttcgtttcgtattcaacgttattaatcatatcaacaattcacatttaagtcaacactataactgtaattatttttattttaaccttttatttcatccattgacacgtcttgacgtaaatctacttgttctaatggaatttttttcgttttatatcgaagcttatgataaataaagaatgctaaaaatactggaattcccatatacgtaattaagaagcgactaaaattaaaatctcctgtnttaataaagtcaacatcttgcccaanaantact

SEQ ID NO: 654 - DNA, 501 bp; double-stranded, linear
tttcaatgccactgcttttggttcttcatttgatacagctgcacttttatctgtttctgcttgtgcttcttttttagcttcttgaacctcttgtgcctcttgtgatgtatcactyaaattatttgcacttgcttcttcttttatcgctgcttgttgtgctttcaatgccactgcttttgrttcttyatttgatacagccacacttttatccgcttctgcttgtgcttctcttttagcttcttgaatctcttgtgcttcttgtgatgtatcacttaaattatttgcacttgcttcttcttttatcgctgcttgttgtgcctttaatgccgcttgctcatttttagatttgtttaaaaatccttcaacacgttcttttgtataggcaaccgtttcttcaagttgcgtttttctttcttcaaacttttgcgacagttcttgtnctttgactttnaaatcatctgctttttgataaactttattttaaaataccaacctaaagcc

SEQ ID NO: 655 - DNA, 830 bp; double-stranded, linear
caccttgtcataattaattttttgatttttcattttactgataataggttcagcattaatcatgatttaacctcccacatttaatcattaacttctattatatatgattcatattaaatgtcagtcaaaaaagttagaaattcattttaatgcatttatatttcgaaaatcccttatgtatctaaaagcattttttaaacttgaattttaaaacactaaacaacacatacgtctctgtgtcattttcattttttgtatgtcatatatatgtttacttcatttaaatcaatttcatcttataatttatcgtgtattttacaaaagattgacttcaattcatcgtaaaagttatacttttgccattttttaatgtaacatggtgttagtaataaaaataatacattgaggtgttttacatgacagcattattcccttatatcgcttttgaaaattcaaaagaagcccttgcatattacgaagaagtatttggtgcaactgacgttaaacgtttagaagttggcgaagaacaagcgtcacattttggtatgactaaggaagaagcgcaagaagcaactatgcatgctgaatttgaagtgcttggcgtaaaagtgttatgttctgattcttttggtcgcgctgacaaaattaataatggcatatcattattaattgattatgatgttaacaataaggaagatgctgataaagttgaagcattctatgagcaaattaaagatcattcttcaattgaaatagaattaccgtttgctgaccaattctggggtggcaaaatgggcgtctttaccgataaatacggtgttcgttggatg

SEQ ID NO: 656 - DNA, 539 bp; double-stranded, linear
gtatccatgggcccgttncgcacaacatttggnacaattaggtacacgngttgtcatcggtcgtttcggtataattttatcgaatgaaggcggtgcgttacaaacaatgaaactaccatacgaatattacattggtggtaaattaggttctggtcaacaatggtattcatggattcatatcaatgatttaattcaagctattttatttttaataaataacgagtcagctagtggtccgtttaatttaactgcacctatacctgaacgtcaaaatttatttggctacactttagcaagagctatgcataagcctcatgaaacttgggcaccaagtcttgcaatgcgtctcatacttggtcaaatgtcaacagtagtattggatactcaaaaagtattacctaataaaattcaagcattgggattccaatttaaatatagtaatttaaaaatggnacttgaagatttaattaaagaataatcaataccattaatgagcattagaaacaacatatgtactaaatgtaatgtctagagcgact

SEQ ID NO: 657 - DNA, 1106 bp; double-stranded, linear
atcaagttgaatatcatccatatttaacccaacataaattgarattatatttggcagcacaacgtatcgtgatggaatcttggtcaccattgatgaatgcacaaattttaaatgatgagacaattaaagacattgctcaagaattaggaaagtcacctgcccaagttgttttaagatggaatgtgcagcatgctgtggttacaatccctaaatcggtgacaccaaacagaatctctgaaaatttccaaatatttgatttcgaattatcagatgaacaaatgacgcgaattgatggtttaaatcaagataagagaattggacctgatccaaaaaaatttgaaggctagattaaaatcgctcaactgatgaaaaggttagatgaattgtcagggcttgggacattaagttcttaggcaatgtaaaaaagctgatttctattaattatttgatagaaatcagcttttttgatatgtattttataatgtacagctcgttgagctgctattttccttatattaagtgccattaatacaaaacctagctctcgtttaactttatttattcctcgaactgacgttcgagttaaacccaaaatagccttcataaatccaaaaacaggctctacatcaatttttctttgactatagatttttttcgtttctggttcagaaagcttttgattaatttggactttaaagtattcccaattataattcttcatgattttcttattggattttgaatttggtttcatgcattgttgcctcaaagaacatgctgaacagtcatcgcattcatatagtttgaagtctcgtttaaaaccatatctatcattacggtatgcatatcttttaaaacctattcttttgttattaggacatataaattcatcattaagttcgtcatatttccaattttgagtgtcgaaaatgtcacttttaaactttctagttttatctttaataaacatgccatacgtaataagtggcgttttattaaaatcatctataatggccatatagttttggctcactacccataacctggcatcagctaccaaatgaaccgaagggatttttggaatccattggttgaaaaaatgggaa

SEQ ID NO: 658 - DNA, 400 bp; double-stranded, linear
ttttaactttactctttgatttaaagagtgataaatgtttacagtttaattaaaactgcataagaacttctagcttttctctttcgttcaaagagaagcagctgttcgcagtttaatcaaaaccacataaagcttttaactttactctttgatttaaagagtgataaatgtttacagtttaattaaaactgcataagaacttctagcttttctctttcgttcaaagagaagcagctgttcgcagtttaatcaaaaccacataaagcttttaactttactctttgatttaaagagtgacaaatgtttacagtttaattaaaactgcataagaacttctagcttttctctttcgttcaaagagaagttctaataccaccatatcgtgcgatcgggaacggta

SEQ ID NO: 659 - DNA, 1899 bp; double-stranded, linear
ataattacaatggctactgcaattattgttggaattatatatttcagtttagtcatcatttatgctcccttgatttcaaattcatatcattagtttaccatattgaagatgatataataacttataaggagtgagaacttttatgaacataaataaaaaagtaacattacaacgaattcaaactttaactgagcttcatggggcaccaggttttgaagaagaagtaaaaaattatatgactcagcaaatggcgccgtacgtagatgaatttattgaaaatcgtatgggtggattttttggtgtgaaaaaatctaaaaatccaaatgcaaaacgtgtaatgattgcagcacatatggatgaaatcggatttatgattacaaatatcactaaaaatggaatgattcaattcacaaatttaggtggtgttgcaaatgatatttggcaaggacaacgcttagtaattaaaaatagaaatggcgataaaattatcggtgttgtttctaatatacctaaacattttcgtactggtagtgaaggtgcaccggaaattaaagatttaacattagatataggtgctcaaaatgaagatgaggtgcgtgagcgcggaatagatataggagatacaattgtacctcacacgccattcacacagttatctgaacatcgatatagtgctaaagcatgggataatcgttatggttgtgtcttggcaattgaaatactagaattattaaaagatatagaattagatgtagacttgtatgttggcgcaaatgttcaagaagaggttggattacgaggtgcgaaagcatctgcagagatgatagacccagacgttgcatttgtagttgattgttcacctgccaatgacgttaaaggaaaccaaccattatctggtgaacttggtaaagggacgttaattcgcataaaagacggtacaatgattttaaagcctgtatttagagactatttattaaagttagtagaagcacatgacattgaacatcaatactatatgtcaccaggtggaacagatggtggagaaattcataaagctaatattggtattccgactgcagttattggtgtatgtgcacgatatattcatagtacagactcagtatttgatataagagactattttgcagctagatctttactttcagaagccatttgtaatttagataataatcaaatagaaacattacaatataaataatcgggtaataacaactattatctctaaatagttatatataatcattaattaaggagacataaaaatgaaacaacttgaatcagaacaacaatttgaatctttaaaacaaggtgctacagtatttgaattcactgcaggctggtgtccagattgtagagtgatagaaccagatttaccggaattagaagcgagatatcctatgtttgacttcgtatcagtagaccgtgataaatttatggatatttgtattgaaaatggtattatgggtattccaagttttctagtatataaaaatggagaactgcttggaagttatattggaaaagaacgaaaatcaattgaacagatagatgcatttttagctcaatacgtgtaatttagactagagaaaaacggggtaatactcgtttttctctgttactatgtgttgatttattgtaaactattataaggtgcgaaattaggagtgttacatatgaatacctttcaaatgagagataaattaaaggaacgtttaagccatttagacgttgattttaaatttaatcgtgaagaagaaactttgcgtatttatcgaacagataataacaaaggtatcacgattaaacttaacgctatagtcgcaaaatatgaagataaaaaagaaaaaattgtagatgaaattgtttattacgttgatg

SEQ ID NO: 660 - DNA, 3774 bp; double-stranded, linear
gtataatatcctttcaatctgttttcatattttatatattttttaaatataagtgctaaatgttttaactaaagcatagattgacaagatgttatacagaatttcaaattctatccaatattgttcgaagtgtagtatcactggattggtattaaacaatgtaaaggagagattgcaaatgccgtataattacaagaaacaaaatggagagttaatgtctgtaatgagccaaggtgaaaagtttattcatcaatcacccgttaatgatgaacttagtgcattgattaagttattaatttctaaaattaacggttgtcattattgtgttgatatccataaaaaagaattaaaggaattgggtgtaacacaaatgaaaattgatgaagtcttgagttttagacatttagatttatttactgatcaagaaaaagtgacgcttgaatttgcagaaatgttaaattcaatcaaagactttaagaagtttgaaattattgaccggctaaaatcattttatgatgaagaacaaattattgatcttgtctttgttgtaaaccaaattaacggttggaacagattaaatattattagtgatagactataattgttcatataaatgcagagtttcatctcgaacgctatatcataacaaatcatgccactatacaggtcaaatcttgtatagtggcattttaatttatccctttgaatactgttatttaacgaatatcggtccacctggtccaacagggatacctaataggaaccaaatgatgacaaatactgtccatacaatacttagcgcgattgaatacggcattaaactagaaagtaaggctccgagtttcatgcgtttatcgtatttttgtgcataagttaataataaaggtaagtacggcatcatcggtgtaattggattggtaattgaatcgcctacacggtaaatgacttgtgtgaatgcgggatgaaagccgataaggattaacattggtacgaatatcggtcctaaaataccccatttagccgatgcgcttccgattaacatgttgaccattgcactcagtacaataatacctagtatcaatacaataccgttttgatgttctaataatttggcacctttaacagcagcgataattcctaaattactccactttaaatacgcaagtagctgtgctgcaaaaaacacaataacgataaatgttcccattgatcctacagcatcgccgaacattttacctaagtcttttgtatttttaatttctttgcttaaaatcccataaactaatccaggtactaaaaatacgacaagaataattaatccgacaccgttaattaatggcgcatcgtctagtaagctgcctgttttagcatttcttaaaaagctatgttcaggaatggctgtaataattaataaaataattgtgactatgaaactgatatttgcccattttaaagcatgtgcttctttgtcagtaatatgtgaagatgtttcttcatggtcatcatgcattaaactgtcatcatattttcctaatctaggaataatgagcttagttgtaactagcaatatcgtaggaagtaatacaacgacactcgctgcgataaagtaccagttcatagcaacgtttgttttaatagaatctgaaacgatacgtgttgccggttctgtaaatgaatagaccaaagcatcttgcataccaacaactatatttgctgcaaatcctccaacagcggaagcatatgccatcgttagtccagcgatagggtgatagccaattttaataaaaagcattgctgcaagcggcggcaagataattgtcgcagcatcgccggctgtactacctaaaataccaattaatataatagtcggtaaaattaagaaacgtggtgcgcgattcacaacagaaatcattaacttatcgaagtatcctgttttctctgcaacaccaataccaatcatcactgctagtactaagcctaatgctgggaactctgagaaatttttaatcgtatcattcattatcatcgtaaatccatcatggctaattatatttttaatataaatggtttgatgcgtacctggatgcttaacagatacattaaataatgagataacccatgtcataatggctaagcccacacacattaaaaagaataagacgctaggatctggcaatttatttccgattttttcaacactattcaagaaacgattgacgatagaccccttttgttgatgttttgatgtcatcaattattcccccctttgttaaatatttaaagtgtaacaaaaaatactctcaaaagtaacaattttcaggaaataaaaaaactaatattgttaaatattttgagttattcaatagaaagtgtatagcagagtagttaagactgcctgaagacttatctattaggtttatgaagcatcgaacagtggaaaataaggactgtaagtttaagatatgttgtataggagtgactgaatgaaacgtttggaaaataaagtagcagtcgtaacaggagcaagtacaggtatcggtcaagcttctgcaatcgctttagctcaataaggtgcgtatgtattggcggtagacatagctgaagcggtatcggagactgtcgataaaattaaaagtaatggtgacaatgcgaaggcgtataatgtggataatgcaagcgaacaacaagtggtagactttgtgtctgacataaaggaacagtttggaagaatcgatgtgttgtttaataatgccggtgtggataatgcggctgatagaattcatgagtatccaatagatgtgtatgacaagattatgaatgtagatatgcgtgggacatttttaatgacgaaaatgatgttacctttaatgatgaatcaaggtggctctattgttaatacgtcttcattttccggacaagcagcagacttgtatcgctctggatataatgctgcgaaaggtgcagtgattaattttacaaaatcaatcgcaattgagtatggccgtgatagcattcgagccaatgcgattgcaccaggtacaattgaaaccccgttagtagataaactgacaggtacgagtgaggatgatgcaggtaaaacatttagagaaaatcaaaaatggatgactccgctgggacgtttaggtaaaccagaagaagttgctaaattagtagtcttcttagcatctgacgacagttcattcataactggagagacgattcgaattgatggtggtgtgatggcttacacatggcctggcgagatgttaagtgatgattcgtggaagcggacattggaataattatttaaaatcgatatccagtggaaaagaatttggcatgaagtaggcaatgtatgcatattgtcgcaatgaaagacatttaaagcggagattaattaatctttgaaaatcacatattgttcatttgaagtgtattgcttaaagcttgttttaacgtattgtaggtcgtgcatctaatttatcagaatctcgagttcaaacttttggagtatctttaaaataagctgtattttgtctattctaataaattaaggagaattttatgttaaaagaaaaagaaagttttagattgctatatcaagctataagagagattgcagataaaattggagataatcagttagaaactaattccgttagtttattattattggactttgattttgaacatgaagtatttgatgaattgtatcttgtgattttaaaatatttaaatacagtaagtatagagaacataagtcatagtgagctt

SEQ ID NO: 661 - DNA, 1078 bp; double-stranded, linear
tactggttttggattttggaggtaatacagtacctaatagtaatnatggtgtcgtcanaattatatctttccgtgatgttcttactcattagaacatcngccttcagaggaatcatgatacgaggaataagaaatttaaatgtgagcgaagtcaatatagtatttgcgattatttttattaactccattattattgttagtttgatttttcgaggataacttcaatttttgcattttgaggttttttaacatatctatttgcatcagttgatggcaaccttttacttaaatctattgtgtagttattgtctgcacctgttattttaatttgtcctttattataagaattattatataattttttacttttaattaatgtttgacgaatacgaaaatctaattcttttaaagttaaaacaggcttattgccttcataaactggaaatccgccagtaaacgtttctgctttatctttatatgttacattcagtttatagtgtttatcgttagatgttgctgcaggagtaacaccaccagtaaacgtttcttgagataatgcaaaagaatcaatggtttcttggtcttttatgcyaaaaatatcaacgcttttatttcttaattggttgatattgccccaactttcaggtccataaacttgaatatgactataccaagaaaactgtaacaacgttgcatgaatcgtaccgttatctttttgccataacgtactgttagagaaggttaaatatttttgcgagtaatatttagttaactcattaacgttagtttcgttttgatttatataataagctttcgcttcagatgaagaattgatakgtgtattaggaaattgtgtagatgctgtacctaatagtaacaatgttgttgataaaataatttttttcgtgatgttattgttcattcgaatttctcctttgagtattgttggaatgtttaattataaaaaggggttaattagataattgaaattatccgcatttacaaaaggtaataggttagttagatttttcgagtatgactcaatttctgcattacgaggatttttaacataacggtt

SEQ ID NO: 662 - DNA, 1398 bp; double-stranded, linear
aacttgctttttagtatctacgttaatattaatagctttaatttcacttgtattaattaaatcagctgtgtaaatacctgctttcaaatcgataactttctttgttccatttttaaagtaaacagtatatttcgcttgcttcgatagtcttaaatctatatcactaatacctctgtctgattttaaaactgatttaactctatcctctaaatctttataactaatattttgattcttattaaatgttaagcttgataaaatattttggcttgtaccgttcacagtgattgcatatggaacatggactttagaatatccatggtgtaacgaacttgatgatttatctaatggcttagctgcggcagacgcttcattattattaaagtttgcacctgttgatgctaaaacacctaatgctaaagttgttgtaatcaatgacttaaatttcataaattatctctccttttttgtgtaattcgtatttgcaacttaattatagccagactttctctattttttgaattaactgaatattaataataaattatctttaacaataattttttaacactgttaaaagttcttttaattttgattaactaattaatttacaatacctaaaatgttgtttggttttgtttataccaagcttcaaacttaaatgtcataacaacattcatttcttaattcctattagatttgtcgattatatttacagcatctttatactcaaaaaacatttacttaaaaatataaattcgatttaataattaatttaaatttagttaatcaattttgcatctattttgttgtaagctatataaaaggagtgataatgatggtgaaaaaaacaaaatccaattcactaaaaaaagttgcaacacttgcattagcaaatttattattagttggtgcacttactgacaatagtgccaaagccgaatctaagaaagatgatactgatttgaagttagttagtcataacgtttatatgttatcgaccgttttgtatccaaactgggggcaatataaacgcgctgatttaatcggacaatcttcttatattaaaaataatgatgtcgtaatattcaatgaagcatttgataatggtgcatcagacaaattattaagtaatgtgaaaaaagaatatccttatcaaacacctgtactcggccgttctcaatcagggtgggacaaaactgaaggtagctactcatcaactgttgcagaagatggtggcgtagcgattgtaagtaaatatcctattaaagaaaaaatccagcatgttttcaaaagcggttgtggattcgataatgatagcaacaaaggctttgtttatacaaaaatagagaaaaatggtaagaacgttcacgttatcggtacacatacacaatctga

SEQ ID NO: 663 - DNA, 1200 bp; double-stranded, linear
ttgtaattggaacgtacgaacttttctaggtaagaaacgtcgaatctcgtcctcattataaccaacttgtagtcgtttattatctaaaataattggacgacgtaataagccaggattatcttgaatgattgaatataagtcttgtaatggtagtgaatcaatatcaacatttaatttttggtatgttttagaacgtgtagaaatgatttcatcagtaccgtcttcagtcatttttaatatttgcttaatttcatcaattgttaaatgttcagaaaaaatattacgctccgtatacggaatgtccatgttcttgktaaccatgctttcgcttttacggcaagatgtgcaacttggtgaagtaaataatgttaccatacatctcactctcctatttgaatgaataaaattcattgcttaaaatttagttatagatcaagaaaaaacatttttttctaaaattcttaatcgttactatttattataactatctaacattaaaattaaatgagaaaaacctaatttttcagataagtttctacacttataaaaaagattattaatccctttgttagtagtaagttatacgtatattctaacacatcttacatttttaagaaatactgttataatgataattattaaaatattactaagaaagtaggcatttaaatggagacattattttcaggcatccaacctagtggaattcctactattggaaattatattggcgcactaaaacaatttgttgatgtgcaaaatgactatgattgttatttctgtatcgtagatcaacatgcaattacaatgccacaagatcgtttaaaattacgtaaacagaccagacaattagcagcgatttatttagcttctggtatagatccagacaaagcaacattgttcatacaatctgaagtccctgcacacgtacaagcaggatggatgttaactacgattgcttctgttggagaattagagcgtatgacgcaatacaaagataaagctcagaaagcagttgaaggtatacctgctggtctattaacatatccacctttaatggcagctgatattgttctttacaatactaatatcgttccagttggagatgaccaaaagcagcatatcgaattgactcgtaaccttgtagatagatttaatagtcgctataatgatgtgcttgtgaacctgaaattcgtatgc

SEQ ID NO: 664 - DNA, 787 bp; double-stranded, linear
tgtaccttttgctttaataaatactgtttctttatcataattaggttcagttaagaaattaaattgtaagctttgagtaatatttttttgactatcacttgttgtagctgtacgtgtatacattttagtatcaccatcaagattcttctcagaaacttgtttgatttcagaattaatctttgcaaatgaagtagctggtaatacagtgaaagtagtcgatagtgctaasgwacaaattgtgatatttttacatagttgtttaatcattagtaatccgccctttcaatattatccttctttataaggtttattgtcatcagaatatttatcaacgactttaactgttttatttttccaatcaacttcataagtgacaattaatctttgaccatctttatttttctctaaaattggaggtgcataatgtatyccaggtctgtttttcaaaatatcttgatttcgtgtgtatgttacttcaaattgcgttttctcatttgacttttcattagataaataagttaaaaattctggattaaagccacttcttactaatgctgggtatctatattttgaagcaaagcttagttcagggttttctacagtagcaattctcgtatttctatagaataataattcatcatttctatttttcacttctccaccatacttcaagtcattcgcaataactgaccagtgtacatggccagttnatttatttttaccgctggcaattgtgtcataatttgctgcatcatcaactaatcgttttggaagtagctatttgctg

SEQ ID NO: 665 - DNA, 533 bp; double-stranded, linear
ttatctgtcattaaccactggtacatgtgaacccggcntnaatcaatatatatatttaaaagcaaaggcgcgccatgtgccttttttntattttgtatatctgtatcaaaatcgatttgattaaaatccgctttattttatcatctattcaaatgattttagtgcgcttattttactatggcattattgcctaacctgtttgagatatattaatatttgatgattcgtattcaaagttttcatttaacatgtatttagtatcatgatagctgcttcattgatgatatactacctactttttcaacacttcttgttcgataatcgttaatacaccctgcttatcattacttggagcgacagcagaggcaatattgaacaattcttcatcatgactattttccatcacataactatgcttagcgaacgctaacatatctttatcattattcgcatctccgaaggccatgagctctgaaggagacatttcccatttatctaacaatcgttttaatgcctgncctttagtcatgttt

SEQ ID NO: 666 - DNA, 400 bp; double-stranded, linear
gacttctcttgcactaaaaattgctcaaattgctcgctgtcataaccaggcggtgtttccaaccatacatatatgccacctttagcatgaacaaatggcaaatcagcttttgcaagcatggcttcgaatcggtcacgacgtgttttaaatacattgctttgttcttctaaaaaatcatcataatggattcaaagcatatattgcggtcatcttgtaaatgcaccaaacatcccagcatttgtgtgcgtttggtactttttcaaagcttgaaatcatatctttattaccaactgccaaaaccgactctgaaaacctggacatgttgatgaacctttnagacaagggaagaaatttgcaatcgcaacatctttgcccattttnccgaagcaagtgngactag

SEQ ID NO: 667 - DNA, 412 bp; double-stranded, linear
tctccaatgctactcaaattaaaaaggttttaaatattgttaattctgatccagagcgaaagattgttatcgtttctgctccaggtaaaagacatgataatgatattaaaacaactgatttgttaatcagattatatgaaaaggtcattaatcatcttgattatcatgataaaaaaagagaaattattcagcgttatgatgatattgtaaaagaattgcaaatggatgaaagtattttacggacgatagatgtgactttggaacattatataaatcaattaaaaaatgaaccaaagagactattagatgcattactttcttgtggtgaagattttaatgcgcaaytgatagcyttatataataatagtcaggttaccaacaamatwtatatccccgaaggaagcgggtattt

SEQ ID NO: 668 - DNA, 400 bp; double-stranded, linear
ttactcgttaaagatattgtaaaagatgaagtgacagaatatgacattcatcaaatgttaccgcatccgattaatatggtaagggttagactttttggtgtgaaattaaaagagattatagctaaaagtaataaacaagantatatgtatgaacatgcacaaggtttgggtttcagagggaatatatttggaggatatattctttataatttagggtacattcattctacagggcgttactatctgaatggagaagaaatcgaggacgacaaggaatatgtactaggtacgatagatatgtatacgttcggtcntattncccaacattgaaggattaccaaagagtatttaatgccagagtttttcagaggtatatttaangaaaattattggctattta

SEQ ID NO: 669 - DNA, 1236 bp; double-stranded, linear
tgttcgatatttttaaatttatcttttaaatacaacaactgtttccgtaatgatttaactgttttatgactaatgccattgaatatttctagcgttttatttaacttatcgataatcgcatgtaaatccttcaaaatgtcttttgtttcaaaagtaaatacattatggaagcgatgaatatcatcatcataaacatcagaatcattgataatcgtaaatatcgttgagaacaattgctcatttaactcatgaatctcattcatactagccttcaagccaaaaatatcaattggtgcaatatctaatttttccaaaattcgctgcttttccagttgatcaattgcctttaacaatttttcattttcgtttttaccaatcaaaccaagctgatatttaatatcagcataactcaactcatttgtcacttgatttaaggcatagtctggtaagcgatgtgcttcatccactatacaatcatcaaacaattgatatattgaattttcaacatcagaatgaattaaatgtgcatgatttgtaataccaatttgaatgttctgtgcatttcgcttaataaaattataataatgaacatcgtgacgtgccggtacatatgtttcaattttctggtcaaaatacatcttttgaccaccttttaaatttaattcctgtatatctccggacggcgtctctgtaatccaaatcagcaattgcattttcaagatattcacttcgtaattacttgtgtcatcttttaaaatttgactaataagccccaatgaaatgtaatcacttttacttttaatcaatagtgcattaattttaaaattcaacgcttcattcattgctggaatatctttttctaacaattgactttgcagtaatttagtattggtagaaatcatgacatgcttcccagtttcaatattatacatcaaggccgcaagtaaatatgctaatgatttaccactgcctagtgatgcttcaatcattgctttttcactatgcatgagctgatctaatatagtttccgctaaatataattgttgcggtcgatatgttaagccaagttgatctacagctttgctatataaagacttcaagctgccattataatttgttgtcggctttttaaaatcaacttgcttacgatagataatctgttcgaacttttcgtacgatttatccaatggctttgcatcatattgcctaaccatctcaaagaaaatatcatacaaa

SEQ ID NO: 670 - DNA, 1819 bp; double-stranded, linear
acasaattattgaccaatatgactcgtggactgatatgtttaaagcactactgcatgaaacatttaaagcatatggcgttctatttatagatgcgcagtttgagccgttaagaaaaatggaagcgcctatgtttaaaaagattttgaaaaaacatcagttgcttgatgatgcttttagagcaacacaacaacgtactcaaaatcaaggcttgaatgcgatgatacaaacagatacaaatgttcatttattcttacatgatgaaaatatgcgtcaattagtttcgtatgatggtaagcaytttamattaaataaaacagataagacatatataaaggaagaaattataaatattgcggaaaatcaacckgaattattttctaataatgtagtgacaagaccattaatggnagaatggttatttgaacacggtggcatttgttggaggaccgagtgaaattaagtactgggctgaactaaaagatgtatttgaactatttgatgttgaaatgcctatcgtgatgccaaggcttagaattacttatttaaatgaccgtatagaaaaattactttcgaaatacaatattccattagaaaaagtgttagtcgatggtgttgaaggagaaagaagtaagtttattagagaacaagcatcacatcaatttattgaaaaggtagaaggtatgattgaacaacagcgtcgtctaaacaaagacttattagatgaagtggcggggaatcaaaataatattaaccttgtgaataaaaataatgaaattcatatacaacagtatgattatttgttaaaacgttatcttttaaacattgaaagagraaacgacatcagtatgaagcmatttagrgraattcaagaaacactccatccaatgggaggattacaagaaagaatatggaatccacttcaaattttgaatgattttgggacagatgtgttcaagccctccacctatccaccactttcttacacttttgatcatattattataaaaccttaatataccaagggtttagcccgatttatcttaatgataaatcgggcatttttttgttttttaaaataaatttcacaaattttgtataaatagtggtggatagtggggagatgtggtaaattatatataaggtgaggtgataaaaaatgttcatgggagaatacgatcatcaattagatacaaaaggacgtatgattataccgtccaagtttcgttatgacttaaatgagcgttttattatcacaagaggccttgataaatgtttattcggttacactctagacgaatggcaacagattgaagagaaaatgaaaaccttacctatgacaaaaaaagacgcacgtaagtttatgcgtatgttcttctctggtgctgttgaagtagaacttgataagcaagggcgtattaacatccctcaaaacttgaggaaatacgctaatttaactaaagaatgtacagtaatcggtgtttcaaatcgtattgagatttgggatagagaaacttggaatgatttctatgaagaatctgaagaaagtttcgaagatattgctgaagatttaatagattttgatttttaaaatggaggaattgaagtgtttcatcatatcagcgttatgttaaacgaaaccattgattatttaaatgtaaaagaaaatggtgtgtacattgactgtacgctaggtggagcgggacangccctttatttactaaatcaattaaatgacgacggaagattaatagcaatcgatcaagaccaaactgcaattgataatgctaaangggtattaaaggatcatttgcataaang

SEQ ID NO: 671 - DNA, 609 bp; double-stranded, linear
accaattattggacaggaattagcaaaaaatgcaatgcttgcattaatctatgcatcgataggtatcatcatctatgtatcattacgatttgaatggcgcatgggtctttcatctgtattggcattattacatgatgtattcattatagtagcgattttcagtttatttagaattgaagtagatttaacatttatcgccgctgtattaacaattgtcggttattcaattaatgatacaatcgtaacgtttgaccgtgtacgtgaaaacttacaaaaggttaaagtgattacgacaacagaacaaattgatgatatcgttaatagatcaattagacagacaatgacacgttcaattaatacagtattaacagttattgtagtagtagttgctatactattcttcggtgctcctacgatattcaactttactttagcattatttatcggattgatttctggtgtattctcttcaatcttcattgccgttccgctatggggaataatgaaaaaacgtcagttgaaaaaatcgccgaaacacaaattagttgtatataaagaaaagaaatcgaacgatgaaaagattttagtttaaaatgaattaagcggtat

SEQ ID NO: 672 - DNA, 2222 bp; double-stranded, linear
cttaaaacagcaatttgaacgtttacaaaatgaacaaatctttgtttatgtttgtcatggtaatcacgatcctttatcatcaaagatttcatcaaactggccagataatgttnttgtattttcaaataaagttgagacgtatgaagcaattactaaatctggtgaaacaatttatattcacggatttagttatgaaaatagagcaagttatgagaacaagattgatgaatatccatcaagtcaaggccaaaaaggcatacatattggtgtcttgcatggtacgtatagtaaatcttcagttaacgaaagatataccgagttcattttagaagatttaaacagtaaattgtatcattattgggctttaggtcatatacatgaacgtcaacaattaagtgatatgcctgtaattaactattcaggtaatattcaaggtagacattttaatgagcaaggtgaaaaaggttgcttattaatcgmgggtgaccacttaaaattaaagactaaattttatcctacacagtatattagatttgaagaagcaactattgaaacggataagacatctaagcaaggtttatacgaggtcattcaaaactttaaagaacaagtgagagaagaaggaaaagccttttatcgtttaacgcttgttattaatagtgagacattaatttcacctcaagatttattacaagttgaagaaatgattacagattatgaagaaaacgaaaatcaatttgtatatattgatgagttaaaaatacaatatgcacaaaatgatgagtcacctttagttaatgaattttcagcggaattattagtcgatcaaactgtttttgataaagcgatgtcagatttatatttaaatccaagggcatctaagttcctagacgattatggaacattcgaccatacagcattagttaatcgtgctgaagaaatattaaaagctgaaatgagaggtgaacaaaatgataattaaatcacttgaaatttatggttacggtcaatttgttcaacgtaaaattgaatttaataaaaacytcactgaaatttttggtgaaaatgaagcgggtaaatcgacgattcaagcattcatccattcgatattatttggatttccaactaaaaagtctaaagagccaagactagaaccacgtctaggtaaccaatacggtggtaaattagtacttattcttgatgatggcttagagattgaagttgaacgaattaaaggcagtgctcaaggtgatgtgaaagtatatttacctaatggtgctgtgcgtgatgatgcttggttacaaaagaaacttaattatatttctaaaaagacatatcaaggtatcttttcatttgatgtactagggcttcaagacattcatagaaatctaaatgaaaaacaattgcaagattatttattacaagcmggggctttaggatcaactgaattcacgtcaatgcgcgaagtgattaatcgtaaaaaagatgaattatataaaaaatcaggtaaaaatccgatcattaatcaacaaattgagcaattaaaacaactagaaagtcaaattcgtgaagaagaagcaaagctagaaacatatcatcgcttagtagatgatcgagataaatcatcacgtcgattagagaatttaaagcataatttaaatcaattatcaaaaatgcatgaagaaaaacaaaaagaggttgctttacatgatcattcacaagaatggaagtctctagaacaacagttaaatattgagccaatcacattcccagaaaaaggtgtggatcgttacgaaaaagcacgagcgcataagcaatcgttagwaagagatattggtttaagaaatgagcgtttagctcaacttaaagaagaagcgactcaattagagccagttaaacaatctgatattgacgccttcattagtttgaatcaacaagaaaatgaaattaaaaataaagaatttgaacttactgcaatcgaaaaggatattgcgaataaacaacgtgataaagatgaattgcaatcaaatattggttggtctgaaacgcatcatgacgtagatagttcagaggcaatgaaaagttatgtcagtgagcaaatcaagaataaacaagaacaagctgcatacattaaacaattagaacgtagtttagaagaaaataaaatcgaagataatgcggttcatagcgaactagattctgttgaagaaaaatagttcctg

SEQ ID NO: 673 - DNA, 406 bp; double-stranded, linear
ttgcaggtatcatttttttaatgccatatggattatgttttctaccgttttataagcaaaaaaagaaaaaacagacatttaaaaaatacatggtttacactacgattggtttgtcaatttgtctaggcttatctctagttttggttcacactacgaaaatttatatggacgaaggtggcgtaagatactattacggtagttttgtaatgaaacaagcgggcggttatgcttatttagctttagcggtactttcaacgttgttaattgttgcgaaaaaagctacaaataaaaataaagaaatcgaaaccgtcgacaatacaaatataacggaaagataattaagggagtgctcattcaggagtgctcttttttgatgtccaaatttagttgcaaatgaaggcataga

SEQ ID NO: 674 - DNA, 927 bp; double-stranded, linear
ccactttgtggattttctttatattctccacgcttgtactacaacttctttcgtttctgtttcatcaccgactgccgcattcgttagcacatgtaataactcttttgcggttaatacattctcatctataatcttatctttttgttcttgtatatattgcttgatgtgcggctttttcaataacctacacgctgtcacatgtgcgctatttgcgttatatcctgyttttatggcactttgtgttacattcagtgttctaatatactcattcacaaaacgtgcttgctttgcagttaactcactcattttatcacccccacaattttatctaatatggtttcataccataatattacagattgttctgaacaatctaaggcactactaatatcttgataactaagtccttgtataagggagtcaaaaatataaaactctttatcggtcgctaatctgtcaacaatcatttctatgtgattctttataatatgatcattgacattatcgtctgtcatcaattcgtcagaatcttcatcacctattaaaaagaaatcatcagtatttatttcatcatcgccccgttaactagctttgaagtctttagcacacttgcatataccggctgtcgtgctggckagatactagcattgaagtggtctgatattgattttgaaaacaacacgattagtattactaaaacatattacaatccaaataataacaagaagaaatatcagatacttccccctaaaactgaaagttctatcggtaagatttccgttgacccaaatgtaataaaggtgttgcgtgattataagataaacgttcaaaataattggaaaaacgaattatataatgataaccattgtaatgaaaaaactatcaatgtggatacaaaccattatgtcacgtaccagcatactcaaa

SEQ ID NO: 675 - DNA, 1100 bp; double-stranded, linear
gatgttaanataagtacatcattttgactcccaaatattggctttagaccttgaaatgcttgttgtgcgatgtcttcaaaatctttagaacgatgaccaaccataggtgcttgaatntctctcataatggcatcaggtaccaggggttgggaccaggtgttaataacaacggttgatgataatacatttatatgcctcctataaataagatttcactattttagcaaattttctgaaaatttaaaagcctaaaaagtgataacgctatattgtcgaacaaacgttatcacttaacgattttatttggcctgaatgatgggatagatttttatgtccacattatttcttacagcatttgaaatcatgcaattattatctgcaattgttatcaattttggtaatcgcttttctaattgtgctatttgatcacttggaatttgaatttgaggatggtgcacaatttttgacatactgaattttccgttatttaaacaagctgttccaatcgattgttgtkcaattgaaatatctgtgaactttgcacgttcaagagtagctgctaatgagatgatataacatgatgaagcggctgatactaacatttcatcgggatttgttcctataccaacaccacctaaagaagcaggtatagaaatattctctgaaagtatgtcgccttgaacgtttccgacattgttacgaccaccttgccaagaagtttggactttaaagtcatgttgatgcaattgctttaacctccaatataattgtgatagtttaattttagaatagtttatcaaagtttaacagaaaggtgacttatcaatgactctgaataaactgaaagatgaattacaaattgtttcgcaccgtggattgccgagtgattttcctgaaaatacaatggtcggttatcgagaggtaatggggctcaatgttgctatgttagaaatagatgttcatttgaccaaagaccaacattttgttgtgatacatgatgaaacaattgatagaacatcggatggtarggggcgtawtgctgattacacattatcgcaattaaaatcatttgattttggtagttataaagatgttgcttt

SEQ ID NO: 676 - DNA, 460 bp; double-stranded, linear
attaatttcatatggaaatagttgaactaactgcgctgtataagcttcaacagtttgatgaattaacgattgatcttcaatatatccgtagaacaaatcttcagtacaaactactttacctttatcaggtttaattgcacctgccaacaattgacctaccaacgctttggaagattcaggttcaccaattatacctaatgcttctccttgataaatatgtaaactaatattgtttaaatcgatatcttcagcatcatatccaaaaggtaaataccatttcttattctgtttattcctatagtagtgtgttacttttagtaactttaaaacaattgaacttcccatctattttcatccttctataattgtaataacgctataggtaatccttcytcgggttcatcgctattaaatctaaacccccacgcaaaaataccttttaatcttnctactttaaaat

SEQ ID NO: 677 - DNA, 1451 bp; double-stranded, linear
gtcaagttttcggctagattttaaacgctcatcactatgtagaatgaaactttcgaaaaactgtaaatcatcataaccttttacataaacataaccttcgccaccaattgcttgaattaaacattgggcggccatttgaatttctaaagattgtttttctagcctattaaagatacctattagttgtgtgtttaagatttttgacatctttatcctccaatctacttataaaatattgtaattaatgactacatattatgcaacggcttaaattgtataaaaatgtatacgtttgcatttagtataactatcgcatttttcaaaaaatacacatttaatctgcagtatttcaatgcattgacgctatttttttgatataattactttgaaaaatacgtgcgtaagcactcaaggaggaactttcatgcctttagtttcaatgaaagaaatgttaattgatgcaaaagaaaatggttatgcggtaggtcaatacaatattaataacctagaattcactcaagcaattttagaagcgtcacaagaagaaaatgcacctgtaattttaggtgtttctgaaggtgctgctcgttacatgagcggtttctacacaattgttaaaatggttgaagggttaatgcatgacttaaacatcactattcctgtagcaatccatttagaccatggttcaagctttgaaaaatgtaaagaagctatcgatgctggtttcacatcagtaatgatcgatgcttcacacagcccattcgaagaaaacgtagcaacaactaaaaaagttgttgaatacgctcatgaaaaaggtgtttctgtagaagctgaattaggtactgttggtggacaagaagatgatgttgtagcagacggcatcatttatgctgatcctaaagaatgtcaagaactagttgaaaaaactggtattgatgcattagcgccacattaggttcagttcatggtccatacaaaggtgaaccaaaattaggatttaaagaaatggaagaaatcggtttatctacaggtttaccattagtattacacggtggtactggtatcccgactaaagatatccaaaaagcaattccatttggtacagctaaaattaacgtaaacactgaaaaccaaatcgcttcagcaaaagcagttcgtgacgttttaaataacgacaaagaagtttacgatcctcgtaaatacttaggacctgcacgtgaagccatcaaagaaacmgttaaaggtaaaattaaagagttcggtacttctaaccgcgctaaataattaatatttagtctttaagttattaataacgtagggatattaattttaaaagaagcagacaaaatggtgtttgcttcttttttatgtcgtataagtaataaataaaacagtttgattttaaaatgaaagcgtaaaaatggtaaaatatatcaaaattgattgtgata

SEQ ID NO: 678 - DNA, 668 bp; double-stranded, linear
ngtattgaagcggttaaacaaacacctaatgcaactgacgaagaaaagcaggctgctgttaatcaaatcaatcaacttaaagatcaagcaattaatcaaattaatcaaaaccaaacaaatgatcaggtagacacaactacaaatcaagcggtaaatgctatagataatgttgaagctgaagtagtaattaaaacaaaggcaattgcagatattgaaaaagctgttaaagaaaagcaacagcaaattgataatagtcttgattcaacagataatgagaaagaagttgcttcacaagcattagctaaagaaaaagaaaaagcacttgcagctattgaccaagctcaaacgaatagtcaggtgaatcaagcagcaacaaatggtgtatcagcgattaaaattattcaacctgaaacaaaagttaaaccagctgcacgtgaaaaaatcaatcaaaaagcgaatgaattacgtgctaagattaatcaggataaagaagcaacagcagaagaaagacaagtagcactagataaaatcaatgaatttgtaaatcaagccatgacagatattacgaataatagaacaaatcaacaagttgatgatacaacagtcagcgctgatagcttgctttagtgacgcctgaccatattgttagagcgctgctagagatgcgt

SEQ ID NO: 679 - DNA, 1906 bp; double-stranded, linear
gatccaaatttaaaaggaaaaatagcctttaacgaatttacgaaacaaattgaatgtttagggaaagtgccatggaatactaattttaagacacgtcaatggcaagacggtgatgatagcagtttaagaagttatatcgaaaagatttatgacatacaccattcaggtaaaacaaaagatgccattataagcgtcaatgcaaaatgcttatcatccagtaagggattatctaaataaaatatcgtgggatggacataaacgccttgaaaagttatttatcaaatacttaggtgttgaagacctgaagtgaatagaacaactaccaaaaaagcattgactgctggaatcgctagagtaatggagcctggatgtaaatttgactatatgcttacactttatggtcctcaaggtgtaggtaaatctgctttgctaaaaaaattaggtggtgcatggttttctgacagtttagtttctgttacaggtaaagaagcttatgaggccttacaaggcgtttggctaatggaaatggcagaacttgcagctacaagaaaagctgaagttgaagctattaagcatttcatatctaaacaagttgaccgatttcgtgttgcttatgggcattatattgaagattttccaaggcaatgtattttcattggtacaactaataaagttgatttcttaagagatgaaactggtggaagacgtttttggccaatgactgtaaatccagagagagttgaagtgaactggtctaaactaaccaaagatgagattgaccaaatttgggcagaagctaaacactattatgaacaaggagaagatttattccttaaccctgaactagaagaagaaatgcgttcaatacaaagcaaacatactgaggaatctccatatacaggcattattgatgaatatcttaacacaccmattcctagcaattgggatgacttaactatctttgaacgaagacgattttatcaaggtgatgttgatatgttaccaacaggaaatgtagattacgttaaaagaaataaagtctgtgcgcttgaagtgtttgttgaatgttttggtaaagataagggagatagtagaggatctatggaaattagaaagatttcaaacatcttaagacaattagacaattggtctgtatatgatggtaataaaagtgggaaaattcgatttggaaaagattatggtgtacagatagcttatgtaagagatgaaagtttagaggatttaatataagaaatattgaataaatatgcattttagagtgttgtatcagatgttgcatcattttttgagtgatgcaacacgggagtgtaaaaagtaatcgtaggtgttgtatcatttttggtgatgcaacattgatgcaacaaatgatacaacacctctttcctttctagctgtagggttcaaccctgtttgtttccaatgttgcatcaaattcactataaagtttaaaaagtagtgttagggagtaaaggggtataggggtaaccctctaacagctatttttaaaagtttggcaagaattgatacaacatcggaacacaaatataaattttgtatacaaggtgaataaatgaaagaatcgacattagaaaaatatttagtgaaagagataacaaagctaaacggtttatgtttaaaatgggtcgcacctggaacaagaggtgtgccagatagaattattattatgccagaaggaaaaacatattttgtagaaatgaagcaagaaaaaggaaagttgcatcctttacaaraatatgtgcatagacaatttgaaaatagagatcataaagtatatgtgttatggaataaagaacaagtaaatacttttatcagawtggtagtgaacatttggcgattgactttcaaaccacatagctntccaaag

SEQ ID NO: 680 - DNA, 948 bp; double-stranded, linear
aattatttgaataaattagcaattaaagagttgatttgtcagtttaagyatttgagtgcatttgaaaaagatgtcatgtatttaatgtgtgaacaatataagccgagagaaattgctcaattgatgcatgtaaaagagaaagtgatttataatgccatacaacgatgtraaaataaaataaaacgttatttcaaaatgatttgaaaagcgccttaggacgtgaattgaattataacgtgttacttactgatggtttgacatttgttataaattttatgtatagtatactggtattataatgaataaaggtgaattattgtgagaaaaatacctttaaattgtgaagcttgtggcaatagaaattataatgttcctaagcaagaaggctcggcaacaagattaaccttaaagaaatattgtccaaaatgtaacgcgcacacaattcataaagaatcgaaataaatacattcgaaataatactttgataatatgttcaaaggatttggaggttgagcagatggctaaaaaagaaagtttctttaaaggcgttaagtctgaaatggaaaaaacaagttggccgacgaaagaagagctatttaaatatactgtaattgtagtttctactgttatattcttcttagtctttttctatgccttagatttaggaattacagcattgaaaaatttattatttggttagaggagtgaagacatgtctgaagaagttggcgcaaagcttggtatgcagtgcatacatattctggatatgaaaataaagttaaaaagaatttagaaaaaagagtagaatctatgaatatgactgaacaaatctttagagtagtcataccggaaggaagaaggaaacctccagtaanaagntggccaagcctaaaaccgcctgttaaaaaaaaccattcccctgggntanggttttaagtgggaatttaa

SEQ ID NO: 681 - DNA, 863 bp; double-stranded, linear
acanataataacaaagcgcttgctagtacctcttaaaaagatgatgctagcaagcgcttktctatactatatattatttttctaaaattttaacaccctcttgagtgcctacaataacttgatctgccatatctaagaagtatcctgtctcaaacacacctgtcagatgaattaaatactcatggaacttatatgggtcaattccttttggtaacttacaatctaaaatataattgccattatcagttataaatgcgacatcttcgtttacacgacgttctacttttatatcagcgtatgattcaattttacgtaatatgtgataccagttaaatttatccacctctactggtaacttaaacgtctcacctaagtattgaactattttcgtttcatcgacaaccacaacaaaacgcgatgccatttcatctataactttctctctgaacagcgcaccaccgccacctttaattatatttaaagatggatctacttcatcagcaccatcaattgctaagtcgatatgatcaacatcattgatttcacatattttaatacctaattcttttgctaaaaatgcaattttattagaagtgcatacacctgtaatattgtaaccacgttctttaattagttgcgccatttgaggtaagagtaattccattgtacttcctgtaccaattcccagcgtcatgtcaccattgattkgacttaaaacatcatttaatgtcattaacttgagtgctttgacatctttcatgaaggtagcctcccatatttatgtaatctattcaattcatattttacatgactcgtataaattaacatacccttatngctaaccatttgtgttaaacatatcg

SEQ ID NO: 682 - DNA, 480 bp; double-stranded, linear
ttcatttttgttgttcagcaattttggtccgaatttcaattcatcagatgatagctctattaattctgtagaatattctgctacaacaatttcataaatatggcctttttcttccattattatttcatcaattatttcataattcaattgttgtaatgtttgtcttaaattttcagtttggatattactttgtaaaatcaaccttggatgttgacttaacttatcttgcccatcttttaaaattttagcaataagtggtccgcccataccacaaattgtgatattatcgattacgtcctcaggttgaataacacttaagccatcccctaaacgtacatcaattctatctactaattggtttgcagctacatttttcacagcagcttgaaaagggccttgaataacttctccagcaataccgattcgcataaatggttttgaattgcatagattggcaaataagcatgatctgagccaata

SEQ ID NO: 683 - DNA, 689 bp; double-stranded, linear
ctgcaaaaaatattggtataataagagggaacagtgtgaacaagttaataacttgtggataactggaaagttgataacaatttggaggaccaaacgacatgaaaatcaccattttagctgtagggaaactaaaagagaaatattggaagcaagccatagcagaatatgaaaaacgtttaggcccatacaccaagatagacatcatagaagttccagacgaaaaagcaccagaaaatatgagtgacaaagaaattgagcaagtaaaagaaaaagaaggccaacgaatactagccaaaatcaaaccacaatccacagtcattacattagaaatacaaggaaagatgctatcttccgaagrttggcccaagaattgaaccaacgcatgacccaagggcaaagcgactttgttttcgtcattggcggatcaaacggcctgcacaaggacgtcttacaacgcataactacgcactatcattcagcaaaatgacattcccacatcaaatgatgcgggttgtgttaattgaacaagtgtacagagcatttaagattatgcgaggagaggcgtatcataagtaaaactaaaaaattctgtatgaggagataataatttggagggtgttaaatggkggacattaaatccmcgttcattcmatatataagatatatcacggtaattgcgcatataactt

SEQ ID NO: 684 - DNA, 858 bp; double-stranded, linear
ttattaaattggtatgtgttcattatacatatgacaaatatgaatgtaaaccgataatttagattttttggaataacctgaaaattcaagttatagcgttgcttatattttaaaaggtggtgataatgagactttttgaaaaataaaattcaaaatacttatagcataatcaatatgcacattaaataaatgtactcttttaatgcgttgataactgtatttgtaatttagagaaggggtgttcactatgctgatgtgttaaaaaataaaataaaaaggacacctcgatgctataaatattagcatcgagacgcccagttaatgtctattaaattgaatatagtctcggacatgaatcaatgccctaggccctgcaatgttatattgacagtagttgactgaatgaaaatgactttgtagctagcttttttcaatccttgtcggtgcaacacatagagaaattggattcctaatttctacaaacaatacaagttgcggaataagtcccaatatagaaggtgacagtaagccaacttacaataatgtgcaagttggtcgggcctcaatacagagattttcgaaaagaaattctacatattatgtttattttaaaacgccgatttcttgtaaatattcttcatatggaatttcttttgaaacgccaccttgtttatttaaatcgataacacggtttgcgattgtattgataaattcaaagtcatatgaagtaaagataatagaacctttgaatgatttaagtccatcattaacagcagtaatactttctaagtctaagggttgtgggtcatcaagtaaaagacgttgccctgataacatcatttactagcancacgactt

SEQ ID NO: 685 - DNA, 1747 bp; double-stranded, linear
ttagtattttcaggntggaaattgatgtttgaaattcactgaaatgggccagaacctgaaatgaaactttaccaacaatttggtcttcatcaatgaggccaaacgcacggctatctttacttacttcacgattatctccaagcactaaatatttaccttttggaatgacatttgatttaggattcgcattcggtaaatctttaacttggaaagtcccagtaatgtaatcaccttgtttatgttttaaattgtagtttaaatatggttcatcttgttttttaccattgacatataatgtatcatttttgtattctactttatcaccaggaacaccgatgacacgtttaacatagtcatcatttttgtttgcatggaagacaactacattacctttttccaaaccacctgttttatatccaacaatgtttacagctactcgctcgccatctttcaaagttggatccattgattcacctttaattgtatatggcgtaacaataaatttacctactataaataaaatgacaaaagcgactgcaattgaaataatccattccaatatttcttttttcaattttgacacctctttttaagatttgaactgaacagtccattttgaaaaaggatagtatcgtaaactaacattaccaataatatcctttttatcgattaaaccaaattgtcttgaatcgtgcttgtkattatcttgatcatttagcacaacaaaattgtttggcggaataatatcaccatctaattctttaaaattgcgcaaactaaaatctttaatttttctgttcttggcataagatgcgtcaaccggtcggtcatcacggtataattgtccctgacgaaacgccattgattgaccaggtttggcaataattcgactagtatatatctcgttaccacgcctatatgtaatgatatcaccattattcaattgattaaatgtaactttaattttatttacaataacacgatcccctttgttaagggttggtgacatatcattattcggaatgacatgaccaactattacaaaagtttgtacgaacagtacaatgataatagcaagtatcaatgaaatcaaatattttacaacttttttcacgatgtcactcctttttcgatcccataaaatgctgttctaacttttttccaacaatccaaaatacaaccaacacaactaacattaatatccctcttaaaggatgcgttaaaattgtagtaatttccttacctaaataacctaaaataattgttgaaactaactttgatgatgccaaaacaatgaaataatatttaggtctaatatgagatagactcgctacaaaatttattaatgtatttggcgtaaaaggaaaacaaagtaaaataaacaatgggattaatccttggcgatcaataaaactaatcaagcgttgaacagcagtacgttgtttaattcgctgcatcctctcagtgttcaccaatcgtttacagatcaaatagactgtaaatgttccagaaattaatccaagccaactaatcaatatacctaaaataggtccataagcttgaatgttaattaaaatatagagtgctaaaggaaatactggaattatagctctaatatataacaatataaatccaggtaaataaccaaactgtcgaaatatctcaaaccattcttctacttgatgaaacgacaaatcatcaatccctttctttggttgaagataattattcttacattataaagtta

SEQ ID NO: 686 - DNA, 645 bp; double-stranded, linear
cgtaaagattactatttaggagggtgactatgaaaaagaaattaggtatgttacttcttgtaccagccgtaactttatcattagccgcatgtgggaatgatgatggaaaagataaagatggcaaggtaacaattwaacgacagttatccmttgcaatcatttgcagagcaaattggtggaaaacacgtgaaggtatcatcaatctatccagcagggacagatttacatagctatgaaccaacacaaaaagatatattaagtgcaagcaagtcagacttgtttatgtatacaggggataatttagatccggttgctaagaaagttgcatctactatcaaagataaagataaaaaactgtctttagaggataaattagataaagcaaagcttttaactgatcaacacgagcatggtgaagagcatgaacatgagggacatgatcatgagaaagaagaacatcatcatcatcatggtggatatgatccacacgtatggttagatcctaaaattaaccaaactttcgctaaagaaattaaagatgaattagtgaaaaaagatccaaaacataaagatgactatgagaaaaactacnaaaattaaacgacgatcttaagaaaattgataacgatatgaagcaagttacaa

SEQ ID NO: 687 - DNA, 956 bp; double-stranded, linear
tttgttactgcttctaaaataatatcctttaattgtttaacatgttggattgtcatatgaggtgatggtacattaaaaggatttaattcatctatttgtgcatattgatttatgacatcttgatgcattgaaatagggttgatatcatttgttactactttattagattggtcttgtgacatactaatggtgccaccagtatgaataacaagtagatgtttcatatatttcctcctatatttaatttacctaattatgataaaatattattcataaaacgacaaggaagggaaatgacgcatgaaagccattaatattgcattagatggtccagctgctgccggaaaaagtacaattgcgaaacgtgtagccagcgaactatcaatgatttatgtcgatacaggagcaatgtatcgtgcattaacatacaaatatttaaaattaaacaaaactgaggactttgcaaaactagttgaccaaacaacattagatttaacttataaagcagataaaggtcaatgtgtcattttagataacgaagatgtaacagactttttaagaaataatgatgtgacgcaacatgtttcatacgttgcatctaaagagccagtacgttcattcgccgttaaaaaacaaaaagagttagctgcagaaaaaggtatcgtaatggatggtcgcgatatcggaactgtagtgctaccagatgcagatttaaaagtatatatgattgcatcagttgaagagcgagcagaaagaagatataaagataatcaattaagaggtatcgaatcaaattttgaagatttaaaacgtgatattgaagctcgtgatcaatatgacatgaaccgtgaaatatcaccattaagaaaagcagatgatgcagtgacattagatacgacmggcmagtcgattgaagaagttactgacganattttagcgatggtgagtncaattna

SEQ ID NO: 688 - DNA, 1166 bp; double-stranded, linear
aaaagggaggaaagagaacagttaaatatgaatacaaaataattttgttttcggacagcaggggtattagacgcgattgacaatgtctgtttaattaaacgtaatgtttatttaagcgatgaatattaggtgaaaagtttttgaatttgaatgtaattgaggtttattgattagacattttattgaattgcgtgttattatataaatgtaaaaataagacgacatgcgcgaacatgtcgtctaagcaagccaaacgctggcttctaaaatatttttttaaccattccaacttgccaaagttaatgcggaatggtttttttattttccgctaattgaaataaaaatgacgttttaatatattatgggctaggtggtttgtaagaaagggttagttattaatgttttatgaattaaggaaatttgagtttaaggtttaatcaattgtgattttgttgatgaagcgtttagttagagtattttcgccaccactagttactccttctcccactttacccgagactggagaagagctatctgaagaataaatagatactttttggccattttgtagtaaaccaagaccttttaactkctcggttagagaattccatgtatttttagcatctagctttttgttaaagtcaycgtagacattttccttagttaaatcaatttgttttaatcctttaaagtctatagattgtgttagatggcctccatcatcatttccaggagcagaaacgctgctagaatatccattgcttaataaataagtaacgttgattgtttcgtactcgttacttaaaataatatcagaatcatgtaagaatctttaacttttttccataattgaccatctgtcattttttcttctgctttagccgttttaacaactttatttgtatctaatcctaagtatgaagaatgtaagcctgttcctaatgttgttaatactaaagcacttgctactaatgttttacctaaaaattttgtattcatttttattgctcctttttttatattgtaaacgtttacaatgaaaatataataataattttttaaaagaacaattaactaaatatcaaaaatgtattaactatctattaactaaaaaatagaataattttttaacatagttttgttgttttgaattataaaaactaaag

SEQ ID NO: 689 - DNA, 1083 bp; double-stranded, linear
agcactgaaggatggctagttgtcatagcatatgcggtcattggtatagttataacgagcgtttcttatatgttgtctattaaaatttttaacaaacaagaactakaattgtcgattttggtgatgatagtatttgaaataatatttagagcaggtgataaatctttacgattgtcatctgttcttttkggtgtggaatgaaatgtgggggataagtataggtgacatatctatattgatttatttgttttgaggtggttatgttgtgtgggaattatttccttttagatagcggggattagaggatatatgttatttataagtatcatttgatgattgtataggctaacgatttcctcggaaatatttaaaaacctcgatcatgtagcataactgaagtttgtcacaaaagtataatgtgaagttcgacacttttggattcagttcaaatactttgaccgaggtaaatactatttattcatgtttattacgtagacgttgatttttaaaataaatcagcatgatgcagaaggttgcaactgatactgagataatcattacatggtcgtgacctttaaataaaaggctgacaatataagacataacgagtatacctagtgaatatgaaatatacttcgcgtttgtcagttcattatggaaataaggcgtgattaaccataatccaatatagaatattaaaacactgatatacatcatattaatttcaaacaagtcatttagtttattgttattactaaaaacaattgcagcattaatcacacctaaagcgatattgattaatagatgcgtatacgataaacggaaaccgatagatgttaatttatgattaatataattttcagtaatgatccaatatacaccgaaaagactaattaaaatcataaattggaatatataaatgtaactaaaatgatcaatgctaaatgatgacgaagctaaaccaaccagtacctcgccaragwtataattgttagtaacgaaaaacgtctactaaatgcatcatattaacaggtntaatacaagtatttctgaaatggaataagnctgtcgctgcatgatacg

SEQ ID NO: 690 - DNA, 627 bp; double-stranded, linear
ttaatcatctggatgtatttagtattnagaataataanaaaacgatcatgttgtatttgagtagcgattggtttgcggaattaggctttactttctttaattaccactatacagcaaagttgattaaatcatcctataatttgaaatgtctactattaaaattgacatatcgataccttgataatcagcctcttaatgacgctgataytagaaaattacaggatattattaaaatcattgcaaaagaagcaagtatggataaaaagattgcacaaaatcaatatcgatatgcgtattatggtgatttgcgtgatgagctcgaatatatttatcaaaatgtaaatcaacgattgacattaaaaagtgtcgctgataaattatttgtctcaaagtcaaatttgtcatcacaattccacttacttatgggcatgggttttaaaaaatatattgatactttgaaaatnggtaaatcgattgaaattctacttactactgatagtactattagcaacataagtgancatttaggttttagtagtagctccacttactctaaaatgtttaaaagttatatggatatcacaccgaatgaatatcgtaatttatcaaaatataataantgtttac

SEQ ID NO: 691 - DNA, 641 bp; double-stranded, linear
ttgaacgtaatgctagcaaatgactttgtgccataaaatattcttcccatttgattctttccaagatgttcaccttccatacttaaaatttagtaacattttctaataatataagattaatcacaaaaaataaaatttgcaattaaaataatccattatgtcgtgaaataagatttcagtttatcaaaagttttacttccaaaaccttttacttttttcaaatcgtcaatttcttgaaatgcaccttgttggttgcgatattcaacaattgcattagctttagcttgcccaactccaggaacagacatcaattctgatacagatgccgtatttaaatttactttagtattatttgtgttcccatttttttcgtgcacactgtttacttcaatttgtggttcaacattcttttgtcctttatgaggtatgaaaatcattttttgatctgttaatttttcagacaaattaatttgacttacatctgcatcctccaataattgtgctttatcaagtaaatcaactactctatccttagatgtcattttataaacattaggatgtttaacagcaccttttacatcgacatatacaggacccttatttttggaattatctccatctttgacctggacatcttctac

SEQ ID NO: 692 - DNA, 631 bp; double-stranded, linear
tattaaagnacttgatgaaccaaatcataaaaagcnatatatgttatttgcagctggcattgtgttngcaactattttacttatttcggcacatttatacagcagaaagagaggtaaccaagtttgagaatcataaagtatttaaccattttagtgataagcgtcgttatcttaaccagctgtcaatcttccagttctcaagaatcaactaaatccggcgaattcagaatcgtaccaacaactgttgcattgacaatgacattggacaaattggatttaccaattgtcggcaaacccacgtcatataagacattgcctaatcgttataaagatgtaccggaaattggtcaaccaatggagccgaatgttgaagctgttaaaaagttaaaaccaacacatgttttgagtgtgtcaacgattaaagatgaaatgcaaccattttacaaacaattaaatatgaaaggctacttttatgattttgatagtttaaaagggatgcaaaagtcgattacacaattaggtgatcaatttaatcgtaaagcacmagcaaaagaattaaatgaccatttaaattctgtaaagcaaaaaattgaaaataaagcagctaaacaaaagaaacatcccaaagtat

SEQ ID NO: 693 - DNA, 1111 bp; double-stranded, linear
aatttaactatgttttccacattgtttcatgtcacgaaaaggacaacgcgcgactataagtatcaactatttccacaagttttattggtgtttttattattcatcgatacgcttcattttcatctctccaacacaaaaaagaagctaagcaacttatgttgcctaactcctctatactatccatattttactattatccatatttcattgaattatctaatgttggcttctattttttcaatatttctaccgtcaatgacgtcactcatgcgatttgtttgtaattttttattaagttcaaacgtataatagccgccatctttcattatcacttttatcttactatctttaggaaactttttatacagatcaaaattttgaattaaatactgtctcaatttaaagtcgagttctttaagtgaaatctcttctttataaatgtagtgtactctaccgtacgtagcaataccgtcaccttcatctctcttgatttgaaatcttggtgcgtttatataatcataataagcgtcttgatttttcttagtgacaccaccatatgaaaacactgtgccattacggttttccgcttctttaacaacaaatatgtctaatcccggatttttacgtgctttaaatctttcaatatctttaccaaatatctgtactcttgtgaattttctatttttatcaaagataaggtaatgcttgccacctttgctataacgataaccagtaacatttttaagttccttacttgcgccactatagtaatctcttaagtcaaagatatcttttgtcacattttcatattttgctttatgttcactcgcatttacagtttgatgcaatgacgttattgttcctgttgctaaaatacctaatgctaaacttgctttcgcaattgctgtcattttcatagttgtatgctccattcgtaattattagatttgttcgcttacgtctattgaatcatacagctttattatagttagcgtatttgacctttcacattaaaccatgtttaataatcattgaatcattattaagtaaattaaggatctataatgttcgttaaataaactgancccgttgtgcttcacacccgntngat

SEQ ID NO: 694 - DNA, 426 bp; double-stranded, linear
ttatggatggattaagaggtcgtgttgaaaaaatcaacgataactctgttattgttgacttaacaattatggaaaattttaatgaccttgatttaccggaaaaaactgttatcaatcataaacgatataagattgttgaataagaaggtaagttataatgaataaaatctcgaaggctttaacttggtttattataagtttcattatatttcatctcatattatttattatgtggggcgaacaccaagaatactggtatttatatacaggtataatgctaattgctggtatcagttatgtattttatcaaagagatattgaatctaagcggttgcttacatcaattggtgttggtattattacggcaattattttaattatgcttcaacttttatkctcacttataacttctaatttaagttatag

SEQ ID NO: 695 - DNA, 737 bp; double-stranded, linear
aaaaggggngtaaggtttagctcaagtacgagaagtctttggtgatgaagcaattgatgaaaatggtgagatgaatcgtcgttatatgggtgatctagtgtttaatcatccagaaaaacgcttagaattaaatgctatcatacatcctatcgtgcgagatattatggaagaagaaaagcaagaatatttaaaacaaggatataatgtaatcatggatattccattattatttgaaaatgaattggaaaatgcagtagacgaagtgtgggttgtatacacttctgaaagtatacaaatggatcgtttaatgcaacgtaataatttgtcattagaagatgcgaaagcacgtgtctatagccaaatttctattgataaaaaaagccgaatggccgatcatgttatcgataatttaggggataaacttgaattaaaacaaaaccttgagagattgttagaagaagaaggttatattgaaaagccgaattacggagaagaagattaatattacactataaataagtcattactttacgtacgcgttgatgtatgtaagtaatgactattttttataaaaaagataaataaatcaacggaaaacgctttcaaatttcatataatatgctatactaattccataaagtataacacataaagatcaaggggtgcttttaatgtcaacgaatattgcaattaatggtatgggtagaattggaagaatggtattacgtattgcatta

SEQ ID NO: 696 - DNA, 432 bp; double-stranded, linear
aacgataagaacaaaagatatattacaaagcgtttatttaaaacgttatttattacgcgcgatgatggcaggatttattatcgggattattacggtcttcgtattatcagttaaagcaacacacgaaccagatttaccgccaggcattgtgaatatggccagtgccattacattcagctttgcgttagtactcattttatttacaaactccgaactactaaccagtaacttcatgtactttactgtaggcctgtattmtaaagtaattaaaccaactagagtattgaaaatatttttattatgctttgcaggaaatattttaggtgctgctatttyatttagtttcatgcgtttttcaaatgtaatgacgccagatawgttaaaycagttatcagcagttatagagcataaaacgttgtctactggttttgt

SEQ ID NO: 697 - DNA, 782 bp; double-stranded, linear
cttttatacgaaagttaanatcaaatataacattaatgtttgatggggattttgcgggtagtgamgcaacacttaaaacaggtcaaaatttgttacagcaagggctaaatgtatttgttatacaattgccatcaggcatggatccggatgaatacattggtaagtatggcaacgatgcatttactgcttttgtaaaaaatgacaaaaagtcatttgcacattataaagtgagtatattaaaagatgaaattgcacataatgacctttcatatgaacgttatttgaaagaactaagtcatgatatttcgcttatgaaatcatcgattttgcaacaaaaggctttaaatgatgttgcaccatttttcaatgttagtcctgagcaattagctaacgaaatacaattcaatcaagcaccagccaattattatccagaagatgagtatggcggttacattgaacctgagccaattggtatggcacaatttgacaatttgagccgtcaagaaaaagcggacnagcatttttaaaacatttaatgagagataaagatacatttttaaattattatgaaagtgttgataaggataacttcacaaatcagcattttaaatatgtattcgaagtcttacatgatttttatgcggaaaatgatcaatataatatcagtgatgctgtgcagtatgttaattcaaatgagttgagagaaacactaattagcttagaacaatataatttgaatgacgaaccatatgaaaatgaaattgatgattatgtcaatgtta

SEQ ID NO: 698 - DNA, 714 bp; double-stranded, linear
aaatcattggcaaaatatacgaattgcatttaaatcgtcaatttacatatatttttgcgtagtaatcaatcgttatcattgttatttatcgttacattatttcgagtatcagtatgtatttcgggcttcgtttgataacgacatttctttgtgacatcgcttcatcagtgtaacaacaaatacaatgatttcgtgatgttagttacccattttatgtgttgcataaaatatgttgttataaaacattttaaatcattttatataaacaatctatatatttttggcatttccaaaatatcacttgttatattaaaaaccgacaagacattttatcttatcggttgaaatttgttattgttatttgtaatgtttttaggtttctttttaatataatatatttcagtgaaaatacatgattgattgtgatttcactgaaacatggttaattgcgttgttgatgaataactttagcataaatataggaagttattttgtacatcgccatatatagaaacgaaattataatgacagctagtacgtaacttgttaaaaatatatgatggttattaatacctatcatatttagtaacgtatatacaatgttactagaaattaatgtgtgaatcagtgctactgttattggtattgcgaacaagaaagtcatttgatttcgtgttatctttgctattcttccattatctaaaccaagttttt

SEQ ID NO: 699 - DNA, 361 bp; double-stranded, linear
actgagagcaataatttagtaacttctactcaaggaattattaaagaagcattgcataaattgggatttgnntttaattaaagaacctttaagaatgttacaagtgcgtatccctgtacgaatggatgatggcacagtaaaaacattcacaggttaccgtgcgcaacataatgatgctgttggaccaacaaaagggggcgtgcgtttccacccagatgttgatgaagaagaagtaaaagcattatcaatgtggatgactttgaaatgtggcattgtgaaacttaccatacggtggtggttaagggtggtgatcgtttgtggatccacgtcaaangagcattccatgaagttggaacgttta

SEQ ID NO: 700 - DNA, 943 bp; double-stranded, linear
gtccttaattggtatccacctttagcaccgcgtacacttcgaattaaccccgcatttcttaaaggacctacaagctgttctaaatataaatcactcaaattattttcttcagcaattgactttaatgatatacatccttgcccctcttttttagcaagagaaatcatcaatgtaagtccatatctccctttagtagaaattttcattgtataacctcacttaattcgaatattgatattcccattttagcattttttgagttaagatagtataagaaaggtgtgacaaatgtgagtacagaaccattagcatcgagaatgcgcccaaaaaatatagatgaaatcatttcccaacaacatttagttggaccaagaggcattatcagaagaatggttgatacaaaaaaattaacttcaatgattttttatggtccacctggtataggcaaaacaagtattgccaaagcaatttcgggcagtacgcaatataaattcagacaattgaatgctgtaactaacactaaaaaagatatgcaacttgttgttgaagaagctaaaatgtctggtcaagttatcttgttattagatgaaatacatcgactagataaagctaaacaagactttttattacctcatttagaaaatggcaaaatcgtcttgatcggtgctacaacttcaaatccttatcatgctatcaatccagcgattcgttcaagagcgcaaatttycgagttatatcctttaaatgacgaagatgtgcgccaagcgttaactcgtgcaatagaagatgatgagaatggtttgaaamcatatcaacccaaaattgatgaagatgccatgacctacttttctacacaaagccaaggtgatgttcgtagtgcgttaaatgcattggaattagctgtattaagcgcagataatgacaaagacggttatcgacatgt

SEQ ID NO: 701 - DNA, 445 bp; double-stranded, linear
cattaagtgaagttgttgatacacccatgcatcaagtcaattgttctgttgatttagatacagaaagcttattaggctttaaaacaattaaaacaaatgcggaaggtcaacaagaaattgtctttgtagatggtccagttattaaagctatgaaagaggggcatattttatatattgatgaaataaatatggctaaacctgaaacattgcctgtattaaatggggtcttagattatcgtcgtcaaattacgaatccatacactggtgaagtaatcaaagctgtaccaggatttaacgttatagcagcgataaatgaaggttatgttggtactttgccaatgaatgaagcactaaaaaaatcgcyttgttgttattcacgtkgattatattgatggggacatttaaaaaatgtgantaaggagcaaggtttattacaagatgttaa

SEQ ID NO: 702 - DNA, 752 bp; double-stranded, linear
tgcaagataaacaaatttgtcattgttttggttgtaaaaaaggtggcaatgtttttcaatttactcaagaaattaaagacatatcatttgttgaagcggttaaagaattaggtgatagasttaatgttgctgtagatattgaggcaacacaatctaactcaaatgttcaaattgcttckgaygatttacaaatgattgaaatgcatgagttaatacaagaattttattattacgctttaacaaagacagtcgaaggcgaacaagcattaacgtacttacaagaacgtggttttacagatgcgcttattaaagagcgaggcattggctttgcacccgatagctcacatttttgtcatgattttcttcaaaaaaagggttacgatattgaattagcatatgaagccggattattatcacgtaacgaagaaaatttcagttattacgatagatttcgaaatcgtattatgtttcctttgaaaaatgcgcaaggaagaattgttggatattcaggtcgaacatataccggtcaagaaccaaaatacttaaatagtcctgaaacacctatctttcaaaaaagaaagttgttatacaacttagataaagcgcgtaaatcaattagaaaattagatgaaatcgtattactagaaggttttatggatgttataaaatctgatactgctggcttgaaaaacgttgttgcaacaatgggtacacagttgtcagatgaacatattacttttatacgaaagtta

SEQ ID NO: 703 - DNA, 830 bp; double-stranded, linear
ncgtttttgtnaaacngcttatatgtataacttttcccaatttatcataagttttgatagaaggagttggatcgctaaagaaaatatctctaaagatatcatcttcaatgataggaatattatgtctttcgctataagtaattatatttttcttttgctcattcgttaaagaacgacctgtcgggttattaaacctaggttctatataaatcgctttatttttaaaattaataaatctatcaatgatggtatcaatttcattaatttgattataaggaacatcaatatgtctaaaattcaattgctcaaaaacatttgtagagtgaatatatgatggtgtattcgaaattattatggcatcttgacctaaaaacccaatagataaaagttgaatggcatgtaaagcgcctgaagtgatcattacattttctctacctacatttataccttgctttgacattcgttcaacgataatatctcttaacttgatataaccatagccattattataaccaaaagataagtcttcaatatgactggctgtattagacatggcttttttcaattgaatatgtggcattaacgatatacccaattcacctttacttatatgtatatacgaatcatctgtctcaattttattaattaattgcaccgtatactgacttctttgttgagaggaccataacatcatttcagaccacttatttgtaatatgtgcttcattcaaatagtcattaacatatgktccactacctactttagtatagataaatccttcagcttctaataactcaatacttttaataatcgttactctatttacgttg

SEQ ID NO: 704 - DNA, 659 bp; double-stranded, linear
agtggtgttggaaaagctattatgaaattattacgtgaacaacaagtttaataaaaaaagaggggtcaaatatgaaaggattaattattattggcagtgcacaagtgaattcacatacaagtgcactagcaagatacttaactgagcattttaaaacacatgatattgaagcggaaatattcgatttagcagaaaaaccgttaaatcaattagatttttcaggaacaacaccgtctattgatgaaatcaaacaaaatatgaaagatttaaaagagaaagcaatggcggcggactttttaatattaggaacgccaaactatcatggttcatattctggaatattgaaaaatgcattagatcatctaaatatggattattttaaaatgaaacctgtaggcttaataggaaatagtggtggtattgttagttcagagccattgtcacatttaagagtaatcgtcagaagtttactaggcattgctgtaccaactcaaatagcaacacatgattctgattttgctaaaaatgaagatggttcatattacttaaatgatagtgaattccaattacgagcaagattatttgtcgatcaaattgtatcttttgtgaataatagtccatatgaacatttaaaataatattaanaaatatgtaaatnt

SEQ ID NO: 705 - DNA, 400 bp; double-stranded, linear
ncaccatatagtaactggcaccaactacattaccgtcttttaaaaagatttttttatagttattatcaacactattaaatatttcaatacctttaatttctgcattttctacaatttgaccagcactatacaagtcacacccagaaacttttaatgacgtaaatgttgttgatcccttgtatccgttcgtttctttatttgttaaatgatcagctaatactttaccttgttcatatagtggtgcaacgagtccataaactttgccgttatgtctgcacattcaccaactgcatatacattgctatcacttgtttgcatcacatcattgacaacaataccacgattacatctagacctgatcttggcactcctgggaaggcggaaccactgcatacaacta

SEQ ID NO: 706 - DNA, 380 bp; double-stranded, linear
ttaaaaatacagctacaggtaattttaatgatttttcatcaatatcaaatttgggattatggtgtggcgctgtaatacctttaaccagtcagaaagaatgcacctggtcgtactttcaaataatgtgaaaaatcttctccaatcatcattaaatctgattcattaaagcgtacatgtaagtcatttgttgcttctttaataacttggatatgctttctcgtttattatggacaggcaaataccctttaatataattcaaatcatagttaatatcatttgctattgctaaaccttgtagaagcttaatccattttgtccatacatgattctgtatatctgaaatcgaaagttctnactgtacctttacaaaatgccttgnn

SEQ ID NO: 707 - DNA, 400 bp; double-stranded, linear
canaaaggatcaaagtgatcggtatagtgataattagctccaaagaaagaatattctaaatcaaatccataccaagcagaaagtattagcgaatatcaatttaaatggtaccgattcaaataaagaaacacgacatatagaatttttacttgatgattttagtgaatcatatgaaccaggagattgtatagtagcattaccgcaaaacgaccctgaattggttgaaaaactaatatccatgttaggttgggatccgcaatctccggtgccaattaatgatcatggtgatacagttcctattgttgaagcactaacatcacattttgaatttactaaattaacattgccattattgaaaaatgcagatatctattttgacaatgaagaattatctgancgt

SEQ ID NO: 708 - DNA, 447 bp; double-stranded, linear
taatgctggtacgggtcatgcagcattatgtgagttgaactacacagttttacaacctgatggttctatcgacatcgaaaaagcgaaagtgattaacgaagagtttgagatttcaaaacaattctggggtcacttagtgaaaagcggtagcatcgagaacccaagagaatttatcaatccattaccacacatcagttatgttagaggtaaaaacaatgttaaattcttaaaagatcgttacgaagcgatgaaagctttccctatgttcgataatatcgaatatactgaagacatcgaagtaatgaaaaaatggattccattgatgatgaaaggccgtgaagataaccctggtatcatggcggcaagtaaaattgacgarggtmcagatgtaamctycggtgaattaacacgtaaaatggctaaaagcattgaagcacatccaaatgc

SEQ ID NO: 709 - DNA, 1448 bp; double-stranded, linear
gtgtctacctgtttttgttgttcaattgttaacttttctttttgaatagtagtattcgataattctttatcgcttataaaatcatctagtggatggctttctttgaaacttttattttcagtcatcaatcatctctccaatagttgctattttacatcaatcttgatgatgtttttgatgtaacttatttaattccatttcaatatctaaacgttcataatcatcttcgttgagacgctttaaatcagcgattaatgttcgtttgacctcatccaaagtaattcgtgtttgttctaacttttgctgttcattaattgattttttgggcatttttgctagacgtgtatatgcatcaaccaaatttaaagcattatcaatatgagaataaaaaaagccttcaactttataaaatgatgcaggtctctgtctaactgtcgtataaatagaacgtgaaatttggtatatatcattaatctgcctaaaatctttaattgatcttatattgacatacgtttttaaaatacctctaagtttttggtgtgtatgatttaactgatttcgaatatagcgatagtcttttctagtcaaaccaatttcgtttaaatatttgcgtgaagtgagtttttgtatcggtaggtatgtcattaaaaagccaacaataccaatagacatatcaattaaaaaagatacatcaagtgcaatcatcccaaatatgcttgttaaaaacgctacaggaattcccactaacaccccaaatatatgagaaatattatatctcactgtcatcttcctttatttagcattttatattgatcgaaaatccgataatttttgatttagttctaactcttcaagttgatggcttgttacatttgatgctggtgaggcaccttcaattacaccttgaataaatctctctatatctgcgtcatccccttgtgcatatatctctacatagtcatctacattttgaacagtaccgacaatgttatagttcattgcaatgcgttgtgtaaaatatctaaatccgacgccttgaacgcgtccgaatacttgtaaatgtatatgtctcatttttaccacctcataatgttattatacgtagttttacttaaaaaaactaataattactatagttactactttgtttgtttcaagtcgtcaaacttgattttcagaggataaaggtataaaaataagtatagagtttttgaagtatggaaggggtctttaataatgtggacagttaccaaaattagagccgattatgagggatggtggttattcagtgactggccagaaaacattgttgaaaaatatcaatatcaagattttgatgacatgtttaagcactatcaacaattgattaatcaatgtaaagttcagttcgataactatgtcacaggcaaatataatatttatgcattttataataattgtgacatgaa

SEQ ID NO: 710 - DNA, 519 bp; double-stranded, linear
gctgnaaaatatgttagaagcagatgcatgggcaaagctggggtccttatttattgtcaggtaaagatgtcttcaattcaactattggaatatatggtatgggagatattggtaaagcttttgcaagaaggttgcaagggtttaatactaatattctttatcataatcgatcaagacataaagatgcagaggcggactttaatgcaacatatgtttcttttgaaacgttgttagcagaaagtgattttatcatctgtacagcgccacttacaaaagaaacacatcataaatttaatgctgaagcatttgaacaaatgaaaaatgatgcaatttttattaatatcggtagaggacaaattgtagatgaaacagcattaatcgatgcactagacaataaagaaattttagcatgtggtttagatgtattagcaaatgaaccgattgatcatacacatccattaatgggacgtgataatgttctgattacaccacacattgggtaggcgcattcagttaacn

SEQ ID NO: 711 - DNA, 1349 bp; double-stranded, linear
ctattacaggtggcgaaccaatgttttctaaaaagtctattagaaatgttgttaaacctctattaaagtatgcacatcatcgaggtatatatacacaaatgaattcaaacctaacattgcctcaagatcgttatttagatattgctgaatatatcgatgttatgcatatctcacacaactggggaacaactgatgaattcgcaaatgttggctttggcgcaatgaagaagcaaccaccgttaaaagctaagttaaaattatatgaacaaatgatttcgaatgcacgtacattatcagaacaaggaatgtttgtatctgcggaaacaatgctcaatcaaagtacgctaccacatttacgaaaaatacatcaagaagtcgttcatgatatgaaatgtagcagacacgagattcaccctatgtatccagctgactttgcaagtcaattaaatgtgttaactctagcggaaatgaaaaagacaattcatgatatattggatttcagagatgaagatatttggatgttatttggtactttgcctgtgtttccatgcttaaaggatgatgaagatcaaaagttactatcacgtttaagaaatgctaaaaatgtaacgactagaaatgacccggatggccgtagtcgtttaaatgtcaatgtatttacaggtaatgtaatcgtaactgatttcggagatgaaacaggtacaatttcgaatatacaaaaagataaattaacagatgtatttgataaatggttatcctctgatcttgctaaatcattaaattgtcattgttccgagtttagttgtttagggccaaatgttcttgttaaaaatatgtactatccgaatatggattttaaagataatgagcgtcatatgcacaaacaaccacaaattatacaattttaaaaactcttaattatgcggagaagcactttatcgataagtagtctccgcatattttaatgctattataaaataaaaaacaattaattgctggcagtactctacttaaataataaagggcatttaataggactaatagtctataataaaaggggtaaattttaactaaaagcataaacgtgcataatcaaaaagacagattgtaggtggaatattcgaacataacagttcaattcatccttaacaatctgtctttatatttttagtctctaatatgttgcacttgagctaaatattcaattgttgtttactttcaatgcgacgtgcttttcttcgttcaacacgtgwggtgctgtatcataaaaccatttttcaacatcatcttctggatatacaccaggtacatgtttaggttgccttcatcatctaacgcaacaaatgtaa

SEQ ID NO: 712 - DNA, 377 bp; double-stranded, linear
gaaattaaaaaagcaattggacaagatgcaacagtgtcattgtttgatgaatttgataaaaaattatacacttacggcgataactggggtcgtggtggagaagtattatatcaagcatttggtttgaaaatgcaaccagaacaacaaaagttaactgccaaaancaggtnggcctgaatggaaccaggaggaanttgaaaatatgctggggattacattgtgagtacaagtgaaggtaaacctacaccaggatacgaatcaacaaacatgtggaagaatttgaaagctactaaagaaggacatattgttaaagttgatgctggtacatactggtacaacgtccttatacattagatttcatgcgtaaagatttaaaa

SEQ ID NO: 713 - DNA, 528 bp; double-stranded, linear
aatgaancgaaaaatgactataaaaagtttaaagtgttttcacttatttcaacacttgtcattgtcattttagcaattataagatttgttcataaaatgatgtaattagagtgagacattgttttatgtctcaggatccagttattcattatatctacaatatttacgattatataaataacccgagattttagtatgattcatttcactaaaatctcgggtttctatttgataatttttaatgggatatggcatgtatacgttcttgccttttatctcatttccaatgattaatctggatattgttctaaaaatgctttcgcttctttattaactgttttaaaatcaataccttgttgcatcgctgcaaagacacatccacaataacactgcctaaagatattatagtcattacacatttctatggaacgctcataacctttacttttcytaaaatcacttggcaaatagttcacatcgtatattttttggacatccataccaagttcattgattaattgtgcgttc

SEQ ID NO: 714 - DNA, 731 bp; double-stranded, linear
tttaatggcatgaagtcacagtatataaagaatctggtgtgacaatcagtatgactaagtatataaaaaaagagcaggtgcgaaataatggcgaaagagtcgaaatcagctaatgaaatttcacctgagcaaattaaccaatggattaaagaacaccaagaaaataagaatacagatgcacaggataagttagttaaacattaccaaaaactaattgagtcattggcatataaatattctaaaggacaatcacatcacgaagatttagttcaagttggtatggttggtttaataggtgccataaatagattcgatatgtcctttgaacggaagtttgaagcctttttagtacctactgtaatcggtgaaatcaaaagatatctacgagataaaacttggagtgtacatgttccgagacgtattaaagaaattgggccaagaatcaaaaaagtgagcgatgaactaaccgctgaattagagcgttcacyttctatcagtgaaatagctgatcgattagaagtctcagaagaagaagtgttagaagcaatggaaatgggacaaagttataatgcgttaagtgttgatcattccattgaagctgataaagatggttcaactgttacgctattagatattatggggcaacaagatgaccnttatgacttaactgaaaaacgtatgattttagaaaaaatattacctatattatctgatcgcgaacgagaaatcat

SEQ ID NO: 715 - DNA, 830 bp; double-stranded, linear
ttttagrggaaagcgaattagtcatatwcgcagcagatwgaatgattgaaaamgaaattgattcgattccaattgtaagaaaaaaagataatcaaaagtatgaagtaattggaagaatttccaaaacaacaatagctaagttattagtagcattatataaagaataggtgagaagtaatggaaaaaattaaaattatcgtagcttcagattctataggtgaaacggcagagttagttgctagggcaggtatttcacaattcaatcctaagcaatgtaaaaatgaattattaagatatccatatattgaatcttttgaagatgttgatgaagtgattcaagttgcaaaagatacaaatgctatcattgtttatacacttattaaacctgaaatgaagcaatatatgagtgagaaagtagcagaattccaattgaagtctgtcgatatcatggggccattaatggatttattatctgcttcggttgaagaaaaaccttataatgagccaggtatcgttcatagattagatgatgcatatttcaagaaaattgatgcgatagagtttgcagttaaatatgatgatggtaaagatcctaaaggattacctaaagctgatattgttttacttggtatttcgagaacttcaaagacaccattatctcagtatttagcgcataagagttacaaagttatgaatgtaccgattgtaccagaaagtgacaccgccagatggcttatatggatattaatccaaagaaatgtatcgcacttaaaataagtgaaganaaattaaatcgcattaganaagagcgactaaaacaattangacta

SEQ ID NO: 716 - DNA, 1159 bp; double-stranded, linear
ngaagaacaagtttancatctaaatgcccgtttaaaactacaactacttgacgatgttaaatcagtgtttaantctcaaatgacgcaaaatagtgattttaatgaagaaaagaaagtgtctacgagagtatacttagatcaaatycatcaacgattgtttttagagcaatctttaattacagaacgtataaaaaaatactttaataagcaactcactgagcaaattgcaccaatcgttcaacaattagcagatttacatgtcattattaatcctcagtttaactttgaatcagctaatatagagcaaccattattgcacatcgatttcaacgatatgctaaatgcattgcctaaacaattaacaaaacgtaaaattttgaatccaaatgggcaaagagatatacatgaatcaatttgtcaaagtacgttaggattattacaaccacaaatgggattattgaggcaacagcttgaattatatgtaaagcaaatggctgtagaagctgaatcgcaatttgaaagttttgaagctaatattcaaacgcaaataaacgatttattagcatttgatttagatacaacacttatcaatcaattgaaagataaacatcaacaactgaaaactattttatattaagaaagaaggaacgttttaaatgcctaataaaatattacttgtagatggtatggcgctattatttagacatttctatgctacaagtcttcataaacaatttatgtacaattcacaaggtgaacctacaaatggaatacaaggatttgtgcgtcatatcttttcggcaatacatgaaatacgccctacacatgtagctgtatgttgggatatgggacaatcaacttttagaaatgatatgtttgatggttataagcaaaakcgttctgcaccaccagaagaattgataccacaatttgattatgttaaagaaatttcagagcaatttggctttgtaaatattggcgttaaaaactatgaagcggatgatgttataggtacattagcacaacaatattcaactgataacgatgtctatattattacgggcgacaaagatttactgcaatgtattaatgacaatgttgaagttggctaattaaaaaaggtttaacatttataatagatatncattacatcgttttn

SEQ ID NO: 717 - DNA, 574 bp; double-stranded, linear
gatttaatcaatgcagttgcagagcaagctgatttaactaaaaaagaagctggttcagcagtagatgctgtattcgaatcaatccaaaactcacttgctaaaggtgaaaaagtacaattaattggtttcggtaactttgaggtacgtgaacgtgctgcacgtaaaggtcgtaaccctcaaactggtaaagaaattgatatcccagcaagtaaagttccagcattcaaagctggtaaagcattaaaagatgctgtaaaataattttacttaaaaagccctgaataagggctttttattttgcttttaatacttacaacctgtacataaattgtaatgttcttctaagtttttaatctttggaacattcattgtttaagcgttcaaaatattacatgacataatagttttgataaaaatagcaactacaaaatatacatatgaatattgagattaattgttagcgttgaatttacttaaaaggtaaccatgtctactatagtattttacgttatttaaaaagatgaataatgtaaatgaagtaaaggttattatgagaattacaaaagctacataa

SEQ ID NO: 718 - DNA, 493 bp; double-stranded, linear
aagatattgaaamtgmaatggagcacgcccttatttgatagaagtaaaagacatttaattcttaccgatgcaggtcaaattttttatgagaaaagtaaagaaattgttgcactgtatgattatttaccatctgaaatggaacgcttgaatggactggaaacaggacatataaacatgggcatgtcggcagtcatgaatatgaagattcttatcaatattcttggtgcattccatcaacaatatccaaatgttacatataatttgatagaaaatggcggtaaaacaattgaacagcaaattatcaatgatgaagtagatataggcgtgaccactttgccagtcgatcatcatattttcgattatactaccctagataaggaagatttgcgacttatcgtgagcagagagcatcgactcgcaaaatatgaaactgttaaactcgaagatttagcaggtgaagacttcattttatttaataaagacttttacttga

SEQ ID NO: 719 - DNA, 1257 bp; double-stranded, linear
gcattgccaaaacaatacgtttatattattgaggaactactgtataaaagtaatgaatatcaaaataaaaaatcatattacgaaacacttgttaaccaagtaattgaacttaaacaggcagatgatttaattattggactcgcttattccgtacaacgcttagtcgtcgatcatttacacgttgtcggtgatatttatgatcgtggaccacaaccagataaaattatggatacactgattaattatcattccctagatattcaatggggtaatcatgatgtgctttgggttggagcctatgctgggtcaaaagtatgcttagcaaacttacttcgaatttgtgcacgttatgataatttagatattatcgaagacgcttatggcattaatttaagaccactgcttactttagctgaaaaatactatgacgcagataatcctgcttttaagcctaaaaaaagacctgacaaacacgaacgtttaactcaacgtgaagaaagtcaaattactaaaattcatcaagctattgcgatgattcaattcaagttagaaataccaattattaaacgtcgtccaaatttcgaaatggaagaacgtcttgtgcttgaaaaggttaattatgatacaaatgaaattacagtttatggtaatacatacccattgaaagacacatgtttccaaactgtcaatcgtgataatccagcagaattactacctgaagaagaagaagtcatgaataaactattattgtcattccaacaatctgaaaaattacgtcgtcatatgtctttcttgatgcgtaaaggctctctttacttaccatataatggcaatttactcattcatggttgtattccagttgatgaaaatggtgagatggaatcatttgaaattgatggtcatacttacagcggccaagaattattagatgtgtttgagtatcatgtccgtaaatcatttgatgaaaaagaaaatactgatgacttatcgacggatttagtttggtatttatggactgggaaatattcgtcactatttggtaaacgtgccatgactacgtttgagcgatactttattgcagataaagcttctcataaagaagaaaagaatccgtactatcatcttcgtgaagatgtgaatatggktcgtaaaatgctcagtgatttcggattaaatccagatgaaggacgcattattaatggtcacacaccagtgaaagaaatcaatggcgagatcctatcaaggctgatggaaaga

SEQ ID NO: 720 - DNA, 400 bp; double-stranded, linear
tgagcacatgacagtggctgaaaacattaaattttttaaatcactttgtaaaaatccaattaacgatacaactatcaacgaatatttacagcaattaaactttgatgatacgtctgccaaagtatctacattgtccggtgggaataaacgtaaaattaatatattagtaggtttactaggtcaacctcgaattctcattttagatgaaccgacagttggtattgatttaaaatctagacatgacatccaccaactacttaacatcatgaaatctaaatgtttaattatattaactacccatcatttagatgaagttgaggcacttgcagatggttatcaagttaattgggccaggtncccttttnttcaacagtttttgggggccaaccatgggcttata

SEQ ID NO: 721 - DNA, 570 bp; double-stranded, linear
cttatttatattataatataaatattttatttttcaatacttaattttaaaaatcccctatgaaaatgttgatgagctacatctttaaatcttattatacattgtataaaattatattgcgaggtagtaaattgatattatacacttttggttgtgtatgcatctcacctatcttttttgcttttttcaaataagaaagtattaaaaatyaatgcctatacaggaacagacatggctaaacttgatttaaatagtcttgacgacgagcacgtaaaattattaataaatgaattaaaatatccagaaactcatatcgatgtaaatgaattaaaaacaatagttgctagtcgaataaatgaaaggcaagaaataataagttttaagttaggaataaagtacttattaacaataaaaagagggaacatagaaaaagataggttttcaatttcaatcattttcaaagatacctatcacaccctagttagaatagatattaacggtggtactcacgataatccagatggaacaatcgctccgaaaagtcatattcacatatataatgataagtat

SEQ ID NO: 722 - DNA, 400 bp; double-stranded, linear
attttagtcttaggtgttgattgcatgatgaatgcagaagttatacctgcagccatattagcaccttcattattgtgtataatttgaatattatttgcttttaaagtatgtccaattaagtttgaagtcgttgttttaccatttgttccactgataaatacaatatcatcaacttgctctgctaattttcttaatatatctgtatccacttttctagcgatttgtccaggtaaatctgttcctcttttacctactgctctacttgctttacgcgccaatttcgctagatggattgccgtccactgtctcatgtgtttcctcctcaaatttccactcgcatcattataacatgacaaggcaacttcaaaaaagtttctcaatcacaaatngataccagtgt

SEQ ID NO: 723 - DNA, 1113 bp; double-stranded, linear
gattatatgctgttggcaaaacaatatacccagatgaatttttatttttagtaatagtataaccatgctttgtcttactaactttgacagcttctaatgaatttgaagcgtctttaagcgtggtataatcttcgccgtatatcccttttaaatttactcgatacttacctttaggcaatgataatctaattctatctggagctttaatgcgtatcgttacgggtgttacaacgcgtcgatatttataagtgagtttatttctttcttgtgtatattcattcactttaacatcatgagctttatccggcgaaagtaattctaaatccatttcaaaatacaaatctttaaattgattagaaactgattttggcaactgtacagttagaccaccattattttgtttaacttgtaataaatgttttgtaggagattgccaggctgcactatttaatttaattgttgaatctgatagtaaatttttattggctttaaaatgtgtattaacatctttaatattgttagaaacaatcccttgcaacattgcttgttctttatctaatggagattttaattctttattggaaaagaccttatttgtaatatgtgcacttggataatggatggtatttttagaatgaatccaacgaactttattgtctttgtgttcagacttaattttaaatccatatggtaagttgtcatcatgattcactctaattcgatcattaacattccaaagtgatagtaaatttgacgatgccaagtaatctataagtgctgtttttatcgattggcatattaatttggagtgtcttgtcataatattttaaaatgtctccattaaaaatactagaatataatgaaatgccattataatgatatataaatggtgaatttaatgcatagtctgacatataatcaatgcgattaaatgagcctgttgcattttgatttatcttttttataagctggtttacatagttactatggtaatcatgttgtttcaacgttgataatgattgttgataaggtttgattgccatgtttttgttgttatctaaaatgacgatttgttgaatcataacgattaatactaatattgcaacggttaat

SEQ ID NO: 724 - DNA, 464 bp; double-stranded, linear
tgccgtttagcaaaatctagtatcgcttgatgatcagattctgaaatttcagtgtgtacttcagctataggtgtcattgcctcattacctggaatgacaaacacttgtttaactagattcgattgattaagtttatatgcaagtgcatgttctcgtccaccagcaccaattactaatacattcatttatgttacgcccctttaaaattagtgtttaaaatgtcgagtgcctgtgactaccattgcaataccatgtttattagccatatcaattgaatcttgatctttaatcgaaccacccggttggataattgcctttataccatgttgtgctgcaagttcaactgtatctcccatagggaaaaatccatcagatactaacggctacatgatcattgatttcaatagctctctctaacgcaattttagcagcaccgacacgattcattggccagcanctatacc

SEQ ID NO: 725 - DNA, 1440 bp; double-stranded, linear
gttaaatncantatttnaaatatattaccttattagaaaaagtcgtaatatgaggtgtacaaatgacgcaaattttaatagtagaagatgaacaaaacttagcaagatttcttgaattggaactcacacatgaaaattacaatgtggacacagagtatgatggacaagacggtttagataaagcgcttagccattactatgatttaatcatattagatttaatgttgccgtcaattaatggcttagaaatttgtcgcaaaattagacaacaacaatctacacctatcattataattacagcgaaaagtgatacgtatgacaaagttgctgggcttgattacggtgcagacgattatatagttaagccgtttgatattgaagaacttttagcaagaattcgtgcaattttacgtcgtcagccacaaaaggatattatcgatgtcaacggtattacaattgataagaacgcttttaaagtgacggtaaatggcgcagaaattgaattaacaaaaacagagtatgatttactatatcttctagctgaaaataaaaaccatgttatgcaacgggaacaaattttaaatcatgtatggggttataatagtgaagtagaaacaaatgtcgtagatgtttatataagrtatttacgaaacaagttaaaaccatacgatcgtgacaaaatgattgaaacagttcgtggcgttgggtatgtgatacgatgacaaaacgtaaattgcgcaataactggattattgttaccacgatgattacgtttgtcacgatatttttgttttgtttaattattatttttttcttgaaagatacactgcataatagtgagcttgatgatgcagaacgaagctcaagcgatattaataatttatttcattctaagcctgttaaagatatatctgcattagacttgaatgcatctttaggtaattttcaagagataattatttatgatgagcataataataaattatttgagacatcgaatgataacacagtgagagttgaaccaggttatgaacaccgttattttgaccgcgtaataaaaaaacgctataaaggcattgaatatttaattattaaagaaccaattacaacgcaagatttcaaagggtatagcttgttaattcattcactagaaaattatgataacatcgtaaaatcattgtatatcattgcgctggcatttggagtgattgcaacaattataactgccacaatcagttatgtattttcaacacaaattactaaaccgcttgtcagtttatcaaataaaatgattgagattcgacgagatggttttcaaaataaattgcaattaaatacaaattatgaagaaatagataatttagcaaatacgtttaatgagatgatgagccaaattgaagaatcatttaatcaacaaagacaatttgttgaagatgcgtc

SEQ ID NO: 726 - DNA, 375 bp; double-stranded, linear
tgatattccgacttgcgaggattattgcgcattaaggattaacgcagtatgagtccaaagacgcgcgacacctggaaaaaggattacctaatgccttatttacagtaaccttgtatgataaagatcggttaattggtatgggtagagtgattggcgatggcggaactgtttttcaaattgttgatattgcagttttgaaaagttaccaaggtcaaggttacggcatctaattatggagcatattatgcaatatattaaaggtgtggctgttgagagtacatacgttatctgattggcagactacccagcgggntaaattatataccaaatttgggtttnatacctaccgaaccagantccaggcggtgatgtatg

SEQ ID NO: 727 - DNA, 471 bp; double-stranded, linear
taaaaaacttagagatgaaaatcatattatttatctgtttttgggacaattttttactaaaaatgaagatccatggcatcaaatacttaatgatttagaagttacaaattctgttgataattttttaaggtcaataagtaataaggccaaagaaacaaaaaaaagagcttttattattattgatgcgcttaatgaaggtgaaggtaaaaggttatggggaaattattttcaaagctttatcaaccatataaagaagtattctaatatagctttaatattttctattagaaccccttttgaagatgttatattacccaaaaacgcaatacaagataacaatattgtagtatttcagcatgaaggttttagtaaggaagaaaactataatccaattgtatctttttgtgatttttatggattagagctacctaagttacctatattaaatccagaattcaacaatccattatt

SEQ ID NO: 728 - DNA, 1750 bp; double-stranded, linear
taggatgttccaccctggcaattgctctaagacatctacagcagtagaataycctgttttcgtctttttaataacaggtaattgtaatgtctcaaacaatacaacacctaattgcttaggagaatttatattaaaatcttcaccagctgcatcatggatatttcgaatcaagacgtctaatttttcttgaatttctttttccatttcttctaaatcatgaacatctgtaaatataccaatttcttccatttcacttaaaatcttagctagcggtagctctaaatcagccaagagttctacctgattgtattcttctaattgtttatccatatttggtttcgcaaagtaaattgcatcagtaatagaagcaacatatggatttaaaacatcatcttcaggtaccttaaatttcttaccttttccatatatactcacatcgtctttcacaaaactttgaccgtacaatgaaacaactgattgaacatcactaatcgtacgagatggatcaattatataactggccaacataatatcgaaagaaatattttgaatatcaatccccaatctatgtgatgctacatatgtttttttagcatcatatacgacttttttcgaattcggattttctaaccatgaaactagttcgacataattatttatgtcatccgcattaattacaatatgtttctcacctgtaaataaagagaattttaaaatattatttcgcaaatagttaccaccgtctaattcgaaatggatggccgcttctttcaatgaagtaaaatccaatattatcaaaagacgtttccaatttcaaatgtcttttctattgcatcttcaacgcttgctgattgatcaatgtcagccaacaattgtttgaattctaacttcttaaacaattcgattttttcttgttgttcatcttgakgagtcattaacgtatcttcaagttttacttcaatcggactatctacattaatcgttgctaattctttactcattaatgcatcttctttgctattttgaagtttttcttttaactttttacctgaaatttcatctaaatgttcatagacaccttctactgtgtcaaattggtttagcaattttattgctgttttctctccaacacctgcaacacctggtatattatcagaagtatctcccattaatcctttcatatcaataatttgattaggtgttaacccgttgtatttttccgcaataaagtcaggtgtataatgatcaacatcagtaacaccttttttagtgtaataaatggttacattatccgttgcaagttgtgttaaatctcggtctcccgtaataataattgtctgaaagcccgctttatctgcttctttacttaaagttccgataatatcatctgcctcatagttatctaattcataacgtttaatatgataagcatctaataattggcgaatataaggaaattgctcacttagttcaggcggcgttttctggcgtccacctttatattcactatatttttcatgtctgaaagtcgttttacctgcatcaaacgctactaaaaaatgatttggcttttcttcttttaaaatcttctctagtaacattgcaaaaccatatactgcattggtatgaatgcctgctttgtttgataacaaaggtaatgcataaaaagctctaaaacttaagctattaccatcgattaatactaatttattcacaattttaacctccagaactaatttatatatntgtg

SEQ ID NO: 729 - DNA, 439 bp; double-stranded, linear
aaattaattttaacatcctttcaaaatagttttaacggatcctcccaaaacgtaaactcacatcagttacttgtaacatgcattttctcctttttttcattcgatattctaacggaagaattatatcatattatcgtcacagtttcgacctcatataagttgtaatgatagaatgactcacacatgttataataataaagaatacaagaatcgaaggagaataaacatggcattagacaaagatatagtagggtctatagaattccttgaagtagtagggttaccaaggtcaacttaccttttaaaggaccaacggtgaaacgtaaagttaaaccaatcagaatgaacgtgatgattgaattagaagtaggggagnatatagttcctcatttatccaaccggtcaggtggattattgcactcaaatatgcngntatacg

SEQ ID NO: 730 - DNA, 481 bp; double-stranded, linear
ggatcancaggttcaaaaggtatactgactaacatttcaccgaggtatgtccatgttcctagtttaggattgatgacaaagccattacgaccaacaaatcctaaacctgcacgttctgctactgccctatctgataatacacccgtatctaccatagatttgatttcaacatctggaactttagattcaataaatgcagctaacatgtctaatcgtttacgcataattgtatgataatcttgaccccacgatgctctagcaaataagcctctgcgatcacctctaacactcttaggtgcacctttcagtttgttaggataaccaactgcaattgctatgattgaccttgctgttggtaaggataatttaggctccgttcgtaaagcaatatcagattcttcaaatcctgaggcataaccatttgcatgatatgcttctagcttttgcttcaattcatcaaagggntcggcagtagtaaatc

SEQ ID NO: 731 - DNA, 828 bp; double-stranded, linear
gtgatgaaaaatctttttctattgattgagaaaatagttatttatatagtttttaaagaaaaaaagtgataatatttagctaatctaatgaaaattgatttattggacaaaaaatacattttaaatgagtagaggaggctgcaawtgggttacagaactttaaaaagtatttttcatgaacacaatgaaagtaaaatgaaggaagagtatattaaaagatttaattctttmgcttctttcaatactaatattaatatcatacctatggaaaatggaaaaaaagttaatgatttggaatatcctctattctttatggtgactaaaaatctatcaaaaaaacaagaattaatatcaattaatagtagaaaaattgatagagcacttaattctttaccatatgcagctagagaacaatattttaatgatttattaatcgatgaattacaaagtactaatgaaattgaaaatgtatttagtactaaacaagagattgcacatgcgttaaataaccaagcatcagaatttcttaagttcagaggcctcgtggatcaatataaagagatagaacttaataaaaaaattaaagttgataatgtaagagacattagagcgatttatgataaattagtttcaaatgaaattaacgaacaagataagttagatggagagctatttcgtaaaaattttgtcggtgtgcatgatgggtcaacgaataaatatatacatgttgggttacaacctgaaaccaaaattgttgaatttataggtgaaatgctaacatttttaaaatattttgatgcgcctcagccgttcaaaatcatggctagt

SEQ ID NO: 732 - DNA, 1622 bp; double-stranded, linear
cgtatgtttcgaattttatgnattgcattggataatagtaccagttaaaagaactaagattgtaattatccccccttaaaattcaagaatatattttcttaatctatcagcaagaggttatatttcaaagtgtttatttttaaaacaacatctaaaagccatttcataataawgttaaatcattagaatgtataaagattccaattaataaaaatagataaaatgcaataaagttccaaatacttattattattcatcacaaattacgtgatgccctctacaacactaaatcaaggatgatatttattttatatacattagcattcattgtttgcttacccacattatcctgtttagtcttttttataactctagtcttgaatgtcatatttacaaagaaaaaaacactaaaatatttaaaactaacactatttattcactttgttcttttatagcaccttttatgtttattttcttgtattcaataaatagtatggagatgataatttaaagtagatatatttgaagtatactatagagtaaattatattggggaaatatgtaaacgaaccggttgattttatagtggattaacacttcatagagaatataatcaagaacaaaaacagtcaataggtgtgaatttttttaaagacggatctgttgctactaaaaaaagaagtatacaattcaatagttaaaccttaaaacaagaaatattattcaaaatcaatgaatttcctatcttattagttttaacaatatttattctcatagagtttgtccaattaaatatagatgattcaaatatttataagcatacaaaagagcagtaagacattttctaatagaaaataactttactgctctttgtacattactcatcaactattgtaaattaaataataaataactacctattttattattcagctaaaaaatgctctgctaaatattttgctgcgccatcctcttcattcgtgtatgccgttacatctgaagttaatgcttggatttcagggcgtgcatttttcatagcaactgtataatgaccaaattcaaacattgctctatcattgtcgctatctccaataactaacgtttcttcttgatgaataccaaaatgtgcaatcatttctttaatgcctgtacctttatcagtttgataagccattgtttccgcattaaatcttgatgaatttgaracactaatctgtagttgcacatgattttgctttaattcatctctaaatgctgttattttttctaaattagaactgaatagataaatttttgaatattcaccttcaggaaacttagttacccaatctatcttaccagcaagcgcatcttgtcttgaagaccattcactatgacttacgccattaataggatcttgactacgaatcatatctcgcatccatgtttcatcttcttttaaagaaactctattaccttcaaaaggaaatacctcataataaatttgttggcgcttagctaaattagtaatttgttgcacttgagccaatgataaaccatgcttgaagataatttctccatctacttctccaattgttccatttgaactaatgatgccattaaccgcaaaatcttgaggtaca

SEQ ID NO: 733 - DNA, 472 bp; double-stranded, linear
aatgccanataaatccaaattcttttaacgaacaagagtgcccaagttattgctgatcgttatgccagatangcatatcaatgataattatggtttagaaagaatttctaagacaaatcatggatataattatgtgtattccaatgataattcaactagtaagcaacatgtaagtatttcaaatcaaggcataataacgaaataatagatggaacagtgtattctaattggatatactgtttttattttgcaataatttaatttaaaaaggtgaattcaacttataaaatgatgtaaatgttatgtcaaaatcaaccaatccgtaatgtattttaaaatgttaatatagttctgaagaagtataaatgaggtgttgaaatggctaaaaataagaaaacgaacgcgatgcgtatgcttgatcgtgcaaaaattaaatacgaagttcatagctttgaggtacnttaagaacatt

SEQ ID NO: 734 - DNA, 519 bp; double-stranded, linear
catagccccaaattttttctattatttgttcacgagtaaagatttgcttaggacgtgctgcaagcataaataataattgaaattccttgttcggtaacgtcatcgttttattagatacttggagttccaaataggattggtttagcgttaagttgccaatagtcatttctgaatttgaattgatattatatcgacgtaatacagcacgaattctaaaaataagttccttaacctcaaagggtttggttacataatcgtcagtaccgcttataaacgcacgctctttgtcactaagtgcatcccgcgctgttaacataataactggtatatcataatcattttttaatgtattacataattgaaagccgtccataccatccatcataatatctaccactgcaatatcgacacgctgtttttctaaaaggttttaatgcagcttcaccacttggttgtgtggtatgcatccaatggtgctctgttttgtnaaatgggctagctataataatttaggggatt

SEQ ID NO: 735 - DNA, 400 bp; double-stranded, linear
acttgaaaacgataaacagtactttccagctacacattggaaagctataaatgggataccttatgcaggcagtagtgatattgatggattgcctcaagacggtatcatttcggtaaatgataaaaataaattagataatttaaaaataggcgaacaggaattattcaaaatagcattgtacagaaatccccaaacggtaaattgtggaaaataacagttgacgatagtgggaaacttggtacagtgctattttattagaaaggaaggtgcattatggaaaatttgtatttaataaaggatttgggagctttagcaggtcgagattatagagctaaggaaatacaaaacttacaaggaataggcattgcgctgggctgaccaccagggtttangtgnccnc

SEQ ID NO: 736 - DNA, 780 bp; double-stranded, linear
cttttttattgaaaaagtggtatttgattatctatttactatttatattagcggcactccttattacattaacgacaatccaacatgtaacagaagatgacaatcatnttaatataggtgtcgtagataaagatcaatcaagtgaaacgaaattaatcttaaactctattggtaaagggagtaacctaggaaaaaacgtgagcattaaagcatatgatgataagcaagcacatactttgttaaaaaaacataaacttcaaggctattttgtttttgataaaggtatgaccaaggcattttataaacaaggcgaactaccaatttcagtatatacatatgatcaacaatccatgaaaagtgtcgtgctatctcagctaacagattctgtttaccaacgtcttatgcgatcaatgggtggcatcttagcttttcaagacttagcaccgaaagcatcacattctgacagtatcaatgttatgactgatttgctgattacaggattaaaccgttcaggtgcatttaacttagaaccgattcatttatacgatacgggcagttattatgcaattacaggatttttaacaacggtattcatctttgcactatctttatttacagttttgaaaatgaatcaagatactgtattgaaagcgcgattgaaaatgtttcatttttctaaagagcgtttattaatcattcgtacgttgattacatggttttatactatgttatgggngtatcgntggtgtagtttggaatgtggttcagtattccgaatna

SEQ ID NO: 737 - DNA, 946 bp; double-stranded, linear
tatttaatttcttnattntggtttttaattntaagatgaccataaatgaatttcttctgctgtcatagaattagagcaaaatacgagcataaatttaactaatttcttgcttgtcttatagtcttgattgccttgtaaaaatgttagtattaattgcttcatcgtttcgaattgttgtgttgatttaatagcgattgctaaacctatatttttttcgaaaagcttttcaaaacatctatttaacaggttgtaattcgtttggctaatctcaatatcgtgaatatcgtcaatgaaaacgacaggttttggtaagtgctcaaagttaatatcgtaatattcattgaaaataaattgaaatagttcattgaaattactaaatcgaacaaatactttggcacgctgacttcgatctttcggattaaaatcatctatatgaatatctgttgtatttgtagccagttgagctgttaaatcaattgttgaaattaactcagtgaattgtgatacgttatcttgttggaagtgtatttgtggtggttcagtaatcttggaaacgagtgaacggaactgtttaggactaaaatgcaagtaattcttaaattgatttgcaaaatttgtatgactgttaaaaccggccaattcagaaacagttgtaatagaatgttttgtagaaagtaataaattgatggcgttaacaagtttaatacttgtaaaataatctttaaaattcatactcaaatatcgaacaaaaagattagaacaatatgattcagagatgttgcaatgcatcgctatatcttttaaagacaagtgcgcatcaatatkgtcatgaatatagtttacacagtctatgaacaccggattgcttaaagcaatatttggtaaatattcatgatctattcttataaaagcttctttaagtaaagtgtctatnatactttgacct

SEQ ID NO: 738 - DNA, 397 bp; double-stranded, linear
tttatttgatgatgtactaaagcaagatgaaagatttgttattgtagttcaagcattagaagaaaagaacggacaattattaaagagaactttaagggaatatcccggtttaaaccataaacaaatgaatgatttatttatgcacttaaaggaattattttccgaagaatcatttgctgaaaaccaatcagcgttcagtattacagtttatacaaatttagattatactgctgaccaaatatatgctcatgtaaaacgtttcagaggtaagcatgactggacacaaacagctaaataaaatcaagatgcttgcagtggattktaacmattaatgttagatgtcmcygcatttttaatgccattcggtaattaatccggatggtccaatttaattaac

SEQ ID NO: 739 - DNA, 915 bp; double-stranded, linear
caaggtatttcatttgacccattcacaccattaatagtggcagcagcattatactttgtcttaacatttgtacttacacgcattatgaacatgattgaagggagattgaatgccagtgattaaaataaacaatcttaataaagtttttggagataatgaagttttaaaasatatcaatcttgaaatcaatcaaggggaagtagtagcaataataggtccatctggtagtggtaaaagtacattgttaagatgtatgaatttattagaagtacctactaaaggtcaagtgatttttgaaggcaatgacttaacggaaaaagggacacaagtagataaactacgtcaaaaaatgggtatggtatttcaaaacttcaacctatttccacataaaaaagttgtcgataatattattttagctcctaaattattaaagaaagataataacgatgaattacataaggaagcattgtcgttattagataaagtgggattaaaagaaaaagcagatgtatatccgaatcaattatcaggtggtcaaaaacaaagggtagcaattgcaagagctttagcaatgcatccagatgttattttattcgatgaaccaacttcagcattagatcctgaggtagttggtgatgtattaaaagtaatgaaagacctagccaaagaaggtatgaccatggtggttgtgacacatgaaatgggatttgccaaagatgtaagtgacaaagtcatatttatggcagatggcgttgtcgtagagtcaggcacnccagtcgaaatatttgaacaaccgcaacatgaaagaacacaaaatttcttagcaagagtattataacaacctaacgaggcttgaatatatgatacgcaccacaaagttatatcatatattcaagctttttattattaanatta

SEQ ID NO: 740 - DNA, 435 bp; double-stranded, linear
agtaaatgcgatgttgcatggaggctatagcaatgagcaataaagcttggggcggtagatttgaagtacaacctgaagagtgggttgacgactttaacgcatccattacttttgatcaaacgctcatagatcaagatatcgaaggcagcattgcacatgcaactatgcttgcgaatcaaggcattattagtcaacaagacagcgaacaaattatacaaggactaaaatctattcaacatgattatcatcaagatcaaattcaatttagtgcatcattagaagatattcatttaaatattgaacatggaattaattaaacgtatcggtggatgctggtggtaagttgcatactggacgcgtagtaaacgatcaagttgcaacagacatgcacttgtacactgaagaaacaagtgcaagnnntcatcgcattggatg

SEQ ID NO: 741 - DNA, 1198 bp; double-stranded, linear
aatatcataaccaaagcttgtcattacttatatgtaaagattagaggctaattacataatcctaacttatttaacaggaagtcatgaaaactatattacaactaaaagtataactttccatcaccaaagtcagaatttattgaaacactcaactgataatatagaaggctaattataaaaatacctggcgattaataaactgtttccgttttttagcacttaatatatttaaaaagacaaatagagccctttcaggctctatttnctgtatccttaacaacagaagctgttaaaactacccgtcttttcacaaccaaagctacaaaaaagatggctagttattctttcgtcacccgctgaatcattagtgttgttatttcctttaacttgcacgtctaaatcaagaactttttccaaagataaaaccccctatttaaaagttgaagttaagaccccttcaattgtcatattaatcattaccacacaataaatcaatgaatttaataataattatttgttattaatttgtaaatcgtcattaattttatggtactattgttagtttaaacaaataatgtaacttctttttttaatatgttgtgaatattttttgtttaactcttaaatttcgggtttaacttcctctatttctaacagttatactccaggattagtttctttagaatccgtaccgattaatttaacagtatggttttgccagtcaacttcataagtagatgtaaacgttactgtattttgatntttgtagttatttccaacccagtgtagtcgattccattgattagtatatctatccatttctctttggtaagttactttgattttagatttttttgtatcattttgtttatgagaaagtacgcttataaattctgggttaaagttaccacgcgccaataaaggcatttgatgtgttggcaagaaattttgaccagcatttgaactactttgtctaccacctaaaaacagttcattaccatatgttgggtcataactatctctaccatatggtccccaaccattattcataattttgtgcgcctcaacaccccagccaattgatttatgatttgtttttctatcaatcgtagttctgtaactttcttgtttataatttatcgtttctgaaaatgattttgatccatttaatccacctgataagccattagatatatta

SEQ ID NO: 742 - DNA, 818 bp; double-stranded, linear
gtggcatatncaaactactactgaaagatcaattacatacgtacagattttgcaaaatgatcaagattatccaacaatttttagatgagacaaaacgtaaatctgtaattaattcagatgttaatgtaacggtaaaagatagaataatgactttatcaacgtgcgaagatgcatatagtgaaacgacgaaaagaattgttgttgtcgcaaaaataattaaggtaagttaaacagaaamgaggataattatgaaatttatggcagaaaataggctgacgttaacaaaaggaacagcaaaagatattatagaacgattttacacgagacatgggattgaaacattagaaggctttgatggcatgtttgttacacaaactttagaacaagaagattttgatgaagtgaaaattttaacagtttggaaatcaaagcaagcttttacggattggttaaaatctgatgtctttaaagcagcgcataaacatgttagaagtaaaaatgaagatgaaagtagcccgattataaataacaaagtaattacatatgatataggctatagttacatgaaataattgaatttaaagaggttgcagtacttgttatgacaattggtattgttagcttttgtaacgaccatacatgataccgatgatggtcgtttttttaatgaacacaaacatgctaacaacaaattgctaaaacatagtttgatttgaatgtggctttggaaaataatcatccattatatcattttggattntattttggaagaagaaaagaattaataatggatattttggggggcgtatggattttna

SEQ ID NO: 743 - DNA, 1209 bp; double-stranded, linear
tgctggtaaatcttcccttatcaagtctttaattggtgaatttaatgctaccggtactaaattgttatataacaaacctatacaacaacaactgcaacatattacatatattccacaaaaagcacatattgatttagattttcctataagtgtggaacaagtgattttatcaggttgctacaaagaaattggatggtttagacgacctaataaatcagcaagggataaactcaaacagttattaagcgatttagaattagaatctttacgtcatcgacaaatttcagaattaagtggtggacaattacaacgtgtgctagtagcaagagcattgatgtccgnaagtgaagtttattttctagatgagccgtttgtcggaattgattttagtagcgaaaaattaatcatgacaaaaatcgagaacttaaaacaacaaggaaaacttattcttatcatccaccatgatctatcaaaagcaaagcaatactttgatcgcattattctattaaatcaaacattacgatactttggtgatagtgaagaggctatgagtgtcactcgcttaaacgaaacatttatgagtagcactgactgtagtgaccctagtcaaaggagcaatataacatgttagagtttgtcgaacatttatttacatatcaattcttgaatcgagcattgataacttcaattattgtagggatagtttgtggtacagttggtagtttaattgtattacgtggtctttcattaatgggagatgcaatgagtcacgcagtattacctggtgttgccctatcattcttatttggtattccaatgtttgtaggcgcacttataactggtatgatcgcaagtatttttatcggttatatcacatctagtagtaaaacgaaacctgacgccgctattggaattagttttaccgctttcttagcttcggggattattattattagcttaataaacactacgacagatttgtaccatattctgtttggtaatttactggcaatcacaaatagtgcatttttaacaactattgtgattggttcaatcgtccttattctaatcattattttctatcgtccattaatgatttctacattcgatccaacgtttagtagaatgagtggtctaaatacgacgttattacattactttgtgatgttgttactctcattagnaacagtagcaagtattcmaacggta

SEQ ID NO: 744 - DNA, 675 bp; double-stranded, linear
ccgcctttcgtaaacctaatataatacgaaattttcgtattgtcaacattaaatacgtttttttcgtaaaaaactttactatgatatgaaaatttcgtataataagaaaaaaggaggtaagtaatatgaacaaagamagmaatattattatagccaaaamcattagaaaatttctcaacgattcaaatatgtctcaaaagaaacttgctgaactcattaacataaaaccatctactttaagcgattatttaaatttacgttccaacccctctcacggcgttatacaaaggatagctgatgttttcgaggttggtaaaagcgacatagatactacatacaaagacgataacgacatcacttccatatacaacaaactcacacctccccgccaagaaaacgtacttaactatgcaaatgaacaattggaagaacagaattctaaaggagataacgttgtagatattaattcatataaacaggagaaaactccagttaacgtcaatggttgcgtctctgctggtgtaggagaacgtttacacgatgaaacgctatttactgaaatggttaaaggacctatccccacacacgatttagcgttaaaagtaaatggtgattctatggracctatgtttaaagatggcgaaatcatatttgtggagaaaactcacaatntga

SEQ ID NO: 745 - DNA, 924 bp; double-stranded, linear
caggtgtcatagttgaacttggtggttttggactaatcgttaaatcatcaatttgtgtcatccaaggttggaatttactgccttgtgtctccagtgcgctgaaaatacctttatcttgaaataagtcaactaactcttggatacctttaattaatgctgggttaccaccagaaattgtaacgtggttaaataaatcgccaccaattcgttttaattcatcataaatttcttcagcggtcatgagttttatatcgcctttagcactaccatcccaagtaaatgcagaatcacaccagctacaggataatcacatccagctgttctcacaaacatcgtttttctaccgattactcgaccttcaccctgaatggttggaccgaatatttcgagtacaggaattttagccattagttacacctgttcctttggtctaaatacgacataacttgttggtgtttctcttacaaatacttgaatacattttggttggtgttcgagcgatgccaaattttctttaacaatttgataaattgtttccgctacgatttcagttgaagggattttgtttttaaaagcaggtaagttatttaacagttgatggtcaaatttaccgtgtatcatctttttcaaatggctaaagttcactaagaagccagtgtcatctagtttatcaccgacaattgttaaayacaaagtaagtatgaccatggacattttgacaaatacctgcttcttcacatggaatgtgatgtgcagccgaaaaattaaaatctttatttaattcgaattgatatggatgcgttgtactaggatagatttgttgtaacattttaaagcgctcctttactttcaagatattgatttagtccacgttgacgtaaatgacaagctggacattcaccacagccatccccaatgataccg

SEQ ID NO: 746 - DNA, 971 bp; double-stranded, linear
atcttttgggtattttctatattagctgttgttttcttagtattatttagttttgctgttggtgcatcaaatgtaccaatgatgattttaacatttatattactcgttgcaacctttggaattggatttactacaaagaaaaaatatcgagaaaacgattggctataagttatatcgacaataacacgcgttgatttaagaccacacatgttcatgatgaacatttaactggttttatattggcgcgtgtttttattatttaaggtataaaagcgtaatatgttacctaattgttaggactacatattacgcttttggtaattattttgattttcttttaaatcgttgttcatgtaattgtattaacgcatcatggtggggctctaaataatcattgctaattcttgatggagaccmcgatttccaactargatkgaattkggaccmctaatkgttaatggtcctcctagtaaattggaagcttgtccattacttccatataaataaccaatccgccagcaaatccccatggtkgaagtcttggcgtcatatatgcttctaaattacctgtagcaactgaaacgatttcaagcgctgcactaccatatgcccttgcacttctagaatcattaacaatttctttaaagatttctcctaaaattggtttagttaaccagttcggattgatcccaataatgctttgtcttagattagaatcattcaatggtttcaagggttggctaccacgatatgcaccttcccctactttagcatgatataagacatcagccataacatcatatacaaaacctgcataaggtttaccatcgatataaataccaattgaaattgcgaaattttcttgttgatgaacaaaattcaatgtaccgtctattgggtcaacaatccataccgtacctttggaagtatcgatgtcatgaccatgcccttcttcacctaatacttgatga

SEQ ID NO: 747 - DNA, 865 bp; double-stranded, linear
ttctcgtcactgtacgttgtattgcggcatcatccattatgatacgttcagacatattctcaccctttcaaaatttagaaacaaaaaacctcatgtctttaatatcgacatgaggtttagtatatacaatcagcctatttacatagaagaatcgtagtattactacttattcttgcatatgtgaaagtgttatgatcattttagtatatatctatattttcatgtctttgacgtctctctggacgctcaattaaagactctttatgttgtacttaaactgttataaggataatactaatcaggcgctttgtcaatctatattgaaaaattaaccatactcagtaaaaatgttaaccttaatctattttataatgtgttttcatttaaaaaaaacgaaaacgataaacacttatagtttacataataatgttatcgtaattatagcacgacacaattatgcatctctttttcgaattgtatctaataaatcttcaaagtcttgtggtaattcagcatgtctttcaatatattcacctgttactggatgttcgaatccaataagtccagcatgtagagcttgaccaccaatatccaatgtctttttcggtccatactttggatcaccaactaatgggaagccaatatatttcatgtgaacacggatttgatgcgtacgtcctgtttcaagttgacattcaacaagcgtataatctttaaaatgttctagtacgttaaaatgtgtcactgcttccttaccatcatcancaacagccatagattgacgatcatttttgtttctaccaattggcgcatcgattgtaccgtaatcatgaggaatattcccgtggaactaaancgatatagt

SEQ ID NO: 748 - DNA, 818 bp; double-stranded, linear
ataacattgtggagcctatgacattgatttatgtctcggtctcaaatgttcttgtaaaaaaactaagtatagttgaattttaagttaaaaaaattgtttttgcaaaaataaaataatccatcaactgcaaaaaaatatgcaatgatggactaatgtcaaaaaattgttacatccattttattttaggttcttcgcctctaaaaatccttgcgatattagagcgatgtctaattatcaatatgattgaaactaagaaactaacgactaataaaatatagtcttgaatgataagcgagccaatcacacagcaaattgctgcaacgatacttgctaaagaaacatatttaaaaatcttcaatacaataaagaagataattgcaagtattagtaaaagtatcggattgactcccaagacgacacctgcactagttgcaacagctttgccaccttggaattttaaataaacaggataaacgtgtccaagtatagcgaataagccaacaattaaaccatttgtaaaaaaagtactaatagggccatctgcgtgaacttgtaaccataaagggaagaaaacagttatgaaccctttgaaaatatctagaaatgttaccaagaatcctgcaggacgacctaatactctaaagctattagtagcgccagtattaccactaccaaattgtctaatatcttttttgaaaaataattttccaattacgaatccacttgggaaagcgccgataagataacttagtagtaacatgacgattatcatcataaatattacacatcctttaatatcttaggactattttatcata

SEQ ID NO: 749 - DNA, 971 bp; double-stranded, linear
atatccaataactgttcattgtcttgatattccttaaatgtttcataatgctcattagaaatgacaatttcaagcaaccaacccgtgccactttcctctttattaattattacgccatcttctaattcatattctataattctgccgtgttcattcacaatttgaaaccttactgctttaaaagttttcatattcccacatcccattagtttaatatttatgatttttgaattatttagaagatttaaggtcatttcatgactaatttctttaaatataacaaataacgagatgctatagctattaattatataaaatttgccattttgaccatttttaagctagtaattaagatataggcataggaggtgaatcacacactacatgctaaataaaatcgtaattgtcgggagctgacgaaagacgcacaaatatttgaaaaggaggatagaaaaattgcaacgttttgtgttgcaacgcaccgaaattataaagatgaaaatggagaaatcgtctgtgattacttattctgtaaagcatttggcaagttagcttctaatatagaaaaatatactaatcaaggtacattggttggtataactggtcaaatgagatcaagaaagtatgataaagacggacaaacacactttgtcactgaattatatgttgaaacaataaaatttatgtcccctaaatcccaaaataatgaaattctctcagatagtattttagatattgactctcaaaatatagataatcatgacttattagaaatttaaatccaattatcctaaacatccttaatatacatttaatccatcctaaattttttatagatctaattaacttgaaatatactcacttaaaaacgacttacatgacctagtactgttggtaaggtcgncttttggtgtagttttcctaataganaatagacntaggttgccaaaccgattacataaaaaattgcc

SEQ ID NO: 750 - DNA, 832 bp; double-stranded, linear
atagattactcttttgatctgtagatcctactgtaacgacattgtccatagatgcaggaacatctttcacttcgccattaccttgatattcacgctgtaattttagtttctgtttgtcattgacatcaataccatcattaccagctgcagcaacaacgatagattttttcttcttggcgtaattgattgctttctgtaacgcatcgtattctactttttcatcttttctaaatgtttgatggtcatttttgtccaaaataatataactaccaacactaatattaatgacttgatttccatcatttgcagcttgaacaatcgcttttgatacccaaagcagttctgtttttttactaccaaacacgcgatacattgtaaatttgttattcggtgcaacacctattaacttaccattagcactcgtttgacccgacaccatcgtgccatgtcctttcctatcattgacatcgtgaacatcacctgtttcctccggttcagtacctctaaaaccgtttaaaggtactaaatttttagaatcagtcgagaaattatttttcaaatcgtcatggtttttcatcacacctgtatctatgattgctattttggtgttagcatgttttggcaaatcatcatacgatgcaccattattggttattttattcatatcccattgtcttgaaaataatgactcatttgatgttctgtctattgttttctcgctagtaatacaagttgaacatgtggcattgatatatttaatatcatttttatagtttgctaaagcattagcatgcattttcgtcattttaatctgtgccacatggaattccgg

SEQ ID NO: 751 - DNA, 475 bp; double-stranded, linear
gtaatatcaatctcttcataagctgaattattttcatgcacttcttgatgtgatgatttgtcacgaaccgctacaactaacattttatcgtctaaaataagttgtttatatttttctaattcatcaggcgctaagttgtagcgtgataaaactgcatgttcaccatcttctcctgttaacagtttagtcattctatcactaaatgttccacttgttgagataagggagatttcagagtcgtgtaagtcatttaggtgtaatttacttttactaataattgttagctctgattctaaataaccttcagatttcttttgattgattacgttgtataattcgccagtgtcatttactacagtaatatctgccatagttgtcgcccctttaaaaatttgtttatttaatcttttacccttcttatnataaagtaaaacccttacattattaagtnataagtcttcattcgcattaaacg

SEQ ID NO: 752 - DNA, 1019 bp; double-stranded, linear
gcgacacttgtgagttctccagcagcaaacgcgttatcttcaaaggctatggacaatcatccacaacaaacgcagtcaagcaaacagcaaacacctaagattcaaaaaggcggtaaccttaaaccattagaacaacgtgaacacgcaaatgttatattaccaaataacgatcgtcaccaaatcacagatacaacgaatggtyattatgcacccgtaacttatattcaagttgaagcacctactggtacatttattgcttccggtgtagttgtaggtaaagatactcttttaacaaataaacacgtcgtagatgctacgcacggtgatcctcatgctttaaaagcattcccttctgcaattaaccaagacaattatccaaatggtggtttcactgctgaacaaatcactaaatattcaggcgaaggtgatttagcaatagttaaattctcccctaatgagcaaaacaaacatattggtgaagtagttaaaccagcaacaatgagtaataatgctgaaacacaagttaaccaaaatattactgtaacaggatatcctggtgataaacctgtagcaacaatgtgggaaagtaaaggaaaaatcacttacctcaaaggcgaactatgcaatatgatttaagtacaactggtggtaattcaggttcacctgtatttaatgaaaaaaatgaagtgatcggaattcattggggcggtgtaccaaatgaatttaatggtgcggtatttattaatgaaaatgtacgcaacttcttaaaacaaaatattgaagatatccattttgccaacgatgaccaacctaataacccagataatcctgataaccctaacaatcctgataaccctaacaacccagatgaaccaaataacccngacaaccctaacaaccctgataatccagacaatggcgataacaataattcagacaatccagatgcagcttaattaacaattaagttcgtctagataaaataggaagcaaagtcttagcaacgtaaaatattttga

SEQ ID NO: 753 - DNA, 533 bp; double-stranded, linear
attcttatcccaggtaggtgntttacttcttatattaggtgcaataactcatgccactcatcttgtggcacaacatgaatcgcattttcaaaaattgcatgtcctgcttgatcagtcaaaccggcagcatgatcaaaatgcatatgtgtcattagcacataatcaatatcctttggcgttaaattataatttgccaaatcagcaattatatgactttcttcatctactccaaaattacgtaattgcttttcagataatttaccattaccaatacctgcatctataatcaaattatattgagccgtttgaatcaaaattggatgtgtcggtaaattgatttgatttcgttcatttgcattgtattgctttgaccacaacggcttcggaacaacaccaaacattgcaccgccatccatttttgtattgccaccatttagataatgaatagatatatccccgattttcataacatcacctattctttctgtattcgttattacaattagcatgtgtttattacatcatatcactat

SEQ ID NO: 754 - DNA, 1225 bp; double-stranded, linear
atcccctgcaagtgataaaattattgaaaaaggcgacatgattacattagattttggcgcgtattataacggctattgttcagatattactagaacatttgctattggagaaccagatcctaaactgaaaganatatatcanatagtacttgaatctcaaatgaaagcaattaatgagattagacctggcatgactggtgcagaagctgatgccatttcaagaaactatttagagtcaaaagggtatggaaaagaatttggacattcactaggacatggtattggtttagaaatccatgaagggccaatgctggctcgtacgatacaagataaacttcaagttaacaactgtgttacagtagaacctggtgtttatatagaaggtttgggcggtataagaatagaagatgatattttaattacagaaaatggttgtcaagtctttactaaatgcacaaaagaccttatagttttaacataagcgtgtaaaatgaggaggaaactgaatgatttcggttaatgattttaaaacaggtttaacaatttctgttgataacgctatttggaaagttatagacttccaacatgtaaagcctggtaaaggttcagcattcgttcgttcaaaattacgtaatttaagaactggtgcaattcaagagaaaacgtttagagctggtgaaaaagttgaaccagcaatgattgaaaatcgtcgcatgcaatatttatatgctgacggagataatcatgtatttatggataatgaaagctttgaacaaacagaactttcaagtgattacttaaaagaagaattgaattacttaaaagaaggtatggaagtacaaattcaaacatacgaaggtgaaactatcggtgttgaattacctaaaactgttgaattaacagtaactgaaacagaacctggtattaaaggtgatactgcaactggtgccactaaatcggcaactgttgaaactggttatacattaaatgtacctttatttgtaaacgaaggtgacgttttaattatcaacactggtgatggaagctacatttcaagaggataatctctaatttgttaacaaatagcttgtattcactatactgatttaacgtaaganattctaaataagtctcataaagctattgcctaaaatgattataggttatatgctgatatgaggctttttatttttaaaataatttttaaaatataaaacgaatcgtc

SEQ ID NO: 755 - DNA, 1265 bp; double-stranded, linear
acaaacaaatcacttagttaaaattgacagtgcattatattccgataaattattcaacattgtagaaannagaattgatacaccagatattggctataatacagtggttttatcagaaaaatgagtgtagaaattaaagggatacctgangtgttgaataaattagaatcggtatacggtaaacaagcaatgcaggctaagagtgataaagctttaaatgaagcatctgaattttttataaaggctttaaagaaagagttcgagagctttaaagatacgggtgccagtatagaagaaatgactaaatctaagccttatacaaaagttggtagtcaagaaagggctgttttaattgaatgggtaggtcctatgaatcgcaaaaacattattcacttgaatgaacatggttatacaagagatggaaaaaaatatacaccaagaggttttggagttattgcaaaaacattagctgctagcgaacgtaagtatagagaaattataaaaaaggagttggccagataaatgaatatattaaacaccataaaaggaattttattatctgatgcagagctcaaaacacatataaattctagaatatactattacaaagtcactgaaaacgctgaaacttccaaaccctttgttgttattacacctgtttatgatttgccttcagactttatgtctgataaatatctcagtgaagaatacttaattcaaatagatgtagaatcttcaaataatcagaaaacaattgatataacaaaacgaataagatacctgttatatcaacaaaatttaattcaagcatctagtcagttagatgcttattttgaagaaactaaacgttatgtgatgtcgagacgatatcaaggcatacccaaaaatatatattataaaaatcagcgcatcgaataggtgtgctttttaatttttaaggaggaaataagcaatggcagaaggacaaggttcttataaagtaggttttaaaagattatacgttggagtttttaacccagaagcaacaaaagtagttaaacgcatgacatgggaagatgaaaaaggtggtacagttgacctaaatatcacaggtttagcaccagatttagtagatatgtttgcatctaacaaacgtgtatggatgaaaaaacaaggtactaatgaaagttaagtcctgacatgagtattttcaatattccaagtgatgatttaaacacagttattggacgtactaaagataaaaatgggtacatcttgggtaggag

SEQ ID NO: 756 - DNA, 1111 bp; double-stranded, linear
catatacccgggttccaagaatcctctatccatatggtcccccaattttgattccaccatattgttaaatatcactttcccagcctacttttttatncagttgggctctctaaaattgttttgaaatccaggttgaacatatttccagtgtatgaccaatcgaaacatttgcaccaataaggccgccaatttttcctgtatcatcaccagtaacattaccgttgaatccataagttaaagtactcatatactcttttgtatcaatcgaatttcttggatagtaatcagatatttgagctacttcattatcaggtagttgcaactgtaccttaaaggctgaaggccaggctaaaccacttttgttagcaccttcttcgctataaactctatattgaccagcaatggtacctttcgttctaataactagcagttttttattatgatttttatcatcgataaaactataaaatacttttttgtgcatgccattttctttatcataagtgactaaatcacctgtttttactgtagtattgcttccaatatctgtagtaccggttttaatattaatatcagaatctgcggcattagcgacaggattcattaatatggaacctagcaatagtgttgttgttactgagctgactatacgtgttttcattttcatcatccttctattttttaaaacgatttgaggaaacaataatcaatatgtcaatttagaatattgcagttgagacatatcaaatatttataatcgtttatattagtatatttaatgtagcaactgataaattactgagtgatgatgagtgattattttaagaatatgtttttaacttttatttaaaatttgaaaggaagcatttcaatttcgagggttagtcaaagttgaataaattctttatgaaacaaggaaaagacatagctaattttattgattaatttctttaaaactaatgatttgtttgatttaaaaatgtaatcgattacaatataaaaatacaaatatcttagaattaaatcaattaattaactattaaataaaaattaactatatattaactagtgtaaattaataaatagaaatagagaaaaagggtattaatta

SEQ ID NO: 757 - DNA, 466 bp; double-stranded, linear
tatctattgtatgtaacaataggtacataatatttttagggtgggttatatgagcataattacaagattgtttaataacagtgattttgaaaaattaaatcaactatgtaaattatatgatgatctaggttatccaacaaatgagaatgatttaaaaaagagactaaagaaaataacgaatcatgatgattacttcctactgcttttgataaaagaaaataaaataattggtttaagtggtatgtgtaaaatgatgttttacgaaawaaatgcagagtatatgagaatccttgcgtttgttatacattctgaatttaggaaaaaaggttatggaaagagattattagctgattctgaagaattttctaaacggttgaattgtaaagcmataacactaaatagtggtaatagagatganagacatctgcacataaactatatagtgatantgggtatgttagcaata

SEQ ID NO: 758 - DNA, 402 bp; double-stranded, linear
cgtacagcataaccaaatacatatctgccaaaatcgccatatgccccagttcctcttccatattccgttgtcattgagtttttaattttatcgatagaaaaatgtaaatggctatctaatttgttttttaaagattttatgtaatctctatatttaaattcgaatattcttttttataccaattacttttataaggtggcctaattttttctaaatttatattagatatatctwtwgataaactaatatatwcaattgtatgcctagcataatctctcattaaaatatgaggatataccatttctttatcaaatatttcttcataaatataattagcaatctctatatgtatttcacaaatgtcgattcgaagtgtcgcccctaaaacagragcatataatc

SEQ ID NO: 759 - DNA, 338 bp; double-stranded, linear
aagttactcaacagccatttgacacgtctcgattagagcgattaggtataaccgagcgccaaactaaagacatgtatcgtttattaggactagccaaatatgaagatcgatttgttattccaacatcacacaaagaaacctatttagatacgtatcacgcacaaggtagtacaggatacaattacggcggcgagcattttggagataactgtgaaggctgtggcgttgcagtaggttcagggaaaactggtcaagaaatttataatggagaattctatggagggatttccgtggttaatttcgataatttaaaaaatatccaagaaagtttgggtnnn

SEQ ID NO: 760 - DNA, 399 bp; double-stranded, linear
ctctattatatttagagttatagctattgcagttgtttatttattgaaaataaatgtactatcattagttttagcaagtgtattaggcagtttggtatctaggctactattatctattattttaaatttacctgtgtgggtagtgttgttaaacgcgattccaggcgtaatattcactttaattgtagctattcctttatatctcacattgagaaaaagaatggcagtattactaagataataaatcaaaacacggtcgtcacaattactgttggcgaccgtgttttactagctatttattgttttcagtttcttttgtatctaacaatttcactttgtgattttcccaatcaatttcatatgttgatttaaatgttctagttttaaagtttttataat

SEQ ID NO: 761 - DNA, 639 bp; double-stranded, linear
gcatatncaaaacaatagctgctttaggtgcgggggctattagcgttatttctgcactaacaggaggtttagttggcgcaggtgttggtggtttccttggatctatagctgcatcgaatattgatactagtaagggaatatatataaaattaaaaactaaaaagtatgcagccggggaatacgttctgacaggagaaaaatggggatatcagtaagggtgattttatggatagattaaaatattcacttaaagttggaattttagcattattattattttgtactttaaattatttagttccaatgcaaagcaatgctttttcaataattatatattcggcaatttttgctgtgttacttatgcttttagtttatatatttttaggaattttaaagaaatgacatgaaacaaattagcattggctatgaagaaatctatggggatagaatttttcatagccattttttaaaagagcatgaagtaaaaaattggaaaaccgtcaatcaaataattgaaaaagaacacttggacaaaaatgaatatgnaagcggaaccgccgttatttttcttttgcaggatcgttagattagattncggttgtatagtataatgaaaaatattataataaatttataaaa

SEQ ID NO: 762 - DNA, 852 bp; double-stranded, linear
ntgttcgttgtctggatccaacgtaaacagtcgcttcatctaatacaatgataggcgcatcttttaatatcattcttgcaatagtgactcgttgtttttcaccaccagacaatttatctcccactgtaccaacattcgtatcatatccatctggcaacttttcaataaattcatgacattgtgctaacttggcagctttttcaactgcctcatccgtagcttctggattgccaagtttaatattttctttaaaagtaagatttaataaaaagttatcttgtccaacaaaaccaactaaatcgttaagttgtttcgattcaatatcttttatatttataccgccaatcgtaatttcacctgaagtcacatcccagtatcgtgatataagcttggcaatggttgacttaccgctaccagatgccccgacgatagctgtgaaattattttctggtactgtaaatgataaatgcttaaagaccagatcgtccttatctttgttatatgaaaatccaacattattaaaagcaatttcataatgttgaggcttcttaaattttgttgacaatactaactcttctagacttaatatttgattcacttcagttaatgcgtattgtatagactttaaatgatttacataattagtaaaattcttaatcggtgctactacacctaaagataatacgatgcataggaaaaattccgcatagtttaattggttgatagatatcaaatacatgccgaccggtaaaatccctaaaaatgttgaaggtaatacactagctcctaaattcatatacccccatgtatttttaaaccaattcaaagtgtgaatcttataattatctactg

SEQ ID NO: 763 - DNA, 852 bp; double-stranded, linear
ctcttcatgcgtcatacgttgtgtcgattgatcagttgttttgtctaaatcactagctttaaatttagattgatttgattgacgtgtcgtaaatngttgttccttttgttggcgtttgcctttttttcttgatcttattaaaaataaattgataaccccaacaataatgagcgctaaaataatgtagctaataatgaaggtcgtagtcatttaatgacccccttaatttttatggatttttacttcagcgttcattccaggaacaacttgtttagacggttctgattctagagtgattttaacaggtattacttgagaaactttagtgtagttaccatcactatttgatgatggcattaatgaaaagttgcagcagttgcttttccaatactatcaactttacctttaatagaagctttttgaccgtcaatagtcacatcaacatctttacctacttcaacatctttaatatctttttcgtcaatatttgctgttacatataaatcatctaaattgtatgcataagcgattgggttaccagcttgcaccattgaaccttccataccatctaatttggcaattgtacctttttgaggcattttaagatccatatctttcgtttcgccatcttgaccttgtacagtaacaattgctactttgtcacctttatcgagtttgtcaccttgtttaacattaagtgatttaatttgtccagatgcaggacttgctattttaatttgatcgccatttacttttgcattatcagttgttacatagcttgttgttttattccaaaaataaaagccagcaatcccaatggctaacngtacaacaaccgtaatgacattnaat

SEQ ID NO: 764 - DNA, 747 bp; double-stranded, linear
acatattcgacattcattttaaattgcatataactacattaaccattcattgtgcagcgcctgttgtttagatgatcatttattgactttttgctcttatnccangcaattttttgatttattgcttataatacattttaagacaaatgtttgtttcaacatcgcatgcgacatcattaaytattcatttaaatttatccagtttctatttgtctgcaattgctgaaaattaaaggagcttatttttaataatggaacaaattatcactgaatttattagccgttttgggtatgcagccatttttatattaatttkatkagaaaatgtactacctatcgtaccatcgggaaattattctgacatttgctggtcttatgtctgttaaatcacatttatcaattttaactttatttattattgcaactatcgcatcgtttatagggctgttaattttatattatatctgccgtttgatttcagaagaacgtctatatcgttttattgatcgacacggtaagtggattaaattgaaaagtaaggatttaaagcgagcaaatgattggtttaaaaagtatggcgtatgggctgtattkatctgtcgtttcatacctgtattacgtgtattgattaccattccagctggtgkaaaccgcatgaatgttgtgacatttaccgttatttcattaataggtactacaatctggaatttcggtttaattttactaggacgcactttgagcgatagc

SEQ ID NO: 765 - DNA, 820 bp; double-stranded, linear
tttaccttttaaccaatcatgcattaatgcaatgtgtactgtcttaacaaatgttgcatattcatcttctgcactccactttttcaattcctgttgattaatggcatgtttttctccattttccaacatattgacatacaatttataatgtttttcaactgcctgaataaaagcgagttgatttttatttaaatgtgattttaacttttctaaatctgaattaataaagtcttctatagtcgaataagacatatcttggtattcaactactgcattaatttcatctaataattgcgattgtgattttagcgttatataactctcgtctccataagatatttctgtagtagctgctgtagtaggatttggagaactgactaaaatatgctcgcctaataatgcatttatcaaactacttttaccagcactaaatgttccaaatacacctatttttattaatttattatctatacgtgttaatgtttcgtggatatcttgctttgtacgcttgaacaaaggcacatccgaaattatatcaagcgctttttgaatatctatagacatatttgttgtagctgtattttgatttagctgctgattatcacgattatcctgagcattatcagtagccacttgatatgttgtctcttgtcgacctattaatttatctagagattcatctaaatgaatatagtagtgacgataattcttagtcgtcaatgactgacgcagctcatttaattctgtataacgttgatattcttttaaatcatcactttcttctgttggnaattcatctgcctgcacattttctatnatt

SEQ ID NO: 766 - DNA, 672 bp; double-stranded, linear
tcaacatgacattaatttaatagcgatgcatacaaatttagatgtaaatccgtatggtgtcaatatgatgttggcgaaggcgatgggtttgaagaacatttcaataataaataatcaacaagatgtatactataaagttcaaacatatatacctaaggataatgttggaccatttaaagataagcttagtgaaaatggattagcgcaagaaggtaattatgaatattgtttctttgaaagtgaaggaagagggcaattcaaaccagttggtgaagctaatccaacaataggacaaattgataaaattgaatatgtagatgaagttaaaattgaatttatgatagatgcatatcaaaagtcaagggctgagcaattaattaaacaataccatccatatgaaacaccggtatttgattttattgagataaaacaaacatccctttatggacttggcgttatggcagaagtggataatcaaatgacattggaagatttcgcagctgatattaaatctaaattaaatatcccaagtgtccgttttgttggtgaktctaatcagaaaattaaacgtattgcaattattggtggttcaggtattggatatgaakatcaagctgtccaacaaggcgcagatgtctgttacggtgatattaaacatcagatgcctagatg

SEQ ID NO: 767 - DNA, 403 bp; double-stranded, linear
gaaaaagttaaacctactgtaactacaacaagcmaagttgaagacmatcactctactaaagttgtmagtactgacacaacaaaagatcaaactaaaacacaaactgctcatacagttaaaacagcacaaactgctcaagaacaaaataaagttcaaacacctgttaaagatgttgcaacagcgaaatctgaaagcaacaatcaagctgtaagtgataataaatcacaacaaactaacaaagttacaaaacataacgaaacgcctaaacaagcatctaaagctaaagaattaccaaaaactggtttaacttcagttgataactttattagcacagttgccttcgcaacacttgcccttttaggttcattatctttattacttttcaaaaggaagaatctaaata

SEQ ID NO: 768 - DNA, 483 bp; double-stranded, linear
ttcaatgctcgttttgcttgcgttagtaatttctaacatattcattcacattttggagcctaaactatcaatcaccactcaaatcatcatcgttttgattttaattgaagcactaattggactgcgtttcttgaaagcgtacgatgttaagcgtggcaaagataaagaaaataagaaaaatagtaaggatttcgttaaactaaaatcaattttagtagcaattttatttacatcattggcgctgacagcaggtactgtagctgatatatacggtttcactgacttaggaaatactagaagtgatttaatcgtttggagcataggtggtattatatttggcctcgtatgttacacaatggaagataaaagataacgataaggagctggcgattataaagctagctccttttttaacttatatatgtaaagaactatcctaagggkttttaatcatatgtcaataatttctataatacattatta

SEQ ID NO: 769 - DNA, 400 bp; double-stranded, linear
attatatgtctgatgtatttcatgtcgttaaaaataaaggtacggaagattttaaagaagatgccattcaaagatttgtgaaacatgattataaagtaacgagcaaagcaaatcgcatggggatgatgcttgaaggtgaaaaaatcaaagctttttatgaagatatgccaccgtatcagactgtcaaaaaaggaacgatacaaattaagcgtgatggcacacctattatcctattaaatgtcattatacgctngtagctacccgcaaatcggtacaatcgcagttatcatttacgaattagcacaaaaccgcaggatcacgttgaattccattatagtatttacggctgaagactgtaagntanactggtaaccatatcatggatgattgatcatagatg

SEQ ID NO: 770 - DNA, 750 bp; double-stranded, linear
atctcttctacttcttttacaaattgagaacgtcttaaaatggctttcacacgggcaacaacttctctaggtkaaaaaggcttagtcatatagtcatcggcacctaattctaaacctaatacccgatcaaattcatcatttttcgccgttaacattaatatagggactaaatttttatttgttcttacagtcttacatacgtcaatgccatcttttttaggtagcataacatctaaaataattaaatctggctgttcactttctaccttttctaaagcctcatcaccatcaaatgcgacaacaacttcataaccagctgkttctargytatatttaagtaatggttacgattgaatgttcgtcatctactwccaacactttttgcgacatggtatgcctccctaacttakaattatatttcattataaccgaactatttataaaaatamcatcctacacattatctttacacattttttacattactttacatataaataaaatacttcttatatttccttctmtcatttgcatgacttactctgggacaacgaaataaattttgtaaaaatagcatttctatcccactacctatgcatgagttttactcatttattcctaagcttatgtacatattcgctttgtctaatgtgtaagaaacactacataatcaatcattggtgactctttattatttctatcctgttgccaacttcaattcatttaaaaaggcgaacctagcaattaaag

SEQ ID NO: 771 - DNA, 1462 bp; double-stranded, linear
atttaattattatttttccaaatcaatacgatataattttatgtttttatcttttggtgctgaggcaaattgataagtcgttttgcctttttcaatatatccaaaattaccagcaactttgctatattccgtatgtgttactgctttgccaacataatttttaacagcttgatatgttggaccattagcatcattatacatcattgaaatatgagttactttaccattgtttttcttaccatcagtagttactaataacataccttttttagtatggaattcgtaataatgttcagttccatcttcattgtaagaatacatcggatttttgtacttagttaaaacatctttaatagattcgccaattttcacattttctaatgactgatcacccttaattaattgtttaacagtatcaatagagttgccacttgctgcttcggcactagtgttcactaagcctactcccattacaacagaacatgcaattatacttgccgttagtagctttttcataagcactctctccttttatttatatcgtcttgtgctcacaaccattatacaacaatcatttctaaaacaacagtcatattacaattatattacaaataataattactacttttatatttcacttatcactaaaaattaaacatgcttttcatcgtgatgtttgttgataaatgcagctgtatcttcgacgaatctttcttgctcttcaacaaatgggaatgcacttgattcttgatatacttcaaagtccgcattttggattaaatcagctacttctttagcttctaatcttgttgttctttcaccgaattctcctgcaataatttttgtcggtactacgacatttctataagtttgagaaatatcagcgtttttgaatacctctttaactgcttgaatttcttctttagttgatatttcatttgtatctacgacatgtttgaggaatcgattcatttttctcggacgataatacttacgcttatttaaaaatttawcytgtttttcaggatcccagtttcgaataatatgggcatattttctaaataaacgttcttccggtaattcaccttcaatagatgttggatttaccaacgtaagtgatgatgtaaattcaggataacgtactgaaatatccgcaccaatgattccacccattkcatggcatacaaatgcaacttcttcaatatataaatatttaagtaattcaacaatgtcatcagaaaaatcttttatttcaatgtgacgaggtttatcagaatagccatgtccacgtaaatcaattaacacaacttgaaatgattttgctaattctgctgctaatttattaaacacagaataattatcaagtacagtatgaatcaatacgataggatagccttcacctaangtactgtaatgtatcgatgttccatcttttctagtaaatagatccataattttctcc

SEQ ID NO: 772 - DNA, 704 bp; double-stranded, linear
attattataaggagttatcttacatgttaaatcttgaaaacaaaacatatgtcatcatgggaatcgctaataagcgtagtattgcttttggtgtcgctaaagttttagatcaattmggtgctaaattagtatttacttaccgtaaagaacgtagccgtaaagagcttgaaaaattattagaacaattaaatcaaccagaagcgcacttatatcaaattgatgttcaaagcgatgaagaggttattaatggttttgagcaaattggtaaagatgttggcaatattgatggtgtatatcattcaatcgcatttgctaatatggaagacttacgcggacgcttttctgaaacttcacgtgaaggcttcttgttagctcaagacattagttcttactcattaacaattgtggctcatgaagctaaaaaattaatgccagaaggtggtagcattgttgcaacaacatatttaggtggcgaattcgcagttcaaaactataatgtgatgggtgttgctaaagcgagcttagaagcaaatgttaaatatttagcattagacttaggtccagataatattcgcgttaatgcaatttcagctagtccaatccgtacattaagtgcaaaaggtgtgggtggtttcaatacaattcttaaaagaaatcgaagagcgtgcaccttttaaaaccgtaatgttgatccagtagaagta

SEQ ID NO: 773 - DNA, 427 bp; double-stranded, linear
gaccacgacaccacaagctatgaagaatgccyttgttaagccgcctttgaattgcatagagatgaaaataccaatattaataaagaagttacagaaaataccttttgtaaaaatattcaaccatgttgaatcaacagtctttttctgaactaaagctgttaaagcttgtgtcatttcaggtgtcatgacatgcgcaaatttcattaagaaaaataacacaaacccacctaaaatatttcctaagaaacaatataataaaatccaagtcatcttcttaacagaaacgactttataataccagcctactgtaaagtacatgaagttacttgttaataattcagagttagttaatacaactaaaatcaaacctaaactaaacgcaatggctcccattaaattgataagtccatctacgtgagtactcgca

SEQ ID NO: 774 - DNA, 400 bp; double-stranded, linear
aggtgagcattattaaatattgccaagaaatcaaaactaaaaactatgcaaaagatgtagatatattatttattcttggcggtgatggcacggttaacgaacttataaacggtgttatgacacatgaccttcaactccctattggcattttaccaggcggtacttttaatgattttacaaaaacgctaaatatagcacctgaatcataaacaagctagtgaacaaatggatttctgcacaagttggtacatacgatgtaattgaaaatgaaatgaatcaatatgcactcaactttgtgggcttaggtctcatgttcaaaacgcggaaaacgtacaagaggttcaaaagatgtattgggtaaatggagttatattgggtccaccgtccaaaacncggcnaa

SEQ ID NO: 775 - DNA, 484 bp; double-stranded, linear
aattattcctcaataggagcattacccgctctctcaccaattcccaaaaatgtagtttctatttgctttgcaccatttaaaattgcagctaatgtatttgcagtagccaaccctagatcgttatgacaatgagcagaaaaaattatgttagaatatttttttacaaagtaattaaaaatatctccgtattctaatggtgtcgaacatcctacagtgtccgcaaatgtaactgttctaacttgatattttgaaataatttccatgtattctttcaatttttctctagaagtccttgttccatcttcaaaacaaatatctactccttttttatctttctttaatatatccaagcagtctttgattttctgaatataatatttatttgaaaaattaagcttttcttttatatgcaagtcagatattggcaatagtatttttaccactaaattatgaattttcaatttgactatttttggtatgtcnt

SEQ ID NO: 776 - DNA, 788 bp; double-stranded, linear
cgcaagatgaagttaaagaacttaatcgcttattaggtaaagtcattcatgcatttgatgaaacaaaggaaaaataattaacttttgtcatgacaattaaagtaatgtttagaatttattaagaatagaaaaacaattagcacgcgtaacttgttagtnaaaaaactgcttgaaaggtttcttagcctatcaagcagtttttttatgcattatattgaatcatattccataaagcaccttgattagctagtaattgttgatagtttcccttttcaactattttaccatttatcatcacaatgatggtctcaaaacgtgacaataaagttaaatcgtgtgtagcaacaattaatgtttctgcatgtgcttcaattaaatccataacttttaaactattttgtttatctaatgcagttgttggttcatctaaaatccatgttgatgcagtatcttttaataacatcctcgtaatcgctaaacgctgaatttctccgccagataatgtatgaccatctaagtcaatttgacgttctagtgccaaatgttctaaatctaattgcttaaatattgcttgcaccgcttcatctttttcatcggtaaataaattttgacgtattgtaccatcaaataattgttgagattgtagcaagacatttaacgattcaaacttatctttgtcatctatttcaaacatatccatattttcgaaacgaacagagccactatctaattgatataaccctgccataatttgtagtaatgtactttttcctgaaccagaaggaccc

SEQ ID NO: 777 - DNA, 1145 bp; double-stranded, linear
ttacaaaagaaatgcaacaaaatttttgaatcattacatttttttataaaaatttcactttagattcacaataattacttattttgtcaatttatttaatgtcaatatgttgattaattaatagtgttgtctaatgtatataatatttaggtcatcgttatagtcaacaataataaggtatttcgagttgaaatttatcttattatttttccacttttacgtgctatcccattacacaaaaacaaataagtaaagatattaagtacaaaaaagtggaacaccttgtagatgctccacctcaattatattaagttatattattttgctgcttggtataattcatcaacttttttccagttaacaatgttccaaaatgcagtcatatagtctggacgtttattttgatatttcagatagtaggcatgctcccaaacatcaaatagtaagattggtgttttgccttctgttaatggattatcttggtttggcgttgtcacaatttctaatttgccatcattaacaactaaccaagtccaacctgatccaaataatgttgttgctttatttgcaaattcatttttaaattcatctaaagtgccccactgcgctttgatgtcatctattacgccacctttttcttcagaattaggtgatagtatttcccagaataatgaatggttaaaatgaccaccgccattattacggactgacatcctcatcgcttccggtaccttgtctaagtnagcaatcatatccgctagtgattgatgctctaactctgttccttcaactgttgcgtttaatttcgtcacgtacgtattgtgatgtttgtcgtgatgaaactccattgttctttgatctatatatggttccaatgcatcatatgcatatggtaaatttggtaatttaaatgccataagtatattcctccttttatgaatatacttttataataattaattttgggtgtgttttgcaataattattatttatttgttatatccaattatataaaatttaaatattcgaaattgatataatatttaatattgaatgcaaaaaggcatttaactgcttttgtttcccgcttttaaagagaattaaaaaagacaacttccatttttcaataagaaattgccttttct

SEQ ID NO: 778 - DNA, 902 bp; double-stranded, linear
aaaagaggnccaatattatcaatatacggccggaagattccctttttcttctccacttactaagcccatcaatggtgtatgttatcaattggtgctatccgcattaaataattatcttcaattgtggtatcaaagctattcgctttttctccaataatgtctttaccatatttattgaatgcacctactaaaatcaacataaatggaattaacaaggttactacaattgccattcttataaattgtggtatataagaaggtcgccaatttaaagctttaataccttcttwtctaaatggagtttctataaagcgatatgatagctctgcaaatataattgttaaacttatatctataaagtacacatatacaggtatctgtccgtctacatagtaactatgtacgaaactaattactgcaaaatgccataaatataaactataagaccttttcccgataaatactaacactggatttgaaaatatcttcgctatccatgtagatggatgaacgacactagcaataataaataacgttaatatggatattaaatagaaaccaccatcatatatccaattcgtctcatcattaataatgaaaaataataatataagtactataaatgataaactacctatgctatcaataacatattttacaactttaggtggatcatttttcaatttaaacggtggccataaaaaagctaaaataacacccagtaacaatgtctgtaatctagtatctgtaccaaaatacactcgtgaatgatccccattaatactatagataaacatcattaaccctaaagaaattattgatactccccaaaaaataaatcctattttgtatcgctttttaattgttaacaataatgtaaccaaaataactgggaaaaatat

SEQ ID NO: 779 - DNA, 400 bp; double-stranded, linear
ggaattagtttcctaatgatcaaaccataaccattagcttttaatgatgttacgcctttaaagattagaggatgatgactaataatagtattataacctttttcgattgcttcatttactacttccaacgtacagtctaatgctgttaaaacaccagtaacttcaacatcttcatcacctattaacaatcctacattatcccaagattcagcagtactaaatggcacatgatgatctaacaatgtcattaaatcagctattttcatactataacaccctttcaattacagcaatttcgtcattaatttgagctaaacgttgakgakgttgttcagtawtgagtttcgatttaatatgataaagtgcytctaactctctttgccatttttttataaaatat

SEQ ID NO: 780 - DNA, 557 bp; double-stranded, linear
gttcctgttttaacatcaatatctatctttttaatatcttgaacataaagcagattcagttggctaatatttgaatttatgttaatcacttttttcgttccatttttaaaatgtactgtgtaagtngctttttttgcatattttaattcacgttccccgatacctctatcatgcttcaatactgatttaacttttttagagatatctttgtagcctacacgtgggtcacctgtaaattttaaatctgataaaattggtgttgatgtgccatttactgcaattgtgtatggtacatatctgtctgctttcgctttagttcctgttttaacagtaatttcaattctcttaacatctttcgcatgaactaagtttgctgtgtaattttttgaattcaactgtaagattcttttaccaccatttttaaaataaacagtataataagctttcttagcatattttaaatcttgttcactaatacctctatcatgcttcagtactgattttatttgactagttaaatttttgtaatttgtccaaggtttatntgaaaatgaaag

SEQ ID NO: 781 - DNA, 475 bp; double-stranded, linear
ttctgataacacaactttcttggaccaagtgacaatggtaaagttgatattctcaaaaaatatattttattgaaaaggtaactatatcgaccgctctgtgcgacttgctgtgtagaaacatcaagcccagcttgaaacttcatataaactaataacttttgataaatgctattcccaatttgttcatactgctccaagttatcattaattctaaatttaatacttacttcatttttaactggaataaaatgtacatcactcgctttcatttctatcgctttattaattatttcttgaaatagaatcttcaaaaaaacacctcctacatataatcacgtaggaggtgtttttattacttcaatttaaccgtgtaaaaatggatttaattgttcatcatcaaccgtcgtatatggaccatgtccagggaataaaggtaaatcgccttctaattcaaatattttatcttgaatagaat

SEQ ID NO: 782 - DNA, 400 bp; double-stranded, linear
atgaatatcggtgcaggacgtatcgtttatcaaagtttaactcgaatcaataaatcaattgaagacggtgatttctttgaaaatgatgttttaaataatgcaattgcacacgtgaattcacatgattcagcgttacacatctttggtttattgtctgacggtggtgtacacagtcattacaaacatttatttgctttgttagaacttgctaaaaaacaaggngttgaaaaagtttacgtacacgcatttttagatggccgtgacgtagatcaaaaatccgctttgaaatacatcgaagagactgaagctaaatccatgaatnagggcatnggccatttgcaccggggcctggccgtaataagccaanggaccgggccaaccgttgggaccgggaagaaaa

SEQ ID NO: 783 - DNA, 810 bp; double-stranded, linear
gattaatgtactcgtgtacataacgtttgaagtatgataaatagatatagaaataaagtcatatgtgacatcaattaaatgatgttcaaatgacaagatacaatagaggaatgtttgtaatanaaacgcttcatataaaggtcgagtcaatatatgatacgactttatatgaagcgttttatttgctatgagctagtatattttataataatttttctatttctctttcgatttgaacaggttttttttgaggtgcaaatcgtttaacaacgttaccytcgcgatccactaaaaacttagtgaaattccatttgattttctcattaaagaatccgtgttgtgccgcagtcaaatatctaaataaaggtaattgatgttccccttttacgtctattttttgatgcatagggaaggtaacaccatagtttaatttacagttttgagctgcttcttcgcctgaaccaggttcttggccaccaaattgattacaagggaaacctagaattacaaacccttgatctttgtatttctcgtataatgattgcaaaccttcaaattgtgaagtaaagccacattcgctagctgtattaacaattagcataacgtcacccttatatgcatctaatttgtaagtaacacctttatttgtttctactacaaaatcataaattgtctccattgtatcatcctttcgatttacttaaaatgtaccacaaaatcgtgtaatagtctktactaraactctatgatagaatactttgagtaggattttattaaggagatgtataacatggntcagcaacaaattca

SEQ ID NO: 784 - DNA, 788 bp; double-stranded, linear
aaattcattgcagaaaacatagataaataaacaaattgactttaaacgagcgttgcaacatatctcgaattgtaaaggagcttgaaaatgaataaaaatatagtcattaaaagcatggcagcattagccattctaacctcagtaactggaataaatgctgcagtcgttgaagagacacaacaaatagcaaatgcagagaagaatgttacgcaagttaaagatacaaatatttttccatataatggcgtcgtttcatttaaagatgcgacaggttttgtaattggaaaaaatacaattatcaccaataaacatgtatcaaaagattataaagttggcgatagaattactgcccatccaaacggtgacaaaggaaatggtggtatatataaaattaaaagcatttctgattatccgggtgatgaagacatctctgtcatgaatattgaagaacaagcagtcgaacgtggaccaaaaggctttaattttaatgaaaatgtccaagcattcaattttgcgaaagatgctaaagttgatgacaaaattaaagttattggttacccattacctgctcaaaatagttttaaacagtttgaatctacaggaactataaaaagaatsaaagacaatattttaaattttggatgccatacattggaacccggggaattcagggatcaccagttctaaattctaacaatgaggtcataggtgtggtggtatgggcgggtattgggaaaaattgggttctggaataataatgggtggccgtatactttacgcctccanat

SEQ ID NO: 785 - DNA, 1023 bp; double-stranded, linear
caatattttagaaacaataattaacttgcgatgaacaaactattaacaataatcttgagtattatatttatcttaattaataatatatttatttaagattatgttacttccaactttcaaagtagaaaaacggtataatttgttgatgggtgtttattgataaactgcaaaaaatacagcctacaaccacatagattgtagactatatttaaaataataggtatttatcatatctcgtaaacttagtgccaatttttatactcgtggtgctggtaagctacccttaaattcaggaacgtagtgtgtagggctataacttggaacagcatattgataatttacatttttgatatttaatgatggtttcccaattttataaccatttgattgtgaaaatgagaaatakttcttcacacctttaactactttataagaatagaagtatttatagtcatatgctttatttactttagcattttgatgtgttgctgttgtgttattttggaaacttggtacatgcatacgatgtgaattgtgaccatatggtggaattaccttgaaactatttatttgtggcacaacacaaaagtgattaattttaatgctagcatgccctggtgtaacaaatttatgcgcgtgatatccaggaactgcaaaatgatgcttgataattaaagattgagatggatgtgtatatctaggcgattctgatggtttaacaataaagtgtttattaatagaatcctttgcatgatttacatgtttatgtacatgtgttgatttgtatgaagtaataactttcttgtagtgggtttgcgtagtaatgaagtggtggtttactttgttttgcgtaataaatctatttacttctgggcctttagcaacaaaatgcttatcaacttgttgtgaagctggattgtttgttgctacattcacgcgattattgatttctttgtactctggcacaatgtttcctaactttgattctggnacgacaaagtttttatctacaattttactagc

SEQ ID NO: 786 - DNA, 487 bp; double-stranded, linear
tcaagtttattcgcttgttggaaagctttaacttgattttctaaagctttatcaaattgcgttgattcattatcaactttataacctaaagctgataaaccaattttaatagttttaatatttttatcatcgtctccaactttaaatgttttcgtattaggaatgacatttaaagattgatatttaggtgtgtcaatagtaacgtctggtttaatgcctttaccgtgaatataatgaccatctggcgttaaccatttcatttcagtatattttaacaatgaaccatccttaaactctcttgtagtttgtacgacacctttgccgaatgtttttgacccataaactttagctttattatagtcttttagcgcaccagtaaacacttcagaagcgctagctgaaccttcattcactaagatggatatatccatgtctttcgcttcttttaacgcatcattagaagttgaattgctcagtactttacctt

SEQ ID NO: 787 - DNA, 803 bp; double-stranded, linear
gnaaacnatatttanaattaagtgttcgatttgcagtaaattcatacagaaaagctaaaattaaaatgatacagtggaataatgtcacattctccataaataattgaccgaagaagcataaaacatagaatagtacagtaacacttaccggctgcttttctttatatataattgcattaatacaataataaataataaagagtgaaattagtgttgatgtcgcataattataaaatcctgcaaaccagccatatgtatctgcataaatagcacttggtaaaattaacattaaagaaaatgctaacaaataatagcttgtccacgctttacaacgtgtaatgtgcataatcatccaaatgatgcccatactaatgaggccatatgaaagccaacgtaaccagcttacatgtacagctataatttcaaagatatttccgatatagcgaccattaagtgatgcaaatcctacttttaaaatatcagtattataattgctaaaccattgtaaatcatcgtgcatgagtggtagtaagatacccataaaagtataaaacaataatatcgcaattaatatcaaagttgtcttgtgtaattgaattgttttcactttgctaatcctcaaatctagttaaattttcctcaacttgtaggtcgaaaaattaattcaatatttttaatgtatttctaattttcacctatgcatgtttcctcaatcaaattagataaacaaggtatttaatattactttcaacaatttatctaaatcgcccctcgtctttttctatgacgaatgattacacttg

SEQ ID NO: 788 - DNA, 400 bp; double-stranded, linear
gaaaagttgtattatgaataaagttaatcaaggtgctcaggaagaggcaatggaagagttattagtgacttttcaaaaattgattaaagactaaaggagtttaagatgatacatcaaaatacgatttacacagcgggaattgaaacagaagaacaagtaagtcaattgacagaacgcatttcaaatatgataggtgttcatcaagtgaatattaatataatagatggtcaagtaactgtatcgtatgagacaccagcaaatttgaatagtattgaaaaagaaatctatgatgaaggatacaaaattgtattttagggtataatgtagagtgcgctatagattttaattttgaaaataaattaaaaattttgtaaatgatgtagtaaaggtatgtcgaata

SEQ ID NO: 789 - DNA, 762 bp; double-stranded, linear
gtttaaagatggagagattattgatttttcagctggaaaaggtgaagcggtattgaaagatttaatcaatactgatgaaggttcaagaagattaggtgaagtagcattagtacctgatgattcaccgatatcaaatcgtaataccattttttacaatactttatttgatgaaaatgcagcatgtcatttagcgattggatctgcttacgcctttaatattcaaggtggaacggaaatgactgttgaggaaaagattgcaagcggattaaatgattcaaatgtacatgtcgatttcatgattggtagtagtgatttgactatttatggcatattcgaagatggttcaaaagaactagtatttgaaaatggaaattgggcatcaacattttaataaatgttattttgaggtgctgagtaggaaatgaaacatgtatttaaaggtcaaatacgtgattaaagtatagattgggagataaaataatgacaaatcaggacagaccaatgaaatctatgtcagaatcaaaatgttataaaaatagacaagttttccctcaagatacgaatcaccatcatacaatgtttggtggtacattgatggctaatattgatgaaattgcagcaatcacagctatgaaacatgctggtgcgcaagtagttaccgcatctacagactcagtagatttcttaaagccgattaaaacaggggacatattacaatacgtagcgatggtttcatacgctgggactagttcaatggaagtg

SEQ ID NO: 790 - DNA, 400 bp; double-stranded, linear
tttaattttatcttttggatatcacatagatgctacttttctatactgttctaaatctattatttcgtcacattgatttgcaatagccatatcatgtgttgctaaaatcagcactttattttcatcgaccaaaccaaataatgattgaataatcatctgtcctgttttaggatctaacgcacccgttggttcatcagctaacataacaatcggatcttttaacatcattctaattaaagcgacacgttgttgttcacctccacttagcgtatgaacttttctttttaaactgtttgacagaccaaactgttctatataacgtatctttatttgtnctttttctttcttacttatttttttatatgctaatccaatatctaaattttcatttactgncaaa

SEQ ID NO: 791 - DNA, 400 bp; double-stranded, linear
ttataccttgggagatgattccaagatgtccaaaatgtgatgccccaatggaagtgantaaacgtaaagcggaagttgggatggttgaagatgctgaatttcatgcgcaactacatcgttataatgcttttctagagcaacatcaagatgataaagtgttgtatttngaaattggaattggttatactacaccacaatttgtgaagcatccttttcagcgttgacacgtaaaaatgaaaatgccctttatatgacgatgaataaaaaggcttcgcattccgaattcaattcaggacgtaccatactttaactgagattctcaacttgttcagcagactccggacgcagcacacgaaatacacatgggggcagagtnacttatggaccgttgaatgngata

SEQ ID NO: 792 - DNA, 678 bp; double-stranded, linear
gttccgtttgatacagagaagcgaatgtaagcataatctttaacagtatcgtatgatataatttaattggcaactttttgtcaccttcataaacttcaaattttctccaaaattgacctgattgtaatcctaattcaatttctggttttgaatcagtgaaaataactctagcaggtttaacagaacttgcataatgataaaactgttgagttccatctttctttttcatttcaaaatcaattggacgagagtttggtgcgctatgatctttgtcttttattgcagggtttttaatcgcttctctaagttcctgattcaaaataggatatgtattgttagtggcytttgctgctggtttaacttcttttgtttccttaggggctttaacttctttaacttctttagcttcttttgtttcagaagtaggggcctcaacttctttattagatactgagacagcattagctactggtttagtttctggagctttttcagatgttgttgttggacttgcaactgcttcagtttttggttgtgcttctgtatttgtaccacctgtttcttcagctgctgcttgtgttcgccatttgacattaataataaaagtgtactaattgctacagatgcaacgcctagtgatgactttctaattgaataaaatgatttaaattctttttg

SEQ ID NO: 793 - DNA, 351 bp; double-stranded, linear
actggcggatccacgatggcatgtgttagtgaagcaattcatttattaccatataatgtattcttcgtaccagccagaggtggactaggcgaaantgttgtctttcaggcaaacacaattgcagccagtatggcacaacaagctggcggttattatacgacgatgtatgtacctggataatgtcagtgaaacaacatataatacattgttgttangagccatcagtcattaaacactttaggacaaaattaaaccaagcaaacgttaatattacacgggcctttggtgatgcgctggaagatnggcgcctcggacgtccaatcacctggaaaaggtccttggaaccacttc

SEQ ID NO: 794 - DNA, 400 bp; double-stranded, linear
gggcgaggcgttcgcgcaccggccgagcagcaaataggccgggatgtcgcgtcttgctgcaggtccgaaaaatatcaacttgaagaggtaacaccgntagatatgtttccacaaacaacacatgttgagacagtggcattattcaatttgaaatagcgcacatgatttgagataaaatttcgccttaataagtgaagaaagaagtcgtatattaaaattttattacagccaatttactttcttgatatgaactttttaaattaaatgtgacattgtatactatatttaaagaagaataagaatgtcatgatcgggagggttggtaatgcataaaattgatttaacgacaaataattttcaaatgcgaggtttattatcctggcaacctggttattgcgtt

SEQ ID NO: 795 - DNA, 407 bp; double-stranded, linear
atgttccaggaacgtatttttacaaccgacaattagcatatgtcataatgagttttataattgtattttttattgcatttttaatgaatgttaaattactgagtaatattaaagtgcaaaaaggtatgattataactatcgtctcactattattactgacgttagtaataggtaaagatattaatggttctaaaagttggataaacttaggatttatgaacttacaggcatctgagttattaaaaattgcaatcatattatatatcccatttatgatcagtaaaaaaatgcctagagtattaagtaaaccaaaattaattttaagtcctattgtattagcattaggttgtacgtttttagttttcctacaaaaagacgtgggcaacattactaatattaatnatntt

SEQ ID NO: 796 - DNA, 1053 bp; double-stranded, linear
cagtaggtacacttgcagcatttgttggatacttagagttattgttcgggcctttacgtcgtttagtcgcatcatttacaactttaacgcaaagttttgcttcaatggaccgtgtattccaattaattgatgaagattatgacatcaaaaatggtgttggtgctcaacctattgaaattaaacaaggtcgtattgatattgatcatgttagttttcaatataacgataacgaagctccaattttaaaagatattaatttgagtattgaaaaaggagaaacagttgctttcgtaggtatgagtggtggtggtaaatcaacattaattaacttaataccgagattttacgatgtaacttctgggcaaattttaatagatggtcacaacmttaaagattttttaacgggaagtttaagaaatcaaataggattggtgcaacaggataatattttattctctgatacagttaaggaaaatattttacttggtcgtccaacagcaacagatgaagaagtagttgaagcggcgaaaatggctaatgcacatgactttattatgaacttgccacagggatatgacactgaagtaggtgaacgaggtgttaaattatcaggtggtcaaaaacaaagattatcgattgctagaatatttttaaataatccgccaattcttatcttggatgaagcaacaagtgcacttgatttagaaagtgaatccattattcaagaagcattagatgtgttgagtaaagatcgaacgacacttatcgtagcgcatcgcttgtccactattacacatgctgacaaaattgtcgtaattgaaaatggacatattgttgaaacaggtacgcatcgtgaattgattgcaaaacaaggtgcttacgagcatttatatagcattcaaaacttataaagtattagttgtttgacttcagtacaatcttgaagagaaaatttgtaacaggatggtggggtcataacatagaaaaagcagtaagagattttcttagttgaaaataatcttnctgcttttttaaatttaatttcgngattca

SEQ ID NO: 797 - DNA, 544 bp; double-stranded, linear
aagagtgactcctgaagtgaaagaaggggaccgtgtcgtgttccaacaatatgctggtacagaagttaaacgagataatgaaacatatctggtattaaatgaagaagatattttagcagttattgaataatacagaacttaattcataaataaattaaatagaacgaaaatgaaacacaactaaacaaatggaggtttatcatttatggttaaacaattgaaattctctgaagatgcacgtcaagcaatgttacgtggtgttgaccaacttgcaaatgcagttaaagtaacgattggtcctaaaggacgtaatgttgtattagataaagagtttacagcacctttaattacgaatgatggtgtgacgattgcyaaagaaatcgaattagaagatccatatgaaaatatgggggctaaactagttcaagaagtcgcaaataagacaaatgaaattgctggtgacggtacgacaactgcaacagtattagctcaagcaatgattcaagaaggcttgaaaaatgttacaagtggtgcgaacccagtt

SEQ ID NO: 798 - DNA, 372 bp; double-stranded, linear
caattgcatagatattgctgatagacgtacggctttgtttatcaacttctaataatccacggtcagcgaatttaacacctaatttcgtctgtgtttggacgacgacctacagttactaatacataatcagcttcgattgttttctcttcgcctttagcttcataagtaactttaactccgttatctgtttcttcagctgatttagccatagcttcagtaacgatttcaacacctttttctttcataccttttttaacaggttgtgtgcatttgntttttcgaggccacctaagatatctttagcaccttcaagggatggggtactttctgnaaccaaagttagcaaatgctgtacctaatnctggtccaatg

SEQ ID NO: 799 - DNA, 1182 bp; double-stranded, linear
aaacgacatttgtttaattggaagaattagcaccattttttgaggcgggtatagattcatttaaaatcgatggtattctacaaacggaagaatatattaatgtggtaacggaacagtatcgtcaagcgatagatttgtacaatgaagatcctgaaatctatgaagatgagaaatttatgttgatggatccaattgaagaaattcaacctgatcatcgaccatttgacgaaggtttcttatataaacaaacagtatattaaggaggttaatcatgaagacaatagaagagattaaatcaactcctaaaacagttatgaagaaaccagaattattagcacctgctggaaacttagaaaagttaaaaatagcagtacattatggcgctgatgccgtatttttaggtggtcaagaatatggattacgttcaaatgctgataatttcacgatggaagaaatagctgaaggtgttgaatttgcgaaccgttacggtgccaaaatttatgttacgacaaatattattgcacatgatgagaatattgaaggtctagaatcatatttgcgtaatttggaaaagactggtgcgacaggtatcattgttgcagatcctttaattatcgaaacatgtaaagaagttgcgccaaaacttgaaattcatttatctactcaacaatcactttctaattacaaagctgtagaatattggaaagaagaaggattggatcgtgttgtattagcacgtgagaccggcgcgatggaaatgcgtgaaatgaaggaaaaagtagatattgaaatcgaagcatttattcatggtgctatgtgtatcgcctattcaggtagatgtacattaagtaatcatatgactgcaagggattccaacagaggcggttgctgtcaaagttgccgttgggattatgaattattagaagttgatgataatggtgaacttgatgttttttataatcaaggtgaagttacaccgtttgcgatgagtcctaaagatttaaaattaatcgaatcaattcctcaaatgatggatattggtgtggactcattaaaaattgaaggacgtatgaagtcaattcattatattgcaacagttgtctcagtatatcgtaaagtcattgatgcgtatgcggcagatcctgacactttaagattaatccggaatggttaatagagtta

SEQ ID NO: 800 - DNA, 989 bp; double-stranded, linear
gtattcttccaataacacctttcatttggaaaccgtttagaaagaatacagttacttcagtttggtttgctttaaaattctctagtgctttgtcttggatgttttcgttgcaatcatctgtcggactccttttacttaatctgggttgtaatctcatctaacatcatttgaagtgacatattttctttatctaaccaatgaacactcattttattcttgaaccatgtcatttgtcgttttgcatattggcgtgaatgttgctttaaatcattgacagcatcttcataaatcatttgtccgttaatcacaggtattaattctttatatccaatagcttgcatactttggcaagattcatagccttgttcaacaagttgttgcacttctctaaataatccgtgatccaacataatatcaacacgtttatttattcttgaatataatgttttacgcgacatttcaatccctaataataatgtatcataattttcagtaaattgttgcactttcttgcgattactcaaaagtttttttgtttttaaataatattcaatagcgcgcaacactctttggcggttgttagggtgaatattttctgacagaaaccgacatcaaattgagctaaataatcgtgtagttgctgattatctaaatgttctaatgcagataacttttgtttaactatggataattgtgcaggtgtactgtttcatcttctaattcataattatatattaatgattgaatatataagcctgttccacctgctatgattggaactttacctctattcgttatatcagtaattaaatcttctgctaatcgcttgaattcatatgctgaaaatgtatcatcaggattcaagatatcaattaaatgatgtggaataccatccatttcttcaggtgtnacttttgcagttccaatattcatatgtctgtagacttgcatagagtcaccgcttatgatttcaccattgatacgcttcg

SEQ ID NO: 801 - DNA, 543 bp; double-stranded, linear
cgttagatatagaattaaaagataatattaaatttcaaaacggtcaaaaattgactgcagaaaaagtgaaatctagccttgaaaatagcatgaaaaaaagcgacttggtcaaatattcattaccaatatcatcaattaccgctaaaggtcaaaaactgacaattaaaaccaactccgcttaccctgaacttgtatctgaattagctaatccttttatggcaatttatgatacagatgctaaatcagatgttaatcaaactcctgttggtacaggcccttaccaaataaaagattataagcaatctcgaaaaatatcattgtcgaattttaaggactattggcaaggtaaaccgaaacttgatcatattactgtgacgtaccaagaagacggcaataatcgcgtcagaaatttagaatctcaaaaagatgatttaataactgatgtcccagttaataaagttcaagacatagaaaataatcaaaatttaaaagtgtcaaaagaatctggatttagaacttctttacttatgtataatcatacta

SEQ ID NO: 802 - DNA, 1139 bp; double-stranded, linear
gcgaattcgtacacacatatacacaaagataatcatagttttacattgaagcacatgaaagataattcatttaaaggaaggtattatcaatgactaaaaaaatgggattattagttatggcttatggcacaccttataaagaaagtgacatagagccatattatacagatattagacatggtaaacgtccatctgaagaagaacttcaagatttgaaagatagatatgaatttataggtggtttatcaccattagcaggtacaacagatgaccaggctgatgcgctagtttcagcattaaataaagcatatgcagatgttgaatttaaactatacttaggattaaaacacatttcaccatttatcgaagatgcggttgaacaaatgcacaatgatggcattactgaagcaatcacggtagtactagcaccacattattcttcattttcagtaggatcatatgacaaacgtgctgatgaagaagctgcaaaatatggtattcaacttacacatgtgaaacattattatgaacaacctaaatttattgaatattggacgaataaagtcaacgaaacattagctcaaataccggaagaggaacataaagacacggtattagttgtttcggcacatagtttgccaaaaggtttaatcgaaaagaataatgatccatatccacaagaactagaacatactgcgcttttaattaaagaacaatctaatattgaacatatcgcgattggttggcaatctgaaggtaatacaggtacaccttggttagggccagatgtacaagatttaacacgtgatttatatgaaaaacatcagtataaaaactttatatatacgccagtaggttttgtatgtgagcatttagaggtgctttatgacaatgattatgaatgtaaagtagtttgcgatgatattggtgcgaattattatcgtccaaaaatgccgaatacacatccattatttatcggtgcaattattgatgaaatcaagtctatattttaatgacgaaagaagcgtgaaacgttgtgactaaatcagtggctattataggagcggggataacaggtttatcaagtgcatattttttaaaacagcaagatcctaatattgatgtaaccatctttgaag

SEQ ID NO: 803 - DNA, 989 bp; double-stranded, linear
tatccnaaatanaaatgtgcgcatttatcaaaaccttacatacaatagagttttccctaacagtaaattagatattattacacctgttgatatgtcttctaatgccaaactgccagttattttttggatgcacggtggtggttatattgcgggtgataagcagtataaaaacccattattagcgaaaattgctgaacaagggtacattgttgtgaatgtaaattatgcattggcgccacaatataaatatcccacaccattaattcaaatgaatcaagcaactcaattcattaaagaaaataaaatgaatttacctattgattttaatcaagtaattattggcggtgaytctgcaggtgctcaattagctagccaatttacggcaatacagacgaatgatcgcttaagagaagccatgaaatttgatcagtcattcaaaccatcgcaaattaaaggtgctatactatttggtggtttttataatatgcaaacagttagagaaactgagtttccaagaatacagttatttatgaaaagttatactggcgaagaagattgggaaaagagttttaaaaacatttcacaaatgtcgacagtaaaacaatcgacaaaaaattatccaccaacatttttatctgttggagatagcgatccattcgaaagtcaaaatatagaattcagtaagaaattacaagaattgaatgtaccagtagatactttgttttatgatggtacgcatcatttacatcatcagtatcaatttcaccttaataaacctgaatcgatagataatatcaaaaaagtgttacttttcttaagtcgtaatacatcctctagtggtattcaaactgaagagaaaccacaaatagaaaatccgagtaatgaattaccgttaaatcctttaaactaatgataaacagtagtaatttattacttaagcaacatttaagattttcaaattaaaaacgagaatttaaaacatgtggtgc

SEQ ID NO: 804 - DNA, 711 bp; double-stranded, linear
taanccctggtttaatgattttgattacgtgtttttataataaaaacatatcgaacattgactacgttattaagctgcttttttgtacactttataaccaatagcttaagatttaaaactaatcggaaagaacaatgattcaccanaaaaatatttatgttgctattaaaaatcagttaatacgaatgttaaaatacgtttgattttcattaataatgattcaagtttatttaaatgagcgttaatgtcagtctgttttgatgcaccttataataaagacagatagttcaaattacgtaataataacaatccaatacattaagattggagcaaaaaaatatgaaattaacaacgatagctaaagcaacattagcattaggaatattaactacaggtgtgtttacagcagaaagtcaaactggtcacgcgaaagtagaacttgatgagacacaacgcaaatattatatcaatatgctacatcaatactattctgaagaaagttttgaaccaacaaacattagtgttaaaagtgaagattactatggctctaacgttttaaactttaaacaacgaaataaagcttttaaagtatttttacttggtgacgataaaaataaatataaagaaaaaacacatggccttgatgtctttgcagtacctgaattaatagatataaaaggtggcatatatagcgttggcggtataacaaag

SEQ ID NO: 805 - DNA, 680 bp; double-stranded, linear
atcaggaaaaacagaataatgtaaatcaagctgttcagcctcaaaataatactaatgaaacatcaaaagtaccggctaattttgtcaaattgaatgatattaaaccaggtgatacttctatacaaggaacaactttaccaaatcaatttatactattaactattgataaaaaagatgtgagctcagttgaagattctgacagcagctttgttatgtctgataaagatgggaattttaagtatgacttaaatggtcgcaaaattgttcataatcaagaaattgaagtgtcttcatcagatccctatttaggtgacgatgaagaagatgaagaagtagaagaaacttcaactgaagaagttggtgctgaggaagaaagtacagaagctaaagctacatatacaacaccgcgatatgaaaaagcgtatgaaataccgaaagaacagctaaaagaaaaagatggacatcaccaagtttttatcgaacctattactgaaggttcaggtattattaaaggccatacctctgtaaaaggtaaagttgctctatctattaataataaattwattaactttgagacaaatgctatggtggtccaaataaagaagaagcgaaatctggatcagaaggaatctggatgcctattgatgaccaaggatactttaattttgacttccaaacga

SEQ ID NO: 806 - DNA, 950 bp; double-stranded, linear
gtatttcattagccattggcaattgacatctgacaatgaggaatggcttttgcattggaattcacagttggagtgcatttactggttattttggaggtcattgttgatacattattaatggagaataaccgaatttgttatgttatttccatttttaatatttgcaattgtattaaatgctgcacttggagataaaattaaaaatccttatggatctgccataattcttgttctagttattatcgtattaagttggggaggtattgacaagacttgttcgtggtaaagtacttcaagaaaaagaaaatgaatactttttggcagcaaaatcaattggtacacccacatataaaattattttgaaacatcttttgccgaatatattaagtgtagttatcgtacaagcaacattgttatttgccggtatgattgtagtggaatcaggrttgagctttttaggattcggaattagtaaagcaataccatcttggggtaatatgttgagtgatgctcaagaaggggatgttataagtggtaaaccgtggatatggatgccacctgctataatgattacattaactatattaagtataaactttgtaggggaagggattaaagatgcttttaatcctagaggtagacgttaaataataaaagaggcactagttaattctagtacctctttattttatctcttacgtcctaaacccatcgctttttccatttttttgacagttttaaatgaaactttgtgtgctytatctctaccttgatctaaaatatcaycaagtttatctgagttatagaaactttcgtatttttcttggaattctactaaaaatgctttaactatttcagcaaggtcacctttaaatttaccataaccttcgccctcatattttgcctcaatatctttaattggcatgtctgttaatccagcgtatattgaa

SEQ ID NO: 807 - DNA, 418 bp; double-stranded, linear
gttaccagtcgaagctttacgacctgttacgaaacattgtttacccatatgagtacctcctttaataaatataaatacacataactacttatatacttaattaagatagcatagtttcatttgaaaaacaatgaataattttcacataaaagtcaaaaatactgagttttgtgatataattgtagactgtgaagttatgtagtatgatattttagagaaataagtgaatgaaacatttaaaatttttatttratgatactacatctattaaaagaaaacgcctatagataatcgtcatgagtgtaaattcagtttactcaacatataataggkgatttaagcgtaagtcattctgataagttgtaccattgatattttatgaaatantcnatgaacttaaagcgtttatgctacacta

SEQ ID NO: 808 - DNA, 842 bp; double-stranded, linear
aatggcnattaatctttaatacgatgcttgaggatttttcctaataaaaccttgatttcmaaaagggtttaaatcmaatgaaacaataataaaaaaatgwcgcaatataataataagtacaaatttaattaagaaattaaattgattgtatatgtatattttggtaacgtaaaagaganatatacaaaataattaattatttatatgaaaagagaatataaatgaagtataaaacagagagacgtgaagcgatgggatatttaamaaggtttgcattgtacataagcgttatgaytttaatatttgcgatagcaggttgtggcaaaggtaatgaaacaaaagaagattcaaaggaagaacaaatcaaaaagagctttgcgaaaacattagatatgtatccaattaagaatctcgaggacttatacgacaaagaaggataccgagatggcgaatttaaaaagggtgataaagggatgtggacgatatatacagatttcgccaaaagtaataaacaaggtggattgagtaatgaaggtatggtcttatacttagatagaaatacacggactgcaaagggacattattttgttaagacattctataataagggcaaattcccagatagaaaaaattataaagttgaaatgaaaaataataaaattatcttattagataaagtagaagatacaaatctaaaaaagagaatagaaaactttaaattttttggacaatatgcaaaccttaaagaattgaaaaactacaacaatggtgatgtcycaattaatgagaatgttccaagttatgacgcaaaatttaaaatgagcaataaagatgaaaatgtt

SEQ ID NO: 809 - DNA, 451 bp; double-stranded, linear
taagactatgccatcttggcaacgcgttgtcgcatattcattattagtaagtatatgcaagcatgattttgccataactttacctctttctatatttaagtaccacttttatcattccctataatatttaacttatttaattaaacgtaaatttaacacaatacgaataccaaatcaaaaataaataaaactatataatggttaatttttaaacttatatatcaatcatttaaatattacaaaaatagatgtagtcagtttaattaaactatccaattgaaaacacactactttttagtattttcaaaataattttaaatgaccacatctacaacgtattactattatcttttgttagttatatattcattttcaatttaraaataaacacttatttaaatcacattctacttttgagatgagctcaaactaacattaaattgtttatatt

SEQ ID NO: 810 - DNA, 1499 bp; double-stranded, linear
acattttgtgcttgttgtccaatccaatttctactttgttgaacagtatgagttgcttgaccacgcatgttactcagcatttgtccaacatgagtattttgagcaaagttacgagattgattcaacacactgtttttcatcattnccattttaggtgaaatacgactaactgcttgttgcattgtcttttgcaatcctgttttaactgcaaatttttctccgcctttgaagcctaatttcattaaacttttcccagcacctttgaggaagcccatacctggcaatggaataagcgaaagtccttccatgattcgttcttctttagatagctttcttccagttacaatattttttcctgtggctgcatttgctgctgaataagcggaataagcaccaatagctactgctccagcaacaggattaatacaagataaaactaccataccagctagtgctgcaatctctatagcttcttcttttttcttttgctcctctagctcttccgcttcagctactgtcatgtaatcacaagaagcgccctgagtcatcattttttcaaaatcacttttagataatttcttatcttcttttttcatttctttgtaatgctgatcaattacttttacaaattcttgatccgattttaatatttcatcgatgctataaacatcgctgtcacttttcttggcatctccctttgcaattttcccagaagccccataggtatctctaccatgtccaccaccatttttaattagtatattttccaatttaacattcgttatacctttgaatgctttatctatatcttctataaatggcgtgtcaataatttctttcattttcgaatctaattgagatgcataatcatataactcattttgataataccccattaatttagatccttgtggacctactacactacttgttaatgatattgcgccatcttcgtctaaagaactgacatcgcttaccgcatcatccattgttgtatctacatctaagaagtcttgaccctctattgcatctattacactttggatagatgacttttcattgtcataatcagctgttagatattcaatatcttttgtcatgtcatgcacctatccctcaatattatagtaaagcttggcaaattccgtaccccaatgttcatctgcttcaaagaacttttgtgctgaattcatgacgccaccaccgagtgtactcaatggacctttgagaccactaatgactgttgcagcactactatagccattttccatagaatgtgcagctttttcactactgtagtaatttaattgcgctatttttccaaagttttgagctatttcatcatacttttgacttatgctttccaattcttttacaacatgtgcaatcgtttcagctttaacactaatttttccactcaacgtcattactcctctgctttattaatatgattttcatcagtatcgaatccaaataattctcgtgataaangtattgaa

SEQ ID NO: 811 - DNA, 620 bp; double-stranded, linear
cncgctgcaccgaagaatgcttttggtttgtgtaaagatgcaggatctaaaccacctgataatgtacgaccacttggtggaataacyaagttataagcgcgtgctaatctcgttatagaatccattaaaataatgacatcttccccaatttctactaaacgctttgcacgttcaagtaataattcagctactttaacatggtgttctggtggttcgtcaaacgttgaatgaacgacttcagcagcttctactgagcgttctaaatctgttacctcttcaggacgctcgccaactaacaaaataaatagctttgcatctggtttgttcgtactgattgcattcgctatttcttttaataacgatgttttacctgctttaggtggcgccactattaaaccacgttgacctaaaccaatcggtgttactaaatccatgatgcgcgttgaataattttgtatttctgtctctaatttaatacgctcatctggataaagtggtgtcaaagcttggaaatgcggacgtttcttcacttcttctgcgttatggtcatgacaaagtcaacttgtaataagccataatatttttcgttatctttaggttttctaactttcccagttact

SEQ ID NO: 812 - DNA, 1094 bp; double-stranded, linear
ccggctgaaattaagttcttgttatatttcgcaaaaatgacaaagaaagataaaaataaactatatcattttcttaaggaggattaatatgtattatccttatttgcgtgggaaacaaaatgaactatttgcaattagagaattgttagagaaaggtttgattggtgattgtattcaacctataattgaaccaattaaatatacaaccacatttaaaaatactttgcaatactgtggtgaaaaagcattctctataaatttagtagtaaattcaaagttaactgaagaagagattagtaacgaaactgttgcacatttaactgaaataataacaaaaaacaaaagtgttattcaaaaagcttacttgggtccttctgatgaaggcaatgataggttgaaacagcaattttcaagtaatagtttagctattttaacaagtgtagatgattgggaaatgtttggagataaaaataaacttgaaatggtttttgtaccagatgatagacacattaaacgtaaattgcgtaatattccaaacaaaggcatsattatggatccttttaataaactaagtcgtaatgttgattatttagataatgatgacgagttttatagcgacgatcacctttattataaggaagatggatacgtagcattttcagactattctgttataggtggagaatatgtagacggtggcttttcgccattagctattgcgrtacatattgtctattttgatgaggctaatgagctaagagttaagcattttgtctctgattctaataatgatagatcaaatccaggtaaaangttttttgaggctgtagataaattagtaacatggtcaaaaaacttagatattaaaaatagatcttatgcgcttggacaatttgaagaattaaatgaaaataataagtatccaggattaggtttaattaaangttatctatcagcatcacctagaaattatgaatagatactgggtctcaaagaaataggaaaagtttatatcgaactgaactgcaagaatgcattgacatggatgaacacacgggtaaaatgatcgcagctgaaatgactatggtattagc

SEQ ID NO: 813 - DNA, 930 bp; double-stranded, linear
cacctatcatcgtctctttaattctatctatctatttaccccaatcgtaaatatgatggacgttatagaataccaagagttgcaggtatntctattatttatctagctgtagtaggtgttattacgttaattgttaatttattgatacctattattggttcgcaagtagatagtttagttaaaaattcaccgcaatatctagaaaaattaattaattctattgataaaatagcaaataatacgtttttctcttcgtattatagtcaaattaatgattggttaaattctttacctaagaaaataccatctatgttaagtgaatttacagatggctttgggtctaaaattgcaacgtttgcagaaacgattgctaatattggcgttgtgattgtcacaacaccatttgtactattctttatgcttaaagatggacatcacttcaaagaattttcaacgaatattatgccaccgaaattccgaaaagattttcatgatctacttgaaaaaatgagtgttcaagttggttcatacattcaaggacaaattatcgtttcattctgtatcggtatactgttgtttatcggttattcggttatcgggttgaaatatagcttagtattagctagtattgcggcagttacaagtgttgtaccatatttagggcctactatagcgatttctccagctattgtaatngctgctataacaycgccgtggatgctcttaaaattagcagtagtatggactttagtacaatttgttgaagggcacttcatttcaccaaatatcatgggtaaaacacttaagattcatccacttacaatcattttcattttactgtgtgcaggcaaattgcttggtattgtaggcgttattttaggtattccgggatatgctattttaaaagtatttagttactcatttattcca

SEQ ID NO: 814 - DNA, 461 bp; double-stranded, linear
gtatgattgctgttttaataccagatgatggcagtggcaaatcttatgactatatgcttgtgaacccaaaaattgtaagtcatagcgttcaagaagcttatttaccaactggtgaaggttgccttagtgtcgatgataatgttgctggtctagttcaccgtcataatagaattacaattaaagccaaagacatcgaaggtaatgatatacaattacgactaamaggatatccagcaattgttttccaacatgaaattgaccatttaaatggtgtaatgttctatgatcacattgacaaagatcacccattacaaccacatacagatgcagtagaagttaaaacacattttctaattatcaaagcttaggataatatgatgtcctaagctttcctttacaacttttcggataaccaacagttaatatatcaccttctaaccaaacttttaatccctcattaa

SEQ ID NO: 815 - DNA, 573 bp; double-stranded, linear
aataaattttagaattgtcgcataattcatcatgacaacataatgacatgtattgttattaacgatataatagaattgaataaagtgggtgataatgtgactaaaaatgagattagaaaatacattttacataaaatgaagaattttaataaagctgaaaagcgaaaagcagacacatggttaagaaatcaattttttgcaactgaagaatacaaagaagcaaacgcaattgcgctagttctttcttttaatcatgaagtagatactttttctattattgaacaagccttaatggatcataaacgtatttttgtaccgaaaatggattatttaaatcatcaaatgacttttaaagagatatttaatctcaaagatattgatgtcgataataaggggatttactatccaacttcaaaaggtgaaacaacgaataacctagatttaattgttgttcctggtgttggatttcaagacgatggatatagaattgggtatggtggtggctattacgacaggtttttagctaattatcagacaaagacaataagcttattatacgattttcaaataaca

SEQ ID NO: 816 - DNA, 3989 bp; double-stranded, linear
tagtttaacaatgtctattctcatagaatttgtccaactaaatgtagacgattcactaaacttctaaaaaaataaaccccaaattataatagtctcaatattaatatattacaatttattcataggatttttatcatttcaattaataggttgttatcagggttaaataaacattttttgtaatagtccttttttacgttcttttaataactcaattctattcatttgattattcattttattgtctatagattttaacaatgcacttactttatcytgttcagtgagacaaggtattttaagatttatattgcataagttcgcatgagttaatttagctggtgcattacctgtgacaaatgctcgtagttctttaaaatttaaataataattcataaaaaacaaattatgatcattacttttaactacatgcgcatgattatttacccagtattgcccattagcaataaagctactcgtctcaaactgcccccattttgcaccatcttctcctattagtaatcgttcttcattattgaataaataatcttttacgtaatcaataattccagttgcaccatagtaagggtataaccccttttctcttaatgaagaagtaattggttttcttctattattttcaaagataaagatgtcttttatgaatttgttttcccactctggatattcttcaccattctcatctttgaatcgcaattcttgtgtgaagattttctgcatatagccttttttctgttgttgaagcaattcaagtttttgttcttctaattcaatttgtcggtcgagtttgctgaagaacttgcctattttttgctgttcttcaaatatagttggggtgaagatttttaaattagcaatttctttgaagtttagaccttctcgactacctccactttgtgcaaggaaaattttccttttaccttttcttgataatagatactgtccaaaaaaattataataatactcttttttcaatctaataatacatacatgttgatttaaattagcatgcgtttcaactatcgaattaatggctgttctacctattgatgctcctgtaatatttaaaagaacatcaccatagtacgttctactatttttcatctcatcatctatatctttactaatataaactaagtcattaagatttaatttaccatttctaatattttgactccttaaaaatggtatgcctttgtttgtatagttttcacttccacctttgggagtctttccactacctattttggtagtaagattccctaacttcttctcttcccattcgccttcaaatcctgggaatctcaactctggcacatttttcgtttgtgtattactcatctttcaacaccccaagttctttcaggtatgcattgatttcttgttcaatttctgcgatttctttgtcgatatttttcaaatcttgttggacttgatctaaatcaattggtgcttcttcttcgaatgtatcaacatatcgcggtatgtttaagttgtaatcgttatcggcgatctcttgtaatgtcgcgctgtagctatatttatcaatcgttgctttacgcttatatgtgtctataatacgttcgacttgggcatcgcttaaatggttttgattttttcctttttcaaaatcattggatgcatcgataaatagtacgttgtcgtcttgttggcgacattttttaaatactaaaatacatgttggaatacttgtcccatagaaaatattggctggtaacccaatcacggcttctaagtagttcttttcttctattaaatagcgacgaatcacaccttctgcggcaccacggaataatacaccatgtgggagtacgactgccatggtaccttcatcgtctaggtaatgtaccatgtgttgaataaaggcaaagtctgctttggattttggcgcaagcttgccgtaaccactgaatcgttcatcattttcaaattttgaatctgctgtccatttcgcactgtatggtgggttcgcaataaccgcatcaaatgtattgcctaaaaaggctggattttccaatgtgtcatcattacggatctcgaagttctcataacgcacatcatgtaataacatattcatgcgtgctaagttgtatgtagtattgttacgttcttgtccgaaataacgatacacttgcgtttctttaccaacacgtaacaacaatgaaccggaaccacatgttgggtcgtacacgtgacgtaatttatctttaccgtctgtgacaatcttcgccagtatcttagatacttgttgtggtgtatagaactcgcctgcttttttacccgctgtcgccgcaaagcgcccgattaggaattcatatgcatcacctaacatatcaatttccatgtcactgtgaacgaatggtaagtcgtcaagattaaccatgactttagagattaaagcagtacgttctttgacattgttacctagtcgcgttgaactcaaatccatatcgctgaacagcccgataaagtcattttcactttcttcacctaatgtagatgtttcaactttgcgaatcgccgtcgctagatgttctatatcgaaatcttgcgtttcaatttcacgaatcatcgcactgaataaatcttgtggctcaatgaagtaaccgacttgatcaattaattctgcttttaagtcttcacgatattcttcatctgcccatgcttcttgatacgtgatgtcttcacctgacaaggcatctgcatattcttgttcggctttttcagataagaagcgatagaaaatcaagcctaaaatgtaattacggaattcactcgcatccatgttccctcttaaatcattcgcaatcgaccataattttttatgtaattcagcttgttgctgacgttgtttttcagtaatagacatgtgattcctccgcctttgcataagtaatttatctctttgtgtaatagatttattataacatttggttatgttgcgatgttgataatttggatgttggtggtggaaattttgagttttagtggcgcaattgttattgaaaaattttatagaaatgttgtagctttcaaatgctttcaaaatcatttatattcttaatgatgtcaaaaagttgttcattcatacataaataaaaccaatcaacaattgagttggtgaaaatcaatcgttgattggctttgatgcatattaaataatgcaatatatattaataaatgttagttatagtatattttgtcaggattgggtgaatgtctaagttttaattatttatctaaattatctgcaatgaatttcttaatttcaggagagaaataaacagcaaatcctcttgtgctttcacctgatggcttattaccggcatagattacaccaatagcttcgtgtttactatttaatataggtgaaccagagctaccaggctgaataattgcatccgatgacactatattcccattcactgataatactttaccagttgattcatacatttgtagtttatttccattaggatttggataaccaatgactgatataggttcattttctttagcttctgatgctatattaaatttactagtgaaatctttgaattttctaccttttggttgtgttgatttttcttcaacttgtacaaccgcaatatcttctttaccaggataatctacaatcttagtaactttataaagtccaccaccgttattataaaaaccattaggatgtgctttgatttcatcaccgactttcatgtgataggtaacatgtttattggtaatgattgtatgatttccaactacaaatcctgttccagcgcccatccatgtaacaccactgtatggtgcaacatttgtatttgtaatttgtttaacagtattttcggctttggctgtttgttgaataccttcaaccattgttgtgccgacaccagttattgatgttaaaatcgtcaatgctgcaatacttttgatgattatatttttat

SEQ ID NO: 817 - DNA, 904 bp; double-stranded, linear
cgttgagcacagttttagataatagataatcttgctctagttgttgcaatgtctgcgatttattgtgcattagcagttgatacgccatagataataatagtttttctttatatgattgaatatgcgtgtaacgttcagttatcgtttctaaggtatactgagatgtatttaattgatatcctttagatttaatacttacgatgatatcatccataaaattgctattgataacatggatatcattgcgaactgtgcggtttgaaacattgacatgtttagcaatttcattagaactaatgtgctttgatggatttttaataaaaaactggagtagttttaagtgtctatcaagcatttaacatgtacctcctttctaaatttttcgtgtaagcgtttttaagggtgtattaatattattaaacatgagagcttatacatacgtcaatgacattaaagcgaacttttatatgattttaacagagtgcgaattatgcaaataaagaacagcagtaagatatttcaaatagaaaaatatctcactgctgtttttctgaatttatgcatctggtacttgtggacgtatcaggcaaatgattaatttttaggtgattgtgcttgaggtgtttgtttagaaggcgtattggtattatttgatttattagcaggtggtgtgttctgttgttgattattttggttgtttgttgacgattgactgccaccaccgtgagtattatttttatttgaatttgagtcttttggctgagctggttgcgtattcgatggtactgttgaatggttgttaggaacatttgacggtgaagatggttgattgtcattagtaacgttattgccattattttgatttttatctgttttgtctgcactatcatcttgttgatcattt

SEQ ID NO: 818 - DNA, 1104 bp; double-stranded, linear
tttaacatgataataaaaaatcttttgttatatcattaggaatatttgatgaacttgatattaaggttacattttgagaaatggacttagggatatttccactattatttagtaagaaatctttagctaataaagattttcctacaccatttttaccaacaatgtgattgatctgaccaagatagaaatttaaatcacaattgtcaactagttgtttgtttttaacttttaaagaatagttatttagtttcatgtatacaactcctatgtataaagggatttattacaccgatatttaattgtatttttaaaaattctttcacattatgtatagawgttataaattagtatatcacactatattttgkctaaatgataaatatatcgttatatttttacaatattctgaaatttatgttcgcctctgaatgctatatccagtgtaatgtgttttgcatatatgaaagcaatttcaaaatgtgaatataggttcattgtggtatgacaaacttcattgcttgtcatgagatggatataatgaagacgactaaaagagcaatgaggaggataatcatggttaaggctattgcggtagatatggacgggacgtttttagattcaaaaaagacatatgataaacttagatttgaagcgatttttactgaacttagaaatagagatattacatttattgctgcgagtggcaatcaatatgcgaagttgaagtctattttcggggatagagatatgtattttatttctgaaaatggtgcagttatttataatggcaatgagttatataattataaaagctttaatcgtcaggtgtttcaacaggttgtcgattacttaaatatgaagcaaagtattgatcaactcgtcatctgtggtttgaaaagcgcgtatattttaaaacatacttctgaagcgtttaaagaagatacgagattttattatcatcagttaaaagaaattgacagtctacagcaattacctgaggatgattatgtcaaaatagcatttaatattaatcgtgagacgcatccgaatgttgacgaagaagtagcaacgcaattcagcaatgatattaaacttgtctcaagt

SEQ ID NO: 819 - DNA, 1425 bp; double-stranded, linear
cccnttttacggattaanggctttttcctatttaaaacctacggcattttcttttcaaccacggcggctcccatatggatggtatngggattggggtttataaaatggggattggaaatggtccatcctaaatactcagtttagtgcttatttcctttagtgctgacgaataaatatgatctaactctacgaaacctaataacgtatcaaatgcttcatcaccattttcaaatttacttaaactatttttaaaatcatgtcgcaaatcctctaaatatagtgatggttttcgatctacatacatttttatactaacctccgatatataatcatctttattgtacctaacattttattaagataatactaatacactatcgaactttgggctgatactgaaacagcacaaagaaactcaaacaattcgaattatgtatcaaaaccttcaattacaggaagtgattttaaaatgatttaacgcaaaaaaacacctgttaccgttatataggtacaagtgcttaattgatagagatgttatacgtctttaaatgattccacaacttttggatgtggaccatccataagcggttctctttgtcgaacgccaccactttggttgccaattgattcgctatcaaagtacgatttatcttgatttgattgttcttgaatatgttcttcattatcagttgttgcatattcactatccacctctgttttttccattgttgctgtatggaattgtacgaagttctcttcttctaatgctttgatttcttctttcgataacgctcgataccaatctttcgcttttttcgccgcaataggaacaacatcttttycaagatatccttcttttaacattgcattcgcaatttctatcgctttttgccgtttaattacttcaaattctttccatttttcggggtaacctttcattgtaaagggcattcccttaacctccaatatgttataattcatgttatataccaccataattataaaatgaaacatattaaacacaattttttagactcccgtcataataacttcagacaaacgttagtctgacctgataaatatttaattttaaacgttcttgtctctctcacgaaaaccattgtgttgaatattcatcattgctgattgaatataattatactgtggtaaatctggtaatatctttatttctaattctgtatttaattcgaaatgcttagcgatgttttcaaatattgctaaatactcgcccattaattgttcatttattgtaagtctatcttcattagccatggctctatttaacataaagctaatttcttctaatgcgaataagctaggataataattttgaatcaatgtcttatcactaaataattcaccattagctgcattataaacttgcgtgcatgttatttaatttgc

SEQ ID NO: 820 - DNA, 1165 bp; double-stranded, linear
ncgnccttatatatgtttttcatgtcctacaaaaaacgaaatattccaattgcctatatacagatattcattaatgacacactcaatagcaaccatnacaatattatgttacctatttaaatgaaatagttcttttaaagaaatacatttttcacatattaatctataatcaaaatcaactgaccgatattctataatttatgattaaaataagttataatataatagtaaagataaagatagaggtggctataatgtgtggacttagaagtataacattaggtacaacaaatatagaacagacaaaacatttcatggttgacatattaggattaaattatgaagaacttcttgaaaactcaattcgtttcggcgatgcagatataagcccaggaacaagacttcaatttatacaagttccaagtgagcaattagaagaatctcactttgtgggtattggattacgtacaccaactgactcaggtttagaggagtatgcggaaatattatcgaataaggatattccatttacaacagttaaagaattaaatggcaataaatatttcagtctcgaagataacaatggtcatattttctcaatatattcaaacgagaataattatggcgttggtttaggtatgccttcttytgagagtgcggtcaatccgttacatcaagtgcaaggtttaggaccagtgattcttaaagtgaatcatgtagatattacaggtcaaattttaacaaatatattcggacttgaagtatttgcagaataccaacccttcgacaatgctgactatcatgtccaagtattcaaagttggaacgggtggtctaggtggcgaaatacatttaatgcctgtagaaaccgaaatgacaatgccggaatatggcgcagtcgatcaagttgagtttgaaacgaaagatgcagatttctttaatcaagcgaaatcgcgcttagatgaagtggaaataccatatcaaacgcttgagcaagatgatattgaatcaattagaattactgaaaacagtggattatcgtttatattcactttacaaaaataatttttttacgatagcgaggacaaaatttatgttacatgaaacttggaaagaacgtacaccaatcaagaaagtagaagtcattaatacagatgcaaagaaat

SEQ ID NO: 821 - DNA, 400 bp; double-stranded, linear
tcgcccaattattatgaaatattcaatacagtttattgatcaaaaaacaaaaatccattatgaaccttgtcatcacgaatattaactgacgttagatggacctctttaatgatagaacaattaataaataatgcacttaagtatgcgagaggtaaagatatatggattgaatttgatgagcaatccaatcaattacacgtaaaagataatggtatcggtattagtgaaggnacttgcctaaaatatttgataagggctattcaggttataatggccagcgccaaagtaactcaagtgggattggtttatttatcgtaaaaccaattttcaacacacacaaaccatccgtttccgtcgtatctaaacaaatgagggtacaaccnttacgantnccatttcc

SEQ ID NO: 822 - DNA, 760 bp; double-stranded, linear
tgatataatacttttgtaaagaaaagcatgtgtgggaggtatgacctgtatgtcgaacgaaatacttatcgtagatgatgaggatagaatcagaagattacttaaaatgtatttagaaagagaatcttttgaaatccatgaagcaagtaatggccaagaggcttatgaacttgcaatggagaataattatgcttgcatactactagatttaatgttgcctgaaatggatggtatccaggtggcaactaaattgcgtgaacataaacaaacaccgattattatgttgactgctaaaggtgaagaaacaaaccgtgttgaaggttttgaatctggtgcagatgattatatcgtcaaaccattttcaccaagagaagtagtcttaagagttaaagcacttctaagaagaacgcaatctacaactgtagaacaaagcgaacctcacgcacgtgatgtgattgaatttaaacatttagaaatagataatgatgcacatcgcgtacttgctgataatcaagaagttaatttgactcctaaagagtacgaattattaatatatttagctaaaacaccaaataaagtatttgaccgtgaacaattattaaaagaagtttggcattatgaattctatggtgatttaagaacagttgatactcatgttaaacgcttagagaaaagttaaatcgtgtgtctagtgaagctgcgcatatgattcaaacagtctggggcgttgggtataaatttgaggttaaatctaatgatg

SEQ ID NO: 823 - DNA, 465 bp; double-stranded, linear
caaaggaaattgcacaattagaagaccgattacgttcacgctttgaatgggggctaattgttgatattacgccaccagattatgaaactcgaatggcaattttgcagaagaaaattgaagaagaaaaattagatattccaccagaagctttaaattatatagcaaatcaaattcaatctaatattcgtgaattagaaggtgcattaacacgtttacttgcatattcacaattattaggaaaaccaattacaactgaattaactgctgaagctttaaaagatatcattcaagcaccaaaatctaaaaagattaccatccaagatattcaaaaaattgtaggccagtactataatgttagaattgaagatttcagtgcaaaamaacgtacaaagtcaattgcatatccgcgtcaaatagctatgtcttgtcyagagagcttacagatttctcattacctaaaaattg

SEQ ID NO: 824 - DNA, 355 bp; double-stranded, linear
caccgcggtggcggacgctctagaactagtggatcccccgggctgcaggaattcggcacgaggtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctccgtgaaattagacgttatcagaagtccactgaacttctgattcgcaaacttcccttccarcgtctngtgcgagaaattgctcaggactttaaaacagatctgcgcttccanagcgcactatcggtgg

SEQ ID NO: 825 - DNA, 1099 bp; double-stranded, linear
ttcacttggcttgttgactgacttgtatatgatgatgtgctttgtgaatcggattcgctcgtgcttgtacttgttgagtttgaggcactttggcttgctgagtttgagtctactccgctttgattcattgaggcacttagtgacaatgatgtactcgttgagtcagacaaacttgtactcgttgacgtacttgtacttcctgatgttgattgagacatacttatgctcattgatgttgaatcggatttactttcacttgatgatgttgagtcggattcactttcacttgtagaaccacttaatgatgtggatgtactaatggaatcagatttacttgtactgattgaatcacttgtcgacattgatgtacttaatgaatcagacttactatcacttgtggaatcacttaatgatgttgacaaacttgtagagtcagacaaacttgtactcgttgacatactcagtgatgttgaaacactctcgctcttaaacgttgacgttgattcactgatacttgtcgatgttgaaatggacgtactaccacttgttgaattacttaatgatgttgatgtgctaccagattctgatgtactgtctgataatgacgtactctcacttgtcgaactactcactgactctgatgttgattcagacgtactttcacttaatgattcacttaaaaaggcagatgcactttgtgattctgaatcgctagtactatttgattcacttaatgatataaacgtgctctctgaagcagatattgcttcacttatagagtcgctcgttgacgttgattcacttattgaatcagactctgatgtacttaagcttgtggaatcactcatagatgttgatgtacgttctgaattacttgtacttaacgatgtcgaagtacttaccgaaccagatgtgctcgtagaagcactttgtgatattgattcacttgatgcagttgatgctgatttgctatcactcgttgaatcactaaacgacgttgatatgctcattgaatcggattgacttgcactcantgaaccagacgtactttgtgattccgaagtacgtactgaagcacttgtcgacgttgatgtacttg

SEQ ID NO: 826 - DNA, 338 bp; double-stranded, linear
tatgcgtatcctgatagtcactttgattttgatatggaattagcgaaagagcaatctcaagacaatccagtttactatgctcaatatgcacatgcgcgtatttgttcaattttaaaacaagcgaaagagcaaggtattgaagtgactgctgcgaatgattttacaacgattactaatgaaaaagcgattganttgttgaaaaaagtagctgattcggancctacaattgaaagtgctgctgagcatagatcggcacatagaattactaattatatccaagatttagccttctcattccataaattcnataatgctgaaaagtgtaccagttggtattg

SEQ ID NO: 827 - DNA, 838 bp; double-stranded, linear
gtattttctttcgcgaatgattttattacttgaataccacgaataacctccaataccttttccactaattggttttgtacattatgatacgctggcgcattttgtcgactctttctttctaataattgaatcgcaaaaaatgatagtaatacgccaatgcatgctaataatgatacttgccacgaaactacaagtagagacaatatgagtactgtaattaatatgtatccattaacaacaacgtccaccattttcatagcaaagttttctaaaaaggttaaatctgttgttactattgttgttaactcatttgaatgatgcgaattaaaataacctaaccttacatttttcaatttatcccctatatctaaacgttctttcgcactcatttcataagcgatgctctcatggcttttgcttttgaaatatgctgtaataaatcgtccaatcactaataaaaccatgataattacaacattcaatatatctttcatataaataggtttatgagatagcacattattaaatatttttgcagctaaaaagataggtaacgcaataaaaatagcatttaaaaatgacatgctaaatcctaaaatcattcttgctttatatggtcttatccagtttaaaattttaaatgtaatttgaaacatatttgacctccttttctcattagtttaattatgtccagtattgattccccaatcttttgtatgcatgtgcgtatcccacattttcttataattaccgtttaattttagcaataagtgatgtgaccctttttctaaaatttgttgtttacctaaaacaataatttggatctgcatgtggaanc

SEQ ID NO: 828 - DNA, 898 bp; double-stranded, linear
tccnaaagaagaaataacattatcataaaatccattgaatataaattcagtcatcccctctgaacttctccataaatataatggtgaataagtatttgtaatgcaattagtagttgtttgacttattaaataagcttttataattaaatttttaaatccatcagtcttataaccatttaatcgaactctatctctaattatttccatattgtaatcactaggcaacttaacatgatattgcattgcatgcatttagcatacccccttttataaaaaggatagcaataataagtaaaatctcatattatccaattgtgatatagttatcataaaaagtgataggtgattaaattgaactttaatgatttggaaatttttataactgtatgtgaagaagcatctatcaataaagctgcaattaaacttagatatgcacaatctaatatatctcaaagaattagcaagcttgaaaatgaattaggtgtagttttgctttttagaaatcaaaaaggtgctaaggcaactaaagcaggcgaagaattcttagcgtatagcaaaaaagtattaagagatacagagactataaaaaataaaatgaaaaataatactatgtctattttatgctcagaactgttatttaattatttatctgagagcgaagaaattatgatgtcgaataactcaattaattttatttctagtggaaatattagaaaagctatagaaaaaaataattatgataaggttatttcattcataaaaattaacgactcaaattatagacttagtaatgttgatactatgaaagtaacgctttacagtaatggaagtaattatgataaagaggctttactaataaataaagatgagtttggtcctttaaggnaaataactttag

SEQ ID NO: 829 - DNA, 798 bp; double-stranded, linear
agtaggagtcataaaatcgnatttcaaaagcaattaatgcaaaatactgagtctacagtgctatttgcgaaagcgtccatacgaagttgagcaatgctaataataatggtctatcaaaaagagacgtgattaatcaatttaatgatttgaaaaaaatgaaaaaatycccttctaatcttgaatatgttgatagttacactgattctcttactggagtaacaacttctgcttttttaaataaagatacaggcaaagtaactctcgggatgactgggactaatttacaagacgaagcctttaaaaagttaaaagaaggtgaattttcaagacaaaatgttaccaatgctttggaaacagttaaagatggatatgcagatcttaaaatattatattctcctgcatctgatcaaaactatagatatgcgaatacacaagaatttataaataaaataaaaagtaagtatgacattgattttattactggacattcactaggtggaagagatgcggtagttctaggaatgagtaatggtattccgaacattgtggtttataatccagctcctatttctataactagtttgaatcctaattccccagatggaaaacgtttattagaattatataaaaattataaaggtaatattactaggtttgttgcagaaaatgatgcattgacagaaaatctgaagaaatataagcattatgtttttttcggtaatgataaagtctttaaaaatggtaaaggtcatgaaatgkaaggctttctgaccgaagaagaacaaaaagctataaaan

SEQ ID NO: 830 - DNA, 400 bp; double-stranded, linear
aatatcaatctcttcataagctgaattattttcatgcacttcttgatgtgatgatttgtcacgaacngctacaactaacattttatcgtctaaaataagttgtttatatttttctaattcatcaggcgctaagttgtagcgtgataaaactgcatgttcaccatcttctcctgttaacagtttagtcattctatcactaaatgttccacttgttgagataaggggagatttcagagtcgtgtaagtcattaggtgtaatttacttttactaataattgttagcctgatctaaataacttcagattctttgattgatangtgnataatcgcagtgcattacacagaatactgccaagtgcgcccttaaaattgttattancttacctctatataagaaccc

SEQ ID NO: 831 - DNA, 475 bp; double-stranded, linear
aagtctgcatgacttttatttgcaagttcgactgcttgatcaaaagcgcgatgatcttcaggattagcactttgaactgagctgaaattcggatcaggtttacattgtgcttctacaagattaaattgattgaaattcaaagattgtaataactcaggtacaatcggaacacttgtaccatgcaaactagtgaacacaacttgtaaatcagatttaggaatatagccaatcatattttgaatgtgtttcatatagtcatcagttacagatttcggaaaaggcttgatataagatgtattttgtttagaaataggtatatcaatctgtaatggatcgccaacttcttcgatataacgacttgcaagctcagatgcatcagtcgataattgcgcaccatcagaaccatatactttgatgccgttatagtctttcggattatgacttgctgtaatcataatgccagcagtagtattaa

SEQ ID NO: 832 - DNA, 724 bp; double-stranded, linear
cttgaattgaaggatacgcaaatgatgcataatcagcttctgtataaagctgtaatgtaatgtcatcaaggtcaccttttctaacaagcaccttattaatagaagtatgattcgcttgccaagtaccttgattattttgttctaaatgaatgacttcgcctaacgatttcaacgtaatatctgcacgctcgtcttcgctaatagtatatgtcttaccatctcgcaaattgagcatcttcaattgtttgttatattttataatcaatttatgcattgtctttgcctcagtcctatactatttttttctttcagcttcttggcgtttttctttatctttttgtgcttgttctttttgtttcttttcgttctcttcttgttgctttaatttctcatctttcgcttttgctttctcttcttcagatttcgctttttcatctttaacttgtttttctttgtctaaaatatcttgcaatttatcgttatactttttcgtttcttcagaacgtttatcattcgataaatctccgttatttttaatctcatttaatttattaatcaacgctaactttgtaatatcgttatcatctaaataagtggcaatattaatcgcttcatcaagatgtccttgtcctaattccatccaatataataagtagtctttgtttgaatttggtgtcacattattaagtaaattttctttcgtatctgtntctaaaccntgttn

SEQ ID NO: 833 - DNA, 994 bp; double-stranded, linear
agcagtttggctcgtagaaatctcccgtctctattctatgtattaacttttattatatttgttatgatactatcgatatgaaagcgttgtcaatggtttttgtaaaaattttgtcaaatttaatttttcaagtctttataaaagtagtttaatttgaaaactagaaataccaatcctaactaatttatttatgacgctcttttgtttaattgacattcttcagccatattttttatgactagttgcattttttactaataaacacctctaaaactttaatgattttaatcgttttagaggtgctaattattttatttgattattttttgtttgatacctactgcatatcccatatgaaaacggcttttttattatgttatatgactaaatctcgtgaaaaatgaaatttttgcagacttatgatttaccaaagtttatcataactagtagttacatatttcgctccatttttaacagcttcattgacttcatctattgtattaattaggccacctgcaatgacttgtgtgtttgtttctttctgaatatgatgaatcgctttactcgcaacacctggaagtacttcaacaaaatcaggttcaactttttttatcaaatctatactgcgtttcaatgcttgactatcaataataaatactctaaaaatcgttaaagtatttaatgatttagctttttttattactttagatttagtcgatacgataccttttggcttgtattgctgaataataaattcacttgcaaattcatcgtggcttaaaccttttatcaaatctatatgaataaaacactctatatgattttgcttcagcaattccataatactttttatatgtcctatatgcatatctagaagcacacacattttatagtctgtnttaatccagtttctctaaatcnttaatgtttcctataagcaggcaatatgttgttaattcactngatccatcctctctacatcacacgcttaaat

SEQ ID NO: 834 - DNA, 783 bp; double-stranded, linear
tcnacaaagtcggtattaggctatgggccatttnactattataactaatcggaaatataccacataacatcattattgagttgattctatcatttggcttattagggttttttatcataatgatttgcattttgctactagtttataaaatgattaggaactatgatccaaacactatagatttactcgttatgtttatagcaatctatccaatcacattattaatgtttagttcaaattatttagttgtaagtgaattttggtttgtgttgttctattttattacaaaaggacggcgtcatcatggctaagaaagtttttattatggatagcgtaaagacaataattggtacgttgcttatagctttaggattacaatttttagcttatccaattattaatcaacgagtaggtaatgaagcgttcggttctattttaacgatttatacaataataacaatcacgagtgttgtattaggcaatacgcttaacaatatacgmttgattaatatgaatctatacaaatccaatcattactactggaaatttgcatcgatacttttaatctcaattctgattgagagtatagctttaattattgtatttctttacttttttaatttgaacatcatcgatattatctttttaattctacttaatattttaatgtgtttaaggatttatctgaatgtattttttaggatgactttaaaatataatcagattttgtatattgctcttattcaatttttaggtttgctgataggactatttctatatnat

SEQ ID NO: 835 - DNA, 794 bp; double-stranded, linear
ttacctaatttttcaatcataagattccccctattgtttaaacataaaaatattatacgattaagcacgagmcacttcaatatatttttcagaatattcttataaatattaatatgatcatttcactatttaaacacgtttaatattaaaataagttattcatataaactggtgctgtttgatccaattgcagacttacgagtcattgaaaagtctcacaaactattgmaagtaaatatcttaaaatagaaagtgaatggttaatttaagtatatttmaaaaatattaacctttttaagcactgctatttaggatatactaaataataactaagtttagaaaaataggaggaacatcgtttatgttaaacaaggtttggttccgaactggcatcgctctgattatgctgttcattctcatcaaactatttatggaagtgcacgaagtatttactccaatagctacaatcatcggttctgtatttcttccatttttaattagtggttttttattttatatctgtctaccttttcaaaacttacttgaaaaagtcggttttccaagatgggctagtataacaacaatcatgttagctttgtttgctattatcggcttaattgttgcgtttgttgcaccaatcatcatttcaaatatcaacaatttaattagtcagacacctggccctacaaaaaggaagcagagcaaattattaaattcgcactggctcaaatggntaaattacctggaggatgtaaccangtggattaccaatatggtaaatcaatgggtgatgg

SEQ ID NO: 836 - DNA, 400 bp; double-stranded, linear
tgtttatactgtgcctgaattagaagaggttttaacacctatgagacaagatggaactcgtgatatttatgttaatttagaaaatgtgagttatatggattcgacaggtttaggtttattcgtaggtacattaaaagcattaaaccaaaatgataaagaactatacattttaggtgtgtcagatcgtatcggtagactatttgaaattactggtcttaaggatttaatgcatgttaatgaaggaacggaggtcgaataacatgcaatctaaagaagattttatcgaaatgcgcgtgccagcatcggcagagtatgtaagtttaattcstttaacactttctggcgttttttcgagactggtgccacatatgatgatattgaagatgccaagattgcagnt

SEQ ID NO: 837 - DNA, 433 bp; double-stranded, linear
attgatccattttgcggttcgggtacaatagctatagaagcttgtttaattgctcaaaatatcgcacctggttttaatcgcgagttcgtatcagagcaatggaacatcatgccagcaaatatttatgatgattaccgtgatgaagcggataagatggctgattatgataaagaaatcgaagtatatgcttctgatatcgatccagaaatggtagagattgctaagcgtaacgctgaagaagttgggttgtctgatattattaaatttagtgtaaaagatgtcaatacattaacaattgatacagaagaaccggtggcgttaattggaaatcctccatatggtgaacgtattggtgatcgtgaagaagttgaagaaatgtaccgttatattggtaaactaatgaaacaacatccatttttatctacatacattt

SEQ ID NO: 838 - DNA, 926 bp; double-stranded, linear
attgggccaactaatcctgtatatccaaatccagcagacaatggtgttcctttaacctgaagaacgtaagcaatgattccagtaattattccatttatagtcaatggtatcgaaataattaaatttttcaagtaaactgggatcatcatttttgcagctcctatgagtaaaactgcatttacaccaatagaattgacacgcaatgagccaaataagaaagtaacacaggcagccactatacctaggtttgctgctccacttcctagtccgtttaaactaatcgcagttgcaatcgctactaacgatattggtgttaccattaataatgaaaatgccacactaataagtatagacattaacaacggatttaagtctgtaaaagaatgaattacatttccaattgcttgagtaatttttcgaatgtaaggtaatgtgattagaccgatacccccactaacgataggtactaaaactggtaatataattaattcaaaagatccaagtttgttttgtaataccatatatataagacatgcaataataacaaccaaactcgtatttataatgtcacctataccttttaacataaaactattattgctatatacaacagcacctgaaccaatcatagctgatgtacctactatagcagcacctgcaccattaaatttaaattgatgagcagctaaaaccccaataataaatgccataaatgattgaattagtatcactaactgatacgttaattctaaaatttcattaccacttttaaatatttttaatacttcacctaataaagcattcggaacaagtgcaataacaacaccagcaccaatagaatttaaaatcttactgaaaaactgtttattatcagcattatttgcgttactcataaacgacctccaatttgaacattanactcatca

SEQ ID NO: 839 - DNA, 400 bp; double-stranded, linear
cttcgaaacgtacttggtcattccctttaccagtacaaccatgtgcaatacctactgaatttgttttctcagcaatctctactaattttttagcgattaatggtcttgataaagctgaaactaatggatatgcattttcatacattaaatttcctttgattgcataacttacatactcatcactaaattcttttgttgcatcaataatatgacattcaactgctcccatatctaaagcttttttataaacgatgtctaaatctttaccttcaccaacatctaggcaacaagctacaacgtcgtatcctttgtcgataagccattgaacggccacacttgtatctagtcctcckgaatatgctaaaacaattttctctttcataaaattcacctcattgta

SEQ ID NO: 840 - DNA, 1043 bp; double-stranded, linear
ggatcgcggtgttgtgcttgatatactttgtagcgataacgtttacctacacaatcataacgacaatgaaaatcgtcatcgactgtaactacattgttgacataaatatcatcaggtaacgttcggttcattgcatattgccattgtgacataggtatattcagctctgtgtcgaaatgaaagtattgctgtatcgcatgtacacctctatcagtcctacttgaaggatggattctcacatgtcttttatgcatgcgttgtaatagcttttcaaattgttgctgtaccgttcgaccattttgttgaatttgaaaacctagaaaattatttccttgatacgcaatttctactaatatacgcatgaatttacactcctgaatattttaatacgaataaaataattgcaattgggataatcatggttaaagatatcgtatctctcaattgccatttaagctgtctgtagctcgttctcttaacattggcatcataacccctaacttccattgcgaccgctaattcttcggcgcgttggaaagctgagatgaatagtggcactagtaatggaataaatgatttaatacgtgttgcaatgttccctgaacttatttcagaaccacgcgacttttgcgccaaaatgattttatctaactcatccattaacgtcgggatgaatcgtaacgcaatggacattatcatacttaattgatgaactggtaatttaaacatctttagtggtgcaagtaatctttcaaacgcatctgttaaatcaattggacttgtagatagtgtcataattgttgcaatcattacaatcccaattaaacgcagtgrtatatatagcccttctaaaataccattagtttcaatcgtgatgccatgccattcaactaatacatatccacctttagttaaaaatatatgcatcattaatgtgaagattaaaaagaaaaatattggtgttaaacctttgattaggaaccataattgaatttttgctaatctcataatgaanangataagtgcaaacacccaaagatatg

SEQ ID NO: 841 - DNA, 343 bp; double-stranded, linear
tcgaaatcaaattataatagacaattttaggaggtggactttcgatgaccaaaggaatcttaggaagaaaaattgggatgacacaagtattcggagaaaacggtgaattaatccctgtaacagtagtagaagctaaagaaaatgttgtattacaaaagaaaactgtagaagttgatggatacaacgcaatccaagttggatttgaagacaaaaaagcatacaaaaaagatgcaaaatctaataaatatgctaataaaccagctgaaggtcacgctaaaaaagctgacgcngcactgagagntcccctcataatttccccaancgtaaccatgtgtgaataaat

SEQ ID NO: 842 - DNA, 430 bp; double-stranded, linear
atgagtattttaatgatgcgctacgagcgtatggtcttactgtganaacaggtgaatttggaacacacatgaatgttagcataaataatgwtggwcagtctctggtagtttagaattagaagaattaaagcaatttagacaatggggttctaaaacaccaggtcatcctgaatacagacatacagatggtgtagaagttactaccggaccacttggacaaggttttgctatgtcmgtaggattmgctttagcagragatcacctagcagggaaatttaataaagaaggatataatgttgtagatcattacacatatgtattagcttctgacggtgatttaatggaaggtatatcgcatgaagcagcttcatttgctggacataataaattaagtaaattagttgttttatacgattcaaatggatatttc

SEQ ID NO: 843 - DNA, 329 bp; double-stranded, linear
ggactgcccgatgatttgacaaatgaattgctgatttgatttatatattatctgnaattaatactcaatacaaactaaaacggtactattaaattgtgcaaagctaaaacaaatttatattcatctatccaacaatatgtcttatcaatggtatagtctttgcacaccaatggaggnaaataaatctcaaccttactatattaatatataatcaaatcttagattaactagtgtaatgatacagatggataattgagtacaaatttaaaaccctgagattttcgctttaatttgaaaacctcagggnttatttgatttttatataatga

SEQ ID NO: 844 - DNA, 400 bp; double-stranded, linear
agatgaagaaagtgtttcatcgattatcttaacagttgttgctttatatactacanttcttcctagatcttgtaccgttgaaaagagacctggttgtaaaatcttaattgacattttcaatcaccacccagtcatcaacattaaagttgccatctgatatatctctttcgatttgtataaatttctgttcatctattgcataaaattgtatccattctcctgcttcgtacattgacattggttcacgctcgctgctaaatacttttaacggtgtgcgtccaataatttgccatccgccagggaaatctgatgggatatagtcctgtttgattattcgcaatacctacagaacctggcatgaattttttaaccttgggcngattacgtctanggngtatgt

SEQ ID NO: 845 - DNA, 535 bp; double-stranded, linear
cataagtccagtaaccttcaactgtgtcctcatctttagttccaaatatatcaacgtatttatttcttaactgattaatgtttccccaactctcggatccaaacacttgaatatgactataccaaacccacgtttgcaatgttgcatgaatgctaccattgggcttttgccataaccattttccagataatgaaaaatgcggctgagtgtaatatttgattagttcattgatattagtctcgttttcactgatattataggcttttgcttcagatgaaaaactgattggtgttttaggaagttgtgttgatgtagtttctaaaagtaacaatgctgttgataaaactaatttattcatgatgttctttttcatatgaaaatctcctttgcgtgaattacccaaagtatataagctattacaccgattcggaattaaataaaagctaaaactatgttaaataaacttaaacagttagtagtgttatttaagcaaaacttatcatttttaagttggacagaacagatcaataagagc

SEQ ID NO: 846 - DNA, 509 bp; double-stranded, linear
tcaatcgatcaaatggtgattgaccttttaaatttgtatgatcaaaataatgattgttggccatatctttactatgcttacgtgcagtttcagaattctgtttagaatacttcaatgtagataattgatgttgttttctttcagcattaactaaatcaaaattttgtagttcaaaactatctgcaagcgatttcgatggtgctccatattgttcttttaatctattttccatagcatcacttacttgtaaaacagctgttacattattacgtcgatgcttatcataaaataccgtcgtataaatgtgatttttatggaaaacatcatattctttattattttgttcgtaacgcactctacctttaacaatctctgtttctggttcgcctaatctttgccttacaaccgatttaggtgtattgtatttaatttttgattttgaagtgattatattttgatttgtatataacgcattaactttatctttcatgtaacttatcattataaaa

SEQ ID NO: 847 - DNA, 400 bp; double-stranded, linear
cgtattgatctataaatagtgtttagatgctatagtcggatgcttaagtaatttaaagaaagtatctttaacatcgatgtgtgtataatcatttttagaagtattataatctttttcttctcccttctaaaatatatacaggtgcttcatcagctagtggttcaactggaatgtcagcataaacttcgcatcatatgttaaacaaaaacgattgtatctgtacttcacctataacagcactatccaattcgtgcttatcaaataaactaagatttttgtcagtaccttttcacaactagtacatacgtcttgagttctgaagcatcatttcataaggagaatactggccacgtgtggactgtctatctcaatgaaccactacactttgcggcattcagcg

SEQ ID NO: 848 - DNA, 400 bp; double-stranded, linear
taccacttgaatacattgcatataaaatacgacgttgtactggttttaaaccatcacgaacatctggcaatgcacgctcttgaataatatatttactatatcttccaaagcgatcacctaaaacatcttcaagtgataaatcttgaattatttcactcactagatttcctcctcatcaaattgatcattttcaagcacttgtacttcagaattatctaaaatactttggtcctcttgcataccaaactcaacatgcttttcaatccattcacgtctaggttgtactttgtgcacccattgaatgttgttacacgtttagatggaacgcacttgcatcttgcaacttgtgacacgnattgaaagttncgtgtttgcgggggttncagcgtcgtttgcccat

SEQ ID NO: 849 - DNA, 400 bp; double-stranded, linear
tttatatgatttatttgaggagttaagagatttatttaaagaagaagatttagaaccatggacatcatgcgaatttgattttacaagagaaggtgaattaaaagtttcatttgattatattgattggataaattcagaatttggtcaaataggtcgacaaaattactataagtatagaaaatttggaattttaccagaaacggaatatgaaattaataaagttaaagaaatcgagcaatatattaaagagctagaagaataaactatcttaatgtaagactaaacaataaagctttgtttagtctttttagcgtttaagtaaaaagcaatagataccgtaaagttgatgctcatcaaataataatataaagataattttaggtttttaaacttttaatcg

SEQ ID NO: 850 - DNA, 923 bp; double-stranded, linear
caggccatacttacaattttggccatcgtccggatgtattnggaatcgttggataataagcatcaaggtcgtgactatttcgtaaaattccaactgtcccagaatttacatcattatgtccaattactgggcaaccagattttgccaactatctatatttcatatattccaaatgttaaaatggttgaatcaaaatctttgaaattatacttatttagtttcagaaatcacggtgattttcacgaagattgtatgaatattattatgaatgatttgatagagcttatggacccacattatattgaagtctggggcaagttcacacacgtggtggaatttctattgatccttatacaaactatggacgtccaaattctaaatatgaaaaaatggctgagcatcgtttgatgaatcatgatttatatcccgaaaaaatagataatcgttaaatgtatcatttaataaacacaccaataagttgattttcctaacttattggtgtgtttttcatttagcatacataataggttacattaaaataacattttataccaaagtacaccaaaagaatattagtacacgaattaaacaacatttttatagaaacctattgcactttaacgtcaataagtatatttttatattatctctaattaattgtgcgcgcttaataacagaatattctcaatatttttatttttttgtgatttgttggaatatttagttgataaggcacaatcaaatttacttaaactattgtattaggggaagaaaggatgggatgtatacatgacacaacaaaactcccatggaaatcaaattcaagacatacctcaaacaggatttttcgggcatcctcgaggactaggcgtactcttctttgtagagttctgggraaggkttagttattatgggcatgcgtg

SEQ ID NO: 851 - DNA, 1004 bp; double-stranded, linear
ttanttgcatctatttcagttggtgtaaagaaagcggaatttgattttattgaaaagttagctcaagaaaaattaatccccgaatatattacaatagatattgcgcatggtcactcagattcagtgataaacatgattaaacatataaaaacccatatacctgatagttttgttattgctggtaatgttggtacgccagaaggtgttagagaattagaaaatgctggtgctgatgctaccaaagtcggtataggtcctggtagagtttgtattacaaagattaaaacaggttttggtactggtggttggcagttagcggcattaaacatatgtagtaaagcagctcgtaaacctttgattgccgatggtggtataagaacgcatggcgacattgctaaatcaattagatttggtgcatcaatggtcatgattggttcattwtttgcggcacacgaagaatcacctggtgaaactgtagaacttgatggtaaacagtataaagaatattttggtagtgcatctgaatttcaaaaaggcgaacataaaaatgtagaaggtaaaaaaatgtttgtagaacataagggttcattaatggataccttaaaagaaatgcaacaagatttacaaagctcaatttcatatgccggtggaaaagacttgaaatcattacgtactgtagattatgttattgttagaaactctattttcaacggtgatagagattaatatttatagtaggtgakgtaaattaaaaaattcatagtaactgttgttgcgtttttatcaattattatcattgcgccantaacagaatttaaaccattcattcatttacaaaatgaagtaagacaatatattgacattcacatcaataaagaaacaatttctgcggaaaataaattggatacaccgaagaaacaacaatttgcctttaataatatacaaatgaacatgtcgaaatcagatgttgagaaaacattaaataaaccaaaaagagtgacatn

SEQ ID NO: 852 - DNA, 400 bp; double-stranded, linear
gttcgctccaatgtacgcagttgtatatgcatagacaccaaaatcgaaccattccattgcattaccgataccggttgcaacaacggtttttttagctttctttgcatccaccatgttaatattctctttattaaaatccatgaattcatacactccctcttgtatgtttcataattatacggagttaattagttttgtcaaatttataagaatttaaacttttatataaataccaaagtatgtttgttcaaaaatttcgctttatcgnattaaattcatggttttatacctcatacattgattagacataataatctaaacacgacgttactttggatatactnaatggtnncacactcagtaggaagcacgcattcgctcgataatgtaaccatactca

SEQ ID NO: 853 - DNA, 361 bp; double-stranded, linear
ggtgaaattgtaactatataatcgatattaccttcagtgttcaaaactggaaaataataattaccatcactctttttgttgaatttataaattttaaaaggttcaccaagtgtatacgaggctttctctttattatagattttatcaagtgaagtaacataagaaagatagtctttttgcgctaaattacgtacgtcagtaggaacactcttgtcctcgacattaacttgcacatgcttcttatcttttgctttgatatttgaattgctctcagcgtttgcaataggggtaacacttaaagaaaatattaaacttaaagctattaattttggaaagtttcttttcatataaaaactccttt

SEQ ID NO: 854 - DNA, 605 bp; double-stranded, linear
acnttatactaganaaagntattaaagtatatctgctttacaccattaaaaagcggcaaatgctatagataatctaaagcatctgccgtatgagnatttatttatttttgattgtcataatcgtgtggttttaaattaattgtttctagctttacaaattttgttttgtgaatgattttatgaataaagtaaatcaacgctagaatgattaaaggtaaaaagtttttaaaagcatttaaccattgatcttttaaaatatattcaactgagccaccaaatagcaagaataatagtgtagtgatgacaatgattggtcctaatggataaaaaggtgctttatatggtaggaccttattagggtcttgaccttgttttttaatagcttgtcgcaatcgtatttgtgaccaaatgcttgatccccaaacaactataatcattgaaccaataatttcaagtaaattaaaaacggcatttgaattaaagtttgcataaataataacaataacaacgactgcataagtagttaataatgctcttaaaggtaacttagttgtcttgtttaatttacttaaaaattggggtgcttttttgtctgaacttaagga

SEQ ID NO: 855 - DNA, 515 bp; double-stranded, linear
ttgaacaagcatttttaaatagtcaacaacatcamgcaattagtgaagaggcacaacttttaaataatccagatgaattaatggcatttttaaagaataagcgtaaaaatattttagaaaatgcatacattatgccgcataatatgagagaaatgttacgaagttatttggaaagtatgtctcaagactttaatgttggcggattttttaataaaaagaagaaaaaactacaaattcaacaacagcgattattaacagcgacagatgcgttacaagaacatgttaatcaacaaattcgtcaaccaatgcgagaagatatgtcatttgttacgcgttttatcaataaaaaagmagcttcagatamagtattaaatcagcattatgacgttaagccagaaatgattgaaggtttatatcaaccacaaacatcaatcagcaatacttatgtacttacattttcagacgaagtggttaaagccattaagaaatatgttgaacaacaatcaacaccaatt

SEQ ID NO: 856 - DNA, 1607 bp; double-stranded, linear
gtcatttttaaaatttcgcattcgcgtttaattttttctcttttttctttttcttctagtgacatactttctttaggtgtttcaaccaattcagatgtatctacatcatcaattttagtgattttgtctacatctttctttaaatcttctgggacgttctcgaaacgcttatattgctctttagagatactagcagctatttcattagctcctaaaatttcatctatcaagccgaaagacaaggcttcttctgcagtaagccaagtttctgcatctaacatctgttttaagtgttcttgatctaaatcttttgctttatctaaataagctgaattactaacagcatctgttttttcaagtaaatccgctgtctttcttaattcttctgcattacctacagtcataacccatgaattatgaatcattaaaaaactatttttgtgcataaaaatagtgtcaccactcatagcgataacactagcaattgatgccgctaaggcatcgacatagatattaatttttgcaggatgcatttttagcatattgtatattgcatgtccttcaaatacactgcctccagatgaatttatatgaacatctatttcactgatgtctcctagttcatctagtttatttttgaaatctgtagcagttacatcactttcaaaccatttatcacttacaatatcaccataaatgaatatttcacctttactttttgattttcttttcatttgaaaatacttagctttcattgacatttttatcaccacctttcaaagattttcttaattcaagtggcgtgtcaattgggtataaatcaccgcttaattagcggcttatctccaccttcaactggtggtaaatcttcccactctctaatgtcatttatagtgtagtaaccactacgaactgctttaaagtacacttctgcttgtgttgcactatcagcccttaaataagatttaacgttaaatttaaaatacctatttttttctctgtctgttttagtaagtagtttccgattaanttcttcttcatactgtttgacgattggcaataaggtatgctgcaagtaaaatctgtttaactcttcatttttcgcgaaatttgtatttgatcttgcatttaagaatattgagggcaattgaaaaacgttagctactctttctcttgttaaattctcgcttgccactatatcttcagagacatattttttaggtaaaggttcgatttcaacaccaggctcttggaataatattccaccgttttcttcatagtactgtttgaaatcttctaacacttgttgccttttttctgtacttacattggaaccatatttaagcataaaagaatctggtttttgcatttctgtaagattaaaggttcttactgcattgtcaaaatcagttgtattcttcaacacatcaatcggactaataccttgaaccatattagatgccacgatgtgtttaaaatgcaacatgtccatattatgaacaatcaatttatttccagttgcagcatgaatggaataataaagttcaccgtgattggttttcaattaacatttcaacaacatctggatttaataagaaaagctttga

SEQ ID NO: 857 - DNA, 346 bp; double-stranded, linear
atgcgcatttaaccgcatttagagatgctgaagatcagtataaagctttgttagaaattacaacattaccagaaggtagaatttatgttgctcgccaagatcaactcattgtgggttatgtcactttccactatcctgatgaaattgagcgctggtctacaggtaagcttccatatttaatcgaattgggggcaattgaagtcagcatcaattttaggcaattacaacttgcagaaaagctgatacaacttagccttctacaccagaattcgagaattatatcggnataactacaggatattaccggcattgggggtttaaaaaattcccagtnagaggtattncc

SEQ ID NO: 858 - DNA, 1176 bp; double-stranded, linear
attactataatgaatcttgcgagatatttagaagtaatgatacaanataatggactttagaatttmaatttacaataaatagttctatgattaaatgtcagttttatgacatttatttattgaaaatacgaacgaatgagcgatatgataatatagataagaatgattttaatttaggaggcctttatggtgcataataaaaacaatacaattttaaaaatgatcaaaggtgaagaaacatcacatacacctgtttggtttatgcgacaagctggccgttcgcaaccagaatatcgaaaattgaaagaaaaatattcactattcgatattacacatcagccggagttgtgcgcttatgtaacacatttaccagttgataattatcatacagatgcagcaattttatacaaagatattatgacaccattaaagccaattggtgtcgatgtagaaattaaatcgggtattggtccagtgattcataatccaatcaaaacaattcaagatgttgagaaactttctcaaatagaccccgaacgagatgtaccatatgtattagatacaattaaacttttaacagaagaaaagttaaatgtgccgctaataggatttactggggcaccatttacattagcgtcatatatgattgaaggcggaccatcgaaaaattacaattttacaaaagcgatgatgtatagagatgaagcaacatggtttgctttaatgaatcatttagttgatgtatctgttaaatatgtaacagctcaagtcgaagcaggtgccgaattgattcaaattttcgattcatgggtaggtgcattaaatgtcgaggattacagacgttacattaaaccacatatgattcgattaatcagtgaggttaaagaaaaacatgatgtgccggtaattttattcggtgtaggtgccagtcatttaatcaatgaatggaatgatttaccgattgatgtattaggcctagattggagaacgtctattaatcaggctcaacaattaggcgttactaaaacattacaagggaatttagatccatcaattttattagcaccatggaatgtcattgaagagagattgaaaccaatattagatcaaggtatggagaacggtaaacacatctttaatttaggacacggtgtattcccagaagtgcaccagaga

SEQ ID NO: 859 - DNA, 621 bp; double-stranded, linear
atttggtgcattggtanaattgacctgaaagnaaaaagtggtttagttgcacattgagtgnaagtgcgcagatgaattatgttgaaaacgtgaggaagagcacctttgctgttggtgatgaagtagacgtaaaagtattatctattgctgatgatggaaaaattagtctttcaattaagaaagctaaagaccgtccacgtagacaacatacgagtaaaccaagtcatcaaaaaccagtgcaaaaagccgaagattttgaaaagaaattaagcaatttcttaaaagatagtgaagataaattaacttcaatcaaacgtcaaacagaatctagacgcggtggcaaaggttcaagacgttaattaaaataaataaagactgtttcgataaggaatatatttagaatgatgcgtatcgaataatcgattgcagcgttagacaatctaagactgtttcttaaataaggagcagtctcttttatttgtaatgatataactaagacttataccatttttgaaaattgtaaaagtgaggtgatgttatgcagttaaatagtaatggttggcatgttgatgaccatattgttgtcgctgtttctacaggtattgatagtatgtgtttnnt

SEQ ID NO: 860 - DNA, 544 bp; double-stranded, linear
tatattaggtacttgtgttggtattgtgccagctttgctgtctactataatttctaaaaggtttgaacatataaaagggaaagtgctaggtgtatttaattttgtgagatatattggaatgactgtcggtgcattattaattggtatcatttctcagccgttggtagccttttacttcacaactataactatcatgttaatagtaatatttctttatataaagatagttgactttcagctaaagtatgccaaataaacttaaaaaagcagtgaatcatttcaatagatggaatgattcactgctttttgtttatagaaatttaaaattcatgcctttatgctaacaacaatattattttactctcttacgtttgccaatgtaaccgtatagcaaagtaaatgactgcgataatgatgacaacatacatatacgtgaataggaaggaagaccagtcatcaacataccaaagctatcgctcaaagtgcgnctggtaaattaaaccgaattccangattgtaggaacccnattaatggaaataacgg

SEQ ID NO: 861 - DNA, 651 bp; double-stranded, linear
tacgtccgccaacattcgtcgctttagtttcataatgtattgccatacttataacctcctaatttaaaatacatttatgctttacccattcgaaaataccttaatcattttcatttatagcattgtttgattgaaggataaaaagttgttgtttacaataaaaataatgagtatctgaaatgagggattcantatgacacatgtggaagtagtagcgactatcgcgccacaattatctatcgaagaaactttaattcanaanattaatcatcgtattgatgcaatagacgtattagaattacgaattgatcaaattgaaaatgtcacagttgatcaagtggcagaamtgattacaaagctgaaggttatgcaagattcattcaaattattagttacgtatcgtacaaagttacaaggtggctatgggcaatttacaaatgactcgtatcttaatttaatatcagacttagcaaatatcaatggcatagatatgattgatatagaatggcaagcagatattgacattgaaaaacatcaacgaatcattacacatttgcaacagtataataaagaggtggttatatcacatcataatttcgaaagtacgcctccattagatgaattgcaatttatatttttnnaaatgcaaaa

SEQ ID NO: 862 - DNA, 401 bp; double-stranded, linear
tgtgagtggtaatgacacacaagcagatttaataggttatagttttaagtttgacggtgcgatttcaaggcaagaggcttctaaagatgtacatgcagttatattatcgaataaaacactatatttattagatgtattacaaaaattaccgatagataaaatgaattcattgaatatccatcaagaaattattgatgaaatgtcagatatcattttaatgttatatcgtgaatatgcaggtatgttttttaaaagtcagaaactaatcaaccaattaaaaagattggamcaataacataaaataataaaaggtattcaagtagccacatagatgtgtttatttgaataccttttkgaatagaaaagagatactggcaattttactaaccagtatctctttt

SEQ ID NO: 863 - DNA, 308 bp; double-stranded, linear
tnttgtgtttgtagaaataatttatagtacaaacgtaaaatgatataaaacaaaataaaaacaaagtaatcaatatgtaatataaaatacactggtactcaatatataatgatgataaaattaattttaattagatagagttgctttgtgtttttaacgcngatgctactacttatcttaacagttgattaagtaaatcatttaacagcgagattatncaaccagggggatgacttaatgaatttattcagacaccaaaatttagtatcagaaatttaatgtcggtattttttcagctttaatgccac

SEQ ID NO: 864 - DNA, 1827 bp; double-stranded, linear
ttctacatcttaaacgatgacctaactatgacgttaatctggaaagatggggagttgctagtatgatgttgaaatttaaagcttgggataaagataaaaaagttatgagtattattgacgaaatcgattttaatagtgggtacattttgatttcaacaggttataaaagtttcaatgaagtaaaactattacaatacacaggatttaaagatgtgcacggtgtggagatttatgaaggggatattgttcaagattgttattcgagagaagtaagttttatcgagtttaaagaaggagccttttatataacttttagcaatgtaactgaattactaagtgaaaatgacgatattattgaaattgttggaaatatttttgaaaatgagatgctattggaggttatgagatgacgttcaccttatcagatgaacaatataaaaatctttgtactaactctaacaagttattagataaacttcacaaagcattaaaagatcgtgaagagtacaagaagcaacgagatgagcttattggggatatagcgaagttacgagattgtaacaaagaactggagaagaaagcaagcgcatgggataggtattgcaagagcgttgaaaaagatttaataaacgaattcggtaacgatgatgaaagagttaaattcggaatggaattaaacaataaaatttttatggaggatgacacaaatgaataatcgcgaaaaaatcgaacagtccgttattagtgctagtgcgtataacggtaatgacacagaggggttgctaaaagagattgaggacgtgtataagaaagcgcaagcgtttgatgaaatacttgagggaatgacaaatgctattcaacattcagttaaagaaggtattgaacttgatgaagcagtagggattatggcaggtcaagttgtctataaatatgaggaggaataggaaaatgactaacacattacaagtaaaactattatcaaaaaatgctagaatgcccgaacgaaatcataagacggatgcaggttatgacatattctcagctgaaactgtcgtactcgaaccacaagaaaaagcagtgatcaaaacagatgtagctgtgagtataccagagggctatgtcggactattaactagtcgtagtggtgtaagtagtaaaacgtatttagtgattgaaacaggcaagatagacgcgggatatcatggcaatttagggattaatatcaagaatgatgaagaacgtgatggaataccctttttatatgatgatatagacgctgaattagaagatggattaataagcattttagatataaaaggtaactatgtacaagatggaagaggcataagaagagtttaccaaatcaacaaaggcgataaactagctcaattggttatcgtgcctatatggacaccggaactaaagcaagtggaggaattcgaaagtgtttcagaacgtggagcaaaaggcttcggaagtagcggagtgtaaagacatcttagatcgagttaaggaggttttggggaagtgacgcaatacttagtcacaacattcaaagattcaacaggacgaccacatgaacatattactgtggctagagataatcagacgtttacagttattgaggcagagagtaaagaagaagctgagcgcaaatacgaggcacaagttaagataaggagagatggagatgccaaagaaaacggtaacgattgatgtagatgaaaacttattagtagtagctagtaatgaaatatcagaactattatatgaatatgacagtgagttaatgtcagctggatggaagatggcgataatagggatatc

SEQ ID NO: 865 - DNA, 1379 bp; double-stranded, linear
tcaattgcatcatcatatgaaattctagggaatggtgtcgcaactttttcaagttttgatgtatcacgctctaaaattttcaactctagtttacaattttctaaaactgattttacaacatgtgttacatattgttcttgaatttctaaactttcagcatgatttgtgaaagccatttctccttcaatcatccagaactcgatcaagtgtctacgtgtttytgatttttcagctctgaaagttggaccaaatgaaaatacttttccgtgtgccattgctgcagcttctaagtataactgaccactttgagataaaaacgcatcttgatcaaagtatttagtatggaataattcacttgtaccttctggcgcacttgctgtcaaaattggtggatcaacctttgtaaatccatctttgttgaaaaattcatacgttgcacgaataacttcatttctaattttcattacagcatgttgttttttagaacgtaaccataaatgacggtgatccattaagaattctgtaccatgatttttaggtgtaatcggatagtcatgcgcttctgaaataacttcaattgatttcacttgcatttcgtatcctaagtcagaacgattatcttctgtaattgtgcctgtaacgtatagagatgattcttgagtaatttctttcgcaagtttgaatacctcttcatcaacttctgatttaactactacgccttgcataaagcctgttccatcacgtaattgtaaaaaggcgattttaccacttgaacgtttatttgttaaccaagcaccaattgtaacgtcttggtttaaatgatctttcgcttgtttaatcgttgttttcataaccattctcctatttattttttcgktatacaatactcattcattttaacaaaatccgctttcaagttctagaactagactaaaagataacgtgtaaatggtaatgatttacgcacagatttgaacattaatttatattaagacaatacaatcatcagtttcagacaaaatatataataaagcctcaatattattagtatgaaggtcgttttttgtnctaacattcaagtttaattataaaactcaaattttgacgaccaaacaaaaattcttgtaacagaacatagcacatgtcatgtcacaagaattttactttgtatttcactttttctttttttgaatttgtcttaataattttccaaactgttgaatgtcgccttttttctgacgataattttcaagtgtttgttcaaaaaagtttttataattactgtttatgagtcgatcatcaaatgaaactattatgccgcgatcattttcatttctaattaatcttccaagtccttngtctanaacgtgtaactgcat

SEQ ID NO: 866 - DNA, 450 bp; double-stranded, linear
ttacaacgaatagttcaccgttcgagtctaatctatgtaatgcttgctcgaatatacgatgcacggtttctttccctgctcttattggtggattggttaaaataaaatcaaaacttttgtcttccacagcagacaaagcatcactttcctttacgatcacattatcaataccatttaattttttgtttttttcaactaaggctagcgctctgtgattaacatctagcattgtaattgaatgatgtggtgatactttagcaatcatcaaaccaattggtccgtaaccacaaccaacatcggcaattcgcttacttggaccaggtggatgcgcttttaaaaaagtttgaacaagaacatctgaaccataatctactttatctttcgaaaacactccttatcagttattaaatcaattttatganggttntaattggatattgagtacgttgt

SEQ ID NO: 867 - DNA, 400 bp; double-stranded, linear
aatgttaacaatatagcaccaattaaccccgacatgataataacgtgtaatgttttatttcctattaattgtctcgcaatatgaggtgcaattaatcctaaaaagctaataccaccgacaactgaaattgcggatcctgctaatattactgctaaaattaacaatagcattttaatagttttaacttttaaaccgagtgcggttgcaacagcatcacctagattcaatacatctaattgataactccataaaatgatgatggatcgttattaaaaccagggaatatagataatatccgcatatcaggccatatagctacctgtcaccaacaggtttntgctccanggttctntaataagacgcacacgcgacaatgcgcttgctaccattaggcagcttg

SEQ ID NO: 868 - DNA, 1132 bp; double-stranded, linear
aatccntnaagtgccataacatcatctcctaacatctttattatacatcaacattttataaaaataacntcttatgataaaaatgaaaatactaattttaatgagagcgtcttaagccgcaattgataaaacatatgctacaatatttttaaacactatacaggaggtactctatgacaaaatatacatttaaacctaaagatttcaaagcgttcaacgtagaaggcttagacgcacgaatggaagctttaaacgaatacatacgaccacaactccgtgaattaggagaatattttagtgacttctttacaagtcaaactggtgaaacattttatcctcacgtagcaaagcatgctagaagaagtgtgaatcctcctaaagatacatgggttgcttttgcaacaaacaaaagaggctataaaatgttacctcatttccaaattggtatgtttgaagatcaactgtttgttatgtttggaatcatgcatgaagcaaaagataaagcaacacgtgcaaaagtttttgaaagaaaatttaaagctattcaacaattacctgatgattatcgtgtttgcttagatcatatgaaacctgataaaccatttattaaagatttaacggatgatgatttaatagaagcgatacaaagagccatcaatgtgaaaaaaggtgaattctttatagcgcgtgcaatcacaccacaagataaaagattaaaaagtgacaaagcatttattgcatttttagaagaaaccttcgatcagttcttaccattttattctgcataaataactttgtttaaataatagagcacttaatcacatccatgatttcgtgctcttttttcttaatattaaatcgaacgttcaacataataattcatacttttaaaaaaattaanataaatttaggttggcctanacattttattaggttattatattgtccataagaagtagaggtgagtcaaaatgaataataaacgacattcaacaaatgaacaattaagtttagacgaaataaacaatacaattaaattcgatcatcgcagttcaaataaacagaaatttttatcatttcttggacctgggttattagtcgctgttggttacatggatcccggaaactggat

SEQ ID NO: 869 - DNA, 418 bp; double-stranded, linear
ctcaatgtattgactgtgatttggagtgtataatgctactgttttgtctatagccatcgcatcaaatattatatttgagtaatcagtgataacgacatcagacattagaattaagtcttgagcactaagatactttggtgcaacaagcgcctcttctggtaagatcgcttcatcaacaccctgaaccacaacatgataggctttgaataaagcatctgatagtggtaattgttgcgcactcactaatccaataggtgcgtataataaaactggtttttgatcatttattttaaacgatttcttatactgttgttgagtagtactttcgttactcttttgtagtaaatattggtgtttaggattaccataagccaatacattgcttggtgactaggaaaagncgtttgataaaagggct

SEQ ID NO: 870 - DNA, 587 bp; double-stranded, linear
gagtntgttacagtaattgattttattggtaattntaagacaaattatttaattccgattgcgctttctggggatcaatcgcaanataaagataattataagaagtttttaacgaataacgattcgattaatggagtatctacaattaattttgaagaagttgctaaaaaacagatttacaattcattggatgcagtatcattaaatcaaaataaattaatattaaaagcttatgaagaagttgaaaatagattgggacacatgccgttactaatggatttcatacaacaacattctatagatccaagcgttatattttctaaatttagtaattattacgagttcttagtgagatataaaaaaatagatacattattgacggaaaatgaatctaaaaatctggttttcttttcaaggcaaatagcacctggattgaaaagaatcgatagtttagttttagaagaacttttaaaaaatgaattaacatatgatgaattaaaaaataaaatgttgaacgaagttaaggatataacagaagatgatatagatacttcattaagaattttagatttttcattttacaacgc

SEQ ID NO: 871 - DNA, 971 bp; double-stranded, linear
ctactaaaccaggtaatcggtagaatccaagcaggaataaataaattaatgcnacaccaataaacgatgcaaacacagtnttatctaatgcatcttgaccaaattgggcacctactgagtttgaataaatttctttcaagtcaactggtaaagaacctgcatttaacaatkcggcgatttgttttgcttttttaacgccttcttgtcctttaaatccacccgagatttctacgctatcagaattgattggttgatcaacacttgctgcagaaataaatttagggtttttcttttgtgcttcttttttatagctgtcaccttttttgaaatctaaccaaacaaccatgacattatcacgtttcttagagatttcttccgttacttttttaaatttgtttttgtcttttactttaaaagtaactgtaggctggtttgtttcctgtttaaattcttgtttggcagatccctgtttaatatcagaaccgcttaattttactttatcttctgcatcgcgaattgttaaattagcttgagaagataaaattttacgtgcttcattctggtctgttacaccagcaagttgtactctaattctattaggttcttcaacttgaattttaggttccgaaacacctaaaacgttaacacgattttctaatgtttgcgctgttgattgtaaggcttttttatctattttgtcgcctttatttaaaggatcgacttgataaagcacctcaaatccaccttgcaaatcaagtcctaaattgmcattctttataacacttttataagttgcagccattccggcaaacaacaatacgactaaaagcaagaacgcaattattctactacttttcttcacatgaacacctcattatttacgtatgtatttagaatacttgaatactattttataacgcaagtgaaatctttcttacaaaatttattagccttatacatattaacatact

SEQ ID NO: 872 - DNA, 636 bp; double-stranded, linear
ctggttaacaacatctggttcggcatctccttagcttccactaaatcttggatgtcttggnnatcttgcgcaagtngtgctttggcttgttcaatttctyctttagtcatcgcattgttaatgccgttatgaccttgttgaagtatttgattaatacgatctttaagtgcttgtttttccttatctgttagatttggatttcgatcaatttcgtcaattaatgcttgaacttgcttatcaacgtctttattggcatcaatttttgcttttggtatttcattggcatgcacttgttcaatcgcgtggttgcctgctgtttgaacttgagatacagcctgattacttgttgctttattaatgttgttgatgatgctgtttgccaattcttctgctttatttttcgcaataagcttgtcttgatccgtcgcatttgaagcttcgatttcttttagcttattagctaaagcttgattaatagattgaattgccttgtctttagcatcttgtagtcgttgatcaccattaagattatggattgcatcattgactgcttggattgcgccattgatatcattcacatttgtgtatcactatttagcaatgtatttgctagacgttggcatcatcgaagtttgt

SEQ ID NO: 873 - DNA, 659 bp; double-stranded, linear
ctctgaatgcattcattaaacgctgggtctctttatatgaaacgtatttgtcatttttagaactcaatccgtaaaaattgtcaactttctttttaatattatcgtaatcaatggttacattacttaaatcaatatctaaatctatattttctgcatcttctttaaagcccgctatactgaaaaagccttcaatcggctgatcaatcatttcaatatattttaaagctgtgattgaacctaaaccatgtgttacaaaatatgtatcctttttgcgtacattaatttgtttcgtcatagcttcaatccactgatccactgtcttcgcttcaggggattcaaaattaaataatgttacgtcatatccttctaaagttaagttatgctccaaccactgataccaatgatttctactatttccatgcatagaatgtacaatattacatctgtcatctcattctctcctttcaacttactacttcttttctatttttaaaaaaatgactgattacctataattgtaaaataaaaacaccttaattagaaatgttatatcgcaaagtgacatttctaattaaagtgtattgtcatcatttcaatatcattcaaaaacagctaaacctttgtctctgcttcaatttcacaaaaataattcccgctga

SEQ ID NO: 874 - DNA, 315 bp; double-stranded, linear
aaaataaaatccattttagtattcgtagaaaatgagagccccctttaccacaatatgtaaatgtatattgtgaaaagggggcttttatttatgacatagttgttcaactcatacattcagttgataatgcagtgcgttatgcagctatccacttcatatgtatggcgcatacttgatatatgaatatcatcaagattttaaaagtatcgctaattttaaagtcttaaaacgcagattaatggtcatgatgtgttantgcgttttggtttttagagccacgtaattcccanggacatataggaggaaccattccac

SEQ ID NO: 875 - DNA, 482 bp; double-stranded, linear
tacacgaccttgtaactcagctgctttataagctagggcgatgttatcaaagttggatgtactttgagcttggcatttcgttaatacttttaacgaaggatttaatatatgtctgatacgtatatattgattatattcaattcttaatttggataagattgctgataatttgaagcaatcggagctaaatggatcgaaaaatgaataaatttcgattttacttacaggtgatagattgatatcttcacgactcttattttccattawtcgtaattctccagccatgtttattcacctacaattaattttaggaattcaccatatgattagcagttaatcttaagcgctcaaataaataatctccaacaccttgtggaaaccagcgcgattaattgctgtctgcatattttctagccatgcatctctttcaaattcagtgattgtaaaatctatatgtctttttcttagcataggatgtccgt

SEQ ID NO: 876 - DNA, 670 bp; double-stranded, linear
atgcaattgaattcttaaaagcagaaggctttgatgatattgaatggggcgaagattttggtgcgccacatgaaacagccattgctaatcattatgatttaccggtgtttattactaattatccaactaaaattaagcctttctatatgcaaccaaatcctgaaaatgaagaaactgtattatgtgcagacttaattgcacctgaaggatacggtgaaattattggtggatctgaacgtgtggatgacttagaattgttagaacaacgcgttaaagaacatggattagacgaagaagcatatagttactacttagacttacgtcgttatggtagtgtgccacactgtggatttggtttaggtttagagcgtacagtagcatggatttctggtgttgaacacgttcgtgaaacagcgccattcccaagattattaaaccgtttatatccataagttttagggtcgttacttaaaatatatattatgataataaaaagaatcgtccagcctatattaatagctgggcgatttattcttggaaaatgaagattgataacggcttatattaatcatgaacaaacttttgtttagtaactatatttggaaaataaatagttcatctgattatccataaagttcattgttaaaatctagtgttaaaaaatactgtt

SEQ ID NO: 877 - DNA, 1258 bp; double-stranded, linear
tgcaaagtaaactggatggctntcttgccgccaaggatctgatggcgcaggggatcaagatctgatcaagagacagatcctaacctctcatttccgataagtttagtatgtattataggtgatgattntcttgttttcaaccttatacacaatatttttganatttatattatattcatataaggaaggcgattaattacgattcatcattatatctctacgtgttaatttattaacctatactatatttatcaacacaacagtttttcctttcattttcaaacataacagaaaaagcctgagacatacttagtcccagactgttctataattaattaaagatataacaaggttaatcattcaaagctaacatcacatttattcactgtaatttttcataaagaataataatgactgtaattctatacctaagtcaatttgatgtacttgcacatctgaaggcgtattaattctaccaggagtgaagtttaaaatacctttcacaccagcttggacgagttcatctgcaactttctgtgcaactctttctggtgtagttagaatcacaacatctatttcttccttcttcaatgttgttattaattcatcgttatctttaacaataacgttccctattttctggccaataacatcttcttttacgtcaaacgcttctgtaatcgtcatatcgtcatgtattgaaaagttatatgtgagcaaagctttccctaggttcccaactccgacaattgcgattttgatcatgtcactctcgcttagttcagatttaaagaaatccaataaactatctatattatatccgtacccttttttacctaattcgccaaaatatgaaaagtcacgacgaattgttgccgagtcaatttgtaacgcatcgctaatcgcttttgaatttacacgatctatacctttagattttaatgaactgacaaatctataatataacggcaaacgttttaaagttgctcgaggaattttaacttggtcactcattcgctatttcctccttcgtgtttgaatgaattatatctatgtattcaaacgagttagagcgtaattgttagattattaaaaracaaataattgattacaatgaatacctaaatattatacattawtgaattttaaaaataaatatcttagtttcaagacggcgttttatactgtaaaatggttattaatgtaataattacgcttgtttcataagttaataaaatttgagaagacgaaggtgaag

SEQ ID NO: 878 - DNA, 546 bp; double-stranded, linear
aaacaatccccnccaaagtaattccaccactaattgtaaataactttggaaaggatgttgtttgtnattcccatggacacatgccatctnatttaagttttatactctatttttctgatgtcttgattaattgcaagcggtcttgcgagccttgttcaagctcatattctttatctacttgcttaccgttttcryttattaatcttacggttgcggtaatcttatcaccatgtttttcagcatctataatttgtggtgaactaatcatcattaaacttcctttagatacacgcttctttacatcatcataaaaagatgatcctttttttatatatgatgatacaaaatcaaaatccgactgattaaacgcagcattattcgctaaagaatatccagcaaagaattctatcaatttgttcttcaagctgttttcttctttttctttcttttcaacatagtcttcgatatcttcactgtcaaaattcaaagttatctctgtattgtattttaaatcgctaagctttaatcgtcttcgtctgtgatgta

SEQ ID NO: 879 - DNA, 870 bp; double-stranded, linear
tttatgaattttttatgtaacattaaatattcttctggcaatcttcctactatktctkttatatatccttcttctccttctttaaatactaaacctgtgggagttagtgtgttatacctaatttctatctcattcaaatgatcattcaaaaggtcaaaaaattctctattaaaataaccccatttcccattttgtaataaatatttctttccatcttccatttcaacttctgcatgtagtatcgtttttagtagcatattatttgaatgccccaaattatckatcacktcaattctgacatcatttatagaattaacgtcatattttaataagtaatctcctatttcagtgatgtaatcaacttcaggatcagtcgcatcaaatgtctctaatgtattatttttaaaagaatttatatatatattgacgtcgagcatatcatctaacaagagtatcatattacttagttctaaaaatcttgatatatctatagatatattttctgtagttgaagaattcgatagtttttttagcaataaagtatctaatacttctattttattcaagtcttttaaagttactattctaggaaattcactaattttttgaggaagattaataatagcgtttatttctttgattatcacactaattttatctatgaattgctgctttctattcggtacacgcaatgaaatacttgtaccacaagtccattgtttttccaaaaatttgaggattctgtggatgtccttggactggatatataagattctgaaggtctaacgtaatctacactattccttctataattaacaatctctttaagcctgttttgttgaaaaaaattaacatttttantaactangg

SEQ ID NO: 880 - DNA, 400 bp; double-stranded, linear
ggtttacatctttatcaactgtaatttcattgacatcttcattcatatttaaaacaccattaaatgtccctgaatattcacttgtttgtttaactgtggcagtgacttgtcgttaccatatgtcatcatatattgtgcaaatgttaaagtccccattgagttgaccgacaaagttgaatttatcgaattgtattcagattgtaaacttagcagacatttttaaccacgagcattcttatccaaatagnccttgtctgttattttcaagtcaattttcacaataggatcactgcatcttttcttagttccctttaaatgcactgaccatcctttgaacgggaagccaggatgaatcttagtaccctctttttctgctnctcacataactttcagatggact

SEQ ID NO: 881 - DNA, 333 bp; double-stranded, linear
aagatattgcgaaaagaagtgacagtaacagaggaatttcaaaatttattcaaccatatattgaaaattgatgaaatggtgcatgcaaatgaagcgcgtattgcgtatgaagcagacatgcgaaaacctttatatagtaaacgcatttatcaaaatttaacattagactctattgtttttagaaatacattgagatatacagcgattatgatgatagcggatatttattgcgttaatgtttgattttgaaaaagcatcctggatcccgttatctgcacatccantattcctagggccatcancctataccatgccatccgagagaggtatggn

SEQ ID NO: 882 - DNA, 617 bp; double-stranded, linear
attgaaagaaaaactgacgtacttatccgatgataaaatgaaagaagtagataatgcactaatgattagtttagggctgaatgcagtagctcaccagaaaaattaggcgtctattatatgtatttttcagagataaataaaatattgatataaaagacaataactttataataattataactatttctaaattctgtacgaagaattttcttataaacaaagattttagcaaataccagttatgatattcatattttttattataaaaggatgtcttaagttttttaggctttaggtattccatcctaaagtttttttagcttaaaagtatcatctacagcaaaattgcaaacgacaaaattgataagtgcaattaaataaatgttagtaagtgaatcataattatccttgcttaagcatttgctttgtaagggaagtgaggaggcaactaatcgtggaagaatttaagcaacattataagggtttaattgatgaaagtttaacgtgccaagataaagtagaattgataaaaaagtgtgagaaatacactgacgaagtgattcgtaaggacgtcttgcctgaagacattgtcgatattcactaaaactatatattga

SEQ ID NO: 883 - DNA, 583 bp; double-stranded, linear
gttgtattaaaatttttcaatttaacaacgaaacaatacgaagaaaaacatattactgagccactggaattgacgagcttattaggtantatttctcgtctagacaatggtcattttgcacatttgcatgctactttcggtactcaatcatatgaaacttttagcggacatctcgctaaagcaattgtttctgcaactgctgaaatcattcttactgtaactgatttggacattcaacgttcattcaaagatgcagtcggtttaaatttacttgatcctcaatagcactttactttttagttgaatcaaattttattacaagttatcataagtgcttaatcataaatgcattctcgtttattaatatacttcaacgagttaaattaaatttttaattaggaattgaatgcgtttataactatcacatttgaatgaataactttttcattagaaagtagtgtktattattgatgcaatctcgatacatcgctagaatttacttttaattttatttatcgtctcccttnttgagactaaaatttttcaatttatgactttaaatttgtttttagcatatatacct

SEQ ID NO: 884 - DNA, 524 bp; double-stranded, linear
gcagagggcttacgataaaaagaaaaatctcgctcgcccgcttcagtcaaactcacaaaagctaacgcatgwytgctycattcgtgcgatacacttttgatacatctacaccaatacttgatatcgtttcaataatgctatctccaaatgcatcattacctaattgtgtaatcatatacgcttgttgtcctaacttttgaactgtacaagctacattgcatggcgcgccaccaatttgcttcgtaaatgtttgaacatcttttaaattcgcatttgtaacatttggaataaaatcaattaacgcttctcctattgaaaatagacgtctcatttatgttcatcctttaaatcatatttagtaaattgtaaatatacttgccctgattctgttgatgttttaatacctagtgcgtcttctgtcgggaaaattcgagatgtcaaaacacgttctccatcattacagaaaatttctatactagatgtatcaacaaaaatttgtaattgctttaatggcgtgtctaata

SEQ ID NO: 885 - DNA, 400 bp; double-stranded, linear
ttaatgatttcttcgtatgattcaccaacaatttgcgctaaaatatcatgcgcaagtacttcaccttcaaccataaattctatttgctctactaaaaattttacgtcattcatgctattcatttttggaattaacaaagcatataagtttgtaaattcttttaaatacgcagcatcagcttttaagtaatggcgtaatgcgtcactcctatatctccggataacatcttctgaataaagtcatcctcataaatatcataatgatggcttgcagctgggtacaattttgtgaaattccatgtaaaaatcctccctaaataaaaaactacttccaacatgaagagttgaggcatgtgcaaactagcccatcactcataacacttccacgtgggactaccaac

SEQ ID NO: 886 - DNA, 857 bp; double-stranded, linear
aagaatttaaacaaaatgatatttggaaacattttaaagctgtgaaaaataatcatgtttatgacttagaggaagtgccattcggtattacagcaaatgttgatgctgataaggcaatgactcaattatatgatttattttataaggataaaaaatagtgagttgatatgatgataaaaaataaaaagaaactactatttttatgtttgttagtcattttaatcgcaactgcttatatttcgtttgtaaccggtacaattaaattgtcatttaatgacctatttacaaaatttacaactggtagcaatgaagcagtggattcaatcattgatttgcgattgccacgtatattaattgcattgatggttggcgcaatgttagcagtttctggagcattattacaagcagcactacaaaatcctttggcagggcgaatatcattggcgtttcctcaggtgcacttataatgagagcctttgtatgttgtttattccacaattgtacttttacttaccattattaagttttattggaggtttaataccatttttaataattatattgttgcattctaaatttagattcaatgctgtaagtatgatattagtaggtgttgcgttattcgtattattaaatggtgttttagaaattttaactcaaaaccctttaatgaaaattcctcaaggcttaacaatgaaaatatggagcgacgtatacatattagcagtatcagcattattgggattaatattaacattactattgtcccctaaattgaatttactaaatttagacgacatacaagcgcgaatatcggttttaatattgatcgttacagatggttaacagggttatta

SEQ ID NO: 887 - DNA, 675 bp; double-stranded, linear
gatttattttaatattattgttagaaggaatttttacaaattcagcgagtgcaatcgaatattcagacttacatcataaaagtaagtttgattcaaagcgtctaagtaatgctaagatgtcattcatcaatccaactcagcttgaaaataaaaacacaaacgatagactgttgaagcatgatttgttatttcatgacatgttcgtaaatgatgattggaaaaaggattttaaagttgaatttgaaaatgaggcactttcaaagaaatttataaataaggatatcgatatatttgctggaaattatggatacggatgtcatgggggagcaaccaataaaacgcaatgtagttatggtggtgttactttaagtgacaataataaatacgatgattataagaatataccttgtaatttatggattgacggacatcaaacagaaatagaactaactgcagtaaaaacgaaaaagaaaattgttactattcaagaattagaggttcaattaagaaattatttgaatgagaagtataagttgtacgaacaaggtggcgacattgttaaagggtatgttaaatattataatgatgatgaacaaaatgtagaatatgatttttataatttaaatggtgagtatggtcgtgaggtattaaaaatgtatgcngataatnaaacna

SEQ ID NO: 888 - DNA, 851 bp; double-stranded, linear
aaanaggatataaggttaataatggaacatagatgataagtgtatatcgtcgtaatttaaaattcctaattaacaatgccttcatttaaaaaccttcttccatcaatttgatgttttcatgatatttaggttttctcttttcaagataaaccattaagtyctcaatagaaggtgtagtgatattcactttakgacctaaaatttctttaaatacttgcgcatgttctgttaatcctataaatcccgtacgcttatgttcttcataaataagtagagatgctaattcatcatcaaggtcctcaatagcaccactcacaacttgatatctttgtaacagttgttcttttgaaccatttaagataacttcaccgtcacttaagtgaatgatataatcagctattttttctaaatctgagataatgtgtgtcgacatgaatattgttttattttcatcaattaattcttgctgaattatctccaatagctcatttctagctaagggatcgagacctgaagtaggctcatcaaaaatatacaattcagcatgatgtgaaaatgcaactgctagtgataatttcattttcatcccagtcgaaaatgtttttattgatttattgattggtaaatcgaacttttcaagataaaattcaaatacttgatggtcccatttacgataaaaaggggcaatcattttttcaagttgcttcgtagtccatctctcattaaaataattttcagagtaaacnaacccaattctattctttaactctatcggattgagagccatatcctcttctaatactctaataacaccagtttgtgggtgatacaaatccataattaacctaatn

SEQ ID NO: 889 - DNA, 362 bp; double-stranded, linear
aatcaccttcacgccaatattgattttcatgcgtaaatacttgtgccgtttcatgatactttgtcaatcgtgcgtgttgctggggggaatatttttcagtagcccaattggctgcatgaccttcaatggctagttcaattgcaggattaattaaatcttccaatgacaatttagcataacgcttgtgaatataatcaaacagctttggaattgctggcacacgacagttttaccatgtgtagtcatatcaaaaaatgatttatattcgcctgaatcanctagataaaattggttggctacatggtcagggtgctggctcacggtgcatcaaacgcngntaatactgcccagtacctttgctc

SEQ ID NO: 890 - DNA, 747 bp; double-stranded, linear
ttggtttattcccaaaaagtacgcgaaaattagtagagaagaatttgaaagtttaaatattgtcaaacccgctaaaaataatactttctggcctgttgcaggatttgcagtgttattaacaaccttaacaagaaaatatatctatttgcttaacatccatttagaaaaagaaatagttatattaacatgctgtatgatacttctaggtgttttcgcattgtttatatatataaatacaaaattgaagttacatatttttgataaaaataaaagtaataacgaaaagatcatattaatacctacatttaaaaatatttgtttatccttatttgcttatatattatttggtggattgtcaacaatggctctgagtatgttagtaacttcatcccctcaaaatataatagaatttcttgctttaattggcatgactgcatgcttctttctactgaatatgtcatcggttctagataaaaaaattcatgttattttaaaaacaaataagtagtaaaattgattaacttaggtagtatcggatacttaaatgttggttcataaaaagcaatgattttaaatcgaggagctatcttagaacagggaaataaaacagccaaagttataaaaagtgaattaataactaattatattatgttagccacgcttcaaataaaanataattagaataaggtgggattgataatcaangctangcgaatctaaaatcatcaataaaaaccccaaatatag

SEQ ID NO: 891 - DNA, 526 bp; double-stranded, linear
attttgaaattttagcagatactgataatggtctcgatgcaatgaaacttattgaagaatataatcctaacgttgttattttagatatagaaatgccaggcatgactggacttgaagttttagcggaaattagaaaaaagcatttgaatattaaagtgattattgtaacaacttttaaaagaccgggatactttgaaaaagcagttgtgaatgatgtggatgcatatgttttaaaagaacgttctatagaagaattggtggaaaccattaataaagtaaataacggagagaaagaatatagcgccacattgatgacttcattttttgtagataaaaacccattaacgcccaaagaacaaattgtattaagggaaattggcaatggtttaagtagtaaagaaataagtgaaaaattatttttgacaganggaacagttagaaattatacatctgttataattgataaattatttgcagataatcgttttgatgcttgggaaaaggcaaatgaaaaaggctggaccta

SEQ ID NO: 892 - DNA, 751 bp; double-stranded, linear
tatttgatgtaaaagcgaangaaccatacaatgtaacaattactagtgataaatacatccctaatactgatttgaaacgtgggcaagctgatttatttgtagcggaaggttctatcaaagatttagtgaaacataagaagcatggtaaggcaattataggaacgaaaaaacatcatgttaatattaagttacgtaaagatattaataaaatctattttatgacagatgttgatttaggtggaccaacgtttgtcttaaatgacaaagactatcaagaaataagaaagtatacaaaggcaaagcatatcgtctctcaatttggattcgatttgaaacataaaaaagatgctttagcattagaaaaagcgaaaaataaagttgataaatctattgaaacaagaagtgaagcgataagctcaatatcaagtttaaccggaatattattatttgtaacatcatttttaggtattacattcttgattgctgtatgttgcattatatacataaagcaaatagatgaaaccgaagatgagttagagaattatagtattttgagaaagcttggatttacacaaaaagatatggcaaggggactaaagtttaaaattatgtttaattttgggttacctttagttattgcactatcacatgcatattttacatcattagcatatatgaaattaatgggtacaacgaatcaaataccggttttcatagtaatgggattatacatttgtatgtatgctgtttt

SEQ ID NO: 893 - DNA, 357 bp; double-stranded, linear
ggatgttgtacattattcagattactttgaaggggcacaaaaatatttgagctatttaaaatcaacagtagatgttaactttgaaggtttgaaaattgctttagatggtgcaaatggttcaacatcatcactagcgccattcttatttggtgacttagaagcagatactgaaacaattggatgtagtcctgatggatataatatcaatgagaaatgtggctctacacatcctggaaaaattagctgaaaaagtagttgaaactgaaatgattttggggttagcatttggacggcgatgggagacaganccatagcagtaagatggaganggnccaatccgttgacggtggacccaat

SEQ ID NO: 894 - DNA, 464 bp; double-stranded, linear
gctaacctgcaaaattcgataagcgattcaatactgacgcctgcatttcgcaaatttttcactaaataaatccaatttaaatcactatcattatatattctatatccattttcatctcgattaactggtggaatcacaccaaccttttcataatatcttaaagtgtcttgagatatattcatgagcgctacgacttctttagttttcattgcgactatcctttcagttatgtttggtcgtctaaagtaatgttgctttatatattgtcatcttcgtttgaatacttcttattttattactcaaatttaaatttgtctcttttttaacattttacatttcatcgtttttaattactttaaaaattgtataactkaaatatttaaaatgatataawcactaagattgataatatttaattntttggaaaattatnttaagttgccaattttggggggatgcggaaa

SEQ ID NO: 895 - DNA, 599 bp; double-stranded, linear
anaatgaaagagttacaggactttattgctcgtttctcagtaacgcttctaaatctaaacaagcaacaagtcgtaaaaaacaactcgagaaaattgaattagatgatattcaaccatcatcaagaagatatcctttcgttaaattcacacctgagcgcgaaatcggtaatgacttactaatcgttcaaaatctatctaaaacgattgacggtgaaaaagtattagataatatttcattcacaatgaatccaaatgataaagcaattttaattggggatagtgaaattgcgaaaaccacattgcttaaaatattagccggtgaaatggaaccagacgaaggttcatataaatggggtgtaacaacgtcattaagttacttccctaaagataactcagaattctttgagggcgttaatatgaaccttgtagattggttaagacaatacgcaccagaagatgagcaaactgaaacatttttacgcggcttcttaggccgtatgctatttagtggagaagaagttaagaaaaaagctagtgtactttcaggtggagaaaaagtacgttgtatgctaagtaaaatgatgttatcaagtgcaaac

SEQ ID NO: 896 - DNA, 1057 bp; double-stranded, linear
tcattagtagaaatcgttaaagatgcatcttgcaatttaaaatccgaatctttgtattgtttgttcacactatctacgtttaacaatgttgtcatatccatgctcctctttgtttaattttaataaaaacgtcttctcttcaataaataactaaaggcgttatatatgaaaatagcaatgataagtagcaaactaaagctttgattaattccagtagtaattgaataaagcccaattactacaatggctagtatcaatattgataagttgatcgcatatgttttaaataatgcaattaattctatatggcgttcaccttcatccaatatttccaatcgcttttcagtgtaattcttatctgcaatttttggtattctgtcatcaaaccttctattaaacagtgtaaattgtgtattgaaaatagcactagcaaaaaatggtattaaaaagaatagtattgcatttgctgcagcgtgccctaccacaaaaataagcaatactaaaaaagcaataactgtctgcagaatacttaatatacttccatttaaaacataacgattcgcaagcaactcatattgatctgttgcatcgatatctacctctttatctacaagttgcttatacttcaatgcacgtctttgattcatcaaaacaatggcttctaccaatatgataataatcgtcgcaacaatcgatattacaacgacattgttatatgtcgcaaacgtcaagttctcaataccaaatccatcaaaattacctaaaattccacctatgataccccctacaagtccacccagtaaaagatatccgatatatcttagtattttcatgcctcatcctcctcaataataaaaacagttyccaccgtttcattgaaaatgcgagcaatttttattgccgttaatactgatggcataaaattgtttcgctcaattagcgatatggtttgtcttgaaacgcccgcttgtttagcaagttgcgtttggtttaagccatctcgtgctcgtaattctttcaatcgattacgcacatcgcatcaactccntaattacac

SEQ ID NO: 897 - DNA, 336 bp; double-stranded, linear
aaattattgagttaacaaatcattacggagcacataattatttaccattgncaattgtcatttcagaagccganggggtatgggttaaagatcctgaaggcaataaatatatggatatgtganctgcatattccgctgttaaccaaggtcatagacatccgaaaggtattcaagcattaaaagatcaagctgataaagtgactttactctcacgtgcttttcatagtgataacttaggtgaatggtacgaaaaaatttgtaaactggcaggtaaagataaagctttaccaatgtaatacaggtgctgtaagcagtagaaacagctttgaaagcagc

SEQ ID NO: 898 - DNA, 302 bp; double-stranded, linear
tgntgntttcttattgttgaccaattattttgcataccaaatccaaatcatgtatttatcaatcacatcctaatgctaaatccaatgtattacattgtttaatggtatagcacaatctatcatatttggtatatcaagtatggaaaacattccatatcatttttactttattttattcttatgtttaatagctgcagtaaatttcgtattagcaggtatacgacacacggcaatttataataaaacatctaaagtgacacaaactgataatcaacagggagtttcaaagatagtcagacggg

SEQ ID NO: 899 - DNA, 469 bp; double-stranded, linear
ccactagctgatacagtaggtataccaagattcgtcatcgttacgacatatcaatttggtcaatatgcgatgttattcttagcgccgactggacttgttatggccacactacaaatgttaaacatgcgatattcacattggttccgatttgtatggccggtagttgcttttgtattgattttcggtggcggagtactaattacgcaagtactaatttattcataatttgaaatgctatattataaaaaatactaatggggttttatgcatctcgtaggtttgtagaaatactaaactaagcgaggtgcattattatttttgattaagaaaataatgacggtaatgataacactagtaagtaattgatacaatgctctatttaataatgatatttttaaaatttgtttttaatgtaatgttagatctatggtatattatatttaacgtggtaaatatgtatttgctgtaa

SEQ ID NO: 900 - DNA, 821 bp; double-stranded, linear
ctttattggtaactctctataatattttaacatttttacgctatcgtgcaaacgcaaccactttgaattytctgatatttttagcatataatttacaccctgcacgatgaattgttaatccagttgtataaatatcgtcaacgagtaatatttccttaccatttaaatctaattccgtatcaataataaatggattttcatctgccagacgctctttcttagttaaatgagactgttttggtctatttgacatctttaaaatcttatcaaagcgaatccctttagcttttagtactgcttctaccgggttaaatgttctagataaatcatgtgccggcgaagaaggaattggcacaatatagtcataagatgtttgtggtatttcaatcaaatgtgccaataattcacataaataatagtctttcaaaaatttatactgatgtatcatctctttcattaaaccgtcatattgaaattgacaatataattgttccattaaattaaagtgtgccgatagaaacttgcagtctaaacaatacgcttcatcttgatttaagtgttttaagcaccttgaacatcgccttgctttaatatcaagtttaatattgtcccaattctctttgcatctgtcacataatctattaggtttcttgaacaaattataaatggttatattttcatataacttagcaccacaactcaaacaattattcatcaatccaacctctttttaatgctaatttgttcatcctttgaatctcttttttagcttgaatcatattcatacttaccccttncatgaaaaaacaatactttttcca

SEQ ID NO: 901 - DNA, 349 bp; double-stranded, linear
tgatgctattaaaaagttaattgtgcggtctgttttgataattttaataataacttcaggtaactaaaaatcctaatattgaaaaaacaaagccatttaaaacataacctagtatattccatgtatgattgtaactcatttgccagttntgtactgacttgcataattctgtcacgtncgaaccatgtacaagcctgcaactactgctgaatgattcctgatgcgtgaacaattcagcaattaaatacgtaacaaatggtgttacaattgaataattgaaacatattaatgtttcatatcctcgacgncatcaatgttaatccggaccttactaatgcatacctataag

SEQ ID NO: 902 - DNA, 390 bp; double-stranded, linear
caagtggtataaatttacctggtgaaatgtaggtcgtggtggcgatgatacattattcgctaaaatcgacggcgttgttaaattcgaacgtaaaggtcgcgacaaaaaacaagtttctgtatatgcagttagctgaataattttgtctagttaacaccagaaagtgaatcttctggtgttttttactttttataaaatgtttttcattattattttcattatgntatttaaaaatggggattttagacgttatactaaatgtgcactgtataggggccctaatcactaactatagggggacaaggatacagtgcagcgttaaggataactgnccacattggtctgggaatataggatttaagcaaggttataaagtactcntaggcccta

SEQ ID NO: 903 - DNA, 334 bp; double-stranded, linear
ggaatagacgtatatgcgcgttgaatttaatcctaataagctttcgcatgatgaagtgctttggttaaaacaaaatatcatcagttatttggacgatgttagttttacgagattagatttggcttttgattttgaatttgatttaaaatgactattatgcattgtcagataagncggtaaaagaaactatattttatggccgaatgtaaaaccagaacaaaatattttggtgtncgaatagtgaaggtttatncggatttataataaaacaagacgtaaagataatgcagatgttgaattgattcacattctatgcggtggaattgattaaacg

SEQ ID NO: 904 - DNA, 334 bp; double-stranded, linear
caagttggggacactgtttcaaatgaaacaacagtgtgtattttagaggcaatgaaactatttaatgaaattcaagcagaaatttcaggtgaaattgttgaaatcttagtagaagacggacaaatggtagagtatggccaaccgttatttaaggtgaaataatgaaaaaggtttaattgcaaaccgcggtgantcgcagttaggattattcgcgcttgtcgtgatttaggcatccaaactgttgcatctttctgaggggataaagatcgctacatctcaaatgctgatgaggcatatncgtgggccncttgtctaaggtcatatttaatatccg

SEQ ID NO: 905 - DNA, 399 bp; double-stranded, linear
ttcaccctgtaattcttaaccgtcaattgacctttatgcagatttaatattcctaaaacgtataactcttctaatgataattgacacatatttaaataacactttagattccgcaataattcttgtgacgacaataaatacgatacatagtcacaactaaaatcaaatgtatattgaccaaaataacgttcaatatagtcactaagctcattattcatatattctatttnatctatatgcattttattaatcgaaatagtcaatttacgttgatccctttgatctcttcctttcaatagccattgatgattgtntaaataacttaacatttgaagaagggccatcttagattggatttctttcattnttaataaactatctattgaagcgctattggaa

SEQ ID NO: 906 - DNA, 1478 bp; double-stranded, linear
tacatttttcaatttatggcaaaatncacaattttcatcgaaatattttgtananaatcattgctaggtgatgagttatctcggttaattacaaaacgatatctaagtttaaatattagatcataaaaaaactatctactgaatatccctccatagcatcatttttctaagcaaaagttaaacttagttagataaaatgcaaatgagattattgtagatagtctctttttaatgtttaaaaatgattaatgccataaacataaataattccaaagaatgccgcgccactaagcactgttaatataagacttagtaacaatgtgcgtttataatgtttaacaaatgctatgaacaaaatgactacattatacgcaaagaaaagtccgaataatgtcattgttattttcaaatcagaatagaaaatatttaatagtaatacaatgactgcataaattaaatacggaataactataaatttgcgttcaaatcttaattgttcgaaacgtttatcttcgtttgtcatgatatgctcctttatgatttaaaagtaaataagtttacggaatatcttgtccgataatagcggtgtaaatgtcaaaccacgactgatcatctaaattaagtkgtagcccttcgattgcttgatcaatacgctttaactgacttgttccaagtatccggcatgatacgatgcggtatttttactaaccacgctatcatcacagctgtgtcactyacacmatatttgtcagctattgattgaacaactttcataatacgttgcgctttaatatcttccttgtcgaaaattttaccgcctgcaaaaggactccaagccatgatttgaacatggttttgatacattgaatccattgttccatcttgtaaactatcaacgtgatatggcgataattctaattgattgatgctaatatgtagtctttctttcataatatattgatttaacaattggtattgtgaatgattaaaattcgacaccccgaatgacttcaacttaccttgtttaacaagtttagttaatgcatcagcaacttgttctggatccatcaatggtgaaggacgatgaatgagtagactatctaaataatctacattcaaattgattaatgactgttcaacagatttcacgatgtgcttactactcaaatcataacgatgtccatttgtaaaatcaaattgcttagaaggcaaaatgataccacatttcgtaacaatttgaattttatttcttaattcgggtgataaatccaaagcattaccaaacagtgattcacattgataatctccataaatatcagcatgatccatcgttgtaattccacgttcaactaattcatttataaaataatttaactctttcgcagtcatcttccattcatttgcacgccaaaaaccttgtacaagcctagaaaaatgaacatagtgattaatcattatttgttccatatntcatccac

SEQ ID NO: 907 - DNA, 543 bp; double-stranded, linear
ttctatgagaatagatattgttaaattaagaaagtagtcaattttattatgacaaaagaaagaagaacatttagttcagagtttaagttacaaatggttagattatataaaaatggtaagcttaagaatgaaattatacgaaagtatgatttaaaaccctcaattatctcaaattcgataaaacaacaccaaaatactggacccttcaatcatcaagataatttaaaaagtgatgaaaaagagttaataaaattacgcaaagaagttcaacatttaaaaatggaacatgatgttttaaagcaaattttaaagttgatttagaaactgaactttttaaagatacattacttgaagattctaatttatctgattatataaagaaccaacttccaacgatatggagagactaagaaatagtttaaatttatttaatttcaataaaaactcataataatatttaagtaagttagattgcttttagcattaggaattcgcttataattagatgttcaatatagacttttttacacatacatgaactat

SEQ ID NO: 908 - DNA, 751 bp; double-stranded, linear
tttncggtngaacatgattncgatattacttctaaaacgattcaaccaaaaccaggagaaagtgttggacgtttagttaatgtcgattgtaaagatacagtactggagtattcagaattagatccagaagttgcaaatcaatttaacaatgctaatatcggtattcatgcatttaaacttggttttattttaaacgctgtaaatcgtgagttaccttatcatttagctattaagaatttgaagcaattagatgagaactttggtgttattgaacaaccaactttaaaattcgaattgttctattttgacatatttacttatggaactagttttgtcacgttacaagttcctagagaagaagaattttcacctcttaaaaataaagaaggtaaagatagtgttgcaactgcaacagaagatttacgtagaatgggtttaatttaatgataggcggtgactatgatgtccaaatcaactaaaaaaagtaatgacacaatcgtagaaacatttaaggatatcatccctttatcatttggagaagaaattggtaatgcggcatctcatggtgttgcagctttgttaacattattagtgttaccctatgcggctgtgcacagttatattgcacatggtacgcttgcgtctgtgagtatgtctatttatgttatttctatctttatgatgtttatttcatctactatttatcattctatgcaaaatgaaacacctcataaatatattttaaggatta

SEQ ID NO: 909 - DNA, 394 bp; double-stranded, linear
aaattgtcacaattcagtctaatttaaaaggaagttaattacaaaattaaaaaatcatgcatcgtgtcatttagatattgaaaaagatgagtcaaatttgtttcatatattttccaataacaaattattatatctaaatatacaatcagaaatatatgaatagaaatatcaataagaaaaataatatgattaaaaatgatgaatggcatacttataaagtgtctaaatattggcggtcaatattacttacaaacacgaatgttaagtaatgtagacaatgctgaaaaaacaataagtagaaactctatatagaatgttcgtttttatttttaataattgaataatcattattgggtggattttaatatggnattccggtcggcacacggattac

SEQ ID NO: 910 - DNA, 1022 bp; double-stranded, linear
taaagctaagaaaaaagaaaaacgtaaagcttataaccaacgaatgaaagaacgtaggaaaaatcaacctagcgcagttagtcaacgtcgaatgaattttgaagagcgacgtcaaatttacaacaatgatatttctgaagaacgcaattcaagtgaagttaaggacaaaaaagagcaagaataaatattgatgatacccagattagtaagcagaggtcttttgcttattaatctgggtttttatatgaggttaattatcgataacgtttaattaaagtgtttaggtgtcataattttaaatgacgatttccccattackatacacctaaattatcatcaatctgaattcagatgtttatkataaaaattagatgaaaaatatgttaatatacaagkaatttaatgtgcgkatatctataggctcgtagtatacttattaaaatattaaacaaagaaaggattttaagatgaatagaaaacctgaattaatcatggcttggattgcaaatagtattagtattatttatttattagttatggggctatcctatttttctttaaaaagtggtaatgcatcacaacgtgaagaattagcgaagcaattatctcagaacggtggcaaggtttctttagatatgcttcagacaacaatgggtgcattagcaattattttattaatttcaacactttatggtatatttgcgacaatttgtattaaaggacgtagaaaattatcgattatactttttgttatcgcgataattgtaagtttgatggctcttaatttaattgcaattgtcttatgggttatcgtgatgattatgttgatttctaaaaaagaatcaaaagaaacaacacataaggacgatgagtatatttatcattaatatgttcatagcaaaagaaaaaccattaaaatgttaagttgttaattattagatacaaccaacattttaatggttttatttttaactttgtagttcttggaatgtttgaacgattaaatagacatttaaaatact

SEQ ID NO: 911 - DNA, 274 bp; double-stranded, linear
ggtactttatttttatttttggtcttagtgatttttacattatttacatataaagcgcctaatggtatgcgtgccatgggtagcattagctaatgcagcaatcgcaacatttttagtggaagcatttaataaatatgtnggtggcgagtattcggtattaaatttttagaagagctaggagacgctgcggaggtctaggtggtgtcgctgccgctggattaacagcattagctatcggtgtgtcaccagtatatgcattagttatagcagccgc

SEQ ID NO: 912 - DNA, 679 bp; double-stranded, linear
ctttaattgttcactttatcattattatcaatcaactctatgatatgaaattgtgttagagataaatctagttcctcattttcctttttatactgtcttcttttatcggcattttctctttctataataaattgttgtaattttaaaataacttctctcttcatatccactattattcctcctcttcattagttaaccggttaactatattattgttgtcactcccatttttgtcaaatattgttgtaattaacatatatttacttagttatgcaccatttattccgcatttcacaaatccacctataatacaaactatcattttaaataagcagaatttaccctgtcttccacacaaattgttttcgacactttaatgtgcctactatccaaaaaagttactcataacaaattgcgcattttaataaatgtagcaatgccatttgcatgctgcaaaaatactcgtattcatatttatgttttatattattaaagttttttaaatccatatttttataacacttgctatgtgataaaattaatnttatatataaaatcttaagattcagattatttaatagcaaaggagatagtgatatggatgttttaacaatagaacatttaacaaagaagataggcaacaaaacgattctcgaagatgtatcatttaagctgaaac

SEQ ID NO: 913 - DNA, 564 bp; double-stranded, linear
gccatccttcagtgctaattttttcaaattctaatgcagatgcaccactaaccataccatatataaagaaaaagaccacgaaagnaataagtagtagtatagatgcacatatcataatgacattggagttttcagcgccaaatttaaatgtcaatgsgaaaatgatagagtatgcccctatgataccaaaactcattaaacctgacataataccaatcatcacactttgggtcacaatcgtagtcacaactaatccaatcattaaacttgcaccgaataagattaaataaaaggcaaagtatgacttaatataatcactacgtttaaccggtaaagtagatacataatacatccatcttgagtctttttcatgtttaatattatcagtaataggtgtgattaacataaccccagccatkgccgaactcatcaacggattaaatactgcaaagtatcctgcagctataatagcgactataaaataaatatatgtttgcnttctcgttgcataaaaactacttaggaacatacctttcattatacttcacctcgcattatgatttt

SEQ ID NO: 914 - DNA, 643 bp; double-stranded, linear
aaagaagaagcaagtgcaaataatttaagtgatatatcacaagaggcacaagaggttcaagaagctaaaaaagaagcacaagcagagaaagacagtgacacattaactaaagatgcaagtgcagcaaaggtagaagtatcaaaaccagagtcacaagctgaaagattagcaaacgctgcaaaacagaagcaagctaaattaacaccaggttcaaaagagagtcaattaactgaagcgttatttgcagaaaaaccagttgctaaaaatgacttgaaagaaattcctcaattagttactaaaaagaatgatgtatcagagacagagacggttaatatagataataaagacactgttaaacaaaaagaagctaaatttgaaaatggtgttattacacgtaaagctgatgaaaaaacaactaataatacagctgttgacaagaaatcaggtaaacaatctaaaaaaacaacaccttcaaataaacgaaatgcatcaaaagcatctacaaataaaacttcaggtcagaaaaagcaacataataagagatcatcacmaggtgcaaagaaacaaagtagttcmagtaagtcaactcaaaagaataatcaaactagtaattaaganttcaaaaacaacaaatgctaantcc

SEQ ID NO: 915 - DNA, 400 bp; double-stranded, linear
aggtttaagggaaaaatcctacctggagagattcaaaaactaaatggactatttccaaaaataaagggcaatcacatggtggttcttattggaagttaataaataacaaaggaaaaagaatagcttctttaactaaagaaggaaaaatcttaagggaataaggtgttgtaaattatgtgctttgatataaataatttggatataaaaaagttgaattttagaaaggtaaaaaacgcaattcatttaagtttaagtggcgataaataccagtttttggaggacggtaaaactatcaataatacttattttttagctgtatatgataatgcaataaacatttttgaagatttgttttcgccttctgattctataaatttggntcatgtagtatatgtttata

SEQ ID NO: 916 - DNA, 400 bp; double-stranded, linear
cccaaagttcgatagtgtattagtattatcttaataaaatgttaggtacaataaagatgattatatatcggaggttagtataaaaatgtatgtagatcgaaaaccatcactatatttagaggatttgcgacatgattttaaaaatagtttaagtaaatttgaaaatggtgatgaagcatttgatacgttattaggtttcgtagagttagatcatatttattcgtcagcactaaaggaaataagcactaaactgagtattttagatgacaatttcaatcacatttatawacacaatcctatacatcatatggagcgacgtgtgaaagaaatgcgtagtttaatagaaaagcttaatcgtaaaggattacagattagcgcagaaactgccaaagaacatata

SEQ ID NO: 917 - DNA, 400 bp; double-stranded, linear
gaaaattactatgaagattgcattaggatgcgaccatattgttacagatacaaaaatgcgtgtatctgaatttttaaaatcaaaaggacatgatgtcattgacgtaggaacatacgatttcacaagaacacattatccaatttttggtaaaaaagttggcgaacaagttgttagcggtaatgcagacttaggtgtttgtatttgtggaacaggtgttggtattaacaatgctgtaaataaagtaccggcgttcgttcagcactagtacgtgatatgacatcagcgttatacgtaaaagaggaattaaatgcgaacgttattggcttcggtggacgtattataggtgagttattaatgtgcgatattatcgatgccattattaatgctggattataaaccc

SEQ ID NO: 918 - DNA, 1220 bp; double-stranded, linear
gtctccagccattwcaccacacatacctgtccatttaccttctttatgtgacgcttcaataacttgtttaactaaacgtaagattgaagggttatatggttggtatagatatgatacacgctctgacatacggtcagcagctaatgtgtattgaattaaatcatttgtaccgatactgaagaaatctacttctttagcaaagacatcagctaatgctgctgttgcaggtatctctaccatgattcctaattctatatcatccgaaatgtcatgaccttcatttttaaggttttctttttcttctaataatatagctttagcttctctaaattcgttaattgttgcaaccattgggaacatgatatttaacttaccataaactgatgcacgtaataatgcacgtagctgtggtctgaaaatatcttgttgcgcaaggcataaacgaatcgcacggtaacctaagaatggattcatttcttcaggcaagtttaagtatgataattctttatctccacctatatctaaagtacgtacaacaacacgtttaccgcccattgcttctaatacttctttataagcttcaaattgttcttcttctgtaggcatttggtcacgacccatatataaaaactcagttctatataagccgataccttgtgcaccattttcaataacacctggcaaatcattaggtgtaccaatatttgcagcaagctctgcgtgaacaccatcaactgtaacagtatcagcatcacgtagwttttgtaattctttcttgtcagcaaaataacgctcacgtttatcttgataagcgattaactcatcttcagttggattaacgattacatcaccatttaatccatctacgataatcatgtcgccttgtttaacttcttgagtaattgattttgtaccaacaattgctggaatttctaaagaacgactcataattgcagagtgacttgttcttccgccaatgtttgtagcaaaaccttgtacgaattctttatttaattgagcagtatcagatggcgttaagtcattccctacaataacaacgctttcatcaatcatactcggattcggtaattctacacctaaaatatgtgataacacacgtttagaaacgtcgcgaatatcagccgcacgttctttcatgtattcgttatccatagattcaaaaattgtaacaaattgtgttgtnacatccgcttaatgtg

SEQ ID NO: 919 - DNA, 315 bp; double-stranded, linear
ttagattgactgcaaatgccgactcaaaagaacaagcacaatcattgattcaacctgttaaacaagaaattcttgatcgtattggagaatattattatggttcagatgacacattaattgagcaagctgtaataaagaaaattcatgaaccttttgtaatatatgatggtattactaatggtgctttatatcatcgattgaaagaagtggatttaaacgatgttctaaagggtatgattaatcacaatgaaaactttgttgatattaataaacctattgagcagcaattaaaagatgcagtgcaatttgttaata

SEQ ID NO: 920 - DNA, 433 bp; double-stranded, linear
actttgtaaacctacaaatgtaatgaataatcctatacctgctgaaacagccatcttcatttgataaggaattgcattaataataacttccctaaaccctgtgacggttaatatcgcaaagaatatacctgagaataaaacgcctgttaaaccaacttgccaaggaatacccatggttaacacaacagtaaatgcaaagaatgcatttaatcccatacctggtgctaacgcaattggatatttagctattagccccatgaatagcgagcctacaaatgctgctaatgcagtcgctacaaaaatggcaccttggtccattttcatatcttctgatacgcctttaacacctgctaaacttaaaacttgcgggttaactgctaaaatataggccatagataagaaagttgtgataccgcctaagatttctctttta

SEQ ID NO: 921 - DNA, 439 bp; double-stranded, linear
ctattttatttgtatagcgcttgatgtaaagttattttagctgtcatactatgtgctaaaccaaattcagttgtgtcatatcttcgcttttttgtcactgttataataggtataatcggatataatgaaaaggkgagggaggattcaaaatgcgtaggttattatattcatttcttttttatatgatcataggtttatttagtggctttttctatagagagctaacaaaagcatatgattttactggtacaacacaattatcacttgtacacacacatacacttattttaggtatgtttatgkktttaatattattaccattggagamgttatttaaattatcaagttactacttatttaactggtcttctatgtatataacataggtgttatcgttactataggtatgatggtgacaaaaggattcttccaagtcact

SEQ ID NO: 922 - DNA, 474 bp; double-stranded, linear
gtaatatctatatacgtatatttaaatgatatatctgggtattttctttttaatagcggctgtagccagtcataaatatctttcgatgttggcgcattaacgcaacttgcacatataacatctgccccataaactaccacactcacgtgctccatatatttatcccccattggtttgatagatttttattacactatctattataatatastmataaagattatcaaattcatctctcgaaaggagacttgcctgatgcctactgaagatacaacgatgtttgatcaagtagcagaagttattgaacgtcttcgtccatttttattacgtgatggtggcgactgmtcattgattgacgtggaagacggtattgtaaattacaattacatggtgcatggtggnacatgccccaagttctacaatcactcttaaaagctgggtattgagccgtgcattacacgaagaagtgcctgg

SEQ ID NO: 923 - DNA, 554 bp; double-stranded, linear
tcaacttgtgaagaaaatttattaactttagtaactcttccaacaaaaccttgtgatgtcatcacagccatatttgaagttatacctgatttagatcccttatcaattacaattgtattcatccactgatccggatttcttgccaaaaccgtagtagaaataggatcaaattttgaaatatcttttaaatcaagctctttttttaatttttcattttccgcttctaattgttggttcttagattctaactggctaatcttatttttagattctttagaatctccttttttaaaaaagtccccaatcgtaccagcaacaaaattaactggataactcacaactcgttgtccaaaagacacagaatcacctatatattgttcaggaggtgattgagattgtgaacgtatggacagcccaattaatgcaataaaaacgataattgcacataaaacaacaattaatttggtatttttaaaaaacttaagcacccagaacacctctattatgtcanaatattgtatatccttttctaattnatattactcccattatga

SEQ ID NO: 924 - DNA, 575 bp; double-stranded, linear
atctttaggcattaagcaagtttatgtagaagactttgaacataaatcctttagcaaagctaaaaaagccttagaagaaaaagggtttaaagttgaaagtaaggaagagtatagtgacnatattgatgagggtgatgtgatttctcaatctcctaaaggaaaatcagtagatgaggggtcaacgatttcatttgttgtttctaaaggtaaaaaaagtgactcatcagatgtcaaaacgacaactgaatcggtagatgtaccatacactggtaaaaatgataagtcacaaaaagttaaagtttatattaaagataaagataatgacggttcaactgaaaaaggtagtttcgatattactagtgatcaacgtatagacattcctttaagaattgaaaaaggaaaaacagcaagttatattgttaaagttgacggtaaaactgtagctgaaaaagaagtcagctatgatgatgtataaatataattgaagtaaatgtaccgaggtttctatttggaagtctcggtatttttatgttggagattgcggtagttttaaaatgcntcntgtcntcatatac

SEQ ID NO: 925 - DNA, 307 bp; double-stranded, linear
aaaaacgctgctgagtttaaaaagcaacaattaaatgaacaaggtattttcaagaaaccagtgattacacctattaaaccatataaaaatttctatccagctgaagactaccatcaagattatnacaaaaagaaccccggtacattattaccaatatcaccgtgggtcaggtagaaaancgtttatagatcncattggggggatccaaagcttaaaaagataaaagtgactaccagatatagatatattgttacacaagaaacggcactggaccaccatttatgaatgatattggaccatttgctaa

SEQ ID NO: 926 - DNA, 400 bp; double-stranded, linear
ctctacgcactcattcagatacacacattgcgcattgctcatagaatcaggtgtacacattaaagaaatacaagaacgattacggcataaagatatcaataccactatgaatatctatgctaaaatcacaaattcatacaaaaaagacgcctcccataagtttagtcaccaaatggaagacgtctcgtaattaaaatatatttgcgtgcattctaatttatacttagaatgaatcatactcgtgcataatgtaattttctagttagtcaaaactataaacagttttacatcattcctggcatgccacccatgttaggttggtcattatttttttctggaattgatgctacaaccgcttcagtcgttaaggacattgctgcaacacttgcagcagttgnaa

SEQ ID NO: 927 - DNA, 809 bp; double-stranded, linear
tttaggtggttttaatngttatggtcattctggacacctacttataataaaatttcaaatcaaactgaacnttttgtaccgtttgattaaactcaaatttattagctccgtatttaaattttggttgggctatattcgtttcggtacttatttcaacaccgtttttataaactcggaagctatcataaacaattctgtctccagcttttagtttgatcccttcgattttcattatttcagcatgcgttaaattccatacaaacgattctgtatcttcgcctaaaataattgttatctttttatacatgttgaattggtcgttaggagcactaccatgatagtaaactgtacctttgctcaaattttcaaatgtatactttcttttgtctccgcctgcatgccaatcaatattaaaatcaaacgaccacaatccaacctttttgttttcttctaactctaggcttgttccaatactttcaccgtatggtaattctgtagtttcgaattttagttcaaaagaaactttattacctttttgtttagggtttataactccgttaaaaataactttatactgtttaccatttacataaatttgttgatcgtgtcttgaatattcgtaatccgggaagttgtttttatctaatttcacgtaatcatcagaagttggttgagtaaacctgtaattcaactcttcttttcttctgatntctcgcaaatacataggttctatgtctgtcgttaacgaatacaacatatctcgcatataagcaatgtctgaacgatttttaactttacaaaaacaagga

SEQ ID NO: 928 - DNA, 1016 bp; double-stranded, linear
naaaactattatcgcatctacagtaatcgctgcaggtcttttaactcaaactaatgatgctaaagctttctttagttatgaatggaaaggtttagaaatcgcaaaaaatttagcagatcaagctaaaaaggacgatgaacgtattgataagttaatgaaagagtctgataaaaatctaactccttacaaagctgaaactgttaatgatctgtaccttattgttaaaaaattaagccaaggtgatgtgaagaaagcagttgtcagaattaaagatggtggtcctagagattactatacttttgacttaactcgtcctttagaagagaacagaaaaaatattaaagttgttaaaaacggtgaaatcgactcgattacttggtattaaaaaacatactgaattaaatagttgtacgccaaacgttagaaaacaatgctaacgtattggcgtgcttttttattttaagtaacttccaatttatttagcatctttacgactgtttaataaagcacgtatgattaacacggttgccactatatccgttacaatttttatgattgttaatacattcgatttccttttcacaatagccacctcgcttgttcaaaacataaacaactattgcattcacttttaagtaattatttatattatttatcccaataagctcaccattcaaataaacacaatattataaaataattatacctttggatatagcaaaaagccacactctatagcatggcttctatcaattattttaaagtattatattttaaaactagatcgatttgtctttgtaattttttcttttcataactgtgttggaaatgaattaaattaacagctctttgtgctttacggtgtgttgcaacagttcttgtacgtttgaaaaagtttacagctttttgtgcatccacaacttttttatttacttgwtttktaaagtttgttgatactgatcatattttttagcagcttcaccgttnttagttgtgcatgagatcaccggcaaccg

SEQ ID NO: 929 - DNA, 400 bp; double-stranded, linear
aaatgaaatcatacctaaaagagatattattacagaatcaatgatttgtgactgtattcaaaatgcaggtattgatttagaagtatttaaagacgacttacaaaaaagtaaactaaccgaaagcttgaaaattgatttgcatattgcaagagaaatggaaatcgaacaagccccttctctcgttttctttagtgaagatgttcatgaagaaggtttaaaagtcgaaggattatacccatatcacatctatacttatataattaatgaattgatgggtaaacctatcgaaaagaatcttcctcctaaattagaaacttatatacagcaacaacaacttgtaacgatggaagaattacttactatttatgaatggccagaaaaacttttaaacaaagagtta

SEQ ID NO: 930 - DNA, 400 bp; double-stranded, linear
tatttctgacatgtatcatgctccttcgtgctttattctaatgtaatatacacaattatacattgaaattcaaatttgtgaacacattgtgaactgacataaattatacacaatttcatagcgcataatgttttaaaaatacacattatagcaattataattaagttcattgtgttgtcatcaaaaaaagaaaaaggtgatgttttaaatggatacagttgaatcagtcggtttttgacagcatgacttagcagttcatatcattttgcaacgatggtgtggtatgcttaatgtcgcaattcagattttaggatcgcaaaatgactcatatatagcatgccaagtggcaagtatcatacgacatggngtgtcaggcatanggctcatactgtgcaatatg

SEQ ID NO: 931 - DNA, 543 bp; double-stranded, linear
ccaatcaatgttgccaatggatcacctaatgacaaccaagtaattgctaccatagtaactgctgttttaattttacctaattgaccagctgcacttacgaatccttgttcaatttgtagtaaacgtaaaccagttacggcaaattctctggcaataataatgattgctactacagaatttgttagtcctagttgcacaagtacaattaaagcacttgcaactaataatttatccgctaatggatccaaaaatttccccatatttgtaactaaattccattttctagctaaataaccatcaacaaaatcgctaagggaagccaatataaaaataaaaccactgattaataactcaattcttatttcatatcctcctagaaatgacacattgccaaatccaaaatcaactaacgcaaacaatataaaaactggtattaacactactctaaaaaccgtaatctggttcggaatattcattatacatcctcatttctcactaatttatttctgttaaaaatattaaaactaaccatgatccataacc

SEQ ID NO: 932 - DNA, 400 bp; double-stranded, linear
gattgcgaatgagattagtgggatgataccggtagaatgggagcaagtatttacaatagcttatgtaactgatcaagctggagaagtcatctttaattatactaaaccagatagtgatgaattaaattattattcagmcatacctaaagattgcaatgtctcaaaagatatttttaagaattcatggtttaaagtttatcgaatgtttgatgagttaagagaaacttttaaagaagaagggcttgaaccatggacatcatgcgaatttgactttacaagagatggcaaattgaatgtatcttttgattatatagattggataaatacagagtttgatcaattgggccgtcaaaattattatatgtacaaaaaatttggggttataccagaaatggaatat

SEQ ID NO: 933 - DNA, 759 bp; double-stranded, linear
atttttacaaagaaatagtagtcttatatatcttaacatttaataactaaatcaaacatattttgagcctttttttgaaaattaacattttaacctttttgattttacaacaaattatagctacgtattgaaaattaaagcmttggtttaagtgttgtgttaaaagyttttatgtttagattgttatattactatgtattcttaaatttgtttaaaaaattaatgctttaaattgatgtataatgggaataagaaataaataaaaacgacccgcacgattaacgtacgggtccactactaaagggagtcaaatttttacctcgtttgtatcatgcagcgttttacacatacttttaagagatgtttattcgttatcgaaggtacacctttattataacttatatcatttttattaaaatacaattcaaaaaaagttattgacatattattgtctaaataatgtataacctttgaacaacaataatgattattaaatagtaactaaatacaaaattacatggggtgaatgataatgaaacaatacttaattactggtgggactggtatggttggatctcaattagttaatgaaattaaaaaatcagattcacatatcacgatattaacgcgacacgaccaaatttcaaatgataagaaaatttcatatgtcaactgggctaaatctgggtgggaacacaaagttcctcaaaatatcgatgtggtcatcaacttagcaggtgctacattgaataaacgatg

SEQ ID NO: 934 - DNA, 400 bp; double-stranded, linear
gatcaagctggggaagtcatttttaattatactaaaccaggtagtgatgaattaaattattattcagacatacctaaagattgcaatgtctcaaaagatatttttaagaattcatggtttaaagtttatcgaatgtttgatgagttaagagaaacttttaaagaagaagagcttgaaccatggacatcatgcgaatttgactttacaagagatggcaaattgaatgtatcttttgattatattgattgggtgaattcagaatttggaccaatgggaagagaccattattatatgtataaaaaatttggnatttggcctgaaaaagaatatgccataaattgggttgnaaaaataaagnttatgttaagagcaagnttgagctgaactataggggagataa

SEQ ID NO: 935 - DNA, 345 bp; double-stranded, linear
ctgaatataatttttncaactacatctcgtttattagacaccgtgcactgactaagaaaatttctcttgactccattagtcctgacgaatactaacatttaactaccttgctcatcgatagaaacaacttgtaatgttaatttcccttattttcttagttttaatctatcagcgattaattcgattgcatctttttcataagcaattggataaacttgaccgcggtacacctaacgctcgaaatatgattttntatcgtcataatctaaaatattatnggcaaaatcacagcagttttcacattgtcttaatcactagaacggcgcagatcgtactaaagaaacg

SEQ ID NO: 936 - DNA, 619 bp; double-stranded, linear
gttatcatcatcttctgaagtatcatcttgcccatcgacttgacttgcatcagttctctttaaatcatcaaactctggactagctaatgtattatatagtgttttaggtaagtaataatattcgtttagcatatcttcttttaaaatatcatctacttgatacataattctttgagccagatacatattatcttcagaattttgattttggaaaaaattaggtaaatataagaacatatttactaaaatatcatctaaatctgaatgtatagatggtatatcaaagaaatcttggcttaaaaatgcatgttctaaatacaaaaataataaatctgtatattgtgttttagtacgatacactttaatttgagattccgtatatgatatacgtgtatctaagcgaagatcaattaatttagcagtacttgggcgctcaactttaatagaatttaatacgcgcatatcttctaataatttaaaaagttgttggataaaatttagggtgtttaaaagttttatcttgtactacttcatttacaatttgtacatccatcatatgataaccgtaagcagctaacataacatctgtttttaaaccagccatttcgatatggcttgg

SEQ ID NO: 937 - DNA, 615 bp; double-stranded, linear
taatccctttcataatgggcatcaatatcatattaatcaatctaaaaaacttacaaatgctgacgttactattgcaataatgagtggtaactttgtcatgcgtggcgaaccagcaatctataataagtttactcgtgcaaaaatggcattatcaacagctgatttagttatcgaactaccagcaactgccagtttatcatctggcgatcattttgccgaactagcagttaaagtcgcngattatatgagtgtcgatacaattgcatttggtagtgaaaataatgatatcaaaacattaaarcmattagcacacagcattaatgaaattgamcaatctgaatccttttcacaaaaagtraaagaaggtaaaagctaccctcgtatcattagcgrattattagagcatcatgaagcactagcaagtcctaacaacatacttggtattagttacctgaaagcaattgctaaaaatgctaaaaacatcaatgcaatttctatcaaacgagaaaatgctcaacatcatgattcattaattcaacaccatcagtttgcaagtggtacatctattagaacatcaatcattagtcaagatgatcattggcatcatgtggtacc

SEQ ID NO: 938 - DNA, 400 bp; double-stranded, linear
agaattgaagatggtaaagtttcaaaatatcattcggttatcataaaagacgcacaagcaacttcaccatattcaatttttatcagaggtgctatttatcgctttgaaccattagtataaatatacgtaagtgctatgagcgagaatgcccatatgaataatgacaagcacaatggaaagaatcgtaatatattatttaatcgtgatgcttaattaaaatgaaaaagattgataatataaatgtgaaaaagtaagtatacccgtaaactaaagtattcacggtgagaggtgctcatgtcataatgatgcacgtgtcataattataatagcttanatatgtccatacaacaccatgtagatatgcatatacagggtatgatagacatagngtctgngaaat

SEQ ID NO: 939 - DNA, 466 bp; double-stranded, linear
gtacaggtatgattggtgatcccatcaggtaaatcagaagaacgtgtgctacaaacagaagaacaagtagataaaaatatcgaaggtattagtaagcaaatgcacaatatttttgaatttggaacagaccatggtgcagtgcttgttaataatagagactggttaggacaaatctcattaattagttttttacgtgactatggtaaacacgtcggcgttaattacatgttaggtaaagattcaatccaaagtcgtttagaacatggtatttcatatacagaattcacatacacgattttacaagctattgatctcggtcatttgaatagagaattgaattgtaagattcaagtaggtggatcagatcaatggggtaatatcacaaagtttaggtattgaatttggacagagcaacaatttgtagataagcaaatgattaatagttgaggggtatgtcgatgaagcg

SEQ ID NO: 940 - DNA, 329 bp; double-stranded, linear
atgaatcacccattgataccaatcatttacatcactgtcatacgaacatatatttaaatagaaaaaaattattttaaagattataactactcttaatcattttagtgaattaaaaaaagtagtgcaaaaagcaaaatatactttatacactacaaatcatttatttataataaagtttcaccaaaaaatgttccaactaatgaaaccgcttgttcagcagtatgattatnactgtcaatcaatggatttacttcaactaaatccattgaggaaattaaatgtgattgatgcagtaattccaatgcnaaatggctttctctatnactaag

SEQ ID NO: 941 - DNA, 315 bp; double-stranded, linear
cgatatagtaccaatttatttgaagaaaaatccgaacttcaaatttccgatgaagcaagatataccggttattatgattggaccaggtactggaattgctccttttagagcatatttacaagaacgtgaagaacttggtatgactggaaaaacatggttgttctttggtgatcaacaccgtagttctgactttttatatgaagaagaaatagaagaatggcntgaaaatggaaactaacacgcgtagattagcatttccaagagnccagacacaagatatgacagccncgatatggagaagtaacgttccatgat

SEQ ID NO: 942 - DNA, 699 bp; double-stranded, linear
taccaataatcaacttgttttacatcatcgtgtgtttcaatcactttcctttttatacctttcttacctttaaagaatgcatcaacatcttttattgaagatccttttgaatctttagtaaatctataatctgcaagttccactttacccattaattctttgtaatctttccatccttgaatccctttactattcgtaaacgacttttctgtcattaatggatccaacttatcaagagatggcgcatctttaattcctttcattttcttctctatttcttcatatttctctaaatctggatctttctcttcttccgattctttttttacagtttcttgttttgattcttctgatttctttgatgataatttatgattcccaccaaaagaacaacctgctacgactaaaagcataattaaaagtaaacatcccagtgtctttttcataaactttctcctcttaagttattttgtttgaatcaaataaacatacataaatttaaaaaacttatttatattgatattttacattaaccatcaatatttttaaatactttaawtgataatttaagaaaattgttttgtctaataatttaagtagttaaaacatagatagatataaaatagtttatagccattaatttataagtttaaaattcgcactatttcaatttgccatttaaaaatagtttgtttaatc

SEQ ID NO: 943 - DNA, 400 bp; double-stranded, linear
cgctccataaatcaacaatgttcgagtctgtaatctagatgataaaacgccaagaatgatcataaatggcacttctaaaccagcacataaactagctaaataaccgacatgttgttcattttcttttaaataatcagtaacaaataaaggcatattcatcgtatacatccattgtccaatgtgtaataaaataaatgcaataaatggtaataaaagcgttttgtctttaaacatattaggagcaattttttcaacatgttgttgcgtactaatagggtgtttaatgtttaaatccttataganaaacacttgaagtactaaagtaaataaaatgatacttattgggccaccaaacaatccagcatagccttttaatccgattaattgggcaccaataaat

SEQ ID NO: 944 - DNA, 570 bp; double-stranded, linear
aagatgacaatactttgtttcaagaattgaaaaaagaattagaacaatgggattttaatgttgctggtattgaagatttcggcaaagtaatggatacatttgaaagttttaatcctgaaattgttatattggatgttcaattacctamatatgatgggttttattggtgcagaaaaatgagagaagtttccaacgtaccaatattatttttatcatctcgtgataatccaatggatcaagtgatgagtatggaacttggcgcagatgattatatgcaaaaaccgttctataccaatgtattaattgctaaattacaagcgatttatcgtcgtgtctatgagtttacagctgaagaaaaacgtacattgacttggcaagatgctgtcgttgatctatcaaaagatagtatacaaaaaggtgatcagacgattttcctgtccaaaacagaaatgattatattagaaattcttattaccaaaaaaaatcaaatcgtttcgagagatacaattatcactgcattatgggatgatgaagcatttgttagtgataatacgttaacagtaaatgtga

SEQ ID NO: 945 - DNA, 1241 bp; double-stranded, linear
ccgagnccaccgttccaaagtccatttttatccccatccctctctgaattgaactataatttttgaatttattaataatgctatttttnttattttatcaaaaactgattacaaatacacatagaaaatgaaatatatttttctttgactatacataactgttatttctttggatatttatattaaatgcattggtagtagttgtagcgcattaatgtttgacggtgtatagtattaattatattgaaagttagttggaagttgatagtaggagtgggagcattgaagcgatttgtggcgacggtattattattactagtctttatatcaggatgtggtaatgrtaaatatgtgaaagaaatagatgaagcagttaaaattcaaaatcaaaaacaagaacacttgcccaaaaaaggcaacggtgatcgtgttgatcattttgaacgcaaagatgctaatatttatgtctatgataaggataaaattatcattttagcttataaacctttgagtaatgatgatgaagtgcattattatgcatatgattttagtgataaacgtgtatcatataagcaagattttgattcgagacgatattatcaacaacatgatgcggattatcatgaagaaaatatgacgaactagatatgaataggagttattatgactaaaaaattactaacattatttatagtgagcatgttaattttaacagcttgcggtaaaaaagaatcagcaacgacatcttcgaaaaacggcaaaccattagttgtcgtatatggcgactataaatgtccttattgtaaagaattagatgaaaaagtcatgccaaagttgcgtaaaaattatatagataatcacaaagtggaataccaatttgtcaatttagctttcttaggtaaagactcaattgttggttcgcgtgcgagtcatgcagtattgatgtatgcacctaaatcatttttagattttcaaaagcaattatttgctgcccagcaagatgaaaataaagaatggttaacaaaagaactattagataaacatattaaacaactgcatttagataaagagacggaaaataaaattataaaagattacaagacaaaagatagcaagtcttggaaagctgcagagaaagataaaaaaatagcgaaagataatcatataaaaacgacaccaactgcatttattaatggcgagaaagttgagatccatatgattatgaaagttatgagaagtta

SEQ ID NO: 946 - DNA, 1057 bp; double-stranded, linear
taatacaatgacaccatttagcatgaccgttatccctgtaattcagctgatattatctgttgcaattttatgtgacgaactgttgcacttaatttgataaatcnacaaatacaaaaaatctaagttgaacaattatgatacaaccgtgcaaacgatatgtagtataacttgtcaacttagacttattgataaatatattaatagtggtttaccatagcaggagatttcacatcaaaattttgaagtagcgtatcaatctttgaatcatcaatatataccttatgtaaatttttcatatacatcgaatgagaaagtgcttcataatttaatgaaaaagatatatgatctccaacttgatagtgtccttgaccatttaaatcaagcattaaatgatcactcgaagcgcctaaaatattgatatgctgatccataggtgaaatattatcgacttttgtayctaaataaccaatatctacaatagcttgtaagaatgattcatgcgtttgtgtattaactcgaggtttaatttctaaaatctcagcctccaatgtaatcgcatcttgatataacatagcgatcgcttgatttgtcgttgtatcaacacctctaaacaacgtttcacctattcgcaattcatttattttacccaaatcattatataaaagttgtggtaacatgctcgaattaccacctgaaataattttcaatcgatatcctatttctctttcaacagctgagacgaatcgattaatcataaagatatcatcatcacttggcgcatcagatttaaaacacataaaattgaatgctaaacctacaaaatggatatttttcaagtgaataatctctttaatataatctaaaacatcataagtcagaacaccttcacggccatctttccaatctaccattaataaaatcttatgtttttttcctaaaacttctggctacttcatttatttgatgtatgggtagataattccggtttgggatacctccatatcnaaccttttttcctaatcaatatcctggaaaanccctttttttgggcagggcg

SEQ ID NO: 947 - DNA, 649 bp; double-stranded, linear
gatatccgctcgatgaatatacctttaaaggtgttggtgcaaattctgaacaattaagtgctatgaatcatgattctttaaaaaaggagtacatttcaaatgactgttaaatataatcaaaatggcgaattaacaatggatggtattagtttaaaaacgattgcacaaagctttggtacacctaccattgtttatgatgaactacaaattagagaacagatgcgccgttaccatcgcgcatttaaagatagtggattaaaatacaatatttcatacgcctcaaaggcatttacttgcattcaaatggtcaaacttgtagctgaggaagatttacagttagatgttgtttctgaaggtgaattatatacagctttagaagcaggttttgaaccgagtcgcatccatttccatggtaacaataaaacgaaacatgaaattaggtatgctttagaarataatatcggttattttgttatagattcattagaagaaattgaattratagaccgctatgctratgatacggttcaagttgtattaccgagttaatcccaggtggttgraagccacmtrcacacgaatttattcaaacygggcaagaaggataggttaaagttttgggattaanccnntttcccattaatgggcc

SEQ ID NO: 948 - DNA, 472 bp; double-stranded, linear
tacaaagcttaaaaacagagcttagtytcgttgaaccattaattagccgcttagaattagaagaagctaatgataaactagctaatatcaatgataagttagatgacatgtatgatttaattgaacatgaagttaaagctaaaaatgatgtcgaagaaacaaaagatatcattacggataacttattcaaagctaaagacatgaattatacattgcaaacagaaattgaatatgtacgtgaaaactactatataaatgaatctgatgctcagagtgttcgtcaatttgaaaatgraattcaaagtttaatttctgtatatgatgatattttaaaaganatgtctaaatctgctgtgcgatatagcgaggttcaggataatttacaatatttagaagatcatgtcacagttattaatgaccaacaagaaaagctacaaaatcatctgattcaattgcgtgaagatgngcagaa

SEQ ID NO: 949 - DNA, 400 bp; double-stranded, linear
agaggatcccaggcgtttgttgatccagcagccgatncagaatacatcttctatgcatataaacgtttcaatttcgaattgaaagatccaaacttcactagtgaagaaaatatgtttaaagatgtatcagacaaaccattaatacctgctcgtaaagctcaaattacaaatgcgaactataaacgacatggtatgaagttgatgattcttgggaatgacgaaccatataacaatgagttcaagaaagatgatcgaaaatgcgaagaatgagaaatttcaaaggtgcgcangtcaagccatgtgtcaggggggcatatgatttcnggtcatcagtaaggactgtgtcatgccatggccatctgttgtacngatctctaatagaatctcagatgcccggcaa

SEQ ID NO: 950 - DNA, 556 bp; double-stranded, linear
aaaatcttcgatgacaaagaaatctaatgatgtttctttaaaatgaccaaactgcaacggaatgatataaccacacttgagatatggcgcttcttttttcaacttagtcatcacatcataatccaaagacatcacacgatattgatgttcaacaccatgctttttcaaaatatcaataacacgttgtgtataatctgctggttctttaccatgtggctttaactctactagtagcttcacatttgattgtttagccgtttcaataaattcgtctaaggatacaaattttgcttcatgtccattttgacgcattttcaaaccgacgatatctttgaaattagattcagaaatatttttattaacacctgttaaacgtttcaaattgttatcatgactaacaacaaattgtttatctttcgtcataattgtatctaactcaacgtattcgacattcgcttttgcagcagctttcaatgacggaatagaattttcaacacctttatcttcgaaaccacgtggccaataatggagatattgtaattgatagtattattgg

SEQ ID NO: 951 - DNA, 469 bp; double-stranded, linear
ttgtggtaatgatgttaatcagtatatttctacttttgacaatgacatctaaaggattaagcaatcttagagtaatagatgatgaggcaaatatcatttcttttattactgaattgaattatattaagtcgcaagctatagcaaatcaaggatatatcaatgttagattttatgaaaacagtgacactattaaagtaatagagaataataaaatacgatttctaaaattaaaagtaggcaaaataattaatgttgcaaaagttgatattattgcctttgataaaaaagggaatatcaataaatttggtagcataacaatttacaataacaattcaatttataggaataatattccatattgaaaaaggcaagaattcgttatgaaaagctataagtgtaaaggttcattcttaatagatagtatggctggntttttgccaattgggattgnattacattactattgatt

SEQ ID NO: 952 - DNA, 730 bp; double-stranded, linear
acatntataatncttatttgcttgctcctttcactttttaagagtaaaanataacctgaaacataactttaacatccaagtttcaggttagtgtaatgtaaatgatttactttgttntattatgattaaacatctaattctctgcttgtaagtgctttaatcatctctggatcagcatgtgagaaaaattggctattactttcttctaatgtcgcaatttgttgtttatcttcttctgtaagttcaaaatcaaatatatctaagttttgagccatacgttctggatttactgattttgcgagtacaacaatgtcacgttctactaaccagcgtaaaataacttgtgcaattgatttgttgtatttatctgcaatggcctgcaacaattgattttggaataattgatttttaccttctgcaaatggtgcccaagcttctaccacaacattttcttgttgaagtgctgcaacttgttcttcttgttgatggaatggattaatttctatttggttcacttgtggttgaatttgattgtgaatacctaaatctacaattcgatcaacgccgaagttagatacaccgattgctttaaattttaccattttcttttaactcctccaatgcacgcccatggagccatatacngccattggtaaaggttgggtggaatnaagcacctaggatccaggataggtcccaaattttaatccggtgggnaatggatcggttc

SEQ ID NO: 953 - DNA, 400 bp; double-stranded, linear
acaaatgacaacgtacaatgacgtcttcacaaacatgcattttaggagattgattattacaaatatccagttttttgttacatctatttgcaaatctgcacttattaacgtgaaatgcttggattgatggcacaattccttctatcgtttcaagtcgtttctgctcttctttaagttttggaattgttgataataatttttgggtataaggatgtttcggattgtgtagtatttcttttatgcctccaaattctacaatttgacctgcatacataactaagactttatcgcaaaactcagcaactacactcaaatcatgtgtaatcatcataattgccatttgcgtttccttttgcaattcttttaataagtctaatatttgcgcttgaatcgtgacatc

SEQ ID NO: 954 - DNA, 251 bp; double-stranded, linear
taaatcttgaggacgtttggtctgaaagcgatgctcaactgttgataaatccaattcgataacatctgtataattaggatcttctttctcaacatcaaanacatatggttttgtttcaaatattcttttactagcgcgatatgttcgtctgatctaccagttaacttcatatatttaagaattctcatcaactggggaagaatccgcaagttgctccatactctggtgccatgtttncaattgtagcacgg

SEQ ID NO: 955 - DNA, 514 bp; double-stranded, linear
aaacatttacacaagtagtagaagcaatttatgatgaagaaggtaacagcttagamgcggcgcgccatccattacaaatcgttcaaattaaagtggatcgcccgatatatccaaacaacatgatgagaaaggaaattggctaatgaaagctactacaatcattggcatagctggtggatctggctcaggaaaaacaactgtaactaacgaaattatgaaaaacttagaaggtcatagtgtcgctttacttgctcaagattactattataaagatcaaaagcacttgactttcgacgagcgcctagaaaccaattatgaccatccatttgcattcgataatgatttattaattgaaaatcttaaagacttgaaaaatggtaaagcagtagaagtaccgacatatgattatgctagtcatacaagaagtggacattaccattggatttttaaacctaaagatgtttatttatcgtagaagggcctttttcgcctttaggaaaataagggtatttac

SEQ ID NO: 956 - DNA, 388 bp; double-stranded, linear
attttaacgaatatcttgccgtacgatgcccaagctgcatctgaaaaggatactgaaattacaaaagagatattatctaagcaagatttattagacaaagttgacaaggcaattcgtcaaattgagcaattaaaacagttatcggcttcatctaaagaacattataaagcacaactaaatgaagcgaaaacagcatcgcaaatagatgaaatcataaaacgagctaatgagttggatagcaagccataaagtctcacctgaatgacggtcaagtgtatagcataatagtcatgctaagttaatgagtctcaatgtgtagggcacaagtgcgggcgtctatgcatgaatgttgccacgctcacaactgggaagtgtaaatgtgactgta

SEQ ID NO: 957 - DNA, 394 bp; double-stranded, linear
aacaaagtacatcgcagttacgagaagaaataaatgcattgtataatcaagttatagaggttggacaagcgttatcaaagcagcgtcgtatagtcgctagggagttaagwgaccacattgtatcggaaattcaaaacttacaaatgaaagacgcaaatcttgagatttcatttaaaaaattagaagaaccgaatattgatggaatcgaatttgtagaatttttaatcagtccaaataaaggggaaccattaaaaagtttaaataaaattgcgtcaggtggagaactttctagaattatgttagcgttaaaaagtatttttgttaaatcgagaggtcaaactgcaattttrttcgatgaggttgactcaggtgtatctggrcaagctgcaccana

SEQ ID NO: 958 - DNA, 503 bp; double-stranded, linear
ccgccatttttttcgatttctttttcaagtttttcacggtcttttgaagatagactattgaaatcttttgcaccactatcatcaaaatcaatatctgctttcaattttgtgctagattttaaaatgaaattaattggttcttcagcatatttgatgccgatatytaacgtagatttctgagtgttattytttacgtcagaatctatattattttcaaaagtgaattcattttcgtcgctatatttatctaatgcgacagtgattttacctttatcttgacgttttgtgccatctactttttcttggttatctaatttgatttttgattcatcatattctgtctttttaccaaattcgtatttatcattatatttattatctttwtctttagaagatacgcctttaattgtatatttcgcttcagcatacgtgtatttatcttgatcgaaatcaagtgcgtaatctagttttaacttatcgtcttctaaagtattagtaccttt

SEQ ID NO: 959 - DNA, 307 bp; double-stranded, linear
tcaaacgtacagagcttgttaagtgtttagattatttacgagagagcgacacattagttgtctatcaacttgatcggttaggtagaacgacaaaactattaattgaattatcacaatgattcgatgataacggaattgacttaccanattagtaacctgaacatttccacgaaagaccccatggggccaaaatgtttttaccgatgatgagtgcctttttccgggttagaagttaatttactatgtgagtgtataaaatagactnagcagccacaagncgagaggccgaaaaaagcgggcgccctct

SEQ ID NO: 960 - DNA, 400 bp; double-stranded, linear
ataaggacatttatagtcgccatatacgacaactaatggtttgccgtttttcgaagatgtcgttgctgattcttttttaccgcaagctgttaaaattaacatgctcactataaataatgttagtaatttttagtccataattactcctaatcctaaccangtcngcnaaatttcctccatgataatccgcatcatgttgttgataatatcgtctcgaatcaaaatcttgcttatatgatacacgtttatcactaaaatcatatgcataataatgcacttcatcatcattactcaaaggtttataagctaaaatgataattttatccttatcatagacataaatattagcatctttgcgttcaaaatgatcaacacgatcaccgtgccttttttggcaagt

SEQ ID NO: 961 - DNA, 400 bp; double-stranded, linear
acaattagttatacccaaaagagttatgtcagtgaagtagacaagcaaaactcaaaatctgttaaatggggtgttaaagcaaacgaatttgttacgcctgatggaaaaaaatctgcgcatgatagatatttatycgtacaaagtccaaatggtccaacaggttcagcaagagaatattttgctcctgataatcaattgccacctttagttcaaagtggctttaatccatcgtttatcactacactatcacatgaaaaaggtycagtgatacgagtgaatttgaaatttcatatggtaagaacttagatattacctatgcgactttattccctagaactggtatttacgcnggaaggaagcataatgcatttggaaataggaaccttgtanttangtatgg

SEQ ID NO: 962 - DNA, 358 bp; double-stranded, linear
cttttacaaagacaaattagcggtaatcggtaangatcgttgttgatccagttgcactattgaaagaattagacggattaaatgaacgtggcattcctacaagtaatttacgtatatctaatcgtgcgcaagtgattttaccatatcacttagcacaagatgaatatgaagaacgtttactggtgacaataagattggtacactaaaaaaggtatcggtccagcatatgtagccaagtcacgtatcggtatcgtatgcagattacttgaaaagaacatcgaagatattaaatcaacatgatataaccagctattcaaggatgttacgaacatgncacattgatgaancttgagatata

SEQ ID NO: 963 - DNA, 258 bp; double-stranded, linear
agtgagcaggttgaagtagtagggccgattcaaatggaaagagatacacataaagatggtaaggtaaagtggcaattgctttatataatgaatcaggatgatgatgaaattaagccaccattttttattcaatgggaggaaagtgattccattgcgtactaaaaaattgcaaaaatattttcaaaaccattttcaattgaaactgtattgtgaaagtaaaaccgtcacaacagtatcgattggttgaantggttgnat

SEQ ID NO: 964 - DNA, 388 bp; double-stranded, linear
ttatcaaaccgccatagccacatctcgattcaaggataaatttgttttctcatatcttatctctcatgacagtgcacgatatatatcttttccaaatattcatcacttttttcctgttaaaatcatttctattattaatgctttaatgacaacttatttaatttattgcatttaatgccctgcttcattttcaaatattaactttaatcgactagctcatcacactatttaccctttccacctatcactactgaattcaaaacgatttgtttacaaatccccttatgccaacggtcgaatttcatcatgtttacatttaattgcaaatgccctcttgaaatattttaaaattaatattattcttagcatactagtcggaattatattc

SEQ ID NO: 965 - DNA, 602 bp; double-stranded, linear
aaagtgaggtatagtccgaccatactctaaaaacgtagcgagataaatatatttcaatcctaacttttatgttttgaggcacttgccatttaggatattgtcgttcgtaatacgacacttgttgtataaatacacctagtccaaatggcagcatcatgagtaagatacttcttaaataacttaaaccaatatcatgccatatgtgtccaataatcaattgaaagacaatgatagatactattaaaacgattatatttattgtcacttgttcaaacgcactccttttccaaataatagaattgctgcttgcatgacaaccataaaacatacaaacatagcagttttaagcgttagactttctagaatgtgatttagaacatgtaagggctcattaaagaaataaacggaatgtaagcgtaagaaacgaccaatataaattccgaatccatttaaaaacattagcacgacaacrattaatctattaagccaacggtgagaagtcaatgttagtatttcaaaatagattnaaatcatcacataaaccgctaagaagacaccaagcagtaaataggtaaagtatttccactcacttaaatttagtc

SEQ ID NO: 966 - DNA, 744 bp; double-stranded, linear
gtcctaaggtagatttatctacaactgttgttattttancaattattggagcgattttattaatgtttgctagcatatattttatnaaaattgtgacatcatactttactaagaaacttttagaaattaaatttaattcgaaatagtattttcaatgaagtgcttcaaagctaaactttcatgacatttttttgaaactagagaaaatggctcatcaacttctagctgaatgccttcttgaaaatgtattaatgttgaattctctatggcagtcataccaacaatataatgtgcattgatataaatttgtatcggtgcacgtttatgttttaacggaaaaagtatagtttttgggttgatgtaaataggaaccagtttattaatatttagtatgttttttgcagtctcaattagcacactttgtgatgataaatgcaatttcgcataatatgraacgagtttgttaattggaactttaagaatgtaatcgcaatgtaaaaagacacaatttgtttcgagatggtttgaagtagcagtttggatataaagtagatatttagtagaattgtcttgcaaatatagtactcctcgtttaataagttgttaatttaatggttaaaataaatttatatgaagatgttagggtgtttcaacatcattaacacatcgaccgaaatttcacaataaactaattaaaattatgttggcatttacgcttaacggacatcttaattaatttaatcg

SEQ ID NO: 967 - DNA, 503 bp; double-stranded, linear
tactttgcaggagcattaggtattctagcatttataatgtcaattgtattgattcacgatccgaaaaagtctacgacaagtggtttccaaaagttagagccacaattgctaacgaaaattaactggaaagtgtttattacaccagttattttaacacttgtattatcgtttggtttatctgcatttgaaacattgtattcactatacacagctgacaaggtaaattattcacctaaagatatttcgattgctattacgggtggcggtatatttggggcacttttccmaatctatttcttcgataaatttatgaagtatttctcagagttaacatttatagcytggkcattawtatattcagttgttgtcytaawawtawtagtttttgctaatggactattgggtcaataatggttaatcagttttgttgtcttcatagggtttggatatggatacggaccagcccattacaaattaattttttccnaanattgcnggggaag

SEQ ID NO: 968 - DNA, 465 bp; double-stranded, linear
tacaggtaaaaaaggtggtccgtttatcgattcattaaaccatcgtagttacacgaaagcatatgtttcatcagaaaccgatattccattttatgctgaagcatttggaattagagaagaaaatgttgtaccaacaggtgtaccacgtactgatgtactatttgatgaagcttatgcaacacaaattaaacaagagatggaagatgaattgccaattataaaaggtaagaaagttattctattcgcaccgacatttagaggtaatggtcacggtacggcacattatccattttttaaaattgattttgaacgtttagcaagatactgcgagaagcataatgcagttgtgttattcmaaatgcatccgttcgtaaaaaatagmcttaatattcacgtgaaccatagaccataccttaatccgatgtggtccagatccatccgtggaaagttaaacggatattccnc

SEQ ID NO: 969 - DNA, 300 bp; double-stranded, linear
aattcggaacaacgagctggcaacaacataagatgacagaggcgaatggtcaatcaattcaagttaacttaaataatgcgcaangcgatttgggatatttaactgctggtaattactatgcaacaagagtgccggatttaccagtagcgttgaaagttatgagggtatttatcggtattcgtaaagatgatacaacaacnatttactcacacctatactctaaaagattncacacgtcatcacaacggcgacttgagcaacatggacagttcctaatgaacataatcaacggtattgttc

SEQ ID NO: 970 - DNA, 400 bp; double-stranded, linear
atacgcgagcgaacggtgaagcgacttgctgctgcaaaacgtctgcgaccttgagcaacaacatgaatggtcttcggtttccgtgtttcgtaaagtctggaaacgcggaagtcagcgccctgcaccattatgttccggatctgcatcgcaggnatgctgctggattatcatccgatttttaaaacgttattaggcgttgtcgttgcaattcaatttacagtacctgctttgattggtgcattggttgccatgaaatttgacctatcgccattagcaattgctgttgtggcaagtgcagcatatgtaggaagcggtgcagcgcagtttaaaaatggtgcttggatgattacgggtattggtgatttaatnaatacaatgattacagcagcgattgcagttg

SEQ ID NO: 971 - DNA, 251 bp; double-stranded, linear
aagtgtaagattagaataaaaaatttataaacgaattgagaaagaccaaagctagcaattattcagaaattaaatcgaagagtcctacagttaatgacttacctgaacgagatttatcnaacaaatctcagtatgaccaatatggcaaatgccgtgtccatgttaactgatgaaaagtactttggtggtagttttgaaagattacaagcattgacgacaaaaacaacattacccgtattatgcaaagnctt

SEQ ID NO: 972 - DNA, 414 bp; double-stranded, linear
tgaagctcttaataaatcttttcttgaacacacaccaacaaaatcgttatcttcattaataataaataatgtacttacatcttctaaaaaaattgtacaaatagcgtcataaactgttgtattctctcttagcacaacaggttgagacatatagtccttaacctcaaattgtcgaagtttttcattaaaaaatttgccttttgatttacctgaataataatatccaactcggggacgcgcttctaaaaaacctgacattgttaatatcgctaaatctggtctaagcgttgctcttgttaaattcaacttatctgctatttgttcaccagwaatgggtcctttagttttaacaatttcgatgattcgttcttgtctttgactgagttctrwaggkcttcacccctttttatgcnc

SEQ ID NO: 973 - DNA, 747 bp; double-stranded, linear
gaaatcgatactaatatcttctttatttacacctgctagttcagcttctaagtaatataattcgtctgttcatatatattcgttacaaatgaaggtgttgaaaagtaattaaatacttgtttacctaaatctttaaatgtatcacttggattaccgttaaaaaagttttgattctcgaattgattgaagttcatatcatcacttccattatagaaatttgtattacaaagccattatatgagtagtattaaaaaagttaaagtaaaaggggagataaaaaagtaataaatgggtagatttgtgcctgataaggaatcagggcaaaagaactgagcatcgagatttatacaagcaataaagataatgaataaacatatcgatgcatacttctgcccatcaccttatgatagggagttattttttgtcggaatagtcaaaatttttagaaacaaaattccgcaaattattaattatatctgatgcttctcgttctgaaatgttgaattcattaaagaccttaacagaaatttcagcaagagggctttttattgctttaccttgttctgttagagaaatttgtaggtttctttcatctttctcttcacgtgttcgaacaacgtaatctttcttttctaatttctttagtaatggkgtcagtgttccagaatctaagaacacacgttcacctaattttttgatgttaagtttttcatcattttcaatcgccaattaaaccanggtancngg

SEQ ID NO: 974 - DNA, 257 bp; double-stranded, linear
tgcttccaagtaatgtggacatttaatacgagctgggattgagatacaccttgcaatgcttcaatatctcccatttcttctgtaatcacatagtcttcaccaagcatcattttctgaaattcttggncatttgcattgcttctcccaagtgaatgcctttaacagcttgtgtcatcatcgatgacttgccattgaaatcgacaaccttcaccttcaaacttagcatcttttataatgccgncttctatatcaaatgt

SEQ ID NO: 975 - DNA, 451 bp; double-stranded, linear
caatggagcatattttacgttcggcaatggacattgatcanacaacaaaacattatataamtaataaagtagaagttatcaaagaaattattaaaaaagtaagagggggaaatcacgtgacatcacaaaatccagaagttaattacgaagcattagctaaatatggccgcgacttagtagaagaagttagacaaggtaaaatggatcctgttataggaagagatgaagaaattcgaaatacgattcgtattttaagtcgtaaaactaaaaacaaccctgtgctcattggtgaaccaggtgttggtaaaactgcaattgttgaaggattagcgcaacgtatagttaagaaagatgtgccagaatcattattagataaaactgtttttgagttagatttaagcgcattagtagcgggcgctaaatatcgtggtgaatttgaagagagattaaa

SEQ ID NO: 976 - DNA, 571 bp; double-stranded, linear
aactattaataatattaagttcactacagatgttgctaatggaccataagttttaaagacatcttcacttttataaccaacaatcgcatctaaaaattgaactaagatcattgcaatggatatagttatcaaaaatatagcactatgaatgactaaagaaanaatagctaataaaaataaaggtaagcttcgactaagtgcataatatgcatttatattatggctagatgcacatgcttgaattgaataacctaaacttacactggcactgattattgtaaatattgctaaaacaaaatacatgttaatccttctttctatatttggatataaacaagtacttgtctaaagttatttaaaagataattagaataaatttatgagaaactggttgttatcattataatggtttcaaatgattataactatgtcataaactgaatttgttgaaatttttcattatgcaaatttattaataacaaacagctcgaactatagcatcattttactaatgaatgcattaaagtaactatgactaaaaatgcatattaattatcattattaagactat

SEQ ID NO: 977 - DNA, 274 bp; double-stranded, linear
cccgaaaaaatttagacattttcaaacagtaacatttgaagatttgtctaagctggaaaagagtagtatgccatcaggggtcggtatattaggctatgctgttgacaaaggtgttgctttaaacaaggggcgcattggtgcaaaagaaggaccagatgcgattaaacaagcatttgcaggtttgccggatttgaatccatgtgnactttagtcngattaccggaatgtttatcctggtcatgggggaattaattggataccccaaaaaggaatt

SEQ ID NO: 978 - DNA, 877 bp; double-stranded, linear
ntnttacttcttcttttaatatttctcgtatagcttcaaatttttcactgtcaaacagtgttcttaatatcccttgcttttcacgactgtttgatattaaaaagcgtttgaattcaccttgaggcaaaataaacaattgtcggaattgatctgcatttactcctaataattcaataatgaattgggtacctgaaattactttactttctctaatttcatacttgccatccaccatctcaaatacatcaaatttagcgttcgtttttgttgtattaccttctttgatataagggccttgtctatgcactttataaattcgatgatttaattgaaattcaaatgttactgacatcggctgtttaccatcagcgaaatgacttctcaaatcattttcttctctttgttcagttgatgctttaccaaacaaggcataagtcattgcatcaaaaatcattgttttacccgatccagtcttaccacttattaaaaacaattcattattatcaattttagaaaaatcaatttcttcttttaaaaaggggccgaaattattcaactttaaatgtaatggtttcattcattaatcctcctttctcaattcgttttctaaaatattttttatctttttagattggatatccgataattctttatcagttatatgtttataaaacatttcgataattgacatgtcatctttttcacttatttcyatagcattattttcttcatngtaattaaaagtttcattcgtcagcgctaaagtattaggataaattngttttaaactcatcattggatcagtaatatgagacatatttttaagtttaaaatgtaaaataattatcgttatntttcacatgaacttnttcattaa

SEQ ID NO: 979 - DNA, 624 bp; double-stranded, linear
attggtactataccatttgtccattttagcgaagacgttaaactatcgattagctagtgaagaaattaatctcactataccttctatacataagcaaattaaaaatttagaacagcatctcaatgtgaaactatttgaaacttataaaaatcaaattatcttgactgaagatggtcatacatttcttccaattgcgcaaagttttattgaacaatatgaaagtggcatcaaacatatccaacttaaaaaaacgatgtttcaatcgaaattaaatgttgtcgtgtcttcatatatcgcgacattcattatgcccaaatttttaaaatctttctttaacgagcatccttttatcgatgtttctcttcatgtcaaaaatgaaaatattgaaaaagatattaataatcatacgtatgacatcgggattagcagaaatcaacctaaactaagagaagttcattctgaaaaagtatgcgaaggtaaaattgtattgattgctcccaataaagagaataatcatcttctaactgaggcatctttatttgaaaaatacaaaataataagtgataaccatccagaatattgggtcatcacttaaaaataatattttaaatatttatgaaaaag

SEQ ID NO: 980 - DNA, 457 bp; double-stranded, linear
tttgtcctgttgcataaactgcagctagcataatgttaattgttgcacctacgctaaccatatctagaaaaatatgtgcaccttttaactctttrgcttcgattttcattgatgtcgtactkgattcatcaatttcagcacctaaagctttaaatcctttaatatgttgatcaattggacgtggcccaagtggacatcctcccggtaaaccaatcacacattttttaaatctacctaacatggcacccatcatatagtatgaagcacgtaatgattcaactttattatttggtaatgcagcattttgtatttcagttgtatcaacttctaawtccgtaccatttagtgawgccttaatatttaaatctkctaataaactcactaaagttttaacatcagagatttngcggtaacccttctaatttcacatgtccttgagctaataatgttgcaggaa

SEQ ID NO: 981 - DNA, 997 bp; double-stranded, linear
attgcagcaacgccccctgtaaaactacgtactcttacatttatgaaacctgcttcttcaaacatgcgcttcaactcttcttttccaggaaaattaaacgtagattgctgtaaccattcatattcttcttttgattttgcaaataattttccaaaaataggcataacaaatttaaagtatagtgcatacatttgtttaaagactggcaaagttggttggctcgtttcaagacataccaccataccacctggtttaagtactctattcatttyttttaacgcgactaaatagtctggcacatttcttaatccaaacccaattgttacataatcaaaagaattgtcttcaaacggcaattccattgcatcaccatgaacaagtttaacattttccattgaagcagttttttcttttcctacttctaacatattctcactaaagtcaataccagtaacttcacctgttggtcctacagctttgcttaatgcgattgtccaatcaccagtaccacaacaaacatctaatgctttcgtcccttttctaacacccatgtctttcatgacgcgttttctccatactttatgctgctcaaaactaataatattatttaatctatcatatttttttgaaatattttgaaaaacgcgatgtacttgctctttatttgctttattgtcagccatgcttaattacctctactttttaaataacttttttggatatcgtgtaagtaatgctttacttcactttgattatatttcttgaagtatgatggatagtaatcagacatatcttcaaataaataattatatatttccgactcatcaatattgataccgaaatgagataacgtaatatatgggaaaagtgtttcaatttttactattgcttgagaaatttcataatcatttaaagcttgatgatgtaatgaagatttcaattcattaatttcaacaattgctttactaatttcattttgaaatgataaatcattgat

SEQ ID NO: 982 - DNA, 1118 bp; double-stranded, linear
cattccctttatcggnacaattattttaaataattggttaataagtttttctattaattgctgttttactttctagagcaacaataaatgttttcagtttaaaataattaagattgtcatttactaatttgctttttccattctttaaccataaatcaacttgtaattgccactcaataggatgatttttaatataaatttgctctggaaaaatataaccataattgtgcactacttcttgatcagttaactgtaattgatacattgcacttaaagtgggttctaaaacagaattttgccagcgacaatatttgatatattgattaattgcgaactttgataatttataaacagcatgataatcacaaggcgcctcattaaacaactcactaattttggcatttcttttttcagcgacatatttgtgcccgcctaaatattgtatttgttgaaacatcattatttgttttttctctaaattgaacgtatgaagttttcgagtgaatggattaataaacatactttgaaaatgattgaacttcactttattatgacaataatcaacatcatttamtaaccaacttactttatatcccattttcttkaaaccttccgttcgttgaagaatctgtttataaggaattggcgaatactgtagctcaataacatatttattattaatcaaaatatccggaatttgttttatttcttttaaaaatggctctatctctactttacatccttgttgctgtatcatctgtgctaaaatcaatttacttttataatgtttaatcgtttcattattaaaacatttttgttccgctaaatgtttatgtgcaaaatgactaattactttgagcccacgctttaaaataacttgcttgccacacaccggacaaaaatattgtgtctttctcaatgcagtagttgctaatacgcgttccttttcttcatttaaagctactaacatatcttcacctcaaaatattacacgtaagtttaactactattactttttcagctttggaaatccattaaaaaaaagggacccccaaaggaggcctcctttcatangtgcggtggcctaattaaataatccgttaattccaggtggncnc

SEQ ID NO: 983 - DNA, 269 bp; double-stranded, linear
catcccctgttaaaaattgntatttgtgtattgatgcttctcagncattattacgagtccatattcattgcttcagtgaaatatcagtagcaataacatttaaatccggcttttcacatttcaaggtaattgcagtacaccactacccgtttccgatatctacggattgttgcatcatcttctaactgttggtaagaaatgcaaccattactgcttcagtttcaggtctggtatcaaacaatttgagtttacatcaaacggtctacctt

SEQ ID NO: 984 - DNA, 298 bp; double-stranded, linear
aacccaagtggaannggttttggtggaaaaattttaggtcctttatctgtcgtgcgaatcattgtattttttaaactttccgcataatcttgatggtcgattaacttttcgcgataacaatattcaatcacttcagaaatcgcttgctctgatatctcttctttttgtaaatattgtataacttctttttcagttctctttttatatgataaatattggattgctttatttaaacctatgcgataatgatcatacttttgaatctctgccatgtcagcagcntcaagttgtngccctt

SEQ ID NO: 985 - DNA, 431 bp; double-stranded, linear
ccatgcgattccacctattaatagtaagacaataataataggaattataatttttaactttttagacattttgcttcctcccaattatttatgagttaatcatatcagaacaatacattttattaaatggtttattttaaattttgtttaaattaatagaattttagttataataatgtttaataagttattggraatcyaataaactacmaaaaatagtttgattacataatgattcttgaaaaatgktggktaacytaataatatgcattttttkggcgargargatttatttaacytataaaaatatkgaagtaagattggggagattatgaatttatggrattgaaagtcgatgattttgtaaagaatataaaaagaccatacttgactgtattgggagtatttgtagttgcagtttcattattttt

SEQ ID NO: 986 - DNA, 329 bp; double-stranded, linear
aaggttaggntggagtacccaaagtaggttttaaaggttggaaatacnaggaggatgaataacatgaatcagtcagtcaaattacttaaacatttaacagatgtaaacggcattgctggttatgaaatgcaagttaaagaagcaatgcgtaactatatagagcctgtcagtgatcaaattattgaagataacttggtggcatttttggaaagaaaaatgctgagaatggtcaatactcattatgatttctggtctatggatgaagtggttatggtaacaagatgtaaactgttattcattacgcgtggtgtgtgatcagcngcactcaa

SEQ ID NO: 987 - DNA, 545 bp; double-stranded, linear
catattatttntatatgagtttaccagtgtcaaaaaaacaattgcttaatgccaactatattacatgcattgttttaacattaattggaacgcttgttattagtttatatgcttatgaagcagatgtgattgaaccaaattcaatctatttttcaactgcatatgcatttgtcatatctaacttcttgtctataccaattgcatttagtcaatttacagaattgcgtagagtcaaagtgccatatggtatatacgtgtttactattatcattttagttccatttttattttcaattgcaatagtattggtgaattattttgttctaagtcaatcatcattcccagatttatattcatatattttaaatattggttttctaattataagcattgttatacttattgttaattattttaaacagctcaataaaataaatactagaaaatttaaaggaggcagtcgatgaaattagaacatattacaaaaaaatacggctcaaatgtcgttttaaatgatattgattttgactttggcganagtagaa

SEQ ID NO: 988 - DNA, 607 bp; double-stranded, linear
acctagcatgacataatcaaatatatcaaaaacacctttctgaactgattcaaccgttccaatagttaatggtctttcagaatcagatgtctttccaccttgaacagtcagatgactaattaaaatattgacggcatcttcatcaatttccggtgctattgtttcaatacagcgcgtaattccctgttgatgtgtttcaatggtgtcatcttcaaagtagtgtttcatttcgctcacagtagcataagggagtgtataaaaattaaccccatttatctctattggtgaattaatcgatgtaaaatctgttcttataaataactgattatgttcaaaccaactcgccccatagtttaacctctctttaccatcgtgatttccactaataataattattggtatacgcagttctaaatttaactttccaatcgcttgttctaataacatgattgcatctttacttggatatgttgtgtcatataaactccagctatcacaatgrtatcaggttcttcttctttcattttttctacgaacatatctaaaatatacgcttgatcttctaaaagctgtttgccatctaatattttccctaagtgccagtctg

SEQ ID NO: 989 - DNA, 722 bp; double-stranded, linear
atcgcgttaagcaacaattacaacaatcatcatataagctaacgccacaacgcgaactactgttagagttctaattgaaaatgaaaaagatcatctaagtgctgaagacgtatatctgaaagtaaaagataaagcgcctgaaattggcttggcgacagtatacagaacgttagagttgttagctgaactaaaagttgtcgacaaaattaactttggtgatggcgtcgctcgttttgatttaagaaaagaaggcgcaaaacatttccaccatcatttagtatgtatggaatgtggtcgtgtagatgaaatcgatgaagatttgttaccagaagttgaaaatcgagttgaaaatgagttcaattttaaaattttagatcatcgtttaactttccatggtgtgtgtgaaacgtgccaagctaaaggtaaaggatagtaaattgcgtaggttaaattaaccttcgctttttttagaggtgtggttatggaaacaattattgaagaatatttgcgttttatacaaattgaaaaaggactaagttctaacacaattggtgcttatagacgtgatttgaaaaagtatcaagattatatgactgaacatcatatctcgcatattgattttatagatcgacaattaattcaagagtgtntggggcatttaatagaccaagggcaatctgctaaatctattgcgcgatttatttcaacaatccgtagttttc

SEQ ID NO: 990 - DNA, 366 bp; double-stranded, linear
atccaaaaaatacgaaagcgctttctatattggtatgcaagtatttcaaaaagaataaatttaattttcctacttttctaaacatttatctttatgtataatgttttcaagtaactaaattataaattaaataaagggagtgtttatcatgcttacaatggggacagcattaagtcaacaagtagatgccaattggcaaacttatattatgattgccgtctacttcttgggtnatgactccaacttattgatagtgttnttatgtttcagataatgcccgatgactttgtcatgccagctccaccgattttgagnaacgacagcgacttccgtccccagccgtgccaggtgctgcctccagtattc

SEQ ID NO: 991 - DNA, 338 bp; double-stranded, linear
tgactacagtaacattacctgtaaataatgattgaatggcttcattttcatcatgaatacctgtaataaattctaattcttcatctgaaacttttacaatatgcgccaatggcaaaaaggtatgaatagtttgtcttaaatcttcagcgttatcccataatggcaatcttacattaggatcaaatacgacagtaccatttgcatttaatgttttggtaatcaattgataatgtgcatctctcatcggactatcgaccaaatcaacagaacaaaaatgtactacatcattttcattcacatcaatatcattcacaaaactkggktcaaataacatatcn

SEQ ID NO: 992 - DNA, 371 bp; double-stranded, linear
agttcatcgtattcttaatacctatatgctatcgttcacaaacttttgttcttttcttccaacataccgcctataatgctcaaaaagaaatcagcagtggaaccactacgttccctaccgctttatcattttcaggcttaaatatttttaaaattttgtgaggaatccgcttaaaaaaactcatatcttcaaaaaaaatgacaaaatttaaatttttgaataacatcattttttagtaaatgttataatttctttataatacaaatatcgaaagaaggcgactgactttgaaaaaattatgttcattaattgtaggtagcattagtttgtatccttgccattatcagcttgtggnaaagaacnaaccnaaa

SEQ ID NO: 993 - DNA, 530 bp; double-stranded, linear
ataatgatttatcaatcgatgttagatgcggttcaattatatcctaagtctatcgtggttgattatactgtggatggacaatacaaaaatgattgtcactatttcggtcaatcatcgatcaacattgccgattgggctcaaaacaataattattatcctaacctgatatatgcgattcaacagactcttgatttaatacattattactctgtagaaacgattttcgatttagctttattgacacttctgaaaggtgatttatcaatcgatggtcatgtcgtttttgattttaaagcccctatagcaacaagtgcttcaatatgggaaactattaaaactattgaagattttgatatgatgtccagtttttttgataaatggcttatattgatcatcatcctataccttttcgcaacctttttatcgaggattcagaacaacttaattcgccagataattggttgtattctaccaagtttatgctacctaaatgggntatataaaataagcaaagcaacgtgctgataaca

SEQ ID NO: 994 - DNA, 551 bp; double-stranded, linear
tattggattnttnccaccaaaggcaacggttccttttctaattctaataatcaaatccccattaatatcaatcccactcaaattctttcacatcattgagtataaaataatatggtgatatacgttgaagttgattntcttatttaagtatactccaacagtattttataaaattatttagtcatcatcttcagtgtttaattcaaaaatatagaatctactgtattgcataataaattgaaatgccacaaattgtgtacaagcaataataatgatacttaccattatgacaaacttggattctacgacattgggcaccaatatatattcgataattctttcaatatatataaatgcgctcaacgcggttaataataaaccgaaatgtgttttagttttaccaccccaacgttttgtyactttaggtaattttaataacgtgaacattccgccaattactaataacaaataactaattatgattgaaatcgtacccatcaaccaataattgaataggtcataatgattttgtacagcaacaaaataataaa

SEQ ID NO: 995 - DNA, 729 bp; double-stranded, linear
attcgccaccattaggtagtggaacacgaacttcatcatctaaacctttaccaattaacgctttagccattggtgattcatttgaaatcttaccattaaatgcatctgattcagctgaaccaacgatttgataactttcctcttcatcacctggtaattctacaaacgttactgttttaccaattttaacaacgttgttatctccagtatcttcaatgattaatgcatttcttaacatatgctcaattctttgaatatcttgttcgatgaatccttgttcatcttttgctgcatcatactcagagttctctgataagtcaccaaatgaacgtgcaactttaattttctctacaacttcaggacgcttaactgtttttaattcttcaagttcacgctctaatttttcaaaaccttcttgagtcattggatattgcttttgattttccatattgtcatcttcctttactgaattatactattgcttgctaactaaagactgaatttttgttgtcataatatctattgcaactttattgctcccaccttcaggaataattatatcagcatatttcttagtcggttcaataaattggtcatgcataggtctaacaacacttaaatattgattggataacagagtccattgaacgcccacgctctttagtatctcgtgttgaaacggcgtaatatnctcaagtctggcatctgtatcaacatatatnttnaaca

SEQ ID NO: 996 - DNA, 325 bp; double-stranded, linear
gacaaatatactgcttctactcaaatattagtgaacatgaaaaagtcctcaagtgatttagctttcccaaaatgttcaaagtagtttgcagtctgttaatacatatacgganattatcaaaagtcctagattctagataaagtatctagagaattgatggtcagtattcaacagctgagtgaaatcattttaaaagtaaccatccaaccaactctcaaattattactgtacagttacactgggataatctgatctgacaaatgtataaatactaagttttgccagcagctaaatagaggtgtatgtacgacttccanctgtagng

SEQ ID NO: 997 - DNA, 271 bp; double-stranded, linear
cttcagttgtcggcaaatcttctatattggaaataccamatacatttaaaaataaatcagtagtaattaactgttggctacgctgttcattaaccactttagcctcaactagtcctttggcaatcaatgtcttaactgcaccatctgaattgatactacgaattaattcaatatcacttcttgataatggctggttataagcaataattggatagtacttccattgctgcttgtgataatttcatttgtgacttttgttcaattgaattgt

SEQ ID NO: 998 - DNA, 498 bp; double-stranded, linear
tttatgtgctaatttgtaattgagattcataatggtatttaaatcattatggtgcgggagttatggtattgccataatatgagagtgcatccacttctataagtaatgcatattgcgagtgcaggaatgaatgagtgcttgattaaaatccttatgggtggttgacataattaaaagaaaccacatttaaaatttcttaatcacaagcggttaactaggtatagtttagttttgagtaaatctttttaaaggtgtacttgtgcattttacttaattaaagacataagacatttaatcggcctaaaataaataaaaaactacctgtttaggtagtttttttaatgtaatagattaaaacactagttcatttcttattaaagatggatagttattttatagataaatttgtcctttagtgtagcggtaatttttaggactttttggtggnaaaaatgttcttaataaaagtaatagtcctactttaccgccaaagccata

SEQ ID NO: 999 - DNA, 568 bp; double-stranded, linear
tgagctggttgtttattatcatcagttttcttctgattatcatctgatttatcttgagatgctttgtcatccttatctttcgactcatcctttgatgctttatcatcattctcttctttagcaggacgttgctttgtaggtgcttgttgctgaggtggcacatattgatattgattctgctgtggcaattgctgatattggtttgcttgtgaatctagctcattctgctctttttcctcttgttgctttttctttctctctttttctgcattttctttttgacgcttttctttttgttcctgcttttgttcgttcaacatacgttctttagctttattcgaatgatctacatatgcaaaaattgcaaatactaatcctccgagtaatagcaataccgtcgcaatgctaactactttcgctgttgtactcattttcttcttacttccatcttcatttttattgtagtcgtaattttgattcgacatactctccctcacttcaaactaatttaaatatagaaattatcacgcaaccattaacattttcacaactaatttgcgaccnagta

SEQ ID NO: 1000 - DNA, 1441 bp; double-stranded, linear
agtgtttctaattgcaaaattccaaatacagtgtcgttatttacttttttcatgctaaacatctcccaattaataatcacatatttagctactatacaagtattaacaaacatcccaacaatcccaaaacttgtatgtgctaacttatgcataaaactacaagtgtaaataaacttgctttctattcaattgtcaaagttgaataaaattaaataagtataaaaaccaataatcaatagagttaatatttagaaataagataatagtacataaaacaaatcactctattacatattaattttataatttatatacaaagaaaatatatcaatattaccattaaattgcaacaattctacatatatttcttcaaaaaagatacgcattgaatttttattacatataactctcatgaaaattgattaaactaaattaattagttagccttaaatttaacaaattaaatcaaaccgaatgaggctaaattggttatttttcaagatatgatttgtataaatcaaaacatttcttacaaatcaaatgtgtataaaatgtgatatacattttcaaccttaaaaaagttctaaaaaaagatgagcatctactgtctcatctttcagttcttttttacgggtctgttttctaatttgagcacaatcttcgatttctttatctaaatgactaccaattaaatctatttcttctattgttaaatcgctatctccatcttcttttatctctggtattattttttcttcaactaagtcacgatatagtgtttttgaattctcgttcaatttcgattcgtgattttgaatactttcttccgcaccaatgtatatctattggcactagcttctacttttgtaccatcaataaaaattgaattatcatcaataagattttgctttaaacattgactatagaactgaataaataaagattcaattaacgcatcagtattaggattcactctaaaacgattaatagttttataagaaagtgtttgatcttgggctaaccacatcattcgaatactgtcatgaagtaatttctctattctacgaccagaaaatacagattgagtatatgcatataagatgatttttaacatcatttttggatgataggatgttgcaccacgatgatgtctgaattcatcgaattcgctatcaggtatcgtttcaacaatttcattaacatatcgcgaaatatcattttgaggaattctaacgaagtttctattggtagtgtaagttggggtcatgttataatttttatacataaggcacctctttaatttagtttagtagtatttattaaattatacgaagggacccaacacagaaaattcattttattgaattttacatttatgtgcaagttggggaaaaatgtcttattttttcaaagtatttaaaagtaaaattacatgttaata

SEQ ID NO: 1001 - DNA, 587 bp; double-stranded, linear
taataatatctgtcatattaagtctccctcattagaactcattataaatgaagttattgtgtgtgtcgccactgccataaattaaatataaagtaataaatattgccaaatacaatagtgttaataaatatggtttgaatgcttcaacatatttattaggtggctgtttacttttagatttcatattgcacctcttaaagttcttagtaaaaacgcctttataaagaccgttcaatataaaatacgttttaaaatttgttttttacaattcattatatcgatattcataatgaaattcaattttaattttatagattcaacatagtaattggttgtcatcactcaaktattgtaaatgatacactttgttgagracatcattcattttaaaggttatttaaacaataaacaattacagtctatataacaattttgttatatacgtcaaaatcaaataaactcatcacattaatatgacgagtttataatgttattgaattatcatcagcgcaaatatatacattcgcaagtcaagcataacatatttaacaattgctttgcttggttttaccaatggattaaaaacc

SEQ ID NO: 1002 - DNA, 522 bp; double-stranded, linear
caattgtgtcataattttgctgatgataactaatcgttttggagtagctatttgatgaagttcgtccaataccttttgttgaatcgaatttaccacctgagcgtatatgaaaatgtactgtctacttttgcagttgaaattttatttttcggcaattggtctaatatttcagttttacgatttctttttacttgaaaatctacatggtactcacttggatactttaaccaatttgaatttttttcttctttatgagattcaaactttaaatttgaatgaattgagccttgttttttaacaagtaatacattcttgtcataagttggatcatcgataaagtcgaattgtaaattttggagtatatttgtwttctcatcatatactgtttcagttcgttttgtgattttaccgtttttcccaatatcatccggtgctgttgaatttttatctttattagtaacattacgttgcttttgtgancttatcaacatgtcttctatttggctgangcttatggngatt

SEQ ID NO: 1003 - DNA, 323 bp; double-stranded, linear
tctttgtttgagacataatgtcatgtaaagttttcacaatgcgttcttcaacttgttgccttgcctctcctttgaaaggaacaattcgatctccgaataagtcctcaggcttgtatagattatcaaatagatagactgactcaccttcaaatattccaaaatgccattccttcagtcccttaaaacgttgatacgattggwtaggtgcaacattttcaagtgtgtcacttgcgcgttcttgcgttgatgatgcatataaatcgaagtttatccccttagtttcataataactacgtgcctttngagcttgagcaattccaagt

SEQ ID NO: 1004 - DNA, 320 bp; double-stranded, linear
ttctaacttgacgtgactgggcatttctgtgnaaatnttctgacattctttttaatatccgcaacgcaattgcttcagttaaagattgnaacttgcaacattatttggtacgaaaaagtcagttttaatgtcgatataagatttattttttttgttatatagtttcgcaactacatttggttgtcttacttgatcatattttgcaaccgtatcgaatgccgtcttttcaaacagctttacgagatacgtaaaccatgacccatccatcgaagtccttggtaaaaacccagggtttccgaagccgtagggtttgaaagata

SEQ ID NO: 1005 - DNA, 305 bp; double-stranded, linear
nattaatgctagccaaaacaganttgcaanatgtaaagacatgtgaaaccctccttatataccgtaattattaacctataaaactataaaaaataggataaatgtaatagagaacgagtacgatatttataaaaaataatatttcacttaaccagtttttagttatcattgcaatggtaaaggatacgatgagtatcacaccacaaatgataataccaggcaggagccaacataaatcatctaaatctttattatatgtgattaaaatattaaagataacaaaagtggtagtaataactatattg

SEQ ID NO: 1006 - DNA, 334 bp; double-stranded, linear
ttcaagatatcagtataaataaaaacttaatatgctcattatagacagctataactatattttctcgtcccactctatagaaatcaatttcatttattaccattttctctatttaaaaacatatttttggtattaacaattaaaagtgggtatatatatttaatgaaccaattttttaggaaagtagggctaaacctatggaaaataaattataccacatggtgtcctcttttaccatgaacacagtgaattaaaaaatattaancaaggtattggggaagtancaccagcattaggtccaattggtagccaccttccaatccattgggggnaa

SEQ ID NO: 1007 - DNA, 565 bp; double-stranded, linear
agaaaatttgttatattagaagcgaataattttaaaacatattatgaaatgtaagaagaaatattatgaaactaggaaaagtagattgttgaaaattccatacaataggngangtaaagtgaataaattctggtattactaaagctattgattgtcctaattgtaataaaaagttggatagtgtagttgaggggagaaaaactaaaatgcaaaaatatattctcaatggatcattataaataccaattagattaaagtattgcgaacatttacaattagaaatcagtattaatctgccatagataattgtattaatgtaaaamataaaatagaatgagaatatacggaaattttttatacatttataaccaattctgttaaactgtgaagagtagagttaaaaacgaactttttgtttatttttattaaaaaatgttctgtttttgaaaattcgagtatacatacgataggagttaaaaaaatgattgaacgctattctagagaagaaatgtctaatatttggactgatcaaaatcgctatgaagccatggttagaagtggaaat

SEQ ID NO: 1008 - DNA, 400 bp; double-stranded, linear
caacattagcgtctaaacaaatctttgactaaacgttcacttgagcgaccatcttgatatttaaaatgtttatctaagaatggcacaactttttcaacctcataatcttcattgtccaaagcatccattaatgcatcaaaggactgtacaattttacctggaacaaatgattcaaatggttcatagaaatcacgcgtcgtaatgtaatcttctaagtcaaatgcatagaaaatcatcggctttttaaatactgcatattcatatattaaagatgaataatcactaatcaacaagtctgtaacaaagagaatatcgttaacttcacgatgatctgacacatcgataaagtatygtstatgttcacgtgaaatayyaagtcyattttttacgaacggatgca

SEQ ID NO: 1009 - DNA, 454 bp; double-stranded, linear
tattgtaaaaactgtggttcttacaatggcgaagaagtagcagctaaataattttagttactcaatataaaaagtcccgcttaaaatgattgttttaagtgggactttttatattgcgaaaaataattggcgaacgaggtaactggatacctcatccgccaattaaaatttgttaatttaataattaaatataaagacgatttattagtttttacgttttctaggtaatacgaatgcaacgatgctacttaaagctaataatgccattaatggtaatgtcatatctntatttgattcttcaccagtttgtggtaatgattttgctttattttcttgtgtatttgtattgttttggctttggagtgtgtccatcatttgtgtttttaatgtttgcttntngtaatggagcactaatcttttgcctcgctagaacctgccggaggtttggaaccac

SEQ ID NO: 1010 - DNA, 400 bp; double-stranded, linear
ggtacaacaactttagacaatgaaatattaaaagatacggatgataaaaagtcgagtaaaacttttgttggcggaacaaaagttgatgaccaacatgctagtatcggaatggattttgaaaatcaggacaaaactttaactgccaaaaaatcatatttcatattaaacgataaaattgtcttcttaggaactggcattaaaagtactgattcatcaaaggatcccagttaccaaccgatgaaaatccgcaagccgatggggaatacggtattttccggccgttaaccaaccacccattccggttatccgggaaaccattccatccttttaggagncnccggtnccnaaaaggacctcgggtatcctttttttaaccaacccgaaattactggtaaaaaag

SEQ ID NO: 1011 - DNA, 400 bp; double-stranded, linear
ttaggtattcgcaaaaatgatcttcaatatatagctatggccaaaagatgggctaaagcttatacaattactgtagcagtgggagttgttacaggtacaattataggacttcaattatcatgatttggcctacatttatggaaatgggtggacacgtattgcacttcccttattatgggaacattgcggtctcttggagctatttcttaagtatatattatatactgggatcgtttaaaataatggcacattcttaatagtataccagtaattatggggccttctcagcatctcatactcaggaatcattatgaatacgcctgcaggtttgagtgaagatggaagtggccatgtcaccntagagcgtgttacccacgttaagtcgtcattncgaatacac

SEQ ID NO: 1012 - DNA, 400 bp; double-stranded, linear
ctttatgggatacactacaaatcgagactataaggttttttattttatttattattacattatcaatagttttataatcgagcttcaaaactttagaaaatagtagaaatagcattcaatatagtgcaaaagtgcaaattgataacttgacacttatctcctataaaccgtacaattaatttgtatgatttatatataatttcataaagtcatattgaatttcatataaagagcaaaccctagaaaangaggtgttgtggaattattaagctcctactcatttgcggggtcatctagggtgtggaggatgtgtgccgaattgtgctcaaanatcccagcagcaacgcgagttgaacagcctaagacgcaacaaaggatctgnnaaggaccatcaggcacg

SEQ ID NO: 1013 - DNA, 353 bp; double-stranded, linear
gtcgttgctgataccacgccagtattggttttaaatgataaaaaaatctgtgagattgcatcattgagacaaacatcgctatttgaaatggccgaatatatagggtttagcgagccacagaaattagtacaattatttattaaccatgataggaaggtgagacgccaatgaatcaatataatactataggttttcacccgggaaatagtcgtattcatcaattaaatgcgactgttaaacttttatncttattagttgttctattctgcaatggtnctatgcacaggtattnatttaattaggctcacatttatgggcaattctcaatgatgaacagtcgttgtgtaatctcg

SEQ ID NO: 1014 - DNA, 627 bp; double-stranded, linear
caaagccttcaacaaataatcctttattagtactgattggttgcacaacataagttacaccaggttcatctttaaatgtaacttccttatagaagagaccttttttagcactatactctgttttttctgatttaattttatcttttagatttttctcttccaagtaactgtcaattagttgaatattcttatggccttgatatgttttcagaccaaagaaaaatgctactgcaacaattaatgaaataaataatataatgataactttaatcgcgttttttttcttcttcattatgtaactcctttttgcttatctattcagtatgaacgaatcaatttatttaataaagagtttttaccagattgtaacaaatttttttattctcaatattattatagaaatcgaattacatacacgatgcttttaaaaaatttaataacaaattttattttactatctatcaaaataattgactacttttaacaattaaggatgatacaattacatttttttcaatttaaaaaatcagtcatatcagtaattaccgatgaaaatactaagatatcgatatattttgcattatttaacatttaaattcnattatagacaattcaataattgcgatg

SEQ ID NO: 1015 - DNA, 462 bp; double-stranded, linear
tagtgtgacattaacactggaacaaaaagaagctgcaattgcagaagttaataagcttaaacaacaagcaattgatcatgttaacaatgcacctgatgttcattcagttgaagaaattcaacaacaagaacaagcgcatattgaacaatttaatccagaacaatttacgattgaacaagcaaaatcaaatgcaattaaatcgattgaagatgcaattcaacatatgattgatgaaatcaaagctcgtactgatctaacagataaagagaagcaagaagctattgctaagttaaatcaattaaaagaacaagcaattcaagcgattcaacgtgcgcaaagcatcgatgaaataagtgagcaattggaacaatttaaagctcaaatgaaagcagctaatccaacagcaaaagaactagctaaacgcaagcaagaagctattagtagaattaaagacttttcaaa

SEQ ID NO: 1016 - DNA, 235 bp; double-stranded, linear
tgattggtcccatcgactcgttataacaaattgaaggtacaaaagtatcttgtgatttaataaattcaagtaaattcgtacctggttctacaaggtaattcttttccatcaagtgtaaccaccaaatgttcttgcatattactcaccccgnctatatatattttccggaaatggcttttaataaattgcgcatatccaccnaaaataacgatgccccacacatctttcagatagg

SEQ ID NO: 1017 - DNA, 227 bp; double-stranded, linear
gttgaaaactataagatcanataaaggtaaaacagtggtttgtgtcattagtggtggtaataatgatattaatcgaatgaaagaaattgaagaacgttcattactatacgaggaaatgaagcattactttatcttaaatttccctcaacgtccaggtgcattgagagaatttgtaaatgacgtattaggacctcaagacgatattactaaatttgaatacttaaaat

SEQ ID NO: 1018 - DNA, 284 bp; double-stranded, linear
gtcttacttgcacaaggtattatttctatcttactcgttgctttcgcaatcatgctatatatcattaatattttagatgcatatcgtaatgctgaacgatttaatcgcaatgaggaaataaaggatccgaagcgcgtatggtggcacatgggacaagacgttcccatacttactaatctcaccaggtacatncttattgatattgtagtgtaattccattatattatgttggagtagcattacaatacaattatacacgcgcctcgagacnacatagatgggtg

SEQ ID NO: 1019 - DNA, 779 bp; double-stranded, linear
caatcatcacacataaatgttcgaataggattgtttttaagtcgtttagactcagttgtgcgctcatctataaatacttttgcatcacagataatgcattgcacttgtctcaaattaaatcacctcaatatgagttacatggttgattcgatatgaataaccatcttcttgattgtaaataaaactatctacaccattatcgctgtaaagtcgtttaccgtcttttgcaaattggaaaaataaatagggtaatagatctatcggtatatctaaatgatcatgctcatttgataatcgaatagtagttgcagagtcatgtggttcggaatgtttgaaaaatggtgtcatattaatgacaaatgaaccttctaacatggcacgttttttatattttatttctgaatttaaagtaggcggattagtttgtccttctaggatagcacgattccattcatgattatcttcaaagtcgattggttttgaaccatcaaatacacctttttctaaatcttcgatgctaacttttctatcatcgaaaatccaagtcgtactatctaatgttataggaaactttacggctcctttaatttgtatcattttcccactccctatcaatgtatatagcattattttaacacaaattgctaacgacacattttaaatctacttgctttttaatatttagtaagataaacttttagtaagacttgagaatttatatagagggggagcgtgtcatggcgaaacaagcaacaatgaaaaatgcagctttgaaacaa

SEQ ID NO: 1020 - DNA, 950 bp; double-stranded, linear
ttaatggtccattaagaataatggcagaaaaccgtttgcataaatcaaaccttgattcactaacttaagtaatactcgcttttcntaaatcctttagaaaggaactatntatcatgattacttcattcagacattctgaagatatagataaacatattataaaaacaccattagatcatacagcgtcatggattaatgtagtaganccagaccgagaagaaattgaaaatcttatggaacaatataatatacctgaagactttatacgtgaccctttggactcagaagaaagttcccgtattgaatatgacgaagatactggttactcattaatcattattgatttacctatcgtcaattcaactaatcgtagcgttctatcttttgtaacgattccattaggcattattattggcaacggtattatcgtaacagtttgtgacgctgaaaatgaatttttagaaaatttacctaagcgtgatattaatttaaaatttcacagcagatttgcattagaaattttaactactattgccgaccattataatcgtaacttacgattacttaataaaagtagaattcgtattgagaaagaactaaaaaataacattactaacaaacaacttttcaaattaatggaagttgaaaaaagtttagtatactttttagctgccttaaaaggtaacgatacaattattaaaaagttattccgtttacctgcaattaaacgttttgaagaagatgaagaattactagaagatttaatcattgaaaataaccaagccatcgaaacaacagaattacatcaacgtatcttagaaagtatcacaacatcatacgcttccttattatctaatgatatgaatacgattatgaagacattaacacttttcacggtactattaacgttaccaayactcgtatttagtttcttcggtatgaatgtgtcg

SEQ ID NO: 1021 - DNA, 528 bp; double-stranded, linear
aatatataaaatgaatacattgtgaggcaattatcaaatgaaatttaataaagtaaaactagttatacatgcgtgtgtactattatttatcattatttctatagcgttaatttttcatcgattacagacgaagacacattctatagacccaatacataaggaaacaaaattatcagacaatgaaaaatatttagtggatcgtaataaggaaaaggttgcgccgtctaaactaaaagaggtatataatagcaaggatcctaaatataagaaaattgacaagtatttacaaagttcattatttaacggttcagtagctatatatgaaaatggcaaattgaaaatgagtaaaggttatggatatcaagattttgaaaaaggtattaaaaacacaccgaatacgatgtttttaatnggttcagctcaaaaattttcaacagggttactgttaaaacagttagaagaagaacataaaataaatatcaatgatccagtaagtaaataccttccatggtttaaaacatctaagcc

SEQ ID NO: 1022 - DNA, 713 bp; double-stranded, linear
gcattncggttaaagtakgtttcagcttctctcattttagaagtaccgaaaattggttggttatctggatttaatrtcacgataaatattgcttactttgttactttgtraaatgtacccattacgagtctcaatgttattccaataaatatcacttgttggtgcatggtttggatatgcacaatgatttcttgaaattgtttgaacgatttctaatggatcacagccaaatgtactgtttaatacttcagagtctctgaataatgcacaaantgaaatacaagttgtccagtttggtaatactctctctttttcgatttgtactaaagtctttttagaaagtccaattgtttgcgccatagtatcttgcgtataaccagcctctatacgaaccattttaaattttgtttgaattaaatctgtaaaactctgtctatccattctgttatctacctttctgtttggggaattttatccggacacaagaaattgcaataatacacatttcttgaaacacagattacatcttaatatatttttaataaaatgaaaagagtcaatttcacatttgtattaaattttgatcaagtcaacaagagttaagtttactttataatgaagcgaaagtaaatgaagtaaaattttatgcataatcactagatttgataaaacttacacttttataatgatatcaaatttacaaaggaaaactg

SEQ ID NO: 1023 - DNA, 570 bp; double-stranded, linear
aataaaatagaaatgattatgggtacaattatcgctatcatatccttgttattaattatattacaagcatttaatattacttggggcgttataccaattacaaattttggacatcaatttttctttttcattggtattattttagtaattgccggcatattttwyaagcgacttgagttttcgggaatcgggttattattttgtcaaaaaaccgtcgatgcaatgattcataatccacaatcagcccagattttttcattaattatatggatattattagtagttctagttatatatttcacaattagattatcttcacgtacaagattataaatatgataaaactattcacttgattaattgtattaattgagatgaatagtttttttattgttggaataacttttggtaatttataaataatttaaaaaaattgtttataaaaggaagcgtatatagaatgaaggttgggtatatagtttattgagggaggtgtcacaatgaataaagtcacaattaatcctcaaatccaattaacttatcaaattgaaggtaaaggggatcctatan

SEQ ID NO: 1024 - DNA, 487 bp; double-stranded, linear
ctttgttgtgcttgagcattattaaaaagagtatttaaatttagttgttggtttgtaataccattttcttttgctgtttcttcatcttcacctgtaagttttgaataagttgataataaatcagaattattaacactatatttccctttaaataatggtgattcgraataatgcttatctttatctgcagctaactggaattkccctaatgcagagtctgcgattgttggttcaagattaatcattgatttctcttttttaggatcatgtccatatgacatgtaattttcgatgcattaacaacagatttakgaatgccaagccctttaacaatttcatctgatgcatctgcgcttaatnctaatgaagataaaaacgattatctttcatckkttcttggaacttcacttcattttcaaaacggtcattaaaataatctttatacatttttgctgtttgttgttcactttttaggtatgtatttttc

SEQ ID NO: 1025 - DNA, 364 bp; double-stranded, linear
atatgttataaacaattttacagttgtatcatctactcgttctattctcatatcatctcactccttacagtcgatgaatagtatccacattgtattaaagcatcaaacaaaatacaatttatttgtttgatttctttctctaaamtattttggtaacttataataacatattcgttgtagcaaaactatttaaatgatttatacagttaaagcattaaagcactttcttaatttaattttaccttatcatagcaaatgtttcatccaaaacactctaatatagagctatattaacaattgcacatttgatttaaaagatactaagcaattattgtaaaattaaaaccaaaaaagcaacactata

SEQ ID NO: 1026 - DNA, 333 bp; double-stranded, linear
tgccccaggggagtacnaaaaaaaagnggggtggggaattggaaaccggaattagtggttaaaggggtttattggatgttgggtctaaagtattcccagaaatttatccatcnatgattgctttagccaagtttttttccaacccatctttatggaatttagttatctcaattacattaataaaatggatgaattacacaaggttgactagaagtatagttaatagcgaaatgaataagccttatataaaaatggcacaattatttcatgtaccaacaagaacaatattaatacgtcatttaacacctaaaattataccggctattatcgttg

SEQ ID NO: 1027 - DNA, 450 bp; double-stranded, linear
tgttccattcgttttaataatggtgatactgtaccagtatcgagtgctaattcagttacgactttcttgacgtttacaggagattcatcccataaaattgttaagacaagaaattgtgggtatgttagattgtacttcttaaaaactttgttagagtagtagcgattaacttgtctttgagcattgtacaaactaaagcatagctgttcttttaaattatgttgatcagacattaaagttctcctccagacatactatccgtttttntctcttttcggattggtaatcattaaaaagttgattgtttattaattcacaactttctttgattcaatgccatgcnaaaattaaagtatgtttaaagtttagaagatatttttgattaaatcaagcaaaaagataatttaatatatatgtgatcatttttaaaaataactgtnatagaaaaga

SEQ ID NO: 1028 - DNA, 535 bp; double-stranded, linear
tgcatctatacctagaactttaatttcggattttattgcgtctgtaatatctttaataccactttcgatagggaaactttcgtcaccttcaacatatttaataccaaagccaccaccaaggtttaataattcaacttgaatgccttgctctttaagccaacgtaaamcaattttagcagtttcaataaatgcttctgtaccttcaatctgtgraccaatatgacaatgtacaccttttaattttaagtgtttagattgttggactttgtcaattgcttttttagctaagccatattgaattgataatccaaacttactatcttcttgcccagtttgaataaattcgtgtgtatgtgcttcaacacctggattaactcgtaatacaacttgaaccgtatcattagcatagcggtctattaattcaatttcttctaatgaatctataacaaaataaccgatattattttctaaagcatacctaatttcatgtttcgttttattgttaccatggaaatggatgcgactcggttcaaaa

SEQ ID NO: 1029 - DNA, 359 bp; double-stranded, linear
gaagatgattgaattatggaatttttttcgagatatgttatttcggggatcagattttgcgattttgccttggatagagtagttgcgatttgtaaatacgtttttcaggttcgattcaatttcgttgttaagataatatggattagtttcactgacatgttgatgcatgtcttttttgttctgataaagtataaaatgtttacttaacattacttagtatgacacctgctaattcaaacattatttgagacattcttttcaaattaattataaatttttacctatagactagtttgatatttatctacatctcaaaattctcatcaacaatctgtcacatccaacatttttacttnagt

SEQ ID NO: 1030 - DNA, 341 bp; double-stranded, linear
tacattggtaaataattctcatagtttatgtctcgttgattaatccaatcattgtttttatcgggtaaaacattcaaacttttcaaattcacaattgattgatgtttcattaaagtatctaatttttgctctctagttaaatattcaccaatgtcattataatagatatcgtgattgtaacttccatctttaactaaaatagatatagctatcggtgctctacttcctgatccaaatatttttccaccttcttttcttgatttttcaccctgtgttcgttggtcgcctctcaaattaattatgtacagatagttaaattcatcgataaaacttttctaaat

SEQ ID NO: 1031 - DNA, 326 bp; double-stranded, linear
gtctaactttaatgtttaaaaancttagaaattttctactcataaatggatgctttatggaatattattaacaggcccagcttcaatgctagctatagaatttggatggttcttaacagagatgggtagacagccttggattgttcgtggttatatgcgcgtggcagaagcagcaacacagcagcggaataaccttcgttacaattttatttggcatatgtacatcatttaagtatacagtgcaacgtatatcgtagttaaaataaccgcgtagagagtaacgtagcagagcagaggaatgaaanattagcttatgnaacggtagg

SEQ ID NO: 1032 - DNA, 263 bp; double-stranded, linear
acaatcaggcttgtgaagaatgaattgcatgacgtttgtgtaattgaactgcgaggtttaatttctaaaatgctccagncctccaatgtaatcgcatcttgatataacatagcgatcgcttgatttgtcgttgtatcaacacctctaaacaacgtttcacctattcggcaattcatttattttacccaaatcattatataaaagttgtggtaacatgctcgaaataccacctgaaataatntcaatcgatatcctatttctct

SEQ ID NO: 1033 - DNA, 514 bp; double-stranded, linear
tttctatagaggatcctgtagagatgcaaattcctggtatcgtccaaattaatgtgaatgataaagctggcataaactatgtaaattcgtttaaagctattttaagatgtgatcctgatgttattttaataggtgaaatcagagataaagatgttgccaagtgtgttatacaggctagtttaagtggtcaccttgttctgactacattgcatgcaactgattgtaaaggtgctattttaaggctattagaaatgggcatttctgtacaagaattgatacaggcaactaacttaattataaaccaacgacttgtaactactattaagcaacagcgacaattagtatgtgaaattctatctcagcaacaactccgatatttcttttcccataatcattcattaccatcatcatttaagaacttagaagataaacttgatgatatgacaaaagcaggtgtcatttgtgaaactacaatgcataaatacatttaaactacattctaagaagcgacaat

SEQ ID NO: 1034 - DNA, 598 bp; double-stranded, linear
tttttcacgaacatttttgtttaaaattttctttcttaaacgtatactttctggtgtaacctcaacaagttcatcatcattaatgaattgtaacgcttcttccaatgttagaatacgcggtctattcattgtttgtgtttggtctttcgttgcagaacgtacgttagtttgatgttttgttttagtgatgttaacagttaaatcattttcacgattatgttcaccaacaatcataccttcataaacttcagtaccaggttccatgaagtttacacctctatcttcaagtcccaaaatggcataagtacttgcagaaccttgatccattgaaattaatgcaccattacgacgaccgccaatttgtgctttaatacgtggtctaaattcytcaaatgtatggttaataataccgtaacctcttgtcattgacataaattcagtcgtataaccaatcataccacgagccggtacattaaagattaaacgtgtaagtccattatcagttgtagtcatatcaaccatttcacctttacgtgcacctaakgattcaataacagcacctgcattttcttgtggcacttcacattgcacacgttca

SEQ ID NO: 1035 - DNA, 313 bp; double-stranded, linear
aaacagtgcttcattatcggtattgatattgatccacaagccgttgacctagggcgcacaatcgttaacgtcttagcaccaaatgaagatataacaattacggatcaaaaggtatctgaacttaaagatatcaaagatgtgacgcatatcatattcagctcgacaattcctttaagtaccagcatttagaaggaattatatganttaaccaatgaaaatgtccgtagtgccatgcgccttgggtgatgggcatccaagccatatttaattaatccgnccccaagaaaccagccggaaganaagtgggccatgt

SEQ ID NO: 1036 - DNA, 235 bp; double-stranded, linear
aataatgagtaggttttgattacttacgagataacatggtgaattattctgaagatagactaatgcgtccattacattttgcaatcattgatgaggttgactcaattttaaatcnacgaggncgacgccattaattatttctggtgaactgaaaagtcaacgtcactttatacacaagcaaatgtttttgcgaaaatgttaaaacaggacgaagattataaatacgatgaaaaac

SEQ ID NO: 1037 - DNA, 263 bp; double-stranded, linear
ncaatatacctcctatcatcacacaaaatgcgttgtttcgtatgattttctcaacatcgtagactaatgcaatcagacacaacaccatgctctatatccaatatttgctttattgcctatcaatgagcgtactgcgtgcttttaaataatcatcatcaattaatgactgtacaggcacctcatgaaaattatcatccgccaagtattgcgcacgatcactatatgctaaatgcatcgcttgtatcanatgatgcaagtaatca

SEQ ID NO: 1038 - DNA, 218 bp; double-stranded, linear
attgtacctggcacaatctcattatgtattggattatcatcattacgagcgccaaatattcatttatccaatctcattaaactccatctctacttcatcgccttaataaaagtttgtgtaaccgttatgacatgttgatcatttttagtnaatgttaaagctataacgtgtgatattgcgagtctgtcggcattcaatatcttcnaaatgccctacat

SEQ ID NO: 1039 - DNA, 396 bp; double-stranded, linear
gtttagacgctaatgntggcatatattacttgccatgcaaatgagtcataaggcatagttttcaagaagggttctgacaatgaagtgagcaacatgtcatgatgagaagcaggactatacaatgagaataaccttttgatttttcatgcataaggcgattcaatcaaaagcaatcaccttccaactgaattgtcattttgtaaaataaaataatcgatccaatcgttatctaattcataaatgtgtaaacacatacgttatgaatggataacgattttttgttatgttaaagtggtacattaatcatgtatttcgtatgataattaacgacaagtgtaatggttaaatgtattttatggatggaaatgcnataataggcctgggttaccatggngc

SEQ ID NO: 1040 - DNA, 400 bp; double-stranded, linear
agcattttgtttaaaagctgatgaagcaataataaactcttcatatcctctgtccattacaatttgaccttgatatacaatttctttaaagttttcgatttctttaaattctctgctatcatttaaaataggtgcattcgtaataacattcgcttccttcttatatcctttagattgataatattcttttgctgcatgacttactgttacgaaggcattaacacgatgttttactatgtgtttttctatactttctacaaactttgaaataagtggaactttattaataaaggcatttttcgcatatatttcatgcgcatcataaacaatattagcttttttataattgcttaaatagaccattaataatacgtcgaaatcatttgcatgaatcacgtca

SEQ ID NO: 1041 - DNA, 268 bp; double-stranded, linear
acttgcgtttctatttagctcagacaggaaaaatattcgctggaaatatgtaggaattttacttgcaattcagcttatctttgcatttatcttgcttaaaactacaatgggaatcaaggttattggtggtatttcaaacggttttaactacttattattaaaagcagcagatggtgttaactttgtattcggtggtattcaatatatcgtccctaagcacccacccattcctcctccggggaataataaccaacngaattaattccgn

SEQ ID NO: 1042 - DNA, 277 bp; double-stranded, linear
gtgaagataagaaattaaagttaagacaaggttaaaaataagcaaaaaatattgaaattacagatcattggantggtattccagaggaagatcaagattcatttttgatcgcttttatcgatggattaaatctcgttcaagaagtcaagcggtaatggactcgattatctattgctcaaaaaatcatcaattaaacggngatcgattaaaattaaagtgaattaacaaggagcaacgttaaatctattttaatcagactgagacgtcatcaagtcat

SEQ ID NO: 1043 - DNA, 379 bp; double-stranded, linear
ttatcatcacaagtgattttgaaaataaaaaaatcgaagatgatgacaatgattcaggtagtgtgccgatattgccgtttattaaacgagacaaagcatatcaaattatccagaatttagtaccagatttatcttatcaacaagttaatgaaggtatgcctttgtcaggnttccacagacactttttaatacctagtattattgtcatagctatggcaggtataggctgttatttttgggaaccattattattgttattaccgatataaccatagtcatatggttattgtgatccaaggtaccttatgtcaacagcgggttaaagcagagacaatacatcagattcggcatgaacgaaattatatttaangctnctaag

SEQ ID NO: 1044 - DNA, 399 bp; double-stranded, linear
atattgaacttgaagaccatgcagatataaatgaaataacatatcgattatcaaaaattttcggtattaaatctattagtccagtattaaaagtagaaaaaacaatagaggcaataagtgcagggacaattaaatttgcgccattntgaagaaaacagcacatttaaaattgatgtgaagcgtgccgataaaaatttcccaatggatacgtatgaattacagcgtgaattgggtggtgcagtattgaagcacttcgacaatatttcagtgaatgtcaaacgtccagatcatggaaattcgagtgggmagtttaggmttagatgccaattttatatggtatgnaagaagttggttccggggttccaggtgggatttaccngttgggtactggtgggtnaa

SEQ ID NO: 1045 - DNA, 400 bp; double-stranded, linear
angataaacagaggagcacaaaaatgaatnnaaatataatcatcaaaagtattgcggcattgacgattttaacatcaataactggtgtcggcacaacagtggttgatggtattcaacaaacagccaaagcagaaaatagtgtgaaattaattaccaacacgaatgttgcaccatacagtggtgttacatggatgggcgctggaacaggatttgtagttgggaatcatacaatcattaccaataaacatgttacttatcacatgaaagtcggtgatgaaatcaaagcacatcctaatggtttttataataacggtggtggactttataaagttactaagattgtagattatcctggtaaagaagatattgcggtcgtacaagttgaagaaaaatcaacgca

SEQ ID NO: 1046 - DNA, 626 bp; double-stranded, linear
ataaacttctacaccatcatctttacctacaacatttgtagctttaacttttagtccaaagttatctttaaagaattgttcacctactttttcaaattctttacgatgcttcttcacaaattcaatcgcatctttttctgcaggtggttgaaagccttgtcctacatattttgaagcttccatttcttctggtactgattttgtttctgtatttgtttctgtatttgtttctgtatttgtgtctttttttgattcattattcatcgctgaacatcctgataacagtagcgttgctattaagattaatttcgcctttttaaacatagctcatcacccatttatgtgkttatatagaatattaaaaagcattttaaaaaaaatttattcatctttacgatacactccatattctattggatcattatcatcataaaaggcttttttagtattaatagtaggctttcctatttgaattgtaattgtagatttttctggcttatttttaaaattatatagtttatcactcagttcaattacatcatcaactgtattgtctttagtaaaattttcctttgtactaaacaatgttgttactgtatctgtattagcagcgnaattcacttctt

SEQ ID NO: 1047 - DNA, 317 bp; double-stranded, linear
gacggcgttcaaaatgcaacggtcaatttaacaacagagcaagctaaagttgactattatcctgaagaaacagatgctgataaacttgtcactcgcattcaaaaattaggtatgacgcgtctattaaagataacaataaagtcaacgtcacgcaactgaagcgtacaacataaattgatagntatcatatcagcagtatatcttaccactataatgtaatgttgacactttcatatgcatatacagactattacgatcatgtccattatttagcncactgtcattatatggtggcattatgagggtataaacttagn

SEQ ID NO: 1048 - DNA, 223 bp; double-stranded, linear
atacgnattatgcaaaaaataaagtgagattggcatatgtgtaaatctaaaatactgttgaaaaatatttttagtgaagtaatcagaagttaaagatttaactgaagtaaaaatataatcaagattacgagtcattaacatttagctttaaagagggaaacatatcaaagtaggttagctaagnaaaacaccgactaaatcggggatatttcgtgacatgttg

SEQ ID NO: 1049 - DNA, 608 bp; double-stranded, linear
aaatatgaataatgcaattgaccaacgttcgataacgttgccatacccatattaaattttgtataaccttgttctttactccaaagtaacatatgcaagtatagaccatccattaatggtaaatctaactctggcaaccatctaattaaatcgactgaaatggcatcattaaagtatgttggcattaaactacaaaatgcaattacttcattttcttcatttcgcattacaccaattggcgctttagataagtattcttcattaaatncaccaacagagaaatgcatttccygacgattatctagccataaatcacttacatgttgaagttcatttataaattcagttgraaacggtggttcaataatttcgaacgaaatattaagttcatcgaattnatttaaagtcgctctaaatcccacggcgttttttacctgaagttgaaaattgcgttaaatcaataattgcttcttcacctaatttgaaaaattggttaccggnattatgatataaaggcatgtgttgatctgtaacttgatagaatataacatcatagcctaaatactcagcgtaattatagaatgcttctaacaattcatcaaaggcat

SEQ ID NO: 1050 - DNA, 292 bp; double-stranded, linear
tgtttttctacgctaaactatatgataaattgcctatgtatttactggtgtttatggcctttacagctgtaattttgattatgatgtacatacaagagaaaaatgaaaattacaaagttgaaaaaagatatgtggttagatatctcacacttaacgttattgtgggatatactttgccattgctttttgtatctatttacgtttttggtgtagtcggttttggatttgatgttttcaattattgtctaggtaktatcttgatgtyatwtatttcttggtttaggtntattnt

SEQ ID NO: 1051 - DNA, 734 bp; double-stranded, linear
taaatcntcaaagatttcttctaaaacattataatcttcaacgatactcgaataataatacagctcatcatttctgggcttggtataataaaatataacttgcccacctccatcgtccacatatgcaattacatataccttttcccactctactggtatcatttcattgatctcatttgcaattttattgtacatttcacttaatttttcttcgaaattcatgttatcgcctctattgttcagcttcttcttgctctttaacatattgctcgatttctttaactttattaatttcatattccgtttctggtaaaattccaaattttctatacttatagtaattttgtcgacctacttgaccaaattctgaatttatccaatcaatataatcaaatgaaacttttaattcaccttctcttgtaaagtcaaattcgcatgatgtccatggttcatgtccttcttctttaaataaattccttaaattttgaaattgtttatacaactcatacactgaatccataaattccgattccgatatatcatatttatttaatacactagtatagtagtataattcattacttccaggttctgtgtaatagtagaacacttctcctcctccgtcatctatatatgccattgcatataccttttcccactctaccggtatcatgctgctaatcttattcgcaatctcgctatacatttcacttaatttttcttcgaaagtcatg

SEQ ID NO: 1052 - DNA, 775 bp; double-stranded, linear
atttttaaccaaaattgcttttttatctgaaaagaaaggcaatgttaatgtttcttcaacaattggtgcaatctctgtttcgtataaattatatttcacaaagttaaagtcatctctatcacttttcaaaaattgtgatatgatttctgcactttgtttttcaaccaattcaggcacatctccataaatagctacaatattgtcgctcattcattacaccctttcattcgtttgacacatcaatagattatatcatgtttctgtatctataaaccacttgcatttccataagagcttgaatcaacttttaaattatcatctaagtcaattgtaacttgaccgttttgttgactattgtaaatgcgtactgcgaatcctttgcaatcgtttaacaacttctatattaggaagwtgatacatattgttcttcccagaagaaatcaaacttattttaggcttaatcatctctataaattctttagaactacttgtcttgctcccatgatgtcctacttttaaaatatcaatctccggcaagttatatttttttagtagtaaagattcattatttttactagcatcgcccattaataaaacttttttattttgatatgtaatcatagtaataatcgaatactcatttttatctcggctatttggaataaaactatcaaaaaaatagaaaactactatctccaagtttaaaactactaacttgtcttacatccataagtttaatggttgtacttatgggcttaatttccgataataacca

SEQ ID NO: 1053 - DNA, 234 bp; double-stranded, linear
gagaccaatcatcataatgaacgacaatcatgtatttaatatttaataaaatactgaataatgctataactgccattaattgaagaccaatcgcatctaatgcgacaacacgatcggcaagtgatgggcctagcacaacgcgaatgagcatagctaacataggangtgacaactatgattaatgcaataacgatgaataaccttgatgantcattataattcgcccacctctct

SEQ ID NO: 1054 - DNA, 400 bp; double-stranded, linear
ctactggtatcatccactgatttcatttgcaatttcattgtacatttgacttagcttttcttcgaaagtcatgttatcgcccctatagttcagcttcatcttgctctttaatatattgctcgatttctttaacttcttccatttcgtattccatttctggtaaaacaccaaactttttatacatataatagttttcacggcctaattgatcaaactctgtatttatccaatcaatataatcaaatgaaacttttaatttaccttcgcttgtaaagtcaaattcacttgatgtccatggttcaagcccttcttctttagaaagtttctcttaacttcttaaacaatctatataaatccgtccacaaatcataaaatactttttcagagacattatactctc

SEQ ID NO: 1055 - DNA, 333 bp; double-stranded, linear
gnggcatatatagcgttggcggtataacaaagaaaaatgtgagatcagtgtttggatttgtaagtaatccaagtctacaagttaaaaaagttgatgctaaaaatggcttttcgataaacgagttgttttttattcaaaaggaagaagtatcattgaaggaactgnactttaaaataagaaaactcttaatcgaaaaatatagattgtataaaggaacgtctgataaaggtagaattgttatcaatatgaaagacgaaaagaagcatgaaattgatttaagtgaaaaattaagttttgaacgtatgtttgatgtaatggatagtaagcaaatta

SEQ ID NO: 1056 - DNA, 347 bp; double-stranded, linear
tgggcagttacatttatgattatcagcacatgtttagcttataaatttttacgaaagtttagccgtttataaagcacatgcataatgaaacgagtatttgccacttgattagtacttcattattatgtcgaaaataaaaataagtggtatttttaatatattaagaagcactcataatcggctgttaattaataatatttttcataagtattgattcatcattttctttatgttaaatatgaatcagtatagataaccatattgttctgtttgagatagaaatattttctatttacttcttaatacagatatcaatatggcnaaagtgttnnatgaatcagaggtaa

SEQ ID NO: 1057 - DNA, 312 bp; double-stranded, linear
tccaaaacggagagccaagagttaactctacttatataggatacgcgccaattgatgatccaaaattagcgttttcaattgtatatacaaatcagcctgtaccaccaccatggttaacaggtggagacttaggtagagatgtaattaactactactttaagcagttaggtaaagatgataaaaataaagacaaagacaaataaaatttaacctgacgattgtgtagcgcatggttgtaaaattttaactttgcmaatattatagatgttggtataataataaagtcgtatttagaaatgatwaggagggaat

SEQ ID NO: 1058 - DNA, 404 bp; double-stranded, linear
gccattttgcgatgctaaatccattgaaaatgcaatacctgaaagtccaccaaacaaagaattgttatattgaccactctgtaaatatggtgctaatttcatgatgtacttatgcacaatttgctcagtattaatatcgaaaactttttgataagcatctaaaaacaaaatgatacctggtataccatgtgataaagttgaaggttcaaaataatcggtttcagtagatgcttttgaaatgaaatcatctacttctgaaatctcttgaaacttcttcttcaatattagattcatatcaatcatttttgtcaccacaccaatgcttttgagttttaacaatttcttttacaatagataaaacaaatgtttcttgatccttatcaatgccaaatattcgattgnag

SEQ ID NO: 1059 - DNA, 233 bp; double-stranded, linear
atgtacataggnatgacataagtgtgccttctttttcaagaccctccatagaaataatacatggatgtgcaccacgntactacctctttaacgttaccagaattgataaattaactttctcttgtgttgctaaacctacaactggtgtaccttcttcgattaaggcaattgtaccatgtttaagttctccaccagcaaaacctcgctgaatgtagaaattcttaagtttaagt

SEQ ID NO: 1060 - DNA, 295 bp; double-stranded, linear
gcaccactactgttaataacacacctaaaaaagtcgaaatataagggttaatcgctgttttaaatgtatatcctagtgcgattgccattaattatccgatagctttttctgctgcttccatagtcatctcacctaatgttggatgtgcatggattgttaatgcgatatcttcagcattcataccagcttcaattgctaaacctaattcagagataatatctgatgcaccagtaccaactacttgagcaccgattaaagtatcatcttctttagtgtaataagtttaacaaatccg

SEQ ID NO: 1061 - DNA, 413 bp; double-stranded, linear
caatgcctctcgtgttgcagcttcttccggtgaaaaaccaatattttcaagtgcaataatttgatctaagtcctgcatgattacttttcttaataccataaaaacacttccttagccctatatatcaaaagtaataccttcatctttatattcattattttcaaactaccttcactataaaaaacgagtctttttattgaaagccattcgccttaatcaattagacaagttgtatkatacgaattagtaaataatcatgattataattcattttaagcatactcaaaaagactggtacatgtataccagtctaattcgaaaaaatatatttagttaaaaccatttcaaaaacgacttcacttttcctggcttagtcggtctgtctaaataaacaaaattaancattggattac

SEQ ID NO: 1062 - DNA, 400 bp; double-stranded, linear
aagctgcatactctccaaacttagaaccaccgaagcgattcacaaaatatttattagctaaaaagtcggcacataaaattaatattgttagcaatgccatagatacataaaacacccatgataaatgctgattatgaaagccaaattgatagattaaaaagccaacccataatactaaaacagaaggaataatcggcttaatcaacccaacaaatgctaacatgaaggcagcgatgataagtagccataaaataattgtcatgttgatatcacatcctcttttgtattttttgatttttagtaaagaatataagtatcatacctaacatggttgatgctgctggataccaaaanatacattttcccaaaccttacccagtggactcctaggcaccacctt

SEQ ID NO: 1063 - DNA, 400 bp; double-stranded, linear
tggatcagaaggaatctggatgcctattgatgacaaaggatactttaattttgacttcaaaacgaaacgtttcgatgatttagagttaaagaaaaatgatgagatctcattaacatttgcacctgatgacgaagatgaggcattgaagtcattaattttcaaaactaaggtaacgagtttagaagatattgataaagcagaaactaaatatgaccatactaaagtggaaaaagtaaaagtattgaaagatgttaaagaagatttacatgtagatgaaatttacggaagcttatatcatacagaaaaaggtaaaggtattcttgataaagaaggtactaaagtaattaaaggtaagactaaattcgcaaatgcagttgtgaaggtagactctgaactaggt

SEQ ID NO: 1064 - DNA, 434 bp; double-stranded, linear
gtggtcgtgaagcaactgatttcaaagaagaagatatcgagcttttcaaagacattgccgacaaagtaaaacaaacaaatagttatgatctagcgtttgatgaattagaaaaagaaaaagacttcctgcaagtcattgtcaaaaacgatgacaaaaacttacctactaatcaaaatgtcgctcaactagtagaagatttacgcctagaaatccagaaaatgcgcgaagaacgtcacctacttggtcaaatgatgaatcaagtacatcagcaacaacaagaattaaaagaacttcaaaatcaacttacatctaaaatcgattcaaatagcgaatccttaaaagccatccaaacatcacaagaggctatccaagaagcgcaagcctctcaagcaaaagcattagctgaatccaccaataaagttggaaagaatgct

SEQ ID NO: 1065 - DNA, 239 bp; double-stranded, linear
taaaacatatggcttgatattgcagaagaattgaagttatcgtaccagaaacggtacataatcatgattatatggaaacgaaaaaaataaaaatgggtcatttaatataggaggatttaacattgaattttgaaggtaantaattggaaaagatttgaagttgcatcgttattatcgtttaatgattttatcactggaagattacttgaaggtgcaaaagatacnttgattcgacatga

SEQ ID NO: 1066 - DNA, 202 bp; double-stranded, linear
aaatatctatagacctttattcggaaatggttcgtctccagaatggaaggatgaagtaccgagtattgaaaggtagaaggtctccaaactttacctgnacgtgcacganatctaactgaagatgatttagcaattgaattgaaacagccaattgtcggttgtaataacttaggagagttattagtattaaatgccattcaca

SEQ ID NO: 1067 - DNA, 749 bp; double-stranded, linear
ctacaattcgatcaacgccgaagttagatacaccgattgctttaattttaccattttcttttaactcttctaatgcacgccatgagccatatacgtcattgtaaggttggtgaataagcactagatcaagatagtccaaatttaatcgttgtaatgatcgttcgattgatttgatagtatcttcatagttaacattttcaatccatactttagtcgtaatgaatagttcacttctatcaatacctgaagcttcaataccttgacctacttcagtttcatttaaataactttgtgctgtatcaatatgtctataacccgctttaattgcttctttaaccgcttctgcngtttgttcttgaggaatttgaaatactccgaaacctaatactggtatctttacatctttacttatttcaatatgattcataaaatgaacctcctttatcttgtatgtccactataaaccatggagcgaactctatagcaagccataggtttactttctctcccaaagacgttcaacattgtcatcataattatcactagcattgattttagcaatatgattatcataattatcaattttatattgtagtaaatctctcgcatcatgaattgtctttaagttttcatttaattcttcgagttgcttatttaaaatttgcttttgctgtgcttgaatattttcatttttaggcaantgcgctaacctgcaaaattcgataagcgattcaatactgacgcctgca

SEQ ID NO: 1068 - DNA, 436 bp; double-stranded, linear
tcctcgagatagacaagaatggtggtacaatgttttttatgacgatggcaaatatnataagaanataattaagaatgacatgtcaaaaattaggcgtaatttttagatttatctatatatttatgccaccgctcaaacttttatnaaaagtaaaaagacaatatttatattgaacttgtgacgtgaatttctaaaacacaaccaacaatccacaaggaaactagtaaataagtttaaataagatttcgaaaaaatgtgtaatattataatatgaaaatctttaagattatagaagaatcatactgactaaaaagattttgaaagtgattaagtatttaaaacacgccaatcttaaaccgctattgacaaatatgaagcggaaccaccgttgtntttcttttncaggtccaattgaataaatgttgatgaatagaat

SEQ ID NO: 1069 - DNA, 551 bp; double-stranded, linear
ttctcaagtaacaggtattattgttactggtacaatcaatagagaaaaatatggcattaactttaaccaagcacttgaaactggtggcgtaatgctaggcaaagatgttaaattcgaagcatcagctgaattctcaatctcagaataatctcattacacaatcctcattgttttaatatatatacgaaatgccaactatatcatccctaggtatagttggcatttttcgtttaactcatgtgtaacaagcactaactgttcaccctaattttagacgcctttcattcaggtaggtcttattgaaactgaaaactttgatgaccttttgcaaagccattaactgtataaagcatagatcctccgcccatttctatatcattggaacaaatgatgagttgatttgttccaggtataaattgcggatgagtagaacgtaacatatgcccttcatctcggcctggtatcaatatttgtcctattggataaccccttttattaaaaactaacactcgaccttggaccatacattgctacggataaattatcggcac

SEQ ID NO: 1070 - DNA, 325 bp; double-stranded, linear
tatnatggtaacgcatgancctgttgcagcacgctatgcaaatcgagtagtgatgctanaagatggtcaaattttcactgaattataccaaggggatgacgataaacatacctttttcaaagaaataatacgtgtacaaagtgttttaggtggcgttaattatgacctttaacgagataatatttaaaaatttccgtcaaaatttatcacattatgccatctatcttttttcgttaattacgagtgtagtattgtattttagctttgtagcattaaaatacgctcataaactaaacatgacagagtcatatccaattatacnggc

SEQ ID NO: 1071 - DNA, 771 bp; double-stranded, linear
taaatgccgcaattggatagctttaatataattaatagtcaaggtattnccaacaanaatatattatccacccgaaggaagcggggtatntttgttactgacgtcccacaagaagcacanatattagatagtgcttactctgaaattaaaaaattaagagattatgatgaaaaactaattatcccaggattttttggcgtatctcatgaaggatatatagttacatttccacgtggcggatcagatataactggcgccatcatatcaagtggtgttagagccacaatttatgaaaatttcaccgatgtgtctggtatttataaagctaatccaaatatcatcaaagatcctgaattaatcgaagaaatcacttatcgagaaatgcgtgaattatcttatgctggttttagtgttttccatgatgaagccttacaaccactttataaagatcgcatccctgtggtgattaaaaatacgaaccgccctcaagataagggtacatttatagtgcatgatagagaaataaatgcgaaaaatgtgattagcggtataagttgtgataaagattttaccgttattaatatcaaaaagtatttaatgaatagacaagtcggctttactagaaagatattaggtgtcttagaggataataatatttcatttgatcatatgccttcaggtattgatactatcagtatcgttatgcgttcaaaacaaattcaaaataaagaaacaaaagtattaaatgaaattcgtcaaaaatgtgatgtt

SEQ ID NO: 1072 - DNA, 237 bp; double-stranded, linear
cggtggatccgtttgatcttgagtgaggtgccaatgaaagttatgagccacgttgtcgcgcgcaccatatcgtagcacctagtgataataataaggaggaattataagtgtttgatcaattagatattgtagaagaaagatacgaacagttaaatgaactgttaatgacccagatgttgnaaatgantcagataaattacgtaaatattctaaagagccagctgatttaccaaaaac

SEQ ID NO: 1073 - DNA, 733 bp; double-stranded, linear
cttcttgtgagggcgttacatcaccggatggatgattatgaactgcgatgattgcattggcattttctctcaccgcaatactaaaaatttcacgtggatgtacaatcgaactatttaatgtacctttaaaaacacaggtttctttaatcactacattttttgaatttaacaataaaatgacaaaatgttcttgtgttaaatctttcattgttggaatcatataatcagcaacatcacttggttgcgttatttktatacgattattttcagctcttctccccatcctttcccctaactcaaatgctgcttttaaagtaattgctttttgtaatccaatccctttaacttttatcaaatcgttaattgaagattttttcaattcattcagattcgaagcagatttaagcagttcattactaatgtctatgctcgagaatccttttcttccggtgttaattaatatagctaataattctgtattcgaaagactttttgcaccatggcttaacaaacgttctcttggcatttctgaagttaccatttctttaattttcaaaaatatacgcctcctaaaaattgatggatatcattataaaaaagtgaattgataaaaaaggarataaatataaatggaacaaggggtaatagtttaatcggcttaaatatcatggtaattaaagcaactaaaccagcaatgacaaatgtaaataanatgacataaatagtgaattgg

SEQ ID NO: 1074 - DNA, 768 bp; double-stranded, linear
atggttattttttatgctctaaatcgtatgtgtttataaggttcaatttcttgccattattaattttgccgagcagtaatgggttgttaaagtatccatcaattatgcttagcaatattgaaaaatttaaatgaaaaagcggttcaattcttgaaaaatagtgtatatttacattttggtaataactaactataatttacataaggaggttgtcatttggtagtattgttatcttatagttgcagttgtatttttagttttctatatcaatttatatctatagaagaaacgtcatttgattatttacatagaagatcgaaatgtgattattgtaattcgtcactcaaawggtatgaattaatgccgattattagttttttattattaaaagggcgatgtcgaaactgtcgaaagcgtatttccctaacacatttcttaggggaaacctttgctttaatacctatcgtctttattaagtatgatttcacatacgtaaatgtacgctatttataactacatatgtttttctgcttatttttactatgaccgatatcacttctttaatgttagattgtcgcttaattataatttattgtatcgtttctctctcgttaagtatgatttatccagtagcttttatcattattagtatgaccacgcatatattctactttttatttcgggcatatattggttatggtgacgttttactaatatctgcactttctttgtttttcccctctccaattcactatttatgtcatttta

SEQ ID NO: 1075 - DNA, 400 bp; double-stranded, linear
tcatattcatttaaaataccattcatctcagcttttctcattttctctttataaagttgtatttcgtgtcttaattctggctcagacatctcactcaatttcttctgttccatcggcaataccactttcttctaatttagctttaattttatcatatttatatccttttctcataaggccttcgatagtttttgaaattaatttctgttgcgtgtacttctttcgatttttattataaattttttctaaatctcgttgtaataaatcgtctaaaaccgcttcatcttgtgtaaaatccatttcattcaatacagcatgaatggtttccatttcaaaccctttttgaattaaagattgcattacttttgcntnaactntattttgtggcccnttttttgtt

SEQ ID NO: 1076 - DNA, 753 bp; double-stranded, linear
ttaggtcaaaatatgttttatccaaaaggcattttatctcaatctgctgaagcaaagagtacaacatataatgcaactataggtatggcgacaaacaaagacggaaaaatgtttgcatcatctttagatgcaatgtttaatgatttaactccagatgaaatattcccttatgcgccaccacaaggcatcgaagaattacgtgatttatggcaacaaaaaatgttgcgtgacaatccagagctatcaatcgacaacatgtcactaccaattgttacgaatgcattaacacatggtttatctttagttggcgatttatttgtaaatcaaggtgacactatcttgttaccagagcataattggggtaattacaaacttgttttcaatacgagaaatggtgcaaaccttcaaacatatcctatctttgataaagacgggcattatactactgattcacttgtagaagctttacaatcatacaataaagataaagtcattatgattttaaattatcctaataatccgacaggttacacacctacgcataaagaagtgactaccatcgtcgatgcaattaaagcattagctgataaaggtacaaaagttatagctgttgtggatgacgcatactatggtttattctatgaagatgtgtatactcaatcattatttactgcattatctaatttaaattcaaatgcaatattacctgttcgtttagatggtgcaacaaaagaatttttcgcatggggattc

SEQ ID NO: 1077 - DNA, 405 bp; double-stranded, linear
agaagcgatttgacaataaaacaattgaaaaacttttggaaagcaagtggtgggagaaaacgcctgacaaactaaaaggattttcggttgaatatttaaataaaaaggatacttaatgatatgagaattttaaatattgtatcgagtaatattgttcaagacccaagggtacttaaacaaatagaaacaattaaaggcgttacggatgattataaaattgttggaatgaataattcacaarctactaataagcgattggaaaatttagattgtaattatcgtttgttaggtagcaaggtagatccaaaaaatattctttctaaattaattaagcgtataagatttgcaacaggtgttatccgagaaattaaagcttataaacctgacgtgattcatgcaaatgat

SEQ ID NO: 1078 - DNA, 504 bp; double-stranded, linear
cacagcagttaaatatataatataatacagtccggctacgacaattaataataagaactccatattcacacctcaatattccataacttttactttaatatcaatccacttaaatccattcacatcattgagtataaaataatatggtgatatacgttgaagttgattatcttatatataagtatacttcacagaatttataaaattgtttagtcatcatcttcagtgtttaattcaaaaatatagaatctactgtattgcatmataaattgaaatgccacaaattgtgctccagcgataaccaacatgctcacaataattataaacttagattctacgacattaggmaccatatatattcgataattttttcaatatatataaatgagctcaacgcagttaataataaaccgaaatgtgttttagttttaccaccccaacgttttgttactttaggtaattttaataacgtgaacattccgccaattactaataacaaataac

SEQ ID NO: 1079 - DNA, 645 bp; double-stranded, linear
cattcttaatcaacttcttcataatgggaatttggcatggtancgaagtgtattacattgtttatggtttataccatgcagcattgtttataggttatggctattatgaacgttggcgtaagamacatccgccacgttggcaaaatggtttcacaacagcacttagcattgtgattacattccactttgtaacatttggctttttaatcttctcaggtaaacttatataataaaggagaatttaattatggaatttagagaacaagtattaaatttattagcagaagtagcagaaaatgatattgtaaaagaaaatccagacgtagaaatttttgaagaaggtattattgattctttccaaacagttggattattattagagattcaaaataaacttgatatcgaagtatctattatggactttgatagagatgagtgggcaacaccaaataaaatcgttgaagcattagaagagttacgatgaaattaaaaccttttttacccattttaattagtggagcggtattcattgtctttctattattacctgctagttggtttacaggattagtaaatgaaaagactgtagaagataatagaacttcattgacagatcaagtactaaaaggcacactcattcaagat

SEQ ID NO: 1080 - DNA, 267 bp; double-stranded, linear
agatgccaaaatcaaaaccaataatttggcaacaacatataagtccactttaccggacctntaaacttatcgtactgttaagaaccaaacgactgccattatttggtcctaaagccacgatggtggtagccnttgtaataatgctggcgtagaaattaaccgccacccctaacaccgaactataacgcggataaaccaataaaattatgatataatcatccgttaagtcaatccatagtttaacatcccttatgtttaatttactct

SEQ ID NO: 1081 - DNA, 441 bp; double-stranded, linear
atatttgtccactattagaagattgtagagaaggacaaaaacgttataaagctagtttgaaagaagcgtgataacatgacaaatattacaaaagaggtatttgataatttagaacaagagattgatttatttgccaaaaataagacattaggttctagtgaagcaaagccctacttggatgaataccatagtaaaattattgattattttaagcaggttaatgacataactggcaatattgattttgataaattaaatcaatatcctgttgtgccaatgaattttaaagaaagatatgattatatgattgaacgtaaatatcattttatgggctatcgacaaatgaagacctttaaaactgaattgattaaaatgnatgctagttatcaaacaaggttaaagaataagcaggtatngacaagattgatcatttcctagtgt

SEQ ID NO: 1082 - DNA, 410 bp; double-stranded, linear
aaaatttcttagttgatggttattgttgttgatttgaataatttgtagcgaatattttgtaacagggctactaagaatttttataacaagaagtgatttcaatcgtactaattttcagcgtttgatgacaaaagtgtatgtccaaacttaaataatggcgataaaatttaagtcatgggtacatttaatgttttttgattcaaacttccattttggtcaatttgctttttttataacatagttgaatatcaataaaagattagcaagttagttcaaaatggctatgtattgttttttgaaatacataggtttgaaatctatattaattatgcaccaaataatttaattagactctatcgaaaatttccaaattttgcttactatctttctaattttacttttatattgtg

SEQ ID NO: 1083 - DNA, 586 bp; double-stranded, linear
cagatattcccttctatttacaagttggtaacccatatttatcagacagcgtagataatcataccgaaaagttgttagaacgctacgagcagttggtggatttagttatgyaaagtaatgatatgaatcacgtttatgtgttaccacaacttcatacattactttggagcaataaaaaaggtgtataaaggataacttattttactttttgcaagtcatatctaatgaataacaatatattaattgatataatagttgattgaagtataacgaacaggagtccatcatgattgtatatatattaattaatattgctatcgtcgtacttataactggattcaatttatataggcatcaaatgcaacatttatcattaagtgcaatgttgttatctattacgataaacgcctttataaatacattcataattgataaatataactttattactctgtgtactataacgatgtttatcatttggacgatactacagttttacattgataaaaaattaaaacctgtatacattacagaccaaaaatttattgctatcatattaacgattgttgtcagtttaacgcaacgt

SEQ ID NO: 1084 - DNA, 638 bp; double-stranded, linear
aacacaaggtagcgtcattagcatttagattttattgccaaattatataacgatttatacatcaataagaaaacaatagatgatgtatctgcagtttctgaagtgaaatatgatattaaatcacaaatgagtgatgatgagattaagcgtttagaggaacaaggacttcaagctattaaagaaggacaatttgcagtacttttgatggcaggtggtcaaggaacaagacttggttacaagggccytaaaggttcgtttgaaattgaaggtgtaagtttatttgaacttcaagctaaccaattaaaaacattgaatcatcaatctggacatacgattcaatggtatattatgacaagtgatatcaatcatgaagaaactttagcttatttcgaagcacatagttattttggatatgatcaagaagcaatccatttctttaaacaagataatattgtggcgcttagtgaagaagggaagttaattttaaatcaacagggtcgtattatggaaacgccgaatggtaatggtggcgtgtttaaatctttagacaaggcaggatacttagaagaaatgtctaataatggcgttaagtcatattttcttgaataatcatcgacaatgttttcagtaacatgttg

SEQ ID NO: 1085 - DNA, 618 bp; double-stranded, linear
attgcaatattatccgcttggttcaacacgtcatctttattaataccatttattggaaattccacccatttcccgggcttcttacttccctttataaaactgcccatttaatgaatactgtttagcttcatctattcgtacttccactagtttaccaatcatttctttaggcgctttgaaattaactagcttatttttatcagtgtagccagcaagaacctgatcatcttttttactacttccttcacaaagtactgttacagtttgtccttcgtacttactcatagctatttgtgaataatgaccaacttttttattcaaacgttgcaatcgttcctttttgacatttaaaggtacattatctttcattttagcagcaggcgtaccatcacgttgtgaatacaagtacgtatatgcatgttcaaaaccaacttcatcatacagagttaaagtttcttcaaattgttcctctgattcatttggataccctacaataatatctgtagttaatgctacattaggaattctatctttgattcgttttactaaatccaaataactttctcgtgtatattttctacccattatntttaatactgcattatttccagattgaac

SEQ ID NO: 1086 - DNA, 502 bp; double-stranded, linear
gagcatgatacagaaataagcaatagtaatattgaaaaagttgtcggtcattacattagccagcaatatcatgatcagtttaattcatcaagaaagtctatctatacttttacagaaacagttcaaccaaatcgtgttatttatgatttttatgattatgatccgtatcaattagcagcaaataatgcgaaagcattaaaggatcatattgaacaaaactttaactttaaagtccaaagtaccggtgttakttactttagtgatggtacagttaatatcattcaaggttctgaagaaagagataaatatgttgatacagtttcaacaaaatcttcgttacgacgtattattagcgaaccanagagctatctaaacaccctttaaataaagaacaggttgancaaatcacagctatattcaagtaaaatcaaaggcataataatccattacgctcgatacgcactatggttattatgcctttaaattatttctatatataant

SEQ ID NO: 1087 - DNA, 429 bp; double-stranded, linear
ttgcctgatggacgatggccatcacagactgagtttagattgtctttaatgcaacaacttgctgtaaaccaaattacgagtggtaatgaaagaataagttcagttaatgggccaccaggtacaggtaagactactttattaaaagatatatttgctcatctagtagttgamagaggtaaagagttagctaaactaaataatcctaaagatgcatttgtcaaracaaaaattcatgaaacggatgataaatacgtatacttactaaagganntattgccaaatataagatggtagtcgcatctagtaataatggagctgttgaaaatatatctaaagatttaccgaaaattgaagaaattataaganatcccgaaaaatgtaaattccctaaatatgaacagaattatgcaaatttagcacatgaattaa

SEQ ID NO: 1088 - DNA, 611 bp; double-stranded, linear
taagacctaatattttggnccaatactatggtgcaggtnatttatatatgacaccaacagatatgggtaaattaattactcaaatacaacaatataaattattcagtcctaaaataaccaatccattattacatgagtttggtacgaaaaagtatccagatgaatatcgatatggtttctatgctaagccaacattgaatagacttaacgggggattctttggacaagtctttactgtttactataatgataagtatgtagttgtacttgcattaaatgtaaaaggaaacaatgaagttcgaatcaaacatatttataatgatattttaaaacaaaataaaccttacaatacgaagggtgttattgttcaataattaatatagaagatataacatgtatatggcattaaggcatcgaccttatctgaccagtatacgagttatatcttcttttttatagtggtaaaaagtttaaagtataaggttgaagaaggatgagtttaaaaatatgtgttaactgataaaagggganatcatttggtgagttggcatcagnctaaantgaatgaagacgaatacgttggtccatgcgtggtgtgantgttttctaaa

SEQ ID NO: 1089 - DNA, 644 bp; double-stranded, linear
ctggataatcgctttaatatgatcaatttgcttttcactcatattaagcttatctagccctttcattttattcatacctggaatcattttcataatatcatccagtggtcctagatttttcaccygwtcaagttgttctaaaaaatcatctaaagtaaacgatgactcacgcatctttttctctaaatcttttgctttttcttgatccacatcttgttgcgctttttcaattaaacttaacacatcacccatacctaaaatacgtgatgccatacgttcaggatggaatagctctaaaccatctaacttttcactcataccaacaaatttaattggtttttgtgtcaccgaacgaatagataaagctgcaccaccacgtgtatcaccatctaatttagttaaggtaacacctgtgacatcaagttgatcgtcaaaagattctgcaacattgacagcatcttgacccgtcattgaatcgacaactaacataatttcgtttggtttagcaatgtcttttacttcttttaattcgttcatcaatgcttcatcgatgtgtaatcgacctgctggtatcaatggattacaaagtctaaatgttcttctttagcangttttaatgcattagttacaatttggtgtgggcc

SEQ ID NO: 1090 - DNA, 207 bp; double-stranded, linear
gatcctatcgttttagtgcatggtttcaatgggtttacagatgatattaatccttcagtgttaactcattattagggcggtaataaaatgaacattcgccaagatttagaaaaaatggttacaaagctatgaagcaagtataagtgcttttggaagtaactatgaccgcgcattgaactttattattatatcaaaggcngtcgngta

SEQ ID NO: 1091 - DNA, 212 bp; double-stranded, linear
gactctagaggatccccgctcaaatgccatttggtgatattcgtgaagctgctggcgaaaaaacatttaatccagtggaagatcgtttcgtaataaaaaaataatcaatatattgttaggaatgggacagaaatgataaagattcattagttattcattatgttgtagttcttacacattagccgctgctaatngcaacttaagantaggtt

SEQ ID NO: 1092 - DNA, 208 bp; double-stranded, linear
tggacctgcaattggttgccagcagcaactttagcttcatagctagctttgtgagcaagtggtaaacctggaacgatatcaccaattgcatagatattgctgatagacgtacggctttgtttatcaacnnctaataatccacgtcagcgaatttaacacctaattcttctaggcctaattcgtcgtgtttggacgacgacctacatta

SEQ ID NO: 1093 - DNA, 902 bp; double-stranded, linear
cttaaaagttgtntcaataatgattgtattagttgcatgcttattatatatgaatcatagtattgatttacctacccttattatgatttcaattttttcatttgtgatatttgatagtgttgaaaatattaatagtgctgcacacgtacttgaaatgatagatatgacgatagatgatattgmaaagataaaaaatgctccagaactggatgagaatggaaaaaatttgacgattaaaaatgaaaatatcgcttttcaaaacgtgaacttttcatatgatgataaacaagtgataaagaatgtgaattttgagatacctacacaaacatcaacagcaataattggaccttcaggaagtgggaaatctacattatgtcacttactcttgcgcttttatgatatcgatgatggaaatattcgcatcgatggtgttgatattaaagatatgacattaagtacgttaatgtcgaaaattagtgcagtatttcaaaaggtgtatttatttaatgatacgattgaaaataacatattgtttggcaatccaggtgcaacgaaagaagaaattattcgtgccgcgaagcaagcatgttgccacgacttcatcatgtcattacctgagggatatcaaacaatgctaaatgaaaaaggtagtaatttatctggcggagaaaagcaaaggatttctattgctagggcgatattaaaagatgcaccaataattattttagatgaagcaactgcaagtattgaccctgaaaatgaacagctgattcaaacggcaattaatgaattaagtaaaggcaaaacagtaattacaattgcacataaacttgaaactattaaanatgcagatcagattatagtgctcaatgnaggtgaaataattcaaaaaggtagtcctg

SEQ ID NO: 1094 - DNA, 632 bp; double-stranded, linear
acgcaagggatatgattaaacaccataatatacaatcaccttttttatacatgaaagcactaatagaatcgattcatttaaacataaaacatgattttaaccagcaagatttgattgaaataccaattgtgtatggttcgaaatatggtccggatttagaatcacttttaaaacattacaaaatcaagctagaaacttttattgaattacattctaaggcgcaatattttgtttcgatgatgggatattcacctgggtttccttatttaactggattaaataagaaattgtatattaatcacacgagtaaacagaaaaaattcattccagctggttctgtagtacttgaagggraraaatgcggtattgtaactacggatacaattaatgattggttagttattggttatacaccattatcactttttaatccgaaagaatcagatttcgcacgcttaaagttaggcgataatattaaatttagacctatcaatgaaaatgaattagaagtaggagcgtttaaagatgtcaatcataattgaaaaaagtggcttattcagtagctttcagactttggcagaaggggatatgaacatgatggtgtaattccatgtggtgcacttgatacttta

SEQ ID NO: 1095 - DNA, 212 bp; double-stranded, linear
gcaacacgattgctaaaaaatgatatacttattaattgttgcaacacttgtttatgtgatatactgatcatggcattgtggcggattgatgaccatacacatgacgtgacaatgataaatcattgccactacttgttaaaacagcaatttctcaagtggaagctggtgcnatatattncgccaataatatgatggatggtttgttgctgaaa

SEQ ID NO: 1096 - DNA, 466 bp; double-stranded, linear
aatgaactgggtattncttttgccatgcttgcccactgccatgcatttgctgaagaatgtttttgtagaaccggcttaagaatttgaagtttgtagtagtatctaaaaagattacttggtgatactcaggatgaattccttgttcattattttcagctcctttgccctgaaccatctggaacagagttatttgtgagtttttacccaatactgtgtaattataaaggtaattaattcaaaacgcaagcccctatataatgtttattaaattataggtcgacccgttttagtactttcttctgcagacttttgtagctgcttgaagaaatcttcattattcttagaccttttaagtttgcgaataaatctttcagtaaagtcagttgagtcagtgaatagatttcttaattgccataatgtgtctaattcagatttacttatcaacaatnctnctttacgcgttgaa

SEQ ID NO: 1097 - DNA, 208 bp; double-stranded, linear
ttttgattcaataggcggttccgtgttatcactgacaactttagttgtagcttcatctttatgtatttcttcgttaaatccttcaagtttttagtcgtgggattttaacctcaggatgttccatcatgtcttgactatcaagtccttntacacgtgtctttatgtgatgcttgattgcgtncccttactttttgaataggggtagtaa

SEQ ID NO: 1098 - DNA, 571 bp; double-stranded, linear
ccttcaacgaaaatagcatattgaccataaatattatgaattgtttgttcaacatcttcagttattggatcttgactcaaaaatacattaaatacttcaataccaaatttacgtgacatttctacagcttcatacgtatcaataataccatcttgactataattaaatgcagacggttcgccgtctgaaaatangattaaaaatcgttgatgttgatttcgacgcattaatcgttcacttgcaactctaatagcaacaccatcacgattatcatcttgaggttcaagtgccataatacgtgggccatctttttcaaaggttgagtaatcatagttaataatttcattaatgatatttggttgtgcatgctcgtctgaatcaaaggcatcctcactgaatgataaaatttcatgtttaatgttcaatgcttttaacgtctcgtggaataacactacacctttcttcgtttcagccattttatcatgcatacttgctggacgcatcaattaacaatgtaaatgtncgcatcaaatgattnacttaaatcttgttttttgtaaaacaatttata

SEQ ID NO: 1099 - DNA, 214 bp; double-stranded, linear
tgcaagtgaacaagtcattaacttgtttaatacacgtggggcacaagtcgaagaagtttgggtgaagggccatgaaattacagaaactggattaacggctggtcaacaaatacttgggaaataacagttctattaagaagcggacagatggaaaagattttacctttcatctgccgctttttgatttgaaggccggaccnaatttaccanggaa

SEQ ID NO: 1100 - DNA, 1158 bp; double-stranded, linear
caccgtattgtacaaagaatttaaagttttcgatttcttntcttaatttatcatcagctatcggtttggttgggataattttattatgttccatttttactggatattctttttctttactacgtgagtatcctnttttatcttcccataattccctcacaataaattcaccttttgtcgttctggtattgcggtctacatacaggaccaatcctctggattccatattctttccatttgtttctattgtcattttagagtgaattatccaagtgcctttgtcgcccttttcaaactcttgatctcgaaagccttccttatcataaaagtcttcaagatttttagttggatacaggctcaacgttttgttgaagttttctttaatttgtttatctttactgctttcttcctttttcattccgcaagcccctataaaaacagctaataatactaaatacagccagagcctcaacctttttgagtgaatcatcatttcacatccccatttttatttttgatgcaaagttaagttcaaattccaatattaataatattagaggaaattttatgattaaatcctcgtggattttaattgttagttgtatttttcacatatcaacatcacaaattatttaaaaagcgcaaatatctttataatttttattggcctaaccaactaattaattaagataaattgcgcttatatttaaaataataacactgaaactcaatgtatttacttattaaaattgatgtttaaatacaactttactaacattcatttttcggtttacattaattkgttagataacgatatatatcatctcttacagctttatccagtgctaaatccatcgttactacgtttgaaccattcggcattttatcttgcttttctgaaccttctatatatccagcagttcctaaataataaaaatatataccatcatcatcttttttctgtacaaaaatatacattttaattccttttgctctatgggacaaaattttctgaacttcttttgattctagcgttctattagatttagtaaaccattttaattcatcttgacttaaaaattcatcttcatattttgtgctatcacttatatcctcatgcttatcataagtgataaatattggcatttcttggctttt

SEQ ID NO: 1101 - DNA, 353 bp; double-stranded, linear
ccaaatgctataaatgcaaaaatngctaatgcgatatttttatagaaaatatctggtcctaaattttgtaaatacgtggtaaacgttgcgtatgacaataagccaatcactacagcgtaaatatgtgaaataattaaaccgaaccgtctcgctctttcaaaaacaagtgttgctaaaataataatcagtaatccaaatgacaagggttgtcgccaacttaatggtaaaaactgacctagatagcatcctatgccaaatataatccaataatacataaaataaagccacactttacttattgattgagcatgctggttttgatgataatatgaatgatttgtattttgcgacaa

SEQ ID NO: 1102 - DNA, 194 bp; double-stranded, linear
cccacacgtcttccaccggataggtttcgagctcgggcgaaccgggcagggcggtgaccaccccgtgcggtgtcttcttggccagcttgtttgcgagcttggccagcgtcttcgtggggccaatgcccacgcaacacgggatgcccacccattggaggatctgggcacggacctggcgggccatcgcttcgntg

SEQ ID NO: 1103 - DNA, 220 bp; double-stranded, linear
ggtcaaccctaaccgtggaacttttagangagangttagcacgattagaacagggaaaattcgcttttgcttttgcatcaggtattgctgctatttcagcatactttttgactttcaaatctggtgatcatgtcatcttacccgatggatgtatatgggcggttacttttcgtctcactgtggcaaattttggatcgatttaatattgaattttacaacc

SEQ ID NO: 1104 - DNA, 235 bp; double-stranded, linear
ggacattgtatcgacatttcaaagataaaagcgatttatgctactacgtcatacaaagagaccttgatatttttatcactcattttaagcaaattaaagatgactatcattctaattatgaggttatgcaagtgtcgtcatcgcttttaaataagtcataataaaaatcaaataattcttgataaaatgcgctttggtaaaaacgtaatttattgttgcctgcttcaatacattg

SEQ ID NO: 1105 - DNA, 229 bp; double-stranded, linear
gcgggggcaggtaaatccactttgacacatcttattgcaggtgtttatcagccaacaataggtactataagtacaaaccagcgtgattttaatattgggatacttagtccanagccctatatttcaggctctataaaagaggatattacgatgtttaaagntatagaaaataatactaatgaagaagtgctagacgaagtagggtttattagaccaagtgccatccttc

SEQ ID NO: 1106 - DNA, 596 bp; double-stranded, linear
aatgtattgatttgtttgtgtggctcagttaatagtatcaatattarccactatattattraattaaaatcaaaatttgatgaagtaaatgtaatcgcgtcaacaaacggtagaaagtttattaatggtgaaatattaaagcaattttgcgataactattatgacgaatttgaagacccttttttaaatcatgtagatatagcaaataaacatgacaagattattattttacctgcgacttctaatacgattaataaaattgcmaatggtatatgtgacaatttattattaactatttgtcatacagcttttgraaaactttctatatttccaaatatgaatttacgaatgtgggaaaatccagttactcaaaataatattcgattattaaaagattatggtgtatcaatatatccagcaaatatttcagaaagttatgaattagcgtcaaaaacatttaaaaagaatgttgtcgcacctggaaccatataaagttctgggaattcatttgagattagaatatggaaaatcataaagcgcgckattgattagtttaatgaatgattggagtcntttgaagatncgatttacaatgg

SEQ ID NO: 1107 - DNA, 673 bp; double-stranded, linear
actagctaaaaataatattctattctttttaacatgggcagttccagcggcaattagtggtatttatattaaatatataaacaaggctacggtagaaagattttttaaattagtatttttcatattttctgtttcatttatttttgtaattttaataccaaaacttacaggtgagatacctagctatatcaattttggacttatgaactatcaaaacgcttcgtacctttcagcatttactgccggattaggcatttatttcattatgaaaggttcagttaaacataagtggatatatgttctatttacaataattgatatccctattgtgtttataccaggagggcgtggaggtgctattttattaattctttacggcttatttgcatttatacttattacgtttaaaagaggaatacctatcgcagtaaaaagcattatgtatatttttgcattaagcatatctagtgtattgatttactttctttttacaaaaggttcgaatactagaacattttcatatctacaaggtggaacacttaatttagaaggtacttctgggaagaggaccgatttatgaaaaaggtatttactttattcaacaaagttcgttattaggctatgggccatttaactattataaactaatcggaaatataccacataacagcat

SEQ ID NO: 1108 - DNA, 506 bp; double-stranded, linear
tcacagtggcggcacaaaaagtaagtggagattattttaatttaattgaccataacgatggcacaatgagctttgctgttgcagatgtcattggaaaaggtataccagctgctttagcaatgagtatgataaagtttggcatggattcttatggacactcacaattaccgagtgatggtttaaaacgtttaaatcgtgttgttgaaaagaatattaatcaaaatatgttcgtcacaatgttttatggtttatatgaagaaatgaaccatttattgtattgtagttcagctggtcatgagcctggatatatttatcgcgctgaaaaagaagaatttgaagaaatttcagttagaggtagagtgttaggaatcagttcacaaacacgatatcaacaacaagaaattccaatataccttgatgatttaattatcattttaacggatggtgtgactgaagctagaaaagtgaaggtacctttatagataaacaaaaacttttagaatata

SEQ ID NO: 1109 - DNA, 552 bp; double-stranded, linear
tgatattgaaaaagatgtcattgttaaagcacaagaaagtaaaattgctcaagttatcacgaatttgttaacgaatgcaattaactattcttatgaagatggagatattaacgttcgtgtgtatcgagatgactttcgtgtcattttcgaagtacaagattttggtataggtattaaattagaagaccaacaacgtatttttgaaagattttatagagtagataaagcacgaagtagnagattctggtgggacaggtcttggattatcaattacaaagcatatagtagasgcccaccaaggcaatattgaagtgaatagtcaagttggcaaaggctcaacgttcaaagttattctaaaagattataaagaataanaattaaagtggtaacagcgcgtgtatttttcacgaagttgttgctgcttttttatttcgttcaaatctctattggtattaaattagagttaatgaagtggaataaattcggttgtcaattttgtcatttgtatatgtcgatttgtaagttataagtaatagattgttgtgaatcang

SEQ ID NO: 1110 - DNA, 244 bp; double-stranded, linear
aacagatcaacaattgcagatcaattactcgtcatattgatcaattatctctgacaacgagtgatgatttattacgtcattgattgatcatcacaagataagtcgctattgatttctcaattttacaacganattaggaaagctgnagcagataattggctaagttggacgataaaggttatcaatcgccaatcgttgccattgaagaacttttgctcactggcgcacgcttcagatgatattt

SEQ ID NO: 1111 - DNA, 825 bp; double-stranded, linear
agtattgagtgttttgatttaagagacttggaaagtgagtcaataatcaaaatcttactcaatacttttattttggtactcgcaatttagatttgttaactaattttttcgcttattataaaacgaaacaatcaagtaaacgataaagcctacaaagatacccaataaaatagatagtactgccgtcactattaatggtaatttgaaaaatatttgtaggaaaatmccaatgataattgcgataattactgcaattaatgtgactgtattttcatttgaaatgttcatttattttcactccttaacaataacattatatcatgctatagctttccaaaatattgaaatatgtagatatggctattgacgatatttcttaacttttatatgattaatcggaatgaaaaaagagaagtaggtggcaatatgaagtcaaataaatcgcttgctatgattgtggtagccatcattattgtaggtgtattagcatttcaatttatgaatcatacgggtcctttcaaaaaggggacgaatcatgaaactgtacaagatttaaatggtaaagataaagtacatgttcaaagagttgtggatggtgatacatttattgcaaatcaaaatggtaaagaaattaaagttaggcttataggggttgatacgccagaaacggtgaaaccgaatacgcctgtacaaccatttggcaaagaagcatcaaattatagtaagaagacattaacaaatcaagatgtttatttagaatatgataaagaaaaccaantcgctatggtagaccattggcgtatgtatggataagtaaagatcgta

SEQ ID NO: 1112 - DNA, 621 bp; double-stranded, linear
tccctataaatccccacaaaaaaagggtaaatccgaacgtcaaatttcatctctttatgccaatcaacgatcgatttaccttttaaaatttaaaatgtatctgtaatactcttagcaatatttgtatatgctgcatcttccataggtggattgtgtaatcctgcacgcatgtcacgatagtaacgttgtaatggtcgattcatttctaagcttttagcaccaactattctcatcgctaaatcaatcacttcaagcccttgattcattaccatcactttactcgcacttgttggatttcttatctgactgtcatctttatattgttgatacccttttgctgtactccataaaaattgtctcgcacataacaatagcgtttccattttccctaaattttgttgcacagttggcaatgttgcaatcgttccttcaatactattagggctatgttggattgcaaagtctacagcataatttctagcagcttgtgctatacctaaataacagcttggtatatgcaatatccaaccatttggcgctttacttttctctgtttccactaaatgttttaatggtacttttacatcatttaatattaaatcatgactttctgtcgctcgc

SEQ ID NO: 1113 - DNA, 619 bp; double-stranded, linear
gtaccttgtttttcagtgttaatttcccaaatataacctggtgtaataccgtattgttttgagaagtacttgaaggcaccttcacttgtaatcatggcacgttgttcttctggaatgtcattaaatttgtctttactgtctttactgtcattatttaatttttccaattgagcaatgtatttgttaccttgcttttcataatctgctttatgttttttgtcgttatcgataaatgtttgttgaattgtttttacgtatttaataccgttatctaaacttaaccatgcgtgtggatcttgtttatctttgttgccttcttcaccgtttaaatagataggtttaacatcttttgatactgcgataacttttttatcttttaatgatttaccagcctgttctaaggctttttcaaaccaaccgttaccagtctcyaaatttaatccgtkgtataaaataacgtcagcgkcagttaactttttaatatcyttaggtttaacytcatawtcatgaggatctkgaccaacaggtacaatacnatgaatatcgacgttgtctccaccaacatttttagccatatcagatagaattgaattcgtcgntactactttnaatttgccat

SEQ ID NO: 1114 - DNA, 549 bp; double-stranded, linear
gaaaaccgcacgacaatgaaaaaagatatccggttaaaatggtcgataataaaatcattccaacaaaagaaattaaagatgaaaaaataaaaaaagaaatcgaaaactttaagttctttgttcaatatggtgactttaaaaatttgaaaaattataaagacggagatatttcatataatccagaggtgccgagttattcggctaaatatcaattaactaatgatgattataatgtaaaacaattacgcaaaagatatgatataccgacgagtaaagctccaaagttattgttaaaaggttcagggaatttaaaaggctcatcagttggatataaagatattgaatttacgtttgtagagaaaaaagaggaaaatatatactttagtgatagcttagattataaaaaaagcggagatgtataatcatggctcaatcagaatatgaaatcaatcccggaaaaagagagtgatgaaatgataaaacgtgtaaataaattagtgcttggtattagtcttctgtttttagtcattagtatgcactgctggttgt

SEQ ID NO: 1115 - DNA, 317 bp; double-stranded, linear
tgttattgcaactattaaaaatatnaaaaacaaagacttaattgattattctttatatattaaaaaaggtttagtggagccatttattgtattctataatcaagaaaatatattctacattagcaatgctgttatagatatcatcagtgtatccaaagatactcttgattatataaagtcagaattcaatgatcactgtgttcgccatactgattttatagcacagagaaaagccgtagtttcgaagagaccaacggcttttttataaatccttagattgtcaaattaagcgggacaagtttatcatcttcgatgaa

SEQ ID NO: 1116 - DNA, 400 bp; double-stranded, linear
actatgactgcaatgccaacaatgaatgttattgcataaagcatatgcatttaatcaagcttatgttatttagcaagggcaagccacttctcgattcatggcttgccttattttattgtatatttttaattatcgttgctgggcccttgattgacaatcgtattaaaatggccttattaagtcaactttgtctatacggtttggaatcttctacccaatgtcttataaaagacaatcccgcacctgaaacataactcatgaanataagaanatggtataccattaatntgaatccatttccantttataacgttgtaaatgacacataattagaatcataaagtttttcgtgggatattgaaactttacccatacgagacatcatggataaaagcgaggc

SEQ ID NO: 1117 - DNA, 696 bp; double-stranded, linear
tgcatataatgttcaaacggcaatgattccactgtataaacctcttgtcgtggatgatctttaatttgttgttttaataactgaactcttttttcatgttcataatgaacataaataaatgcactaagatatatcacagctaaaactagtgatgcacctttaataaaattaacattgattgacttatatttccgaaattcttttaataaaataattaaaatgattacatgtatcgtataaacaatcaaaaaattacctggttctattggagtaacaatgactagtgtcgacgccgaaacacatattgcaataagtaaggaatataaagtgatttgtgttttacgatcattaatagacaaataaatacctacaaatatcgaaaacgcaaagtaaccacatacaattacgttcacaaaaccaaccaatccaatatctgtatttttatttaataaaaactgattgtaaaatagtaaataataaagcggtaaagtgataaatcctatcataatgatacgacgctttaatattgttaaatgtacataccgatcacttctaagcagtagataaataataagcgctgcaatcatacttaaaattataatctgactgaaaatgacaccatatggaagtgacgttgatatcatttctgcaaattttgaaaagataccttgattatttgaaacttgttgatattct

SEQ ID NO: 1118 - DNA, 223 bp; double-stranded, linear
gcagtgacaatcaataatttgtaactagaagataataaagagaacgctctatagagacgaattgaaggtttgattttaatgtctgttagtaagaatcatatcaatgagatgcctatagtactcagantatattaaattaaaaccgtcattaattgtttttccgaaaaccatttgtaaccatttnaatgtagttggacctacctacgttctccaataatccatt

SEQ ID NO: 1119 - DNA, 265 bp; double-stranded, linear
ctgctttaccttttccaactttagaaattgctacataggggccttctgctttaccgccccaattccaattccacattttcaagaaataaggaggcaaaaatgttcatatatgaattggaattatttgttttcttattaggccgagatgcgccgcgtgcggctgctggagatggcggacgcgatggatatgttctgccaagggttggtttgcgcattcacagttctccgcaagaattgattggctccaattcttggagtggtgaat

SEQ ID NO: 1120 - DNA, 329 bp; double-stranded, linear
taataaatcaatcacnatcactttgtgttaaaatatgtgtcaaaggaagtgagggtttgtcatgacattacatgcttatttaggtagagcgggaacaggtaagtctacgaaaatgttgaccgaaataaaacaaaaaatgaaagcagatccgcttggagatccaatcattttaattgcgcaactcaaagtacatttcaattagaacaagcctttgtcaatgatccggaattaaatggtagtttaagaacagaagtgttgcattttgaacgattaagtcatcgtattttccaagaagttggtagttatagcgaacaaaagtnatctaaagc

SEQ ID NO: 1121 - DNA, 252 bp; double-stranded, linear
acacctcttttttaatatatgtgaactatatatagtgtatagagaggttacttgttactcaatataaacaaaaatcaactttgtcaaaataaatgtgacaaaattaaataaagtgtcatcaatgtgacagtatagatcattttgcaaaaagtcaaaacaaaaaaattgttttagggatttttcaaaattttcattgtggaaaatgatttgncaaaacaaaacaacacnttgtgagcaatgaagcttcaatgg

SEQ ID NO: 1122 - DNA, 400 bp; double-stranded, linear
naataataggcgccacctaataaaccagctggaatgcctatcattggtgttgtgaatgagcttaatacaataacaagtattgttaaagcaatgacgttataccaagttacagtcaaatttttcaaatcctcatatgattgttttactaattctctaaatttcatgattcaatctctccttttcttaaatcaattaatagttatactgcattgcttaaaatcaanatatctaatgaagcatcttttaatcgtaagtgttaaatggttttcttaatcaatttgtttgaatgtataanagcaattaaagcaaaagtaatgtaaatgagggtgtatacaacaattactacaataaccggcatgaaggaaatattacccatcaatttcataaatgcgattgcggc

SEQ ID NO: 1123 - DNA, 270 bp; double-stranded, linear
aatacaaccttttatcatagtgtaaatgtattctaccagtattgagaagttttcatattattcaatacctgaaatcgccatagtaatattactaaatgcacactgcatatgttgtttaacaacacaactttaaaaatatattctaactctatctacgaatgtacttaaatatcataacaatctattccaaatcnaattacattattagctaccttaaaaaccaaaccgaggccttaggcctcggtttaaatatatataacgngcgacatg

SEQ ID NO: 1124 - DNA, 400 bp; double-stranded, linear
ggtcttctgtatcaaattatattatgagagttagactcagtattaatgaaatcgttgataaagatcaagtgcttgcatcacaaataggtggattactatgatgtttaatcaaattaataataaaaatgaattagaagaatcatatgaatctgagaaaaaacgtatagagaatgaactgcaaaatttaaatgaacttaggcatagaactcgaaaagaaaatgaacgtagttatgatgtttttcaatatttgaagcacgaaatgaattatagtgaagatgcccaaaggaaaatgacgagaaatatagaagcgtatgagcaagaaatcaatgagataattagaaagcaagaatggaaattaggaagaatataaagaagacttaaaaaagtcttatgaaaagca

SEQ ID NO: 1125 - DNA, 377 bp; double-stranded, linear
tttttaatggaaaaagatgtatctttattgttgtttaaataaatagcactttgttcatttaaatataytcgatcattgataatatgtgctttactattccaaataactttcaaattttgataatattcatcaatactctcaatataactaaccagtttatacaaccattcgccatcgactttcacatatttttgaatactatttccaaytttaagacgtgttggttcatttacaaaatgccccaaattaataccacttaataatccaaatggagttggacgtgttgacattctaattaaatattttaataaactttctttagcatctctaaccttcttgttatcgccatcaaaatttattncntgtaaagtacaata

SEQ ID NO: 1126 - DNA, 227 bp; double-stranded, linear
gttacattactgttcatgtccacaacgtttgtcagcgattatcatcattgtgttatatcttatttatagcaagtgcatggtctggataagtaaaggtattcatacttaagtaacttgaacattggtttaggactattttaatggtnctgcttnaattgttggccaactggttcttattttaaatatgtaactagctctacgggtagttactaaacacatcctggttt

SEQ ID NO: 1127 - DNA, 717 bp; double-stranded, linear
ccaatgataccgttatagcatgttaatgtttttgtacgaatataatctaaaacttcgagttcatcacttaatttccacgtttctgctttgtttaaccacattaaaggagtatgaatgncaaaatctttgtccatagctaggcttaatgttacgttcattgattttataaaactatcgcgacagtctgggtagcctgaaaagtctgtttcacatacgcctgtaataatatgcttagccccaatttgataagctagagcgcctgcaaacgacaagaaaagtaaatttctagctggaacaaatgtattaggtataccatcttcattattagtaatttccatatcatgttgtgttaatgcgtttggagtaagttgtgataataatgacatatctaaaacgtgatgtttcattccttgatcttgtgcaatttgttttgcgacttcaatttcagtatcatgtctttggccataattaaacgttacgagttcaacttctttgaaatgtttttttgcataaaagagacatgttgtactgtcttgaccaccactaaagacaacgatggctttttcattatttaatacactttccattttgtaattgctcctatcattaataatattaataaagaggttaatggcattgataagcccgtttttaatttataaaataaaaaaagccnatctccataaaagatagacganagaaatgggttgctcctat

SEQ ID NO: 1128 - DNA, 595 bp; double-stranded, linear
gattattgcattgacaacttatatctatctaacgttagtagcatttaatttcatttccggggttctaactttaccaggattagcggcgttggtattaggtgtaggtatggctgtagatgccaatattatcatgtatgagcgtattaaggatgaacttcgaataggtagaacgataaagcaagccttttctaaagcaaacaaaagttcattcctaacaatttttgattctaacttaacaacagttatcgccgcagcagtattattcttcttcggtgaaagttcagttaaaggtttcgcgacaatgttattattaggtattctaatgatctttgttacagccgtgttcttatcaagattcttattatcattacttgtttcatcaaatatattcaaaaatcaattttggttatntggtgttaaaaagaataaacgacatgatattaatgaaggtgtagatgttcatgaccttaaaacttcattcgagaaatggaattttgttaaattagctaagccattaattggagtaagtattttaattgtagtgtcggttagttattcnttatatctcaagtaaacttaggantgantctcaagt

SEQ ID NO: 1129 - DNA, 371 bp; double-stranded, linear
attttaactttctaagaacaagttgtcaagattttttcttaacatatcatgttctgttacaatattaataatgaataccgaaaggacgaattgcaaatgaaaagcgttggcttaatcacagaatataatccctttcataatgggcatcaatatcatattaatcaatctaaaaaacttacaaatgctgacgttactattgcaataatgagtggtaactttgtcatgcgtggcgaaccagcaatctataataagttactcgtgcaaaatggctttccaccgctgtttagtttcggactaccagcaactgcagttatcactggcgncatttgcgactgccgttaagcgcggttttggtgcgtacatgcntggng

SEQ ID NO: 1130 - DNA, 200 bp; double-stranded, linear
atgatgatgagattatgactttgcgaaagatatcggtgcgccttatgaatttaaaacanantaaagaccatggtcgttaccggtagttaactttgcagctggtggcgttgcgactcctccaagatgctgctttaatgatggaattaggtgctgacggtgtatccgttggatccgggaattttaaaaccagaagatcccgg

SEQ ID NO: 1131 - DNA, 203 bp; double-stranded, linear
atgagctagtcgattaaagttaatatttgaaaatgaagcagggcattaaatgcaataaattaaataagttgtcattaaagcattaataatagaaatgattttaacaggaaaaaagtgatgaatatttggaaaagatatatatcgtgcactgtcctgagagattagatttgggaaaccaatttatccntgaatcgagatgtngc

SEQ ID NO: 1132 - DNA, 182 bp; double-stranded, linear
aatcaatataagcttttaattcttcaatcaatgatttaggtaagtttctgttgtatacgtatctaacagtattgaaatctttgttagcgtcaatcgaccatgtatttttaagtattgtctctaacaacttagcacgacgtcttaaccctttagtaaacaatccttctttagntttagtacgt

SEQ ID NO: 1133 - DNA, 485 bp; double-stranded, linear
caaatttagccaggnatacaaatacatataataaaactgtttgtaagcttacgttgacaatctggcgtaattggaaaactaatgaattttctccaagtaggttttaccctgtaaacmaaataacaattcmaataatatgraatcacaaagcgactagaaatccggtaatatgactaatcatatattcaatgtgtaataattttaacagcaataaatagacaacataataatttaacgtattaatgccgccaacaatgataaattttaaaatttcagcatgcgtttgtgttagtttcatatgtgtactcctcaacatcanaatatatgcataactacgttctcgaacatactcgaatatgcgagccaatccgcttcacttcaaatatgcttatttcaatctttataccctttcacagcaatttagtctctttnccctcatccttataggccntatatgtaaccgattatcgggtggactcattggc

SEQ ID NO: 1134 - DNA, 213 bp; double-stranded, linear
cttgttttatcgacagatgctgaacacgcagtcaaaataaataaattacataataaaattccaattaatcttttcataatatcatccttttgtttttcaattgatattcattttcaattataaaatattaraagaattagtcaacgcctgtgagtaatacacatcagtaacatttctattttcatttatgatattatctaattattaatttat

SEQ ID NO: 1135 - DNA, 526 bp; double-stranded, linear
tgtgactccatgtattcatgtatcattgtacatttgtgaattggttgaaaactgatagtgcccgtttaattacaggtactgaggatgctttcaggacatggatttgttcgaaaatatgacaatatttcactatggctcttcacttctctagggaaattgctatcttgattaatccaatcaaccaattcacctaatggtgtgtcatcaccaagaaaactttgcataaattcgtaaaagctcaatacctcacctcgattaatatacttgagccattaatataataccataaaagaatgtgtattttacataaaactttttataaagcaattttataaatctaaatttattgaatgtttaagaagttgtgtataatgaaataaacgtgttgaaatagttaggatgatgttagtggatatcaaacatatgaaatattntattgaagtcgttaagcanggaggcatgactaatgcttccaaatcattatatattgcacaacctacaattaggaaagcnattaaagatattg

SEQ ID NO: 1136 - DNA, 321 bp; double-stranded, linear
agcaaaagcaatgatgacaaaagaacaagctatgttagcagatggaagtattaaacaagatcaatatgataaacaactgttatcganaatcggaaaatcacaattagatgaattgtcttctaaagatttacaagttttagctatttttccgagagatgaatgcaggaacagttttagatccacaaatgataaaanatggaagatgttcagtgcaaaaagagtatggcagcagttttctccagcaacttttccanatttacccaggtgtttaacacgtcctattggatttgggcttaggacaattattccatatgggcggat

SEQ ID NO: 1137 - DNA, 330 bp; double-stranded, linear
ataaatccttataaaatcatgagttggacgacttatccacacaattatactttttcagttctctatatgtcaaatacctgtgaatatgttgctaaaaatagtataactttgtgtgtaatttctaattatccacaattctgaaaactataaatgtgcataagtggatamctttccttctatagagtatctgttagtgagtgtatcaaaacagtttgggaaataatttataaagtntgtataaganctgtataaggtgttcgaacattgtaaacactcatgcttcggaccaaactcatggtgatgttatgaaatttgattgctcgcatcgng

SEQ ID NO: 1138 - DNA, 459 bp; double-stranded, linear
cttgataagggaagatttgccagcaccattcgggcccatgataccaattatttcgccgcgtactggtatcgataaggaaatgtttttaagtacatgcttattacctaaaaacagatttaaatcttttgtttctaacaaacgtttatacctcctaattaaaagtttaggctaacctaattaattgtataataaactgagaatatttatcatgtcaagtaaattcgtgatataatatagacaatgtatgtgaggtgaaagtatgttaactgaagaaaaagaggactatttaaaggcaatccttacgaataatggcgataaaaactttgtgacaaataaaatcttatctcaatttttaaatattaagcctccatctgtaagtgaaatggtaggacgtcttgaaaaagcaggctatgttgaaacaaaaccatacaaaggtgttagattaacagaggatggttt

SEQ ID NO: 1139 - DNA, 165 bp; double-stranded, linear
taaatactctcgccggttatttcgcttcctctatacggattggcgaaagatacggtgcatcggtttcaactagcaaacgctccattgacacatgcttagcaacttctttaggctgtttagcatttttaaatgtcacaggtccacctaatgaatataaaaattcan

SEQ ID NO: 1140 - DNA, 214 bp; double-stranded, linear
acctgaatgcccatcaatgacagactggataaagaaaatatggtacatatacactatggaatactatgcagccagaaaaaaatgaggtcatatcttttgtgggacatagatgcagctggaggccattatatttagtaaactaatgcaggaacagaaaaacaaatactgcatgttctcacagcaggagctgaatgatgacaattcatgaacataa

SEQ ID NO: 1141 - DNA, 229 bp; double-stranded, linear
gtttctagttgtttatagttatcgcatctcttgatgtaaaatctaagatgtttatgcatttctagatgttaattcttcgctgcttaagaattatcttgatggtaaatctagttgtgccatgcattttctcatgatgaatctaaggtgttaattcattgatgtgtgctgtttcttgnngcttcattatcttgatggtgaatttcgttgtctaatgcactttttcaaatga

SEQ ID NO: 1142 - DNA, 311 bp; double-stranded, linear
ttatgaatcgtaaacactattatgaaattgcgagagtagtatggacaattagaatgatggtttgagatnaatgagtgttattaaccagtgcgtcattttcaaaattagatgccatttgctgtttataataagaagatttgataattaactatgataagaaaaaataataatcccctaaatacattataaacaaattaaatgataarataataatatatatttctactaaagttgtttggaggtaaatgtgtgaataggaatatcgttaaactagttgtgttcatgctaattttagttgtagcagtagcggg

SEQ ID NO: 1143 - DNA, 403 bp; double-stranded, linear
gatcatgctgcttatgaattattaaaagagcaattagaagatgtgcttgatacattaactgatagagragaaaatgtattacgattaagatttggtcttgatgacggcagaacaagaacacttgaagaagttggtaaagttttcggtgttacacgtgaacgtattcgacaaattgaagcaaaagcacttagaaaattaagacatccaagtcgtagtaaacgtttgaaagactttatggattaatttatatcaattttaatgattgataccaagacatgaataagcgcttatttatttttagattaagatttaacttgagtgaggttggtacattgaataatgttcaacctcttttttcataaaggagaataaaatgatttcgttaaataaccgattaacgacn

SEQ ID NO: 1144 - DNA, 612 bp; double-stranded, linear
ntttttattgacgaatngatttggatgccagtggtttggtcctaaatcttgaatggtaatcggtattttgaagttgtcatgtgctacacggtaaccgataccnataagtacgagtgcgatgacaatggttgttacgagcaagatgtattgtaaccattgcttgaacacaacaagttgtatataaggcttcattgacgatacctccaaaccaatacagctaaattaattatcaaaagtgcgatgaasctaagatagaaactagggtgcagttctaaaatgtagttgtttaaaataatttctaacaattgatttgttacaactgcgaacggttgaatattgaaaacaccatttgctatatgttgtaaaaaaatcgtaggtattgttaaaccagataacaccaggatgacaatagctaatatgactttactaatactattcaacaagcctgttgttaaaagttcgatgagtaataaccacagtattaaaaaggtaacataatagcttaaatgaatggctaacgttggccaattatataattcaaagatattcggaatactgaacacaatccaaactacaccaacgatactccataacatagtataaaaccatgtn

SEQ ID NO: 1145 - DNA, 223 bp; double-stranded, linear
gaattaattacgcaatatccgcatcttaaatcagtaatcgaaaaatatgctttaaaataaaagtgatcaatgaagtggtttgaaggttgtnaataaacctttgagtcacttccatttttaaangtatcctggatggaaccagaatagatttgaagcttcagcggtttttaatgaaaatagccattaaatgatttggaaacggtaagagggggtatttaaaatg

SEQ ID NO: 1146 - DNA, 598 bp; double-stranded, linear
cgctacggttgtcacgtagagattaaagacattcgttttagcagtcttttttattgaagtagacaatgcaagattaaatggtagtgtcatttcattttattcaactgctagtaatacaatactcagtgttatttctgaagactggttgataatgagacatgcatatttacaaaactgtgtatattgtgtatattgtatatatacagaagttgatagggggacgttgatgaaaataattttaaaaaacaatagtgattttccgatttatgaacagattaagcaacaagtaaaacaaaatattttaaagggacatgttgctcctggagagcatttgccgtcaatgagagaacttgccaaagatcttcaagtaagtttgattactaccaaacgtgcttatgaagatttagagaaagacggttttgttacaacaattagaggaaaagggacctttgttaaggagcaagatagttctattttaaaagagaaacaattttttaccatgaaaatttgggttaaaggaattgggttaattaagcncaagcccatccgaattgccacttgaggganttccaggatatttnaccgtcatttattgagg

SEQ ID NO: 1147 - DNA, 400 bp; double-stranded, linear
caaatccaagtgcaacagctttatcaaccgctaaagctaaatccgtatcagctttttcagcttgaactggtttgatttgtaactgttctgttagaagttggcgttcttctttactgactgaatcaaagtctcccactgagaaaaaagggataatttgatgcttcaataaaatcaaagcacctctatcaacgccgccccatttaccttcattacttttggcccaaatatcttgcggcaagtgtcgatcagaacataataaatttatatgcatatacactcaacctttcaatgcttgtgtgactttttaaaatcccctggttaaaggaaaatgaacnggttaccagcattgtaggcaccatttcaacaccaacttcggcggatcnggattacgcctccatcc

SEQ ID NO: 1148 - DNA, 352 bp; double-stranded, linear
ttttatgggtcgtattttttaaagaacagtcatctcaatcaaaagaatagaattatgattaaaattgatgtrgtgtaattaaagtaagaaatrrkaaatttcctagatactagataaatcgttcaatattttattaataaggaggccaatgaytgtgaattatcttaaacataagttttataacttgttaactacaatgattgttctctttatttttgtactttctggtgcgatttttttaacatttctagggtttggtttatatggattaagtagaatacttatttattttaggttgggtgactttacatataatagaagtatgtacgataacctatnatattatggcagt

SEQ ID NO: 1149 - DNA, 916 bp; double-stranded, linear
aaagcacctctatcaacgccgccccatttaccttcattacttttggcccaaatatcttgcggcaagtgtcgatcagaacataataaatttatatgcatatacactcaacctttcaatgcttgtgtgacttttttataatcctcttgtttaaagaaaaatgaacctgttactagcattgtagcaccattttcaacacaaactttcgctgtatcggtatttacgcctccatcaacttcaatatcaaagtttaattgacgttccattttaatagcattaagacccgctattttttctacgcattgatcaataaatgattgaccaccaaaccctgggktaactgtcatcactagtacataatcaacaatgtctaaaataggktcaatttgtgatatkggkgtaccaggattaattactacaccagcttttttatctaaatgtttaatcatttgaatagcacgatgaatatgaggcgttgattcgacatgaattgaaatcatatcggcaccatgttctgcaaatgatgcaatatacttttctggattttcaatcatcaaatgtacgtctataggtaatgttgtgccttttcttactgcatctaatattggtaaaccaatagatatattaggcacaaattgaccatccataacatcaaaatgaactccgtcgacgcctgcttcttcaagtcgttttaattcatgttgtaaatccaaaaaatcaacagataataatgatggatatagttttgtcatttaatatctaacctttctatttgaaatttcattaaatagttgtaaataatggtcgtatctaaattgcgcaatattccctatctctaattgatgcntaaccattaccattagggtccttggnaaggntaccaatcccaaaccttaccatggttcccccataacggttt

SEQ ID NO: 1150 - DNA, 400 bp; double-stranded, linear
aattggttgtggcttcataatgtgcagttgctagactgacaacaacatcgttttctaagcctacgataaagacataatcgttttcggttttgttgttttctaatgagcgtttgatgatacgtttatcttcagttaaagataaatttaacttagtatcgtaaagtttaagtgcttcgttgtaatgtggatctttgacagattgaatggttttaaattccataagaacacctccccaatttaaataatattatagcataatcgcctgctgtaaaagactgttcataaacttttaaatggtataaaaaactgtactatcttaaattagacagtacagtaatctcattttgaattcagtgtgataactaagctttgggacctttagatgcnttcacaaaatgtg

SEQ ID NO: 1151 - DNA, 156 bp; double-stranded, linear
caccgtagttgctaccgaataccaccatgtcgccaggttgtgctaagaagtccggtgtattttggtatacagttagctaatccgtcgaagttgttagcgacggnatatcttttgacctaaaccttttagagtaatccaaacaaaactttccaacca

SEQ ID NO: 1152 - DNA, 233 bp; double-stranded, linear
tcaatatatttattttctaatgttagcattagactgtcaattaacttgctaagttgttcttttttagtaattaaataacgcatataatcatctaaatttttcattttttcatctagcattaaaaggtagtgcttgatattatttctactgttgctccaaaaactgntcaaatatacgtcacatagtcatactacacctttatatagtttaaataccaatngcatgacctcgtg

SEQ ID NO: 1153 - DNA, 339 bp; double-stranded, linear
tatattanctatcgtttagtgaatcgtttttttaaagtaaagagaatttcatatattactggtacaactacaagtgttaataaagttgatgaaattmaaccaccaataactgtagcagctaatcctttcgaaataagaatcgngctatcttgaccaaataacanaggaactaatgcaccaattgttgcaatcgccgtcattaatatcggtctaattctagtaccgcctgcttcgattaatgcttctttcatctccatgccctgttgctcattattaataacacggtctattaacacaatggcatttgttactacgatnccaattcaacattagcatacc

SEQ ID NO: 1154 - DNA, 817 bp; double-stranded, linear
gtcacccgaggagatatncaactattaccatcaagatgngaaaaatggtgccttgggcaattggttttttcattttaatcttaattattatattgttctttttactaagaaacttcaattcacctgaagcgcaaactaaaatattagtgaatgcgattgagaataatgataaacaaaaagtagcaacattattaagtactaaagataataaagtagattctgaagaagcaaaagtatacattaactatatcaaagatgaagttgggcttaagcaatttgtcagcgaccttaaaaatacggtacataaattgaataagagtaagaccagcgtagcttcttatattcaaaccagatctggtcaaaatatattacgtgtaagtaaaaatggcacacgttatatctttttcgataatatgagctttactgcacctaccaagcaaccaattgttaaaccgaaagaaaaaacaaaatatgagtttaaatctggtggtaagaaaaagatggttatagctgaagcaaataaagtgacgccaataggtaattttataccggggacatatagaattccagctatgaaatcaactgagaacggtgattttgcaggccatttaaaatttgattttagacaaagtaattctgaaacggtagatgttactgaagattttgaagaagcaaatatatctgtaactttaaaaggcgatacaaaattaaatgatagttctaaaaaagtaactataaatgaccatgaaatggcattttcaagttccaaaacgtatggtccatatccacaaaataaagatattaccatttccagctt

SEQ ID NO: 1155 - DNA, 322 bp; double-stranded, linear
anagaaaatctactcttttatttcaccggtcctttcntatctctcatttggcatactcctttttccatattttccactttcantacagtgaatttacatgtaattttacaaatacaataggagtgcacaatggaatataacacttatctttataaaattattttatatattgacgcacttaaaacaatctacaaataaaattattatttttagttttcaatgaataattcattcttatctgttggaaaaacccatcaactcaatagcattgaatttctaaaataaaaaataccttaacgcatttaaaaatacatttaactgc

SEQ ID NO: 1156 - DNA, 777 bp; double-stranded, linear
gtttccaanggaangngaaaagcgtcaaccaatgtaactatttaaagtcaaagtgtttgaccaaatttgacttaatatgtaaaataatgagtaacagttattacaaggaggaaatatagatgaatttaattcctacagttattgaaacaacaaaccgcggtgaacgtgcatatgatatatactcacgtttattaaaagaccgtattattatgttaggttcacaaattgatgacaacgtagcaaattcaatcgtatcacagttattattcttacaagcgcaagactcagagaaagatatttatttatacattaattcaccaggtggaagtgtaacagctggttttgcgatttatgatacaattcaacacattaaacctgatgttcaaacaatttgtatcggtatggctgcatcaatgggatcattcttattagcagctggtgcaaaaggtaaacgtttcgcgttaccaaatgcagaagtaatgattcaccaaccattaggtggtgctcaaggacaagcaactgaaatcgaaattgctgcaaatcacattttaaaaacacgtgaaaaattaaaccgcattttatcagagcgtactggtcaaagtattgaaaaaatacaaaaagacacagatcgtgataacttcttaactgcagaagaagctaaagaatatggcttaattgatgaagtgatggtacctgaaacaaaataattcaaagtaaagagtagactaagcngtctgcnctttttgtatgagtaaaccaaggtgtcaataatttgtn

SEQ ID NO: 1157 - DNA, 155 bp; double-stranded, linear
taatgttggtaaatgggttaaggctcaaggtcgtattgaagaagatacatttattagagatttagttatgatgatgtctgatattgaagagattaaaaaagcgacaaaaaaagatnaggctgaagaaagcgtgtagaattccacttgcatactgc

SEQ ID NO: 1158 - DNA, 400 bp; double-stranded, linear
gactggtaaaatttacttgcaagtaaagctaaaaggtcaaatagataaagaacaacttgtttttcaaaatgacaaaaatgaagaatttccttttgttataaaagatgaaaaggatgacacaatagtaagaattttaattgaacagcatatggataaaatcaatatgcatgttaaaacgttggctgaaaagaaaaatctagataacaaagaaatggtgtattctattcattttaaagagaaaaaagtacaacatgatgatgcaaaagaagtgccttcaaaacatcaaaatcaagaaaataatcaagatcagcttaaaanagatattgatgacaaanaagatagtcaaaaatcagatactaagggaaagacgtactagcctttttactggaaaaagggttta

SEQ ID NO: 1159 - DNA, 347 bp; double-stranded, linear
gttggtacagtgttgagtggctttgaatatcgaacacaaaaagaaaagtatgacaatttatataaatttttcaaagataatgaagagaaataccaatatacaggctttacaaaagaagcaataaacaagacgcaaaatgtcgsatataaaaatgaatatttttatatcacttactcgtcaagaagcttaaaagaatatcgtaagtattacgaaccattsattcataaaaatgataaagaatttaaagaggatggaccagccagaaagagtgattacgcgctatcagtcagtacacatgttagtccaggaatttctagcatcngtgtgtgaatgangggtactttatn

SEQ ID NO: 1160 - DNA, 203 bp; double-stranded, linear
atagttattaattagtagaatgaggatatttaaatataaaggatagtgttgaacttatggacatgaatttcgattatacatgaacggtgttgtagaacaagcaaggaatgaaattgaatctgcgggatatgagcaattaactactgcagaagatgttgnaaagtccaagatggncacctagttatgatcatctgtatgtggtg

(The sequence listing continues in the following parts.)

What is claimed is:

1. An isolated polynucleotide fragment comprising at least 50 contiguous nucleotides or the complement thereof, or a nucleotide sequence corresponding to nucleotides 3-746 of SEQ ID NO 559.

2. The isolated polynucleotide fragment of claim 1, wherein said polynucleotide fragment further comprises a heterologous polynucleotide sequence.

3. A method for making a recombinant vector comprising inserting the isolated polynucleotide fragment of claim 1 into a vector.

4. A recombinant vector comprising the isolated polynucleotide fragment of claim 1.

5. A recombinant host cell comprising the isolated polynucleotide fragment of claim 1.

6. The isolated polynucleotide fragment of claim 1, wherein said polynucleotide fragment comprises at least 100 contiguous nucleotides, or the complement thereof, of a nucleotide sequence corresponding to nucleotides 3-746 of SEQ ID NO:559.

7. The isolated polynucleotide fragment of claim 6, wherein said polynucleotide fragment further comprises a heterologous polynucleotide sequence.

8. A method for making a recombinant vector comprising inserting the isolated polynucleotide fragment of claim 6 into a vector.

9. A recombinant vector comprising the isolated polynucleotide fragment of claim 6.

10. An isolated recombinant host cell comprising the isolated polynucleotide fragment of claim 6.

11. An isolated polynucleotide fragment comprising the nucleic acid sequence corresponding to nucleotides 3-746 of SEQ ID NO:559.

12. The isolated polynucleotide fragment of 11, wherein said polynucleotide fragment further comprises a heterologous polynucleotide sequence.

13. A method for making a recombinant vector comprising inserting the isolated polynucleotide fragment of claim 11 into a vector.

14. A recombinant vector comprising the isolated polynucleotide fragment of claim 11.

15. An isolated recombinant host cell comprising the isolated polynucleotide fragment of claim 11.

* * * * *